United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 175

SEQ ID NO: 7307525 - DNA, 22 bp, Homo sapiens
tcagaacatgaaggttaatttg

SEQ ID NO: 7307526 - DNA, 21 bp, Homo sapiens
tcagaagagctgcctcttggt

SEQ ID NO: 7307527 - DNA, 22 bp, Homo sapiens
tcagaagactactaggacacat

SEQ ID NO: 7307528 - DNA, 22 bp, Homo sapiens
tcagaagaaagatgttattact

SEQ ID NO: 7307529 - DNA, 21 bp, Homo sapiens
tcagaactggtgcagatgaat

SEQ ID NO: 7307530 - DNA, 19 bp, Homo sapiens
tcagaactcagaatgtgta

SEQ ID NO: 7307531 - DNA, 22 bp, Homo sapiens
tcaccttgtgatctccctgcct

SEQ ID NO: 7307532 - DNA, 22 bp, Homo sapiens
tcacggacctaagaggaagatt

SEQ ID NO: 7307533 - DNA, 22 bp, Homo sapiens
tcacctgtattaatacagaact

SEQ ID NO: 7307534 - DNA, 22 bp, Homo sapiens
tcacccatcctggatgagattc

SEQ ID NO: 7307535 - DNA, 22 bp, Homo sapiens
tcacatgcagtcactgagcagg

SEQ ID NO: 7307536 - DNA, 22 bp, Homo sapiens
tcacccaggtccaggctctggc

SEQ ID NO: 7307537 - DNA, 22 bp, Homo sapiens
tcacatgaagatccctcaattt

SEQ ID NO: 7307538 - DNA, 18 bp, Homo sapiens
tcacatgacagctgttgc

SEQ ID NO: 7307539 - DNA, 22 bp, Homo sapiens
tcacatcttggattacaatttt

SEQ ID NO: 7307540 - DNA, 22 bp, Homo sapiens
tcacatcttattagagtatctc

SEQ ID NO: 7307541 - DNA, 22 bp, Homo sapiens
tcacatctgttgatacagcatc

SEQ ID NO: 7307542 - DNA, 22 bp, Homo sapiens
tcactgtccctgtcctcttatc

SEQ ID NO: 7307543 - DNA, 22 bp, Homo sapiens
tcagaacatcctggtttaaaat

SEQ ID NO: 7307544 - DNA, 22 bp, Homo sapiens
tcagaacatatattttgtgatg

SEQ ID NO: 7307545 - DNA, 22 bp, Homo sapiens
tcagaacagttcttaatattgc

SEQ ID NO: 7307546 - DNA, 23 bp, Homo sapiens
tcagaacagttcttggtgcatag

SEQ ID NO: 7307547 - DNA, 22 bp, Homo sapiens
tcagaacagtgcctggcactaa

SEQ ID NO: 7307548 - DNA, 22 bp, Homo sapiens
tcagaacagtgcctggcactaa

SEQ ID NO: 7307549 - DNA, 22 bp, Homo sapiens
tcagtttttgtttgccagatag

SEQ ID NO: 7307550 - DNA, 22 bp, Homo sapiens
tcataaaaatagactctaaagt

SEQ ID NO: 7307551 - DNA, 22 bp, Homo sapiens
tcataaaacacaccaggtagtt

SEQ ID NO: 7307552 - DNA, 19 bp, Homo sapiens
tcagttttagtcatcagtt

SEQ ID NO: 7307553 - DNA, 22 bp, Homo sapiens
tcagttttcaatttcatcagag

SEQ ID NO: 7307554 - DNA, 22 bp, Homo sapiens
tcagttttcatttcatgagcag

SEQ ID NO: 7307555 - DNA, 22 bp, Homo sapiens
tcagttactcctttccttaggt

SEQ ID NO: 7307556 - DNA, 22 bp, Homo sapiens
tcagttactcaacagaggtgga

SEQ ID NO: 7307557 - DNA, 22 bp, Homo sapiens
tcagttatcattgctgtaaatt

SEQ ID NO: 7307558 - DNA, 23 bp, Homo sapiens
tcagttattggtgataaagctgg

SEQ ID NO: 7307559 - DNA, 22 bp, Homo sapiens
tcagttactctgatgtcctgtg

SEQ ID NO: 7307560 - DNA, 21 bp, Homo sapiens
tcagttactgagagagaagtg

SEQ ID NO: 7307561 - DNA, 22 bp, Homo sapiens
tcagttacttgcttgtttgaaa

SEQ ID NO: 7307562 - DNA, 22 bp, Homo sapiens
tcatccagtaccatggaaggca

SEQ ID NO: 7307563 - DNA, 22 bp, Homo sapiens
tcatccaaggattttattgcat

SEQ ID NO: 7307564 - DNA, 22 bp, Homo sapiens
tcatattttgcaaggtcagcta

SEQ ID NO: 7307565 - DNA, 22 bp, Homo sapiens
tcatcattctgacaagtctaca

SEQ ID NO: 7307566 - DNA, 22 bp, Homo sapiens
tcataaaatgctcctgatattg

SEQ ID NO: 7307567 - DNA, 22 bp, Homo sapiens
tcataaaacacaccaggtagtt

SEQ ID NO: 7307568 - DNA, 22 bp, Homo sapiens
tcataaacacactagtatgatt

SEQ ID NO: 7307569 - DNA, 22 bp, Homo sapiens
tcataaagctcttccaaatgta

SEQ ID NO: 7307570 - DNA, 22 bp, Homo sapiens
tcatctctccccagtgtcttta

SEQ ID NO: 7307571 - DNA, 22 bp, Homo sapiens
tcatcctgtatcctcagaccat

SEQ ID NO: 7307572 - DNA, 22 bp, Homo sapiens
tcatcgcctcgtgcatcttggc

SEQ ID NO: 7307573 - DNA, 22 bp, Homo sapiens
tcatccctaaggacagctctgc

SEQ ID NO: 7307574 - DNA, 22 bp, Homo sapiens
tcatcctgcactggctcctcct

SEQ ID NO: 7307575 - DNA, 22 bp, Homo sapiens
tcaggctcaggaatgtgtttat

SEQ ID NO: 7307576 - DNA, 22 bp, Homo sapiens
tcaggctctgagctgatgctaa

SEQ ID NO: 7307577 - DNA, 18 bp, Homo sapiens
tcaggctctctggctaga

SEQ ID NO: 7307578 - DNA, 22 bp, Homo sapiens
tcagggagaggtgagagcctgt

SEQ ID NO: 7307579 - DNA, 22 bp, Homo sapiens
tcagggactaggtgctgcctga

SEQ ID NO: 7307580 - DNA, 22 bp, Homo sapiens
tcaggggacttaggagagaagt

SEQ ID NO: 7307581 - DNA, 22 bp, Homo sapiens
tcaggtgacctgagccactatg

SEQ ID NO: 7307582 - DNA, 22 bp, Homo sapiens
tcagggggaggagactgccagt

SEQ ID NO: 7307583 - DNA, 23 bp, Homo sapiens
tcagagtagcaatttttctctcc

SEQ ID NO: 7307584 - DNA, 22 bp, Homo sapiens
tcagaggttacccatgggacag

SEQ ID NO: 7307585 - DNA, 22 bp, Homo sapiens
tcagccagggctctggcctcag

SEQ ID NO: 7307586 - DNA, 22 bp, Homo sapiens
tcagccagtatttgagtgctca

SEQ ID NO: 7307587 - DNA, 22 bp, Homo sapiens
tcagccagggcagagcaggtga

SEQ ID NO: 7307588 - DNA, 22 bp, Homo sapiens
tcagaggcttccttcctcggag

SEQ ID NO: 7307589 - DNA, 22 bp, Homo sapiens
tcagcctcattttctgctctgt

SEQ ID NO: 7307590 - DNA, 22 bp, Homo sapiens
tcagcctcaggtgttcagattt

SEQ ID NO: 7307591 - DNA, 22 bp, Homo sapiens
tcagcctccgaaagtgctggga

SEQ ID NO: 7307592 - DNA, 22 bp, Homo sapiens
tcagcctctctgagtccagacc

SEQ ID NO: 7307593 - DNA, 22 bp, Homo sapiens
tcagcctcctaatttcctgtga

SEQ ID NO: 7307594 - DNA, 23 bp, Homo sapiens
tcagcctcttaggacttctcacc

SEQ ID NO: 7307595 - DNA, 23 bp, Homo sapiens
tcagcttcattgtcttctatggc

SEQ ID NO: 7307596 - DNA, 22 bp, Homo sapiens
tcagcttctcaaaatggcttag

SEQ ID NO: 7307597 - DNA, 22 bp, Homo sapiens
tcaggaaatggacatctttgct

SEQ ID NO: 7307598 - DNA, 19 bp, Homo sapiens
tcaggaggtcgacctggca

SEQ ID NO: 7307599 - DNA, 22 bp, Homo sapiens
tcaggcaggacaattatttagg

SEQ ID NO: 7307600 - DNA, 22 bp, Homo sapiens
ttttattggtaatgataaaagt

SEQ ID NO: 7307601 - DNA, 22 bp, Homo sapiens
ttttattggtaatgataaaagt

SEQ ID NO: 7307602 - DNA, 22 bp, Homo sapiens
ttttattgggagtcctctactg

SEQ ID NO: 7307603 - DNA, 22 bp, Homo sapiens
ttttacttcattcctgacttca

SEQ ID NO: 7307604 - DNA, 22 bp, Homo sapiens
ttttactttggatacagtactt

SEQ ID NO: 7307605 - DNA, 22 bp, Homo sapiens
ttttcaaagactggaggctgat

SEQ ID NO: 7307606 - DNA, 16 bp, Homo sapiens
ttttattgtgacagcc

SEQ ID NO: 7307607 - DNA, 22 bp, Homo sapiens
ttttattgtctgtattgcctat

SEQ ID NO: 7307608 - DNA, 22 bp, Homo sapiens
ttttattgtcaatgaagacaga

SEQ ID NO: 7307609 - DNA, 22 bp, Homo sapiens
ttttattgtcaatgaagacaga

SEQ ID NO: 7307610 - DNA, 22 bp, Homo sapiens
ttttattgtctcccagttctgg

SEQ ID NO: 7307611 - DNA, 20 bp, Homo sapiens
tttgtctgttaagtgtttct

SEQ ID NO: 7307612 - DNA, 22 bp, Homo sapiens
tttgtcttcatccttcgagctg

SEQ ID NO: 7307613 - DNA, 22 bp, Homo sapiens
tttgtcttatccaatctctcag

SEQ ID NO: 7307614 - DNA, 22 bp, Homo sapiens
tttgtgcaagacatgctaagag

SEQ ID NO: 7307615 - DNA, 22 bp, Homo sapiens
tttgtgcaagacatgctaagag

SEQ ID NO: 7307616 - DNA, 22 bp, Homo sapiens
tttgtgcaagagggccacctta

SEQ ID NO: 7307617 - DNA, 22 bp, Homo sapiens
tttgtgcaatttatgtactata

SEQ ID NO: 7307618 - DNA, 22 bp, Homo sapiens
tttgtgcaatttatgtactata

SEQ ID NO: 7307619 - DNA, 22 bp, Homo sapiens
tttgtgcacattgcttttctat

SEQ ID NO: 7307620 - DNA, 22 bp, Homo sapiens
tttgtgcaatttatgtactata

SEQ ID NO: 7307621 - DNA, 22 bp, Homo sapiens
tttgtgcacattgcttttctat

SEQ ID NO: 7307622 - DNA, 22 bp, Homo sapiens
tttgtgcagatgtatatttgtg

SEQ ID NO: 7307623 - DNA, 19 bp, Homo sapiens
tttgtgcagcaacattaat

SEQ ID NO: 7307624 - DNA, 22 bp, Homo sapiens
tttgtgcagatgtatatttgtg

SEQ ID NO: 7307625 - DNA, 22 bp, Homo sapiens
tttgtgcacattgcttttctat

SEQ ID NO: 7307626 - DNA, 22 bp, Homo sapiens
tttgtgcacttctgtagctgcc

SEQ ID NO: 7307627 - DNA, 22 bp, Homo sapiens
tttgtgcacttctgtagctgcc

SEQ ID NO: 7307628 - DNA, 23 bp, Homo sapiens
tttgtgcagaagacaaagtggcc

SEQ ID NO: 7307629 - DNA, 22 bp, Homo sapiens
tttgtgcagataggagacaatc

SEQ ID NO: 7307630 - DNA, 22 bp, Homo sapiens
tttgtgcagctaagaaaatggc

SEQ ID NO: 7307631 - DNA, 22 bp, Homo sapiens
tttgtgcaggtataggcggaga

SEQ ID NO: 7307632 - DNA, 22 bp, Homo sapiens
tttgtgcaggtgtgtcagatcg

SEQ ID NO: 7307633 - DNA, 22 bp, Homo sapiens
tttgtgcagtggttaagaccat

SEQ ID NO: 7307634 - DNA, 22 bp, Homo sapiens
tttgtgcataaagggctatagt

SEQ ID NO: 7307635 - DNA, 22 bp, Homo sapiens
tttgtgcataaagggctatagt

SEQ ID NO: 7307636 - DNA, 22 bp, Homo sapiens
tttgtgcatgggtatggccaat

SEQ ID NO: 7307637 - DNA, 22 bp, Homo sapiens
tttgtgcatgggtatggccaat

SEQ ID NO: 7307638 - DNA, 22 bp, Homo sapiens
tttgtgcattcaagtaggagcc

SEQ ID NO: 7307639 - DNA, 22 bp, Homo sapiens
ttttacaggtcataggtatagt

SEQ ID NO: 7307640 - DNA, 22 bp, Homo sapiens
ttttacaggtgaaaaatgaaga

SEQ ID NO: 7307641 - DNA, 22 bp, Homo sapiens
ttttacaagctgagtcgttaaa

SEQ ID NO: 7307642 - DNA, 22 bp, Homo sapiens
tttgtgtaccttgtacatttgt

SEQ ID NO: 7307643 - DNA, 22 bp, Homo sapiens
tttgtgtatgtatgcttgtaca

SEQ ID NO: 7307644 - DNA, 19 bp, Homo sapiens
tttgtgtatgtgcgtacca

SEQ ID NO: 7307645 - DNA, 22 bp, Homo sapiens
ttttacaagctgagtcgttaaa

SEQ ID NO: 7307646 - DNA, 22 bp, Homo sapiens
ttttccttctagagcagatttc

SEQ ID NO: 7307647 - DNA, 22 bp, Homo sapiens
ttttcctatatgcaaagaatgc

SEQ ID NO: 7307648 - DNA, 19 bp, Homo sapiens
ttttcccaccctttagaat

SEQ ID NO: 7307649 - DNA, 22 bp, Homo sapiens
ttttgtgtccttcacatcatgt

SEQ ID NO: 7307650 - DNA, 23 bp, Homo sapiens
ttttgtgtgacttaatatctctt

SEQ ID NO: 7307651 - DNA, 19 bp, Homo sapiens
ttttgtgtagctgctggtt

SEQ ID NO: 7307652 - DNA, 22 bp, Homo sapiens
ttttgtgtagagatggggtctt

SEQ ID NO: 7307653 - DNA, 22 bp, Homo sapiens
tttttgtagtcattagaagagg

SEQ ID NO: 7307654 - DNA, 17 bp, Homo sapiens
ttttgttcatcttcaaa

SEQ ID NO: 7307655 - DNA, 22 bp, Homo sapiens
ttttgtcagtgagaacagagtt

SEQ ID NO: 7307656 - DNA, 22 bp, Homo sapiens
ttttgtatgagaagtgctttac

SEQ ID NO: 7307657 - DNA, 22 bp, Homo sapiens
tttttgttctgattatactggt

SEQ ID NO: 7307658 - DNA, 22 bp, Homo sapiens
tttttgtgtgagcagggtgtta

SEQ ID NO: 7307659 - DNA, 21 bp, Homo sapiens
tttgaaagtgggtgattcttt

SEQ ID NO: 7307660 - DNA, 21 bp, Homo sapiens
tttgaaagtgggtgattcttt

SEQ ID NO: 7307661 - DNA, 22 bp, Homo sapiens
tttgaaagtcaaccttccagtt

SEQ ID NO: 7307662 - DNA, 22 bp, Homo sapiens
tttctatatgaggagctaaagt

SEQ ID NO: 7307663 - DNA, 22 bp, Homo sapiens
tttctattgatctaataaacat

SEQ ID NO: 7307664 - DNA, 22 bp, Homo sapiens
tttgaaattaagatattgtcca

SEQ ID NO: 7307665 - DNA, 22 bp, Homo sapiens
tttgaaatgtatcagtataggt

SEQ ID NO: 7307666 - DNA, 22 bp, Homo sapiens
tttgaaatgtatcagtataggt

SEQ ID NO: 7307667 - DNA, 22 bp, Homo sapiens
tttgaaatatgaggcattatga

SEQ ID NO: 7307668 - DNA, 22 bp, Homo sapiens
tttgaaagttcttctgacacta

SEQ ID NO: 7307669 - DNA, 22 bp, Homo sapiens
tttgaaatatgtgatgagagag

SEQ ID NO: 7307670 - DNA, 22 bp, Homo sapiens
tttgaaatatgtgatgagagag

SEQ ID NO: 7307671 - DNA, 22 bp, Homo sapiens
tttctatatgaggagctaaagt

SEQ ID NO: 7307672 - DNA, 22 bp, Homo sapiens
tttctagggctcttgtcttctg

SEQ ID NO: 7307673 - DNA, 22 bp, Homo sapiens
tttctaggcacagtgtcttccc

SEQ ID NO: 7307674 - DNA, 22 bp, Homo sapiens
tttctagctgacaaaaatgttt

SEQ ID NO: 7307675 - DNA, 22 bp, Homo sapiens
tttctagatcaaacttttatat

SEQ ID NO: 7307676 - DNA, 22 bp, Homo sapiens
tttctagagttcatcatggtaa

SEQ ID NO: 7307677 - DNA, 22 bp, Homo sapiens
tttgacagtgatgatatataca

SEQ ID NO: 7307678 - DNA, 20 bp, Homo sapiens
tttgacatatacagttcagg

SEQ ID NO: 7307679 - DNA, 22 bp, Homo sapiens
tttgacatgtgcttataacttt

SEQ ID NO: 7307680 - DNA, 22 bp, Homo sapiens
tttgacattaaggaacatatat

SEQ ID NO: 7307681 - DNA, 22 bp, Homo sapiens
tttgagaaggtgacaaattcta

SEQ ID NO: 7307682 - DNA, 22 bp, Homo sapiens
tttgacagcataatcctacacc

SEQ ID NO: 7307683 - DNA, 22 bp, Homo sapiens
tttgaagactactgggagtgaa

SEQ ID NO: 7307684 - DNA, 22 bp, Homo sapiens
tttgaagacatattgttacata

SEQ ID NO: 7307685 - DNA, 22 bp, Homo sapiens
tttgaacatgctgcatgataat

SEQ ID NO: 7307686 - DNA, 23 bp, Homo sapiens
tttgaacatttctagattacata

SEQ ID NO: 7307687 - DNA, 23 bp, Homo sapiens
tttgaacatttctagattacata

SEQ ID NO: 7307688 - DNA, 22 bp, Homo sapiens
tttgaactgttctaggatttaa

SEQ ID NO: 7307689 - DNA, 22 bp, Homo sapiens
tttgaacagacactttctacag

SEQ ID NO: 7307690 - DNA, 22 bp, Homo sapiens
tttgaacaagagcttcacatta

SEQ ID NO: 7307691 - DNA, 22 bp, Homo sapiens
tttgaacaggagtatctatagt

SEQ ID NO: 7307692 - DNA, 22 bp, Homo sapiens
tttgaacagggaatgttccaca

SEQ ID NO: 7307693 - DNA, 22 bp, Homo sapiens
tttgctgactggatgcagttgg

SEQ ID NO: 7307694 - DNA, 21 bp, Homo sapiens
tttgagaattggtcagagtgc

SEQ ID NO: 7307695 - DNA, 22 bp, Homo sapiens
tttgagctatgggcttggattt

SEQ ID NO: 7307696 - DNA, 22 bp, Homo sapiens
tttgagcttgtagcattgctat

SEQ ID NO: 7307697 - DNA, 22 bp, Homo sapiens
tttgagatggagtcttgctctg

SEQ ID NO: 7307698 - DNA, 22 bp, Homo sapiens
tttggctctgtgtcttcaccca

SEQ ID NO: 7307699 - DNA, 22 bp, Homo sapiens
tttggctctgcgtcttcaccca

SEQ ID NO: 7307700 - DNA, 17 bp, Homo sapiens
tttggcagtcttttaca

SEQ ID NO: 7307701 - DNA, 22 bp, Homo sapiens
tttgggctcttgctgacctggg

SEQ ID NO: 7307702 - DNA, 22 bp, Homo sapiens
tttgggctcccacaggcttgtg

SEQ ID NO: 7307703 - DNA, 22 bp, Homo sapiens
tttgggctcactatgctgaaga

SEQ ID NO: 7307704 - DNA, 22 bp, Homo sapiens
tttggggaaccactgaggtagg

SEQ ID NO: 7307705 - DNA, 22 bp, Homo sapiens
tttggggactgttagagaaaat

SEQ ID NO: 7307706 - DNA, 22 bp, Homo sapiens
tttggggaggttatcggtgtgc

SEQ ID NO: 7307707 - DNA, 22 bp, Homo sapiens
tttggggagacatggccagctg

SEQ ID NO: 7307708 - DNA, 22 bp, Homo sapiens
tttggggatgacaggttaggaa

SEQ ID NO: 7307709 - DNA, 22 bp, Homo sapiens
tttggggatgtctgagttgttg

SEQ ID NO: 7307710 - DNA, 22 bp, Homo sapiens
tttgggtagataacaaagatct

SEQ ID NO: 7307711 - DNA, 22 bp, Homo sapiens
tttgtcatgtccttaactgtct

SEQ ID NO: 7307712 - DNA, 21 bp, Homo sapiens
ttttttcttgcgtgaggcctg

SEQ ID NO: 7307713 - DNA, 22 bp, Homo sapiens
ttgaaagacattatttatatat

SEQ ID NO: 7307714 - DNA, 22 bp, Homo sapiens
ttgaaacttttcttggagaaac

SEQ ID NO: 7307715 - DNA, 22 bp, Homo sapiens
ttgaaacttagaaattgagctg

SEQ ID NO: 7307716 - DNA, 22 bp, Homo sapiens
ttgaaactgtcagcttttacgc

SEQ ID NO: 7307717 - DNA, 22 bp, Homo sapiens
ttgaaactgggaagcagggggt

SEQ ID NO: 7307718 - DNA, 22 bp, Homo sapiens
ttgaaactttagtaaactaagg

SEQ ID NO: 7307719 - DNA, 22 bp, Homo sapiens
ttgaaactgcttattgaatttg

SEQ ID NO: 7307720 - DNA, 22 bp, Homo sapiens
ttgaaactcccttttgtctagt

SEQ ID NO: 7307721 - DNA, 22 bp, Homo sapiens
ttgaaactgagtgtgtttgggg

SEQ ID NO: 7307722 - DNA, 22 bp, Homo sapiens
ttgaaacattctcctattgatt

SEQ ID NO: 7307723 - DNA, 22 bp, Homo sapiens
ttgaaactcatcttagtgatgt

SEQ ID NO: 7307724 - DNA, 22 bp, Homo sapiens
ttgaaactatgaagacaaccat

SEQ ID NO: 7307725 - DNA, 22 bp, Homo sapiens
ttgaaagatatgttaatctttc

SEQ ID NO: 7307726 - DNA, 22 bp, Homo sapiens
ttgaaagatatgttaatctttc

SEQ ID NO: 7307727 - DNA, 22 bp, Homo sapiens
ttgaaagctccatattgtagag

SEQ ID NO: 7307728 - DNA, 20 bp, Homo sapiens
ttgaaaatgcattgtgcagt

SEQ ID NO: 7307729 - DNA, 22 bp, Homo sapiens
ttgaaaatatcacaggagcagc

SEQ ID NO: 7307730 - DNA, 22 bp, Homo sapiens
ttgaaacagtagctcatagacc

SEQ ID NO: 7307731 - DNA, 22 bp, Homo sapiens
ttgaaaatggtaagcatgatat

SEQ ID NO: 7307732 - DNA, 22 bp, Homo sapiens
ttctttttggatagctgatgaa

SEQ ID NO: 7307733 - DNA, 22 bp, Homo sapiens
ttgaaaaaattggtagaggatg

SEQ ID NO: 7307734 - DNA, 22 bp, Homo sapiens
ttgaaaaaattggtagaggatg

SEQ ID NO: 7307735 - DNA, 22 bp, Homo sapiens
ttgaaaaccgtgggaggctgaa

SEQ ID NO: 7307736 - DNA, 22 bp, Homo sapiens
ttgaaaacagcgtagattcaca

SEQ ID NO: 7307737 - DNA, 22 bp, Homo sapiens
ttgaaaacagcgtagattcaca

SEQ ID NO: 7307738 - DNA, 22 bp, Homo sapiens
ttgaaaacatttatattagaat

SEQ ID NO: 7307739 - DNA, 22 bp, Homo sapiens
ttgagaagcacagggcctgtgc

SEQ ID NO: 7307740 - DNA, 22 bp, Homo sapiens
ttgagaaggtggtcatttgcaa

SEQ ID NO: 7307741 - DNA, 22 bp, Homo sapiens
ttgagaagaaatagtttgcaat

SEQ ID NO: 7307742 - DNA, 22 bp, Homo sapiens
ttgagagaaaaaatttattggt

SEQ ID NO: 7307743 - DNA, 22 bp, Homo sapiens
ttgagaaataagcatgtctaga

SEQ ID NO: 7307744 - DNA, 22 bp, Homo sapiens
ttgagataggtggaatctcttt

SEQ ID NO: 7307745 - DNA, 22 bp, Homo sapiens
ttgagatagatctcatcttccc

SEQ ID NO: 7307746 - DNA, 22 bp, Homo sapiens
ttgagagaggaaacatagtctc

SEQ ID NO: 7307747 - DNA, 22 bp, Homo sapiens
ttctttgaccaaacagttttcc

SEQ ID NO: 7307748 - DNA, 22 bp, Homo sapiens
ttctttgagttagtacagtcca

SEQ ID NO: 7307749 - DNA, 19 bp, Homo sapiens
ttctttgagttcttctgag

SEQ ID NO: 7307750 - DNA, 22 bp, Homo sapiens
ttctttctttgtagtcctgaac

SEQ ID NO: 7307751 - DNA, 23 bp, Homo sapiens
ttctttggaattgggctgcaagg

SEQ ID NO: 7307752 - DNA, 22 bp, Homo sapiens
ttctttggcatttcctgtatgt

SEQ ID NO: 7307753 - DNA, 22 bp, Homo sapiens
ttctttgcccatgtttcctaag

SEQ ID NO: 7307754 - DNA, 22 bp, Homo sapiens
ttctttgcccttaatgaaataa

SEQ ID NO: 7307755 - DNA, 22 bp, Homo sapiens
ttctttggaataagtcaagctg

SEQ ID NO: 7307756 - DNA, 22 bp, Homo sapiens
ttctttgggcaattgctggccc

SEQ ID NO: 7307757 - DNA, 22 bp, Homo sapiens
ttctttgggattgtagctgtct

SEQ ID NO: 7307758 - DNA, 22 bp, Homo sapiens
ttctttggcttacgtctggcct

SEQ ID NO: 7307759 - DNA, 22 bp, Homo sapiens
ttctttggctgccagtctggag

SEQ ID NO: 7307760 - DNA, 22 bp, Homo sapiens
ttctttggggtctccagcatag

SEQ ID NO: 7307761 - DNA, 22 bp, Homo sapiens
ttctttggggaatattctggtt

SEQ ID NO: 7307762 - DNA, 22 bp, Homo sapiens
ttctttggtgggagattgaggt

SEQ ID NO: 7307763 - DNA, 22 bp, Homo sapiens
ttctttgggctcagagagggag

SEQ ID NO: 7307764 - DNA, 22 bp, Homo sapiens
ttcttctgcctcccacctgata

SEQ ID NO: 7307765 - DNA, 22 bp, Homo sapiens
ttcttctgtgaggtgtgtgcct

SEQ ID NO: 7307766 - DNA, 22 bp, Homo sapiens
ttcttcttctggctgcacctgg

SEQ ID NO: 7307767 - DNA, 22 bp, Homo sapiens
ttctgggaggctggctgtcata

SEQ ID NO: 7307768 - DNA, 22 bp, Homo sapiens
ttcttccttggtttcctggata

SEQ ID NO: 7307769 - DNA, 22 bp, Homo sapiens
ttctggcttttcatgttccagt

SEQ ID NO: 7307770 - DNA, 22 bp, Homo sapiens
ttctggagtattcctggcacct

SEQ ID NO: 7307771 - DNA, 22 bp, Homo sapiens
ttctggagtattcctggcagcc

SEQ ID NO: 7307772 - DNA, 22 bp, Homo sapiens
ttctggagggcatgctgctgcc

SEQ ID NO: 7307773 - DNA, 19 bp, Homo sapiens
ttctggaggttaccctgag

SEQ ID NO: 7307774 - DNA, 22 bp, Homo sapiens
ttctggaggttattaggagtct

SEQ ID NO: 7307775 - DNA, 22 bp, Homo sapiens
ttctccagtttctcccttcagt

SEQ ID NO: 7307776 - DNA, 22 bp, Homo sapiens
ttctccagtcactgacttcgag

SEQ ID NO: 7307777 - DNA, 22 bp, Homo sapiens
ttctcttcccactttctgtatt

SEQ ID NO: 7307778 - DNA, 22 bp, Homo sapiens
ttctcttgtgccaagttgttgc

SEQ ID NO: 7307779 - DNA, 22 bp, Homo sapiens
ttctcttgagctggtcatgttt

SEQ ID NO: 7307780 - DNA, 22 bp, Homo sapiens
ttctcttgactaccagttagga

SEQ ID NO: 7307781 - DNA, 22 bp, Homo sapiens
ttctcttattctggatatgcag

SEQ ID NO: 7307782 - DNA, 22 bp, Homo sapiens
ttctcttagctgtaaagtcaat

SEQ ID NO: 7307783 - DNA, 22 bp, Homo sapiens
ttctgagggaaccttgttcttg

SEQ ID NO: 7307784 - DNA, 22 bp, Homo sapiens
ttctgatactggaatcgatgcc

SEQ ID NO: 7307785 - DNA, 22 bp, Homo sapiens
ttctgattcatgatccagttct

SEQ ID NO: 7307786 - DNA, 22 bp, Homo sapiens
ttctgattgctgatgaggccca

SEQ ID NO: 7307787 - DNA, 22 bp, Homo sapiens
ttctgattgctgatgaggccca

SEQ ID NO: 7307788 - DNA, 22 bp, Homo sapiens
ttctgattgctgatgaggccca

SEQ ID NO: 7307789 - DNA, 19 bp, Homo sapiens
ttctgccctctcttctagc

SEQ ID NO: 7307790 - DNA, 22 bp, Homo sapiens
ttctcaaggacaaaatgacatg

SEQ ID NO: 7307791 - DNA, 22 bp, Homo sapiens
ttctcaaagggtggtttgcaaa

SEQ ID NO: 7307792 - DNA, 19 bp, Homo sapiens
ttctccagcctgacctgag

SEQ ID NO: 7307793 - DNA, 22 bp, Homo sapiens
ttctccagagtttctctcactg

SEQ ID NO: 7307794 - DNA, 22 bp, Homo sapiens
ttctccagcctattggcctatc

SEQ ID NO: 7307795 - DNA, 19 bp, Homo sapiens
ttctccaggctgcagaggg

SEQ ID NO: 7307796 - DNA, 22 bp, Homo sapiens
ttctccaggcttgggccaggtc

SEQ ID NO: 7307797 - DNA, 19 bp, Homo sapiens
ttctccagggacttaggga

SEQ ID NO: 7307798 - DNA, 22 bp, Homo sapiens
ttctccaggggagggttctcca

SEQ ID NO: 7307799 - DNA, 22 bp, Homo sapiens
ttcgtgtggagatgtttctgca

SEQ ID NO: 7307800 - DNA, 22 bp, Homo sapiens
ttcggtcattcaatgagggcag

SEQ ID NO: 7307801 - DNA, 22 bp, Homo sapiens
ttcgggaggcggagcttgcagt

SEQ ID NO: 7307802 - DNA, 22 bp, Homo sapiens
ttctaaagtgcaatctgacaga

SEQ ID NO: 7307803 - DNA, 22 bp, Homo sapiens
ttcgactctgtgcctgaagagc

SEQ ID NO: 7307804 - DNA, 22 bp, Homo sapiens
ttccttgtttcaagccatccac

SEQ ID NO: 7307805 - DNA, 22 bp, Homo sapiens
ttccttgttgaaaatgtctgca

SEQ ID NO: 7307806 - DNA, 22 bp, Homo sapiens
ttccctgcaacctttccctggg

SEQ ID NO: 7307807 - DNA, 22 bp, Homo sapiens
ttccctccgaacctcagtgctg

SEQ ID NO: 7307808 - DNA, 22 bp, Homo sapiens
ttagtgtattttcaaatgtaga

SEQ ID NO: 7307809 - DNA, 22 bp, Homo sapiens
tcctctggcccagctgcctctg

SEQ ID NO: 7307810 - DNA, 22 bp, Homo sapiens
tcctctggctctttccctagga

SEQ ID NO: 7307811 - DNA, 22 bp, Homo sapiens
tcctctgctgttctggttcttt

SEQ ID NO: 7307812 - DNA, 20 bp, Homo sapiens
tcctccttgcagagcccaga

SEQ ID NO: 7307813 - DNA, 21 bp, Homo sapiens
tcctcctgtagagggtcctgg

SEQ ID NO: 7307814 - DNA, 22 bp, Homo sapiens
tcctcctgtctaccagttcctg

SEQ ID NO: 7307815 - DNA, 22 bp, Homo sapiens
tcctcctgtttctcaggcctgg

SEQ ID NO: 7307816 - DNA, 22 bp, Homo sapiens
tcctctgctcagcattcctcac

SEQ ID NO: 7307817 - DNA, 20 bp, Homo sapiens
ttatgtgtacctgtgctccc

SEQ ID NO: 7307818 - DNA, 22 bp, Homo sapiens
ttatgtcttaagtatgctaatt

SEQ ID NO: 7307819 - DNA, 22 bp, Homo sapiens
ttatgtgccactttttgaagat

SEQ ID NO: 7307820 - DNA, 22 bp, Homo sapiens
ttatgtgtgtacatgcatatgt

SEQ ID NO: 7307821 - DNA, 22 bp, Homo sapiens
ttatgtgtataattacaggaag

SEQ ID NO: 7307822 - DNA, 22 bp, Homo sapiens
ttatgtgtataattacaggaag

SEQ ID NO: 7307823 - DNA, 22 bp, Homo sapiens
ttatgtgtgtacatgcatatgt

SEQ ID NO: 7307824 - DNA, 22 bp, Homo sapiens
ttatgtgtgtacatgcatatgt

SEQ ID NO: 7307825 - DNA, 22 bp, Homo sapiens
ttatgtgtgtgtatacatacaa

SEQ ID NO: 7307826 - DNA, 22 bp, Homo sapiens
ttatgtgtgtgtatacatacaa

SEQ ID NO: 7307827 - DNA, 22 bp, Homo sapiens
ttatgctaaatgaatcaagtca

SEQ ID NO: 7307828 - DNA, 22 bp, Homo sapiens
ttatgcatatagcagatacgag

SEQ ID NO: 7307829 - DNA, 22 bp, Homo sapiens
ttatgctagttgaaataacaca

SEQ ID NO: 7307830 - DNA, 22 bp, Homo sapiens
ttataattctggcataggctgt

SEQ ID NO: 7307831 - DNA, 22 bp, Homo sapiens
ttataattgcttattagaccca

SEQ ID NO: 7307832 - DNA, 22 bp, Homo sapiens
ttatacactgcagaaccagcat

SEQ ID NO: 7307833 - DNA, 22 bp, Homo sapiens
ttatacacgtttatggagctac

SEQ ID NO: 7307834 - DNA, 22 bp, Homo sapiens
ttattttgccacaggtgacctt

SEQ ID NO: 7307835 - DNA, 22 bp, Homo sapiens
ttattttgccacaggtgacctt

SEQ ID NO: 7307836 - DNA, 22 bp, Homo sapiens
ttattttggtaaatgtttgcct

SEQ ID NO: 7307837 - DNA, 22 bp, Homo sapiens
ttattttggtaaatgtttgcct

SEQ ID NO: 7307838 - DNA, 22 bp, Homo sapiens
ttattttctcctcagaaagtgg

SEQ ID NO: 7307839 - DNA, 22 bp, Homo sapiens
ttattttgagagaatgtgtgct

SEQ ID NO: 7307840 - DNA, 22 bp, Homo sapiens
ttattttgagagaatgtgtgct

SEQ ID NO: 7307841 - DNA, 21 bp, Homo sapiens
ttcaaaatggtgtgtttgtct

SEQ ID NO: 7307842 - DNA, 22 bp, Homo sapiens
ttcaaaagtaatcagtattaga

SEQ ID NO: 7307843 - DNA, 22 bp, Homo sapiens
ttattttgtagctctgatcttt

SEQ ID NO: 7307844 - DNA, 22 bp, Homo sapiens
ttattttgtagctctgatcttt

SEQ ID NO: 7307845 - DNA, 22 bp, Homo sapiens
ttcaaacaactcatttatgcaa

SEQ ID NO: 7307846 - DNA, 22 bp, Homo sapiens
ttcaagactccaagaaattagt

SEQ ID NO: 7307847 - DNA, 23 bp, Homo sapiens
ttcaagagccatgctcttcttat

SEQ ID NO: 7307848 - DNA, 22 bp, Homo sapiens
ttcaaggaaaccagcatttggt

SEQ ID NO: 7307849 - DNA, 22 bp, Homo sapiens
ttatttatatctctgcagttta

SEQ ID NO: 7307850 - DNA, 22 bp, Homo sapiens
ttatttatatctctgcagttta

SEQ ID NO: 7307851 - DNA, 22 bp, Homo sapiens
ttatttgtggcatatgagacga

SEQ ID NO: 7307852 - DNA, 22 bp, Homo sapiens
ttatttgtggcatccatgttgg

SEQ ID NO: 7307853 - DNA, 20 bp, Homo sapiens
ttatttgtttactttggtcc

SEQ ID NO: 7307854 - DNA, 20 bp, Homo sapiens
ttatttgtttactttggtcc

SEQ ID NO: 7307855 - DNA, 18 bp, Homo sapiens
ttatttgttacagcacat

SEQ ID NO: 7307856 - DNA, 22 bp, Homo sapiens
ttatttgttttctgagaagtat

SEQ ID NO: 7307857 - DNA, 22 bp, Homo sapiens
ttatttgttttctgagaagtat

SEQ ID NO: 7307858 - DNA, 22 bp, Homo sapiens
ttattgtttaaagccatgtaaa

SEQ ID NO: 7307859 - DNA, 22 bp, Homo sapiens
ttattgtttgggtataatttga

SEQ ID NO: 7307860 - DNA, 22 bp, Homo sapiens
ttatgtttgagtatatgactca

SEQ ID NO: 7307861 - DNA, 22 bp, Homo sapiens
ttatgttttatggctatatcat

SEQ ID NO: 7307862 - DNA, 22 bp, Homo sapiens
ttatgtttgagtatatgactca

SEQ ID NO: 7307863 - DNA, 22 bp, Homo sapiens
ttattgtttgggtataatttga

SEQ ID NO: 7307864 - DNA, 22 bp, Homo sapiens
ttcactgtgaactcatattcag

SEQ ID NO: 7307865 - DNA, 22 bp, Homo sapiens
ttcactgtgatggtgcagaggc

SEQ ID NO: 7307866 - DNA, 17 bp, Homo sapiens
ttcagaagcattttggc

SEQ ID NO: 7307867 - DNA, 22 bp, Homo sapiens
ttcaatcattccaacactttaa

SEQ ID NO: 7307868 - DNA, 22 bp, Homo sapiens
ttcaatatgatattagctgtgg

SEQ ID NO: 7307869 - DNA, 22 bp, Homo sapiens
ttcactgtactgactgtcttat

SEQ ID NO: 7307870 - DNA, 19 bp, Homo sapiens
ttcaagtaaactattatta

SEQ ID NO: 7307871 - DNA, 21 bp, Homo sapiens
ttcatcagccagaaatcaagc

SEQ ID NO: 7307872 - DNA, 22 bp, Homo sapiens
ttcatatttgaaacagaagtta

SEQ ID NO: 7307873 - DNA, 22 bp, Homo sapiens
ttcataggaaaaatgtgaggtg

SEQ ID NO: 7307874 - DNA, 22 bp, Homo sapiens
ttcataggaaaatgctggcccc

SEQ ID NO: 7307875 - DNA, 22 bp, Homo sapiens
ttcataggaaatagtgttcttt

SEQ ID NO: 7307876 - DNA, 22 bp, Homo sapiens
ttcatagatctcaattttgagg

SEQ ID NO: 7307877 - DNA, 22 bp, Homo sapiens
ttcataggaatttaaagaggaa

SEQ ID NO: 7307878 - DNA, 21 bp, Homo sapiens
ttcataggacgactgtctgtc

SEQ ID NO: 7307879 - DNA, 22 bp, Homo sapiens
ttcataggagagaagaaagtgt

SEQ ID NO: 7307880 - DNA, 22 bp, Homo sapiens
ttcataggatagagtgagattt

SEQ ID NO: 7307881 - DNA, 22 bp, Homo sapiens
ttcataggatcaaaagctgttt

SEQ ID NO: 7307882 - DNA, 23 bp, Homo sapiens
ttcataggcacattgcgcacaga

SEQ ID NO: 7307883 - DNA, 22 bp, Homo sapiens
ttcataggcaccctgtctgagg

SEQ ID NO: 7307884 - DNA, 22 bp, Homo sapiens
ttcataggtggatgctgccagg

SEQ ID NO: 7307885 - DNA, 22 bp, Homo sapiens
ttcataggtttgctgtgaacat

SEQ ID NO: 7307886 - DNA, 22 bp, Homo sapiens
ttcataggcagcactggctcct

SEQ ID NO: 7307887 - DNA, 22 bp, Homo sapiens
ttcatagggagagtggtggaaa

SEQ ID NO: 7307888 - DNA, 22 bp, Homo sapiens
ttcatagggctggggtgggagc

SEQ ID NO: 7307889 - DNA, 22 bp, Homo sapiens
ttcatagggtatttccatagta

SEQ ID NO: 7307890 - DNA, 22 bp, Homo sapiens
ttcataggtacagggaatttct

SEQ ID NO: 7307891 - DNA, 22 bp, Homo sapiens
ttcataggtcaaaaaacaagag

SEQ ID NO: 7307892 - DNA, 19 bp, Homo sapiens
ttcataggtgagcatacag

SEQ ID NO: 7307893 - DNA, 22 bp, Homo sapiens
ttcccagattggagggcagggg

SEQ ID NO: 7307894 - DNA, 19 bp, Homo sapiens
ttcccagagccatgagtga

SEQ ID NO: 7307895 - DNA, 22 bp, Homo sapiens
ttccaagtgtcagatcagattt

SEQ ID NO: 7307896 - DNA, 22 bp, Homo sapiens
ttccaagtgttgagattagagg

SEQ ID NO: 7307897 - DNA, 21 bp, Homo sapiens
ttccagttttaattaaattgt

SEQ ID NO: 7307898 - DNA, 22 bp, Homo sapiens
ttccaattgcagatcagataca

SEQ ID NO: 7307899 - DNA, 22 bp, Homo sapiens
ttccaattgtgagattttttaa

SEQ ID NO: 7307900 - DNA, 22 bp, Homo sapiens
ttccaatcaggataataattag

SEQ ID NO: 7307901 - DNA, 22 bp, Homo sapiens
ttccaattgcagatcagataca

SEQ ID NO: 7307902 - DNA, 22 bp, Homo sapiens
ttcatcaggcatcatgctcaag

SEQ ID NO: 7307903 - DNA, 22 bp, Homo sapiens
ttccaactctgaaatgtgaaat

SEQ ID NO: 7307904 - DNA, 22 bp, Homo sapiens
ttccaactttaaaattcattct

SEQ ID NO: 7307905 - DNA, 22 bp, Homo sapiens
ttccaacttcccatccctgctg

SEQ ID NO: 7307906 - DNA, 22 bp, Homo sapiens
ttccaactttgtcatatattat

SEQ ID NO: 7307907 - DNA, 22 bp, Homo sapiens
ttccaagacacctttagtcact

SEQ ID NO: 7307908 - DNA, 22 bp, Homo sapiens
ttccaagaaacaagtgatgcag

SEQ ID NO: 7307909 - DNA, 22 bp, Homo sapiens
tttatgtcaaaactacagttgg

SEQ ID NO: 7307910 - DNA, 22 bp, Homo sapiens
tttatgtgatgcatcccagaaa

SEQ ID NO: 7307911 - DNA, 22 bp, Homo sapiens
tttatgtcccttcaaatgttta

SEQ ID NO: 7307912 - DNA, 22 bp, Homo sapiens
tttatgtttgcattttcaaaga

SEQ ID NO: 7307913 - DNA, 22 bp, Homo sapiens
tttattgccctgtagtacagga

SEQ ID NO: 7307914 - DNA, 22 bp, Homo sapiens
tttatgttgaagagactgtgtt

SEQ ID NO: 7307915 - DNA, 21 bp, Homo sapiens
tttatgtacttcatagagtag

SEQ ID NO: 7307916 - DNA, 22 bp, Homo sapiens
tttatgagcaatgctgagggga

SEQ ID NO: 7307917 - DNA, 22 bp, Homo sapiens
tttatgaactacagatataact

SEQ ID NO: 7307918 - DNA, 22 bp, Homo sapiens
tttattgtctatgaactgcttg

SEQ ID NO: 7307919 - DNA, 22 bp, Homo sapiens
tttattgtgttgaaactgaatt

SEQ ID NO: 7307920 - DNA, 22 bp, Homo sapiens
tttattgggtgcagtgcccaca

SEQ ID NO: 7307921 - DNA, 22 bp, Homo sapiens
tttattgggcctggaggatcta

SEQ ID NO: 7307922 - DNA, 22 bp, Homo sapiens
tttattgtctatgaactgcttg

SEQ ID NO: 7307923 - DNA, 22 bp, Homo sapiens
tttattggaacacagccatgac

SEQ ID NO: 7307924 - DNA, 22 bp, Homo sapiens
tttatctttaggactttgcaga

SEQ ID NO: 7307925 - DNA, 22 bp, Homo sapiens
tttatcttctgcagttctggct

SEQ ID NO: 7307926 - DNA, 22 bp, Homo sapiens
tttatctgtcatttcccatatc

SEQ ID NO: 7307927 - DNA, 22 bp, Homo sapiens
tttatctgtcctttgccagtga

SEQ ID NO: 7307928 - DNA, 22 bp, Homo sapiens
tttatctgtggtaaataacatt

SEQ ID NO: 7307929 - DNA, 22 bp, Homo sapiens
tttatctgtatatctcaagtgt

SEQ ID NO: 7307930 - DNA, 22 bp, Homo sapiens
tttagtgtaagcataaagaaca

SEQ ID NO: 7307931 - DNA, 22 bp, Homo sapiens
tttatctgcattctgaccatct

SEQ ID NO: 7307932 - DNA, 22 bp, Homo sapiens
tttagcattactaaaatgaaaa

SEQ ID NO: 7307933 - DNA, 22 bp, Homo sapiens
tttagcatcgaagtaaatttag

SEQ ID NO: 7307934 - DNA, 22 bp, Homo sapiens
tttagcgtagctgacagctaat

SEQ ID NO: 7307935 - DNA, 22 bp, Homo sapiens
tttaggaagtttcagataggaa

SEQ ID NO: 7307936 - DNA, 21 bp, Homo sapiens
tttaggaagtttaaggcaggt

SEQ ID NO: 7307937 - DNA, 22 bp, Homo sapiens
tttaggaagatctgaaggaaga

SEQ ID NO: 7307938 - DNA, 22 bp, Homo sapiens
tttaagagctagtatgtcattt

SEQ ID NO: 7307939 - DNA, 22 bp, Homo sapiens
tttaagagcatttgcaatttat

SEQ ID NO: 7307940 - DNA, 22 bp, Homo sapiens
tttaagacttaggaaagaggat

SEQ ID NO: 7307941 - DNA, 22 bp, Homo sapiens
tttaagacttagatttattggg

SEQ ID NO: 7307942 - DNA, 22 bp, Homo sapiens
tttaagacccacagggaagttg

SEQ ID NO: 7307943 - DNA, 22 bp, Homo sapiens
tttaagactcttgtagtacaca

SEQ ID NO: 7307944 - DNA, 22 bp, Homo sapiens
tttaagacagtgcaagctgaat

SEQ ID NO: 7307945 - DNA, 22 bp, Homo sapiens
tttaagaagttatgttataaat

SEQ ID NO: 7307946 - DNA, 19 bp, Homo sapiens
tttacaagttctttgtatg

SEQ ID NO: 7307947 - DNA, 22 bp, Homo sapiens
tttacactgcttgaacaatctc

SEQ ID NO: 7307948 - DNA, 22 bp, Homo sapiens
tttacactcctggaaatgatat

SEQ ID NO: 7307949 - DNA, 22 bp, Homo sapiens
tttacagatctgttgatttgtt

SEQ ID NO: 7307950 - DNA, 22 bp, Homo sapiens
tttacagatgaggaaactgaga

SEQ ID NO: 7307951 - DNA, 22 bp, Homo sapiens
tttacagatgaggaaactgaga

SEQ ID NO: 7307952 - DNA, 22 bp, Homo sapiens
tttacagatgaggaaactgaga

SEQ ID NO: 7307953 - DNA, 22 bp, Homo sapiens
tttacagatgaggatactgagg

SEQ ID NO: 7307954 - DNA, 22 bp, Homo sapiens
tttacagatgtggaaagtgagc

SEQ ID NO: 7307955 - DNA, 22 bp, Homo sapiens
tttacacttgaggaaactgagg

SEQ ID NO: 7307956 - DNA, 22 bp, Homo sapiens
tttacagaatgtcaatttctat

SEQ ID NO: 7307957 - DNA, 22 bp, Homo sapiens
tttacagaatgttgaatttggg

SEQ ID NO: 7307958 - DNA, 22 bp, Homo sapiens
tttacagatctgttgatttgtt

SEQ ID NO: 7307959 - DNA, 22 bp, Homo sapiens
tttacagaggtgtcctgcattg

SEQ ID NO: 7307960 - DNA, 22 bp, Homo sapiens
tttacagagagagaactggact

SEQ ID NO: 7307961 - DNA, 22 bp, Homo sapiens
tttacagagaatgtacataaag

SEQ ID NO: 7307962 - DNA, 22 bp, Homo sapiens
ttgttgatgtggacgtctggaa

SEQ ID NO: 7307963 - DNA, 22 bp, Homo sapiens
ttgttcttgtctttgccttcac

SEQ ID NO: 7307964 - DNA, 22 bp, Homo sapiens
ttgttcttgccaagacatgaag

SEQ ID NO: 7307965 - DNA, 22 bp, Homo sapiens
ttgttgcatttcaagtatgaga

SEQ ID NO: 7307966 - DNA, 22 bp, Homo sapiens
ttgttgccaccctcccttccta

SEQ ID NO: 7307967 - DNA, 22 bp, Homo sapiens
ttgtttaaaagaaatcatagaa

SEQ ID NO: 7307968 - DNA, 22 bp, Homo sapiens
tttaacatgtgaattttggaag

SEQ ID NO: 7307969 - DNA, 22 bp, Homo sapiens
tttaacatgttcaagaaacata

SEQ ID NO: 7307970 - DNA, 20 bp, Homo sapiens
tttcaagtcagcaattctca

SEQ ID NO: 7307971 - DNA, 22 bp, Homo sapiens
tttcaagcatgtcaagttagtc

SEQ ID NO: 7307972 - DNA, 21 bp, Homo sapiens
tttatttatataggacacatg

SEQ ID NO: 7307973 - DNA, 23 bp, Homo sapiens
tttatttatttaggctgagggat

SEQ ID NO: 7307974 - DNA, 22 bp, Homo sapiens
tttcaagtggggacatttgaga

SEQ ID NO: 7307975 - DNA, 22 bp, Homo sapiens
tttcaagtggggacatttgaga

SEQ ID NO: 7307976 - DNA, 22 bp, Homo sapiens
tttcaatcaccataaagcaact

SEQ ID NO: 7307977 - DNA, 22 bp, Homo sapiens
tttcaagttgtttatatccaga

SEQ ID NO: 7307978 - DNA, 22 bp, Homo sapiens
tttcacaactgcttatttgaga

SEQ ID NO: 7307979 - DNA, 22 bp, Homo sapiens
tttcacattcagatatagactt

SEQ ID NO: 7307980 - DNA, 22 bp, Homo sapiens
tttcacattcagatatagactt

SEQ ID NO: 7307981 - DNA, 22 bp, Homo sapiens
tttcacattagatatgtcattt

SEQ ID NO: 7307982 - DNA, 23 bp, Homo sapiens
tttcacattaatgtttagcagga

SEQ ID NO: 7307983 - DNA, 23 bp, Homo sapiens
tttcacattaatgtttagcagga

SEQ ID NO: 7307984 - DNA, 22 bp, Homo sapiens
tttcacattctctggttatcga

SEQ ID NO: 7307985 - DNA, 22 bp, Homo sapiens
tttcacattcttctgaatctac

SEQ ID NO: 7307986 - DNA, 23 bp, Homo sapiens
tttcacatttactgttagatggc

SEQ ID NO: 7307987 - DNA, 22 bp, Homo sapiens
tttcacatttgttttaagaagt

SEQ ID NO: 7307988 - DNA, 22 bp, Homo sapiens
tttcagtgtaaggtttccagga

SEQ ID NO: 7307989 - DNA, 20 bp, Homo sapiens
tttcagtggtttgtgcctag

SEQ ID NO: 7307990 - DNA, 22 bp, Homo sapiens
tttcacatttgttttaagaagt

SEQ ID NO: 7307991 - DNA, 22 bp, Homo sapiens
tttcagtgggtttatttcatgt

SEQ ID NO: 7307992 - DNA, 22 bp, Homo sapiens
tttcataaacagtagaagacta

SEQ ID NO: 7307993 - DNA, 22 bp, Homo sapiens
tttcataaacagtagaagacta

SEQ ID NO: 7307994 - DNA, 22 bp, Homo sapiens
tttcagtgtatcttccaaaagc

SEQ ID NO: 7307995 - DNA, 22 bp, Homo sapiens
tttcagtgtgagtgtcttattt

SEQ ID NO: 7307996 - DNA, 22 bp, Homo sapiens
tttcacatcagaggtagattag

SEQ ID NO: 7307997 - DNA, 22 bp, Homo sapiens
tttcacatcagaggtagattag

SEQ ID NO: 7307998 - DNA, 22 bp, Homo sapiens
tttcacatatggttgttgattg

SEQ ID NO: 7307999 - DNA, 22 bp, Homo sapiens
tttcacatgtgctgttgtcaat

SEQ ID NO: 7308000 - DNA, 22 bp, Homo sapiens
tttcacatgtgctgttgtcaat

SEQ ID NO: 7308001 - DNA, 22 bp, Homo sapiens
tttcacatgtggaatgccaggt

SEQ ID NO: 7308002 - DNA, 22 bp, Homo sapiens
tttcacatgtatataggcatta

SEQ ID NO: 7308003 - DNA, 22 bp, Homo sapiens
tttcacatggaagctctcgaga

SEQ ID NO: 7308004 - DNA, 22 bp, Homo sapiens
tttcacatcatgggatggaagc

SEQ ID NO: 7308005 - DNA, 22 bp, Homo sapiens
tttcatcaccccaaatctatgg

SEQ ID NO: 7308006 - DNA, 22 bp, Homo sapiens
tttcataatactgtacatgaaa

SEQ ID NO: 7308007 - DNA, 22 bp, Homo sapiens
tttcataatactgtacatgaaa

SEQ ID NO: 7308008 - DNA, 22 bp, Homo sapiens
tttcataacctcaagctacagt

SEQ ID NO: 7308009 - DNA, 22 bp, Homo sapiens
tttcataatctgtcaagtgggg

SEQ ID NO: 7308010 - DNA, 22 bp, Homo sapiens
tttcataatgtcacagtcaaaa

SEQ ID NO: 7308011 - DNA, 22 bp, Homo sapiens
tttcataatagtgcagtttgtt

SEQ ID NO: 7308012 - DNA, 22 bp, Homo sapiens
tttcataatatccagagatttt

SEQ ID NO: 7308013 - DNA, 22 bp, Homo sapiens
tttcataatatccagagatttt

SEQ ID NO: 7308014 - DNA, 22 bp, Homo sapiens
tttccagtgaaattttgaatgt

SEQ ID NO: 7308015 - DNA, 22 bp, Homo sapiens
tttccaaataaggtcacattct

SEQ ID NO: 7308016 - DNA, 22 bp, Homo sapiens
tttccagtgggccccttgaaat

SEQ ID NO: 7308017 - DNA, 22 bp, Homo sapiens
tttccatattctgcgtctgcca

SEQ ID NO: 7308018 - DNA, 22 bp, Homo sapiens
tttcctttgagggtcctacact

SEQ ID NO: 7308019 - DNA, 22 bp, Homo sapiens
tttcctttctggtttggtcata

SEQ ID NO: 7308020 - DNA, 22 bp, Homo sapiens
tttctaaaatagattttatggt

SEQ ID NO: 7308021 - DNA, 22 bp, Homo sapiens
tttctaaactggattcagcctg

SEQ ID NO: 7308022 - DNA, 22 bp, Homo sapiens
tttctaaacaaagggagtttgg

SEQ ID NO: 7308023 - DNA, 22 bp, Homo sapiens
tttcggccgcgtgaagttttct

SEQ ID NO: 7308024 - DNA, 22 bp, Homo sapiens
tttctaagaaagtaatggttat

SEQ ID NO: 7308025 - DNA, 22 bp, Homo sapiens
tttctaagatgtggtttcaagg

SEQ ID NO: 7308026 - DNA, 22 bp, Homo sapiens
tttctaaagggtagatttggcc

SEQ ID NO: 7308027 - DNA, 22 bp, Homo sapiens
tttctaaggctaggtcttaagg

SEQ ID NO: 7308028 - DNA, 22 bp, Homo sapiens
ttgtgcaatggtgtttaggttt

SEQ ID NO: 7308029 - DNA, 22 bp, Homo sapiens
ttgtgcaatcccctcattttat

SEQ ID NO: 7308030 - DNA, 22 bp, Homo sapiens
ttgtgcaatcccctcattttat

SEQ ID NO: 7308031 - DNA, 22 bp, Homo sapiens
ttgtgcaatagttttctcatga

SEQ ID NO: 7308032 - DNA, 22 bp, Homo sapiens
ttgtgcatgatgcatacatggt

SEQ ID NO: 7308033 - DNA, 22 bp, Homo sapiens
ttgtgcattgcagcagtgcttt

SEQ ID NO: 7308034 - DNA, 22 bp, Homo sapiens
ttgtgcatttctctgagtgtgt

SEQ ID NO: 7308035 - DNA, 22 bp, Homo sapiens
ttgtgcatgactgtgaatagct

SEQ ID NO: 7308036 - DNA, 22 bp, Homo sapiens
ttgtgcatattaggtacatgct

SEQ ID NO: 7308037 - DNA, 22 bp, Homo sapiens
ttgtgcatatagagttagatgg

SEQ ID NO: 7308038 - DNA, 22 bp, Homo sapiens
ttgtgcagagttgcctttattt

SEQ ID NO: 7308039 - DNA, 22 bp, Homo sapiens
ttgtgcagagttgcctttattt

SEQ ID NO: 7308040 - DNA, 22 bp, Homo sapiens
ttgtgcagagaaatctttcttg

SEQ ID NO: 7308041 - DNA, 22 bp, Homo sapiens
ttgtgcaatttaaaatcttcct

SEQ ID NO: 7308042 - DNA, 22 bp, Homo sapiens
ttgtgcctttgcttttacaagt

SEQ ID NO: 7308043 - DNA, 22 bp, Homo sapiens
ttgtgctaagcaatttgcttaa

SEQ ID NO: 7308044 - DNA, 22 bp, Homo sapiens
ttgtgctaagtgctatgaaggc

SEQ ID NO: 7308045 - DNA, 19 bp, Homo sapiens
ttgtgccaagggtcagaag

SEQ ID NO: 7308046 - DNA, 22 bp, Homo sapiens
ttgtgccagagaaagcacaaga

SEQ ID NO: 7308047 - DNA, 22 bp, Homo sapiens
ttgtgccagagaaagcacaaga

SEQ ID NO: 7308048 - DNA, 22 bp, Homo sapiens
ttgtgccataaccaccctgact

SEQ ID NO: 7308049 - DNA, 22 bp, Homo sapiens
ttgtgccatgaactgtatgaag

SEQ ID NO: 7308050 - DNA, 22 bp, Homo sapiens
ttgtgccatgaactgtatgaag

SEQ ID NO: 7308051 - DNA, 22 bp, Homo sapiens
ttgtgccattaataaggagttg

SEQ ID NO: 7308052 - DNA, 22 bp, Homo sapiens
ttgtggaagccctatgagagac

SEQ ID NO: 7308053 - DNA, 23 bp, Homo sapiens
ttgtggaagggagatggcaacag

SEQ ID NO: 7308054 - DNA, 22 bp, Homo sapiens
ttgtgctgagcttctagctgtg

SEQ ID NO: 7308055 - DNA, 22 bp, Homo sapiens
ttgtatgtttctgtgcacatga

SEQ ID NO: 7308056 - DNA, 22 bp, Homo sapiens
ttgtattaggccctagggagtt

SEQ ID NO: 7308057 - DNA, 22 bp, Homo sapiens
ttgtattagtaagtcagctgct

SEQ ID NO: 7308058 - DNA, 22 bp, Homo sapiens
ttgtatgctgatcaaaagcttc

SEQ ID NO: 7308059 - DNA, 22 bp, Homo sapiens
ttgtatgctgatcaaaagcttc

SEQ ID NO: 7308060 - DNA, 22 bp, Homo sapiens
ttgtatgaatgtatcctaattt

SEQ ID NO: 7308061 - DNA, 22 bp, Homo sapiens
ttgtagcagttctggactgcga

SEQ ID NO: 7308062 - DNA, 22 bp, Homo sapiens
ttgtatataaagcccccactgt

SEQ ID NO: 7308063 - DNA, 22 bp, Homo sapiens
ttggctgttttataggtcagtt

SEQ ID NO: 7308064 - DNA, 22 bp, Homo sapiens
ttgggctcaggagtttgagacc

SEQ ID NO: 7308065 - DNA, 22 bp, Homo sapiens
ttgggctgcagcaattattagt

SEQ ID NO: 7308066 - DNA, 22 bp, Homo sapiens
ttggggaggttgccacattcca

SEQ ID NO: 7308067 - DNA, 17 bp, Homo sapiens
ttggggattgattactt

SEQ ID NO: 7308068 - DNA, 22 bp, Homo sapiens
ttggggataagaattgaatgca

SEQ ID NO: 7308069 - DNA, 22 bp, Homo sapiens
ttggccctttatgggatgggca

SEQ ID NO: 7308070 - DNA, 22 bp, Homo sapiens
ttggcagaggtctcgttgtggc

SEQ ID NO: 7308071 - DNA, 22 bp, Homo sapiens
ttggcgcccaggacgccgccgc

SEQ ID NO: 7308072 - DNA, 22 bp, Homo sapiens
ttggctcacaaggacggttgct

SEQ ID NO: 7308073 - DNA, 22 bp, Homo sapiens
ttggctcagcatcttggtgcca

SEQ ID NO: 7308074 - DNA, 22 bp, Homo sapiens
ttggctcagtgtgagggagatg

SEQ ID NO: 7308075 - DNA, 22 bp, Homo sapiens
ttggctgtatgtacatctgtta

SEQ ID NO: 7308076 - DNA, 22 bp, Homo sapiens
ttgcttcagtcagtgctgccca

SEQ ID NO: 7308077 - DNA, 22 bp, Homo sapiens
ttgcttcagtagctctttaaag

SEQ ID NO: 7308078 - DNA, 22 bp, Homo sapiens
ttgctattttgagagtcatagt

SEQ ID NO: 7308079 - DNA, 22 bp, Homo sapiens
ttgctcacttggaactaggcat

SEQ ID NO: 7308080 - DNA, 22 bp, Homo sapiens
ttgctatttcctgaaataagca

SEQ ID NO: 7308081 - DNA, 17 bp, Homo sapiens
ttgctactacgccaagt

SEQ ID NO: 7308082 - DNA, 22 bp, Homo sapiens
ttgctactgttctttgctagag

SEQ ID NO: 7308083 - DNA, 22 bp, Homo sapiens
ttgctacttagagtgcagcagc

SEQ ID NO: 7308084 - DNA, 22 bp, Homo sapiens
ttgctactactcaactctgcca

SEQ ID NO: 7308085 - DNA, 22 bp, Homo sapiens
ttgctactggcatctcgtgggt

SEQ ID NO: 7308086 - DNA, 22 bp, Homo sapiens
ttgcctgtttgagagctgtgtt

SEQ ID NO: 7308087 - DNA, 22 bp, Homo sapiens
ttgcctttaacccctgaaaggc

SEQ ID NO: 7308088 - DNA, 22 bp, Homo sapiens
ttgcctttgacggtgcagcagt

SEQ ID NO: 7308089 - DNA, 22 bp, Homo sapiens
ttgcctgtgaggattctggttg

SEQ ID NO: 7308090 - DNA, 22 bp, Homo sapiens
ttgccattgcaaagtactatga

SEQ ID NO: 7308091 - DNA, 22 bp, Homo sapiens
ttgccattccagggtattaggg

SEQ ID NO: 7308092 - DNA, 22 bp, Homo sapiens
ttgccattgctcagtgaacaga

SEQ ID NO: 7308093 - DNA, 22 bp, Homo sapiens
ttgccattatcatttatgatac

SEQ ID NO: 7308094 - DNA, 22 bp, Homo sapiens
ttgccatttagtatgcttgtat

SEQ ID NO: 7308095 - DNA, 22 bp, Homo sapiens
ttgcattttggttgtaaatatg

SEQ ID NO: 7308096 - DNA, 22 bp, Homo sapiens
ttgcatttgctcatttgatatg

SEQ ID NO: 7308097 - DNA, 22 bp, Homo sapiens
ttgccaagtgttttaaaatatt

SEQ ID NO: 7308098 - DNA, 22 bp, Homo sapiens
ttgccaagtttaatgaatgact

SEQ ID NO: 7308099 - DNA, 22 bp, Homo sapiens
ttgcatttttagatgcttctgt

SEQ ID NO: 7308100 - DNA, 22 bp, Homo sapiens
ttgagtaccttggattacaggt

SEQ ID NO: 7308101 - DNA, 19 bp, Homo sapiens
ttgcatttcatgtttgatt

SEQ ID NO: 7308102 - DNA, 22 bp, Homo sapiens
ttggaattaatatttgtataca

SEQ ID NO: 7308103 - DNA, 22 bp, Homo sapiens
ttggaattcagcttgcttataa

SEQ ID NO: 7308104 - DNA, 19 bp, Homo sapiens
ttggatgctaccaggtacc

SEQ ID NO: 7308105 - DNA, 22 bp, Homo sapiens
ttggatgggcattaggaaagtc

SEQ ID NO: 7308106 - DNA, 20 bp, Homo sapiens
ttggatgtgcatggccgtgc

SEQ ID NO: 7308107 - DNA, 22 bp, Homo sapiens
ttggcactttgaatgagctcag

SEQ ID NO: 7308108 - DNA, 22 bp, Homo sapiens
ttggcactcaactgtcgttgtt

SEQ ID NO: 7308109 - DNA, 22 bp, Homo sapiens
ttggcacctgatatgtgacctt

SEQ ID NO: 7308110 - DNA, 22 bp, Homo sapiens
ttggcactctccctgcactggt

SEQ ID NO: 7308111 - DNA, 22 bp, Homo sapiens
ttgcttgcttctattttataca

SEQ ID NO: 7308112 - DNA, 22 bp, Homo sapiens
ttggaacagaaacagacaaata

SEQ ID NO: 7308113 - DNA, 22 bp, Homo sapiens
ttggaacatccaggacagatat

SEQ ID NO: 7308114 - DNA, 22 bp, Homo sapiens
ttggaagacagccgtctttatt

SEQ ID NO: 7308115 - DNA, 22 bp, Homo sapiens
ttggaagacagtgaaacagcac

SEQ ID NO: 7308116 - DNA, 22 bp, Homo sapiens
ttggaagacaatgctgattctc

SEQ ID NO: 7308117 - DNA, 22 bp, Homo sapiens
aatgttcattgattaaatgaat

SEQ ID NO: 7308118 - DNA, 22 bp, Homo sapiens
aatgttcagtctcaagagtgat

SEQ ID NO: 7308119 - DNA, 22 bp, Homo sapiens
aatgttgccccaggacaaagga

SEQ ID NO: 7308120 - DNA, 22 bp, Homo sapiens
aatgttctgcaactgttttcat

SEQ ID NO: 7308121 - DNA, 22 bp, Homo sapiens
aatgttctgatgtagggtttag

SEQ ID NO: 7308122 - DNA, 22 bp, Homo sapiens
aatgttgacctcctgaatgttt

SEQ ID NO: 7308123 - DNA, 22 bp, Homo sapiens
aattaggcaaattaatttctct

SEQ ID NO: 7308124 - DNA, 22 bp, Homo sapiens
aatgtttgcctgactagagtgg

SEQ ID NO: 7308125 - DNA, 22 bp, Homo sapiens
aatgtttggactggaaggtccc

SEQ ID NO: 7308126 - DNA, 22 bp, Homo sapiens
aattaccatcgtcaaatcatat

SEQ ID NO: 7308127 - DNA, 22 bp, Homo sapiens
aattaccaggatttttcagtat

SEQ ID NO: 7308128 - DNA, 23 bp, Homo sapiens
aattaccatgcaacttgtgaaac

SEQ ID NO: 7308129 - DNA, 22 bp, Homo sapiens
aattaccaggatttttcagtat

SEQ ID NO: 7308130 - DNA, 22 bp, Homo sapiens
aatgttgtgtttcagttcaaga

SEQ ID NO: 7308131 - DNA, 22 bp, Homo sapiens
aatgtttgagcatctacatgct

SEQ ID NO: 7308132 - DNA, 22 bp, Homo sapiens
aatgtttgcatctattcacatg

SEQ ID NO: 7308133 - DNA, 20 bp, Homo sapiens
aatgtttctgaacaggtagt

SEQ ID NO: 7308134 - DNA, 22 bp, Homo sapiens
aatgtttgaactttgcatattt

SEQ ID NO: 7308135 - DNA, 22 bp, Homo sapiens
aatgtttctggatattgtgggt

SEQ ID NO: 7308136 - DNA, 22 bp, Homo sapiens
aatgtttgaccaaaaaactgca

SEQ ID NO: 7308137 - DNA, 22 bp, Homo sapiens
aatgtttcaattaagtctttta

SEQ ID NO: 7308138 - DNA, 22 bp, Homo sapiens
aatgtttaatgttagtggtaat

SEQ ID NO: 7308139 - DNA, 22 bp, Homo sapiens
aatgtttcattcttgcccattg

SEQ ID NO: 7308140 - DNA, 22 bp, Homo sapiens
aatgtttcatttagttgtctcc

SEQ ID NO: 7308141 - DNA, 22 bp, Homo sapiens
aatgtttcgtaaattgtctatg

SEQ ID NO: 7308142 - DNA, 22 bp, Homo sapiens
aatttataataaatagggcttt

SEQ ID NO: 7308143 - DNA, 22 bp, Homo sapiens
aatttatatgtaattaggcaca

SEQ ID NO: 7308144 - DNA, 22 bp, Homo sapiens
agagctggggcataaatgccac

SEQ ID NO: 7308145 - DNA, 22 bp, Homo sapiens
agagctggggccagagtcaagg

SEQ ID NO: 7308146 - DNA, 20 bp, Homo sapiens
aatttactcacagaatgaat

SEQ ID NO: 7308147 - DNA, 23 bp, Homo sapiens
agaaggtgggcctgctgagttat

SEQ ID NO: 7308148 - DNA, 22 bp, Homo sapiens
agaagggccagctggacacctg

SEQ ID NO: 7308149 - DNA, 22 bp, Homo sapiens
agaagggctacacgggctctcc

SEQ ID NO: 7308150 - DNA, 21 bp, Homo sapiens
agacagagtgcagtctacata

SEQ ID NO: 7308151 - DNA, 22 bp, Homo sapiens
aatgcaatacctttttatgctg

SEQ ID NO: 7308152 - DNA, 19 bp, Homo sapiens
agacagagactgaaataga

SEQ ID NO: 7308153 - DNA, 22 bp, Homo sapiens
aatgtcacatacaatggcaagt

SEQ ID NO: 7308154 - DNA, 22 bp, Homo sapiens
aatgtcattgagctccaatcct

SEQ ID NO: 7308155 - DNA, 22 bp, Homo sapiens
aatgtcctaggcatgattttgt

SEQ ID NO: 7308156 - DNA, 22 bp, Homo sapiens
aatgtgtttagttaatgagttg

SEQ ID NO: 7308157 - DNA, 22 bp, Homo sapiens
aatgtctatttgctacaaagcc

SEQ ID NO: 7308158 - DNA, 22 bp, Homo sapiens
agcaagctacctagatagtcta

SEQ ID NO: 7308159 - DNA, 22 bp, Homo sapiens
agcaaggaaagtaggcacggaa

SEQ ID NO: 7308160 - DNA, 22 bp, Homo sapiens
agcaaggagtagaacaagagtg

SEQ ID NO: 7308161 - DNA, 22 bp, Homo sapiens
agcaaggattatcctgggaagg

SEQ ID NO: 7308162 - DNA, 22 bp, Homo sapiens
agcacaggtacggagatgctac

SEQ ID NO: 7308163 - DNA, 22 bp, Homo sapiens
acaattctgatggtttcccagt

SEQ ID NO: 7308164 - DNA, 22 bp, Homo sapiens
acaagttaggttttaatccaaa

SEQ ID NO: 7308165 - DNA, 22 bp, Homo sapiens
acaagttaggttttaatccaaa

SEQ ID NO: 7308166 - DNA, 22 bp, Homo sapiens
acaagtttatttgattagaaca

SEQ ID NO: 7308167 - DNA, 22 bp, Homo sapiens
acaagttaggttttaatccaaa

SEQ ID NO: 7308168 - DNA, 22 bp, Homo sapiens
agatggggctcagtgtggaggc

SEQ ID NO: 7308169 - DNA, 22 bp, Homo sapiens
agatggggcagaatggagccat

SEQ ID NO: 7308170 - DNA, 22 bp, Homo sapiens
acaagttaccaaaaaagattca

SEQ ID NO: 7308171 - DNA, 22 bp, Homo sapiens
acaagtgggtcctacataaagc

SEQ ID NO: 7308172 - DNA, 22 bp, Homo sapiens
acaaggtaagaaacattggctt

SEQ ID NO: 7308173 - DNA, 18 bp, Homo sapiens
acaaggtcaattggttac

SEQ ID NO: 7308174 - DNA, 22 bp, Homo sapiens
acaaatgtctacattgagaata

SEQ ID NO: 7308175 - DNA, 23 bp, Homo sapiens
acaaatgtctagagagggtgtga

SEQ ID NO: 7308176 - DNA, 18 bp, Homo sapiens
acaaatgtagtgtcttaa

SEQ ID NO: 7308177 - DNA, 22 bp, Homo sapiens
acaaatgtctcctcttttgtta

SEQ ID NO: 7308178 - DNA, 22 bp, Homo sapiens
acaaatgtctcctcttttgtta

SEQ ID NO: 7308179 - DNA, 22 bp, Homo sapiens
acaaatgtgattgtttctgaaa

SEQ ID NO: 7308180 - DNA, 22 bp, Homo sapiens
acaaatgtggacatggataatg

SEQ ID NO: 7308181 - DNA, 22 bp, Homo sapiens
acaaatgtggacatggataatg

SEQ ID NO: 7308182 - DNA, 18 bp, Homo sapiens
acaaatgtgtcacaggaa

SEQ ID NO: 7308183 - DNA, 22 bp, Homo sapiens
acaaatgtgtctaattgtgcct

SEQ ID NO: 7308184 - DNA, 22 bp, Homo sapiens
acaaatgtgtctaattgtgcct

SEQ ID NO: 7308185 - DNA, 22 bp, Homo sapiens
acaaatgttacataagtttgga

SEQ ID NO: 7308186 - DNA, 22 bp, Homo sapiens
acaaatgttggatttgtcttcc

SEQ ID NO: 7308187 - DNA, 22 bp, Homo sapiens
acaaatgttggatttgtcttcc

SEQ ID NO: 7308188 - DNA, 22 bp, Homo sapiens
acaaattaccatggaatttggg

SEQ ID NO: 7308189 - DNA, 22 bp, Homo sapiens
acaaattgaccgcaagattcat

SEQ ID NO: 7308190 - DNA, 22 bp, Homo sapiens
acaaatgactatttggtacagg

SEQ ID NO: 7308191 - DNA, 22 bp, Homo sapiens
acaaatatggtactcggagaaa

SEQ ID NO: 7308192 - DNA, 22 bp, Homo sapiens
acaaacttcccagacaagctcc

SEQ ID NO: 7308193 - DNA, 22 bp, Homo sapiens
acaaacttcccagacaagctcc

SEQ ID NO: 7308194 - DNA, 22 bp, Homo sapiens
acaaacttccatcatgaatttt

SEQ ID NO: 7308195 - DNA, 22 bp, Homo sapiens
acaaaatttttagacaaggctt

SEQ ID NO: 7308196 - DNA, 22 bp, Homo sapiens
acaaaattgtgttaaactttat

SEQ ID NO: 7308197 - DNA, 22 bp, Homo sapiens
acaaaatcaaaggagtgattca

SEQ ID NO: 7308198 - DNA, 22 bp, Homo sapiens
acaaacagctaacatatgttaa

SEQ ID NO: 7308199 - DNA, 22 bp, Homo sapiens
agagctgggtggtggtgactca

SEQ ID NO: 7308200 - DNA, 22 bp, Homo sapiens
agagctgggtggacttgtagtt

SEQ ID NO: 7308201 - DNA, 22 bp, Homo sapiens
agagctgggtgaagtgccatca

SEQ ID NO: 7308202 - DNA, 22 bp, Homo sapiens
aattttattaactggatgtagc

SEQ ID NO: 7308203 - DNA, 22 bp, Homo sapiens
aattttattagaaggcaagggg

SEQ ID NO: 7308204 - DNA, 20 bp, Homo sapiens
acaaaataggtactgggtag

SEQ ID NO: 7308205 - DNA, 22 bp, Homo sapiens
aattttctgcctagcaaaaact

SEQ ID NO: 7308206 - DNA, 22 bp, Homo sapiens
agcagtggtgtgaggagggctc

SEQ ID NO: 7308207 - DNA, 22 bp, Homo sapiens
acagaaagatgatttgaaatgg

SEQ ID NO: 7308208 - DNA, 22 bp, Homo sapiens
acagaaattgctaatagctcat

SEQ ID NO: 7308209 - DNA, 22 bp, Homo sapiens
acagaaattgctaatagctcat

SEQ ID NO: 7308210 - DNA, 19 bp, Homo sapiens
acagaaattagttattttc

SEQ ID NO: 7308211 - DNA, 22 bp, Homo sapiens
acagaaattagcagtgagttta

SEQ ID NO: 7308212 - DNA, 22 bp, Homo sapiens
acagaacaagacctgcttattg

SEQ ID NO: 7308213 - DNA, 22 bp, Homo sapiens
acactgtatgaaaacaggaaat

SEQ ID NO: 7308214 - DNA, 22 bp, Homo sapiens
acacattttggctaggtggaga

SEQ ID NO: 7308215 - DNA, 22 bp, Homo sapiens
acacattttctaacagggatca

SEQ ID NO: 7308216 - DNA, 22 bp, Homo sapiens
acacattttctaacagggatca

SEQ ID NO: 7308217 - DNA, 22 bp, Homo sapiens
acacattttggctaggtggaga

SEQ ID NO: 7308218 - DNA, 22 bp, Homo sapiens
acacattttgttaaaccctgtg

SEQ ID NO: 7308219 - DNA, 23 bp, Homo sapiens
acacatttttcccgttctgaggt

SEQ ID NO: 7308220 - DNA, 22 bp, Homo sapiens
acacattttcaacactgtcaag

SEQ ID NO: 7308221 - DNA, 22 bp, Homo sapiens
acacattttcaacactgtcaag

SEQ ID NO: 7308222 - DNA, 22 bp, Homo sapiens
acacattttcaacactgtcaag

SEQ ID NO: 7308223 - DNA, 23 bp, Homo sapiens
acacatttttcccgttctgaggt

SEQ ID NO: 7308224 - DNA, 19 bp, Homo sapiens
acacatttgcacaatccac

SEQ ID NO: 7308225 - DNA, 22 bp, Homo sapiens
acacatttgcataatacctcat

SEQ ID NO: 7308226 - DNA, 22 bp, Homo sapiens
acacatttgcataatacctcat

SEQ ID NO: 7308227 - DNA, 22 bp, Homo sapiens
acacatttgggctcctacataa

SEQ ID NO: 7308228 - DNA, 22 bp, Homo sapiens
acacatatatttgcatatacac

SEQ ID NO: 7308229 - DNA, 22 bp, Homo sapiens
acacatatatttgcatatacac

SEQ ID NO: 7308230 - DNA, 22 bp, Homo sapiens
acacatatatttgcatatacac

SEQ ID NO: 7308231 - DNA, 23 bp, Homo sapiens
acacatatattcagatacagatg

SEQ ID NO: 7308232 - DNA, 22 bp, Homo sapiens
acacatatctaagatagatgac

SEQ ID NO: 7308233 - DNA, 22 bp, Homo sapiens
acacatatctaagatagatgac

SEQ ID NO: 7308234 - DNA, 22 bp, Homo sapiens
acacatatgccattacagcaaa

SEQ ID NO: 7308235 - DNA, 22 bp, Homo sapiens
acacatatggttgctgcagtga

SEQ ID NO: 7308236 - DNA, 22 bp, Homo sapiens
acacatatgtatgcatcatgtg

SEQ ID NO: 7308237 - DNA, 22 bp, Homo sapiens
acacatatgtatgcatcatgtg

SEQ ID NO: 7308238 - DNA, 22 bp, Homo sapiens
agcagcagtacatataagacta

SEQ ID NO: 7308239 - DNA, 22 bp, Homo sapiens
agcagcagtcatgcctatgctc

SEQ ID NO: 7308240 - DNA, 22 bp, Homo sapiens
agcagcagtgacagccgaaagc

SEQ ID NO: 7308241 - DNA, 22 bp, Homo sapiens
acacatatatgtgcgtgtatat

SEQ ID NO: 7308242 - DNA, 22 bp, Homo sapiens
acacataagaaactacaaagag

SEQ ID NO: 7308243 - DNA, 22 bp, Homo sapiens
acacagatgggtagaaaacaga

SEQ ID NO: 7308244 - DNA, 22 bp, Homo sapiens
acaatttgaggctactcaattg

SEQ ID NO: 7308245 - DNA, 22 bp, Homo sapiens
acaattttccccataggttatc

SEQ ID NO: 7308246 - DNA, 22 bp, Homo sapiens
agcaccccatagtcagtcacgt

SEQ ID NO: 7308247 - DNA, 22 bp, Homo sapiens
agcacctatagaagttgtgttc

SEQ ID NO: 7308248 - DNA, 20 bp, Homo sapiens
acaatttcctcactatatgc

SEQ ID NO: 7308249 - DNA, 22 bp, Homo sapiens
acaatttcaccttttggttcaa

SEQ ID NO: 7308250 - DNA, 20 bp, Homo sapiens
acaattgtccctgtctgtca

SEQ ID NO: 7308251 - DNA, 22 bp, Homo sapiens
acagagatcagaggcataagca

SEQ ID NO: 7308252 - DNA, 22 bp, Homo sapiens
agccacaggtgttggccagtgt

SEQ ID NO: 7308253 - DNA, 22 bp, Homo sapiens
agccatgtcacatatggtcatc

SEQ ID NO: 7308254 - DNA, 22 bp, Homo sapiens
agccatggcgccactagaggga

SEQ ID NO: 7308255 - DNA, 22 bp, Homo sapiens
acagataaaagttgtttaaaat

SEQ ID NO: 7308256 - DNA, 22 bp, Homo sapiens
acagataaggcagttaagagtt

SEQ ID NO: 7308257 - DNA, 22 bp, Homo sapiens
agcccccagtctaaactgttgg

SEQ ID NO: 7308258 - DNA, 22 bp, Homo sapiens
acagagcatataaagtgctttg

SEQ ID NO: 7308259 - DNA, 23 bp, Homo sapiens
acagcaagaggaccagatgtgag

SEQ ID NO: 7308260 - DNA, 22 bp, Homo sapiens
acagcaaaggacgaacactctg

SEQ ID NO: 7308261 - DNA, 22 bp, Homo sapiens
agcctgcgatcccacctggcct

SEQ ID NO: 7308262 - DNA, 21 bp, Homo sapiens
agcctgcctgaactctgtggc

SEQ ID NO: 7308263 - DNA, 22 bp, Homo sapiens
agcctgccttgggctgcttgag

SEQ ID NO: 7308264 - DNA, 22 bp, Homo sapiens
agctatttctcttattatatcc

SEQ ID NO: 7308265 - DNA, 22 bp, Homo sapiens
acagcaggaattaacatataag

SEQ ID NO: 7308266 - DNA, 22 bp, Homo sapiens
acagcaggagccttcatatgct

SEQ ID NO: 7308267 - DNA, 22 bp, Homo sapiens
agctcctgtgtgcccacctgct

SEQ ID NO: 7308268 - DNA, 22 bp, Homo sapiens
agctcctgtgtgcccacctgct

SEQ ID NO: 7308269 - DNA, 22 bp, Homo sapiens
acagcaggcatgaagaaatgtt

SEQ ID NO: 7308270 - DNA, 22 bp, Homo sapiens
agctcctgttctgagagcagga

SEQ ID NO: 7308271 - DNA, 19 bp, Homo sapiens
agctcctgttcagcagctc

SEQ ID NO: 7308272 - DNA, 22 bp, Homo sapiens
agctctgggggaaagtctgctc

SEQ ID NO: 7308273 - DNA, 22 bp, Homo sapiens
agctctgggctgacatgctccc

SEQ ID NO: 7308274 - DNA, 22 bp, Homo sapiens
agctctcccaccttcttcttac

SEQ ID NO: 7308275 - DNA, 22 bp, Homo sapiens
aaggtagggatgtattcagctt

SEQ ID NO: 7308276 - DNA, 22 bp, Homo sapiens
aaggtagattctggatcgaagg

SEQ ID NO: 7308277 - DNA, 22 bp, Homo sapiens
aaggtgaggattttgttctgct

SEQ ID NO: 7308278 - DNA, 22 bp, Homo sapiens
aaggtgagagggaaattttcca

SEQ ID NO: 7308279 - DNA, 17 bp, Homo sapiens
aaggtgagagctgttct

SEQ ID NO: 7308280 - DNA, 22 bp, Homo sapiens
aagtcacaagcatatatgcatt

SEQ ID NO: 7308281 - DNA, 23 bp, Homo sapiens
accccaggcatcgcattcctctt

SEQ ID NO: 7308282 - DNA, 22 bp, Homo sapiens
accccagggctgccagcctcct

SEQ ID NO: 7308283 - DNA, 22 bp, Homo sapiens
aagtacatgctgtaatgattgg

SEQ ID NO: 7308284 - DNA, 23 bp, Homo sapiens
aagtacatatatttagatagtga

SEQ ID NO: 7308285 - DNA, 22 bp, Homo sapiens
aagtacatatatttatgattct

SEQ ID NO: 7308286 - DNA, 22 bp, Homo sapiens
aagtaccaagtttgtttgacgc

SEQ ID NO: 7308287 - DNA, 22 bp, Homo sapiens
aagtacatttttaacttacagc

SEQ ID NO: 7308288 - DNA, 23 bp, Homo sapiens
aagtacctacacattatttcaga

SEQ ID NO: 7308289 - DNA, 22 bp, Homo sapiens
aagtacctagaaatatttttga

SEQ ID NO: 7308290 - DNA, 22 bp, Homo sapiens
aagtactaaggctattatgatg

SEQ ID NO: 7308291 - DNA, 22 bp, Homo sapiens
aagggcccagccaagctatgct

SEQ ID NO: 7308292 - DNA, 22 bp, Homo sapiens
aagggcccggctgtgggcagag

SEQ ID NO: 7308293 - DNA, 22 bp, Homo sapiens
aagggcccattctctcagaaaa

SEQ ID NO: 7308294 - DNA, 22 bp, Homo sapiens
aagggcccttctgttagtggca

SEQ ID NO: 7308295 - DNA, 22 bp, Homo sapiens
aagggctccaagaggtagctgg

SEQ ID NO: 7308296 - DNA, 22 bp, Homo sapiens
aagggctcttctatttatggcc

SEQ ID NO: 7308297 - DNA, 22 bp, Homo sapiens
aagggcatgagaagcttgaaag

SEQ ID NO: 7308298 - DNA, 22 bp, Homo sapiens
aagggcattgaggctgagagac

SEQ ID NO: 7308299 - DNA, 22 bp, Homo sapiens
aagggaaatggccaggcagaga

SEQ ID NO: 7308300 - DNA, 22 bp, Homo sapiens
aagggagaaagaatgagtttag

SEQ ID NO: 7308301 - DNA, 22 bp, Homo sapiens
aagggagaaaacttgtggctta

SEQ ID NO: 7308302 - DNA, 22 bp, Homo sapiens
aagggagaaaacttgtggctta

SEQ ID NO: 7308303 - DNA, 22 bp, Homo sapiens
acatgtgtggccgctgtagaca

SEQ ID NO: 7308304 - DNA, 22 bp, Homo sapiens
acatgtgtatagcctgtataga

SEQ ID NO: 7308305 - DNA, 22 bp, Homo sapiens
acatgtgtggacatgaatctac

SEQ ID NO: 7308306 - DNA, 22 bp, Homo sapiens
aaggctttatgactccagtgga

SEQ ID NO: 7308307 - DNA, 22 bp, Homo sapiens
acatgtgtacatatatatgtgc

SEQ ID NO: 7308308 - DNA, 22 bp, Homo sapiens
acatgtgtacatatatatgtgc

SEQ ID NO: 7308309 - DNA, 22 bp, Homo sapiens
acagtacagtgcagaggaagat

SEQ ID NO: 7308310 - DNA, 22 bp, Homo sapiens
aaggaaagacatataaatgact

SEQ ID NO: 7308311 - DNA, 22 bp, Homo sapiens
aaggaaagctgtggttctgaga

SEQ ID NO: 7308312 - DNA, 18 bp, Homo sapiens
aagctgccctcaggcagg

SEQ ID NO: 7308313 - DNA, 22 bp, Homo sapiens
aagctgcccaagactgaagcat

SEQ ID NO: 7308314 - DNA, 22 bp, Homo sapiens
aagctgccagctgagctgaggc

SEQ ID NO: 7308315 - DNA, 23 bp, Homo sapiens
aagctgccagtctgaagcctggg

SEQ ID NO: 7308316 - DNA, 22 bp, Homo sapiens
aagctgccaatggtaagctgct

SEQ ID NO: 7308317 - DNA, 22 bp, Homo sapiens
aagctgccacacggtgagtact

SEQ ID NO: 7308318 - DNA, 22 bp, Homo sapiens
aaggcagggaaagtggattagg

SEQ ID NO: 7308319 - DNA, 22 bp, Homo sapiens
aaggcaggatgggaaaagattt

SEQ ID NO: 7308320 - DNA, 22 bp, Homo sapiens
aaggcaggagctgtatcttatt

SEQ ID NO: 7308321 - DNA, 22 bp, Homo sapiens
aaggcagtggctggaaaacctg

SEQ ID NO: 7308322 - DNA, 22 bp, Homo sapiens
aaggcagttcactcacgcagcc

SEQ ID NO: 7308323 - DNA, 22 bp, Homo sapiens
aaggcagtttgggccaccatct

SEQ ID NO: 7308324 - DNA, 22 bp, Homo sapiens
aaggaactaactatgtagagat

SEQ ID NO: 7308325 - DNA, 22 bp, Homo sapiens
aaggaactgatgctcaaagaat

SEQ ID NO: 7308326 - DNA, 22 bp, Homo sapiens
aaggaactttgcagaggtgatt

SEQ ID NO: 7308327 - DNA, 22 bp, Homo sapiens
aaggaagaagactctttactcc

SEQ ID NO: 7308328 - DNA, 22 bp, Homo sapiens
aaggaagaagactctttactcc

SEQ ID NO: 7308329 - DNA, 22 bp, Homo sapiens
aaggaagaaatgaataggtgga

SEQ ID NO: 7308330 - DNA, 22 bp, Homo sapiens
aaggaagaaatgaataggtgga

SEQ ID NO: 7308331 - DNA, 22 bp, Homo sapiens
aaggaagaaatgaataggtgga

SEQ ID NO: 7308332 - DNA, 22 bp, Homo sapiens
aaggaagaagggaagttactta

SEQ ID NO: 7308333 - DNA, 22 bp, Homo sapiens
aaggaagaagggaagttactta

SEQ ID NO: 7308334 - DNA, 21 bp, Homo sapiens
aaggcagaagcatggaatgag

SEQ ID NO: 7308335 - DNA, 22 bp, Homo sapiens
aaggaacactacaaggctggga

SEQ ID NO: 7308336 - DNA, 22 bp, Homo sapiens
acagtatacattgattaggacc

SEQ ID NO: 7308337 - DNA, 22 bp, Homo sapiens
aaggaaatgaagctgatgttgg

SEQ ID NO: 7308338 - DNA, 22 bp, Homo sapiens
actccaggttttctctcaagtt

SEQ ID NO: 7308339 - DNA, 22 bp, Homo sapiens
aagttacattttggtctaattg

SEQ ID NO: 7308340 - DNA, 22 bp, Homo sapiens
aagttatatcatctcattgacg

SEQ ID NO: 7308341 - DNA, 22 bp, Homo sapiens
aagttagtgcctccttaaattt

SEQ ID NO: 7308342 - DNA, 22 bp, Homo sapiens
aagttaggcttagttgagattt

SEQ ID NO: 7308343 - DNA, 22 bp, Homo sapiens
aagttatctttgattagaaata

SEQ ID NO: 7308344 - DNA, 22 bp, Homo sapiens
actaaatttgtcaatgacactt

SEQ ID NO: 7308345 - DNA, 22 bp, Homo sapiens
aagtgctttaaaatttcctgag

SEQ ID NO: 7308346 - DNA, 22 bp, Homo sapiens
aagtcacagctaaatagctaag

SEQ ID NO: 7308347 - DNA, 22 bp, Homo sapiens
aagtcactgttttagttttctc

SEQ ID NO: 7308348 - DNA, 22 bp, Homo sapiens
aagtcactttcccattccttgc

SEQ ID NO: 7308349 - DNA, 22 bp, Homo sapiens
aagtttaaggtggaagtggtgg

SEQ ID NO: 7308350 - DNA, 22 bp, Homo sapiens
aagttgtatgtcttagaaagta

SEQ ID NO: 7308351 - DNA, 22 bp, Homo sapiens
aataagactctgctagaaattc

SEQ ID NO: 7308352 - DNA, 22 bp, Homo sapiens
aataagaatttacttgtcaaga

SEQ ID NO: 7308353 - DNA, 22 bp, Homo sapiens
aataagatcctgaagatatgtt

SEQ ID NO: 7308354 - DNA, 22 bp, Homo sapiens
aataagaattgccagatttgaa

SEQ ID NO: 7308355 - DNA, 22 bp, Homo sapiens
actgcctgtttggcatggcccc

SEQ ID NO: 7308356 - DNA, 22 bp, Homo sapiens
actgcctgtgtcccttcagtgc

SEQ ID NO: 7308357 - DNA, 22 bp, Homo sapiens
actgcgctccagcctgggtgac

SEQ ID NO: 7308358 - DNA, 22 bp, Homo sapiens
actgcgctccagcctgggtgac

SEQ ID NO: 7308359 - DNA, 22 bp, Homo sapiens
aatgaaactcgaaataatcaca

SEQ ID NO: 7308360 - DNA, 22 bp, Homo sapiens
aatgaacaagagagagaacttt

SEQ ID NO: 7308361 - DNA, 22 bp, Homo sapiens
aatgaacacagccctctacttt

SEQ ID NO: 7308362 - DNA, 22 bp, Homo sapiens
agaaaacattacataggtgtgt

SEQ ID NO: 7308363 - DNA, 22 bp, Homo sapiens
agaaaacataggagacaggaaa

SEQ ID NO: 7308364 - DNA, 22 bp, Homo sapiens
agaaaacactgccccctctctc

SEQ ID NO: 7308365 - DNA, 22 bp, Homo sapiens
agaaaaatcttggcgcttgtct

SEQ ID NO: 7308366 - DNA, 22 bp, Homo sapiens
aatgaacatataaagagatctt

SEQ ID NO: 7308367 - DNA, 22 bp, Homo sapiens
aatgaacatggacaagttaata

SEQ ID NO: 7308368 - DNA, 22 bp, Homo sapiens
aatgaacatataaagagatctt

SEQ ID NO: 7308369 - DNA, 22 bp, Homo sapiens
aatgaacaggtgaatgtcagat

SEQ ID NO: 7308370 - DNA, 22 bp, Homo sapiens
aatgaacaggtgaatgtcagat

SEQ ID NO: 7308371 - DNA, 22 bp, Homo sapiens
aatgaacacttagcctttctat

SEQ ID NO: 7308372 - DNA, 22 bp, Homo sapiens
agaaataagagctttccttggg

SEQ ID NO: 7308373 - DNA, 22 bp, Homo sapiens
agaaatacaaagtactaagata

SEQ ID NO: 7308374 - DNA, 19 bp, Homo sapiens
aatgactgagtacattgtc

SEQ ID NO: 7308375 - DNA, 20 bp, Homo sapiens
agaaatactttggtataatg

SEQ ID NO: 7308376 - DNA, 22 bp, Homo sapiens
aatgagaaccttgaaaggaact

SEQ ID NO: 7308377 - DNA, 19 bp, Homo sapiens
aatgactgagtacattgtc

SEQ ID NO: 7308378 - DNA, 22 bp, Homo sapiens
aatgagaatgtaagtgaagaga

SEQ ID NO: 7308379 - DNA, 21 bp, Homo sapiens
agaagggattgtggtaaagat

SEQ ID NO: 7308380 - DNA, 18 bp, Homo sapiens
agaaggagctatgggcag

SEQ ID NO: 7308381 - DNA, 18 bp, Homo sapiens
agaaggagctatgggcag

SEQ ID NO: 7308382 - DNA, 22 bp, Homo sapiens
agaagggaactcagagatgatt

SEQ ID NO: 7308383 - DNA, 22 bp, Homo sapiens
aatccagcacatggacacagtc

SEQ ID NO: 7308384 - DNA, 22 bp, Homo sapiens
aatccagctgtgtcacaggtga

SEQ ID NO: 7308385 - DNA, 20 bp, Homo sapiens
aatcccttctctggactctt

SEQ ID NO: 7308386 - DNA, 22 bp, Homo sapiens
acttgtctttaatccgaatgta

SEQ ID NO: 7308387 - DNA, 22 bp, Homo sapiens
aatatttttgaggccctgttat

SEQ ID NO: 7308388 - DNA, 22 bp, Homo sapiens
acttcttttcaaatcatgcaaa

SEQ ID NO: 7308389 - DNA, 19 bp, Homo sapiens
acttcttttcaacacagga

SEQ ID NO: 7308390 - DNA, 22 bp, Homo sapiens
acttcctgctatgagcttctgt

SEQ ID NO: 7308391 - DNA, 22 bp, Homo sapiens
acttcctggattcccaagggct

SEQ ID NO: 7308392 - DNA, 22 bp, Homo sapiens
acttcctggcgtagctgacatt

SEQ ID NO: 7308393 - DNA, 22 bp, Homo sapiens
aatacaatcaaattcactagca

SEQ ID NO: 7308394 - DNA, 22 bp, Homo sapiens
aatacaatcaaattcactagca

SEQ ID NO: 7308395 - DNA, 21 bp, Homo sapiens
aatacagaaatgagtagttgc

SEQ ID NO: 7308396 - DNA, 22 bp, Homo sapiens
acttgaaagaagtttccttaaa

SEQ ID NO: 7308397 - DNA, 22 bp, Homo sapiens
acttgaaaccttggcaaacaat

SEQ ID NO: 7308398 - DNA, 22 bp, Homo sapiens
acttgaaaggaagctctaaaac

SEQ ID NO: 7308399 - DNA, 22 bp, Homo sapiens
acttgaataggtgtcaaggcca

SEQ ID NO: 7308400 - DNA, 22 bp, Homo sapiens
acttgaataggaaagccacaaa

SEQ ID NO: 7308401 - DNA, 22 bp, Homo sapiens
acttgaaacatctttaaatgta

SEQ ID NO: 7308402 - DNA, 22 bp, Homo sapiens
acttgaaacatctttaaatgta

SEQ ID NO: 7308403 - DNA, 19 bp, Homo sapiens
acttcttttcaacacagga

SEQ ID NO: 7308404 - DNA, 22 bp, Homo sapiens
acttgaaaagctcagcagtagt

SEQ ID NO: 7308405 - DNA, 22 bp, Homo sapiens
acttgaaaccttggcaaacaat

SEQ ID NO: 7308406 - DNA, 22 bp, Homo sapiens
acttgaaaccctgagatgataa

SEQ ID NO: 7308407 - DNA, 23 bp, Homo sapiens
aatatatgtgtttttctgcttca

SEQ ID NO: 7308408 - DNA, 22 bp, Homo sapiens
aatatatttgaatcaggaacaa

SEQ ID NO: 7308409 - DNA, 22 bp, Homo sapiens
aatatcaacagtgtccttctaa

SEQ ID NO: 7308410 - DNA, 22 bp, Homo sapiens
aatatttgttagtgttttaatg

SEQ ID NO: 7308411 - DNA, 22 bp, Homo sapiens
aatatcagaatgtaatggtcct

SEQ ID NO: 7308412 - DNA, 22 bp, Homo sapiens
acttgaatttagtttttcctaa

SEQ ID NO: 7308413 - DNA, 22 bp, Homo sapiens
aatatatgagggagctatttga

SEQ ID NO: 7308414 - DNA, 22 bp, Homo sapiens
aatatatgactccactgcatga

SEQ ID NO: 7308415 - DNA, 22 bp, Homo sapiens
aatatatgactccactgcatga

SEQ ID NO: 7308416 - DNA, 22 bp, Homo sapiens
aatatatgaccaggaagttctg

SEQ ID NO: 7308417 - DNA, 22 bp, Homo sapiens
aatatatagaagtacccgttgt

SEQ ID NO: 7308418 - DNA, 17 bp, Homo sapiens
aaacaatgcagacaagc

SEQ ID NO: 7308419 - DNA, 22 bp, Homo sapiens
aaacaatgagcttttacacact

SEQ ID NO: 7308420 - DNA, 22 bp, Homo sapiens
aaacaatgagcttttacacact

SEQ ID NO: 7308421 - DNA, 22 bp, Homo sapiens
aaacaatgacaacacagctgcg

SEQ ID NO: 7308422 - DNA, 22 bp, Homo sapiens
aaacaatgaaattcattcttca

SEQ ID NO: 7308423 - DNA, 17 bp, Homo sapiens
aaacaatgcagacaagc

SEQ ID NO: 7308424 - DNA, 22 bp, Homo sapiens
aaacaatgtacatttataatgc

SEQ ID NO: 7308425 - DNA, 22 bp, Homo sapiens
aaacaatttccacctctcctga

SEQ ID NO: 7308426 - DNA, 22 bp, Homo sapiens
aaacacaagaggcagggtacag

SEQ ID NO: 7308427 - DNA, 22 bp, Homo sapiens
aaacaatgttgtctccaagagg

SEQ ID NO: 7308428 - DNA, 22 bp, Homo sapiens
aaacaatgttgtctccaagagg

SEQ ID NO: 7308429 - DNA, 22 bp, Homo sapiens
aaaggtaactggggttttgcca

SEQ ID NO: 7308430 - DNA, 22 bp, Homo sapiens
aaaggtcagctgccatcgttct

SEQ ID NO: 7308431 - DNA, 22 bp, Homo sapiens
aaacagttaattgctttcagtt

SEQ ID NO: 7308432 - DNA, 22 bp, Homo sapiens
aaacagtttataacatgatact

SEQ ID NO: 7308433 - DNA, 22 bp, Homo sapiens
aaacagtttcattttcatgacc

SEQ ID NO: 7308434 - DNA, 22 bp, Homo sapiens
aaacagtttataacatgatact

SEQ ID NO: 7308435 - DNA, 22 bp, Homo sapiens
aaagttacagtaattcagtgta

SEQ ID NO: 7308436 - DNA, 21 bp, Homo sapiens
aaagttacagtcagtgggtgc

SEQ ID NO: 7308437 - DNA, 22 bp, Homo sapiens
aaagttacccaatctctatgaa

SEQ ID NO: 7308438 - DNA, 22 bp, Homo sapiens
aaagttactatcacaatgaaat

SEQ ID NO: 7308439 - DNA, 22 bp, Homo sapiens
aaagttactatcacaatgaaat

SEQ ID NO: 7308440 - DNA, 22 bp, Homo sapiens
aaagttactttgctgtgcttca

SEQ ID NO: 7308441 - DNA, 22 bp, Homo sapiens
aaagttagtttcttatatgtct

SEQ ID NO: 7308442 - DNA, 22 bp, Homo sapiens
aaagttagtttcttatatgtct

SEQ ID NO: 7308443 - DNA, 22 bp, Homo sapiens
aaagttaggtgtggatttctca

SEQ ID NO: 7308444 - DNA, 22 bp, Homo sapiens
aaagttagtaaaatgggatata

SEQ ID NO: 7308445 - DNA, 22 bp, Homo sapiens
aaagttagtcagaaccagccat

SEQ ID NO: 7308446 - DNA, 22 bp, Homo sapiens
aaagttagaatgatatcaacga

SEQ ID NO: 7308447 - DNA, 22 bp, Homo sapiens
aaagttagcattctctcttgct

SEQ ID NO: 7308448 - DNA, 22 bp, Homo sapiens
aaaggttaaggtgttcaagaaa

SEQ ID NO: 7308449 - DNA, 21 bp, Homo sapiens
aaactgaccttgcctgagaca

SEQ ID NO: 7308450 - DNA, 21 bp, Homo sapiens
aaactgaccttgcctgagaca

SEQ ID NO: 7308451 - DNA, 22 bp, Homo sapiens
aaactgaagtagattctgaaat

SEQ ID NO: 7308452 - DNA, 22 bp, Homo sapiens
aaactgaagccttggagtgaca

SEQ ID NO: 7308453 - DNA, 22 bp, Homo sapiens
aaactctgttgagataatattt

SEQ ID NO: 7308454 - DNA, 22 bp, Homo sapiens
aaactctggagatgtttatgca

SEQ ID NO: 7308455 - DNA, 22 bp, Homo sapiens
aaactctgtagctaaacataat

SEQ ID NO: 7308456 - DNA, 22 bp, Homo sapiens
aaactgaaacatcatcatgttg

SEQ ID NO: 7308457 - DNA, 22 bp, Homo sapiens
aaagaactaatgtgcaaggttt

SEQ ID NO: 7308458 - DNA, 22 bp, Homo sapiens
aaactgattttaacattgatat

SEQ ID NO: 7308459 - DNA, 22 bp, Homo sapiens
aaactgataaaataagtacatt

SEQ ID NO: 7308460 - DNA, 22 bp, Homo sapiens
aaactgataaaataagtacatt

SEQ ID NO: 7308461 - DNA, 22 bp, Homo sapiens
aaagacacaaatgtagaccaaa

SEQ ID NO: 7308462 - DNA, 22 bp, Homo sapiens
aaatgcactgaatattccaaat

SEQ ID NO: 7308463 - DNA, 22 bp, Homo sapiens
aaagaggatggagtagtcagct

SEQ ID NO: 7308464 - DNA, 22 bp, Homo sapiens
aaagaggaaccaagagcacgtg

SEQ ID NO: 7308465 - DNA, 22 bp, Homo sapiens
aaattaagagtaactctgtaga

SEQ ID NO: 7308466 - DNA, 22 bp, Homo sapiens
aaattaagggtgagaagagttg

SEQ ID NO: 7308467 - DNA, 22 bp, Homo sapiens
aaattaagagtaactctgtaga

SEQ ID NO: 7308468 - DNA, 22 bp, Homo sapiens
aaattacagatcaccaatgcat

SEQ ID NO: 7308469 - DNA, 22 bp, Homo sapiens
aaattacagatcaccaatgcat

SEQ ID NO: 7308470 - DNA, 22 bp, Homo sapiens
aaattacagatcaccaatgcat

SEQ ID NO: 7308471 - DNA, 22 bp, Homo sapiens
aaattaccattgtaaagtattt

SEQ ID NO: 7308472 - DNA, 22 bp, Homo sapiens
aaattacagccttgggtagctt

SEQ ID NO: 7308473 - DNA, 20 bp, Homo sapiens
aaattactgccacacatttc

SEQ ID NO: 7308474 - DNA, 22 bp, Homo sapiens
aaattactttacactttcatct

SEQ ID NO: 7308475 - DNA, 22 bp, Homo sapiens
aaattagaaatactttcaaagc

SEQ ID NO: 7308476 - DNA, 22 bp, Homo sapiens
aaacagaaatttcctcatgctc

SEQ ID NO: 7308477 - DNA, 22 bp, Homo sapiens
aaaaatcacttttataggcagc

SEQ ID NO: 7308478 - DNA, 22 bp, Homo sapiens
aaaaatagaaggattgactgag

SEQ ID NO: 7308479 - DNA, 22 bp, Homo sapiens
aaaatgacattccagtgatatt

SEQ ID NO: 7308480 - DNA, 20 bp, Homo sapiens
aaaaacagtaatgctgaaga

SEQ ID NO: 7308481 - DNA, 22 bp, Homo sapiens
aaaaacctcaattacttttgca

SEQ ID NO: 7308482 - DNA, 23 bp, Homo sapiens
aaaatcttctgcctatgaagaaa

SEQ ID NO: 7308483 - DNA, 22 bp, Homo sapiens
aaaaaagattgatggtggatgc

SEQ ID NO: 7308484 - DNA, 22 bp, Homo sapiens
aaaaaattatcatagttcctga

SEQ ID NO: 7308485 - DNA, 22 bp, Homo sapiens
aaaaaattccattctgtgcctt

SEQ ID NO: 7308486 - DNA, 23 bp, Homo sapiens
aaacaagccctaatgaagagtcc

SEQ ID NO: 7308487 - DNA, 22 bp, Homo sapiens
aaacaagcaagcacataatttt

SEQ ID NO: 7308488 - DNA, 22 bp, Homo sapiens
aaacaagcaagcacataatttt

SEQ ID NO: 7308489 - DNA, 22 bp, Homo sapiens
aaaatctaagtagcgagtaagg

SEQ ID NO: 7308490 - DNA, 22 bp, Homo sapiens
aaaatctgcacaggtcagtttt

SEQ ID NO: 7308491 - DNA, 22 bp, Homo sapiens
aaaatctgcttccttttacaga

SEQ ID NO: 7308492 - DNA, 22 bp, Homo sapiens
aaacaagtttgtagactagcca

SEQ ID NO: 7308493 - DNA, 22 bp, Homo sapiens
aaacaatgaaatatttttatgg

SEQ ID NO: 7308494 - DNA, 22 bp, Homo sapiens
aaacaagtcactttatcttgaa

SEQ ID NO: 7308495 - DNA, 22 bp, Homo sapiens
aaacaagtgtaaactagtctgt

SEQ ID NO: 7308496 - DNA, 22 bp, Homo sapiens
aaacaagtttagaataatgaat

SEQ ID NO: 7308497 - DNA, 22 bp, Homo sapiens
aaacaagtttagaataatgaat

SEQ ID NO: 7308498 - DNA, 22 bp, Homo sapiens
aaagaccatgtttacagctagg

SEQ ID NO: 7308499 - DNA, 22 bp, Homo sapiens
aaagacattagcttagatgtca

SEQ ID NO: 7308500 - DNA, 22 bp, Homo sapiens
aaagacattgaagaaggactta

SEQ ID NO: 7308501 - DNA, 22 bp, Homo sapiens
aaagactaaatgaatgagctca

SEQ ID NO: 7308502 - DNA, 22 bp, Homo sapiens
aaagacatggcaagagatgggg

SEQ ID NO: 7308503 - DNA, 22 bp, Homo sapiens
aaagacatggaactagagatgg

SEQ ID NO: 7308504 - DNA, 22 bp, Homo sapiens
aaagacattagattaacgtaca

SEQ ID NO: 7308505 - DNA, 22 bp, Homo sapiens
aaagacattagattaacgtaca

SEQ ID NO: 7308506 - DNA, 23 bp, Homo sapiens
aaaatcattaatttaccctgaaa

SEQ ID NO: 7308507 - DNA, 22 bp, Homo sapiens
aaacccagagactagaaagacc

SEQ ID NO: 7308508 - DNA, 22 bp, Homo sapiens
aaaagagaatcctgtacagaga

SEQ ID NO: 7308509 - DNA, 22 bp, Homo sapiens
aaaagtactattttaacaaagt

SEQ ID NO: 7308510 - DNA, 22 bp, Homo sapiens
aaaagtactattttaacaaagt

SEQ ID NO: 7308511 - DNA, 22 bp, Homo sapiens
aaatgtacaacatccatatata

SEQ ID NO: 7308512 - DNA, 22 bp, Homo sapiens
aagctctttgacctgggcctgg

SEQ ID NO: 7308513 - DNA, 22 bp, Homo sapiens
aaatgtaccttgatagtttggt

SEQ ID NO: 7308514 - DNA, 22 bp, Homo sapiens
aaatgtaccttgatagtttggt

SEQ ID NO: 7308515 - DNA, 22 bp, Homo sapiens
aaatgtacgggagtagaattag

SEQ ID NO: 7308516 - DNA, 22 bp, Homo sapiens
aaatgtactgatacttatttta

SEQ ID NO: 7308517 - DNA, 22 bp, Homo sapiens
aagcacagataaaacaggattc

SEQ ID NO: 7308518 - DNA, 22 bp, Homo sapiens
aaatcctggcctcaagtggtcc

SEQ ID NO: 7308519 - DNA, 22 bp, Homo sapiens
aagcatcaacactatattgatg

SEQ ID NO: 7308520 - DNA, 22 bp, Homo sapiens
aagcacagattgctgcatccat

SEQ ID NO: 7308521 - DNA, 22 bp, Homo sapiens
aagcacagctggaacagcagga

SEQ ID NO: 7308522 - DNA, 22 bp, Homo sapiens
aagcacagcagagccttgcttg

SEQ ID NO: 7308523 - DNA, 22 bp, Homo sapiens
aaatgcaggattaacagctttg

SEQ ID NO: 7308524 - DNA, 22 bp, Homo sapiens
aaatgcaggaaattatgctttt

SEQ ID NO: 7308525 - DNA, 22 bp, Homo sapiens
aaatagctgtatttaccctgta

SEQ ID NO: 7308526 - DNA, 22 bp, Homo sapiens
aaatagcagcctttagttaaca

SEQ ID NO: 7308527 - DNA, 22 bp, Homo sapiens
aaatagcagcctttagttaaca

SEQ ID NO: 7308528 - DNA, 22 bp, Homo sapiens
aaatagcataaaataggaagct

SEQ ID NO: 7308529 - DNA, 22 bp, Homo sapiens
aaatagcataaaataggaagct

SEQ ID NO: 7308530 - DNA, 22 bp, Homo sapiens
aaatagcattgtatttagctga

SEQ ID NO: 7308531 - DNA, 22 bp, Homo sapiens
aaatccagtttgtcatttccca

SEQ ID NO: 7308532 - DNA, 22 bp, Homo sapiens
aaatactgtagataatagagtt

SEQ ID NO: 7308533 - DNA, 22 bp, Homo sapiens
aaatactggttttggagatgct

SEQ ID NO: 7308534 - DNA, 22 bp, Homo sapiens
aaatagacacttggacagacaa

SEQ ID NO: 7308535 - DNA, 22 bp, Homo sapiens
aaatagatttctctgggtttgt

SEQ ID NO: 7308536 - DNA, 22 bp, Homo sapiens
aaataacttggtttcatcagag

SEQ ID NO: 7308537 - DNA, 22 bp, Homo sapiens
aaataagaaattcttctttgca

SEQ ID NO: 7308538 - DNA, 23 bp, Homo sapiens
aaagtgtagccaggttaagaacc

SEQ ID NO: 7308539 - DNA, 22 bp, Homo sapiens
aaagtgttatgagaactaagtg

SEQ ID NO: 7308540 - DNA, 22 bp, Homo sapiens
aaagtgttgattttatagtgca

SEQ ID NO: 7308541 - DNA, 22 bp, Homo sapiens
aaagtgttgatatgtgacatcc

SEQ ID NO: 7308542 - DNA, 22 bp, Homo sapiens
aaagtgttatgcaaaactctgt

SEQ ID NO: 7308543 - DNA, 22 bp, Homo sapiens
aaataacagtcagggacaacat

SEQ ID NO: 7308544 - DNA, 22 bp, Homo sapiens
aaagtcacatagcatcacttct

SEQ ID NO: 7308545 - DNA, 22 bp, Homo sapiens
aaagtggtttcccagttcagta

SEQ ID NO: 7308546 - DNA, 22 bp, Homo sapiens
aaagtgtagagactttggaacc

SEQ ID NO: 7308547 - DNA, 22 bp, Homo sapiens
aaagtgtactatgtcatgaaca

SEQ ID NO: 7308548 - DNA, 22 bp, Homo sapiens
aaagtgtaaggaatttaagtaa

SEQ ID NO: 7308549 - DNA, 20 bp, Homo sapiens
aaagtgtaaggcaaagttgt

SEQ ID NO: 7308550 - DNA, 20 bp, Homo sapiens
aaagtgtaagcatataatta

SEQ ID NO: 7308551 - DNA, 22 bp, Homo sapiens
aaagtgtaaaagcatgttaggg

SEQ ID NO: 7308552 - DNA, 20 bp, Homo sapiens
aaagtgtaagcatataatta

SEQ ID NO: 7308553 - DNA, 22 bp, Homo sapiens
aaagtatatttacttactgtga

SEQ ID NO: 7308554 - DNA, 22 bp, Homo sapiens
aaaggaaaataagtagttccat

SEQ ID NO: 7308555 - DNA, 22 bp, Homo sapiens
aaaggaagatctatacacccca

SEQ ID NO: 7308556 - DNA, 22 bp, Homo sapiens
aaagcttttcagtatgttcatg

SEQ ID NO: 7308557 - DNA, 22 bp, Homo sapiens
aaagctttgtaaataaacaggt

SEQ ID NO: 7308558 - DNA, 22 bp, Homo sapiens
aaaggaagattgagcttttcca

SEQ ID NO: 7308559 - DNA, 22 bp, Homo sapiens
aaaggaagatgccaggactctg

SEQ ID NO: 7308560 - DNA, 22 bp, Homo sapiens
aaagtacaaggaaaggatctga

SEQ ID NO: 7308561 - DNA, 22 bp, Homo sapiens
aaagtagaacattttcttatct

SEQ ID NO: 7308562 - DNA, 22 bp, Homo sapiens
aactaaaagtgtgtctcttgta

SEQ ID NO: 7308563 - DNA, 22 bp, Homo sapiens
aactaaaagtgtgtctcttgta

SEQ ID NO: 7308564 - DNA, 22 bp, Homo sapiens
aactaaaactggtttgttctct

SEQ ID NO: 7308565 - DNA, 22 bp, Homo sapiens
aactaaatctggcatttagagc

SEQ ID NO: 7308566 - DNA, 23 bp, Homo sapiens
aaagatcaaagtggcaggcctgt

SEQ ID NO: 7308567 - DNA, 22 bp, Homo sapiens
aaagatatgtctccaaagagat

SEQ ID NO: 7308568 - DNA, 20 bp, Homo sapiens
aaagatactttttgtaatgg

SEQ ID NO: 7308569 - DNA, 22 bp, Homo sapiens
aaagatacttaatagttgtctg

SEQ ID NO: 7308570 - DNA, 22 bp, Homo sapiens
aaagccacagttctatgtctgc

SEQ ID NO: 7308571 - DNA, 22 bp, Homo sapiens
aaattttagtaaggaagttgag

SEQ ID NO: 7308572 - DNA, 22 bp, Homo sapiens
aaattgtgctcacactgatatt

SEQ ID NO: 7308573 - DNA, 22 bp, Homo sapiens
aaattgtggcgtctgtaagagt

SEQ ID NO: 7308574 - DNA, 22 bp, Homo sapiens
aacaaaacatttgtcttgtttc

SEQ ID NO: 7308575 - DNA, 22 bp, Homo sapiens
aaagataatgtttccttattct

SEQ ID NO: 7308576 - DNA, 22 bp, Homo sapiens
aacaaacaaacattttgtcatc

SEQ ID NO: 7308577 - DNA, 22 bp, Homo sapiens
aaagctggcctctcaggcttta

SEQ ID NO: 7308578 - DNA, 22 bp, Homo sapiens
aaagcttagcattttcaaaatg

SEQ ID NO: 7308579 - DNA, 22 bp, Homo sapiens
aacagcaatagcactattcatt

SEQ ID NO: 7308580 - DNA, 23 bp, Homo sapiens
aacagccacactgctgagattca

SEQ ID NO: 7308581 - DNA, 22 bp, Homo sapiens
aagtcattctatttctctatgt

SEQ ID NO: 7308582 - DNA, 22 bp, Homo sapiens
aagtcattctatttctctatgt

SEQ ID NO: 7308583 - DNA, 22 bp, Homo sapiens
aagtcattatctcttctaatct

SEQ ID NO: 7308584 - DNA, 22 bp, Homo sapiens
aagtcattggtagcttgatagg

SEQ ID NO: 7308585 - DNA, 22 bp, Homo sapiens
aagtcattggtagcttgatagg

SEQ ID NO: 7308586 - DNA, 22 bp, Homo sapiens
aacaggaattgatgggagtcct

SEQ ID NO: 7308587 - DNA, 22 bp, Homo sapiens
aacactaaaggtcagttagaag

SEQ ID NO: 7308588 - DNA, 22 bp, Homo sapiens
aacactgaaacattgattgaca

SEQ ID NO: 7308589 - DNA, 22 bp, Homo sapiens
aacaaatggaacacaaatcttt

SEQ ID NO: 7308590 - DNA, 22 bp, Homo sapiens
aacaaatcttaaagtaattcaa

SEQ ID NO: 7308591 - DNA, 22 bp, Homo sapiens
aacaaatgacctgatttcttcc

SEQ ID NO: 7308592 - DNA, 22 bp, Homo sapiens
aacaaagtgtacttccatactg

SEQ ID NO: 7308593 - DNA, 22 bp, Homo sapiens
aacaaagtttcaggaagataga

SEQ ID NO: 7308594 - DNA, 22 bp, Homo sapiens
aaggtcacactcccagagctga

SEQ ID NO: 7308595 - DNA, 22 bp, Homo sapiens
aacactgaagtagtgaatactg

SEQ ID NO: 7308596 - DNA, 22 bp, Homo sapiens
aacactgaagaccaggtaattt

SEQ ID NO: 7308597 - DNA, 22 bp, Homo sapiens
aacactgacgacgtgaactaaa

SEQ ID NO: 7308598 - DNA, 22 bp, Homo sapiens
aacactgagaacaatacagagt

SEQ ID NO: 7308599 - DNA, 22 bp, Homo sapiens
aacactgagaggggagtggcac

SEQ ID NO: 7308600 - DNA, 22 bp, Homo sapiens
aaatgttaggttgtactgagtc

SEQ ID NO: 7308601 - DNA, 22 bp, Homo sapiens
aaatgttctaaattacatgtga

SEQ ID NO: 7308602 - DNA, 22 bp, Homo sapiens
aaatgtgtttctttgtgaatgg

SEQ ID NO: 7308603 - DNA, 22 bp, Homo sapiens
aaatgttttgctcccatgtggt

SEQ ID NO: 7308604 - DNA, 22 bp, Homo sapiens
aaatgttttgctcccatgtggt

SEQ ID NO: 7308605 - DNA, 22 bp, Homo sapiens
aaatgtttctacttgtgagcat

SEQ ID NO: 7308606 - DNA, 22 bp, Homo sapiens
aaatgtttaagtgtaggagcaa

SEQ ID NO: 7308607 - DNA, 22 bp, Homo sapiens
aaatgtgtgtatgtacatatat

SEQ ID NO: 7308608 - DNA, 22 bp, Homo sapiens
aaatgtgtgcacaaagacagct

SEQ ID NO: 7308609 - DNA, 22 bp, Homo sapiens
aaatgtgtcatattcaaagtca

SEQ ID NO: 7308610 - DNA, 22 bp, Homo sapiens
aaatgtgtatatgaaacatgat

SEQ ID NO: 7308611 - DNA, 22 bp, Homo sapiens
aaatgtgcttcttactctcaat

SEQ ID NO: 7308612 - DNA, 22 bp, Homo sapiens
aaatgtgcttgtgatcagctgt

SEQ ID NO: 7308613 - DNA, 20 bp, Homo sapiens
aacaaactacaaaattatgt

SEQ ID NO: 7308614 - DNA, 22 bp, Homo sapiens
aaattgcattcaggatgcagga

SEQ ID NO: 7308615 - DNA, 22 bp, Homo sapiens
aaattgcattcttgtcttgata

SEQ ID NO: 7308616 - DNA, 22 bp, Homo sapiens
aaattgcattgagctgcttatt

SEQ ID NO: 7308617 - DNA, 22 bp, Homo sapiens
aaattgcaggtaggtgggtgat

SEQ ID NO: 7308618 - DNA, 22 bp, Homo sapiens
aacaaagtacttttcagtgctt

SEQ ID NO: 7308619 - DNA, 22 bp, Homo sapiens
aacaaagtagctgctgttctta

SEQ ID NO: 7308620 - DNA, 22 bp, Homo sapiens
aacaaagtcgttgcctagaaga

SEQ ID NO: 7308621 - DNA, 22 bp, Homo sapiens
aaattcttcaggtaattttgat

SEQ ID NO: 7308622 - DNA, 22 bp, Homo sapiens
aaattctgtcctgaatgccatt

SEQ ID NO: 7308623 - DNA, 22 bp, Homo sapiens
aaattctgatttaataagtgta

SEQ ID NO: 7308624 - DNA, 22 bp, Homo sapiens
aaattgcaaaagtacttttagg

SEQ ID NO: 7308625 - DNA, 22 bp, Homo sapiens
aaattgcagatgctaaatgact

SEQ ID NO: 7308626 - DNA, 22 bp, Homo sapiens
aaattgcacccgaggaggaggt

SEQ ID NO: 7308627 - DNA, 22 bp, Homo sapiens
aaattgcaaccaggtctctgtc

SEQ ID NO: 7308628 - DNA, 22 bp, Homo sapiens
aaattgcacaatatagacatga

SEQ ID NO: 7308629 - DNA, 22 bp, Homo sapiens
aaattgaatgattaagtggtga

SEQ ID NO: 7308630 - DNA, 22 bp, Homo sapiens
aaattgaatttgggaaacattg

SEQ ID NO: 7308631 - DNA, 22 bp, Homo sapiens
aactgtttatgtaagtatgcag

SEQ ID NO: 7308632 - DNA, 22 bp, Homo sapiens
aactgtttggaactcttccaca

SEQ ID NO: 7308633 - DNA, 22 bp, Homo sapiens
aactgtttttcacgtgtctcat

SEQ ID NO: 7308634 - DNA, 22 bp, Homo sapiens
aactgtttatgtaagtatgcag

SEQ ID NO: 7308635 - DNA, 22 bp, Homo sapiens
aactgttgcttgtaatatgtgc

SEQ ID NO: 7308636 - DNA, 22 bp, Homo sapiens
aactgttacatagttatagatc

SEQ ID NO: 7308637 - DNA, 22 bp, Homo sapiens
aactgttttttactagaggact

SEQ ID NO: 7308638 - DNA, 22 bp, Homo sapiens
aacttaaacaagctcccaagtt

SEQ ID NO: 7308639 - DNA, 22 bp, Homo sapiens
aacttaaacccactcatgtaga

SEQ ID NO: 7308640 - DNA, 22 bp, Homo sapiens
aacttacaatgttagagtctca

SEQ ID NO: 7308641 - DNA, 22 bp, Homo sapiens
aatgatacatatgtatcgttag

SEQ ID NO: 7308642 - DNA, 22 bp, Homo sapiens
aatcatgtgggatagtctgctc

SEQ ID NO: 7308643 - DNA, 22 bp, Homo sapiens
aatcatcttcatcttacacaga

SEQ ID NO: 7308644 - DNA, 22 bp, Homo sapiens
aatcatgtttacgtgacatgtc

SEQ ID NO: 7308645 - DNA, 22 bp, Homo sapiens
aactgaaacttaggaagtaatc

SEQ ID NO: 7308646 - DNA, 22 bp, Homo sapiens
aactgaaacttaggaagtaatc

SEQ ID NO: 7308647 - DNA, 22 bp, Homo sapiens
aatccacacatctggcatgtga

SEQ ID NO: 7308648 - DNA, 22 bp, Homo sapiens
aactgcataatatatcatgcag

SEQ ID NO: 7308649 - DNA, 22 bp, Homo sapiens
aatataacacagatggcctgtt

SEQ ID NO: 7308650 - DNA, 22 bp, Homo sapiens
aactacatagaaattagtattt

SEQ ID NO: 7308651 - DNA, 22 bp, Homo sapiens
aacatttttaagaccaagtgct

SEQ ID NO: 7308652 - DNA, 21 bp, Homo sapiens
aacatttcaggatccaaattg

SEQ ID NO: 7308653 - DNA, 22 bp, Homo sapiens
aacatttcataacttgactttt

SEQ ID NO: 7308654 - DNA, 22 bp, Homo sapiens
aataacttcatgtaacatttaa

SEQ ID NO: 7308655 - DNA, 22 bp, Homo sapiens
aaccaccattctctcctcttcc

SEQ ID NO: 7308656 - DNA, 22 bp, Homo sapiens
aatagtttgaatttatcagatg

SEQ ID NO: 7308657 - DNA, 22 bp, Homo sapiens
aacaggcaatttaggactcttt

SEQ ID NO: 7308658 - DNA, 22 bp, Homo sapiens
aacaggcaggagaattctgcct

SEQ ID NO: 7308659 - DNA, 22 bp, Homo sapiens
aacatgcttgcttagaatcagc

SEQ ID NO: 7308660 - DNA, 22 bp, Homo sapiens
aagcagcatgattgtaatacta

SEQ ID NO: 7308661 - DNA, 22 bp, Homo sapiens
aagcagagtccccttcccatgg

SEQ ID NO: 7308662 - DNA, 23 bp, Homo sapiens
acagacaacactgatgagagaaa

SEQ ID NO: 7308663 - DNA, 22 bp, Homo sapiens
aagcagagtgatataaacatgg

SEQ ID NO: 7308664 - DNA, 22 bp, Homo sapiens
acagagtatctatcaggagtat

SEQ ID NO: 7308665 - DNA, 22 bp, Homo sapiens
acagagtaggtgctcagtaaat

SEQ ID NO: 7308666 - DNA, 22 bp, Homo sapiens
acagagtaaatccaagaacgct

SEQ ID NO: 7308667 - DNA, 20 bp, Homo sapiens
acagagtagaacatatgcca

SEQ ID NO: 7308668 - DNA, 20 bp, Homo sapiens
acagagtagaacatatgcca

SEQ ID NO: 7308669 - DNA, 22 bp, Homo sapiens
acagagtacattcagagactat

SEQ ID NO: 7308670 - DNA, 22 bp, Homo sapiens
acagagtagctcaagaagattg

SEQ ID NO: 7308671 - DNA, 22 bp, Homo sapiens
aagcatttatagataagaattt

SEQ ID NO: 7308672 - DNA, 22 bp, Homo sapiens
aagcatggtttctgacgtcatg

SEQ ID NO: 7308673 - DNA, 22 bp, Homo sapiens
aagcatttggcatgaaactctt

SEQ ID NO: 7308674 - DNA, 22 bp, Homo sapiens
aagcatttggttctgaagactc

SEQ ID NO: 7308675 - DNA, 22 bp, Homo sapiens
acagcagctgccttcaggctct

SEQ ID NO: 7308676 - DNA, 22 bp, Homo sapiens
acagcagcttgtctgttcttta

SEQ ID NO: 7308677 - DNA, 22 bp, Homo sapiens
acagcagcttgcgtgtctggtc

SEQ ID NO: 7308678 - DNA, 22 bp, Homo sapiens
aagcacagaaaaggagcatgga

SEQ ID NO: 7308679 - DNA, 22 bp, Homo sapiens
aagcacaggagacgcacagcca

SEQ ID NO: 7308680 - DNA, 22 bp, Homo sapiens
aagcacagtgggcagagcagcc

SEQ ID NO: 7308681 - DNA, 22 bp, Homo sapiens
aagatttactagcataatagct

SEQ ID NO: 7308682 - DNA, 22 bp, Homo sapiens
aagatttctctcctggaaagca

SEQ ID NO: 7308683 - DNA, 22 bp, Homo sapiens
acacagggggcattctaggagt

SEQ ID NO: 7308684 - DNA, 18 bp, Homo sapiens
aagaggctgttctgtggg

SEQ ID NO: 7308685 - DNA, 22 bp, Homo sapiens
aagatgttgactcctttgatgt

SEQ ID NO: 7308686 - DNA, 22 bp, Homo sapiens
aagatttactagcataatagct

SEQ ID NO: 7308687 - DNA, 22 bp, Homo sapiens
aagattcttgactagaatgatt

SEQ ID NO: 7308688 - DNA, 22 bp, Homo sapiens
aagattgtccaccacctggatt

SEQ ID NO: 7308689 - DNA, 22 bp, Homo sapiens
aagattgttttggatgctaact

SEQ ID NO: 7308690 - DNA, 22 bp, Homo sapiens
aagattgtcaggcttgctgtat

SEQ ID NO: 7308691 - DNA, 22 bp, Homo sapiens
aagagatgtggaatcatttaca

SEQ ID NO: 7308692 - DNA, 22 bp, Homo sapiens
aagagaggggttgcatggaaat

SEQ ID NO: 7308693 - DNA, 22 bp, Homo sapiens
aagagagggacttattaaagtc

SEQ ID NO: 7308694 - DNA, 22 bp, Homo sapiens
acaaagataagtcagaaagtca

SEQ ID NO: 7308695 - DNA, 22 bp, Homo sapiens
aagacatacagacagtgagcca

SEQ ID NO: 7308696 - DNA, 22 bp, Homo sapiens
aagacatgttttaagaatattt

SEQ ID NO: 7308697 - DNA, 22 bp, Homo sapiens
acaaagattcatttgcattatt

SEQ ID NO: 7308698 - DNA, 22 bp, Homo sapiens
acaaagattcatttgcattatt

SEQ ID NO: 7308699 - DNA, 22 bp, Homo sapiens
acaaagattcatttgcattatt

SEQ ID NO: 7308700 - DNA, 22 bp, Homo sapiens
acaaagatcttgctttcctact

SEQ ID NO: 7308701 - DNA, 22 bp, Homo sapiens
acaaagatgtttaaagcattta

SEQ ID NO: 7308702 - DNA, 19 bp, Homo sapiens
aagagcagggaaagaattg

SEQ ID NO: 7308703 - DNA, 23 bp, Homo sapiens
aagagcagggaatatttatttgc

SEQ ID NO: 7308704 - DNA, 20 bp, Homo sapiens
aagagctgactcacagtggt

SEQ ID NO: 7308705 - DNA, 22 bp, Homo sapiens
aagagcagtgttttactcagct

SEQ ID NO: 7308706 - DNA, 22 bp, Homo sapiens
aagagctgattaagtcatgagg

SEQ ID NO: 7308707 - DNA, 22 bp, Homo sapiens
aagagctggagctgctacagga

SEQ ID NO: 7308708 - DNA, 22 bp, Homo sapiens
aagagctggagctgctacagga

SEQ ID NO: 7308709 - DNA, 22 bp, Homo sapiens
aagagctggattgtgctgcaga

SEQ ID NO: 7308710 - DNA, 21 bp, Homo sapiens
aagagctggatcaaggataag

SEQ ID NO: 7308711 - DNA, 22 bp, Homo sapiens
aagaggaactgggggctgagtc

SEQ ID NO: 7308712 - DNA, 22 bp, Homo sapiens
aagagctgttgtctgcttactg

SEQ ID NO: 7308713 - DNA, 22 bp, Homo sapiens
aagagcttcctctttcattgct

SEQ ID NO: 7308714 - DNA, 21 bp, Homo sapiens
aagagctgtcaggaaggctgc

SEQ ID NO: 7308715 - DNA, 22 bp, Homo sapiens
aagacaggaaaagctccaggcc

SEQ ID NO: 7308716 - DNA, 22 bp, Homo sapiens
aagacaggaacatagcaaatcc

SEQ ID NO: 7308717 - DNA, 23 bp, Homo sapiens
aattgtgcttcccaggggctatt

SEQ ID NO: 7308718 - DNA, 22 bp, Homo sapiens
aattgtgctgtgatcaattact

SEQ ID NO: 7308719 - DNA, 22 bp, Homo sapiens
aattgtgctgtaggctcgttaa

SEQ ID NO: 7308720 - DNA, 22 bp, Homo sapiens
aattgtgctgctataggattaa

SEQ ID NO: 7308721 - DNA, 21 bp, Homo sapiens
aattgtgctattctgctttta

SEQ ID NO: 7308722 - DNA, 22 bp, Homo sapiens
aattgtgctatgattatgaaag

SEQ ID NO: 7308723 - DNA, 22 bp, Homo sapiens
aattgtgcccgtgacatttcat

SEQ ID NO: 7308724 - DNA, 22 bp, Homo sapiens
aattgtgcatttttaaatcacg

SEQ ID NO: 7308725 - DNA, 22 bp, Homo sapiens
aagaataaattaagatacttag

SEQ ID NO: 7308726 - DNA, 22 bp, Homo sapiens
aagaataaattaagatacttag

SEQ ID NO: 7308727 - DNA, 22 bp, Homo sapiens
aagaagcagagctgtgggtgtt

SEQ ID NO: 7308728 - DNA, 23 bp, Homo sapiens
aagaataaatgacattaaaggtg

SEQ ID NO: 7308729 - DNA, 23 bp, Homo sapiens
aagaataaatgacattaaaggtg

SEQ ID NO: 7308730 - DNA, 22 bp, Homo sapiens
aagaataagaggatttagaaca

SEQ ID NO: 7308731 - DNA, 22 bp, Homo sapiens
aagaataagtagatgggagaag

SEQ ID NO: 7308732 - DNA, 22 bp, Homo sapiens
aagaaatcagaaaagcattcgt

SEQ ID NO: 7308733 - DNA, 22 bp, Homo sapiens
aagaaatgcacacaactgctgg

SEQ ID NO: 7308734 - DNA, 21 bp, Homo sapiens
aagaaagataattaaggaccc

SEQ ID NO: 7308735 - DNA, 22 bp, Homo sapiens
aacttcatgtaatttaaaacag

SEQ ID NO: 7308736 - DNA, 22 bp, Homo sapiens
aacttcagggggcacattcaag

SEQ ID NO: 7308737 - DNA, 22 bp, Homo sapiens
aacttcagggacagaaaagagc

SEQ ID NO: 7308738 - DNA, 22 bp, Homo sapiens
aacttcatgtaatttaaaacag

SEQ ID NO: 7308739 - DNA, 22 bp, Homo sapiens
aacttagttaagattaagtctc

SEQ ID NO: 7308740 - DNA, 22 bp, Homo sapiens
aacttcaaatgtgactttgcat

SEQ ID NO: 7308741 - DNA, 18 bp, Homo sapiens
aacttcaactacaatgga

SEQ ID NO: 7308742 - DNA, 22 bp, Homo sapiens
aagaaatggcttcatctgagta

SEQ ID NO: 7308743 - DNA, 22 bp, Homo sapiens
aagaaatgctgatgttggatgg

SEQ ID NO: 7308744 - DNA, 22 bp, Homo sapiens
aagaaatgcagaaatgtgctgg

SEQ ID NO: 7308745 - DNA, 22 bp, Homo sapiens
aatgttttacagatcccattag

SEQ ID NO: 7308746 - DNA, 22 bp, Homo sapiens
aagaagcactttcctacatgtt

SEQ ID NO: 7308747 - DNA, 22 bp, Homo sapiens
agcacattcttgccttaacctc

SEQ ID NO: 7308748 - DNA, 22 bp, Homo sapiens
agcacatttaagtatgaaatat

SEQ ID NO: 7308749 - DNA, 22 bp, Homo sapiens
agcacattttctcaaagctcat

SEQ ID NO: 7308750 - DNA, 22 bp, Homo sapiens
agcaccaagcctagagtgatgt

SEQ ID NO: 7308751 - DNA, 23 bp, Homo sapiens
agcaccaggaacagtgtggtcct

SEQ ID NO: 7308752 - DNA, 22 bp, Homo sapiens
agcaccaggctgttggaagccc

SEQ ID NO: 7308753 - DNA, 22 bp, Homo sapiens
caagacttagagcatcttgaaa

SEQ ID NO: 7308754 - DNA, 22 bp, Homo sapiens
caagactttggaggaatttgga

SEQ ID NO: 7308755 - DNA, 22 bp, Homo sapiens
agcacattaagtgagttcatgt

SEQ ID NO: 7308756 - DNA, 23 bp, Homo sapiens
caacagctgttagatatgggctt

SEQ ID NO: 7308757 - DNA, 22 bp, Homo sapiens
caacagctggaggcttggcccg

SEQ ID NO: 7308758 - DNA, 22 bp, Homo sapiens
caacagctcagacacgggacct

SEQ ID NO: 7308759 - DNA, 22 bp, Homo sapiens
caaattaatgtgtctcaaaata

SEQ ID NO: 7308760 - DNA, 22 bp, Homo sapiens
caaattaccctcaacatctaga

SEQ ID NO: 7308761 - DNA, 22 bp, Homo sapiens
caacacttcttatacttactga

SEQ ID NO: 7308762 - DNA, 22 bp, Homo sapiens
agcaaagccgagacagccagtg

SEQ ID NO: 7308763 - DNA, 22 bp, Homo sapiens
agcaaagcatcactccaatctg

SEQ ID NO: 7308764 - DNA, 22 bp, Homo sapiens
agcaaagcatcactccaatctg

SEQ ID NO: 7308765 - DNA, 22 bp, Homo sapiens
agcaaagcactttgcatacata

SEQ ID NO: 7308766 - DNA, 18 bp, Homo sapiens
agcaaagcaagagatcac

SEQ ID NO: 7308767 - DNA, 22 bp, Homo sapiens
agcaaagctatctctatggaga

SEQ ID NO: 7308768 - DNA, 22 bp, Homo sapiens
caaaataccacgacttgtttta

SEQ ID NO: 7308769 - DNA, 22 bp, Homo sapiens
caaaagttctcacccagacatg

SEQ ID NO: 7308770 - DNA, 22 bp, Homo sapiens
caaaagttattgcggtttttgc

SEQ ID NO: 7308771 - DNA, 23 bp, Homo sapiens
caaaagttagcccttcccatctc

SEQ ID NO: 7308772 - DNA, 22 bp, Homo sapiens
agcaaagaagggttcttcatta

SEQ ID NO: 7308773 - DNA, 22 bp, Homo sapiens
agcagcagggacaaaggaacag

SEQ ID NO: 7308774 - DNA, 22 bp, Homo sapiens
agcagcaggcttaaggaaaagt

SEQ ID NO: 7308775 - DNA, 22 bp, Homo sapiens
agcagcagggacaaaggaacag

SEQ ID NO: 7308776 - DNA, 22 bp, Homo sapiens
caatttttgtacttatagtact

SEQ ID NO: 7308777 - DNA, 22 bp, Homo sapiens
caattttttccatgctcttaca

SEQ ID NO: 7308778 - DNA, 22 bp, Homo sapiens
caattttttccatgctcttaca

SEQ ID NO: 7308779 - DNA, 22 bp, Homo sapiens
caagatttatattttcacacaa

SEQ ID NO: 7308780 - DNA, 22 bp, Homo sapiens
caagagcatttagttagctggt

SEQ ID NO: 7308781 - DNA, 22 bp, Homo sapiens
agcagcaggctagggaactgct

SEQ ID NO: 7308782 - DNA, 22 bp, Homo sapiens
agcaggctgatgggcatgcttg

SEQ ID NO: 7308783 - DNA, 22 bp, Homo sapiens
cacagtttatgatctcagtgaa

SEQ ID NO: 7308784 - DNA, 22 bp, Homo sapiens
cacagtttggtatagaagtgat

SEQ ID NO: 7308785 - DNA, 22 bp, Homo sapiens
cacagtttggttttgctgtaat

SEQ ID NO: 7308786 - DNA, 22 bp, Homo sapiens
cacagtttctgaacactttgca

SEQ ID NO: 7308787 - DNA, 22 bp, Homo sapiens
agcaggcagctgggggagttga

SEQ ID NO: 7308788 - DNA, 22 bp, Homo sapiens
agcaggcaggaggctactaagg

SEQ ID NO: 7308789 - DNA, 22 bp, Homo sapiens
cacagttatatgttcacaagga

SEQ ID NO: 7308790 - DNA, 22 bp, Homo sapiens
cacacacagttttgtattctgt

SEQ ID NO: 7308791 - DNA, 22 bp, Homo sapiens
cacacacagttttgtattctgt

SEQ ID NO: 7308792 - DNA, 22 bp, Homo sapiens
agcaggcacaagaaagggaggt

SEQ ID NO: 7308793 - DNA, 22 bp, Homo sapiens
cacacaaatattctggaggcaa

SEQ ID NO: 7308794 - DNA, 22 bp, Homo sapiens
cacaattttcctttaagtgtat

SEQ ID NO: 7308795 - DNA, 22 bp, Homo sapiens
cacaattttcctttaagtgtat

SEQ ID NO: 7308796 - DNA, 22 bp, Homo sapiens
agcagctgatggggaaggagtt

SEQ ID NO: 7308797 - DNA, 22 bp, Homo sapiens
cacccaggctggagtgcagggg

SEQ ID NO: 7308798 - DNA, 22 bp, Homo sapiens
cacccaggctggagtgcagtga

SEQ ID NO: 7308799 - DNA, 22 bp, Homo sapiens
cacccaggctggagtgcagtgg

SEQ ID NO: 7308800 - DNA, 22 bp, Homo sapiens
agcaggctgccttccaaagcct

SEQ ID NO: 7308801 - DNA, 22 bp, Homo sapiens
agcatacagtaggtgctcagtt

SEQ ID NO: 7308802 - DNA, 22 bp, Homo sapiens
agcatacagtaggtgctcagtt

SEQ ID NO: 7308803 - DNA, 22 bp, Homo sapiens
agcatacaccctaaactgctta

SEQ ID NO: 7308804 - DNA, 22 bp, Homo sapiens
cactgctttaaggctgagtaac

SEQ ID NO: 7308805 - DNA, 22 bp, Homo sapiens
cactgcttggccctgagggcag

SEQ ID NO: 7308806 - DNA, 22 bp, Homo sapiens
cactgcttccattgttcacctg

SEQ ID NO: 7308807 - DNA, 22 bp, Homo sapiens
cacctagccttcttgtgcctct

SEQ ID NO: 7308808 - DNA, 22 bp, Homo sapiens
cacctctgcctcaagcttccca

SEQ ID NO: 7308809 - DNA, 22 bp, Homo sapiens
cagaataatattggtctcatag

SEQ ID NO: 7308810 - DNA, 22 bp, Homo sapiens
cagaataccctatagacagaat

SEQ ID NO: 7308811 - DNA, 22 bp, Homo sapiens
cagaataagctgtgttgtcaag

SEQ ID NO: 7308812 - DNA, 22 bp, Homo sapiens
cagaataagctgtgttgtcaag

SEQ ID NO: 7308813 - DNA, 22 bp, Homo sapiens
agccactggcctgggcagctct

SEQ ID NO: 7308814 - DNA, 19 bp, Homo sapiens
cagaaatagcgaagtgtaa

SEQ ID NO: 7308815 - DNA, 22 bp, Homo sapiens
cagaaatatcagttgaaagtgc

SEQ ID NO: 7308816 - DNA, 22 bp, Homo sapiens
agccacagtgggctaccagctc

SEQ ID NO: 7308817 - DNA, 22 bp, Homo sapiens
agccacagtctgtagccagctt

SEQ ID NO: 7308818 - DNA, 22 bp, Homo sapiens
agcatataaatggacatatttg

SEQ ID NO: 7308819 - DNA, 22 bp, Homo sapiens
agcatatacaaactcatataca

SEQ ID NO: 7308820 - DNA, 22 bp, Homo sapiens
agcatatacaaactcatataca

SEQ ID NO: 7308821 - DNA, 22 bp, Homo sapiens
agccagagactttacctgtgca

SEQ ID NO: 7308822 - DNA, 22 bp, Homo sapiens
cagaatatgactcgggcactac

SEQ ID NO: 7308823 - DNA, 23 bp, Homo sapiens
agccacttctatcttgctcctgg

SEQ ID NO: 7308824 - DNA, 22 bp, Homo sapiens
agccactgtgtgaccagctgtc

SEQ ID NO: 7308825 - DNA, 22 bp, Homo sapiens
agccactgtgcaggagcagtgt

SEQ ID NO: 7308826 - DNA, 22 bp, Homo sapiens
agcccagaaatgaaaggatgat

SEQ ID NO: 7308827 - DNA, 22 bp, Homo sapiens
agcccagagccccggccatgtt

SEQ ID NO: 7308828 - DNA, 22 bp, Homo sapiens
agcccagagggtagcagaagaa

SEQ ID NO: 7308829 - DNA, 22 bp, Homo sapiens
agcccaagcataggagggaggc

SEQ ID NO: 7308830 - DNA, 22 bp, Homo sapiens
cagagaaagggtgaattccttc

SEQ ID NO: 7308831 - DNA, 22 bp, Homo sapiens
cagacttttgacattaatacag

SEQ ID NO: 7308832 - DNA, 22 bp, Homo sapiens
cagactttctggaagctaaaaa

SEQ ID NO: 7308833 - DNA, 22 bp, Homo sapiens
cagactttcaaggagtgaaggc

SEQ ID NO: 7308834 - DNA, 22 bp, Homo sapiens
agcccagggaaccaggaagtgg

SEQ ID NO: 7308835 - DNA, 22 bp, Homo sapiens
cagaggctcttcctcactgccc

SEQ ID NO: 7308836 - DNA, 22 bp, Homo sapiens
agcccagccggattcccagttc

SEQ ID NO: 7308837 - DNA, 21 bp, Homo sapiens
cagaggcaggtcctgggacgg

SEQ ID NO: 7308838 - DNA, 22 bp, Homo sapiens
agcccaggcagagggatgcttg

SEQ ID NO: 7308839 - DNA, 22 bp, Homo sapiens
agcctctgggggagctgggagc

SEQ ID NO: 7308840 - DNA, 22 bp, Homo sapiens
agcctctgtagaaagcagtgtg

SEQ ID NO: 7308841 - DNA, 22 bp, Homo sapiens
agcctctgtgactcacaggtca

SEQ ID NO: 7308842 - DNA, 22 bp, Homo sapiens
agcctctgcttatgcaaaggta

SEQ ID NO: 7308843 - DNA, 22 bp, Homo sapiens
agcctctgcacttcttacaggt

SEQ ID NO: 7308844 - DNA, 22 bp, Homo sapiens
cagagggccccctggccacagt

SEQ ID NO: 7308845 - DNA, 22 bp, Homo sapiens
cagaggtagggttggcccagga

SEQ ID NO: 7308846 - DNA, 22 bp, Homo sapiens
agcctcttccagctcctttcta

SEQ ID NO: 7308847 - DNA, 22 bp, Homo sapiens
cagcagctcaggctgcttccca

SEQ ID NO: 7308848 - DNA, 22 bp, Homo sapiens
cagcagctcagtctctcagtag

SEQ ID NO: 7308849 - DNA, 22 bp, Homo sapiens
agcctggagttcccaggagaag

SEQ ID NO: 7308850 - DNA, 22 bp, Homo sapiens
cagcagctgaggcgctggcgtg

SEQ ID NO: 7308851 - DNA, 22 bp, Homo sapiens
agcctggcactgaggcagggcg

SEQ ID NO: 7308852 - DNA, 22 bp, Homo sapiens
cagcagggcccccgggtgcgcc

SEQ ID NO: 7308853 - DNA, 22 bp, Homo sapiens
cagcaggatatggtggagagag

SEQ ID NO: 7308854 - DNA, 22 bp, Homo sapiens
cagcatcaacattctcagctct

SEQ ID NO: 7308855 - DNA, 22 bp, Homo sapiens
cagccctgagaaggaggatctc

SEQ ID NO: 7308856 - DNA, 22 bp, Homo sapiens
cagccctgcagagggcgctcct

SEQ ID NO: 7308857 - DNA, 22 bp, Homo sapiens
agctcctgagtagctttactca

SEQ ID NO: 7308858 - DNA, 22 bp, Homo sapiens
agctcctgatacatgcaggaat

SEQ ID NO: 7308859 - DNA, 23 bp, Homo sapiens
agctcctgaggccagcctctcct

SEQ ID NO: 7308860 - DNA, 20 bp, Homo sapiens
agctcctgagggttactttc

SEQ ID NO: 7308861 - DNA, 22 bp, Homo sapiens
agctcctgattctcagagatag

SEQ ID NO: 7308862 - DNA, 18 bp, Homo sapiens
agctcctgaactctgtgg

SEQ ID NO: 7308863 - DNA, 22 bp, Homo sapiens
agctcctgaaaatccagactgg

SEQ ID NO: 7308864 - DNA, 22 bp, Homo sapiens
cagctcagtctggagagatgca

SEQ ID NO: 7308865 - DNA, 22 bp, Homo sapiens
cagctaagccacactcagatgg

SEQ ID NO: 7308866 - DNA, 22 bp, Homo sapiens
cagctaaggctccttctaggta

SEQ ID NO: 7308867 - DNA, 22 bp, Homo sapiens
cagctaagaatgtctgagatca

SEQ ID NO: 7308868 - DNA, 22 bp, Homo sapiens
atttcacagctgctgttcaggt

SEQ ID NO: 7308869 - DNA, 22 bp, Homo sapiens
atttattgaagcttattacgtt

SEQ ID NO: 7308870 - DNA, 22 bp, Homo sapiens
agataaattcctaagatttcag

SEQ ID NO: 7308871 - DNA, 22 bp, Homo sapiens
agataaaatggttcaaaggcta

SEQ ID NO: 7308872 - DNA, 22 bp, Homo sapiens
agataaaatgattttctggatc

SEQ ID NO: 7308873 - DNA, 17 bp, Homo sapiens
agagttttaagaaattt

SEQ ID NO: 7308874 - DNA, 22 bp, Homo sapiens
agagtttgtactttaccctgag

SEQ ID NO: 7308875 - DNA, 20 bp, Homo sapiens
agatacagtttaattactct

SEQ ID NO: 7308876 - DNA, 20 bp, Homo sapiens
agatacagtttaattactct

SEQ ID NO: 7308877 - DNA, 22 bp, Homo sapiens
agatacatcatttataccttca

SEQ ID NO: 7308878 - DNA, 22 bp, Homo sapiens
atttcacatctatctcagattt

SEQ ID NO: 7308879 - DNA, 22 bp, Homo sapiens
atttcacagctgtcagtgttac

SEQ ID NO: 7308880 - DNA, 22 bp, Homo sapiens
atttcacagctgtcagtgttac

SEQ ID NO: 7308881 - DNA, 22 bp, Homo sapiens
atttcacagctgtcagtgttac

SEQ ID NO: 7308882 - DNA, 22 bp, Homo sapiens
attgctcagcacaagcagcaga

SEQ ID NO: 7308883 - DNA, 22 bp, Homo sapiens
attgctaggaacaggttgcacc

SEQ ID NO: 7308884 - DNA, 22 bp, Homo sapiens
attgctacttcctcaggaaaac

SEQ ID NO: 7308885 - DNA, 22 bp, Homo sapiens
attgccaggagggttgagaata

SEQ ID NO: 7308886 - DNA, 22 bp, Homo sapiens
agaggtcatatctcagaagaga

SEQ ID NO: 7308887 - DNA, 22 bp, Homo sapiens
agaggtccccagatgattccag

SEQ ID NO: 7308888 - DNA, 22 bp, Homo sapiens
agaggtgacataggagaggctc

SEQ ID NO: 7308889 - DNA, 22 bp, Homo sapiens
agaggtcttaagatctagactg

SEQ ID NO: 7308890 - DNA, 23 bp, Homo sapiens
agagttgtatcctatgtgcttct

SEQ ID NO: 7308891 - DNA, 22 bp, Homo sapiens
atttctctcattgttagctagg

SEQ ID NO: 7308892 - DNA, 22 bp, Homo sapiens
atttctctaagcatccgtttgc

SEQ ID NO: 7308893 - DNA, 22 bp, Homo sapiens
atttctcagttcctactgttta

SEQ ID NO: 7308894 - DNA, 22 bp, Homo sapiens
atttctctgcctcagcttctgc

SEQ ID NO: 7308895 - DNA, 22 bp, Homo sapiens
atttctctgcctcagcttctgc

SEQ ID NO: 7308896 - DNA, 22 bp, Homo sapiens
agataggccattaagaaggata

SEQ ID NO: 7308897 - DNA, 22 bp, Homo sapiens
atttcctggtgtggaagtattt

SEQ ID NO: 7308898 - DNA, 22 bp, Homo sapiens
caaaaaacacagatgtctgtgt

SEQ ID NO: 7308899 - DNA, 22 bp, Homo sapiens
atttgtttcagggccttggtat

SEQ ID NO: 7308900 - DNA, 22 bp, Homo sapiens
caaaaggcaggggaaagagtgc

SEQ ID NO: 7308901 - DNA, 22 bp, Homo sapiens
caaaagtagtgaagttgtacat

SEQ ID NO: 7308902 - DNA, 22 bp, Homo sapiens
atttggcacagcttttcctacc

SEQ ID NO: 7308903 - DNA, 22 bp, Homo sapiens
atttgtgccaaattatttctaa

SEQ ID NO: 7308904 - DNA, 22 bp, Homo sapiens
atttgtgcatatcccatccacc

SEQ ID NO: 7308905 - DNA, 22 bp, Homo sapiens
atttgtgccaaattatttctaa

SEQ ID NO: 7308906 - DNA, 22 bp, Homo sapiens
atttgttgaataaattagtatt

SEQ ID NO: 7308907 - DNA, 22 bp, Homo sapiens
agaggactgttggtcttagaaa

SEQ ID NO: 7308908 - DNA, 22 bp, Homo sapiens
attattataaagtgcatgacct

SEQ ID NO: 7308909 - DNA, 22 bp, Homo sapiens
attattaaagcttaggtcttat

SEQ ID NO: 7308910 - DNA, 22 bp, Homo sapiens
agagctgtgttaagaacaggcc

SEQ ID NO: 7308911 - DNA, 22 bp, Homo sapiens
agagctgggacttggactcaat

SEQ ID NO: 7308912 - DNA, 22 bp, Homo sapiens
agagctggtttactcaggaatt

SEQ ID NO: 7308913 - DNA, 22 bp, Homo sapiens
atgtgtatatttattgtagttt

SEQ ID NO: 7308914 - DNA, 22 bp, Homo sapiens
atgtgtatatttggtgtcaata

SEQ ID NO: 7308915 - DNA, 22 bp, Homo sapiens
atgtgtatatttggtgtcaata

SEQ ID NO: 7308916 - DNA, 22 bp, Homo sapiens
atgtgtatacttgtgcttactc

SEQ ID NO: 7308917 - DNA, 22 bp, Homo sapiens
atgtgtatacttgtgcttactc

SEQ ID NO: 7308918 - DNA, 22 bp, Homo sapiens
atgtttatgcaaacatgtgagt

SEQ ID NO: 7308919 - DNA, 22 bp, Homo sapiens
attgcatatgcagcacatcagg

SEQ ID NO: 7308920 - DNA, 22 bp, Homo sapiens
attccagatgcttgtatttaaa

SEQ ID NO: 7308921 - DNA, 22 bp, Homo sapiens
attccagagaggttctggaggt

SEQ ID NO: 7308922 - DNA, 22 bp, Homo sapiens
agagggagaaaagaatcagttg

SEQ ID NO: 7308923 - DNA, 22 bp, Homo sapiens
agagggagaaaagaatcagttg

SEQ ID NO: 7308924 - DNA, 22 bp, Homo sapiens
agaggcctttctgttgagtgaa

SEQ ID NO: 7308925 - DNA, 22 bp, Homo sapiens
attcatttgctattgtgtatgg

SEQ ID NO: 7308926 - DNA, 22 bp, Homo sapiens
agaggcctgtgtgctccagtgg

SEQ ID NO: 7308927 - DNA, 22 bp, Homo sapiens
attcatttagagggattaagca

SEQ ID NO: 7308928 - DNA, 22 bp, Homo sapiens
attcagtaggtgtgaacttatt

SEQ ID NO: 7308929 - DNA, 22 bp, Homo sapiens
attcagtaggtctagaataaga

SEQ ID NO: 7308930 - DNA, 22 bp, Homo sapiens
attcagtattctgctgcataat

SEQ ID NO: 7308931 - DNA, 22 bp, Homo sapiens
agaccacaggcatgcacagagc

SEQ ID NO: 7308932 - DNA, 22 bp, Homo sapiens
agaccacagtcaggctcctggt

SEQ ID NO: 7308933 - DNA, 22 bp, Homo sapiens
agaccactaaaactttctctat

SEQ ID NO: 7308934 - DNA, 22 bp, Homo sapiens
agacattttggaaagtattact

SEQ ID NO: 7308935 - DNA, 22 bp, Homo sapiens
agaccaagaaaggatgaggatc

SEQ ID NO: 7308936 - DNA, 22 bp, Homo sapiens
agaccaagactataatgagagg

SEQ ID NO: 7308937 - DNA, 22 bp, Homo sapiens
agacattttacattcttccatt

SEQ ID NO: 7308938 - DNA, 22 bp, Homo sapiens
agacattttacattcttccatt

SEQ ID NO: 7308939 - DNA, 22 bp, Homo sapiens
agacattttacattcttccatt

SEQ ID NO: 7308940 - DNA, 23 bp, Homo sapiens
agacattttaataaggacttttt

SEQ ID NO: 7308941 - DNA, 22 bp, Homo sapiens
agacattttggaaagtattact

SEQ ID NO: 7308942 - DNA, 18 bp, Homo sapiens
agaccagacaagaatggt

SEQ ID NO: 7308943 - DNA, 22 bp, Homo sapiens
agaccaggtctttatggctcca

SEQ ID NO: 7308944 - DNA, 22 bp, Homo sapiens
agaccaggggttgagtcctagc

SEQ ID NO: 7308945 - DNA, 22 bp, Homo sapiens
atggccagggtggcactgtggt

SEQ ID NO: 7308946 - DNA, 22 bp, Homo sapiens
agagaagagcaatgataaattt

SEQ ID NO: 7308947 - DNA, 18 bp, Homo sapiens
agagaagaggtgttagtc

SEQ ID NO: 7308948 - DNA, 22 bp, Homo sapiens
atggccagcaagttcagaattt

SEQ ID NO: 7308949 - DNA, 19 bp, Homo sapiens
agagaccacagagctgcct

SEQ ID NO: 7308950 - DNA, 22 bp, Homo sapiens
agagacccattgccggaatcac

SEQ ID NO: 7308951 - DNA, 22 bp, Homo sapiens
agagacatgcagttgttgtgaa

SEQ ID NO: 7308952 - DNA, 22 bp, Homo sapiens
agagaagattcttatatgtctt

SEQ ID NO: 7308953 - DNA, 22 bp, Homo sapiens
agagaagagtcttgtcaaatta

SEQ ID NO: 7308954 - DNA, 22 bp, Homo sapiens
agagaaggaaagctgacatggg

SEQ ID NO: 7308955 - DNA, 22 bp, Homo sapiens
agagaccttcctgactccagag

SEQ ID NO: 7308956 - DNA, 22 bp, Homo sapiens
atgtattttaagatttgcctca

SEQ ID NO: 7308957 - DNA, 22 bp, Homo sapiens
atgtatttgcttgttatggatt

SEQ ID NO: 7308958 - DNA, 22 bp, Homo sapiens
atgtatttgcgtatggacatac

SEQ ID NO: 7308959 - DNA, 22 bp, Homo sapiens
atgtgggaaatacaagctaaaa

SEQ ID NO: 7308960 - DNA, 22 bp, Homo sapiens
atgtgggagatttcaggaggtg

SEQ ID NO: 7308961 - DNA, 22 bp, Homo sapiens
atgtgggttgatggaggtgtca

SEQ ID NO: 7308962 - DNA, 22 bp, Homo sapiens
agagcctgtcaattgtaaagag

SEQ ID NO: 7308963 - DNA, 22 bp, Homo sapiens
agagcctgttttgtgggagatg

SEQ ID NO: 7308964 - DNA, 22 bp, Homo sapiens
agagcctgttcggaggcgcccc

SEQ ID NO: 7308965 - DNA, 22 bp, Homo sapiens
atggggggatgaaggagtccaa

SEQ ID NO: 7308966 - DNA, 22 bp, Homo sapiens
atggggggatgaaggagtccaa

SEQ ID NO: 7308967 - DNA, 22 bp, Homo sapiens
atgggggcctgaacaggcaaaa

SEQ ID NO: 7308968 - DNA, 22 bp, Homo sapiens
atgggggcggctgaagcccagg

SEQ ID NO: 7308969 - DNA, 22 bp, Homo sapiens
agagatggccttaggtgggaat

SEQ ID NO: 7308970 - DNA, 22 bp, Homo sapiens
agagatggatgttattatgggt

SEQ ID NO: 7308971 - DNA, 22 bp, Homo sapiens
agagccaatcttcagagcagag

SEQ ID NO: 7308972 - DNA, 22 bp, Homo sapiens
agagccagaccattgccgtgca

SEQ ID NO: 7308973 - DNA, 19 bp, Homo sapiens
agagccagacagcatagga

SEQ ID NO: 7308974 - DNA, 22 bp, Homo sapiens
atgaaatttgaccaattattta

SEQ ID NO: 7308975 - DNA, 22 bp, Homo sapiens
atgaaatttgaccaattattta

SEQ ID NO: 7308976 - DNA, 22 bp, Homo sapiens
atgaaattgatcttgaactttt

SEQ ID NO: 7308977 - DNA, 20 bp, Homo sapiens
atgaaattcctgttttctga

SEQ ID NO: 7308978 - DNA, 23 bp, Homo sapiens
atgaaagttcttaaaatgtcatg

SEQ ID NO: 7308979 - DNA, 23 bp, Homo sapiens
atgaaagttcttaaaatgtcatg

SEQ ID NO: 7308980 - DNA, 22 bp, Homo sapiens
atgaaatttgctgctaagttcc

SEQ ID NO: 7308981 - DNA, 22 bp, Homo sapiens
atgaacaataaaatagatcaca

SEQ ID NO: 7308982 - DNA, 22 bp, Homo sapiens
atgaacaataaaatagatcaca

SEQ ID NO: 7308983 - DNA, 22 bp, Homo sapiens
atgaaagatgatttaaagtact

SEQ ID NO: 7308984 - DNA, 22 bp, Homo sapiens
atgaaactgggataactatagc

SEQ ID NO: 7308985 - DNA, 22 bp, Homo sapiens
atgaaagtagggtaaaatcaca

SEQ ID NO: 7308986 - DNA, 22 bp, Homo sapiens
agacaaatgaacaaatatgtga

SEQ ID NO: 7308987 - DNA, 22 bp, Homo sapiens
agacaaatggagtatgagcaac

SEQ ID NO: 7308988 - DNA, 22 bp, Homo sapiens
agacaaatgaacaaatatgtga

SEQ ID NO: 7308989 - DNA, 22 bp, Homo sapiens
agaagttatccaccttagatgc

SEQ ID NO: 7308990 - DNA, 19 bp, Homo sapiens
agaagttagacattgcaat

SEQ ID NO: 7308991 - DNA, 19 bp, Homo sapiens
agaagttagacattgcaat

SEQ ID NO: 7308992 - DNA, 22 bp, Homo sapiens
agaagttatccaccttagatgc

SEQ ID NO: 7308993 - DNA, 22 bp, Homo sapiens
agaagttaattcctgaaattct

SEQ ID NO: 7308994 - DNA, 22 bp, Homo sapiens
atgaaactaaactacataagtt

SEQ ID NO: 7308995 - DNA, 22 bp, Homo sapiens
atgaaactgaaggacaaccaga

SEQ ID NO: 7308996 - DNA, 22 bp, Homo sapiens
atgaaactctagctttcagcac

SEQ ID NO: 7308997 - DNA, 22 bp, Homo sapiens
atgaaactctaacttaacaagt

SEQ ID NO: 7308998 - DNA, 23 bp, Homo sapiens
atgaaactcaagccagatccaag

SEQ ID NO: 7308999 - DNA, 22 bp, Homo sapiens
agaagtttggatgccatcatag

SEQ ID NO: 7309000 - DNA, 22 bp, Homo sapiens
atctcagacatgttgtccatga

SEQ ID NO: 7309001 - DNA, 22 bp, Homo sapiens
agaagggaactcagagatgatt

SEQ ID NO: 7309002 - DNA, 22 bp, Homo sapiens
atgcactgtaggtgccatctgc

SEQ ID NO: 7309003 - DNA, 22 bp, Homo sapiens
atgcacatgtatctatatacaa

SEQ ID NO: 7309004 - DNA, 22 bp, Homo sapiens
atgcacatgtatgtcaatattt

SEQ ID NO: 7309005 - DNA, 22 bp, Homo sapiens
atgcacctgaactccatcagct

SEQ ID NO: 7309006 - DNA, 22 bp, Homo sapiens
atgacaaattcagaccatagca

SEQ ID NO: 7309007 - DNA, 22 bp, Homo sapiens
atgcaagacataaataatcttt

SEQ ID NO: 7309008 - DNA, 22 bp, Homo sapiens
atgacaaaagaagacatgaggt

SEQ ID NO: 7309009 - DNA, 22 bp, Homo sapiens
atgacaaaatgaatgcagctag

SEQ ID NO: 7309010 - DNA, 22 bp, Homo sapiens
atgacaaacccaggatgtaaca

SEQ ID NO: 7309011 - DNA, 22 bp, Homo sapiens
atgacaaaggctgaaagggaaa

SEQ ID NO: 7309012 - DNA, 23 bp, Homo sapiens
atgacaaacaggacatcttgtgc

SEQ ID NO: 7309013 - DNA, 23 bp, Homo sapiens
atgacaaacaggacatcttgtgc

SEQ ID NO: 7309014 - DNA, 22 bp, Homo sapiens
agacagcagggagcaggattca

SEQ ID NO: 7309015 - DNA, 22 bp, Homo sapiens
agacagcatgatacatgatgct

SEQ ID NO: 7309016 - DNA, 22 bp, Homo sapiens
agacatttattcacacatttat

SEQ ID NO: 7309017 - DNA, 22 bp, Homo sapiens
agacatttattgaacacctagc

SEQ ID NO: 7309018 - DNA, 22 bp, Homo sapiens
agacatattggcttgctttaat

SEQ ID NO: 7309019 - DNA, 22 bp, Homo sapiens
agacatatggtgaaacatttta

SEQ ID NO: 7309020 - DNA, 22 bp, Homo sapiens
agacatttggaagatacacata

SEQ ID NO: 7309021 - DNA, 22 bp, Homo sapiens
agacatttggagccaactttcc

SEQ ID NO: 7309022 - DNA, 22 bp, Homo sapiens
agacatttggagccaactttcc

SEQ ID NO: 7309023 - DNA, 22 bp, Homo sapiens
agacatttggaagatacacata

SEQ ID NO: 7309024 - DNA, 20 bp, Homo sapiens
acctgccacagagaaaggta

SEQ ID NO: 7309025 - DNA, 22 bp, Homo sapiens
acctgcaggggtgctctctggg

SEQ ID NO: 7309026 - DNA, 22 bp, Homo sapiens
acctgatatgtttgatcaccct

SEQ ID NO: 7309027 - DNA, 22 bp, Homo sapiens
acctcctgatgagagtaaagga

SEQ ID NO: 7309028 - DNA, 22 bp, Homo sapiens
acctgaatccccagggccttcc

SEQ ID NO: 7309029 - DNA, 20 bp, Homo sapiens
acctcctggaagcaggtgcc

SEQ ID NO: 7309030 - DNA, 22 bp, Homo sapiens
acctctggccttcaggcatcat

SEQ ID NO: 7309031 - DNA, 22 bp, Homo sapiens
acctggagtcatttgaggagta

SEQ ID NO: 7309032 - DNA, 20 bp, Homo sapiens
acctggctctcaggagcaac

SEQ ID NO: 7309033 - DNA, 22 bp, Homo sapiens
acctggccatccagctggcatc

SEQ ID NO: 7309034 - DNA, 22 bp, Homo sapiens
agtcaactgcattaggaaatga

SEQ ID NO: 7309035 - DNA, 23 bp, Homo sapiens
actcagctttgggagatgactca

SEQ ID NO: 7309036 - DNA, 22 bp, Homo sapiens
agtatttcttcatatgattact

SEQ ID NO: 7309037 - DNA, 22 bp, Homo sapiens
agtatttcttcatatgattact

SEQ ID NO: 7309038 - DNA, 22 bp, Homo sapiens
agtatttgatcagatgatagta

SEQ ID NO: 7309039 - DNA, 22 bp, Homo sapiens
agtcaaacaaatgtttattgag

SEQ ID NO: 7309040 - DNA, 22 bp, Homo sapiens
agtattttcgccatcacaagaa

SEQ ID NO: 7309041 - DNA, 22 bp, Homo sapiens
actagtctgccagggagaggca

SEQ ID NO: 7309042 - DNA, 22 bp, Homo sapiens
agtatatagtggcgctgtatgc

SEQ ID NO: 7309043 - DNA, 22 bp, Homo sapiens
agtatttcttcatatgattact

SEQ ID NO: 7309044 - DNA, 22 bp, Homo sapiens
actaggggctcaggcccaggga

SEQ ID NO: 7309045 - DNA, 22 bp, Homo sapiens
acgcagcacaaaggaaaggatc

SEQ ID NO: 7309046 - DNA, 22 bp, Homo sapiens
acgattgtggacctgggacagt

SEQ ID NO: 7309047 - DNA, 22 bp, Homo sapiens
acggaaggctggagaagtacca

SEQ ID NO: 7309048 - DNA, 22 bp, Homo sapiens
agtaaaattaatggatcagaag

SEQ ID NO: 7309049 - DNA, 22 bp, Homo sapiens
agtaaaattaatggatcagaag

SEQ ID NO: 7309050 - DNA, 22 bp, Homo sapiens
agtaaaatcttaagcacagtgg

SEQ ID NO: 7309051 - DNA, 22 bp, Homo sapiens
agtaaaatcttaagcacagtgg

SEQ ID NO: 7309052 - DNA, 22 bp, Homo sapiens
agtaaaatttctgctgaggaga

SEQ ID NO: 7309053 - DNA, 22 bp, Homo sapiens
agtaaaattgtattggaaaaca

SEQ ID NO: 7309054 - DNA, 22 bp, Homo sapiens
actggaaaaccactgaaatgag

SEQ ID NO: 7309055 - DNA, 22 bp, Homo sapiens
actggaaaattcaaatggggtc

SEQ ID NO: 7309056 - DNA, 22 bp, Homo sapiens
actggaaaacactactacatgc

SEQ ID NO: 7309057 - DNA, 22 bp, Homo sapiens
actggaaaggctctgaatggga

SEQ ID NO: 7309058 - DNA, 22 bp, Homo sapiens
actggaaagttgattatgtcca

SEQ ID NO: 7309059 - DNA, 21 bp, Homo sapiens
agtgtgtgataggcaggaaga

SEQ ID NO: 7309060 - DNA, 22 bp, Homo sapiens
actggaagccagttgacaatca

SEQ ID NO: 7309061 - DNA, 22 bp, Homo sapiens
agtgtatacttttagtagaatt

SEQ ID NO: 7309062 - DNA, 22 bp, Homo sapiens
agtgtatgtcaagtatatacac

SEQ ID NO: 7309063 - DNA, 22 bp, Homo sapiens
actgctttatctgagaagtcct

SEQ ID NO: 7309064 - DNA, 22 bp, Homo sapiens
agtgtttaaactgaagtgatga

SEQ ID NO: 7309065 - DNA, 21 bp, Homo sapiens
agtgtgtgataggcaggaaga

SEQ ID NO: 7309066 - DNA, 18 bp, Homo sapiens
actggctttagcatcaga

SEQ ID NO: 7309067 - DNA, 23 bp, Homo sapiens
actggctttgatccagatagatt

SEQ ID NO: 7309068 - DNA, 22 bp, Homo sapiens
actggctttgagggaatagcta

SEQ ID NO: 7309069 - DNA, 22 bp, Homo sapiens
agtgtacatgtttacagcatct

SEQ ID NO: 7309070 - DNA, 22 bp, Homo sapiens
agtgtacattctgtttgaggta

SEQ ID NO: 7309071 - DNA, 22 bp, Homo sapiens
agtgtacatcagaacatatcaa

SEQ ID NO: 7309072 - DNA, 22 bp, Homo sapiens
agtgtacatagttaggaacatc

SEQ ID NO: 7309073 - DNA, 22 bp, Homo sapiens
agtgtacatcagaacatatcaa

SEQ ID NO: 7309074 - DNA, 22 bp, Homo sapiens
agtgtacatcagaacatatcaa

SEQ ID NO: 7309075 - DNA, 22 bp, Homo sapiens
agtgtacatgtacacattagta

SEQ ID NO: 7309076 - DNA, 22 bp, Homo sapiens
agtgtacagttctatgaatttc

SEQ ID NO: 7309077 - DNA, 22 bp, Homo sapiens
agtgtacactaaatgaatacaa

SEQ ID NO: 7309078 - DNA, 22 bp, Homo sapiens
agtgtacaagaccttattgttg

SEQ ID NO: 7309079 - DNA, 22 bp, Homo sapiens
actcttcacttcccctgccagc

SEQ ID NO: 7309080 - DNA, 22 bp, Homo sapiens
actcttcagggcagtgagcggg

SEQ ID NO: 7309081 - DNA, 22 bp, Homo sapiens
actcttcagtacaataatatct

SEQ ID NO: 7309082 - DNA, 22 bp, Homo sapiens
actcttcacacttgtctccagg

SEQ ID NO: 7309083 - DNA, 22 bp, Homo sapiens
actcttcaccgctactgaaata

SEQ ID NO: 7309084 - DNA, 22 bp, Homo sapiens
actcttcaagggcctagaggtg

SEQ ID NO: 7309085 - DNA, 22 bp, Homo sapiens
actcttcacacatgctgccctc

SEQ ID NO: 7309086 - DNA, 22 bp, Homo sapiens
agtgcatgcgcttgggaggggt

SEQ ID NO: 7309087 - DNA, 22 bp, Homo sapiens
agtgcatgcgcttgggaggggt

SEQ ID NO: 7309088 - DNA, 22 bp, Homo sapiens
agtgcatgccttcctgtggatg

SEQ ID NO: 7309089 - DNA, 22 bp, Homo sapiens
agtgcatgaaagcatacaaggc

SEQ ID NO: 7309090 - DNA, 22 bp, Homo sapiens
agtgcatgccttcctgtggatg

SEQ ID NO: 7309091 - DNA, 22 bp, Homo sapiens
agtgcatacccttctaaaaagt

SEQ ID NO: 7309092 - DNA, 20 bp, Homo sapiens
agtgcatggagggagagggc

SEQ ID NO: 7309093 - DNA, 22 bp, Homo sapiens
agtgcatggtcaagctaaacca

SEQ ID NO: 7309094 - DNA, 19 bp, Homo sapiens
agtgcatgggcgaggtgca

SEQ ID NO: 7309095 - DNA, 22 bp, Homo sapiens
agtgcatgtatctacagtcaca

SEQ ID NO: 7309096 - DNA, 23 bp, Homo sapiens
agtgcatgcttgacttagcaagc

SEQ ID NO: 7309097 - DNA, 18 bp, Homo sapiens
agtgcatgctaggggaag

SEQ ID NO: 7309098 - DNA, 20 bp, Homo sapiens
agtgcatggagggagagggc

SEQ ID NO: 7309099 - DNA, 22 bp, Homo sapiens
agtgcatgttcactggcatggt

SEQ ID NO: 7309100 - DNA, 22 bp, Homo sapiens
agtgcatgtccagtagtttatg

SEQ ID NO: 7309101 - DNA, 19 bp, Homo sapiens
agtcttgtatttttcaagc

SEQ ID NO: 7309102 - DNA, 22 bp, Homo sapiens
agtctttagagtcttagtgttt

SEQ ID NO: 7309103 - DNA, 22 bp, Homo sapiens
actcggccatggcgccccggcc

SEQ ID NO: 7309104 - DNA, 22 bp, Homo sapiens
actcctgggttctaaatttgaa

SEQ ID NO: 7309105 - DNA, 22 bp, Homo sapiens
actcctgggttgcagtcctcaa

SEQ ID NO: 7309106 - DNA, 17 bp, Homo sapiens
actcctggtctgaaggg

SEQ ID NO: 7309107 - DNA, 20 bp, Homo sapiens
actcctggtaacttttgtga

SEQ ID NO: 7309108 - DNA, 22 bp, Homo sapiens
actcctggtgctgatgaagaga

SEQ ID NO: 7309109 - DNA, 22 bp, Homo sapiens
actcctggttcccagttgagat

SEQ ID NO: 7309110 - DNA, 22 bp, Homo sapiens
actcctggttcccagttgagat

SEQ ID NO: 7309111 - DNA, 22 bp, Homo sapiens
actcctggtttgtgtcctggct

SEQ ID NO: 7309112 - DNA, 23 bp, Homo sapiens
atctaaagtgttaaatagctggg

SEQ ID NO: 7309113 - DNA, 22 bp, Homo sapiens
atctatttctgctaataacaat

SEQ ID NO: 7309114 - DNA, 22 bp, Homo sapiens
atctcacactgggtttgagggt

SEQ ID NO: 7309115 - DNA, 20 bp, Homo sapiens
atcggcttgcctggaaacaa

SEQ ID NO: 7309116 - DNA, 22 bp, Homo sapiens
atcatccaagcgtagttcttct

SEQ ID NO: 7309117 - DNA, 22 bp, Homo sapiens
agaaagtgcttccctttggact

SEQ ID NO: 7309118 - DNA, 22 bp, Homo sapiens
agaaagggtcactgaaagagga

SEQ ID NO: 7309119 - DNA, 22 bp, Homo sapiens
agaaagggtcactgaaagagga

SEQ ID NO: 7309120 - DNA, 22 bp, Homo sapiens
agaaagggctattttgaggtag

SEQ ID NO: 7309121 - DNA, 22 bp, Homo sapiens
agaaagggttctctgaggtgct

SEQ ID NO: 7309122 - DNA, 22 bp, Homo sapiens
agaaattaggaaagtaacactt

SEQ ID NO: 7309123 - DNA, 22 bp, Homo sapiens
agaaagtttattcctatctagc

SEQ ID NO: 7309124 - DNA, 22 bp, Homo sapiens
atatttcacgtaggttgttttc

SEQ ID NO: 7309125 - DNA, 22 bp, Homo sapiens
atatttcagctttacttaggaa

SEQ ID NO: 7309126 - DNA, 22 bp, Homo sapiens
atatttcagctttacttaggaa

SEQ ID NO: 7309127 - DNA, 22 bp, Homo sapiens
agaaagctccccatgagatgat

SEQ ID NO: 7309128 - DNA, 21 bp, Homo sapiens
atatttctcataaggttatgg

SEQ ID NO: 7309129 - DNA, 22 bp, Homo sapiens
atatttcatggggttccatact

SEQ ID NO: 7309130 - DNA, 22 bp, Homo sapiens
atattcttatccttttctctgt

SEQ ID NO: 7309131 - DNA, 22 bp, Homo sapiens
atattctgggttagatatgttt

SEQ ID NO: 7309132 - DNA, 22 bp, Homo sapiens
atattcattgaacacctactac

SEQ ID NO: 7309133 - DNA, 22 bp, Homo sapiens
atattccagttatatcaaatca

SEQ ID NO: 7309134 - DNA, 22 bp, Homo sapiens
atattccattggtttcccttct

SEQ ID NO: 7309135 - DNA, 22 bp, Homo sapiens
actttctattgtttagattctg

SEQ ID NO: 7309136 - DNA, 22 bp, Homo sapiens
actttctattcccacagagata

SEQ ID NO: 7309137 - DNA, 22 bp, Homo sapiens
actttcatttgtaataaacttc

SEQ ID NO: 7309138 - DNA, 22 bp, Homo sapiens
actttcaagcaagaacactttg

SEQ ID NO: 7309139 - DNA, 22 bp, Homo sapiens
actttcaagccctctagagaca

SEQ ID NO: 7309140 - DNA, 22 bp, Homo sapiens
actttcaattcactgagatata

SEQ ID NO: 7309141 - DNA, 22 bp, Homo sapiens
actttcaattcccttagcaact

SEQ ID NO: 7309142 - DNA, 22 bp, Homo sapiens
actttcagaattgtacagagtc

SEQ ID NO: 7309143 - DNA, 22 bp, Homo sapiens
atatgaaagtaagcatgtgtgt

SEQ ID NO: 7309144 - DNA, 22 bp, Homo sapiens
atatgcttacagcttaaaatcc

SEQ ID NO: 7309145 - DNA, 22 bp, Homo sapiens
atatgcttacagcttaaaatcc

SEQ ID NO: 7309146 - DNA, 22 bp, Homo sapiens
atatggacttaaaatttgatgt

SEQ ID NO: 7309147 - DNA, 22 bp, Homo sapiens
agaaaaggttgaaagtaggatt

SEQ ID NO: 7309148 - DNA, 22 bp, Homo sapiens
agaaaaggttgaaagtaggatt

SEQ ID NO: 7309149 - DNA, 22 bp, Homo sapiens
ataaaatttgctactgttaaat

SEQ ID NO: 7309150 - DNA, 22 bp, Homo sapiens
ataaaatttgctactgttaaat

SEQ ID NO: 7309151 - DNA, 22 bp, Homo sapiens
actgtgagtgatttccttctgg

SEQ ID NO: 7309152 - DNA, 22 bp, Homo sapiens
ataatgaatgcagagttatttt

SEQ ID NO: 7309153 - DNA, 22 bp, Homo sapiens
actgtgcatctattgccattta

SEQ ID NO: 7309154 - DNA, 22 bp, Homo sapiens
actgtgcatctattgccattta

SEQ ID NO: 7309155 - DNA, 22 bp, Homo sapiens
actgggaagacaagaaagatag

SEQ ID NO: 7309156 - DNA, 22 bp, Homo sapiens
actgggaagacaagaaagatag

SEQ ID NO: 7309157 - DNA, 22 bp, Homo sapiens
actgggaagactggaattgctc

SEQ ID NO: 7309158 - DNA, 22 bp, Homo sapiens
ataaaaactgacccatcctttg

SEQ ID NO: 7309159 - DNA, 22 bp, Homo sapiens
actgtcagggatcatgaaagct

SEQ ID NO: 7309160 - DNA, 22 bp, Homo sapiens
actgtcaggatggcagcttgtt

SEQ ID NO: 7309161 - DNA, 22 bp, Homo sapiens
atacaggttctctagggaacag

SEQ ID NO: 7309162 - DNA, 22 bp, Homo sapiens
atacaggtggaactaaataaat

SEQ ID NO: 7309163 - DNA, 19 bp, Homo sapiens
acttctgaggaactgcaca

SEQ ID NO: 7309164 - DNA, 22 bp, Homo sapiens
atacagggacatccagtttttc

SEQ ID NO: 7309165 - DNA, 22 bp, Homo sapiens
atacaggtaggggacatacatc

SEQ ID NO: 7309166 - DNA, 22 bp, Homo sapiens
atacagattgctatacttacaa

SEQ ID NO: 7309167 - DNA, 22 bp, Homo sapiens
atacagcttacagttctaatgc

SEQ ID NO: 7309168 - DNA, 22 bp, Homo sapiens
atacagcagtgaataagataaa

SEQ ID NO: 7309169 - DNA, 22 bp, Homo sapiens
atacagcagtgaataagataaa

SEQ ID NO: 7309170 - DNA, 22 bp, Homo sapiens
atacagatgttgaatgttatat

SEQ ID NO: 7309171 - DNA, 22 bp, Homo sapiens
atacacttgtacattttttaat

SEQ ID NO: 7309172 - DNA, 22 bp, Homo sapiens
atacagatgttaaagcaatttc

SEQ ID NO: 7309173 - DNA, 22 bp, Homo sapiens
acttagaaagggattctagatt

SEQ ID NO: 7309174 - DNA, 22 bp, Homo sapiens
acttaatcattctctctgcttt

SEQ ID NO: 7309175 - DNA, 22 bp, Homo sapiens
acttaaatagaactcctcaata

SEQ ID NO: 7309176 - DNA, 22 bp, Homo sapiens
acttaaatagaactcctcaata

SEQ ID NO: 7309177 - DNA, 23 bp, Homo sapiens
acttaaatggttctttatctcag

SEQ ID NO: 7309178 - DNA, 23 bp, Homo sapiens
acttaaatggttctttatctcag

SEQ ID NO: 7309179 - DNA, 21 bp, Homo sapiens
acttaaattccttgatattta

SEQ ID NO: 7309180 - DNA, 20 bp, Homo sapiens
acttaacaccgactaatgat

SEQ ID NO: 7309181 - DNA, 22 bp, Homo sapiens
actttcaaaagagaagtcatga

SEQ ID NO: 7309182 - DNA, 22 bp, Homo sapiens
atactgtgtaaaatttgaacct

SEQ ID NO: 7309183 - DNA, 22 bp, Homo sapiens
atactgctgctgctgaaatcac

SEQ ID NO: 7309184 - DNA, 22 bp, Homo sapiens
atactgattgatattcccatga

SEQ ID NO: 7309185 - DNA, 22 bp, Homo sapiens
acttctgtaaagggaagacagt

SEQ ID NO: 7309186 - DNA, 22 bp, Homo sapiens
atacatgttcgtgtacatgttc

SEQ ID NO: 7309187 - DNA, 22 bp, Homo sapiens
atacatctatgcctttctgaca

SEQ ID NO: 7309188 - DNA, 22 bp, Homo sapiens
atacatgtttgctggataaaca

SEQ ID NO: 7309189 - DNA, 22 bp, Homo sapiens
atacatgttgtaccatatgttt

SEQ ID NO: 7309190 - DNA, 22 bp, Homo sapiens
atacatgttgtaccatatgttt

SEQ ID NO: 7309191 - DNA, 22 bp, Homo sapiens
atacatgttgtaccatatgttt

SEQ ID NO: 7309192 - DNA, 22 bp, Homo sapiens
atacatgttgagaaaatatctg

SEQ ID NO: 7309193 - DNA, 22 bp, Homo sapiens
atacattattgttaaagaacat

SEQ ID NO: 7309194 - DNA, 22 bp, Homo sapiens
aggacacactgttctcacgtaa

SEQ ID NO: 7309195 - DNA, 22 bp, Homo sapiens
aggacacacaaagagtgagaac

SEQ ID NO: 7309196 - DNA, 22 bp, Homo sapiens
acaggggacctaggaccctcgg

SEQ ID NO: 7309197 - DNA, 22 bp, Homo sapiens
aggaagaatgtttacatatcaa

SEQ ID NO: 7309198 - DNA, 23 bp, Homo sapiens
aggaagagagagtgcctctttct

SEQ ID NO: 7309199 - DNA, 23 bp, Homo sapiens
aggaagagagagtgcctctttct

SEQ ID NO: 7309200 - DNA, 22 bp, Homo sapiens
aggaagaaactgagctctgaca

SEQ ID NO: 7309201 - DNA, 21 bp, Homo sapiens
aggaagaaaggttggaggttg

SEQ ID NO: 7309202 - DNA, 22 bp, Homo sapiens
aggaagaaactgagctctgaca

SEQ ID NO: 7309203 - DNA, 22 bp, Homo sapiens
aggaagaaactgagctctgaca

SEQ ID NO: 7309204 - DNA, 22 bp, Homo sapiens
aggaagaaacctactagagttt

SEQ ID NO: 7309205 - DNA, 21 bp, Homo sapiens
aggaagaaaggttggaggttg

SEQ ID NO: 7309206 - DNA, 22 bp, Homo sapiens
aggaagaaatgtgacttcaaac

SEQ ID NO: 7309207 - DNA, 22 bp, Homo sapiens
aggaagaacagataatggacgc

SEQ ID NO: 7309208 - DNA, 22 bp, Homo sapiens
aggaagaacagataatggacgc

SEQ ID NO: 7309209 - DNA, 22 bp, Homo sapiens
aggaagaacctaagaaagtctc

SEQ ID NO: 7309210 - DNA, 22 bp, Homo sapiens
aggaagaacctaagaaagtctc

SEQ ID NO: 7309211 - DNA, 22 bp, Homo sapiens
aggaagaacctaagaaagtctc

SEQ ID NO: 7309212 - DNA, 22 bp, Homo sapiens
aggaagaacctaagaaagtctc

SEQ ID NO: 7309213 - DNA, 22 bp, Homo sapiens
aggaagaacctaagaaagtctc

SEQ ID NO: 7309214 - DNA, 22 bp, Homo sapiens
acagggaagttctgcaacagga

SEQ ID NO: 7309215 - DNA, 22 bp, Homo sapiens
acaggcagattaagggtaggca

SEQ ID NO: 7309216 - DNA, 22 bp, Homo sapiens
agctgagacacttgagagacta

SEQ ID NO: 7309217 - DNA, 22 bp, Homo sapiens
agctgaagggaggatatgtaca

SEQ ID NO: 7309218 - DNA, 21 bp, Homo sapiens
acagctggccgcgcgggtcgg

SEQ ID NO: 7309219 - DNA, 22 bp, Homo sapiens
acaggagtttctgacagagaca

SEQ ID NO: 7309220 - DNA, 22 bp, Homo sapiens
acaggagtttaagaaatatttc

SEQ ID NO: 7309221 - DNA, 22 bp, Homo sapiens
acagtttattgcacaggtaacc

SEQ ID NO: 7309222 - DNA, 21 bp, Homo sapiens
acagtttattagagtaagtgc

SEQ ID NO: 7309223 - DNA, 22 bp, Homo sapiens
acagtttataaaaataatgagg

SEQ ID NO: 7309224 - DNA, 20 bp, Homo sapiens
acagtttatccagttagcag

SEQ ID NO: 7309225 - DNA, 22 bp, Homo sapiens
acatagcttaaatgagaagata

SEQ ID NO: 7309226 - DNA, 22 bp, Homo sapiens
acatagcataaagaatgactct

SEQ ID NO: 7309227 - DNA, 22 bp, Homo sapiens
acatagcataaagaatgactct

SEQ ID NO: 7309228 - DNA, 22 bp, Homo sapiens
acatagcacgtctcaatttgga

SEQ ID NO: 7309229 - DNA, 22 bp, Homo sapiens
acatagtaagtgctcagtaaat

SEQ ID NO: 7309230 - DNA, 22 bp, Homo sapiens
acatagatggggtgtcatgtca

SEQ ID NO: 7309231 - DNA, 22 bp, Homo sapiens
acatatttccatgcagcatgtc

SEQ ID NO: 7309232 - DNA, 22 bp, Homo sapiens
acatatttccatgcagcatgtc

SEQ ID NO: 7309233 - DNA, 22 bp, Homo sapiens
acatatttccatgcagcatgtc

SEQ ID NO: 7309234 - DNA, 22 bp, Homo sapiens
acatattaactgcactacacta

SEQ ID NO: 7309235 - DNA, 22 bp, Homo sapiens
aggcagctggaggcagagacta

SEQ ID NO: 7309236 - DNA, 22 bp, Homo sapiens
acatatattttcacacatggtt

SEQ ID NO: 7309237 - DNA, 22 bp, Homo sapiens
acatatattttcacacatggtt

SEQ ID NO: 7309238 - DNA, 22 bp, Homo sapiens
acatatgttgtaaacattccaa

SEQ ID NO: 7309239 - DNA, 19 bp, Homo sapiens
acagtcagggaataaagac

SEQ ID NO: 7309240 - DNA, 22 bp, Homo sapiens
acagtctgcttgtctccatggt

SEQ ID NO: 7309241 - DNA, 22 bp, Homo sapiens
acagtctgcatatgacctgtag

SEQ ID NO: 7309242 - DNA, 22 bp, Homo sapiens
acagtgtggggtgagatggaac

SEQ ID NO: 7309243 - DNA, 23 bp, Homo sapiens
acagtgtggtggacaaggagcag

SEQ ID NO: 7309244 - DNA, 22 bp, Homo sapiens
acagtgtggtttgagcactggg

SEQ ID NO: 7309245 - DNA, 22 bp, Homo sapiens
aggacacagacttagatttaaa

SEQ ID NO: 7309246 - DNA, 22 bp, Homo sapiens
aggacacagctcttcagtaaga

SEQ ID NO: 7309247 - DNA, 22 bp, Homo sapiens
aggagcagaccgtagtcctgca

SEQ ID NO: 7309248 - DNA, 22 bp, Homo sapiens
acagtacaccactgtgtacagt

SEQ ID NO: 7309249 - DNA, 22 bp, Homo sapiens
aggagcactgagccagcatggg

SEQ ID NO: 7309250 - DNA, 22 bp, Homo sapiens
aggagcaaatgatgagacagca

SEQ ID NO: 7309251 - DNA, 22 bp, Homo sapiens
acatgcttccaaattatgttgg

SEQ ID NO: 7309252 - DNA, 22 bp, Homo sapiens
acatgcatacaagcacatgtag

SEQ ID NO: 7309253 - DNA, 22 bp, Homo sapiens
acatgccagaacttgtaccaat

SEQ ID NO: 7309254 - DNA, 22 bp, Homo sapiens
acatgccagcccatttaaatgg

SEQ ID NO: 7309255 - DNA, 21 bp, Homo sapiens
acatcagagttgtgaaggtag

SEQ ID NO: 7309256 - DNA, 22 bp, Homo sapiens
acatcagagggctcacatgatc

SEQ ID NO: 7309257 - DNA, 22 bp, Homo sapiens
acatcagagggctcacatgatc

SEQ ID NO: 7309258 - DNA, 22 bp, Homo sapiens
acatcacagtagttaagccaga

SEQ ID NO: 7309259 - DNA, 22 bp, Homo sapiens
acatattttgaaagctttctaa

SEQ ID NO: 7309260 - DNA, 22 bp, Homo sapiens
acatattttgaaagctttctaa

SEQ ID NO: 7309261 - DNA, 22 bp, Homo sapiens
acatcacacgccttccaggagg

SEQ ID NO: 7309262 - DNA, 22 bp, Homo sapiens
acatcacagagcccagataaag

SEQ ID NO: 7309263 - DNA, 22 bp, Homo sapiens
acatcacagagcccagataaag

SEQ ID NO: 7309264 - DNA, 21 bp, Homo sapiens
acatccagggtcctcactgcc

SEQ ID NO: 7309265 - DNA, 22 bp, Homo sapiens
acatccagtatcagaagcatca

SEQ ID NO: 7309266 - DNA, 22 bp, Homo sapiens
acatccactatccttgcttgtt

SEQ ID NO: 7309267 - DNA, 22 bp, Homo sapiens
acatcattttcttcagtgtttg

SEQ ID NO: 7309268 - DNA, 22 bp, Homo sapiens
acatcatttgtctgtagctgaa

SEQ ID NO: 7309269 - DNA, 19 bp, Homo sapiens
acatgttttgcagaacagc

SEQ ID NO: 7309270 - DNA, 22 bp, Homo sapiens
acatgtttgataaatatttggg

SEQ ID NO: 7309271 - DNA, 22 bp, Homo sapiens
acatgtttaagtttgttatatg

SEQ ID NO: 7309272 - DNA, 22 bp, Homo sapiens
acatgtttacattaggtgatat

SEQ ID NO: 7309273 - DNA, 22 bp, Homo sapiens
acatgtttaagtttgttatatg

SEQ ID NO: 7309274 - DNA, 22 bp, Homo sapiens
acatgtttaagtttaatgaaaa

SEQ ID NO: 7309275 - DNA, 22 bp, Homo sapiens
aggccaggcgagacacccggct

SEQ ID NO: 7309276 - DNA, 22 bp, Homo sapiens
aggccaggggtgagcacttctg

SEQ ID NO: 7309277 - DNA, 22 bp, Homo sapiens
acatgttagctactattgttat

SEQ ID NO: 7309278 - DNA, 22 bp, Homo sapiens
acatgttagaaatgcagaatct

SEQ ID NO: 7309279 - DNA, 22 bp, Homo sapiens
acatgttgtttgccccagttgt

SEQ ID NO: 7309280 - DNA, 22 bp, Homo sapiens
acatgttagggacagagtatgt

SEQ ID NO: 7309281 - DNA, 22 bp, Homo sapiens
acatgtgtaagatgtgatatat

SEQ ID NO: 7309282 - DNA, 22 bp, Homo sapiens
acatgtgtaagatgtgatatat

SEQ ID NO: 7309283 - DNA, 22 bp, Homo sapiens
acatgtgttttcctacttatga

SEQ ID NO: 7309284 - DNA, 22 bp, Homo sapiens
acatgtgttttcctacttatga

SEQ ID NO: 7309285 - DNA, 22 bp, Homo sapiens
acatttgattgatgaatcaaat

SEQ ID NO: 7309286 - DNA, 22 bp, Homo sapiens
acatttgattgatgaatcaaat

SEQ ID NO: 7309287 - DNA, 22 bp, Homo sapiens
acatttgaggatgttaagaatg

SEQ ID NO: 7309288 - DNA, 22 bp, Homo sapiens
acatttgataattataaagaca

SEQ ID NO: 7309289 - DNA, 22 bp, Homo sapiens
acatttgactctgttcatatta

SEQ ID NO: 7309290 - DNA, 22 bp, Homo sapiens
acatttgagcatctactaagtg

SEQ ID NO: 7309291 - DNA, 20 bp, Homo sapiens
acatttgaagtcgcatttct

SEQ ID NO: 7309292 - DNA, 22 bp, Homo sapiens
acatttgacatttagtatcagc

SEQ ID NO: 7309293 - DNA, 22 bp, Homo sapiens
acatttgaaattctgaacagat

SEQ ID NO: 7309294 - DNA, 22 bp, Homo sapiens
acatttgaaatgccatgtgagg

SEQ ID NO: 7309295 - DNA, 22 bp, Homo sapiens
acatttgaaataaactcaagtg

SEQ ID NO: 7309296 - DNA, 22 bp, Homo sapiens
acatttcttttcatctctatat

SEQ ID NO: 7309297 - DNA, 22 bp, Homo sapiens
acatttctcagggagttttgct

SEQ ID NO: 7309298 - DNA, 18 bp, Homo sapiens
acatttctatgcttctgg

SEQ ID NO: 7309299 - DNA, 22 bp, Homo sapiens
acatttctttctattcagtagc

SEQ ID NO: 7309300 - DNA, 22 bp, Homo sapiens
acatttctttctattcagtagc

SEQ ID NO: 7309301 - DNA, 22 bp, Homo sapiens
acatttcttttcatctctatat

SEQ ID NO: 7309302 - DNA, 18 bp, Homo sapiens
aggcctgcccagcactgt

SEQ ID NO: 7309303 - DNA, 22 bp, Homo sapiens
acattgcaattaggtacctatg

SEQ ID NO: 7309304 - DNA, 22 bp, Homo sapiens
acattgatgtgatgcagaagtg

SEQ ID NO: 7309305 - DNA, 22 bp, Homo sapiens
acattgtataatgattatcaca

SEQ ID NO: 7309306 - DNA, 22 bp, Homo sapiens
acatttcagaatcacacagctt

SEQ ID NO: 7309307 - DNA, 22 bp, Homo sapiens
acattgtagacttttcatatgt

SEQ ID NO: 7309308 - DNA, 22 bp, Homo sapiens
acattgtagacttttcatatgt

SEQ ID NO: 7309309 - DNA, 22 bp, Homo sapiens
acattgtaagcatattagctga

SEQ ID NO: 7309310 - DNA, 22 bp, Homo sapiens
acatttctaatttaatgtaaca

SEQ ID NO: 7309311 - DNA, 22 bp, Homo sapiens
acatttctatagtgcatctgtt

SEQ ID NO: 7309312 - DNA, 22 bp, Homo sapiens
acatttctatcatcctgtaatg

SEQ ID NO: 7309313 - DNA, 22 bp, Homo sapiens
acatttctatcatcctgtaatg

SEQ ID NO: 7309314 - DNA, 22 bp, Homo sapiens
acatttctagttgttcatctcc

SEQ ID NO: 7309315 - DNA, 22 bp, Homo sapiens
acatttctagttgttcatctcc

SEQ ID NO: 7309316 - DNA, 22 bp, Homo sapiens
accaggcctggctgggcagcca

SEQ ID NO: 7309317 - DNA, 22 bp, Homo sapiens
accaggctccccttggatcctg

SEQ ID NO: 7309318 - DNA, 22 bp, Homo sapiens
accaggctctgccagtgtttac

SEQ ID NO: 7309319 - DNA, 22 bp, Homo sapiens
accaggctctgccagtgtttac

SEQ ID NO: 7309320 - DNA, 22 bp, Homo sapiens
accaggctggagtgcagtggcg

SEQ ID NO: 7309321 - DNA, 22 bp, Homo sapiens
agggctgccccagtccagccgg

SEQ ID NO: 7309322 - DNA, 22 bp, Homo sapiens
agggggctcagcaggctctgga

SEQ ID NO: 7309323 - DNA, 22 bp, Homo sapiens
accagctcagagcaggctcctg

SEQ ID NO: 7309324 - DNA, 18 bp, Homo sapiens
agggagagaccgcgggtc

SEQ ID NO: 7309325 - DNA, 22 bp, Homo sapiens
accagctcttctgctctagttg

SEQ ID NO: 7309326 - DNA, 22 bp, Homo sapiens
accagctctctagccctggtcc

SEQ ID NO: 7309327 - DNA, 22 bp, Homo sapiens
agggcagcagcggcccaggcct

SEQ ID NO: 7309328 - DNA, 22 bp, Homo sapiens
agggcagcagctcctcctagct

SEQ ID NO: 7309329 - DNA, 22 bp, Homo sapiens
agggcagcacaaggcatggact

SEQ ID NO: 7309330 - DNA, 22 bp, Homo sapiens
agggagacaaaagcagctgcca

SEQ ID NO: 7309331 - DNA, 22 bp, Homo sapiens
agggagacacatgaggaagtca

SEQ ID NO: 7309332 - DNA, 22 bp, Homo sapiens
acatttgtatttggtgagtggt

SEQ ID NO: 7309333 - DNA, 22 bp, Homo sapiens
acatttgtatgcgtttttactg

SEQ ID NO: 7309334 - DNA, 20 bp, Homo sapiens
acatttgtatctcccagtgg

SEQ ID NO: 7309335 - DNA, 22 bp, Homo sapiens
acatttgtatatatgcagcata

SEQ ID NO: 7309336 - DNA, 21 bp, Homo sapiens
accagcaggagatcagaagga

SEQ ID NO: 7309337 - DNA, 22 bp, Homo sapiens
accagcagttatgaggccagga

SEQ ID NO: 7309338 - DNA, 22 bp, Homo sapiens
aggaccctgagcgggcatgccg

SEQ ID NO: 7309339 - DNA, 22 bp, Homo sapiens
aggacctactgatatcttagca

SEQ ID NO: 7309340 - DNA, 22 bp, Homo sapiens
aggaccataagtagggcatgtg

SEQ ID NO: 7309341 - DNA, 22 bp, Homo sapiens
aggaccatcctaaggtaggcaa

SEQ ID NO: 7309342 - DNA, 22 bp, Homo sapiens
aggaccaccggtccatccaccc

SEQ ID NO: 7309343 - DNA, 22 bp, Homo sapiens
caggtgggaccatgatagggca

SEQ ID NO: 7309344 - DNA, 22 bp, Homo sapiens
caggtgcacattactgtgttgg

SEQ ID NO: 7309345 - DNA, 22 bp, Homo sapiens
caggtgcacttgctttgtgttt

SEQ ID NO: 7309346 - DNA, 22 bp, Homo sapiens
aggactaaagggagcctagact

SEQ ID NO: 7309347 - DNA, 22 bp, Homo sapiens
aggactgaaaatgagttcttct

SEQ ID NO: 7309348 - DNA, 21 bp, Homo sapiens
cagtgctcaggaatagagaga

SEQ ID NO: 7309349 - DNA, 19 bp, Homo sapiens
aggagaagtagcagaaatt

SEQ ID NO: 7309350 - DNA, 22 bp, Homo sapiens
cagttctggaggctccacatct

SEQ ID NO: 7309351 - DNA, 22 bp, Homo sapiens
cagttctgagctttcccagaag

SEQ ID NO: 7309352 - DNA, 22 bp, Homo sapiens
cagtggcgtgatctctgctcac

SEQ ID NO: 7309353 - DNA, 22 bp, Homo sapiens
cagttttagggcaatgtgaaga

SEQ ID NO: 7309354 - DNA, 22 bp, Homo sapiens
cagttttatacactgcagctcc

SEQ ID NO: 7309355 - DNA, 22 bp, Homo sapiens
cagttttacccaagcttatttt

SEQ ID NO: 7309356 - DNA, 22 bp, Homo sapiens
cagttttagctagagcaaacca

SEQ ID NO: 7309357 - DNA, 22 bp, Homo sapiens
cagttttacccaagcttatttt

SEQ ID NO: 7309358 - DNA, 22 bp, Homo sapiens
cagttttaggacatgtggatgt

SEQ ID NO: 7309359 - DNA, 22 bp, Homo sapiens
cagttttaaattgttagataat

SEQ ID NO: 7309360 - DNA, 16 bp, Homo sapiens
cagttttaaggcccaa

SEQ ID NO: 7309361 - DNA, 22 bp, Homo sapiens
cagttttaaattttgaatgtct

SEQ ID NO: 7309362 - DNA, 22 bp, Homo sapiens
cagttttaaattgttagataat

SEQ ID NO: 7309363 - DNA, 22 bp, Homo sapiens
cagtttcagaatcaaaacatca

SEQ ID NO: 7309364 - DNA, 22 bp, Homo sapiens
catattctgttggtcacataga

SEQ ID NO: 7309365 - DNA, 16 bp, Homo sapiens
catattgctgaaagag

SEQ ID NO: 7309366 - DNA, 22 bp, Homo sapiens
catattgctgtcattgtccctc

SEQ ID NO: 7309367 - DNA, 23 bp, Homo sapiens
catattcaaaactggaccactct

SEQ ID NO: 7309368 - DNA, 23 bp, Homo sapiens
catattcaaaactggaccactct

SEQ ID NO: 7309369 - DNA, 22 bp, Homo sapiens
catattcaaggggtaaggcaaa

SEQ ID NO: 7309370 - DNA, 22 bp, Homo sapiens
aggagggagcttaagccaggca

SEQ ID NO: 7309371 - DNA, 22 bp, Homo sapiens
catacattacctaacttaatgc

SEQ ID NO: 7309372 - DNA, 22 bp, Homo sapiens
catacatatgtggatgtcatat

SEQ ID NO: 7309373 - DNA, 22 bp, Homo sapiens
cagttttatgtcgaatgtatac

SEQ ID NO: 7309374 - DNA, 22 bp, Homo sapiens
cagttttatcatctgtgaaatg

SEQ ID NO: 7309375 - DNA, 22 bp, Homo sapiens
cagttttatgaatgcttattag

SEQ ID NO: 7309376 - DNA, 22 bp, Homo sapiens
cagttttatgaatgcttattag

SEQ ID NO: 7309377 - DNA, 22 bp, Homo sapiens
catagacattgataggttatat

SEQ ID NO: 7309378 - DNA, 22 bp, Homo sapiens
catataaatacaacatgtgtta

SEQ ID NO: 7309379 - DNA, 22 bp, Homo sapiens
cataggctcttcagagaactga

SEQ ID NO: 7309380 - DNA, 22 bp, Homo sapiens
catgttttgtgtacagaatatt

SEQ ID NO: 7309381 - DNA, 22 bp, Homo sapiens
cattaacaaatggaagcatgaa

SEQ ID NO: 7309382 - DNA, 22 bp, Homo sapiens
cattttaaatgatttaagccaa

SEQ ID NO: 7309383 - DNA, 22 bp, Homo sapiens
cattaacaattgtttatgctgt

SEQ ID NO: 7309384 - DNA, 22 bp, Homo sapiens
cattaacaattgtttatgctgt

SEQ ID NO: 7309385 - DNA, 22 bp, Homo sapiens
cattaacaattgtttatgctgt

SEQ ID NO: 7309386 - DNA, 22 bp, Homo sapiens
cattaacaatgactgcttgact

SEQ ID NO: 7309387 - DNA, 22 bp, Homo sapiens
catttgaaattcttagaacaaa

SEQ ID NO: 7309388 - DNA, 22 bp, Homo sapiens
ccaatcctgatctaatccaact

SEQ ID NO: 7309389 - DNA, 22 bp, Homo sapiens
ccaatcttatctttattttcta

SEQ ID NO: 7309390 - DNA, 22 bp, Homo sapiens
ccaagtcctgctgccactctac

SEQ ID NO: 7309391 - DNA, 22 bp, Homo sapiens
ccaagtactctcaccaaagctt

SEQ ID NO: 7309392 - DNA, 22 bp, Homo sapiens
ccaagtacagattcctccactg

SEQ ID NO: 7309393 - DNA, 22 bp, Homo sapiens
ccaaggggattgcagaagcagc

SEQ ID NO: 7309394 - DNA, 22 bp, Homo sapiens
ccaaggagaaatgctgtgcttt

SEQ ID NO: 7309395 - DNA, 22 bp, Homo sapiens
ccaaggagaaatgctgtgcttt

SEQ ID NO: 7309396 - DNA, 23 bp, Homo sapiens
aggcagcaggttgtccagggtga

SEQ ID NO: 7309397 - DNA, 22 bp, Homo sapiens
ccaagataatctgtgaaaaatc

SEQ ID NO: 7309398 - DNA, 22 bp, Homo sapiens
aggagggcaggctggctgccta

SEQ ID NO: 7309399 - DNA, 22 bp, Homo sapiens
catggatatattgtacagtagc

SEQ ID NO: 7309400 - DNA, 22 bp, Homo sapiens
catggacatatgagacctttcc

SEQ ID NO: 7309401 - DNA, 22 bp, Homo sapiens
catggacaacctccattcgagt

SEQ ID NO: 7309402 - DNA, 22 bp, Homo sapiens
catggacagtgggacagtgtgt

SEQ ID NO: 7309403 - DNA, 22 bp, Homo sapiens
aggatgttcgggtcacatagcc

SEQ ID NO: 7309404 - DNA, 22 bp, Homo sapiens
aggattctgatctgagctgttt

SEQ ID NO: 7309405 - DNA, 22 bp, Homo sapiens
catgtacattctgtagatggag

SEQ ID NO: 7309406 - DNA, 22 bp, Homo sapiens
catgtataggtccatagtgaat

SEQ ID NO: 7309407 - DNA, 22 bp, Homo sapiens
catgtatagcaaatatttgttc

SEQ ID NO: 7309408 - DNA, 22 bp, Homo sapiens
catgtatagacactcatacagt

SEQ ID NO: 7309409 - DNA, 22 bp, Homo sapiens
catgtatacagtagaatactat

SEQ ID NO: 7309410 - DNA, 22 bp, Homo sapiens
catgtataagcgctaggagtgc

SEQ ID NO: 7309411 - DNA, 22 bp, Homo sapiens
catgtccacagttctgagaggc

SEQ ID NO: 7309412 - DNA, 22 bp, Homo sapiens
catgtccatttatgcacagaaa

SEQ ID NO: 7309413 - DNA, 22 bp, Homo sapiens
catgtatatttctgtatgtgca

SEQ ID NO: 7309414 - DNA, 22 bp, Homo sapiens
catgtatagttggaactacatc

SEQ ID NO: 7309415 - DNA, 22 bp, Homo sapiens
catggggagacacctagggaaa

SEQ ID NO: 7309416 - DNA, 22 bp, Homo sapiens
catggggatgaggctgagactt

SEQ ID NO: 7309417 - DNA, 23 bp, Homo sapiens
catggggagcagtgctcctgacc

SEQ ID NO: 7309418 - DNA, 23 bp, Homo sapiens
catggggagcagtgctcctgacc

SEQ ID NO: 7309419 - DNA, 22 bp, Homo sapiens
caggtgaggctgaacagatgaa

SEQ ID NO: 7309420 - DNA, 22 bp, Homo sapiens
caggtgagtaacaatgggtgat

SEQ ID NO: 7309421 - DNA, 22 bp, Homo sapiens
caggtgagtttgctattgtaca

SEQ ID NO: 7309422 - DNA, 22 bp, Homo sapiens
caggtgagttttcctccttggt

SEQ ID NO: 7309423 - DNA, 22 bp, Homo sapiens
caggtgagaggcggtcctgcat

SEQ ID NO: 7309424 - DNA, 22 bp, Homo sapiens
caggtgagctctatctagggag

SEQ ID NO: 7309425 - DNA, 20 bp, Homo sapiens
caggtgagcagatctgggtg

SEQ ID NO: 7309426 - DNA, 22 bp, Homo sapiens
cagggtgcgggagatgtgcacc

SEQ ID NO: 7309427 - DNA, 22 bp, Homo sapiens
caggggctgagaaggaacgtcc

SEQ ID NO: 7309428 - DNA, 22 bp, Homo sapiens
caggggctgtggcacatggtgt

SEQ ID NO: 7309429 - DNA, 22 bp, Homo sapiens
caggggctgtgggcggagcctc

SEQ ID NO: 7309430 - DNA, 22 bp, Homo sapiens
caggggctgagaaggaacgtcc

SEQ ID NO: 7309431 - DNA, 22 bp, Homo sapiens
caggggctctgagattgtctaa

SEQ ID NO: 7309432 - DNA, 22 bp, Homo sapiens
caggggctgaaatgttggggtt

SEQ ID NO: 7309433 - DNA, 22 bp, Homo sapiens
caggggctctgggtgatgtgag

SEQ ID NO: 7309434 - DNA, 22 bp, Homo sapiens
caggggctctaatgcatgatca

SEQ ID NO: 7309435 - DNA, 22 bp, Homo sapiens
cagggtgagcctctggagccct

SEQ ID NO: 7309436 - DNA, 22 bp, Homo sapiens
cagggtgcagagctagggtagt

SEQ ID NO: 7309437 - DNA, 22 bp, Homo sapiens
cagggtgcatacccatgcatac

SEQ ID NO: 7309438 - DNA, 23 bp, Homo sapiens
cagggtgaccaatgtggccatca

SEQ ID NO: 7309439 - DNA, 22 bp, Homo sapiens
cagggtgactgccctggccact

SEQ ID NO: 7309440 - DNA, 22 bp, Homo sapiens
caggggctgtttgcctcaggcc

SEQ ID NO: 7309441 - DNA, 22 bp, Homo sapiens
cagggcctcctaaggcatctaa

SEQ ID NO: 7309442 - DNA, 22 bp, Homo sapiens
cagggcctgagggctgctctgc

SEQ ID NO: 7309443 - DNA, 22 bp, Homo sapiens
cagggcctgcctggttcctgga

SEQ ID NO: 7309444 - DNA, 22 bp, Homo sapiens
cagggcctgcaagagacctggg

SEQ ID NO: 7309445 - DNA, 22 bp, Homo sapiens
cagggcctcgaagcctctgggc

SEQ ID NO: 7309446 - DNA, 22 bp, Homo sapiens
cagggcctctgtgggctctctc

SEQ ID NO: 7309447 - DNA, 22 bp, Homo sapiens
cagggctcgctgccagcttcag

SEQ ID NO: 7309448 - DNA, 22 bp, Homo sapiens
caggggctccctgggtgccagt

SEQ ID NO: 7309449 - DNA, 22 bp, Homo sapiens
caggggctagcacttaatgttt

SEQ ID NO: 7309450 - DNA, 22 bp, Homo sapiens
cagggctccctgcagcctctgt

SEQ ID NO: 7309451 - DNA, 22 bp, Homo sapiens
caggctggagttacctttaggg

SEQ ID NO: 7309452 - DNA, 22 bp, Homo sapiens
cagggagctattagggttagtg

SEQ ID NO: 7309453 - DNA, 22 bp, Homo sapiens
cagggagctggtgccagccgac

SEQ ID NO: 7309454 - DNA, 22 bp, Homo sapiens
cagggagctggtgccagccgac

SEQ ID NO: 7309455 - DNA, 22 bp, Homo sapiens
cagggagctggtgccagccgac

SEQ ID NO: 7309456 - DNA, 22 bp, Homo sapiens
cagggagctattagggttagtg

SEQ ID NO: 7309457 - DNA, 22 bp, Homo sapiens
cagggagctggctggctgtgcc

SEQ ID NO: 7309458 - DNA, 22 bp, Homo sapiens
cagggagctggctggctgtgcc

SEQ ID NO: 7309459 - DNA, 22 bp, Homo sapiens
caggctgcggccgtgtgagcat

SEQ ID NO: 7309460 - DNA, 22 bp, Homo sapiens
agctgtggcagcagccgtggca

SEQ ID NO: 7309461 - DNA, 22 bp, Homo sapiens
agctgtggaagactgtcagggt

SEQ ID NO: 7309462 - DNA, 22 bp, Homo sapiens
agctgtggaagactgtcagggt

SEQ ID NO: 7309463 - DNA, 22 bp, Homo sapiens
agctgtggcagcactttggagt

SEQ ID NO: 7309464 - DNA, 22 bp, Homo sapiens
agctgtggcaaccttgtcagac

SEQ ID NO: 7309465 - DNA, 22 bp, Homo sapiens
agctgtggattgggtactttct

SEQ ID NO: 7309466 - DNA, 22 bp, Homo sapiens
caggctcagccacaggggaagg

SEQ ID NO: 7309467 - DNA, 22 bp, Homo sapiens
agctgctgcggaaagatgccac

SEQ ID NO: 7309468 - DNA, 22 bp, Homo sapiens
agctgctgcgcctcaccctggc

SEQ ID NO: 7309469 - DNA, 22 bp, Homo sapiens
agctgctgccggtggccaccct

SEQ ID NO: 7309470 - DNA, 22 bp, Homo sapiens
caggaagggggatccttggaag

SEQ ID NO: 7309471 - DNA, 22 bp, Homo sapiens
caggaaggggctcactctggcc

SEQ ID NO: 7309472 - DNA, 22 bp, Homo sapiens
caggaagagaacatggaggctg

SEQ ID NO: 7309473 - DNA, 22 bp, Homo sapiens
caggaagagaacatggaggctg

SEQ ID NO: 7309474 - DNA, 22 bp, Homo sapiens
cagctgagaaatggggaaaggg

SEQ ID NO: 7309475 - DNA, 22 bp, Homo sapiens
cagctgagaccagaatgcaggt

SEQ ID NO: 7309476 - DNA, 22 bp, Homo sapiens
cagctctgtaaattccttcatc

SEQ ID NO: 7309477 - DNA, 22 bp, Homo sapiens
cagctctgtctgtagaaacttc

SEQ ID NO: 7309478 - DNA, 22 bp, Homo sapiens
cagctctggttcctgggcccag

SEQ ID NO: 7309479 - DNA, 22 bp, Homo sapiens
cagctctgggtgacaggagggc

SEQ ID NO: 7309480 - DNA, 22 bp, Homo sapiens
cagctctgggtaggaggaatct

SEQ ID NO: 7309481 - DNA, 22 bp, Homo sapiens
cagctctggggcagagtgacta

SEQ ID NO: 7309482 - DNA, 22 bp, Homo sapiens
ccagggtcttggagaggagtgc

SEQ ID NO: 7309483 - DNA, 22 bp, Homo sapiens
ccagggtgagtgtcatgggtta

SEQ ID NO: 7309484 - DNA, 22 bp, Homo sapiens
ccagggtgaggaggctcccacg

SEQ ID NO: 7309485 - DNA, 22 bp, Homo sapiens
ccagggtgagaaaaggctggat

SEQ ID NO: 7309486 - DNA, 22 bp, Homo sapiens
ccagggtcttggagaggagtgc

SEQ ID NO: 7309487 - DNA, 17 bp, Homo sapiens
ccagggaggggccgcgc

SEQ ID NO: 7309488 - DNA, 21 bp, Homo sapiens
ccatgtcagatgtgggctgtg

SEQ ID NO: 7309489 - DNA, 18 bp, Homo sapiens
cccactgtccccacaggc

SEQ ID NO: 7309490 - DNA, 16 bp, Homo sapiens
cccactgtctggtctt

SEQ ID NO: 7309491 - DNA, 22 bp, Homo sapiens
cccactgtctgttcccagggcc

SEQ ID NO: 7309492 - DNA, 22 bp, Homo sapiens
aggctgaggtgtgctgtgatcg

SEQ ID NO: 7309493 - DNA, 20 bp, Homo sapiens
ccagctttccctgcagcatc

SEQ ID NO: 7309494 - DNA, 22 bp, Homo sapiens
aggccctggcccccagagattc

SEQ ID NO: 7309495 - DNA, 22 bp, Homo sapiens
ccagcctccatgtagatagctg

SEQ ID NO: 7309496 - DNA, 22 bp, Homo sapiens
ccagcctgaaatgcctcatcct

SEQ ID NO: 7309497 - DNA, 22 bp, Homo sapiens
ccagcctcatcgcctgcctgtc

SEQ ID NO: 7309498 - DNA, 17 bp, Homo sapiens
aggccagatgaggcaag

SEQ ID NO: 7309499 - DNA, 19 bp, Homo sapiens
ccagctggcctgggacctc

SEQ ID NO: 7309500 - DNA, 22 bp, Homo sapiens
aggcccagagcaggaaagggtt

SEQ ID NO: 7309501 - DNA, 22 bp, Homo sapiens
aggcccagcccgtcctcgtgct

SEQ ID NO: 7309502 - DNA, 19 bp, Homo sapiens
aggcccagcgctgggggct

SEQ ID NO: 7309503 - DNA, 22 bp, Homo sapiens
aggcagggtgatgataatgatt

SEQ ID NO: 7309504 - DNA, 22 bp, Homo sapiens
ccacagcttcgcagtctgctgc

SEQ ID NO: 7309505 - DNA, 22 bp, Homo sapiens
aggcagggtcttgctatgttgc

SEQ ID NO: 7309506 - DNA, 22 bp, Homo sapiens
aggcaggggagctggaagggta

SEQ ID NO: 7309507 - DNA, 22 bp, Homo sapiens
ccagcagagggcgcttcacacc

SEQ ID NO: 7309508 - DNA, 22 bp, Homo sapiens
agggctcataattcctgacttc

SEQ ID NO: 7309509 - DNA, 22 bp, Homo sapiens
agggctcatctgagactgacat

SEQ ID NO: 7309510 - DNA, 23 bp, Homo sapiens
agggcctcaggagggctgcatgg

SEQ ID NO: 7309511 - DNA, 22 bp, Homo sapiens
agggccctctgggcactgtggc

SEQ ID NO: 7309512 - DNA, 22 bp, Homo sapiens
agggccctccccgctcagggca

SEQ ID NO: 7309513 - DNA, 22 bp, Homo sapiens
agggccctaaggaaggcacaca

SEQ ID NO: 7309514 - DNA, 22 bp, Homo sapiens
agggccctagggaatgagacat

SEQ ID NO: 7309515 - DNA, 22 bp, Homo sapiens
agggccctccccgctcagggca

SEQ ID NO: 7309516 - DNA, 22 bp, Homo sapiens
cctccccacgggcagccggcgc

SEQ ID NO: 7309517 - DNA, 22 bp, Homo sapiens
ccctggaggctggaggcagtag

SEQ ID NO: 7309518 - DNA, 22 bp, Homo sapiens
agggccagagtacatcagggct

SEQ ID NO: 7309519 - DNA, 22 bp, Homo sapiens
agggccagaggcaccttgcagc

SEQ ID NO: 7309520 - DNA, 16 bp, Homo sapiens
agggccagaagcatca

SEQ ID NO: 7309521 - DNA, 22 bp, Homo sapiens
agggccagaatccctcagtcta

SEQ ID NO: 7309522 - DNA, 21 bp, Homo sapiens
ccctttctccatacttcatcc

SEQ ID NO: 7309523 - DNA, 22 bp, Homo sapiens
ccctttcttccgtgacttctgc

SEQ ID NO: 7309524 - DNA, 22 bp, Homo sapiens
agggccagagtctgtgtagata

SEQ ID NO: 7309525 - DNA, 22 bp, Homo sapiens
ccgcccacactaaatatgagcg

SEQ ID NO: 7309526 - DNA, 22 bp, Homo sapiens
cctgaggattgttggtgcttcc

SEQ ID NO: 7309527 - DNA, 22 bp, Homo sapiens
cctgaggatattcaccagcatg

SEQ ID NO: 7309528 - DNA, 22 bp, Homo sapiens
cctgaggagattgtggctgggg

SEQ ID NO: 7309529 - DNA, 22 bp, Homo sapiens
cctgaggaccagcacccatctg

SEQ ID NO: 7309530 - DNA, 22 bp, Homo sapiens
cctgaggacacacgctgcagga

SEQ ID NO: 7309531 - DNA, 22 bp, Homo sapiens
cctgaggacacacgctgcagga

SEQ ID NO: 7309532 - DNA, 22 bp, Homo sapiens
aggggagaaaaatgccttctgt

SEQ ID NO: 7309533 - DNA, 22 bp, Homo sapiens
cctcctggagcattggtgagga

SEQ ID NO: 7309534 - DNA, 22 bp, Homo sapiens
cctcctggagcattggtgagga

SEQ ID NO: 7309535 - DNA, 22 bp, Homo sapiens
cctcctggaaaaattccctggc

SEQ ID NO: 7309536 - DNA, 22 bp, Homo sapiens
cctcctggaggctctaagggag

SEQ ID NO: 7309537 - DNA, 22 bp, Homo sapiens
cctcctggccctgggcctggaa

SEQ ID NO: 7309538 - DNA, 22 bp, Homo sapiens
cctcctggaggctctagggaaa

SEQ ID NO: 7309539 - DNA, 22 bp, Homo sapiens
cctcctggatggatttggtgga

SEQ ID NO: 7309540 - DNA, 22 bp, Homo sapiens
agggatgctgtgatacatcctt

SEQ ID NO: 7309541 - DNA, 22 bp, Homo sapiens
agggatgcctcattttaagtga

SEQ ID NO: 7309542 - DNA, 22 bp, Homo sapiens
agggatgcccagataattggta

SEQ ID NO: 7309543 - DNA, 22 bp, Homo sapiens
agggatgctgctaagtggtcta

SEQ ID NO: 7309544 - DNA, 22 bp, Homo sapiens
agggagtgttacataatgggtt

SEQ ID NO: 7309545 - DNA, 22 bp, Homo sapiens
agggagtgtaaatggtgctcag

SEQ ID NO: 7309546 - DNA, 22 bp, Homo sapiens
agggatgatcagggtagaggct

SEQ ID NO: 7309547 - DNA, 22 bp, Homo sapiens
agggagaaaattggatgcacaa

SEQ ID NO: 7309548 - DNA, 22 bp, Homo sapiens
agggagtggttaagaaggtgca

SEQ ID NO: 7309549 - DNA, 22 bp, Homo sapiens
agggagtgtaaatggtgctcag

SEQ ID NO: 7309550 - DNA, 22 bp, Homo sapiens
agggaggagtcctcaaagtcat

SEQ ID NO: 7309551 - DNA, 22 bp, Homo sapiens
ccctggaggaccccaatgtggc

SEQ ID NO: 7309552 - DNA, 22 bp, Homo sapiens
cccaggagttggaggctacggt

SEQ ID NO: 7309553 - DNA, 22 bp, Homo sapiens
aggcttctgtttcttaaaggtg

SEQ ID NO: 7309554 - DNA, 22 bp, Homo sapiens
aggcttctctgcaagatgttaa

SEQ ID NO: 7309555 - DNA, 23 bp, Homo sapiens
agggaagaaacatgaagggctgt

SEQ ID NO: 7309556 - DNA, 22 bp, Homo sapiens
agggaagaagctggtagtaggt

SEQ ID NO: 7309557 - DNA, 22 bp, Homo sapiens
cccagggcttgagtcatccatg

SEQ ID NO: 7309558 - DNA, 22 bp, Homo sapiens
cccagggctgtagaatgtccaa

SEQ ID NO: 7309559 - DNA, 22 bp, Homo sapiens
cccagggcttttctcactagac

SEQ ID NO: 7309560 - DNA, 22 bp, Homo sapiens
ctgtatgttccgttttgtcact

SEQ ID NO: 7309561 - DNA, 21 bp, Homo sapiens
ctgtattaacttttgcacctt

SEQ ID NO: 7309562 - DNA, 22 bp, Homo sapiens
ctgtattagccaggtgcacaag

SEQ ID NO: 7309563 - DNA, 22 bp, Homo sapiens
ctgtattattttcttagctctg

SEQ ID NO: 7309564 - DNA, 22 bp, Homo sapiens
ctgtatttcccacattctctat

SEQ ID NO: 7309565 - DNA, 22 bp, Homo sapiens
ctgtaattcactagggtcagcg

SEQ ID NO: 7309566 - DNA, 22 bp, Homo sapiens
atattttgaagttaataatgtg

SEQ ID NO: 7309567 - DNA, 22 bp, Homo sapiens
atattttggcaaatgtctagat

SEQ ID NO: 7309568 - DNA, 22 bp, Homo sapiens
ctgtatggtccacgtgggtgcc

SEQ ID NO: 7309569 - DNA, 22 bp, Homo sapiens
atatttgttgagttcttatgat

SEQ ID NO: 7309570 - DNA, 22 bp, Homo sapiens
atatttgttgagttcttatgat

SEQ ID NO: 7309571 - DNA, 22 bp, Homo sapiens
atatttgttagagtctatgtgt

SEQ ID NO: 7309572 - DNA, 22 bp, Homo sapiens
atatttgttagagtctatgtgt

SEQ ID NO: 7309573 - DNA, 22 bp, Homo sapiens
atatttgtttggcagagttcag

SEQ ID NO: 7309574 - DNA, 22 bp, Homo sapiens
atattttcacagaacttgcaaa

SEQ ID NO: 7309575 - DNA, 22 bp, Homo sapiens
atattttgaagttaataatgtg

SEQ ID NO: 7309576 - DNA, 22 bp, Homo sapiens
ctggggaggcagggctgcccct

SEQ ID NO: 7309577 - DNA, 22 bp, Homo sapiens
ctggtggaatggcagagggaac

SEQ ID NO: 7309578 - DNA, 22 bp, Homo sapiens
ctggtggaagcctgggctcaga

SEQ ID NO: 7309579 - DNA, 22 bp, Homo sapiens
atatcacagctctttcattgct

SEQ ID NO: 7309580 - DNA, 22 bp, Homo sapiens
atatcacagtagttgtttagtt

SEQ ID NO: 7309581 - DNA, 22 bp, Homo sapiens
atatcacagtagttgtttagtt

SEQ ID NO: 7309582 - DNA, 22 bp, Homo sapiens
atatcataaatcggtgcatgaa

SEQ ID NO: 7309583 - DNA, 22 bp, Homo sapiens
atatcatgttctctgtgtgtca

SEQ ID NO: 7309584 - DNA, 22 bp, Homo sapiens
atatcactagagaagttgttaa

SEQ ID NO: 7309585 - DNA, 22 bp, Homo sapiens
atatcattatgttatgagcaca

SEQ ID NO: 7309586 - DNA, 22 bp, Homo sapiens
atatcacaaacaagtctgtact

SEQ ID NO: 7309587 - DNA, 23 bp, Homo sapiens
atatcacacccagtacagtctcc

SEQ ID NO: 7309588 - DNA, 22 bp, Homo sapiens
atatcaaacgaagttattttaa

SEQ ID NO: 7309589 - DNA, 22 bp, Homo sapiens
atatattttgcggtcacgtggc

SEQ ID NO: 7309590 - DNA, 22 bp, Homo sapiens
atatattttgcggtcacgtggc

SEQ ID NO: 7309591 - DNA, 22 bp, Homo sapiens
atatattttttgagacagagtc

SEQ ID NO: 7309592 - DNA, 22 bp, Homo sapiens
atatatgtgcaggctcacacat

SEQ ID NO: 7309593 - DNA, 19 bp, Homo sapiens
atatatgtatacaatgtgg

SEQ ID NO: 7309594 - DNA, 22 bp, Homo sapiens
ctgggcctggacgggcagatct

SEQ ID NO: 7309595 - DNA, 22 bp, Homo sapiens
ctgggccatggaagtctctgcc

SEQ ID NO: 7309596 - DNA, 22 bp, Homo sapiens
atctcattctcccgtgccatgg

SEQ ID NO: 7309597 - DNA, 22 bp, Homo sapiens
atctcagtcaggttgaatttgg

SEQ ID NO: 7309598 - DNA, 22 bp, Homo sapiens
atctcataaacacacatatatg

SEQ ID NO: 7309599 - DNA, 22 bp, Homo sapiens
atctcccagccacagcattctt

SEQ ID NO: 7309600 - DNA, 22 bp, Homo sapiens
atctgcatttgaacaagctcct

SEQ ID NO: 7309601 - DNA, 21 bp, Homo sapiens
atctggaagaactggtaagtg

SEQ ID NO: 7309602 - DNA, 22 bp, Homo sapiens
cttcatgagtgtacaacctgtg

SEQ ID NO: 7309603 - DNA, 22 bp, Homo sapiens
cttcatgatcctaccacattga

SEQ ID NO: 7309604 - DNA, 22 bp, Homo sapiens
cttcatgagggtaatctacaaa

SEQ ID NO: 7309605 - DNA, 22 bp, Homo sapiens
cttcatgatgaccaactgccat

SEQ ID NO: 7309606 - DNA, 22 bp, Homo sapiens
cttcatgacccataaaaattta

SEQ ID NO: 7309607 - DNA, 22 bp, Homo sapiens
cttcatgaggaagatttcacaa

SEQ ID NO: 7309608 - DNA, 22 bp, Homo sapiens
cttcataatctgaaatttgtaa

SEQ ID NO: 7309609 - DNA, 22 bp, Homo sapiens
atccttccagagttattctcaa

SEQ ID NO: 7309610 - DNA, 22 bp, Homo sapiens
ctgtttcaaagggtactgtgag

SEQ ID NO: 7309611 - DNA, 22 bp, Homo sapiens
ctgtttcagctactgttccatg

SEQ ID NO: 7309612 - DNA, 22 bp, Homo sapiens
ctgtttctccacactcttccca

SEQ ID NO: 7309613 - DNA, 22 bp, Homo sapiens
cttcagaatccagaatcagaat

SEQ ID NO: 7309614 - DNA, 22 bp, Homo sapiens
cttcagatattaatatcaatta

SEQ ID NO: 7309615 - DNA, 22 bp, Homo sapiens
cttcagatccctctgccactgt

SEQ ID NO: 7309616 - DNA, 22 bp, Homo sapiens
cttcagaggggactcaaagtca

SEQ ID NO: 7309617 - DNA, 22 bp, Homo sapiens
cttcagagcatcacttcagctg

SEQ ID NO: 7309618 - DNA, 22 bp, Homo sapiens
ctgttattaaaaagctcaggct

SEQ ID NO: 7309619 - DNA, 22 bp, Homo sapiens
ctgttaggcatgtgtgcgtgca

SEQ ID NO: 7309620 - DNA, 22 bp, Homo sapiens
ctgttagtaatgaagagaatgg

SEQ ID NO: 7309621 - DNA, 22 bp, Homo sapiens
ctgttactggacgcacgcagct

SEQ ID NO: 7309622 - DNA, 22 bp, Homo sapiens
ctgttatttctgaatgccatcc

SEQ ID NO: 7309623 - DNA, 22 bp, Homo sapiens
ctgttatttatgctgctccatt

SEQ ID NO: 7309624 - DNA, 22 bp, Homo sapiens
ctgttatttctgccaggtgagt

SEQ ID NO: 7309625 - DNA, 22 bp, Homo sapiens
ctgttatttgctggaagagttt

SEQ ID NO: 7309626 - DNA, 22 bp, Homo sapiens
ctgtttattacgtaattaatat

SEQ ID NO: 7309627 - DNA, 22 bp, Homo sapiens
atcattatcctcctatttgcct

SEQ ID NO: 7309628 - DNA, 22 bp, Homo sapiens
atcattagttgtggaattcttg

SEQ ID NO: 7309629 - DNA, 22 bp, Homo sapiens
ctgtgtgtgaacacagcccagc

SEQ ID NO: 7309630 - DNA, 22 bp, Homo sapiens
ctgtgtgtgaacacagcccagc

SEQ ID NO: 7309631 - DNA, 22 bp, Homo sapiens
ctgtgtgtgaacacagcccagc

SEQ ID NO: 7309632 - DNA, 22 bp, Homo sapiens
ctgttactcctttggcagatta

SEQ ID NO: 7309633 - DNA, 22 bp, Homo sapiens
ctgtgcctccaagtggtctctg

SEQ ID NO: 7309634 - DNA, 22 bp, Homo sapiens
ctgtgccttctgcctggaacat

SEQ ID NO: 7309635 - DNA, 22 bp, Homo sapiens
ctgtgcgttgtgaaatgtttag

SEQ ID NO: 7309636 - DNA, 22 bp, Homo sapiens
ctgtgcgtaagtagccaaaata

SEQ ID NO: 7309637 - DNA, 22 bp, Homo sapiens
ctgtgcctccagtctcgcttct

SEQ ID NO: 7309638 - DNA, 22 bp, Homo sapiens
ctgtgcctccctttactttgag

SEQ ID NO: 7309639 - DNA, 22 bp, Homo sapiens
ctgtgcctgcaggccacatcaa

SEQ ID NO: 7309640 - DNA, 22 bp, Homo sapiens
ctgtgcctgccttgttcactga

SEQ ID NO: 7309641 - DNA, 22 bp, Homo sapiens
atcaggaagtctgccacaaggc

SEQ ID NO: 7309642 - DNA, 22 bp, Homo sapiens
atcaggaatcttttgtcagaca

SEQ ID NO: 7309643 - DNA, 19 bp, Homo sapiens
ctgtgtcacatttatgaaa

SEQ ID NO: 7309644 - DNA, 22 bp, Homo sapiens
ctgtgtattgaaaaagggttaa

SEQ ID NO: 7309645 - DNA, 22 bp, Homo sapiens
ctgtgtatctctgtgggacaga

SEQ ID NO: 7309646 - DNA, 22 bp, Homo sapiens
ctgtgtatgactccagagggta

SEQ ID NO: 7309647 - DNA, 22 bp, Homo sapiens
ctgtgggagcacatgacagata

SEQ ID NO: 7309648 - DNA, 22 bp, Homo sapiens
ctgtgggagcacatgacagata

SEQ ID NO: 7309649 - DNA, 22 bp, Homo sapiens
ctgtgggagcacatgacagata

SEQ ID NO: 7309650 - DNA, 21 bp, Homo sapiens
atcagggatgggttggacacc

SEQ ID NO: 7309651 - DNA, 22 bp, Homo sapiens
atacagaagcctgtatttctgg

SEQ ID NO: 7309652 - DNA, 22 bp, Homo sapiens
ctggaagaccccccaggactca

SEQ ID NO: 7309653 - DNA, 23 bp, Homo sapiens
ctggaacatagtagatggtcaga

SEQ ID NO: 7309654 - DNA, 22 bp, Homo sapiens
ctggaacagtgttggagcttga

SEQ ID NO: 7309655 - DNA, 22 bp, Homo sapiens
ctggaacagaagcactggagag

SEQ ID NO: 7309656 - DNA, 22 bp, Homo sapiens
atacatgactcacacattctgc

SEQ ID NO: 7309657 - DNA, 22 bp, Homo sapiens
atacatctcatgtaagagataa

SEQ ID NO: 7309658 - DNA, 22 bp, Homo sapiens
atacatctggatgtatgcattt

SEQ ID NO: 7309659 - DNA, 20 bp, Homo sapiens
ataatttaccctgcaccact

SEQ ID NO: 7309660 - DNA, 22 bp, Homo sapiens
ataatgtttcagtactgtctgt

SEQ ID NO: 7309661 - DNA, 22 bp, Homo sapiens
ataatgtttcagtactgtctgt

SEQ ID NO: 7309662 - DNA, 22 bp, Homo sapiens
ataatgttgatgattgtctttg

SEQ ID NO: 7309663 - DNA, 22 bp, Homo sapiens
ctggccagggtgcgatcgtggt

SEQ ID NO: 7309664 - DNA, 22 bp, Homo sapiens
ctggccagtgactgctcacccg

SEQ ID NO: 7309665 - DNA, 22 bp, Homo sapiens
atacttttaattccttctgagt

SEQ ID NO: 7309666 - DNA, 22 bp, Homo sapiens
atactttgctacattgtacatt

SEQ ID NO: 7309667 - DNA, 22 bp, Homo sapiens
atagtacacatcctacaatgtt

SEQ ID NO: 7309668 - DNA, 22 bp, Homo sapiens
atagcagtgacattttaatgtg

SEQ ID NO: 7309669 - DNA, 22 bp, Homo sapiens
atagacacagatctatatatgt

SEQ ID NO: 7309670 - DNA, 22 bp, Homo sapiens
atagacacagatctatatatgt

SEQ ID NO: 7309671 - DNA, 22 bp, Homo sapiens
atagacacatgttattatactt

SEQ ID NO: 7309672 - DNA, 22 bp, Homo sapiens
atagacaaacacgaagatgaca

SEQ ID NO: 7309673 - DNA, 22 bp, Homo sapiens
atagaattatggaaagcatctt

SEQ ID NO: 7309674 - DNA, 22 bp, Homo sapiens
agttttcaatatatgatagtga

SEQ ID NO: 7309675 - DNA, 22 bp, Homo sapiens
agtttgtatgccaacagcaaag

SEQ ID NO: 7309676 - DNA, 22 bp, Homo sapiens
agtttgtgcaatggtgtcacct

SEQ ID NO: 7309677 - DNA, 20 bp, Homo sapiens
agtttgtgtgtctatgcgct

SEQ ID NO: 7309678 - DNA, 20 bp, Homo sapiens
agtttgtgtgtctatgcgct

SEQ ID NO: 7309679 - DNA, 22 bp, Homo sapiens
ctgatacaatgctaataaattt

SEQ ID NO: 7309680 - DNA, 22 bp, Homo sapiens
agtttcagttctgtcatttata

SEQ ID NO: 7309681 - DNA, 22 bp, Homo sapiens
agtttcacatagctcagtgctc

SEQ ID NO: 7309682 - DNA, 22 bp, Homo sapiens
agtttatttctccatttaccta

SEQ ID NO: 7309683 - DNA, 22 bp, Homo sapiens
agtgttaatggtgtatattagg

SEQ ID NO: 7309684 - DNA, 22 bp, Homo sapiens
agtgttaagagaaaattctgct

SEQ ID NO: 7309685 - DNA, 22 bp, Homo sapiens
agtttacaacagtagctatgga

SEQ ID NO: 7309686 - DNA, 22 bp, Homo sapiens
agttttgatactttctcttcat

SEQ ID NO: 7309687 - DNA, 18 bp, Homo sapiens
ctgcccagagcatttcat

SEQ ID NO: 7309688 - DNA, 22 bp, Homo sapiens
ctgccctctagggatgcactgg

SEQ ID NO: 7309689 - DNA, 22 bp, Homo sapiens
agttttcctctcatttatcaat

SEQ ID NO: 7309690 - DNA, 22 bp, Homo sapiens
ctgccctgtggctctgagtcat

SEQ ID NO: 7309691 - DNA, 22 bp, Homo sapiens
ataataatgaaagccactgtgt

SEQ ID NO: 7309692 - DNA, 22 bp, Homo sapiens
ctctgtttttcaatagttcttg

SEQ ID NO: 7309693 - DNA, 22 bp, Homo sapiens
agtgtctgcctgggaggagcat

SEQ ID NO: 7309694 - DNA, 22 bp, Homo sapiens
agtgtctgcagtgatgtctctt

SEQ ID NO: 7309695 - DNA, 22 bp, Homo sapiens
agtgtctgccaactgcatggtc

SEQ ID NO: 7309696 - DNA, 22 bp, Homo sapiens
agtgtctgccagctgccaggtg

SEQ ID NO: 7309697 - DNA, 22 bp, Homo sapiens
agtgtctgcctatttttcaagc

SEQ ID NO: 7309698 - DNA, 19 bp, Homo sapiens
ctcttaaattgtctcttgc

SEQ ID NO: 7309699 - DNA, 22 bp, Homo sapiens
ctcttaaagcttccagtttcaa

SEQ ID NO: 7309700 - DNA, 22 bp, Homo sapiens
ctcttaaataacatcattgctt

SEQ ID NO: 7309701 - DNA, 22 bp, Homo sapiens
agtggggaagagcatgggccct

SEQ ID NO: 7309702 - DNA, 23 bp, Homo sapiens
agtgtctgagtgcaggctgtgca

SEQ ID NO: 7309703 - DNA, 22 bp, Homo sapiens
agtgtctgagtaaatttctcat

SEQ ID NO: 7309704 - DNA, 22 bp, Homo sapiens
agtgtctgagctatcattaggg

SEQ ID NO: 7309705 - DNA, 22 bp, Homo sapiens
agtgtctgatcagttgactaga

SEQ ID NO: 7309706 - DNA, 22 bp, Homo sapiens
agtgtctgcaaaatgaaagagc

SEQ ID NO: 7309707 - DNA, 22 bp, Homo sapiens
agtgtctgatgcacagttgtcc

SEQ ID NO: 7309708 - DNA, 22 bp, Homo sapiens
agtgtctgaactgggtgctgac

SEQ ID NO: 7309709 - DNA, 22 bp, Homo sapiens
agtgtctgaagcctcagcccga

SEQ ID NO: 7309710 - DNA, 22 bp, Homo sapiens
agtgtctgaaggatttggcttc

SEQ ID NO: 7309711 - DNA, 21 bp, Homo sapiens
agtgtctgagcgctgcttctg

SEQ ID NO: 7309712 - DNA, 22 bp, Homo sapiens
agtgtctgagccagaattagaa

SEQ ID NO: 7309713 - DNA, 22 bp, Homo sapiens
agtgtgtgcatgcattcgtgca

SEQ ID NO: 7309714 - DNA, 18 bp, Homo sapiens
agtgtgtgccctttcagg

SEQ ID NO: 7309715 - DNA, 22 bp, Homo sapiens
agtgtgtgcatgcattcgtgca

SEQ ID NO: 7309716 - DNA, 22 bp, Homo sapiens
agtgtgggggctttggtgtcac

SEQ ID NO: 7309717 - DNA, 22 bp, Homo sapiens
agtgtgtgcctttggatacctg

SEQ ID NO: 7309718 - DNA, 18 bp, Homo sapiens
agtgtgtgccctttcagg

SEQ ID NO: 7309719 - DNA, 22 bp, Homo sapiens
agtgtgtgctgttccccggagg

SEQ ID NO: 7309720 - DNA, 21 bp, Homo sapiens
agtgtgtgtggaatgagaata

SEQ ID NO: 7309721 - DNA, 22 bp, Homo sapiens
agtgtgtgctgttccccggagg

SEQ ID NO: 7309722 - DNA, 21 bp, Homo sapiens
agtgtgtgtggaatgagaata

SEQ ID NO: 7309723 - DNA, 22 bp, Homo sapiens
agtgtgtgtttgggcggtttat

SEQ ID NO: 7309724 - DNA, 22 bp, Homo sapiens
agtgtgtgtttgggcggtttat

SEQ ID NO: 7309725 - DNA, 22 bp, Homo sapiens
agtgtgtgtttgggcggtttat

SEQ ID NO: 7309726 - DNA, 22 bp, Homo sapiens
agtgtgttgtaggctcaaatgg

SEQ ID NO: 7309727 - DNA, 21 bp, Homo sapiens
agtgtgttcttggcattacct

SEQ ID NO: 7309728 - DNA, 22 bp, Homo sapiens
agtggcagccgagcaggagatg

SEQ ID NO: 7309729 - DNA, 22 bp, Homo sapiens
agtgcaggccccaggccaggcc

SEQ ID NO: 7309730 - DNA, 22 bp, Homo sapiens
ctctctggggttccagacgtgg

SEQ ID NO: 7309731 - DNA, 22 bp, Homo sapiens
ctctctggggttccagacgtgg

SEQ ID NO: 7309732 - DNA, 22 bp, Homo sapiens
ctctgagagtgctcagagggta

SEQ ID NO: 7309733 - DNA, 22 bp, Homo sapiens
ctctgagaatatgagctctttg

SEQ ID NO: 7309734 - DNA, 22 bp, Homo sapiens
ctccagttggccccagttggtt

SEQ ID NO: 7309735 - DNA, 22 bp, Homo sapiens
agtgacagtctgatttctcaaa

SEQ ID NO: 7309736 - DNA, 22 bp, Homo sapiens
agtgacagtatttgttgccaat

SEQ ID NO: 7309737 - DNA, 22 bp, Homo sapiens
ctccagttggccccagttggtt

SEQ ID NO: 7309738 - DNA, 22 bp, Homo sapiens
agtgatttgactcttttattgt

SEQ ID NO: 7309739 - DNA, 22 bp, Homo sapiens
agtgaccaaagatatttttcag

SEQ ID NO: 7309740 - DNA, 22 bp, Homo sapiens
agtgatttgcagtatttactaa

SEQ ID NO: 7309741 - DNA, 21 bp, Homo sapiens
ctcccagggtgactgttcaac

SEQ ID NO: 7309742 - DNA, 22 bp, Homo sapiens
ctcctcagctgggaggagtccc

SEQ ID NO: 7309743 - DNA, 22 bp, Homo sapiens
ctcctcagagagcagcttgggg

SEQ ID NO: 7309744 - DNA, 18 bp, Homo sapiens
agtcatttacttttgtga

SEQ ID NO: 7309745 - DNA, 22 bp, Homo sapiens
agtcattttgccagtcttcagg

SEQ ID NO: 7309746 - DNA, 22 bp, Homo sapiens
agtccaaagcagatgagggcca

SEQ ID NO: 7309747 - DNA, 22 bp, Homo sapiens
agtctgcattttaacaagatcc

SEQ ID NO: 7309748 - DNA, 22 bp, Homo sapiens
agtctgtgtgaatgtgggcttt

SEQ ID NO: 7309749 - DNA, 22 bp, Homo sapiens
agtctgtgtgaatgtgggcttt

SEQ ID NO: 7309750 - DNA, 22 bp, Homo sapiens
agtctgtgtatattcactgccc

SEQ ID NO: 7309751 - DNA, 22 bp, Homo sapiens
agtctgtgtactgggtttctgt

SEQ ID NO: 7309752 - DNA, 22 bp, Homo sapiens
agtctgtgtacctttggccttc

SEQ ID NO: 7309753 - DNA, 22 bp, Homo sapiens
agtctgtgtacctttggccttc

SEQ ID NO: 7309754 - DNA, 22 bp, Homo sapiens
agtctgtggggtccctggggca

SEQ ID NO: 7309755 - DNA, 19 bp, Homo sapiens
agtctgtggatttgtgggt

SEQ ID NO: 7309756 - DNA, 19 bp, Homo sapiens
agtctgtggatttgtgggt

SEQ ID NO: 7309757 - DNA, 22 bp, Homo sapiens
agtctgtgaaaagataggaagt

SEQ ID NO: 7309758 - DNA, 22 bp, Homo sapiens
agtctgtgctgttggtgaggat

SEQ ID NO: 7309759 - DNA, 22 bp, Homo sapiens
agtctgtggatggactggcaga

SEQ ID NO: 7309760 - DNA, 23 bp, Homo sapiens
agtctgtgcttggtgggagggcc

SEQ ID NO: 7309761 - DNA, 22 bp, Homo sapiens
agtctgtgctgttggtgaggat

SEQ ID NO: 7309762 - DNA, 23 bp, Homo sapiens
agtctgtgctgaagaagttacaa

SEQ ID NO: 7309763 - DNA, 23 bp, Homo sapiens
agtctgtgctgaagaagttacaa

SEQ ID NO: 7309764 - DNA, 22 bp, Homo sapiens
agtctgtgagtgatgtacctgc

SEQ ID NO: 7309765 - DNA, 22 bp, Homo sapiens
agtctgtgactcattggatctc

SEQ ID NO: 7309766 - DNA, 22 bp, Homo sapiens
agtctgtgactcattggatctc

SEQ ID NO: 7309767 - DNA, 22 bp, Homo sapiens
agtctgtgaacttggcagggaa

SEQ ID NO: 7309768 - DNA, 22 bp, Homo sapiens
aggttgggatgagtgggtgagc

SEQ ID NO: 7309769 - DNA, 19 bp, Homo sapiens
aggttacaggtgtcacaga

SEQ ID NO: 7309770 - DNA, 23 bp, Homo sapiens
aggttacagttgttaagttgcaa

SEQ ID NO: 7309771 - DNA, 22 bp, Homo sapiens
aggttagaatgtaagagtttca

SEQ ID NO: 7309772 - DNA, 22 bp, Homo sapiens
aggttagataagaaggttgtgg

SEQ ID NO: 7309773 - DNA, 22 bp, Homo sapiens
aggttagatagtttattagaac

SEQ ID NO: 7309774 - DNA, 22 bp, Homo sapiens
cctggtgcaccaagtaagggtg

SEQ ID NO: 7309775 - DNA, 22 bp, Homo sapiens
aggtgtctggatgggtgtcctt

SEQ ID NO: 7309776 - DNA, 23 bp, Homo sapiens
aggtgtgcttctgggcacctggg

SEQ ID NO: 7309777 - DNA, 22 bp, Homo sapiens
aggtgtggctggggcagaggcc

SEQ ID NO: 7309778 - DNA, 22 bp, Homo sapiens
aggtttattatgtagcattatt

SEQ ID NO: 7309779 - DNA, 20 bp, Homo sapiens
cctttattatttgtatgatg

SEQ ID NO: 7309780 - DNA, 22 bp, Homo sapiens
cctttattcaattagtcctaat

SEQ ID NO: 7309781 - DNA, 22 bp, Homo sapiens
agtaatgaggatgtttgcaaaa

SEQ ID NO: 7309782 - DNA, 22 bp, Homo sapiens
agtaatttgttataaagcaata

SEQ ID NO: 7309783 - DNA, 21 bp, Homo sapiens
agtaattgcggtgattagtga

SEQ ID NO: 7309784 - DNA, 22 bp, Homo sapiens
agtacaaaatgcagcatcatca

SEQ ID NO: 7309785 - DNA, 22 bp, Homo sapiens
ctaaacaagggattataattga

SEQ ID NO: 7309786 - DNA, 22 bp, Homo sapiens
cgtgcatgatatatgagttgtt

SEQ ID NO: 7309787 - DNA, 22 bp, Homo sapiens
cgtgcatgatatatgagttgtt

SEQ ID NO: 7309788 - DNA, 22 bp, Homo sapiens
cgtgcatgtaagtttaccgtca

SEQ ID NO: 7309789 - DNA, 22 bp, Homo sapiens
cggtcaggtgcagcgttggcac

SEQ ID NO: 7309790 - DNA, 22 bp, Homo sapiens
agtcagagcaaactggacagac

SEQ ID NO: 7309791 - DNA, 23 bp, Homo sapiens
agtcagagcagaagggctgcttg

SEQ ID NO: 7309792 - DNA, 22 bp, Homo sapiens
agtcagaggaatgggccaggct

SEQ ID NO: 7309793 - DNA, 22 bp, Homo sapiens
agtcagagtctattgctgtggt

SEQ ID NO: 7309794 - DNA, 22 bp, Homo sapiens
ctacaccttgatctaacatttt

SEQ ID NO: 7309795 - DNA, 22 bp, Homo sapiens
ctacagaaacactggacatgtg

SEQ ID NO: 7309796 - DNA, 22 bp, Homo sapiens
agtcataattataaacatcagt

SEQ ID NO: 7309797 - DNA, 22 bp, Homo sapiens
aggtggagtgtgcagggagagc

SEQ ID NO: 7309798 - DNA, 22 bp, Homo sapiens
aggtggagatcagggactaagg

SEQ ID NO: 7309799 - DNA, 22 bp, Homo sapiens
aggtggagttaagtgtgaactg

SEQ ID NO: 7309800 - DNA, 22 bp, Homo sapiens
aggtgagggtgccagtgcatgg

SEQ ID NO: 7309801 - DNA, 19 bp, Homo sapiens
aggtgaggggcaccatgtc

SEQ ID NO: 7309802 - DNA, 19 bp, Homo sapiens
aggtgaggggcaccatgtc

SEQ ID NO: 7309803 - DNA, 22 bp, Homo sapiens
aggtctggaggcggagtcagga

SEQ ID NO: 7309804 - DNA, 22 bp, Homo sapiens
aggtctggaaacagcagggaga

SEQ ID NO: 7309805 - DNA, 22 bp, Homo sapiens
aggtcctgtccttggtctctga

SEQ ID NO: 7309806 - DNA, 22 bp, Homo sapiens
aggtatgagcctctgcacccag

SEQ ID NO: 7309807 - DNA, 22 bp, Homo sapiens
cctggagcatcaggaggaaggg

SEQ ID NO: 7309808 - DNA, 22 bp, Homo sapiens
cctgcctggcttccagaagaga

SEQ ID NO: 7309809 - DNA, 18 bp, Homo sapiens
cctggacctgtctccttt

SEQ ID NO: 7309810 - DNA, 22 bp, Homo sapiens
cctggactcagaggtgctggtg

SEQ ID NO: 7309811 - DNA, 22 bp, Homo sapiens
cctgcctgctttctgctttgca

SEQ ID NO: 7309812 - DNA, 22 bp, Homo sapiens
cctgcctggagctgagtgtgga

SEQ ID NO: 7309813 - DNA, 22 bp, Homo sapiens
cctgcctggatcagccatcctg

SEQ ID NO: 7309814 - DNA, 22 bp, Homo sapiens
cctgcctggcacatagtactct

SEQ ID NO: 7309815 - DNA, 20 bp, Homo sapiens
cctgcctggccattccttgg

SEQ ID NO: 7309816 - DNA, 22 bp, Homo sapiens
cctgcctggcccaccttgccac

SEQ ID NO: 7309817 - DNA, 22 bp, Homo sapiens
cctgcctggctgtcagcagagc

SEQ ID NO: 7309818 - DNA, 22 bp, Homo sapiens
cctgcctgcgtcctctgagggc

SEQ ID NO: 7309819 - DNA, 22 bp, Homo sapiens
cctgcctgcgtcctctgagggc

SEQ ID NO: 7309820 - DNA, 22 bp, Homo sapiens
aggggctttggtgctggtcctg

SEQ ID NO: 7309821 - DNA, 22 bp, Homo sapiens
aggggctgtggaaaccaactct

SEQ ID NO: 7309822 - DNA, 22 bp, Homo sapiens
agggtggagggagtccctgagc

SEQ ID NO: 7309823 - DNA, 22 bp, Homo sapiens
cctggagctcactgggagccgg

SEQ ID NO: 7309824 - DNA, 22 bp, Homo sapiens
cctggagcccctctggccagcc

SEQ ID NO: 7309825 - DNA, 22 bp, Homo sapiens
cctggagcccaaggcagtgaga

SEQ ID NO: 7309826 - DNA, 22 bp, Homo sapiens
cctggagcccctctggccagcc

SEQ ID NO: 7309827 - DNA, 20 bp, Homo sapiens
cctggagcctggaaggagtc

SEQ ID NO: 7309828 - DNA, 22 bp, Homo sapiens
aggtatatgttcatgtatgtgt

SEQ ID NO: 7309829 - DNA, 22 bp, Homo sapiens
aggtatatgctattacttctgc

SEQ ID NO: 7309830 - DNA, 22 bp, Homo sapiens
aggtatattttgtatatactct

SEQ ID NO: 7309831 - DNA, 22 bp, Homo sapiens
aggtatatgaagatgaaataac

SEQ ID NO: 7309832 - DNA, 18 bp, Homo sapiens
aggtatatgaatctcttt

SEQ ID NO: 7309833 - DNA, 22 bp, Homo sapiens
aggtataagaagattatttata

SEQ ID NO: 7309834 - DNA, 22 bp, Homo sapiens
gagtggggcgtggatccagcgt

SEQ ID NO: 7309835 - DNA, 22 bp, Homo sapiens
gagtggggcccactgctgggtg

SEQ ID NO: 7309836 - DNA, 23 bp, Homo sapiens
atgttattattagcagtcttgcc

SEQ ID NO: 7309837 - DNA, 21 bp, Homo sapiens
gagtgggctgagatggggctg

SEQ ID NO: 7309838 - DNA, 22 bp, Homo sapiens
gagtggggaaagccaggacaga

SEQ ID NO: 7309839 - DNA, 22 bp, Homo sapiens
gatggaggagatggcagggtgc

SEQ ID NO: 7309840 - DNA, 22 bp, Homo sapiens
gattcactcatattttacgttt

SEQ ID NO: 7309841 - DNA, 22 bp, Homo sapiens
gatgtgggtgtcttcagctggt

SEQ ID NO: 7309842 - DNA, 22 bp, Homo sapiens
gatgtggggttgagggaccagc

SEQ ID NO: 7309843 - DNA, 22 bp, Homo sapiens
gatgtggggataatactggtac

SEQ ID NO: 7309844 - DNA, 18 bp, Homo sapiens
gatgtgggccctggatat

SEQ ID NO: 7309845 - DNA, 22 bp, Homo sapiens
gatgtctttagggcaaaatatt

SEQ ID NO: 7309846 - DNA, 22 bp, Homo sapiens
gattcctttcgcctgccgagct

SEQ ID NO: 7309847 - DNA, 22 bp, Homo sapiens
gattccttggctctgtctcagg

SEQ ID NO: 7309848 - DNA, 22 bp, Homo sapiens
attaaattggatctgcatagtt

SEQ ID NO: 7309849 - DNA, 22 bp, Homo sapiens
attaacactttggagtctgctc

SEQ ID NO: 7309850 - DNA, 22 bp, Homo sapiens
attaacagaattttacatgctt

SEQ ID NO: 7309851 - DNA, 22 bp, Homo sapiens
attaacagtttatgatgtgcct

SEQ ID NO: 7309852 - DNA, 22 bp, Homo sapiens
gcaccaggtgcagccgggcccc

SEQ ID NO: 7309853 - DNA, 22 bp, Homo sapiens
gcaccatgacagtgaggagaac

SEQ ID NO: 7309854 - DNA, 22 bp, Homo sapiens
attatccaacacccagttacat

SEQ ID NO: 7309855 - DNA, 22 bp, Homo sapiens
attaagactgcccatgttttta

SEQ ID NO: 7309856 - DNA, 22 bp, Homo sapiens
attaagactattgatatttaca

SEQ ID NO: 7309857 - DNA, 22 bp, Homo sapiens
attataggcttgagccaccgtg

SEQ ID NO: 7309858 - DNA, 22 bp, Homo sapiens
attagtttggtgcaaaagtaat

SEQ ID NO: 7309859 - DNA, 22 bp, Homo sapiens
attatgtatttggtatagtttg

SEQ ID NO: 7309860 - DNA, 22 bp, Homo sapiens
gcaccatgatggagcctcatta

SEQ ID NO: 7309861 - DNA, 22 bp, Homo sapiens
attctgatcattcaagatgtca

SEQ ID NO: 7309862 - DNA, 22 bp, Homo sapiens
attctgaagttgcaggagaagc

SEQ ID NO: 7309863 - DNA, 22 bp, Homo sapiens
gcaggattgggctgaaggagtg

SEQ ID NO: 7309864 - DNA, 22 bp, Homo sapiens
attcacaaaatgatatagatac

SEQ ID NO: 7309865 - DNA, 22 bp, Homo sapiens
attcaatgggggtttctagttg

SEQ ID NO: 7309866 - DNA, 19 bp, Homo sapiens
attcatttttgccttctaa

SEQ ID NO: 7309867 - DNA, 22 bp, Homo sapiens
attcatgcaggattgtctccaa

SEQ ID NO: 7309868 - DNA, 22 bp, Homo sapiens
attcttttaaatggcagtagta

SEQ ID NO: 7309869 - DNA, 22 bp, Homo sapiens
attcttttgtcctagcttgata

SEQ ID NO: 7309870 - DNA, 22 bp, Homo sapiens
attctttccagacactgattgc

SEQ ID NO: 7309871 - DNA, 20 bp, Homo sapiens
gcaggcagggaatgggggtg

SEQ ID NO: 7309872 - DNA, 22 bp, Homo sapiens
attctgctagtaacagatgaag

SEQ ID NO: 7309873 - DNA, 22 bp, Homo sapiens
attctggaagcaagcttttaaa

SEQ ID NO: 7309874 - DNA, 22 bp, Homo sapiens
attctgctgcacaccttccccc

SEQ ID NO: 7309875 - DNA, 22 bp, Homo sapiens
attgcaaataatgcgagccagt

SEQ ID NO: 7309876 - DNA, 22 bp, Homo sapiens
attgcaaataactgtactgaat

SEQ ID NO: 7309877 - DNA, 22 bp, Homo sapiens
gcatggagaagtgggaacaggt

SEQ ID NO: 7309878 - DNA, 22 bp, Homo sapiens
attgcacaaacacagtcagact

SEQ ID NO: 7309879 - DNA, 23 bp, Homo sapiens
attttgcctcttggctgcttagg

SEQ ID NO: 7309880 - DNA, 22 bp, Homo sapiens
attttgatgctatctaatgaat

SEQ ID NO: 7309881 - DNA, 22 bp, Homo sapiens
attttgcacactatgcagcttt

SEQ ID NO: 7309882 - DNA, 22 bp, Homo sapiens
caaaagcagcaagtttatatgt

SEQ ID NO: 7309883 - DNA, 22 bp, Homo sapiens
caaaagcaaagtccctgaatgt

SEQ ID NO: 7309884 - DNA, 22 bp, Homo sapiens
caaaagcaaagtccctgaatgt

SEQ ID NO: 7309885 - DNA, 22 bp, Homo sapiens
caaaagatacttgcatctaact

SEQ ID NO: 7309886 - DNA, 22 bp, Homo sapiens
caaaagatacttgcatctaact

SEQ ID NO: 7309887 - DNA, 22 bp, Homo sapiens
gctccccagcttagccctggct

SEQ ID NO: 7309888 - DNA, 22 bp, Homo sapiens
gctcccagtctgatggaggaga

SEQ ID NO: 7309889 - DNA, 22 bp, Homo sapiens
gctcccagttcccaaagtgacc

SEQ ID NO: 7309890 - DNA, 22 bp, Homo sapiens
caaagaatgagtgagtacataa

SEQ ID NO: 7309891 - DNA, 22 bp, Homo sapiens
caaagaatcactcatctttagc

SEQ ID NO: 7309892 - DNA, 20 bp, Homo sapiens
caaagacatgctaggggtgg

SEQ ID NO: 7309893 - DNA, 22 bp, Homo sapiens
gctctgagagtgggtgattctg

SEQ ID NO: 7309894 - DNA, 22 bp, Homo sapiens
caaagactgcataacacatgaa

SEQ ID NO: 7309895 - DNA, 22 bp, Homo sapiens
gctctgctgtcttcttgcaggc

SEQ ID NO: 7309896 - DNA, 22 bp, Homo sapiens
gctctgctgtggaatcctctcc

SEQ ID NO: 7309897 - DNA, 21 bp, Homo sapiens
attttcattaattcagtgtgg

SEQ ID NO: 7309898 - DNA, 22 bp, Homo sapiens
attttccatctccacaccaggg

SEQ ID NO: 7309899 - DNA, 22 bp, Homo sapiens
attttcagttgaaaaagttggt

SEQ ID NO: 7309900 - DNA, 22 bp, Homo sapiens
attttcatgactaccttaaata

SEQ ID NO: 7309901 - DNA, 22 bp, Homo sapiens
attttctagatagatgatgcat

SEQ ID NO: 7309902 - DNA, 22 bp, Homo sapiens
attttctaagcctgtcagactt

SEQ ID NO: 7309903 - DNA, 22 bp, Homo sapiens
atttgtcaacaggcatttaggt

SEQ ID NO: 7309904 - DNA, 22 bp, Homo sapiens
atttgtcagtggaagtgattca

SEQ ID NO: 7309905 - DNA, 22 bp, Homo sapiens
atttgtctaatgagtgtgtact

SEQ ID NO: 7309906 - DNA, 22 bp, Homo sapiens
atttgtcaataagatgaacata

SEQ ID NO: 7309907 - DNA, 22 bp, Homo sapiens
atttcttcctctgtcagtaact

SEQ ID NO: 7309908 - DNA, 22 bp, Homo sapiens
atttgggcagtccatgaaataa

SEQ ID NO: 7309909 - DNA, 22 bp, Homo sapiens
atttgtaaagtgcttaaaagta

SEQ ID NO: 7309910 - DNA, 22 bp, Homo sapiens
atttgtaagctagagccatgat

SEQ ID NO: 7309911 - DNA, 17 bp, Homo sapiens
atttgtaactagctctt

SEQ ID NO: 7309912 - DNA, 22 bp, Homo sapiens
atttgtaacacgtgacaggttg

SEQ ID NO: 7309913 - DNA, 22 bp, Homo sapiens
atttgtaatttcttatctgtgt

SEQ ID NO: 7309914 - DNA, 22 bp, Homo sapiens
gccagctggagactggcagggg

SEQ ID NO: 7309915 - DNA, 22 bp, Homo sapiens
atttattacctcggagtttctg

SEQ ID NO: 7309916 - DNA, 20 bp, Homo sapiens
atttatgtatagcttgttgt

SEQ ID NO: 7309917 - DNA, 22 bp, Homo sapiens
atttatgtatctgtgtagatca

SEQ ID NO: 7309918 - DNA, 22 bp, Homo sapiens
gccagctgctcgcgtagggtag

SEQ ID NO: 7309919 - DNA, 22 bp, Homo sapiens
attgtacagatgaacctcactc

SEQ ID NO: 7309920 - DNA, 22 bp, Homo sapiens
attgtacaggttggaggaagtg

SEQ ID NO: 7309921 - DNA, 22 bp, Homo sapiens
attgtacatgcagtgagtcatc

SEQ ID NO: 7309922 - DNA, 19 bp, Homo sapiens
atttattgtatgattccat

SEQ ID NO: 7309923 - DNA, 23 bp, Homo sapiens
atttcctaaaagataatcattac

SEQ ID NO: 7309924 - DNA, 22 bp, Homo sapiens
atttcctaacagaggcaacagt

SEQ ID NO: 7309925 - DNA, 23 bp, Homo sapiens
atttcctactataaaagaggtaa

SEQ ID NO: 7309926 - DNA, 23 bp, Homo sapiens
atttcctactataaaagaggtaa

SEQ ID NO: 7309927 - DNA, 22 bp, Homo sapiens
atttctgtttgctactataagt

SEQ ID NO: 7309928 - DNA, 22 bp, Homo sapiens
gccctgtgccagtcacgctgtg

SEQ ID NO: 7309929 - DNA, 20 bp, Homo sapiens
gccctgtgatgtcttgacct

SEQ ID NO: 7309930 - DNA, 22 bp, Homo sapiens
gccctgtgatggagactagagg

SEQ ID NO: 7309931 - DNA, 22 bp, Homo sapiens
gccctggtgtgcccagcatggg

SEQ ID NO: 7309932 - DNA, 22 bp, Homo sapiens
atttcttcaggtcagaaataga

SEQ ID NO: 7309933 - DNA, 22 bp, Homo sapiens
atttcttatgaatattgactgt

SEQ ID NO: 7309934 - DNA, 22 bp, Homo sapiens
atttctgtttgctactataagt

SEQ ID NO: 7309935 - DNA, 22 bp, Homo sapiens
atttctgtttgctactataagt

SEQ ID NO: 7309936 - DNA, 22 bp, Homo sapiens
atttcttaaaacttcagggaga

SEQ ID NO: 7309937 - DNA, 22 bp, Homo sapiens
gagccccaggacagctctagtt

SEQ ID NO: 7309938 - DNA, 22 bp, Homo sapiens
gagccctcgggcgagcccgcgc

SEQ ID NO: 7309939 - DNA, 22 bp, Homo sapiens
atgggcagacagggagctcacg

SEQ ID NO: 7309940 - DNA, 22 bp, Homo sapiens
gagctgccctgagctttgcatg

SEQ ID NO: 7309941 - DNA, 22 bp, Homo sapiens
gagctgccggcccacagtacta

SEQ ID NO: 7309942 - DNA, 22 bp, Homo sapiens
gagctgccagacatgggaatga

SEQ ID NO: 7309943 - DNA, 22 bp, Homo sapiens
gagctgcagagtaacctttgca

SEQ ID NO: 7309944 - DNA, 22 bp, Homo sapiens
gagctgcagcggctgacgcaac

SEQ ID NO: 7309945 - DNA, 22 bp, Homo sapiens
gagctgcatgcggaaacctgtt

SEQ ID NO: 7309946 - DNA, 22 bp, Homo sapiens
gagctgcatgcaactgtttaaa

SEQ ID NO: 7309947 - DNA, 22 bp, Homo sapiens
gagctctgtgtagcctgagggt

SEQ ID NO: 7309948 - DNA, 22 bp, Homo sapiens
gagctgcagacatagataagcg

SEQ ID NO: 7309949 - DNA, 21 bp, Homo sapiens
gagctgcaccttgacctgttt

SEQ ID NO: 7309950 - DNA, 22 bp, Homo sapiens
gagctgcacgcagcatccaaga

SEQ ID NO: 7309951 - DNA, 22 bp, Homo sapiens
gagctgcacatctgaggctaat

SEQ ID NO: 7309952 - DNA, 22 bp, Homo sapiens
gagcacaggctttggtggacac

SEQ ID NO: 7309953 - DNA, 22 bp, Homo sapiens
atggcagagaacaaagcaacaa

SEQ ID NO: 7309954 - DNA, 19 bp, Homo sapiens
atggctctgatttaatgtg

SEQ ID NO: 7309955 - DNA, 22 bp, Homo sapiens
atggatctgctaatgggaagca

SEQ ID NO: 7309956 - DNA, 22 bp, Homo sapiens
atggagggtgtcagagagcgaa

SEQ ID NO: 7309957 - DNA, 22 bp, Homo sapiens
gagaatatattgaagtagttcc

SEQ ID NO: 7309958 - DNA, 22 bp, Homo sapiens
atggcagacacaggcaggcaga

SEQ ID NO: 7309959 - DNA, 22 bp, Homo sapiens
atggcagacacaggcaggcaga

SEQ ID NO: 7309960 - DNA, 22 bp, Homo sapiens
atggcagaaagaatagaggcta

SEQ ID NO: 7309961 - DNA, 22 bp, Homo sapiens
atggatttgcttatacacatgt

SEQ ID NO: 7309962 - DNA, 22 bp, Homo sapiens
atgcttaaccttggtgtacaat

SEQ ID NO: 7309963 - DNA, 22 bp, Homo sapiens
atgcttaaaaggctgcgttaga

SEQ ID NO: 7309964 - DNA, 22 bp, Homo sapiens
atgcttaactctgtacatagtt

SEQ ID NO: 7309965 - DNA, 22 bp, Homo sapiens
atgcttaacttcctagtctata

SEQ ID NO: 7309966 - DNA, 22 bp, Homo sapiens
atgctgtctctgctatccaaag

SEQ ID NO: 7309967 - DNA, 22 bp, Homo sapiens
atgctgtggtagacagcattcc

SEQ ID NO: 7309968 - DNA, 22 bp, Homo sapiens
atgctgtgctggctaaccatgg

SEQ ID NO: 7309969 - DNA, 22 bp, Homo sapiens
gaggttgggatgagggatacag

SEQ ID NO: 7309970 - DNA, 22 bp, Homo sapiens
gaggttgggaagtccaagctgg

SEQ ID NO: 7309971 - DNA, 22 bp, Homo sapiens
gaggttgggaagtccaagctgg

SEQ ID NO: 7309972 - DNA, 22 bp, Homo sapiens
gaggttggagggctggcctgca

SEQ ID NO: 7309973 - DNA, 22 bp, Homo sapiens
gaggtgtgcacagcgtgctgac

SEQ ID NO: 7309974 - DNA, 22 bp, Homo sapiens
atgttatagttataaaatgagg

SEQ ID NO: 7309975 - DNA, 22 bp, Homo sapiens
atgttacagttgagtaaattaa

SEQ ID NO: 7309976 - DNA, 22 bp, Homo sapiens
atgttacagggagagaaggcca

SEQ ID NO: 7309977 - DNA, 22 bp, Homo sapiens
atgttacatagtccttatttgt

SEQ ID NO: 7309978 - DNA, 22 bp, Homo sapiens
atgttaaaagtgaggatggcca

SEQ ID NO: 7309979 - DNA, 23 bp, Homo sapiens
atgttaaacataactgaagagcc

SEQ ID NO: 7309980 - DNA, 22 bp, Homo sapiens
atgttaaaagtctgagtgggag

SEQ ID NO: 7309981 - DNA, 18 bp, Homo sapiens
atgtggctagtgctactg

SEQ ID NO: 7309982 - DNA, 22 bp, Homo sapiens
atgtggccttaatgacagcagc

SEQ ID NO: 7309983 - DNA, 22 bp, Homo sapiens
atgtcagagcttccacaatagt

SEQ ID NO: 7309984 - DNA, 22 bp, Homo sapiens
atgtgcgtgtgtacatatatat

SEQ ID NO: 7309985 - DNA, 22 bp, Homo sapiens
atgtcataaatatactgttcct

SEQ ID NO: 7309986 - DNA, 22 bp, Homo sapiens
atgtcagattcctaaatatctt

SEQ ID NO: 7309987 - DNA, 22 bp, Homo sapiens
atgtggccagtcatgtagtaac

SEQ ID NO: 7309988 - DNA, 22 bp, Homo sapiens
atgtggcccagcggtcaggctg

SEQ ID NO: 7309989 - DNA, 22 bp, Homo sapiens
atgtggcccagcggtcaggctg

SEQ ID NO: 7309990 - DNA, 22 bp, Homo sapiens
atgtggccttaatgacagcagc

SEQ ID NO: 7309991 - DNA, 22 bp, Homo sapiens
atgtggatcacaggggtgtgtc

SEQ ID NO: 7309992 - DNA, 22 bp, Homo sapiens
atgtgctttgctggaaatgtca

SEQ ID NO: 7309993 - DNA, 22 bp, Homo sapiens
atgtgctttctttgtttcataa

SEQ ID NO: 7309994 - DNA, 22 bp, Homo sapiens
atgtgctttctttgtttcataa

SEQ ID NO: 7309995 - DNA, 22 bp, Homo sapiens
atgtgctttattaagtaaaaat

SEQ ID NO: 7309996 - DNA, 22 bp, Homo sapiens
atgtgctttaggtttgtttaca

SEQ ID NO: 7309997 - DNA, 22 bp, Homo sapiens
atgtgctttaggtttgtttaca

SEQ ID NO: 7309998 - DNA, 22 bp, Homo sapiens
atgtgcttgtaatgttaaatgt

SEQ ID NO: 7309999 - DNA, 22 bp, Homo sapiens
atgtgcttggaaaagcagtggt

SEQ ID NO: 7310000 - DNA, 22 bp, Homo sapiens
atgtgcttggaaaagcagtggt

SEQ ID NO: 7310001 - DNA, 18 bp, Homo sapiens
atgtgctcatggggaaag

SEQ ID NO: 7310002 - DNA, 18 bp, Homo sapiens
atgtgctcatggggaaag

SEQ ID NO: 7310003 - DNA, 22 bp, Homo sapiens
gaggagctgtcaccgtgactca

SEQ ID NO: 7310004 - DNA, 22 bp, Homo sapiens
gaggagctgtctttgtgatctt

SEQ ID NO: 7310005 - DNA, 22 bp, Homo sapiens
gaggagggagctggaagctctt

SEQ ID NO: 7310006 - DNA, 22 bp, Homo sapiens
gaggagctgggtcagggagaca

SEQ ID NO: 7310007 - DNA, 23 bp, Homo sapiens
atgtatttaaatttcagtgatga

SEQ ID NO: 7310008 - DNA, 22 bp, Homo sapiens
gaggcctgggttggaggtgcat

SEQ ID NO: 7310009 - DNA, 22 bp, Homo sapiens
atgtatttctatgtagtgaaga

SEQ ID NO: 7310010 - DNA, 22 bp, Homo sapiens
atgtatgttttcagttgtatta

SEQ ID NO: 7310011 - DNA, 22 bp, Homo sapiens
atgtatgttttcagttgtatta

SEQ ID NO: 7310012 - DNA, 22 bp, Homo sapiens
atgtatgttcaagcaatgatta

SEQ ID NO: 7310013 - DNA, 22 bp, Homo sapiens
atgtatgtttctatatatgaca

SEQ ID NO: 7310014 - DNA, 22 bp, Homo sapiens
atgtatgttagacaagcctaca

SEQ ID NO: 7310015 - DNA, 22 bp, Homo sapiens
atgtatgttagtgtattatcta

SEQ ID NO: 7310016 - DNA, 22 bp, Homo sapiens
atgtatgtctgcatacacatac

SEQ ID NO: 7310017 - DNA, 22 bp, Homo sapiens
atgtatgtctgatgcacatgca

SEQ ID NO: 7310018 - DNA, 22 bp, Homo sapiens
atgtatgtgagctttgagatca

SEQ ID NO: 7310019 - DNA, 22 bp, Homo sapiens
atgtatgtatgtacttttgtat

SEQ ID NO: 7310020 - DNA, 22 bp, Homo sapiens
atgtatgtatgctgtgcttgca

SEQ ID NO: 7310021 - DNA, 22 bp, Homo sapiens
atgtatgtatgctgtgcttgca

SEQ ID NO: 7310022 - DNA, 22 bp, Homo sapiens
atgtatgtagtgtacatataca

SEQ ID NO: 7310023 - DNA, 18 bp, Homo sapiens
atgtatgtacatatttat

SEQ ID NO: 7310024 - DNA, 22 bp, Homo sapiens
atgagactacctgtaatgtggc

SEQ ID NO: 7310025 - DNA, 22 bp, Homo sapiens
atgagaatatgatttactattg

SEQ ID NO: 7310026 - DNA, 22 bp, Homo sapiens
atgacattgaatatgttaacta

SEQ ID NO: 7310027 - DNA, 22 bp, Homo sapiens
atgagaggtttcgtcagaggaa

SEQ ID NO: 7310028 - DNA, 18 bp, Homo sapiens
atgagaggtgtcagaaga

SEQ ID NO: 7310029 - DNA, 22 bp, Homo sapiens
atgagcaggaagagcacaaaga

SEQ ID NO: 7310030 - DNA, 22 bp, Homo sapiens
atgagcagatatggattttaga

SEQ ID NO: 7310031 - DNA, 22 bp, Homo sapiens
atgacagatagtcttcatttgc

SEQ ID NO: 7310032 - DNA, 19 bp, Homo sapiens
ctttttcaccttctagaag

SEQ ID NO: 7310033 - DNA, 22 bp, Homo sapiens
ctttttatctcttaatgatgtt

SEQ ID NO: 7310034 - DNA, 22 bp, Homo sapiens
ctttttatctcttaatgatgtt

SEQ ID NO: 7310035 - DNA, 22 bp, Homo sapiens
ctttggaaaagcataccaagga

SEQ ID NO: 7310036 - DNA, 22 bp, Homo sapiens
ctttgctttactcccactgtgt

SEQ ID NO: 7310037 - DNA, 22 bp, Homo sapiens
ctttggctgacaggtttctggt

SEQ ID NO: 7310038 - DNA, 22 bp, Homo sapiens
ctttgccatgggcttgataggt

SEQ ID NO: 7310039 - DNA, 20 bp, Homo sapiens
ctttgcctattctctgcctg

SEQ ID NO: 7310040 - DNA, 22 bp, Homo sapiens
ctttgctaatgttgcattttca

SEQ ID NO: 7310041 - DNA, 22 bp, Homo sapiens
ctttgctactgtgaatagtgcc

SEQ ID NO: 7310042 - DNA, 22 bp, Homo sapiens
ctttgctagtgatttgtttagg

SEQ ID NO: 7310043 - DNA, 22 bp, Homo sapiens
ctttcaaaacgctctgtatgca

SEQ ID NO: 7310044 - DNA, 22 bp, Homo sapiens
ctttctttgcagtgagccagag

SEQ ID NO: 7310045 - DNA, 22 bp, Homo sapiens
ctttctttgcagtgagccagag

SEQ ID NO: 7310046 - DNA, 22 bp, Homo sapiens
atgacacataaaacaaggactg

SEQ ID NO: 7310047 - DNA, 22 bp, Homo sapiens
ctttattgtccttcttaggtgg

SEQ ID NO: 7310048 - DNA, 22 bp, Homo sapiens
ctttattgtccttcttaggtgg

SEQ ID NO: 7310049 - DNA, 22 bp, Homo sapiens
ctttattagatgtagactttct

SEQ ID NO: 7310050 - DNA, 22 bp, Homo sapiens
ctttatgttggggtgtcttagt

SEQ ID NO: 7310051 - DNA, 22 bp, Homo sapiens
ctttatgttcagtacaatgctt

SEQ ID NO: 7310052 - DNA, 22 bp, Homo sapiens
ctttacttctcaaaataaagca

SEQ ID NO: 7310053 - DNA, 22 bp, Homo sapiens
ctttacttgctttgttacaaaa

SEQ ID NO: 7310054 - DNA, 22 bp, Homo sapiens
ctttactgtttggtgctctatt

SEQ ID NO: 7310055 - DNA, 22 bp, Homo sapiens
atctttgggatcctgatttact

SEQ ID NO: 7310056 - DNA, 22 bp, Homo sapiens
atctttgggatatttgtgatta

SEQ ID NO: 7310057 - DNA, 22 bp, Homo sapiens
cttgtttgattattgcctgagg

SEQ ID NO: 7310058 - DNA, 22 bp, Homo sapiens
atctttggatcgctcccccttc

SEQ ID NO: 7310059 - DNA, 22 bp, Homo sapiens
atctttggacggtcccaactga

SEQ ID NO: 7310060 - DNA, 22 bp, Homo sapiens
atctttggccacttgtgctgca

SEQ ID NO: 7310061 - DNA, 20 bp, Homo sapiens
atctttggctcagaagcctt

SEQ ID NO: 7310062 - DNA, 21 bp, Homo sapiens
atctttgaagcatgcagtgag

SEQ ID NO: 7310063 - DNA, 22 bp, Homo sapiens
atctttgaagaggacttgaagt

SEQ ID NO: 7310064 - DNA, 22 bp, Homo sapiens
atctttgatgactaatgctttg

SEQ ID NO: 7310065 - DNA, 22 bp, Homo sapiens
atctttggaaagccaagcacag

SEQ ID NO: 7310066 - DNA, 22 bp, Homo sapiens
atctttcagggccatttgtatt

SEQ ID NO: 7310067 - DNA, 22 bp, Homo sapiens
atctttcaggcctagtgtttaa

SEQ ID NO: 7310068 - DNA, 21 bp, Homo sapiens
atctttattacgcagagaaga

SEQ ID NO: 7310069 - DNA, 22 bp, Homo sapiens
cttctccctggcttctgcacac

SEQ ID NO: 7310070 - DNA, 22 bp, Homo sapiens
atctggaatagcatggggttga

SEQ ID NO: 7310071 - DNA, 22 bp, Homo sapiens
atctggaagtaggagagtgggc

SEQ ID NO: 7310072 - DNA, 22 bp, Homo sapiens
atctggaagtcagaggtttgca

SEQ ID NO: 7310073 - DNA, 22 bp, Homo sapiens
atctggaattgaagaggtttga

SEQ ID NO: 7310074 - DNA, 22 bp, Homo sapiens
atctggaattaagagaaagtga

SEQ ID NO: 7310075 - DNA, 22 bp, Homo sapiens
gaagccttgaactgcaaacccc

SEQ ID NO: 7310076 - DNA, 22 bp, Homo sapiens
gaagcctttgcctaaaacatta

SEQ ID NO: 7310077 - DNA, 22 bp, Homo sapiens
gaagcctggagaccagatgttg

SEQ ID NO: 7310078 - DNA, 22 bp, Homo sapiens
gaagctgggtcgctgggatcct

SEQ ID NO: 7310079 - DNA, 22 bp, Homo sapiens
gaagctggggtgctgagggcaa

SEQ ID NO: 7310080 - DNA, 22 bp, Homo sapiens
gaaggagctactaataagaggg

SEQ ID NO: 7310081 - DNA, 22 bp, Homo sapiens
gaaggaggcgttagccctagga

SEQ ID NO: 7310082 - DNA, 22 bp, Homo sapiens
gaagctgatgaggaccagattg

SEQ ID NO: 7310083 - DNA, 22 bp, Homo sapiens
gaaggaggtctgcattctacag

SEQ ID NO: 7310084 - DNA, 22 bp, Homo sapiens
gaaggaggtgtcagttggactg

SEQ ID NO: 7310085 - DNA, 22 bp, Homo sapiens
gaaggagggtgcggatctgagc

SEQ ID NO: 7310086 - DNA, 22 bp, Homo sapiens
gaaggaggtctgatacaatatg

SEQ ID NO: 7310087 - DNA, 22 bp, Homo sapiens
gaaggagggagcggcgcggatt

SEQ ID NO: 7310088 - DNA, 22 bp, Homo sapiens
gaaggaggctccccaaagtctg

SEQ ID NO: 7310089 - DNA, 22 bp, Homo sapiens
atgatgttgataaattacttta

SEQ ID NO: 7310090 - DNA, 22 bp, Homo sapiens
atgatgtaacataaagatgtct

SEQ ID NO: 7310091 - DNA, 22 bp, Homo sapiens
gaagagatgacaaaggagcatg

SEQ ID NO: 7310092 - DNA, 22 bp, Homo sapiens
gaagagatgacaaaggagcatg

SEQ ID NO: 7310093 - DNA, 22 bp, Homo sapiens
gaagaaatgtgttcaaggtagg

SEQ ID NO: 7310094 - DNA, 22 bp, Homo sapiens
gaagaaatgtgttcaaggtagg

SEQ ID NO: 7310095 - DNA, 22 bp, Homo sapiens
gaagaaagggaattaacttgag

SEQ ID NO: 7310096 - DNA, 22 bp, Homo sapiens
atgagcagtttttaagtagcaa

SEQ ID NO: 7310097 - DNA, 22 bp, Homo sapiens
atgagcagtaggttcatggctg

SEQ ID NO: 7310098 - DNA, 19 bp, Homo sapiens
atgagcaggcaagacaagc

SEQ ID NO: 7310099 - DNA, 22 bp, Homo sapiens
atgagcaggtttaagagaggcc

SEQ ID NO: 7310100 - DNA, 22 bp, Homo sapiens
atgctactcattaagtttgtca

SEQ ID NO: 7310101 - DNA, 22 bp, Homo sapiens
atgctacttgccagttacttga

SEQ ID NO: 7310102 - DNA, 22 bp, Homo sapiens
atgctactatccttctgcttaa

SEQ ID NO: 7310103 - DNA, 23 bp, Homo sapiens
atgctctgggctgtgggacctgc

SEQ ID NO: 7310104 - DNA, 22 bp, Homo sapiens
atgctcttgaggctaaagacat

SEQ ID NO: 7310105 - DNA, 16 bp, Homo sapiens
atgctgctattagagg

SEQ ID NO: 7310106 - DNA, 22 bp, Homo sapiens
atgctaaactatgatcattttc

SEQ ID NO: 7310107 - DNA, 19 bp, Homo sapiens
gaatttatctcttcagtcc

SEQ ID NO: 7310108 - DNA, 22 bp, Homo sapiens
gaagtctgctgctcaggagttt

SEQ ID NO: 7310109 - DNA, 22 bp, Homo sapiens
gaagtcagctccccaggtcccc

SEQ ID NO: 7310110 - DNA, 20 bp, Homo sapiens
cacaggccttgtgagcagac

SEQ ID NO: 7310111 - DNA, 22 bp, Homo sapiens
ggagagcctgtgcagccgggtt

SEQ ID NO: 7310112 - DNA, 22 bp, Homo sapiens
ggcacaaaggaataaagagaac

SEQ ID NO: 7310113 - DNA, 22 bp, Homo sapiens
cacatatatgaaatgaggaatt

SEQ ID NO: 7310114 - DNA, 22 bp, Homo sapiens
cacatatatgggcccctgaggg

SEQ ID NO: 7310115 - DNA, 16 bp, Homo sapiens
cacatatatttatatg

SEQ ID NO: 7310116 - DNA, 22 bp, Homo sapiens
ggcaataatgacattttaaaaa

SEQ ID NO: 7310117 - DNA, 22 bp, Homo sapiens
cacatgaattgatgccaagtgc

SEQ ID NO: 7310118 - DNA, 22 bp, Homo sapiens
cacatgaattgatgccaagtgc

SEQ ID NO: 7310119 - DNA, 22 bp, Homo sapiens
cacatgaagattcaactggatg

SEQ ID NO: 7310120 - DNA, 22 bp, Homo sapiens
ggcagagtgctctgggcagggg

SEQ ID NO: 7310121 - DNA, 20 bp, Homo sapiens
ggcagatacctgtgtttaag

SEQ ID NO: 7310122 - DNA, 22 bp, Homo sapiens
ggcagatactaagctgcttcct

SEQ ID NO: 7310123 - DNA, 22 bp, Homo sapiens
ggcagatggaagaggctgggtc

SEQ ID NO: 7310124 - DNA, 22 bp, Homo sapiens
cacattatgctactaccaaatg

SEQ ID NO: 7310125 - DNA, 22 bp, Homo sapiens
cacatgttaacttcctacagtg

SEQ ID NO: 7310126 - DNA, 22 bp, Homo sapiens
cacatgttcttaacttctgttt

SEQ ID NO: 7310127 - DNA, 22 bp, Homo sapiens
cacattcatggagtttgcctgt

SEQ ID NO: 7310128 - DNA, 22 bp, Homo sapiens
cactgcactccagcctgggaga

SEQ ID NO: 7310129 - DNA, 22 bp, Homo sapiens
cactattttctcttcagatggc

SEQ ID NO: 7310130 - DNA, 22 bp, Homo sapiens
cactcagcccacccatgtttgt

SEQ ID NO: 7310131 - DNA, 22 bp, Homo sapiens
cactatttcctggattttgacg

SEQ ID NO: 7310132 - DNA, 22 bp, Homo sapiens
cactatcttgtagggcatggca

SEQ ID NO: 7310133 - DNA, 22 bp, Homo sapiens
cactatatgcctttgaaataca

SEQ ID NO: 7310134 - DNA, 22 bp, Homo sapiens
cacggccagggctgtgggtgcg

SEQ ID NO: 7310135 - DNA, 22 bp, Homo sapiens
cactagttcacaaaataggaaa

SEQ ID NO: 7310136 - DNA, 22 bp, Homo sapiens
cactataatcctgttttagaac

SEQ ID NO: 7310137 - DNA, 22 bp, Homo sapiens
caccaggcacagctctcctgct

SEQ ID NO: 7310138 - DNA, 23 bp, Homo sapiens
cacctggcttgagttggtgggtc

SEQ ID NO: 7310139 - DNA, 20 bp, Homo sapiens
cacctggctgactgtctcca

SEQ ID NO: 7310140 - DNA, 22 bp, Homo sapiens
ggccaggctggttccttgacct

SEQ ID NO: 7310141 - DNA, 22 bp, Homo sapiens
cactggttttgctgataaggca

SEQ ID NO: 7310142 - DNA, 22 bp, Homo sapiens
cacttaaatctgttgagaaaaa

SEQ ID NO: 7310143 - DNA, 22 bp, Homo sapiens
cacttaaatctgttgagaaaaa

SEQ ID NO: 7310144 - DNA, 22 bp, Homo sapiens
cacttaaatctgttgagaaaaa

SEQ ID NO: 7310145 - DNA, 22 bp, Homo sapiens
cacttaaatgttcctacagcag

SEQ ID NO: 7310146 - DNA, 22 bp, Homo sapiens
cacttaaatgttcctacagcag

SEQ ID NO: 7310147 - DNA, 22 bp, Homo sapiens
cacttcaaggaatatctagaaa

SEQ ID NO: 7310148 - DNA, 22 bp, Homo sapiens
cacttcaattaacttcagcatt

SEQ ID NO: 7310149 - DNA, 22 bp, Homo sapiens
cacttcaatctctgcctccatc

SEQ ID NO: 7310150 - DNA, 22 bp, Homo sapiens
cacttgagttcttaatagtcag

SEQ ID NO: 7310151 - DNA, 22 bp, Homo sapiens
cacttctgttgccttgtgcaat

SEQ ID NO: 7310152 - DNA, 22 bp, Homo sapiens
cactttaactcacatttcagct

SEQ ID NO: 7310153 - DNA, 22 bp, Homo sapiens
cactttaactcacatttcagct

SEQ ID NO: 7310154 - DNA, 22 bp, Homo sapiens
cacttgttggtggtgaaatcac

SEQ ID NO: 7310155 - DNA, 21 bp, Homo sapiens
cactttaaaaatatctttata

SEQ ID NO: 7310156 - DNA, 22 bp, Homo sapiens
cacttgttggtggtgaaatcac

SEQ ID NO: 7310157 - DNA, 22 bp, Homo sapiens
caagaacagtttgccaaattgg

SEQ ID NO: 7310158 - DNA, 22 bp, Homo sapiens
gctgcctgatttacatagtgaa

SEQ ID NO: 7310159 - DNA, 22 bp, Homo sapiens
gctgcctgcacagagctgcttt

SEQ ID NO: 7310160 - DNA, 22 bp, Homo sapiens
gctgcctgcacagagctgcttt

SEQ ID NO: 7310161 - DNA, 17 bp, Homo sapiens
gctgcctgcaactgact

SEQ ID NO: 7310162 - DNA, 22 bp, Homo sapiens
caactttctgttaaatgttagt

SEQ ID NO: 7310163 - DNA, 22 bp, Homo sapiens
caagaaattctgttcagatagc

SEQ ID NO: 7310164 - DNA, 22 bp, Homo sapiens
caagaaatggggaggggagttg

SEQ ID NO: 7310165 - DNA, 22 bp, Homo sapiens
caagaaatggggaggggagttg

SEQ ID NO: 7310166 - DNA, 22 bp, Homo sapiens
caaattttgtgtgttctctagt

SEQ ID NO: 7310167 - DNA, 22 bp, Homo sapiens
caactttagaccccaagtagct

SEQ ID NO: 7310168 - DNA, 22 bp, Homo sapiens
caacacattgaagctatgatga

SEQ ID NO: 7310169 - DNA, 22 bp, Homo sapiens
gctctggaggctggaagaccat

SEQ ID NO: 7310170 - DNA, 22 bp, Homo sapiens
gctctggatccggctgggtctg

SEQ ID NO: 7310171 - DNA, 22 bp, Homo sapiens
gctctggaacctgccaggatgc

SEQ ID NO: 7310172 - DNA, 22 bp, Homo sapiens
gctctggaacctgccaggatgc

SEQ ID NO: 7310173 - DNA, 22 bp, Homo sapiens
gctctggaagcatctgagagga

SEQ ID NO: 7310174 - DNA, 22 bp, Homo sapiens
gctctggaccctgccagcctta

SEQ ID NO: 7310175 - DNA, 22 bp, Homo sapiens
gctctggaccctggagtggctg

SEQ ID NO: 7310176 - DNA, 23 bp, Homo sapiens
gctctggagctgggcctggcagg

SEQ ID NO: 7310177 - DNA, 22 bp, Homo sapiens
gctgccctgcatctgtgccttc

SEQ ID NO: 7310178 - DNA, 22 bp, Homo sapiens
gctgccctctctggccccacac

SEQ ID NO: 7310179 - DNA, 22 bp, Homo sapiens
caagaagaggtgattggtaagt

SEQ ID NO: 7310180 - DNA, 22 bp, Homo sapiens
caagaagaggtgattggtaagt

SEQ ID NO: 7310181 - DNA, 22 bp, Homo sapiens
caagaatataaatactttcaaa

SEQ ID NO: 7310182 - DNA, 22 bp, Homo sapiens
caagaataaccagacaatagca

SEQ ID NO: 7310183 - DNA, 22 bp, Homo sapiens
caagaataaccagacaatagca

SEQ ID NO: 7310184 - DNA, 22 bp, Homo sapiens
gctgcctgcctgcatttaatcc

SEQ ID NO: 7310185 - DNA, 22 bp, Homo sapiens
gctgcctgcctagttccacagt

SEQ ID NO: 7310186 - DNA, 22 bp, Homo sapiens
gctgcctgccttgcctggagga

SEQ ID NO: 7310187 - DNA, 22 bp, Homo sapiens
gctgcctgcagtgttttcccag

SEQ ID NO: 7310188 - DNA, 18 bp, Homo sapiens
gctgcctgcattcctcac

SEQ ID NO: 7310189 - DNA, 22 bp, Homo sapiens
gctgcctgccctgggtcatctg

SEQ ID NO: 7310190 - DNA, 21 bp, Homo sapiens
gctgcctgcccctcgggggct

SEQ ID NO: 7310191 - DNA, 22 bp, Homo sapiens
caagcgtggctgctctgatgga

SEQ ID NO: 7310192 - DNA, 22 bp, Homo sapiens
caagcctgtctcaccagtgcta

SEQ ID NO: 7310193 - DNA, 22 bp, Homo sapiens
gctggggagcaagagtagtgag

SEQ ID NO: 7310194 - DNA, 22 bp, Homo sapiens
gctggggactccccaccatagc

SEQ ID NO: 7310195 - DNA, 22 bp, Homo sapiens
gctggggagaattgggttatct

SEQ ID NO: 7310196 - DNA, 19 bp, Homo sapiens
gctggggaatggatattga

SEQ ID NO: 7310197 - DNA, 22 bp, Homo sapiens
gctggggaccagctgtctctga

SEQ ID NO: 7310198 - DNA, 19 bp, Homo sapiens
caattctattatcattcca

SEQ ID NO: 7310199 - DNA, 22 bp, Homo sapiens
caattcccagctgccgggctgc

SEQ ID NO: 7310200 - DNA, 22 bp, Homo sapiens
caattctttgtagaagctctcc

SEQ ID NO: 7310201 - DNA, 22 bp, Homo sapiens
caatgttttgttgaatgaatag

SEQ ID NO: 7310202 - DNA, 22 bp, Homo sapiens
caatcatttatgcttgcggagg

SEQ ID NO: 7310203 - DNA, 22 bp, Homo sapiens
caatgttttgttgaatgaatag

SEQ ID NO: 7310204 - DNA, 22 bp, Homo sapiens
caatgttttcaactgacaagta

SEQ ID NO: 7310205 - DNA, 22 bp, Homo sapiens
caatttcagtctcagagagttc

SEQ ID NO: 7310206 - DNA, 22 bp, Homo sapiens
caatttcagtgctgtggagagg

SEQ ID NO: 7310207 - DNA, 23 bp, Homo sapiens
caatttcatatgattctacctaa

SEQ ID NO: 7310208 - DNA, 22 bp, Homo sapiens
caatttcagacctttccttgga

SEQ ID NO: 7310209 - DNA, 22 bp, Homo sapiens
caatttcactaataatatttac

SEQ ID NO: 7310210 - DNA, 22 bp, Homo sapiens
caatttcaatacaaaatacatt

SEQ ID NO: 7310211 - DNA, 22 bp, Homo sapiens
caatttcatggataaaagatgt

SEQ ID NO: 7310212 - DNA, 22 bp, Homo sapiens
caatttcatcttgtgcttcaat

SEQ ID NO: 7310213 - DNA, 22 bp, Homo sapiens
caatttcattaatagatataga

SEQ ID NO: 7310214 - DNA, 22 bp, Homo sapiens
caatagaaaactcaatacttaa

SEQ ID NO: 7310215 - DNA, 22 bp, Homo sapiens
caatagaaggcacagataggta

SEQ ID NO: 7310216 - DNA, 22 bp, Homo sapiens
caatatataggaacaacttagg

SEQ ID NO: 7310217 - DNA, 22 bp, Homo sapiens
caatatataatgagtactttcc

SEQ ID NO: 7310218 - DNA, 22 bp, Homo sapiens
gctggggagctagacctcagca

SEQ ID NO: 7310219 - DNA, 22 bp, Homo sapiens
gctggggaggcagcagagaaca

SEQ ID NO: 7310220 - DNA, 22 bp, Homo sapiens
caatactgcatctttgcccttt

SEQ ID NO: 7310221 - DNA, 22 bp, Homo sapiens
caatactgggcaggagagtaca

SEQ ID NO: 7310222 - DNA, 20 bp, Homo sapiens
ggagagcagggaagacagta

SEQ ID NO: 7310223 - DNA, 22 bp, Homo sapiens
ggagaagggacagactcagctt

SEQ ID NO: 7310224 - DNA, 22 bp, Homo sapiens
ggagaaggcgaagtcattcttt

SEQ ID NO: 7310225 - DNA, 22 bp, Homo sapiens
ggagaagggccaattccatgta

SEQ ID NO: 7310226 - DNA, 21 bp, Homo sapiens
cacacagtgatctatccacat

SEQ ID NO: 7310227 - DNA, 22 bp, Homo sapiens
ggaagctgccagtccaccagct

SEQ ID NO: 7310228 - DNA, 22 bp, Homo sapiens
ggaagctgcataactagcgtgg

SEQ ID NO: 7310229 - DNA, 22 bp, Homo sapiens
ggaagctggacaggctttgagt

SEQ ID NO: 7310230 - DNA, 20 bp, Homo sapiens
ggaagctgtgggtccccagg

SEQ ID NO: 7310231 - DNA, 22 bp, Homo sapiens
ggaagctgtgctctcaggcctc

SEQ ID NO: 7310232 - DNA, 22 bp, Homo sapiens
ggaagctgtgctctcaggcctc

SEQ ID NO: 7310233 - DNA, 22 bp, Homo sapiens
ggaagctggcatatgtaatcct

SEQ ID NO: 7310234 - DNA, 22 bp, Homo sapiens
ggacatttctattgagctaaga

SEQ ID NO: 7310235 - DNA, 22 bp, Homo sapiens
ggacatttagaacagagtattt

SEQ ID NO: 7310236 - DNA, 22 bp, Homo sapiens
cacaacttagcagcttgaaaca

SEQ ID NO: 7310237 - DNA, 19 bp, Homo sapiens
cacaacttcgcttgattcc

SEQ ID NO: 7310238 - DNA, 22 bp, Homo sapiens
cacaacttagcaatgttttaga

SEQ ID NO: 7310239 - DNA, 22 bp, Homo sapiens
cagcaaaggtagaagcacagga

SEQ ID NO: 7310240 - DNA, 22 bp, Homo sapiens
cagcagccactagagggctcac

SEQ ID NO: 7310241 - DNA, 22 bp, Homo sapiens
cagattaagtgctcaacagtgt

SEQ ID NO: 7310242 - DNA, 20 bp, Homo sapiens
cagcaaaatgaaaatggatt

SEQ ID NO: 7310243 - DNA, 22 bp, Homo sapiens
cagcaaaagccagcataagctc

SEQ ID NO: 7310244 - DNA, 22 bp, Homo sapiens
cagcaaaagccagcataagctc

SEQ ID NO: 7310245 - DNA, 22 bp, Homo sapiens
cagattttgatgaatgtggaaa

SEQ ID NO: 7310246 - DNA, 22 bp, Homo sapiens
cagatttctatttcaaatacat

SEQ ID NO: 7310247 - DNA, 22 bp, Homo sapiens
gtacactattaaacctgctcat

SEQ ID NO: 7310248 - DNA, 22 bp, Homo sapiens
gtacacatatttccaagggtaa

SEQ ID NO: 7310249 - DNA, 22 bp, Homo sapiens
gtacacatatattaaaaattgt

SEQ ID NO: 7310250 - DNA, 23 bp, Homo sapiens
gtacacatagtgtagttatattt

SEQ ID NO: 7310251 - DNA, 20 bp, Homo sapiens
gtacacatatatgtatgtgt

SEQ ID NO: 7310252 - DNA, 22 bp, Homo sapiens
gtactataggtaatgtagacca

SEQ ID NO: 7310253 - DNA, 22 bp, Homo sapiens
gtacacataggttactgattaa

SEQ ID NO: 7310254 - DNA, 22 bp, Homo sapiens
gtacacagatgcttgagaatct

SEQ ID NO: 7310255 - DNA, 22 bp, Homo sapiens
gtacacactatgtattgtacac

SEQ ID NO: 7310256 - DNA, 22 bp, Homo sapiens
gtacacactatttaaagtgttt

SEQ ID NO: 7310257 - DNA, 22 bp, Homo sapiens
gtacacactgtttgatcatttc

SEQ ID NO: 7310258 - DNA, 22 bp, Homo sapiens
gtagaaatggtgtgtttcttct

SEQ ID NO: 7310259 - DNA, 22 bp, Homo sapiens
gtagaaatagtggttgacagga

SEQ ID NO: 7310260 - DNA, 20 bp, Homo sapiens
gtacttcaggtgtggtctga

SEQ ID NO: 7310261 - DNA, 22 bp, Homo sapiens
gtcacagaggctgccagggttg

SEQ ID NO: 7310262 - DNA, 22 bp, Homo sapiens
gtcagagttccaaattaatcaa

SEQ ID NO: 7310263 - DNA, 22 bp, Homo sapiens
gtcacaggaagcagcaggcact

SEQ ID NO: 7310264 - DNA, 22 bp, Homo sapiens
gtattttacttacgcatgactt

SEQ ID NO: 7310265 - DNA, 22 bp, Homo sapiens
gtcacacacatttctttggtgc

SEQ ID NO: 7310266 - DNA, 22 bp, Homo sapiens
gtcacacacatttctttggtgc

SEQ ID NO: 7310267 - DNA, 22 bp, Homo sapiens
gtcacacagagccctgtgctca

SEQ ID NO: 7310268 - DNA, 21 bp, Homo sapiens
gtcacacaggcctggagctga

SEQ ID NO: 7310269 - DNA, 21 bp, Homo sapiens
gtcacacaggcctggagctga

SEQ ID NO: 7310270 - DNA, 22 bp, Homo sapiens
gtcagcagggtccccttgagtg

SEQ ID NO: 7310271 - DNA, 22 bp, Homo sapiens
gtcagcagggctccctggcagg

SEQ ID NO: 7310272 - DNA, 21 bp, Homo sapiens
gtcagcagatccagcacttgt

SEQ ID NO: 7310273 - DNA, 22 bp, Homo sapiens
cagcatcccagagcccagagct

SEQ ID NO: 7310274 - DNA, 22 bp, Homo sapiens
cagcatccgttctcaggactga

SEQ ID NO: 7310275 - DNA, 22 bp, Homo sapiens
gtccagagatggacgagcagat

SEQ ID NO: 7310276 - DNA, 22 bp, Homo sapiens
gtccagagatggacgagcagat

SEQ ID NO: 7310277 - DNA, 22 bp, Homo sapiens
gtccagagccggaagagtgaca

SEQ ID NO: 7310278 - DNA, 22 bp, Homo sapiens
gtccagagggctgcaggatgct

SEQ ID NO: 7310279 - DNA, 22 bp, Homo sapiens
gtccagagggctgcaggatgct

SEQ ID NO: 7310280 - DNA, 22 bp, Homo sapiens
cagcatctgtatcctaggctga

SEQ ID NO: 7310281 - DNA, 22 bp, Homo sapiens
cagccctgtctatgactgatga

SEQ ID NO: 7310282 - DNA, 22 bp, Homo sapiens
cagccctcctttcactcccagg

SEQ ID NO: 7310283 - DNA, 19 bp, Homo sapiens
cagccctcttaccactgtg

SEQ ID NO: 7310284 - DNA, 22 bp, Homo sapiens
gtgagagcctgtctggatgtcg

SEQ ID NO: 7310285 - DNA, 22 bp, Homo sapiens
gtgagagctgctagactgttat

SEQ ID NO: 7310286 - DNA, 22 bp, Homo sapiens
gtgagagctcagctgccctggg

SEQ ID NO: 7310287 - DNA, 22 bp, Homo sapiens
gtcctgtgctcagacatggggg

SEQ ID NO: 7310288 - DNA, 22 bp, Homo sapiens
gtcctgtgcccagaccctctgt

SEQ ID NO: 7310289 - DNA, 22 bp, Homo sapiens
gtcctggttttcacagaccttt

SEQ ID NO: 7310290 - DNA, 22 bp, Homo sapiens
gtcctgtgacctgcatcctgag

SEQ ID NO: 7310291 - DNA, 22 bp, Homo sapiens
gtcctgtgatgagtaccaggtg

SEQ ID NO: 7310292 - DNA, 22 bp, Homo sapiens
gtcctgtgcaccgtgggatgtt

SEQ ID NO: 7310293 - DNA, 22 bp, Homo sapiens
gtcctgtgagattcatgctcaa

SEQ ID NO: 7310294 - DNA, 22 bp, Homo sapiens
cagacaaagcggaaactgttta

SEQ ID NO: 7310295 - DNA, 22 bp, Homo sapiens
cagaataaacagaaacgtagct

SEQ ID NO: 7310296 - DNA, 22 bp, Homo sapiens
cagaaacacttgtagagaagtt

SEQ ID NO: 7310297 - DNA, 22 bp, Homo sapiens
cagaaacacttgtagagaagtt

SEQ ID NO: 7310298 - DNA, 22 bp, Homo sapiens
cagacacagatatgcatatggc

SEQ ID NO: 7310299 - DNA, 22 bp, Homo sapiens
cagacacacaagcaatctaagt

SEQ ID NO: 7310300 - DNA, 22 bp, Homo sapiens
cagacagaaggaaggccaacat

SEQ ID NO: 7310301 - DNA, 22 bp, Homo sapiens
gggagccaaggagagaggcctt

SEQ ID NO: 7310302 - DNA, 22 bp, Homo sapiens
gggagctgcacacgccccggaa

SEQ ID NO: 7310303 - DNA, 22 bp, Homo sapiens
gggagctgctgaacacaagggt

SEQ ID NO: 7310304 - DNA, 22 bp, Homo sapiens
gggagctgccttagaccggagg

SEQ ID NO: 7310305 - DNA, 20 bp, Homo sapiens
gggagctggaattgtcttag

SEQ ID NO: 7310306 - DNA, 22 bp, Homo sapiens
cagagcagaaacctgggtgatt

SEQ ID NO: 7310307 - DNA, 22 bp, Homo sapiens
cagagcactgcttggaggattt

SEQ ID NO: 7310308 - DNA, 22 bp, Homo sapiens
gggatctgtgttgcgatggatt

SEQ ID NO: 7310309 - DNA, 22 bp, Homo sapiens
gggatctgggcctcacacacat

SEQ ID NO: 7310310 - DNA, 23 bp, Homo sapiens
gggatctgtaagttgaagacaaa

SEQ ID NO: 7310311 - DNA, 22 bp, Homo sapiens
gggatgaattgagtcagaaggg

SEQ ID NO: 7310312 - DNA, 22 bp, Homo sapiens
gggatctggaattttggtatgt

SEQ ID NO: 7310313 - DNA, 22 bp, Homo sapiens
gggatctgggacaacaggtggt

SEQ ID NO: 7310314 - DNA, 23 bp, Homo sapiens
gggatctgtaaacctggagaacc

SEQ ID NO: 7310315 - DNA, 22 bp, Homo sapiens
gggatgactttttgaaatggat

SEQ ID NO: 7310316 - DNA, 22 bp, Homo sapiens
cagagacagaaaatggatctag

SEQ ID NO: 7310317 - DNA, 22 bp, Homo sapiens
gggatctgatttaggatgggag

SEQ ID NO: 7310318 - DNA, 22 bp, Homo sapiens
gggatctgctccagagggaaaa

SEQ ID NO: 7310319 - DNA, 22 bp, Homo sapiens
cagagacacttaacaggaatgg

SEQ ID NO: 7310320 - DNA, 22 bp, Homo sapiens
cagagacacttaacaggaatgg

SEQ ID NO: 7310321 - DNA, 22 bp, Homo sapiens
cagagacaccccagaaaataag

SEQ ID NO: 7310322 - DNA, 22 bp, Homo sapiens
cagagccacagcctccagattt

SEQ ID NO: 7310323 - DNA, 22 bp, Homo sapiens
gggcaggggtcagtggccccaa

SEQ ID NO: 7310324 - DNA, 18 bp, Homo sapiens
gggtcctgtgggagacag

SEQ ID NO: 7310325 - DNA, 22 bp, Homo sapiens
gggtcctgcgtgggcccaggac

SEQ ID NO: 7310326 - DNA, 22 bp, Homo sapiens
gggtccaggtcttcaggcagag

SEQ ID NO: 7310327 - DNA, 22 bp, Homo sapiens
gggtccagtttcatctgaggtt

SEQ ID NO: 7310328 - DNA, 22 bp, Homo sapiens
gggtgtgttcctaaggaaacca

SEQ ID NO: 7310329 - DNA, 22 bp, Homo sapiens
gggtgtgtcttttgctcctgga

SEQ ID NO: 7310330 - DNA, 20 bp, Homo sapiens
gggtgtgtgcagggcctggt

SEQ ID NO: 7310331 - DNA, 22 bp, Homo sapiens
gggtgtgtcttttgctcctgga

SEQ ID NO: 7310332 - DNA, 22 bp, Homo sapiens
gggtgtgcaggtcatggcgtct

SEQ ID NO: 7310333 - DNA, 18 bp, Homo sapiens
ggtcctgaatgcctgcta

SEQ ID NO: 7310334 - DNA, 22 bp, Homo sapiens
ggtcaacttgagaagctagtac

SEQ ID NO: 7310335 - DNA, 22 bp, Homo sapiens
gggtaaatctcttttcatggct

SEQ ID NO: 7310336 - DNA, 22 bp, Homo sapiens
gggctggaggtgagcaggacag

SEQ ID NO: 7310337 - DNA, 22 bp, Homo sapiens
gggctggaggcctgcctggtta

SEQ ID NO: 7310338 - DNA, 22 bp, Homo sapiens
cagagccagagacctgctgtgc

SEQ ID NO: 7310339 - DNA, 22 bp, Homo sapiens
cagagccagaactagaccttgt

SEQ ID NO: 7310340 - DNA, 22 bp, Homo sapiens
cagagccacttggagatgagaa

SEQ ID NO: 7310341 - DNA, 22 bp, Homo sapiens
gggctggatctcctgcaggcag

SEQ ID NO: 7310342 - DNA, 22 bp, Homo sapiens
gggctgtggagccgcgagggct

SEQ ID NO: 7310343 - DNA, 22 bp, Homo sapiens
cccagcagaccgctgtgatggc

SEQ ID NO: 7310344 - DNA, 22 bp, Homo sapiens
cccagcagaatctgatgagggc

SEQ ID NO: 7310345 - DNA, 23 bp, Homo sapiens
cccagcagagatgaggaggggtc

SEQ ID NO: 7310346 - DNA, 22 bp, Homo sapiens
tgcagcagtcagtcaggcctgg

SEQ ID NO: 7310347 - DNA, 22 bp, Homo sapiens
cccagcagccagaatgaggagc

SEQ ID NO: 7310348 - DNA, 22 bp, Homo sapiens
cccagagaagtgaagtgacttg

SEQ ID NO: 7310349 - DNA, 22 bp, Homo sapiens
cccagagagcacaggtggtggg

SEQ ID NO: 7310350 - DNA, 19 bp, Homo sapiens
cccagagagatctcttgcc

SEQ ID NO: 7310351 - DNA, 22 bp, Homo sapiens
cccacaggcaggtgcatgggct

SEQ ID NO: 7310352 - DNA, 22 bp, Homo sapiens
cccacaggctaggggtagggca

SEQ ID NO: 7310353 - DNA, 22 bp, Homo sapiens
cccacagggctgctgatggcag

SEQ ID NO: 7310354 - DNA, 22 bp, Homo sapiens
tgcagagagttagggcccgtat

SEQ ID NO: 7310355 - DNA, 22 bp, Homo sapiens
tgcagagatagaactactttct

SEQ ID NO: 7310356 - DNA, 22 bp, Homo sapiens
ccatggaagaactgatgtgcca

SEQ ID NO: 7310357 - DNA, 19 bp, Homo sapiens
ccatggagagagatgcatt

SEQ ID NO: 7310358 - DNA, 22 bp, Homo sapiens
tgatgacccaaggtgtcctctg

SEQ ID NO: 7310359 - DNA, 22 bp, Homo sapiens
tgatgactgccattctattact

SEQ ID NO: 7310360 - DNA, 22 bp, Homo sapiens
tgaggcagtgctgggaagcctg

SEQ ID NO: 7310361 - DNA, 22 bp, Homo sapiens
tgatacataaaccatcattttg

SEQ ID NO: 7310362 - DNA, 22 bp, Homo sapiens
ccatttttcataaactatccaa

SEQ ID NO: 7310363 - DNA, 22 bp, Homo sapiens
ccatttttcataaactatccaa

SEQ ID NO: 7310364 - DNA, 22 bp, Homo sapiens
ccattgtgcacctccagggctg

SEQ ID NO: 7310365 - DNA, 22 bp, Homo sapiens
ccatggcctcgctctacgtggg

SEQ ID NO: 7310366 - DNA, 22 bp, Homo sapiens
ccatggcctcgctctacgtggg

SEQ ID NO: 7310367 - DNA, 22 bp, Homo sapiens
ccatggccaggaaagccaaggt

SEQ ID NO: 7310368 - DNA, 22 bp, Homo sapiens
ccatggccgccgctgctcagga

SEQ ID NO: 7310369 - DNA, 20 bp, Homo sapiens
ccatggccacatctgtgctg

SEQ ID NO: 7310370 - DNA, 22 bp, Homo sapiens
ccatggccaattgcaccttgct

SEQ ID NO: 7310371 - DNA, 23 bp, Homo sapiens
ccatggccaatgtcaagctacta

SEQ ID NO: 7310372 - DNA, 19 bp, Homo sapiens
cccaactggatccatcata

SEQ ID NO: 7310373 - DNA, 19 bp, Homo sapiens
cccaacttgactattttct

SEQ ID NO: 7310374 - DNA, 22 bp, Homo sapiens
cccaggagacagaaacagaggt

SEQ ID NO: 7310375 - DNA, 23 bp, Homo sapiens
tgcatatcagaaatttcatatgg

SEQ ID NO: 7310376 - DNA, 22 bp, Homo sapiens
cccaggaggcctgcctggccgg

SEQ ID NO: 7310377 - DNA, 19 bp, Homo sapiens
cccaggaggcggaggttgc

SEQ ID NO: 7310378 - DNA, 22 bp, Homo sapiens
cccaggaggcggaggttgtggt

SEQ ID NO: 7310379 - DNA, 22 bp, Homo sapiens
tgccctcagccacctccaagtt

SEQ ID NO: 7310380 - DNA, 19 bp, Homo sapiens
cccaggagtctggctggtt

SEQ ID NO: 7310381 - DNA, 22 bp, Homo sapiens
cccaggagtaagtgacattgtt

SEQ ID NO: 7310382 - DNA, 22 bp, Homo sapiens
cccaggagttagaggttgtggt

SEQ ID NO: 7310383 - DNA, 22 bp, Homo sapiens
tgcagtctggatgtcctcagat

SEQ ID NO: 7310384 - DNA, 22 bp, Homo sapiens
tgcagtcttccagctgcacaaa

SEQ ID NO: 7310385 - DNA, 22 bp, Homo sapiens
cccaggaccgcgcggctgagcg

SEQ ID NO: 7310386 - DNA, 22 bp, Homo sapiens
cccaggacccttcaatggctcc

SEQ ID NO: 7310387 - DNA, 22 bp, Homo sapiens
cccaggaccatccttctgtgcc

SEQ ID NO: 7310388 - DNA, 22 bp, Homo sapiens
cccagcagtaaccagtggaaat

SEQ ID NO: 7310389 - DNA, 22 bp, Homo sapiens
tgcagcatctccttaaatcttg

SEQ ID NO: 7310390 - DNA, 19 bp, Homo sapiens
cccagccaggtcttgcatc

SEQ ID NO: 7310391 - DNA, 22 bp, Homo sapiens
cccagcccacggtcctgggtgg

SEQ ID NO: 7310392 - DNA, 22 bp, Homo sapiens
tgacagagctggagaataattt

SEQ ID NO: 7310393 - DNA, 22 bp, Homo sapiens
tgacagagctggagaataattt

SEQ ID NO: 7310394 - DNA, 22 bp, Homo sapiens
tgacagagcatgtagtgacagc

SEQ ID NO: 7310395 - DNA, 22 bp, Homo sapiens
tgacagagcaagatctagataa

SEQ ID NO: 7310396 - DNA, 22 bp, Homo sapiens
tgacagagaggtaagttatgaa

SEQ ID NO: 7310397 - DNA, 22 bp, Homo sapiens
ccagggccaagagacctcgagg

SEQ ID NO: 7310398 - DNA, 22 bp, Homo sapiens
ccagggccaagagacctcgagg

SEQ ID NO: 7310399 - DNA, 22 bp, Homo sapiens
ccaggctttcccagcctctcca

SEQ ID NO: 7310400 - DNA, 22 bp, Homo sapiens
tgacaatgggtggacaagatag

SEQ ID NO: 7310401 - DNA, 22 bp, Homo sapiens
tgacaattcattatatctacag

SEQ ID NO: 7310402 - DNA, 22 bp, Homo sapiens
tgacatctgtcataaaatgtat

SEQ ID NO: 7310403 - DNA, 22 bp, Homo sapiens
tgacatttttgtacaaagtcag

SEQ ID NO: 7310404 - DNA, 23 bp, Homo sapiens
ccagggcccctacaccactgtcc

SEQ ID NO: 7310405 - DNA, 22 bp, Homo sapiens
ccagggcccacggccagaatag

SEQ ID NO: 7310406 - DNA, 23 bp, Homo sapiens
ccagggcccctacaccactgtcc

SEQ ID NO: 7310407 - DNA, 22 bp, Homo sapiens
ccagggccagtaagattggcat

SEQ ID NO: 7310408 - DNA, 22 bp, Homo sapiens
ccagggtctctgctgcctgaga

SEQ ID NO: 7310409 - DNA, 22 bp, Homo sapiens
tgagaaaactcaaagacagatc

SEQ ID NO: 7310410 - DNA, 22 bp, Homo sapiens
ccagggtcttcgaggcagcaat

SEQ ID NO: 7310411 - DNA, 21 bp, Homo sapiens
tgactttatattgtgtcagga

SEQ ID NO: 7310412 - DNA, 22 bp, Homo sapiens
tgactttagacttagtcaagtt

SEQ ID NO: 7310413 - DNA, 22 bp, Homo sapiens
tgagaggtgaggcatgaggcat

SEQ ID NO: 7310414 - DNA, 22 bp, Homo sapiens
ccagggtgggaggctgaaggcg

SEQ ID NO: 7310415 - DNA, 22 bp, Homo sapiens
ccagggtgtagggattccagat

SEQ ID NO: 7310416 - DNA, 22 bp, Homo sapiens
tgaggaatgctgagcagaggaa

SEQ ID NO: 7310417 - DNA, 22 bp, Homo sapiens
tgaggaagttgtttctcttcta

SEQ ID NO: 7310418 - DNA, 22 bp, Homo sapiens
tgagcagaagttataaataaga

SEQ ID NO: 7310419 - DNA, 19 bp, Homo sapiens
tctgcagactatattgtga

SEQ ID NO: 7310420 - DNA, 22 bp, Homo sapiens
tcttgtttcttctaagcagcag

SEQ ID NO: 7310421 - DNA, 22 bp, Homo sapiens
tcttggggtagacctgagaatt

SEQ ID NO: 7310422 - DNA, 22 bp, Homo sapiens
tctttatttctgaatcccccat

SEQ ID NO: 7310423 - DNA, 22 bp, Homo sapiens
tctttattttatgcttgtgcaa

SEQ ID NO: 7310424 - DNA, 22 bp, Homo sapiens
tctttcaaagcaaaatgaggct

SEQ ID NO: 7310425 - DNA, 22 bp, Homo sapiens
tctttcaaagctgtagtagatt

SEQ ID NO: 7310426 - DNA, 19 bp, Homo sapiens
ccaggcctggcgtctccgc

SEQ ID NO: 7310427 - DNA, 22 bp, Homo sapiens
ccaggctcactgactaccacat

SEQ ID NO: 7310428 - DNA, 22 bp, Homo sapiens
ccaggctcacagcatcccagga

SEQ ID NO: 7310429 - DNA, 17 bp, Homo sapiens
ccaggctccatcactgt

SEQ ID NO: 7310430 - DNA, 22 bp, Homo sapiens
tgaagagatagaagtacatgct

SEQ ID NO: 7310431 - DNA, 22 bp, Homo sapiens
tgaagagattaagttggttttg

SEQ ID NO: 7310432 - DNA, 22 bp, Homo sapiens
tgaagagatagaagtacatgct

SEQ ID NO: 7310433 - DNA, 22 bp, Homo sapiens
tgaacaggtcttagtaggttct

SEQ ID NO: 7310434 - DNA, 22 bp, Homo sapiens
tgaacagctatcttgtcagtgt

SEQ ID NO: 7310435 - DNA, 22 bp, Homo sapiens
tgaacaggagaaaggtttcttt

SEQ ID NO: 7310436 - DNA, 22 bp, Homo sapiens
tgaacacatttgggaaaatctt

SEQ ID NO: 7310437 - DNA, 22 bp, Homo sapiens
tgaacacattttcttcagtaga

SEQ ID NO: 7310438 - DNA, 22 bp, Homo sapiens
tgaacactgccatatttaagaa

SEQ ID NO: 7310439 - DNA, 22 bp, Homo sapiens
tgaagatttccaccaaatcaca

SEQ ID NO: 7310440 - DNA, 22 bp, Homo sapiens
tgaagctttaggatgggttcat

SEQ ID NO: 7310441 - DNA, 22 bp, Homo sapiens
tgaaggagaaatggaaagtggg

SEQ ID NO: 7310442 - DNA, 22 bp, Homo sapiens
tgaaggaatgagtatactgttt

SEQ ID NO: 7310443 - DNA, 22 bp, Homo sapiens
tgaaaggaaagtacagtgatgc

SEQ ID NO: 7310444 - DNA, 22 bp, Homo sapiens
tgaaagcattagtctaaggtag

SEQ ID NO: 7310445 - DNA, 20 bp, Homo sapiens
tgaaagcatgtggtatttgg

SEQ ID NO: 7310446 - DNA, 22 bp, Homo sapiens
tgaaaggaagagggctactcct

SEQ ID NO: 7310447 - DNA, 22 bp, Homo sapiens
tgaaagggaacctgctggactg

SEQ ID NO: 7310448 - DNA, 22 bp, Homo sapiens
tgaacacataaggctttcctgt

SEQ ID NO: 7310449 - DNA, 22 bp, Homo sapiens
cctggagcttttccagttgaca

SEQ ID NO: 7310450 - DNA, 22 bp, Homo sapiens
cctggagggaccctggccctgt

SEQ ID NO: 7310451 - DNA, 22 bp, Homo sapiens
cctggagggcgccgcacagtcc

SEQ ID NO: 7310452 - DNA, 22 bp, Homo sapiens
tgtattctctcaatatttcata

SEQ ID NO: 7310453 - DNA, 22 bp, Homo sapiens
tgtcaacacacctatctcaatt

SEQ ID NO: 7310454 - DNA, 22 bp, Homo sapiens
cctggagcacatggcaggaggc

SEQ ID NO: 7310455 - DNA, 22 bp, Homo sapiens
tgtacattgtcactcatcaagt

SEQ ID NO: 7310456 - DNA, 22 bp, Homo sapiens
tgtacatttagagctcaataga

SEQ ID NO: 7310457 - DNA, 22 bp, Homo sapiens
tgtacatagatcttgaaaatta

SEQ ID NO: 7310458 - DNA, 22 bp, Homo sapiens
tgtacatagaaaggatacagct

SEQ ID NO: 7310459 - DNA, 19 bp, Homo sapiens
tgtacatatagagctcagt

SEQ ID NO: 7310460 - DNA, 22 bp, Homo sapiens
tgtacatatatgtatgtacgca

SEQ ID NO: 7310461 - DNA, 22 bp, Homo sapiens
tgtacatacatagatatacaca

SEQ ID NO: 7310462 - DNA, 22 bp, Homo sapiens
tgtaattgctttgtaatgaaat

SEQ ID NO: 7310463 - DNA, 22 bp, Homo sapiens
tgtaattgcttgtttacctgct

SEQ ID NO: 7310464 - DNA, 22 bp, Homo sapiens
tgtaatttcctgatgttagaac

SEQ ID NO: 7310465 - DNA, 22 bp, Homo sapiens
tgtaattttacgtgacacagtt

SEQ ID NO: 7310466 - DNA, 22 bp, Homo sapiens
tgtaatgttagaaacaattgct

SEQ ID NO: 7310467 - DNA, 22 bp, Homo sapiens
tgtacatacatagatatacaca

SEQ ID NO: 7310468 - DNA, 22 bp, Homo sapiens
tgtacagttaatcttaagccat

SEQ ID NO: 7310469 - DNA, 22 bp, Homo sapiens
tgtaaagacagataaaacagca

SEQ ID NO: 7310470 - DNA, 22 bp, Homo sapiens
tgtaaagacgcttatagcttgc

SEQ ID NO: 7310471 - DNA, 22 bp, Homo sapiens
tgtaaagagaagaaacgtgagc

SEQ ID NO: 7310472 - DNA, 22 bp, Homo sapiens
cctgctgttctgtttagtgaac

SEQ ID NO: 7310473 - DNA, 20 bp, Homo sapiens
cctgctgtttccatggggcc

SEQ ID NO: 7310474 - DNA, 22 bp, Homo sapiens
cctgctgttttcttcacttcag

SEQ ID NO: 7310475 - DNA, 22 bp, Homo sapiens
cctgctgtgtccctggctttct

SEQ ID NO: 7310476 - DNA, 21 bp, Homo sapiens
cctgctgtgatcttagtgagt

SEQ ID NO: 7310477 - DNA, 22 bp, Homo sapiens
cctgctgttagatttcagtcac

SEQ ID NO: 7310478 - DNA, 22 bp, Homo sapiens
cctgctgtgtgacgggatgtta

SEQ ID NO: 7310479 - DNA, 22 bp, Homo sapiens
tgtaagtagtaatggaaggaca

SEQ ID NO: 7310480 - DNA, 22 bp, Homo sapiens
tgtaatatatataactgtgtgc

SEQ ID NO: 7310481 - DNA, 22 bp, Homo sapiens
cctgcctgcctgctggccggga

SEQ ID NO: 7310482 - DNA, 22 bp, Homo sapiens
cctgcctgggctcacttgccag

SEQ ID NO: 7310483 - DNA, 22 bp, Homo sapiens
cctgcctgcggcccgcggggag

SEQ ID NO: 7310484 - DNA, 22 bp, Homo sapiens
cctgcctgggttcaaatcccag

SEQ ID NO: 7310485 - DNA, 22 bp, Homo sapiens
cctgcctggggacaaaggaggg

SEQ ID NO: 7310486 - DNA, 20 bp, Homo sapiens
cctgcctgcctcggctcatt

SEQ ID NO: 7310487 - DNA, 22 bp, Homo sapiens
cctgcctgtaagatgggtacaa

SEQ ID NO: 7310488 - DNA, 22 bp, Homo sapiens
cctgcctggtgtaagtctaagg

SEQ ID NO: 7310489 - DNA, 22 bp, Homo sapiens
cctgcctgtactagagacccag

SEQ ID NO: 7310490 - DNA, 22 bp, Homo sapiens
cctgcctgtcatcgcctgcgcc

SEQ ID NO: 7310491 - DNA, 22 bp, Homo sapiens
cctgcctgtccctcagtccaca

SEQ ID NO: 7310492 - DNA, 20 bp, Homo sapiens
cctgcctgtgtttgtgatga

SEQ ID NO: 7310493 - DNA, 23 bp, Homo sapiens
cctgcctgttctaactccatttc

SEQ ID NO: 7310494 - DNA, 22 bp, Homo sapiens
cctgcctgtctttatcccctgt

SEQ ID NO: 7310495 - DNA, 22 bp, Homo sapiens
tgggtcaccacttcagaggaga

SEQ ID NO: 7310496 - DNA, 22 bp, Homo sapiens
cctgctgtagggcccctggggc

SEQ ID NO: 7310497 - DNA, 22 bp, Homo sapiens
cctgctgtaccctactcggagt

SEQ ID NO: 7310498 - DNA, 22 bp, Homo sapiens
cctgctgtaatgtgtctttatt

SEQ ID NO: 7310499 - DNA, 22 bp, Homo sapiens
cctgctgtcagtggggcaggca

SEQ ID NO: 7310500 - DNA, 22 bp, Homo sapiens
cctgctgtagggcccctggggc

SEQ ID NO: 7310501 - DNA, 22 bp, Homo sapiens
cctgctgtcagcatcctcgcga

SEQ ID NO: 7310502 - DNA, 22 bp, Homo sapiens
cctgctgtccctctgggctcca

SEQ ID NO: 7310503 - DNA, 22 bp, Homo sapiens
cctgctgtcccctgagcctgga

SEQ ID NO: 7310504 - DNA, 22 bp, Homo sapiens
cctgctgtctgctgtgttaagc

SEQ ID NO: 7310505 - DNA, 22 bp, Homo sapiens
cctgctgtgaaactggcatatg

SEQ ID NO: 7310506 - DNA, 22 bp, Homo sapiens
cctgctgtctctgggcaggcag

SEQ ID NO: 7310507 - DNA, 22 bp, Homo sapiens
cctgctgtgaagccaggcctgt

SEQ ID NO: 7310508 - DNA, 22 bp, Homo sapiens
cctgctgtgaccggggagcagg

SEQ ID NO: 7310509 - DNA, 20 bp, Homo sapiens
cctgctgtgctttccatgga

SEQ ID NO: 7310510 - DNA, 22 bp, Homo sapiens
tggtctgttcaaggtggctgat

SEQ ID NO: 7310511 - DNA, 20 bp, Homo sapiens
tggtctggagccagtgagga

SEQ ID NO: 7310512 - DNA, 22 bp, Homo sapiens
tggtctggaactcctggcttca

SEQ ID NO: 7310513 - DNA, 22 bp, Homo sapiens
tggtctgggcaaatccttctga

SEQ ID NO: 7310514 - DNA, 22 bp, Homo sapiens
tggtctcttttcagcctgggga

SEQ ID NO: 7310515 - DNA, 22 bp, Homo sapiens
tggtctgcagacatgtgggtgt

SEQ ID NO: 7310516 - DNA, 22 bp, Homo sapiens
tgggagcctggcaggccagagg

SEQ ID NO: 7310517 - DNA, 22 bp, Homo sapiens
tgggagccattttagaggctgc

SEQ ID NO: 7310518 - DNA, 22 bp, Homo sapiens
tgggagctcctggagggcagga

SEQ ID NO: 7310519 - DNA, 22 bp, Homo sapiens
tggctctgaccaggtagaggag

SEQ ID NO: 7310520 - DNA, 21 bp, Homo sapiens
tggctctgaaagagtgctgca

SEQ ID NO: 7310521 - DNA, 22 bp, Homo sapiens
cctgaagcacaaaagcacagct

SEQ ID NO: 7310522 - DNA, 22 bp, Homo sapiens
tgggccagaggcatggagctat

SEQ ID NO: 7310523 - DNA, 21 bp, Homo sapiens
tgggccagatctgagtttcta

SEQ ID NO: 7310524 - DNA, 22 bp, Homo sapiens
tgggccagatccatggcaataa

SEQ ID NO: 7310525 - DNA, 22 bp, Homo sapiens
tgggccagaagtatgcatgttt

SEQ ID NO: 7310526 - DNA, 22 bp, Homo sapiens
tgggccagagagtaagaaaggt

SEQ ID NO: 7310527 - DNA, 22 bp, Homo sapiens
tgggcagggagctggaaccaca

SEQ ID NO: 7310528 - DNA, 22 bp, Homo sapiens
cctgagggctcagcccccagcc

SEQ ID NO: 7310529 - DNA, 22 bp, Homo sapiens
cctgacctacctgaagtctaca

SEQ ID NO: 7310530 - DNA, 22 bp, Homo sapiens
tggggtacttgtatcaaagcac

SEQ ID NO: 7310531 - DNA, 22 bp, Homo sapiens
tgggggtgtcctggtgcacaca

SEQ ID NO: 7310532 - DNA, 20 bp, Homo sapiens
tggggtcctggaggggatcc

SEQ ID NO: 7310533 - DNA, 22 bp, Homo sapiens
ccctgtgcctagttggcctaaa

SEQ ID NO: 7310534 - DNA, 22 bp, Homo sapiens
ccctgggataccagacaccaga

SEQ ID NO: 7310535 - DNA, 22 bp, Homo sapiens
ccgtgctaggtgatgtgatccc

SEQ ID NO: 7310536 - DNA, 21 bp, Homo sapiens
ccgtgctcggctatggaccac

SEQ ID NO: 7310537 - DNA, 18 bp, Homo sapiens
ccgggctttggtgacaca

SEQ ID NO: 7310538 - DNA, 20 bp, Homo sapiens
cctcacagggcagagagggg

SEQ ID NO: 7310539 - DNA, 17 bp, Homo sapiens
cctcacagggaccagac

SEQ ID NO: 7310540 - DNA, 22 bp, Homo sapiens
cctcacagcctcatgcccagcc

SEQ ID NO: 7310541 - DNA, 22 bp, Homo sapiens
cctcacagccctcctctagcac

SEQ ID NO: 7310542 - DNA, 22 bp, Homo sapiens
ccgtgtgtatggtggaactgct

SEQ ID NO: 7310543 - DNA, 23 bp, Homo sapiens
ccgtgtgtatactctgtaataga

SEQ ID NO: 7310544 - DNA, 21 bp, Homo sapiens
cctaaacaagactgacacaca

SEQ ID NO: 7310545 - DNA, 22 bp, Homo sapiens
cctaaagaattttcatagagct

SEQ ID NO: 7310546 - DNA, 22 bp, Homo sapiens
cctcactcttgtcctggcaggt

SEQ ID NO: 7310547 - DNA, 22 bp, Homo sapiens
cctcactctgcaccctgcagca

SEQ ID NO: 7310548 - DNA, 21 bp, Homo sapiens
tggccctggccacggctgcca

SEQ ID NO: 7310549 - DNA, 22 bp, Homo sapiens
tggcctcaagtctgagggcctt

SEQ ID NO: 7310550 - DNA, 22 bp, Homo sapiens
tggcctcggcatccagcaagag

SEQ ID NO: 7310551 - DNA, 22 bp, Homo sapiens
tggcctctctaccaggcagcct

SEQ ID NO: 7310552 - DNA, 22 bp, Homo sapiens
cctcagctgcttccctggagcc

SEQ ID NO: 7310553 - DNA, 23 bp, Homo sapiens
tggctactttatgaggttgagga

SEQ ID NO: 7310554 - DNA, 22 bp, Homo sapiens
tggctactgtatttggacgaca

SEQ ID NO: 7310555 - DNA, 22 bp, Homo sapiens
tggctaacagttaagatttcat

SEQ ID NO: 7310556 - DNA, 19 bp, Homo sapiens
tggctaattttatagaggc

SEQ ID NO: 7310557 - DNA, 20 bp, Homo sapiens
ccctgcagccatgggagtgg

SEQ ID NO: 7310558 - DNA, 22 bp, Homo sapiens
tggaggtgacggggcctcgttg

SEQ ID NO: 7310559 - DNA, 22 bp, Homo sapiens
tggaagaatttggggataaatt

SEQ ID NO: 7310560 - DNA, 22 bp, Homo sapiens
tggaagaatttggggataaatt

SEQ ID NO: 7310561 - DNA, 22 bp, Homo sapiens
tggaagaatgctccacagggaa

SEQ ID NO: 7310562 - DNA, 22 bp, Homo sapiens
tggaagaatgctccacagggaa

SEQ ID NO: 7310563 - DNA, 22 bp, Homo sapiens
tggaagaatgtttgccttataa

SEQ ID NO: 7310564 - DNA, 22 bp, Homo sapiens
tggaagaatgtttgccttataa

SEQ ID NO: 7310565 - DNA, 22 bp, Homo sapiens
tggaagacatactgttttctta

SEQ ID NO: 7310566 - DNA, 22 bp, Homo sapiens
tggaagaataggatagaagaac

SEQ ID NO: 7310567 - DNA, 22 bp, Homo sapiens
tggaagaatatgggggtacaga

SEQ ID NO: 7310568 - DNA, 22 bp, Homo sapiens
tggaagaatatgggggtacaga

SEQ ID NO: 7310569 - DNA, 22 bp, Homo sapiens
tggaagaataggatagaagaac

SEQ ID NO: 7310570 - DNA, 22 bp, Homo sapiens
tggaagaatagaagatggttga

SEQ ID NO: 7310571 - DNA, 22 bp, Homo sapiens
tggaagaataggatagaagaac

SEQ ID NO: 7310572 - DNA, 22 bp, Homo sapiens
tggaagaaggcagagaggcatt

SEQ ID NO: 7310573 - DNA, 22 bp, Homo sapiens
tggaagaaggcagagaggcatt

SEQ ID NO: 7310574 - DNA, 22 bp, Homo sapiens
tggaaagagaaactcttgctaa

SEQ ID NO: 7310575 - DNA, 22 bp, Homo sapiens
tggaagaagctacaagcggtga

SEQ ID NO: 7310576 - DNA, 22 bp, Homo sapiens
tggaagaagctacaagcggtga

SEQ ID NO: 7310577 - DNA, 22 bp, Homo sapiens
tggaaagacatgtccttcatta

SEQ ID NO: 7310578 - DNA, 22 bp, Homo sapiens
tggaaagacattcagccgctgg

SEQ ID NO: 7310579 - DNA, 22 bp, Homo sapiens
tggaaagacatgtccttcatta

SEQ ID NO: 7310580 - DNA, 22 bp, Homo sapiens
ccctactcaccacacatcttta

SEQ ID NO: 7310581 - DNA, 22 bp, Homo sapiens
ccctagaaatgaaagcatacgt

SEQ ID NO: 7310582 - DNA, 22 bp, Homo sapiens
cccgggttgtccgcgcgtccgg

SEQ ID NO: 7310583 - DNA, 22 bp, Homo sapiens
tgcctgcgaggcatgggtgaga

SEQ ID NO: 7310584 - DNA, 22 bp, Homo sapiens
tgcctcataacactcctggagt

SEQ ID NO: 7310585 - DNA, 22 bp, Homo sapiens
tgcctcagtttctccatatgaa

SEQ ID NO: 7310586 - DNA, 22 bp, Homo sapiens
tgctttatttataaaatagcaa

SEQ ID NO: 7310587 - DNA, 22 bp, Homo sapiens
tgctttcactgatgtatcattt

SEQ ID NO: 7310588 - DNA, 22 bp, Homo sapiens
tgctttcatgaagtctatagag

SEQ ID NO: 7310589 - DNA, 21 bp, Homo sapiens
tgctttctaaaaatactattg

SEQ ID NO: 7310590 - DNA, 22 bp, Homo sapiens
tcctctgccaaagggagttgcc

SEQ ID NO: 7310591 - DNA, 22 bp, Homo sapiens
tcctgaattgttgagaagcagc

SEQ ID NO: 7310592 - DNA, 18 bp, Homo sapiens
tcctctctttccccaggg

SEQ ID NO: 7310593 - DNA, 22 bp, Homo sapiens
ccacatttactgatgtatgtat

SEQ ID NO: 7310594 - DNA, 22 bp, Homo sapiens
tcctgacctgaactggggtctt

SEQ ID NO: 7310595 - DNA, 22 bp, Homo sapiens
tcggtcaccgcgggctgcggcg

SEQ ID NO: 7310596 - DNA, 22 bp, Homo sapiens
ccaccagctttgccaccctgct

SEQ ID NO: 7310597 - DNA, 22 bp, Homo sapiens
ccacatttggagaagatacttt

SEQ ID NO: 7310598 - DNA, 20 bp, Homo sapiens
ccacattttactgtttgcca

SEQ ID NO: 7310599 - DNA, 20 bp, Homo sapiens
ccacattttactgtttgcca

SEQ ID NO: 7310600 - DNA, 22 bp, Homo sapiens
tctcaacaccacttgctgaaga

SEQ ID NO: 7310601 - DNA, 22 bp, Homo sapiens
tctatataacctccacttctac

SEQ ID NO: 7310602 - DNA, 22 bp, Homo sapiens
ccacttttcactaagatgaatt

SEQ ID NO: 7310603 - DNA, 22 bp, Homo sapiens
tctccacactttctctcccagg

SEQ ID NO: 7310604 - DNA, 21 bp, Homo sapiens
ccagagagagggaagtgggtt

SEQ ID NO: 7310605 - DNA, 22 bp, Homo sapiens
ccagagagctacaaggcataaa

SEQ ID NO: 7310606 - DNA, 22 bp, Homo sapiens
tctccaggaaccatcatggtaa

SEQ ID NO: 7310607 - DNA, 22 bp, Homo sapiens
tctccaggaaagacactggact

SEQ ID NO: 7310608 - DNA, 22 bp, Homo sapiens
ccagagaggccaaggtcgtggt

SEQ ID NO: 7310609 - DNA, 22 bp, Homo sapiens
tctccgatcacaggttttcaat

SEQ ID NO: 7310610 - DNA, 22 bp, Homo sapiens
tctcccttggtcacagattcct

SEQ ID NO: 7310611 - DNA, 22 bp, Homo sapiens
tctgatataaaagtgacattca

SEQ ID NO: 7310612 - DNA, 21 bp, Homo sapiens
tctgatatatccccaagttac

SEQ ID NO: 7310613 - DNA, 22 bp, Homo sapiens
tctgatatcgcactaaactctg

SEQ ID NO: 7310614 - DNA, 22 bp, Homo sapiens
tctgatatctctccctgggtca

SEQ ID NO: 7310615 - DNA, 22 bp, Homo sapiens
tctgatatgaatgtctagctct

SEQ ID NO: 7310616 - DNA, 22 bp, Homo sapiens
tctgcagaaggaatcagctgag

SEQ ID NO: 7310617 - DNA, 22 bp, Homo sapiens
tctgatattggacaattcaggg

SEQ ID NO: 7310618 - DNA, 22 bp, Homo sapiens
ccagcatctaacgctcctggga

SEQ ID NO: 7310619 - DNA, 22 bp, Homo sapiens
ccagcatctatgtgctgttgat

SEQ ID NO: 7310620 - DNA, 22 bp, Homo sapiens
tctgaatttagtgattagcttt

SEQ ID NO: 7310621 - DNA, 17 bp, Homo sapiens
tctgaatttatactttg

SEQ ID NO: 7310622 - DNA, 19 bp, Homo sapiens
tctgaattatttatgtacc

SEQ ID NO: 7310623 - DNA, 22 bp, Homo sapiens
tctgaattaaaccctttgtgcc

SEQ ID NO: 7310624 - DNA, 22 bp, Homo sapiens
ccagcagctttattggctctcc

SEQ ID NO: 7310625 - DNA, 22 bp, Homo sapiens
ccagcagctcagctactggtca

SEQ ID NO: 7310626 - DNA, 22 bp, Homo sapiens
ccagcagctgcaaagcctgggt

SEQ ID NO: 7310627 - DNA, 22 bp, Homo sapiens
ccagcagctgacaccagtccca

SEQ ID NO: 7310628 - DNA, 22 bp, Homo sapiens
ccagcagctgctatgtggtttt

SEQ ID NO: 7310629 - DNA, 22 bp, Homo sapiens
ccagcagagtatcaatgtattt

SEQ ID NO: 7310630 - DNA, 22 bp, Homo sapiens
ccagcactgctctcagactgag

SEQ ID NO: 7310631 - DNA, 22 bp, Homo sapiens
ccagcagagggtcttggccatt

SEQ ID NO: 7310632 - DNA, 22 bp, Homo sapiens
ccagcagcaggccaggccctcc

SEQ ID NO: 7310633 - DNA, 22 bp, Homo sapiens
ccagcagcagcgtccaaggaga

SEQ ID NO: 7310634 - DNA, 22 bp, Homo sapiens
ccagcagagtggggtttagagt

SEQ ID NO: 7310635 - DNA, 23 bp, Homo sapiens
tctcctggctgcactgtggccac

SEQ ID NO: 7310636 - DNA, 17 bp, Homo sapiens
tctcctggctctatcag

SEQ ID NO: 7310637 - DNA, 22 bp, Homo sapiens
tctcctggctctaaaaggctgt

SEQ ID NO: 7310638 - DNA, 22 bp, Homo sapiens
tctcctggctcaccaggctgga

SEQ ID NO: 7310639 - DNA, 22 bp, Homo sapiens
tctcctggccgggctgtcccct

SEQ ID NO: 7310640 - DNA, 22 bp, Homo sapiens
tctcctggcctttaggttaagg

SEQ ID NO: 7310641 - DNA, 18 bp, Homo sapiens
tcctcagcctcacctagc

SEQ ID NO: 7310642 - DNA, 22 bp, Homo sapiens
tcctcagctttggtttactcat

SEQ ID NO: 7310643 - DNA, 22 bp, Homo sapiens
tcctcagcttttatttcacttg

SEQ ID NO: 7310644 - DNA, 20 bp, Homo sapiens
catttgggatcatgaggttt

SEQ ID NO: 7310645 - DNA, 22 bp, Homo sapiens
catttgtaatactgacttgcag

SEQ ID NO: 7310646 - DNA, 22 bp, Homo sapiens
tcctctccatgtctcacgccac

SEQ ID NO: 7310647 - DNA, 22 bp, Homo sapiens
catttgtatcatatgtatctta

SEQ ID NO: 7310648 - DNA, 22 bp, Homo sapiens
cattgaatccttccttcagaag

SEQ ID NO: 7310649 - DNA, 22 bp, Homo sapiens
cattgagaatctgggctacagc

SEQ ID NO: 7310650 - DNA, 18 bp, Homo sapiens
cattgacagtatatcttt

SEQ ID NO: 7310651 - DNA, 22 bp, Homo sapiens
cattgacatcaggcttggccaa

SEQ ID NO: 7310652 - DNA, 22 bp, Homo sapiens
cattgagcgaccctgcatgact

SEQ ID NO: 7310653 - DNA, 22 bp, Homo sapiens
tccccactctgggccaccacaa

SEQ ID NO: 7310654 - DNA, 19 bp, Homo sapiens
tccccagcacctctgagtc

SEQ ID NO: 7310655 - DNA, 22 bp, Homo sapiens
tccccagcattgagggtctctc

SEQ ID NO: 7310656 - DNA, 22 bp, Homo sapiens
tccccagccgtgaaggagagga

SEQ ID NO: 7310657 - DNA, 22 bp, Homo sapiens
tcccgttgatgacggtgcatcc

SEQ ID NO: 7310658 - DNA, 22 bp, Homo sapiens
tccctactgttagggactcagc

SEQ ID NO: 7310659 - DNA, 22 bp, Homo sapiens
catgttaatatgcattgagtac

SEQ ID NO: 7310660 - DNA, 22 bp, Homo sapiens
catgttaactaagattaactat

SEQ ID NO: 7310661 - DNA, 22 bp, Homo sapiens
catgtttaattgcgatgtttga

SEQ ID NO: 7310662 - DNA, 22 bp, Homo sapiens
tcccagcccaggtatgatgata

SEQ ID NO: 7310663 - DNA, 22 bp, Homo sapiens
tcccagccaggctctaccactt

SEQ ID NO: 7310664 - DNA, 22 bp, Homo sapiens
tcccagaggaaatggcagctga

SEQ ID NO: 7310665 - DNA, 22 bp, Homo sapiens
tcccagaggaaatggcagctga

SEQ ID NO: 7310666 - DNA, 17 bp, Homo sapiens
tccagcctcctctgctg

SEQ ID NO: 7310667 - DNA, 22 bp, Homo sapiens
tccagcctcctatttaccctaa

SEQ ID NO: 7310668 - DNA, 17 bp, Homo sapiens
tccagcctcctctgctg

SEQ ID NO: 7310669 - DNA, 22 bp, Homo sapiens
tccagcctcatttctcctgctt

SEQ ID NO: 7310670 - DNA, 22 bp, Homo sapiens
tccagcctcatttctcctgctt

SEQ ID NO: 7310671 - DNA, 22 bp, Homo sapiens
tccagctgctgacccagtagcc

SEQ ID NO: 7310672 - DNA, 22 bp, Homo sapiens
tccagctgccaaccgggccccg

SEQ ID NO: 7310673 - DNA, 22 bp, Homo sapiens
tccagctgacatctcctgaggg

SEQ ID NO: 7310674 - DNA, 22 bp, Homo sapiens
tccagagaattctacgcagtgc

SEQ ID NO: 7310675 - DNA, 22 bp, Homo sapiens
tccagagaaatctagtcttaca

SEQ ID NO: 7310676 - DNA, 21 bp, Homo sapiens
tccagacctccctctcctagc

SEQ ID NO: 7310677 - DNA, 22 bp, Homo sapiens
tccagactctgtcacttcctag

SEQ ID NO: 7310678 - DNA, 22 bp, Homo sapiens
tccagcctaatgttcttcccac

SEQ ID NO: 7310679 - DNA, 22 bp, Homo sapiens
tccaggccccagaccgtactgc

SEQ ID NO: 7310680 - DNA, 22 bp, Homo sapiens
tccaggccccagcaccttggga

SEQ ID NO: 7310681 - DNA, 22 bp, Homo sapiens
tccaggcccctgcctgggcctg

SEQ ID NO: 7310682 - DNA, 22 bp, Homo sapiens
tccaggccccccacgctaatgg

SEQ ID NO: 7310683 - DNA, 22 bp, Homo sapiens
tccaggcccgagatgggctgga

SEQ ID NO: 7310684 - DNA, 22 bp, Homo sapiens
tccaggcccatggagcagagct

SEQ ID NO: 7310685 - DNA, 22 bp, Homo sapiens
tccaggccccactgaagcccct

SEQ ID NO: 7310686 - DNA, 22 bp, Homo sapiens
catgttaaaatatacattctga

SEQ ID NO: 7310687 - DNA, 22 bp, Homo sapiens
catgtgtgtggctgacaatttt

SEQ ID NO: 7310688 - DNA, 22 bp, Homo sapiens
catgtgtgtccatgtgactaag

SEQ ID NO: 7310689 - DNA, 22 bp, Homo sapiens
catgtgtgtggacgagcgtggc

SEQ ID NO: 7310690 - DNA, 22 bp, Homo sapiens
catgtgtgtgagggaaacatgt

SEQ ID NO: 7310691 - DNA, 22 bp, Homo sapiens
catgtgtgtggacgagcgtggc

SEQ ID NO: 7310692 - DNA, 22 bp, Homo sapiens
catgtgtgtctccaccagctgc

SEQ ID NO: 7310693 - DNA, 22 bp, Homo sapiens
tccaggctcagtcaagcacttc

SEQ ID NO: 7310694 - DNA, 22 bp, Homo sapiens
tccaggctcagtcaagcacttc

SEQ ID NO: 7310695 - DNA, 19 bp, Homo sapiens
tccaggctccattggcaga

SEQ ID NO: 7310696 - DNA, 18 bp, Homo sapiens
tccaggctccaggctaac

SEQ ID NO: 7310697 - DNA, 22 bp, Homo sapiens
tccaggctccctcaggatgcac

SEQ ID NO: 7310698 - DNA, 22 bp, Homo sapiens
tccaggctcccctgcgtgctcc

SEQ ID NO: 7310699 - DNA, 22 bp, Homo sapiens
tcatgacatctgttaggtttat

SEQ ID NO: 7310700 - DNA, 22 bp, Homo sapiens
cataacacattcatcagcagag

SEQ ID NO: 7310701 - DNA, 22 bp, Homo sapiens
tcatgattggaatggaatatgt

SEQ ID NO: 7310702 - DNA, 22 bp, Homo sapiens
catgaaaaatttactgttaaca

SEQ ID NO: 7310703 - DNA, 22 bp, Homo sapiens
catctttggagaaacttccgtt

SEQ ID NO: 7310704 - DNA, 22 bp, Homo sapiens
catctttgggctgcatggaagg

SEQ ID NO: 7310705 - DNA, 20 bp, Homo sapiens
catctttggcaggactcctt

SEQ ID NO: 7310706 - DNA, 19 bp, Homo sapiens
catctttggtcacctagtc

SEQ ID NO: 7310707 - DNA, 22 bp, Homo sapiens
catcttttggcctattctgagg

SEQ ID NO: 7310708 - DNA, 22 bp, Homo sapiens
catctttgttttggatataatc

SEQ ID NO: 7310709 - DNA, 22 bp, Homo sapiens
catctttggttttctatatgcc

SEQ ID NO: 7310710 - DNA, 22 bp, Homo sapiens
catctttgtaacttccacataa

SEQ ID NO: 7310711 - DNA, 22 bp, Homo sapiens
catctttgttctgtaaactttt

SEQ ID NO: 7310712 - DNA, 22 bp, Homo sapiens
catctttgtttcatctgtccag

SEQ ID NO: 7310713 - DNA, 22 bp, Homo sapiens
tccacatcaagggcagagaggt

SEQ ID NO: 7310714 - DNA, 22 bp, Homo sapiens
tccacatagagcttagaagcaa

SEQ ID NO: 7310715 - DNA, 22 bp, Homo sapiens
tcatttatcgctgccttttaaa

SEQ ID NO: 7310716 - DNA, 22 bp, Homo sapiens
tcatttatgtctttgccatcca

SEQ ID NO: 7310717 - DNA, 22 bp, Homo sapiens
tcatttatgcaggaatggcata

SEQ ID NO: 7310718 - DNA, 21 bp, Homo sapiens
tcatttattgagaaatgactg

SEQ ID NO: 7310719 - DNA, 21 bp, Homo sapiens
tcatttattgagaaatgactg

SEQ ID NO: 7310720 - DNA, 22 bp, Homo sapiens
cataaagtagcagagcatgact

SEQ ID NO: 7310721 - DNA, 22 bp, Homo sapiens
cataaagtagcagagcatgact

SEQ ID NO: 7310722 - DNA, 22 bp, Homo sapiens
cataaagtaggcaagcattcca

SEQ ID NO: 7310723 - DNA, 22 bp, Homo sapiens
cataaagtctcataattcactt

SEQ ID NO: 7310724 - DNA, 19 bp, Homo sapiens
cataaatgtacaagataca

SEQ ID NO: 7310725 - DNA, 19 bp, Homo sapiens
cataaatgtacaagataca

SEQ ID NO: 7310726 - DNA, 22 bp, Homo sapiens
cataaagttttataggctcaaa

SEQ ID NO: 7310727 - DNA, 22 bp, Homo sapiens
cataaagtgtataagtgaagaa

SEQ ID NO: 7310728 - DNA, 22 bp, Homo sapiens
cataaactctctgtaccaatat

SEQ ID NO: 7310729 - DNA, 22 bp, Homo sapiens
tcagctttggtcacattgagtt

SEQ ID NO: 7310730 - DNA, 22 bp, Homo sapiens
cagtttacctatatgtaaattt

SEQ ID NO: 7310731 - DNA, 22 bp, Homo sapiens
cagttaaattctccagttacca

SEQ ID NO: 7310732 - DNA, 22 bp, Homo sapiens
cagttaaatttggctgttttct

SEQ ID NO: 7310733 - DNA, 22 bp, Homo sapiens
cagttacatatttagtaggtta

SEQ ID NO: 7310734 - DNA, 22 bp, Homo sapiens
cagttacataaatgataaaatg

SEQ ID NO: 7310735 - DNA, 19 bp, Homo sapiens
cagttacaggcactgtggg

SEQ ID NO: 7310736 - DNA, 22 bp, Homo sapiens
cagttacagctgcaccagagcc

SEQ ID NO: 7310737 - DNA, 21 bp, Homo sapiens
cagttacagccaggacaaggc

SEQ ID NO: 7310738 - DNA, 22 bp, Homo sapiens
cagttacacaccattgtgaaca

SEQ ID NO: 7310739 - DNA, 21 bp, Homo sapiens
cagttacacaagtgttaccag

SEQ ID NO: 7310740 - DNA, 21 bp, Homo sapiens
cagttacacaagtgttaccag

SEQ ID NO: 7310741 - DNA, 18 bp, Homo sapiens
cagttacaccttcattca

SEQ ID NO: 7310742 - DNA, 22 bp, Homo sapiens
cagttacagagccagttagaga

SEQ ID NO: 7310743 - DNA, 19 bp, Homo sapiens
cagttacagcagctaagac

SEQ ID NO: 7310744 - DNA, 19 bp, Homo sapiens
cagttacagcagctaagac

SEQ ID NO: 7310745 - DNA, 22 bp, Homo sapiens
cagttacattaataatgcacat

SEQ ID NO: 7310746 - DNA, 22 bp, Homo sapiens
cagttacatgctcatgtcatca

SEQ ID NO: 7310747 - DNA, 19 bp, Homo sapiens
cagtttaactaattttatc

SEQ ID NO: 7310748 - DNA, 19 bp, Homo sapiens
cagtttaactaattttatc

SEQ ID NO: 7310749 - DNA, 22 bp, Homo sapiens
cagtttaaggcaggacatggga

SEQ ID NO: 7310750 - DNA, 22 bp, Homo sapiens
cagtttaaagaaggatgggagt

SEQ ID NO: 7310751 - DNA, 22 bp, Homo sapiens
tcagcagagctcaggctccagc

SEQ ID NO: 7310752 - DNA, 22 bp, Homo sapiens
tcagcagaatgtggcatgtcac

SEQ ID NO: 7310753 - DNA, 22 bp, Homo sapiens
tcagcagagtttcatcttggga

SEQ ID NO: 7310754 - DNA, 22 bp, Homo sapiens
cagtgtttagcacagtgcttgg

SEQ ID NO: 7310755 - DNA, 22 bp, Homo sapiens
cagtgtttagcacagtgcttgg

SEQ ID NO: 7310756 - DNA, 22 bp, Homo sapiens
tcagacttgactttgtaagttt

SEQ ID NO: 7310757 - DNA, 22 bp, Homo sapiens
cagtgggggtgaggccgaggta

SEQ ID NO: 7310758 - DNA, 22 bp, Homo sapiens
cagtgggatatgggggcagcat

SEQ ID NO: 7310759 - DNA, 22 bp, Homo sapiens
cagtgggatatgggggcagcat

SEQ ID NO: 7310760 - DNA, 22 bp, Homo sapiens
cagtgggaagaatgcagcctcc

SEQ ID NO: 7310761 - DNA, 22 bp, Homo sapiens
cagtgggacatgggcactgggc

SEQ ID NO: 7310762 - DNA, 22 bp, Homo sapiens
cagtgggaatgaagtggaggcc

SEQ ID NO: 7310763 - DNA, 22 bp, Homo sapiens
cagtgggaagggcagaggcttt

SEQ ID NO: 7310764 - DNA, 23 bp, Homo sapiens
cagtgccatttgtcttgcctatg

SEQ ID NO: 7310765 - DNA, 18 bp, Homo sapiens
tcacagacttactgggcc

SEQ ID NO: 7310766 - DNA, 22 bp, Homo sapiens
tcacagacttgtctccagggat

SEQ ID NO: 7310767 - DNA, 21 bp, Homo sapiens
tcacagactggtcagtgaggc

SEQ ID NO: 7310768 - DNA, 22 bp, Homo sapiens
tcacagactgtgttgctactca

SEQ ID NO: 7310769 - DNA, 22 bp, Homo sapiens
tcacagttaattgttggaatgt

SEQ ID NO: 7310770 - DNA, 22 bp, Homo sapiens
tcacagttactccttcagatga

SEQ ID NO: 7310771 - DNA, 22 bp, Homo sapiens
tcacagttcaactagttcagat

SEQ ID NO: 7310772 - DNA, 21 bp, Homo sapiens
tcacagttcaagatgaacccc

SEQ ID NO: 7310773 - DNA, 22 bp, Homo sapiens
tcacagttcatctgataaacta

SEQ ID NO: 7310774 - DNA, 23 bp, Homo sapiens
tcacagttacttttgcatcaacc

SEQ ID NO: 7310775 - DNA, 17 bp, Homo sapiens
tcacagttggtctcagt

SEQ ID NO: 7310776 - DNA, 22 bp, Homo sapiens
tatttcttttcgtgacttattg

SEQ ID NO: 7310777 - DNA, 22 bp, Homo sapiens
tatttcttttcgtgacttattg

SEQ ID NO: 7310778 - DNA, 22 bp, Homo sapiens
tatttcttttcgtgacttattg

SEQ ID NO: 7310779 - DNA, 22 bp, Homo sapiens
tcacaaatattttaacagtagg

SEQ ID NO: 7310780 - DNA, 22 bp, Homo sapiens
tcacaacgcctctgcaaatcct

SEQ ID NO: 7310781 - DNA, 19 bp, Homo sapiens
tcacaactgggggttgagg

SEQ ID NO: 7310782 - DNA, 22 bp, Homo sapiens
tcacagactcaagggcatagga

SEQ ID NO: 7310783 - DNA, 22 bp, Homo sapiens
tcacagacgcatcctcaggtag

SEQ ID NO: 7310784 - DNA, 22 bp, Homo sapiens
tcacagacctggtgggaggtgg

SEQ ID NO: 7310785 - DNA, 18 bp, Homo sapiens
tcacacttcctttgggtc

SEQ ID NO: 7310786 - DNA, 22 bp, Homo sapiens
cagtgagataccacagagcaaa

SEQ ID NO: 7310787 - DNA, 22 bp, Homo sapiens
cagtgacacccagtctggccca

SEQ ID NO: 7310788 - DNA, 22 bp, Homo sapiens
cagtgacgtaaactgcatgtgc

SEQ ID NO: 7310789 - DNA, 22 bp, Homo sapiens
cagtgacacgggctggcccacg

SEQ ID NO: 7310790 - DNA, 22 bp, Homo sapiens
cagtgacagcaagcagtgctgg

SEQ ID NO: 7310791 - DNA, 22 bp, Homo sapiens
cagtgacaggttccatgccgca

SEQ ID NO: 7310792 - DNA, 22 bp, Homo sapiens
tatttcattctttatcaggagc

SEQ ID NO: 7310793 - DNA, 22 bp, Homo sapiens
tatttccaaaaaggccatattc

SEQ ID NO: 7310794 - DNA, 22 bp, Homo sapiens
tatttcattctttatcaggagc

SEQ ID NO: 7310795 - DNA, 22 bp, Homo sapiens
caggtttcattggcagcttcat

SEQ ID NO: 7310796 - DNA, 22 bp, Homo sapiens
tatttcagtcacttcttctctg

SEQ ID NO: 7310797 - DNA, 21 bp, Homo sapiens
tatttctttgactctctccct

SEQ ID NO: 7310798 - DNA, 22 bp, Homo sapiens
tatttctttcaggtatgtgttg

SEQ ID NO: 7310799 - DNA, 22 bp, Homo sapiens
tatttcttgttccctccaagtt

SEQ ID NO: 7310800 - DNA, 22 bp, Homo sapiens
cagtcccagaagagcctgggag

SEQ ID NO: 7310801 - DNA, 22 bp, Homo sapiens
tatttccagaggagtatagaag

SEQ ID NO: 7310802 - DNA, 22 bp, Homo sapiens
tatttccacctattattttctg

SEQ ID NO: 7310803 - DNA, 22 bp, Homo sapiens
tatttccacaccttttgaatct

SEQ ID NO: 7310804 - DNA, 22 bp, Homo sapiens
tatttccaagctgaatccaatg

SEQ ID NO: 7310805 - DNA, 22 bp, Homo sapiens
tatttccacaccttttgaatct

SEQ ID NO: 7310806 - DNA, 22 bp, Homo sapiens
tatttccaaaagcctattatga

SEQ ID NO: 7310807 - DNA, 22 bp, Homo sapiens
tatttccaaaagcctattatga

SEQ ID NO: 7310808 - DNA, 21 bp, Homo sapiens
tatttccaaccctttatcctt

SEQ ID NO: 7310809 - DNA, 21 bp, Homo sapiens
cagtagtgaggtatttgccaa

SEQ ID NO: 7310810 - DNA, 22 bp, Homo sapiens
cagggtggccctgtggtctcat

SEQ ID NO: 7310811 - DNA, 22 bp, Homo sapiens
tatcatcattggcaggtgagaa

SEQ ID NO: 7310812 - DNA, 22 bp, Homo sapiens
caggggagttttatgcaacaga

SEQ ID NO: 7310813 - DNA, 22 bp, Homo sapiens
tagtgaaacagttatcaatctg

SEQ ID NO: 7310814 - DNA, 21 bp, Homo sapiens
tagggcaggcattggaagaga

SEQ ID NO: 7310815 - DNA, 22 bp, Homo sapiens
tagggcaggggaggaatctgaa

SEQ ID NO: 7310816 - DNA, 22 bp, Homo sapiens
tagctagaaagtgaagatcaca

SEQ ID NO: 7310817 - DNA, 22 bp, Homo sapiens
tagctagaaagtttcagctgtg

SEQ ID NO: 7310818 - DNA, 22 bp, Homo sapiens
tagctactagtgaattttggta

SEQ ID NO: 7310819 - DNA, 22 bp, Homo sapiens
cagggcagccaggccccgtggg

SEQ ID NO: 7310820 - DNA, 22 bp, Homo sapiens
taggaaattggaaactcttcac

SEQ ID NO: 7310821 - DNA, 22 bp, Homo sapiens
taggaaattgacacctgcttga

SEQ ID NO: 7310822 - DNA, 22 bp, Homo sapiens
taggaaattaagtctcttttgt

SEQ ID NO: 7310823 - DNA, 22 bp, Homo sapiens
cagggcctggagctgggcctgc

SEQ ID NO: 7310824 - DNA, 22 bp, Homo sapiens
cagggcctgcttccttcttgtt

SEQ ID NO: 7310825 - DNA, 22 bp, Homo sapiens
cagggcctccccggcagtcttt

SEQ ID NO: 7310826 - DNA, 22 bp, Homo sapiens
taggagcttttggagtcctgtg

SEQ ID NO: 7310827 - DNA, 22 bp, Homo sapiens
taggagctgagacatctttaaa

SEQ ID NO: 7310828 - DNA, 21 bp, Homo sapiens
taggagctgatggggaagtag

SEQ ID NO: 7310829 - DNA, 22 bp, Homo sapiens
taggagctataatgtgaagtct

SEQ ID NO: 7310830 - DNA, 22 bp, Homo sapiens
taggagctaaaatattttatat

SEQ ID NO: 7310831 - DNA, 22 bp, Homo sapiens
cagggctcaggctctgggattc

SEQ ID NO: 7310832 - DNA, 22 bp, Homo sapiens
cagggcctgtcacgacgctcat

SEQ ID NO: 7310833 - DNA, 22 bp, Homo sapiens
gtgaggggagtaaagccatgtt

SEQ ID NO: 7310834 - DNA, 22 bp, Homo sapiens
tactatttggaattttaaattg

SEQ ID NO: 7310835 - DNA, 22 bp, Homo sapiens
tactatgtgaaaatactatagt

SEQ ID NO: 7310836 - DNA, 22 bp, Homo sapiens
gtgaggggtggctgagcagttt

SEQ ID NO: 7310837 - DNA, 22 bp, Homo sapiens
gtgaggggccaagagtagggca

SEQ ID NO: 7310838 - DNA, 22 bp, Homo sapiens
tactcattgattcctttactca

SEQ ID NO: 7310839 - DNA, 22 bp, Homo sapiens
tactcattcatgttgttgtatg

SEQ ID NO: 7310840 - DNA, 22 bp, Homo sapiens
tactcatgactgatgaatacct

SEQ ID NO: 7310841 - DNA, 22 bp, Homo sapiens
tactcactattctatcagatag

SEQ ID NO: 7310842 - DNA, 22 bp, Homo sapiens
tactattttgacatgaaattga

SEQ ID NO: 7310843 - DNA, 22 bp, Homo sapiens
tactatttttgcaacgtataca

SEQ ID NO: 7310844 - DNA, 22 bp, Homo sapiens
tactatttttgcaacgtataca

SEQ ID NO: 7310845 - DNA, 22 bp, Homo sapiens
tactgtctttaggggtagaaat

SEQ ID NO: 7310846 - DNA, 23 bp, Homo sapiens
tactgtcttctattaagtaagga

SEQ ID NO: 7310847 - DNA, 22 bp, Homo sapiens
caggctggagtgcaatgacgcc

SEQ ID NO: 7310848 - DNA, 22 bp, Homo sapiens
caggctggagtgcaatggcaca

SEQ ID NO: 7310849 - DNA, 22 bp, Homo sapiens
tagaatactagtgaagtcatcg

SEQ ID NO: 7310850 - DNA, 22 bp, Homo sapiens
tagataaattagaaagtttact

SEQ ID NO: 7310851 - DNA, 22 bp, Homo sapiens
tagataaaagggcaaagggcat

SEQ ID NO: 7310852 - DNA, 22 bp, Homo sapiens
caggctgggctccggagataaa

SEQ ID NO: 7310853 - DNA, 21 bp, Homo sapiens
tagcaatacgtggaccatggg

SEQ ID NO: 7310854 - DNA, 22 bp, Homo sapiens
tagcaagtggcaccacatttct

SEQ ID NO: 7310855 - DNA, 22 bp, Homo sapiens
tagcaaggcgtggcactcaaat

SEQ ID NO: 7310856 - DNA, 22 bp, Homo sapiens
tagcaatatgctaccttaaatg

SEQ ID NO: 7310857 - DNA, 22 bp, Homo sapiens
tagctaagcattatgtaaacta

SEQ ID NO: 7310858 - DNA, 22 bp, Homo sapiens
tagctaaggcaatcttttgcac

SEQ ID NO: 7310859 - DNA, 22 bp, Homo sapiens
tagctaagtacacattgaataa

SEQ ID NO: 7310860 - DNA, 22 bp, Homo sapiens
tagctaagttacttggcaacag

SEQ ID NO: 7310861 - DNA, 22 bp, Homo sapiens
tagctacaaatctgataagtgg

SEQ ID NO: 7310862 - DNA, 22 bp, Homo sapiens
cagggatggcgctggctgcccg

SEQ ID NO: 7310863 - DNA, 22 bp, Homo sapiens
tagataatttggcatcatattg

SEQ ID NO: 7310864 - DNA, 22 bp, Homo sapiens
tagataaattagaaagtttact

SEQ ID NO: 7310865 - DNA, 22 bp, Homo sapiens
tttcagaaattgttattattct

SEQ ID NO: 7310866 - DNA, 22 bp, Homo sapiens
tttcacatatcaactctatcct

SEQ ID NO: 7310867 - DNA, 22 bp, Homo sapiens
tttcagaaattatattagatgc

SEQ ID NO: 7310868 - DNA, 22 bp, Homo sapiens
ctccttcccctactcagcatcc

SEQ ID NO: 7310869 - DNA, 22 bp, Homo sapiens
tttcagtttatgtcttgaatta

SEQ ID NO: 7310870 - DNA, 22 bp, Homo sapiens
ctccttcctgcagatctgagat

SEQ ID NO: 7310871 - DNA, 22 bp, Homo sapiens
ctccttcagctgaatccctgct

SEQ ID NO: 7310872 - DNA, 22 bp, Homo sapiens
tttcagaatatcgattcagtga

SEQ ID NO: 7310873 - DNA, 22 bp, Homo sapiens
tttatgtaagtggaatgatgcc

SEQ ID NO: 7310874 - DNA, 23 bp, Homo sapiens
tttatgcagcatgtagaacatgg

SEQ ID NO: 7310875 - DNA, 22 bp, Homo sapiens
tttatgcagcctcagtatcaga

SEQ ID NO: 7310876 - DNA, 22 bp, Homo sapiens
tttatgcatctctaggaagggc

SEQ ID NO: 7310877 - DNA, 22 bp, Homo sapiens
tttatgcctccagatcttgctt

SEQ ID NO: 7310878 - DNA, 22 bp, Homo sapiens
ctccaggaggttgctgcttcct

SEQ ID NO: 7310879 - DNA, 18 bp, Homo sapiens
tttatgagctgtgggacc

SEQ ID NO: 7310880 - DNA, 22 bp, Homo sapiens
tttccaaggatgtgtctctcta

SEQ ID NO: 7310881 - DNA, 22 bp, Homo sapiens
tttccaagttgttaccttctac

SEQ ID NO: 7310882 - DNA, 22 bp, Homo sapiens
tttccaataaggtcaccttcct

SEQ ID NO: 7310883 - DNA, 22 bp, Homo sapiens
tttcatgttacatttaaaatgt

SEQ ID NO: 7310884 - DNA, 22 bp, Homo sapiens
tttccaatgtagatgtctctgg

SEQ ID NO: 7310885 - DNA, 22 bp, Homo sapiens
tttccaattcaagcttttacgt

SEQ ID NO: 7310886 - DNA, 22 bp, Homo sapiens
tttctcaactgtattatgcaga

SEQ ID NO: 7310887 - DNA, 22 bp, Homo sapiens
tttctcaacctcaacactattt

SEQ ID NO: 7310888 - DNA, 22 bp, Homo sapiens
tttctcaactgtattatgcaga

SEQ ID NO: 7310889 - DNA, 22 bp, Homo sapiens
tttctcaaaagacagaagtgaa

SEQ ID NO: 7310890 - DNA, 22 bp, Homo sapiens
ctctctttttcgtgtgccgaag

SEQ ID NO: 7310891 - DNA, 22 bp, Homo sapiens
ctctctttgatgtataaataat

SEQ ID NO: 7310892 - DNA, 22 bp, Homo sapiens
ctctctgtggtggctgtcccat

SEQ ID NO: 7310893 - DNA, 22 bp, Homo sapiens
tttgaaagacagaatatttttg

SEQ ID NO: 7310894 - DNA, 22 bp, Homo sapiens
tttgaaagacagaatatttttg

SEQ ID NO: 7310895 - DNA, 22 bp, Homo sapiens
tttgaaactcatgatcatcact

SEQ ID NO: 7310896 - DNA, 22 bp, Homo sapiens
tttgaaactctgaacatgtttc

SEQ ID NO: 7310897 - DNA, 22 bp, Homo sapiens
tttgaaaatttaagtgctacac

SEQ ID NO: 7310898 - DNA, 22 bp, Homo sapiens
tttgaaaattagacacaggcta

SEQ ID NO: 7310899 - DNA, 22 bp, Homo sapiens
tttgaaacccgtcactttgagt

SEQ ID NO: 7310900 - DNA, 22 bp, Homo sapiens
tttgaaacctagttatatgact

SEQ ID NO: 7310901 - DNA, 22 bp, Homo sapiens
tttgaaacaggtgattcagcta

SEQ ID NO: 7310902 - DNA, 22 bp, Homo sapiens
tttgaaaagaaccatcgcctta

SEQ ID NO: 7310903 - DNA, 22 bp, Homo sapiens
tttgaaaagaaccatcgcctta

SEQ ID NO: 7310904 - DNA, 22 bp, Homo sapiens
tttgaaaacttaatttggtcgt

SEQ ID NO: 7310905 - DNA, 22 bp, Homo sapiens
tttgaaaaaggcctttggtatg

SEQ ID NO: 7310906 - DNA, 22 bp, Homo sapiens
tttgactcattgattttctctg

SEQ ID NO: 7310907 - DNA, 22 bp, Homo sapiens
tttgactcaagcctttctttag

SEQ ID NO: 7310908 - DNA, 19 bp, Homo sapiens
tttgaaagagttttattgg

SEQ ID NO: 7310909 - DNA, 22 bp, Homo sapiens
tttgaaagagctgatacatgaa

SEQ ID NO: 7310910 - DNA, 22 bp, Homo sapiens
tttgcaaaccggagctctgcaa

SEQ ID NO: 7310911 - DNA, 22 bp, Homo sapiens
tttgcaaacattcagggctcca

SEQ ID NO: 7310912 - DNA, 22 bp, Homo sapiens
tttgcaaacacttaagaagaga

SEQ ID NO: 7310913 - DNA, 22 bp, Homo sapiens
tttgagaagatgtaatgttaag

SEQ ID NO: 7310914 - DNA, 22 bp, Homo sapiens
tttgcaaaatgtcttgtgttag

SEQ ID NO: 7310915 - DNA, 22 bp, Homo sapiens
tttgagaaaggggatttaattc

SEQ ID NO: 7310916 - DNA, 22 bp, Homo sapiens
tttgactgttttatgaggtggt

SEQ ID NO: 7310917 - DNA, 22 bp, Homo sapiens
tttgactcttgtctcttgttag

SEQ ID NO: 7310918 - DNA, 22 bp, Homo sapiens
tttgactcctgtgtttctggaa

SEQ ID NO: 7310919 - DNA, 22 bp, Homo sapiens
tttgactcctgccttctcctgt

SEQ ID NO: 7310920 - DNA, 22 bp, Homo sapiens
tttgcaaagaaattattgctgt

SEQ ID NO: 7310921 - DNA, 22 bp, Homo sapiens
tttgcaaagaaattattgctgt

SEQ ID NO: 7310922 - DNA, 18 bp, Homo sapiens
tttgcaaaggaagtatgg

SEQ ID NO: 7310923 - DNA, 22 bp, Homo sapiens
tttgcaaagtccattgaagtta

SEQ ID NO: 7310924 - DNA, 22 bp, Homo sapiens
tttgcaaagtccattgaagtta

SEQ ID NO: 7310925 - DNA, 22 bp, Homo sapiens
tttgcaaagtccctgggatgga

SEQ ID NO: 7310926 - DNA, 22 bp, Homo sapiens
tttgcaaagtgactattatatg

SEQ ID NO: 7310927 - DNA, 22 bp, Homo sapiens
tttgcaaagtgactattatatg

SEQ ID NO: 7310928 - DNA, 22 bp, Homo sapiens
tttgcaaagtgcttgcagagta

SEQ ID NO: 7310929 - DNA, 22 bp, Homo sapiens
ctctggcacactccttccaggt

SEQ ID NO: 7310930 - DNA, 22 bp, Homo sapiens
ctctggcaattgctgctgactc

SEQ ID NO: 7310931 - DNA, 22 bp, Homo sapiens
ctctggccgcagctcagctctg

SEQ ID NO: 7310932 - DNA, 22 bp, Homo sapiens
tttggaatgtagtttaatcatc

SEQ ID NO: 7310933 - DNA, 22 bp, Homo sapiens
ctctggctatggcacggcgctc

SEQ ID NO: 7310934 - DNA, 22 bp, Homo sapiens
tttgttcattagcattggcctt

SEQ ID NO: 7310935 - DNA, 22 bp, Homo sapiens
tttgttcattaaaagtgctgta

SEQ ID NO: 7310936 - DNA, 22 bp, Homo sapiens
ctctgggtgttaatgtcagtgt

SEQ ID NO: 7310937 - DNA, 22 bp, Homo sapiens
ctctgggtgtgacagcacctgg

SEQ ID NO: 7310938 - DNA, 22 bp, Homo sapiens
ctctgggtggtctcactgagtg

SEQ ID NO: 7310939 - DNA, 22 bp, Homo sapiens
ctctgggtctccctgaggctaa

SEQ ID NO: 7310940 - DNA, 22 bp, Homo sapiens
ctctgggtgagacagacctggt

SEQ ID NO: 7310941 - DNA, 22 bp, Homo sapiens
ctctgtgcttatgctccatggg

SEQ ID NO: 7310942 - DNA, 22 bp, Homo sapiens
ctctggtttatttcttggaaag

SEQ ID NO: 7310943 - DNA, 22 bp, Homo sapiens
ttttgctggggtggctagctta

SEQ ID NO: 7310944 - DNA, 22 bp, Homo sapiens
ttttgcctgagagtgaaaataa

SEQ ID NO: 7310945 - DNA, 22 bp, Homo sapiens
ttttgcctgtgaatactatctt

SEQ ID NO: 7310946 - DNA, 22 bp, Homo sapiens
ttttgctgtgtccttgagccgg

SEQ ID NO: 7310947 - DNA, 17 bp, Homo sapiens
ttttctctcttggattc

SEQ ID NO: 7310948 - DNA, 21 bp, Homo sapiens
ctctgtgttgagggtgttgag

SEQ ID NO: 7310949 - DNA, 22 bp, Homo sapiens
ttttctcttccctctggacctg

SEQ ID NO: 7310950 - DNA, 22 bp, Homo sapiens
ctctgtgtcagctgggtgtgca

SEQ ID NO: 7310951 - DNA, 22 bp, Homo sapiens
ctctgtgtgctggtggggtcct

SEQ ID NO: 7310952 - DNA, 22 bp, Homo sapiens
ctctgtgtgctggtggggtcct

SEQ ID NO: 7310953 - DNA, 22 bp, Homo sapiens
ctctgtgtctgagttatggtct

SEQ ID NO: 7310954 - DNA, 22 bp, Homo sapiens
ctctgtgttccgggttgctgct

SEQ ID NO: 7310955 - DNA, 22 bp, Homo sapiens
ctctgtgttcagcctagcagaa

SEQ ID NO: 7310956 - DNA, 22 bp, Homo sapiens
ctctgtgtggtcctctgtattg

SEQ ID NO: 7310957 - DNA, 22 bp, Homo sapiens
ctctgtgtggtcctctgtattg

SEQ ID NO: 7310958 - DNA, 22 bp, Homo sapiens
ctctgtgtggtatgattgtcat

SEQ ID NO: 7310959 - DNA, 22 bp, Homo sapiens
ctctgtgtggtatgattgtcat

SEQ ID NO: 7310960 - DNA, 22 bp, Homo sapiens
ctggagcctaggttgacctggg

SEQ ID NO: 7310961 - DNA, 17 bp, Homo sapiens
ctggagcctccaactcc

SEQ ID NO: 7310962 - DNA, 22 bp, Homo sapiens
ctggagaagaggtagtatgtag

SEQ ID NO: 7310963 - DNA, 22 bp, Homo sapiens
ctggagaaacatcaggcatagg

SEQ ID NO: 7310964 - DNA, 22 bp, Homo sapiens
ctggagaaaatccatgtgtatg

SEQ ID NO: 7310965 - DNA, 22 bp, Homo sapiens
ctggaagggtacataggaaact

SEQ ID NO: 7310966 - DNA, 19 bp, Homo sapiens
ctggaaggagggactgttc

SEQ ID NO: 7310967 - DNA, 22 bp, Homo sapiens
ctggaaagtgtctccatcctgg

SEQ ID NO: 7310968 - DNA, 22 bp, Homo sapiens
ctggaaagtgaggagagttcca

SEQ ID NO: 7310969 - DNA, 22 bp, Homo sapiens
ctgctgtctttatttcactgct

SEQ ID NO: 7310970 - DNA, 22 bp, Homo sapiens
ctgctgtctcactggtgtggtt

SEQ ID NO: 7310971 - DNA, 22 bp, Homo sapiens
ctgctgtgacagctgccgtgtt

SEQ ID NO: 7310972 - DNA, 22 bp, Homo sapiens
ctggaagagtcctaaacagata

SEQ ID NO: 7310973 - DNA, 22 bp, Homo sapiens
ctggaagctggaacaggtgtgg

SEQ ID NO: 7310974 - DNA, 22 bp, Homo sapiens
ctggaagcgtcggaggaagggc

SEQ ID NO: 7310975 - DNA, 20 bp, Homo sapiens
ctggaagcctttccagagca

SEQ ID NO: 7310976 - DNA, 22 bp, Homo sapiens
ctgcctgttcctgatcattcta

SEQ ID NO: 7310977 - DNA, 22 bp, Homo sapiens
ctgcctgtttcctcttgctccc

SEQ ID NO: 7310978 - DNA, 22 bp, Homo sapiens
ctgccttgcaccggctctctgg

SEQ ID NO: 7310979 - DNA, 21 bp, Homo sapiens
ctgccttgaatggtactggga

SEQ ID NO: 7310980 - DNA, 22 bp, Homo sapiens
ctgccttggttcccagccagca

SEQ ID NO: 7310981 - DNA, 22 bp, Homo sapiens
ctgctctgtttcttagctgggt

SEQ ID NO: 7310982 - DNA, 22 bp, Homo sapiens
ctgctctgttcccccatcatct

SEQ ID NO: 7310983 - DNA, 22 bp, Homo sapiens
ctgctcttcccactcactccca

SEQ ID NO: 7310984 - DNA, 22 bp, Homo sapiens
ctgctcttcccactcactccca

SEQ ID NO: 7310985 - DNA, 22 bp, Homo sapiens
ctgctctgtttcttagctgggt

SEQ ID NO: 7310986 - DNA, 22 bp, Homo sapiens
ctgctctgtttcttagctgggt

SEQ ID NO: 7310987 - DNA, 22 bp, Homo sapiens
ctgctctgtgcacttgttcagg

SEQ ID NO: 7310988 - DNA, 22 bp, Homo sapiens
ctgctgagagccacgtggcaca

SEQ ID NO: 7310989 - DNA, 22 bp, Homo sapiens
ctgctgagagctgaaggctgta

SEQ ID NO: 7310990 - DNA, 22 bp, Homo sapiens
ctgctgggaaggtctgctcagt

SEQ ID NO: 7310991 - DNA, 22 bp, Homo sapiens
ctgctgggcagaggctgcatga

SEQ ID NO: 7310992 - DNA, 22 bp, Homo sapiens
ctgctgagaaaagactgaggga

SEQ ID NO: 7310993 - DNA, 22 bp, Homo sapiens
ctgctgagagatgccaatctca

SEQ ID NO: 7310994 - DNA, 22 bp, Homo sapiens
ctgctgagaacccagattacta

SEQ ID NO: 7310995 - DNA, 22 bp, Homo sapiens
ctgctgggtttgcctttcacca

SEQ ID NO: 7310996 - DNA, 22 bp, Homo sapiens
ctgctgggtccccctgctgatt

SEQ ID NO: 7310997 - DNA, 22 bp, Homo sapiens
ctgctgggtctatgcaagtgga

SEQ ID NO: 7310998 - DNA, 22 bp, Homo sapiens
ctgctgtcaaaaatcactccat

SEQ ID NO: 7310999 - DNA, 22 bp, Homo sapiens
ctgctgtcaaaaatcactccat

SEQ ID NO: 7311000 - DNA, 22 bp, Homo sapiens
ctgctgtagagaagggttgtca

SEQ ID NO: 7311001 - DNA, 22 bp, Homo sapiens
ctgctgtagccactgggctcag

SEQ ID NO: 7311002 - DNA, 22 bp, Homo sapiens
ctgctggtgcagagtggggctg

SEQ ID NO: 7311003 - DNA, 22 bp, Homo sapiens
ctgctgtcccagcctcctcaca

SEQ ID NO: 7311004 - DNA, 22 bp, Homo sapiens
ctgctgtccaggagtgccctgt

SEQ ID NO: 7311005 - DNA, 22 bp, Homo sapiens
ctgctgtccaacctgcactcgc

SEQ ID NO: 7311006 - DNA, 22 bp, Homo sapiens
ctgctgtcatagccatccctcc

SEQ ID NO: 7311007 - DNA, 22 bp, Homo sapiens
ctgcccaggggagtgctgtcgg

SEQ ID NO: 7311008 - DNA, 22 bp, Homo sapiens
ctgccattggattttcacattt

SEQ ID NO: 7311009 - DNA, 22 bp, Homo sapiens
ctgcccacagttctctgccatg

SEQ ID NO: 7311010 - DNA, 22 bp, Homo sapiens
ctgcagcctaggtgcagctggg

SEQ ID NO: 7311011 - DNA, 22 bp, Homo sapiens
ctgcagcctcaacctcctgagc

SEQ ID NO: 7311012 - DNA, 22 bp, Homo sapiens
ctgcagcctcaacctcctgagc

SEQ ID NO: 7311013 - DNA, 22 bp, Homo sapiens
ctgcagctttcgctccatcagc

SEQ ID NO: 7311014 - DNA, 22 bp, Homo sapiens
ctcttcctacagtctgctatgc

SEQ ID NO: 7311015 - DNA, 22 bp, Homo sapiens
ctcttctctgcagcctttgaag

SEQ ID NO: 7311016 - DNA, 22 bp, Homo sapiens
ctcttcctagtgtgcagcgtgg

SEQ ID NO: 7311017 - DNA, 22 bp, Homo sapiens
ctgaggctggagtgcagtggtg

SEQ ID NO: 7311018 - DNA, 22 bp, Homo sapiens
ctgaggctctgggtgtcactgt

SEQ ID NO: 7311019 - DNA, 22 bp, Homo sapiens
ttggatcatggaatgtctgctt

SEQ ID NO: 7311020 - DNA, 22 bp, Homo sapiens
ttggatcaaatttcatgctgtc

SEQ ID NO: 7311021 - DNA, 22 bp, Homo sapiens
ttggaagattacttagttttct

SEQ ID NO: 7311022 - DNA, 22 bp, Homo sapiens
ttggaaaagtgaaactagatgc

SEQ ID NO: 7311023 - DNA, 22 bp, Homo sapiens
ctcagtgctagaagtagattgc

SEQ ID NO: 7311024 - DNA, 22 bp, Homo sapiens
ctccaggacagattcagggcca

SEQ ID NO: 7311025 - DNA, 22 bp, Homo sapiens
ttgcataaatgcttaaaatttg

SEQ ID NO: 7311026 - DNA, 22 bp, Homo sapiens
ttgcatactgacctctaagctt

SEQ ID NO: 7311027 - DNA, 22 bp, Homo sapiens
ttgcatgcaaggcctccgtggc

SEQ ID NO: 7311028 - DNA, 22 bp, Homo sapiens
ttgcatctaccatatcaaagat

SEQ ID NO: 7311029 - DNA, 22 bp, Homo sapiens
ttgcatccgaaacaatttctct

SEQ ID NO: 7311030 - DNA, 22 bp, Homo sapiens
ttgcatccgggctacttccaca

SEQ ID NO: 7311031 - DNA, 23 bp, Homo sapiens
ttgcatcctgacgtctattttct

SEQ ID NO: 7311032 - DNA, 22 bp, Homo sapiens
ttgcatgcacctaacaaattat

SEQ ID NO: 7311033 - DNA, 22 bp, Homo sapiens
ttgcatcagcaggcataattgg

SEQ ID NO: 7311034 - DNA, 22 bp, Homo sapiens
ttgcatatcctccaacacatgg

SEQ ID NO: 7311035 - DNA, 22 bp, Homo sapiens
ttgccctagggtcttatcctcc

SEQ ID NO: 7311036 - DNA, 22 bp, Homo sapiens
ctcagggtgagaaattgatcca

SEQ ID NO: 7311037 - DNA, 22 bp, Homo sapiens
ctcagggtaatgaaagacgaat

SEQ ID NO: 7311038 - DNA, 22 bp, Homo sapiens
ctcagggatgggcagatgttaa

SEQ ID NO: 7311039 - DNA, 22 bp, Homo sapiens
cgtgtgttgaaagatgtacatc

SEQ ID NO: 7311040 - DNA, 22 bp, Homo sapiens
cgtttattttgaagattccact

SEQ ID NO: 7311041 - DNA, 22 bp, Homo sapiens
ctaaaaactctacgatgcacag

SEQ ID NO: 7311042 - DNA, 22 bp, Homo sapiens
cgtgtctgggatagcagaagta

SEQ ID NO: 7311043 - DNA, 22 bp, Homo sapiens
cgtgtctgggctcccatggcag

SEQ ID NO: 7311044 - DNA, 22 bp, Homo sapiens
cgtgtctgggatagcagaagta

SEQ ID NO: 7311045 - DNA, 23 bp, Homo sapiens
cgtgtctgtgggcgatccggcct

SEQ ID NO: 7311046 - DNA, 22 bp, Homo sapiens
cgtgtctgtatgtcaatcagct

SEQ ID NO: 7311047 - DNA, 22 bp, Homo sapiens
cgtgtctgtgtatgcaggccgt

SEQ ID NO: 7311048 - DNA, 17 bp, Homo sapiens
cgtgtgcttgtgtgcac

SEQ ID NO: 7311049 - DNA, 22 bp, Homo sapiens
cgtgtgcgtgcatatgcacaag

SEQ ID NO: 7311050 - DNA, 22 bp, Homo sapiens
cgtgtgcgcacacctgtttcca

SEQ ID NO: 7311051 - DNA, 22 bp, Homo sapiens
cgtgtggtcccggcaaggcaag

SEQ ID NO: 7311052 - DNA, 22 bp, Homo sapiens
cgtgtgtgtacctgcgcattta

SEQ ID NO: 7311053 - DNA, 20 bp, Homo sapiens
cgtgtgtggctattttgggt

SEQ ID NO: 7311054 - DNA, 22 bp, Homo sapiens
cgtgtgtgtacctgcgcattta

SEQ ID NO: 7311055 - DNA, 20 bp, Homo sapiens
cgtgtgtggctattttgggt

SEQ ID NO: 7311056 - DNA, 22 bp, Homo sapiens
ctagagaacaacattcatatgg

SEQ ID NO: 7311057 - DNA, 22 bp, Homo sapiens
ttctgaaggctcctcaggaaag

SEQ ID NO: 7311058 - DNA, 22 bp, Homo sapiens
ttctgcaggatgctctggtggt

SEQ ID NO: 7311059 - DNA, 22 bp, Homo sapiens
ttctattgcacacaaataatta

SEQ ID NO: 7311060 - DNA, 22 bp, Homo sapiens
ttctatgctagtggaaagcttc

SEQ ID NO: 7311061 - DNA, 22 bp, Homo sapiens
ttctatgtgaacgttatagttt

SEQ ID NO: 7311062 - DNA, 22 bp, Homo sapiens
ttctggaaccagcctgcctggg

SEQ ID NO: 7311063 - DNA, 22 bp, Homo sapiens
ttctggaaccaacatgccagtt

SEQ ID NO: 7311064 - DNA, 22 bp, Homo sapiens
ttctggaactatactgttggtg

SEQ ID NO: 7311065 - DNA, 22 bp, Homo sapiens
ttctggaagccccagagtcaga

SEQ ID NO: 7311066 - DNA, 22 bp, Homo sapiens
ttctggaagctgggcagcaccc

SEQ ID NO: 7311067 - DNA, 22 bp, Homo sapiens
ctcagagatatagtccctgctt

SEQ ID NO: 7311068 - DNA, 17 bp, Homo sapiens
ctcagagcaggacagaa

SEQ ID NO: 7311069 - DNA, 22 bp, Homo sapiens
ctcactcagacatccagtgcag

SEQ ID NO: 7311070 - DNA, 22 bp, Homo sapiens
ctcacctgcaatcccttccagg

SEQ ID NO: 7311071 - DNA, 22 bp, Homo sapiens
ctcactgcaacctctgccccca

SEQ ID NO: 7311072 - DNA, 22 bp, Homo sapiens
ttctggcaaggcaagcctggct

SEQ ID NO: 7311073 - DNA, 22 bp, Homo sapiens
tgtcagcagaaatctggtctgc

SEQ ID NO: 7311074 - DNA, 22 bp, Homo sapiens
tgtcagcaccatgggtagtgat

SEQ ID NO: 7311075 - DNA, 22 bp, Homo sapiens
tgtcaataactggagtcattat

SEQ ID NO: 7311076 - DNA, 22 bp, Homo sapiens
tgtcaatatgtaataactgaat

SEQ ID NO: 7311077 - DNA, 22 bp, Homo sapiens
ttaaatagtaggtctattttgg

SEQ ID NO: 7311078 - DNA, 22 bp, Homo sapiens
ttaaattattgagggattgtca

SEQ ID NO: 7311079 - DNA, 22 bp, Homo sapiens
ttaagatgatgtttcttgttgt

SEQ ID NO: 7311080 - DNA, 22 bp, Homo sapiens
ttaagaggagatcatactggag

SEQ ID NO: 7311081 - DNA, 22 bp, Homo sapiens
ttaaattatttctagtgaggtg

SEQ ID NO: 7311082 - DNA, 22 bp, Homo sapiens
ttaaatttctacgtgatccagg

SEQ ID NO: 7311083 - DNA, 22 bp, Homo sapiens
ttaaattgtcatttgagcaatg

SEQ ID NO: 7311084 - DNA, 22 bp, Homo sapiens
ttaaattgtcatttgagcaatg

SEQ ID NO: 7311085 - DNA, 22 bp, Homo sapiens
ccttaaaagaactatctcttct

SEQ ID NO: 7311086 - DNA, 18 bp, Homo sapiens
cctgtgtgtgttgcaggc

SEQ ID NO: 7311087 - DNA, 22 bp, Homo sapiens
ttaagcatggaagtgaaataat

SEQ ID NO: 7311088 - DNA, 22 bp, Homo sapiens
ccttaaattctccatttgaaag

SEQ ID NO: 7311089 - DNA, 23 bp, Homo sapiens
ccttaaatatctaccctgtggca

SEQ ID NO: 7311090 - DNA, 22 bp, Homo sapiens
ccttcaaaacactagtttttga

SEQ ID NO: 7311091 - DNA, 22 bp, Homo sapiens
ttacagtttagtccaagccaga

SEQ ID NO: 7311092 - DNA, 22 bp, Homo sapiens
ttacagtttagtccaagccaga

SEQ ID NO: 7311093 - DNA, 22 bp, Homo sapiens
ttacagtttaccaagaatattg

SEQ ID NO: 7311094 - DNA, 22 bp, Homo sapiens
ttacagttgttctatcagcatg

SEQ ID NO: 7311095 - DNA, 22 bp, Homo sapiens
ttacagttgtagaaagtggttg

SEQ ID NO: 7311096 - DNA, 22 bp, Homo sapiens
ttacagttgcccccagcctcgc

SEQ ID NO: 7311097 - DNA, 22 bp, Homo sapiens
ttacagttgctacaaaggataa

SEQ ID NO: 7311098 - DNA, 22 bp, Homo sapiens
ttacagttggtattagaccaaa

SEQ ID NO: 7311099 - DNA, 22 bp, Homo sapiens
ttacaaagattatattcagtta

SEQ ID NO: 7311100 - DNA, 22 bp, Homo sapiens
ttatattgggtctggtatcagg

SEQ ID NO: 7311101 - DNA, 22 bp, Homo sapiens
ttatattgtgtaataagtgaag

SEQ ID NO: 7311102 - DNA, 22 bp, Homo sapiens
ttatatttctggtagccttcag

SEQ ID NO: 7311103 - DNA, 22 bp, Homo sapiens
ttataaaggtttgtgcatattt

SEQ ID NO: 7311104 - DNA, 22 bp, Homo sapiens
ttataaagattgttatgtatct

SEQ ID NO: 7311105 - DNA, 22 bp, Homo sapiens
ttataaaggtttgtgcatattt

SEQ ID NO: 7311106 - DNA, 22 bp, Homo sapiens
ttataactttggatatgacaag

SEQ ID NO: 7311107 - DNA, 22 bp, Homo sapiens
ttataacaacagtttactttaa

SEQ ID NO: 7311108 - DNA, 22 bp, Homo sapiens
ccttgccccatctgggaatccc

SEQ ID NO: 7311109 - DNA, 22 bp, Homo sapiens
ccttgagaggaagtttgtagaa

SEQ ID NO: 7311110 - DNA, 22 bp, Homo sapiens
ccttgagatgagctaatttttt

SEQ ID NO: 7311111 - DNA, 22 bp, Homo sapiens
ccttgccctgagcaggggtcag

SEQ ID NO: 7311112 - DNA, 22 bp, Homo sapiens
ccttgcccgctgcctctgagtt

SEQ ID NO: 7311113 - DNA, 22 bp, Homo sapiens
ttagttttcccatctttatggt

SEQ ID NO: 7311114 - DNA, 22 bp, Homo sapiens
ttataaaggtttgtgcatattt

SEQ ID NO: 7311115 - DNA, 22 bp, Homo sapiens
ttagacatagaatattgtctag

SEQ ID NO: 7311116 - DNA, 22 bp, Homo sapiens
ttagcaagataacagtaatttt

SEQ ID NO: 7311117 - DNA, 22 bp, Homo sapiens
ccttcaaattctcttagctgaa

SEQ ID NO: 7311118 - DNA, 22 bp, Homo sapiens
ccttcaaatttagaacaagtga

SEQ ID NO: 7311119 - DNA, 22 bp, Homo sapiens
ttacataaaagttcacgtaggc

SEQ ID NO: 7311120 - DNA, 22 bp, Homo sapiens
ttacataaaagttcacgtaggc

SEQ ID NO: 7311121 - DNA, 22 bp, Homo sapiens
ttacataacggtatgaaaaatg

SEQ ID NO: 7311122 - DNA, 22 bp, Homo sapiens
ccttcaaactttcattaaccag

SEQ ID NO: 7311123 - DNA, 22 bp, Homo sapiens
ccttcaaagagtatttcctgag

SEQ ID NO: 7311124 - DNA, 22 bp, Homo sapiens
ccttcaaagtacacatctttat

SEQ ID NO: 7311125 - DNA, 22 bp, Homo sapiens
ttacatacttactagatctatg

SEQ ID NO: 7311126 - DNA, 22 bp, Homo sapiens
ttacataactttaaaatgccgt

SEQ ID NO: 7311127 - DNA, 20 bp, Homo sapiens
ttatttcagttgctagattg

SEQ ID NO: 7311128 - DNA, 23 bp, Homo sapiens
ttattgcaaggtaaaattgctga

SEQ ID NO: 7311129 - DNA, 22 bp, Homo sapiens
cgctctggcaggcacaggaggg

SEQ ID NO: 7311130 - DNA, 20 bp, Homo sapiens
cgctcctgttcccggtccca

SEQ ID NO: 7311131 - DNA, 22 bp, Homo sapiens
cgctcctgaccagctgtgtccc

SEQ ID NO: 7311132 - DNA, 22 bp, Homo sapiens
ttatttcatgtaaaatttatgt

SEQ ID NO: 7311133 - DNA, 22 bp, Homo sapiens
ttatttcatataatgttatcaa

SEQ ID NO: 7311134 - DNA, 22 bp, Homo sapiens
cctttttcagcttctagaggct

SEQ ID NO: 7311135 - DNA, 22 bp, Homo sapiens
ccttttcttgccactgactcgg

SEQ ID NO: 7311136 - DNA, 22 bp, Homo sapiens
ccttttctgtttcctgtcactg

SEQ ID NO: 7311137 - DNA, 22 bp, Homo sapiens
ccttttctacaagcaaatgtgc

SEQ ID NO: 7311138 - DNA, 22 bp, Homo sapiens
ttatccactttagtttcagtat

SEQ ID NO: 7311139 - DNA, 22 bp, Homo sapiens
cctttgggttcaatctcggtct

SEQ ID NO: 7311140 - DNA, 22 bp, Homo sapiens
ccttttttctatgccaactctg

SEQ ID NO: 7311141 - DNA, 22 bp, Homo sapiens
cgaaatcagcatcttgaggcaa

SEQ ID NO: 7311142 - DNA, 22 bp, Homo sapiens
cgaaatcaaacttgggcttctg

SEQ ID NO: 7311143 - DNA, 22 bp, Homo sapiens
cgactactaactactgtagaaa

SEQ ID NO: 7311144 - DNA, 16 bp, Homo sapiens
ttattgaggccaagga

SEQ ID NO: 7311145 - DNA, 23 bp, Homo sapiens
cggggccagggtcaggaccggtc

SEQ ID NO: 7311146 - DNA, 22 bp, Homo sapiens
ttcaaattaccacatttgctta

SEQ ID NO: 7311147 - DNA, 22 bp, Homo sapiens
ttcaaattaccacatttgctta

SEQ ID NO: 7311148 - DNA, 21 bp, Homo sapiens
ttcaaagtttgcctaaagatt

SEQ ID NO: 7311149 - DNA, 21 bp, Homo sapiens
ttcaaagtttgcctaaagatt

SEQ ID NO: 7311150 - DNA, 22 bp, Homo sapiens
ttcaaatctctcctaatccact

SEQ ID NO: 7311151 - DNA, 22 bp, Homo sapiens
ttcaaatcactttggagcttaa

SEQ ID NO: 7311152 - DNA, 22 bp, Homo sapiens
ttcaaagtgctgttcaaagtag

SEQ ID NO: 7311153 - DNA, 22 bp, Homo sapiens
ttcaaagtgcttttaaccttta

SEQ ID NO: 7311154 - DNA, 22 bp, Homo sapiens
ttcaaagtgcatgttcctcaga

SEQ ID NO: 7311155 - DNA, 22 bp, Homo sapiens
ttcaaagtcctgtcaggtagcc

SEQ ID NO: 7311156 - DNA, 22 bp, Homo sapiens
ttcaaagtgtgacctgacaagc

SEQ ID NO: 7311157 - DNA, 22 bp, Homo sapiens
ttcaaagtgtgacctgacaagc

SEQ ID NO: 7311158 - DNA, 22 bp, Homo sapiens
gagctgtccaagatggtcgtaa

SEQ ID NO: 7311159 - DNA, 22 bp, Homo sapiens
gagctgggtatatggctttatg

SEQ ID NO: 7311160 - DNA, 22 bp, Homo sapiens
gagctgggtgtttatttgccaa

SEQ ID NO: 7311161 - DNA, 22 bp, Homo sapiens
gagctcctcccagggtagcact

SEQ ID NO: 7311162 - DNA, 22 bp, Homo sapiens
gagctgggcctcagaacacagt

SEQ ID NO: 7311163 - DNA, 22 bp, Homo sapiens
gagctgggcacacgccacttga

SEQ ID NO: 7311164 - DNA, 22 bp, Homo sapiens
gagctgggattcatctatgtct

SEQ ID NO: 7311165 - DNA, 22 bp, Homo sapiens
gagcaggatggcacttctgtga

SEQ ID NO: 7311166 - DNA, 18 bp, Homo sapiens
gagctcagcgtgtttcta

SEQ ID NO: 7311167 - DNA, 22 bp, Homo sapiens
gagctcagcccaaagagcagtg

SEQ ID NO: 7311168 - DNA, 22 bp, Homo sapiens
gagctcatccccatggtccgtc

SEQ ID NO: 7311169 - DNA, 22 bp, Homo sapiens
gagctcatccccatggtccgtc

SEQ ID NO: 7311170 - DNA, 22 bp, Homo sapiens
gaggagacggggtgcctggagc

SEQ ID NO: 7311171 - DNA, 21 bp, Homo sapiens
gaggactgcacactctgattg

SEQ ID NO: 7311172 - DNA, 22 bp, Homo sapiens
gaggaggttccgggtggagaag

SEQ ID NO: 7311173 - DNA, 18 bp, Homo sapiens
gaggatggaaggagatgc

SEQ ID NO: 7311174 - DNA, 22 bp, Homo sapiens
gaggccagaagtgcctcgggct

SEQ ID NO: 7311175 - DNA, 22 bp, Homo sapiens
gaggccagagttccccgagtca

SEQ ID NO: 7311176 - DNA, 22 bp, Homo sapiens
gaggcctggagccgcctaggcg

SEQ ID NO: 7311177 - DNA, 22 bp, Homo sapiens
gagggtcttacctaagcagggt

SEQ ID NO: 7311178 - DNA, 22 bp, Homo sapiens
gagggtctcttaatgccagggg

SEQ ID NO: 7311179 - DNA, 22 bp, Homo sapiens
gaggtgagtggatcacgaggtc

SEQ ID NO: 7311180 - DNA, 22 bp, Homo sapiens
gaggtgagtggatcacgaggtc

SEQ ID NO: 7311181 - DNA, 22 bp, Homo sapiens
gaggtgctgctgtacttcttgc

SEQ ID NO: 7311182 - DNA, 22 bp, Homo sapiens
gaggtgagaagggggtcagatg

SEQ ID NO: 7311183 - DNA, 22 bp, Homo sapiens
gaggtcttagaagaaaaatcat

SEQ ID NO: 7311184 - DNA, 22 bp, Homo sapiens
gagggccattctgagggggtga

SEQ ID NO: 7311185 - DNA, 22 bp, Homo sapiens
gagggccagcctgccaagggcc

SEQ ID NO: 7311186 - DNA, 22 bp, Homo sapiens
gagggccaggcggagacaggcg

SEQ ID NO: 7311187 - DNA, 22 bp, Homo sapiens
gagggccaggcagcaagaaggc

SEQ ID NO: 7311188 - DNA, 22 bp, Homo sapiens
gagggccagatcccaggaggaa

SEQ ID NO: 7311189 - DNA, 22 bp, Homo sapiens
gagggccagagtcctggggtca

SEQ ID NO: 7311190 - DNA, 22 bp, Homo sapiens
gagggacagctaaagagaaatt

SEQ ID NO: 7311191 - DNA, 22 bp, Homo sapiens
gagggccacgttcagggctctc

SEQ ID NO: 7311192 - DNA, 22 bp, Homo sapiens
gagggagaattgcagccagcgt

SEQ ID NO: 7311193 - DNA, 22 bp, Homo sapiens
gagggaagattccccatatggg

SEQ ID NO: 7311194 - DNA, 22 bp, Homo sapiens
gagggaaggtcacccttgtagc

SEQ ID NO: 7311195 - DNA, 22 bp, Homo sapiens
gaggcgagaagctggagatggt

SEQ ID NO: 7311196 - DNA, 22 bp, Homo sapiens
gaggcctggtctatgagatgtt

SEQ ID NO: 7311197 - DNA, 22 bp, Homo sapiens
gaggcctggtgctgtgtccaca

SEQ ID NO: 7311198 - DNA, 22 bp, Homo sapiens
gaggcctggtttgcatgagaat

SEQ ID NO: 7311199 - DNA, 22 bp, Homo sapiens
gagaagaacttgggcaaagtca

SEQ ID NO: 7311200 - DNA, 22 bp, Homo sapiens
gagaagaaatagaatcacattt

SEQ ID NO: 7311201 - DNA, 22 bp, Homo sapiens
gagaagaaatagaatcacattt

SEQ ID NO: 7311202 - DNA, 22 bp, Homo sapiens
gagaagaacttgggcaaagtca

SEQ ID NO: 7311203 - DNA, 16 bp, Homo sapiens
gagaagagcccggcag

SEQ ID NO: 7311204 - DNA, 22 bp, Homo sapiens
gagaagcaatcagcagccaccc

SEQ ID NO: 7311205 - DNA, 22 bp, Homo sapiens
gagaaagggaacttacagagtg

SEQ ID NO: 7311206 - DNA, 22 bp, Homo sapiens
gagaagcaatcagcagccaccc

SEQ ID NO: 7311207 - DNA, 22 bp, Homo sapiens
gagaagcaatcgtgacatctcc

SEQ ID NO: 7311208 - DNA, 22 bp, Homo sapiens
gagaagcaatcagtggccaccc

SEQ ID NO: 7311209 - DNA, 22 bp, Homo sapiens
gagaagcaatttccaactgtgc

SEQ ID NO: 7311210 - DNA, 22 bp, Homo sapiens
gagaagcaggtttagcagacaa

SEQ ID NO: 7311211 - DNA, 22 bp, Homo sapiens
gagaagcaggtttagcagacaa

SEQ ID NO: 7311212 - DNA, 22 bp, Homo sapiens
gagaagcaggtttagcagacaa

SEQ ID NO: 7311213 - DNA, 22 bp, Homo sapiens
gagagaagaacaatgtcattca

SEQ ID NO: 7311214 - DNA, 22 bp, Homo sapiens
gagagaagggggatatgagcct

SEQ ID NO: 7311215 - DNA, 22 bp, Homo sapiens
gagaggagtaggctgatggtgc

SEQ ID NO: 7311216 - DNA, 22 bp, Homo sapiens
gagcaatagcaccaattaactc

SEQ ID NO: 7311217 - DNA, 22 bp, Homo sapiens
gagcacagaactaaatgctggt

SEQ ID NO: 7311218 - DNA, 22 bp, Homo sapiens
gagcaagactacaggcagatga

SEQ ID NO: 7311219 - DNA, 22 bp, Homo sapiens
gagcaaaataaattctgacaaa

SEQ ID NO: 7311220 - DNA, 22 bp, Homo sapiens
gagaggatccacaaaccaggaa

SEQ ID NO: 7311221 - DNA, 22 bp, Homo sapiens
gagattttcagcttgactggga

SEQ ID NO: 7311222 - DNA, 17 bp, Homo sapiens
gagattttcgtcctgaa

SEQ ID NO: 7311223 - DNA, 22 bp, Homo sapiens
gagatttttcaacaagaatagg

SEQ ID NO: 7311224 - DNA, 22 bp, Homo sapiens
gagcacgttgaagcgcactgtc

SEQ ID NO: 7311225 - DNA, 22 bp, Homo sapiens
gagcagagaatccagctaagtg

SEQ ID NO: 7311226 - DNA, 22 bp, Homo sapiens
gagcaccaaggctctgccatgg

SEQ ID NO: 7311227 - DNA, 22 bp, Homo sapiens
gagcacccgtcggtggtaggaa

SEQ ID NO: 7311228 - DNA, 20 bp, Homo sapiens
gagcacagtaatgactgcta

SEQ ID NO: 7311229 - DNA, 18 bp, Homo sapiens
gagcagaggctcaactgg

SEQ ID NO: 7311230 - DNA, 18 bp, Homo sapiens
gagcagaggagggttttt

SEQ ID NO: 7311231 - DNA, 22 bp, Homo sapiens
gagcagagcttctcaaagtaaa

SEQ ID NO: 7311232 - DNA, 16 bp, Homo sapiens
gagcagagcggttcca

SEQ ID NO: 7311233 - DNA, 23 bp, Homo sapiens
gagcagagcgggcgggggtcctg

SEQ ID NO: 7311234 - DNA, 22 bp, Homo sapiens
gagcagagacagtacaactggc

SEQ ID NO: 7311235 - DNA, 22 bp, Homo sapiens
gagcaggaactgaaaatgagac

SEQ ID NO: 7311236 - DNA, 22 bp, Homo sapiens
gagcaggaacagatcccttgga

SEQ ID NO: 7311237 - DNA, 18 bp, Homo sapiens
gacaaatgcaatttaaag

SEQ ID NO: 7311238 - DNA, 22 bp, Homo sapiens
gacaaagcagacaagataattc

SEQ ID NO: 7311239 - DNA, 22 bp, Homo sapiens
gacaaagtcaacagtactctca

SEQ ID NO: 7311240 - DNA, 22 bp, Homo sapiens
gacaaagtgctaaaccacagag

SEQ ID NO: 7311241 - DNA, 22 bp, Homo sapiens
gacagcagccacagggagaggg

SEQ ID NO: 7311242 - DNA, 22 bp, Homo sapiens
gacagcagggacatgtaggaag

SEQ ID NO: 7311243 - DNA, 22 bp, Homo sapiens
gacagcaggatgtgaggggatg

SEQ ID NO: 7311244 - DNA, 22 bp, Homo sapiens
gacaaaagtgttttgaacaagg

SEQ ID NO: 7311245 - DNA, 22 bp, Homo sapiens
gacaaaactgagatcacactgt

SEQ ID NO: 7311246 - DNA, 18 bp, Homo sapiens
gacaaaagtacagacaga

SEQ ID NO: 7311247 - DNA, 22 bp, Homo sapiens
gacaaaactgagatcacactgt

SEQ ID NO: 7311248 - DNA, 22 bp, Homo sapiens
gaatttatctacgttaagtatg

SEQ ID NO: 7311249 - DNA, 22 bp, Homo sapiens
gaatttttctggaagcaattat

SEQ ID NO: 7311250 - DNA, 22 bp, Homo sapiens
gacaaaacacattagtttaaaa

SEQ ID NO: 7311251 - DNA, 22 bp, Homo sapiens
gacaaaacacattagtttaaaa

SEQ ID NO: 7311252 - DNA, 22 bp, Homo sapiens
gaatgtttttaggaatgttatg

SEQ ID NO: 7311253 - DNA, 22 bp, Homo sapiens
gaatgtttgtgcagagtcatct

SEQ ID NO: 7311254 - DNA, 22 bp, Homo sapiens
gaatgtttttataagtgttaca

SEQ ID NO: 7311255 - DNA, 22 bp, Homo sapiens
gaatgtttttcaaacctgtggc

SEQ ID NO: 7311256 - DNA, 22 bp, Homo sapiens
gaatgtttttcattggtgactc

SEQ ID NO: 7311257 - DNA, 22 bp, Homo sapiens
gaattacagagttgttaagtca

SEQ ID NO: 7311258 - DNA, 22 bp, Homo sapiens
gaattacataataaaatgagag

SEQ ID NO: 7311259 - DNA, 19 bp, Homo sapiens
gaatgtttgtattcagcgc

SEQ ID NO: 7311260 - DNA, 22 bp, Homo sapiens
gaatgctctttggtcctagact

SEQ ID NO: 7311261 - DNA, 22 bp, Homo sapiens
gaagaatattcttgatcttaga

SEQ ID NO: 7311262 - DNA, 22 bp, Homo sapiens
gaatgctctcattttccaacat

SEQ ID NO: 7311263 - DNA, 22 bp, Homo sapiens
gacatcaattcagcattttaag

SEQ ID NO: 7311264 - DNA, 22 bp, Homo sapiens
gacatatttgaaaccaagagaa

SEQ ID NO: 7311265 - DNA, 22 bp, Homo sapiens
gacatacagccctctccctggt

SEQ ID NO: 7311266 - DNA, 22 bp, Homo sapiens
gacatatactatggatggttct

SEQ ID NO: 7311267 - DNA, 18 bp, Homo sapiens
gacagctgtcctgagccc

SEQ ID NO: 7311268 - DNA, 22 bp, Homo sapiens
gacagctgtacactcctggtta

SEQ ID NO: 7311269 - DNA, 22 bp, Homo sapiens
gacagctggcagtggaaaggtg

SEQ ID NO: 7311270 - DNA, 17 bp, Homo sapiens
gacagctggttcctggc

SEQ ID NO: 7311271 - DNA, 22 bp, Homo sapiens
gacatacagcatggtctatgaa

SEQ ID NO: 7311272 - DNA, 22 bp, Homo sapiens
gacatacagaatctgcagactt

SEQ ID NO: 7311273 - DNA, 22 bp, Homo sapiens
gacagccaggtctgatgaccca

SEQ ID NO: 7311274 - DNA, 22 bp, Homo sapiens
gacagctggcagtggaaaggtg

SEQ ID NO: 7311275 - DNA, 22 bp, Homo sapiens
gacagccatcagcacacgctgc

SEQ ID NO: 7311276 - DNA, 22 bp, Homo sapiens
gacagctgaaaaatgtaaggta

SEQ ID NO: 7311277 - DNA, 22 bp, Homo sapiens
gacagctacagggagagcattg

SEQ ID NO: 7311278 - DNA, 22 bp, Homo sapiens
gaccttgtaaattttcactcca

SEQ ID NO: 7311279 - DNA, 22 bp, Homo sapiens
gactactcaaactttctctata

SEQ ID NO: 7311280 - DNA, 22 bp, Homo sapiens
gaccttcaagcaccatatttat

SEQ ID NO: 7311281 - DNA, 22 bp, Homo sapiens
gacctggggtggaaggaaggca

SEQ ID NO: 7311282 - DNA, 22 bp, Homo sapiens
gacctggggtggaaggaaggca

SEQ ID NO: 7311283 - DNA, 22 bp, Homo sapiens
gacctggaatgaagggtccctc

SEQ ID NO: 7311284 - DNA, 22 bp, Homo sapiens
gacattaatggcaaattaatta

SEQ ID NO: 7311285 - DNA, 22 bp, Homo sapiens
gacattaatttctttggtaatt

SEQ ID NO: 7311286 - DNA, 22 bp, Homo sapiens
gacattcaactttgatgattat

SEQ ID NO: 7311287 - DNA, 22 bp, Homo sapiens
gacatgtgctgtctcttaaatt

SEQ ID NO: 7311288 - DNA, 22 bp, Homo sapiens
gacatgtattagtacatatggt

SEQ ID NO: 7311289 - DNA, 22 bp, Homo sapiens
gacatgcattaagacacactga

SEQ ID NO: 7311290 - DNA, 22 bp, Homo sapiens
gacatgcatattcactcttctt

SEQ ID NO: 7311291 - DNA, 22 bp, Homo sapiens
gacatgaatgttatactttatt

SEQ ID NO: 7311292 - DNA, 22 bp, Homo sapiens
gacatgaacctaccataatgat

SEQ ID NO: 7311293 - DNA, 22 bp, Homo sapiens
gaaacttgataattgaaacaga

SEQ ID NO: 7311294 - DNA, 22 bp, Homo sapiens
gaaactttcatgaatataagat

SEQ ID NO: 7311295 - DNA, 22 bp, Homo sapiens
gaaacttttaaacctcatgagt

SEQ ID NO: 7311296 - DNA, 22 bp, Homo sapiens
gaaagaagctttagatggctat

SEQ ID NO: 7311297 - DNA, 22 bp, Homo sapiens
gaaacgaagctctagattagaa

SEQ ID NO: 7311298 - DNA, 22 bp, Homo sapiens
gaaaaatgagctgatgtcaggg

SEQ ID NO: 7311299 - DNA, 19 bp, Homo sapiens
ctttggaggatgaggctgg

SEQ ID NO: 7311300 - DNA, 22 bp, Homo sapiens
ctttttgtctctgtcctgatga

SEQ ID NO: 7311301 - DNA, 22 bp, Homo sapiens
ctttttcttctaggtgtgcctg

SEQ ID NO: 7311302 - DNA, 22 bp, Homo sapiens
ctttttctgatgttccatgatt

SEQ ID NO: 7311303 - DNA, 22 bp, Homo sapiens
ctttttctgatgttccatgatt

SEQ ID NO: 7311304 - DNA, 16 bp, Homo sapiens
ctttttctcccctctt

SEQ ID NO: 7311305 - DNA, 20 bp, Homo sapiens
ctttttctccagctctgagc

SEQ ID NO: 7311306 - DNA, 20 bp, Homo sapiens
ctttttctccagctctgagc

SEQ ID NO: 7311307 - DNA, 22 bp, Homo sapiens
ctttttctaatcataattgtct

SEQ ID NO: 7311308 - DNA, 22 bp, Homo sapiens
gaaattaaccacctttggcttt

SEQ ID NO: 7311309 - DNA, 22 bp, Homo sapiens
gaaattaagcaggggtctgtgg

SEQ ID NO: 7311310 - DNA, 22 bp, Homo sapiens
gaaattcaaataagatatgtag

SEQ ID NO: 7311311 - DNA, 22 bp, Homo sapiens
gaaattcactgtatttcttggg

SEQ ID NO: 7311312 - DNA, 22 bp, Homo sapiens
gaagaactgtgacagaagcagt

SEQ ID NO: 7311313 - DNA, 22 bp, Homo sapiens
gaagaactttagggcagaattt

SEQ ID NO: 7311314 - DNA, 22 bp, Homo sapiens
gaagaagacatggaacaatagt

SEQ ID NO: 7311315 - DNA, 22 bp, Homo sapiens
gaagaagcctctgtggatctga

SEQ ID NO: 7311316 - DNA, 22 bp, Homo sapiens
gaagaagcattctgctgttttg

SEQ ID NO: 7311317 - DNA, 19 bp, Homo sapiens
gaagaagcttgagaagtag

SEQ ID NO: 7311318 - DNA, 22 bp, Homo sapiens
gaagaactaactgaccatgaat

SEQ ID NO: 7311319 - DNA, 22 bp, Homo sapiens
gaagaactgacaaactagatca

SEQ ID NO: 7311320 - DNA, 22 bp, Homo sapiens
gaagaaattgaattcatgagct

SEQ ID NO: 7311321 - DNA, 22 bp, Homo sapiens
gaagaacacctgctgcccagtg

SEQ ID NO: 7311322 - DNA, 22 bp, Homo sapiens
gaacttcagaatcagcatatct

SEQ ID NO: 7311323 - DNA, 22 bp, Homo sapiens
gaaatgtctctggatttgcttt

SEQ ID NO: 7311324 - DNA, 22 bp, Homo sapiens
gaaatgtctcttgatttttgga

SEQ ID NO: 7311325 - DNA, 22 bp, Homo sapiens
gaaatgtcatagtcttcaagcc

SEQ ID NO: 7311326 - DNA, 22 bp, Homo sapiens
gaaatgtctttgacaagagagg

SEQ ID NO: 7311327 - DNA, 22 bp, Homo sapiens
gaaagacatagttgcaagatgg

SEQ ID NO: 7311328 - DNA, 22 bp, Homo sapiens
gaaagacatagttgcaagatgg

SEQ ID NO: 7311329 - DNA, 22 bp, Homo sapiens
gaaagacttcctttgagagtac

SEQ ID NO: 7311330 - DNA, 22 bp, Homo sapiens
gaaagactaactagaaagtgca

SEQ ID NO: 7311331 - DNA, 22 bp, Homo sapiens
gaaatacaggaatgccacacag

SEQ ID NO: 7311332 - DNA, 22 bp, Homo sapiens
gaaatacaggaatgccacacag

SEQ ID NO: 7311333 - DNA, 22 bp, Homo sapiens
gaaatatacattgcaggaagag

SEQ ID NO: 7311334 - DNA, 22 bp, Homo sapiens
ctttctctgtgtttcacatgct

SEQ ID NO: 7311335 - DNA, 20 bp, Homo sapiens
ctttctctaatttataagta

SEQ ID NO: 7311336 - DNA, 22 bp, Homo sapiens
ctttctctgtgtttcacatgct

SEQ ID NO: 7311337 - DNA, 22 bp, Homo sapiens
ctttctctgtgtttcacatgct

SEQ ID NO: 7311338 - DNA, 21 bp, Homo sapiens
ctttgcatctatatgttctca

SEQ ID NO: 7311339 - DNA, 22 bp, Homo sapiens
ctttccaatgcatttccaatgt

SEQ ID NO: 7311340 - DNA, 22 bp, Homo sapiens
ctttccaatgtcactatgaatc

SEQ ID NO: 7311341 - DNA, 22 bp, Homo sapiens
cttggagatacaagtggtacct

SEQ ID NO: 7311342 - DNA, 22 bp, Homo sapiens
cttgcttacctagttagctcca

SEQ ID NO: 7311343 - DNA, 22 bp, Homo sapiens
cttgcctaggtgtatattaaat

SEQ ID NO: 7311344 - DNA, 22 bp, Homo sapiens
cttgcctgaggaacagagggta

SEQ ID NO: 7311345 - DNA, 22 bp, Homo sapiens
cttgcctgctggagcagggctc

SEQ ID NO: 7311346 - DNA, 22 bp, Homo sapiens
cttcttccaagcttatgctcaa

SEQ ID NO: 7311347 - DNA, 22 bp, Homo sapiens
cttcttctctacatcctttgat

SEQ ID NO: 7311348 - DNA, 20 bp, Homo sapiens
cttcttcagtagtttgttct

SEQ ID NO: 7311349 - DNA, 20 bp, Homo sapiens
cttcttcagcctatgcttca

SEQ ID NO: 7311350 - DNA, 22 bp, Homo sapiens
cttccctttctggtgacttctc

SEQ ID NO: 7311351 - DNA, 18 bp, Homo sapiens
cttccctcttcctttgtc

SEQ ID NO: 7311352 - DNA, 22 bp, Homo sapiens
cttcccagacggggtggcagcc

SEQ ID NO: 7311353 - DNA, 22 bp, Homo sapiens
cttcccaggtgctcttagcatg

SEQ ID NO: 7311354 - DNA, 22 bp, Homo sapiens
cttccccaggacctctgctaaa

SEQ ID NO: 7311355 - DNA, 22 bp, Homo sapiens
cttcagaaccagccagaagagg

SEQ ID NO: 7311356 - DNA, 22 bp, Homo sapiens
cttcacctcctcctctgtgggc

SEQ ID NO: 7311357 - DNA, 22 bp, Homo sapiens
ctgttaaaagcactgccatcct

SEQ ID NO: 7311358 - DNA, 22 bp, Homo sapiens
ctgttaaaaagaccaatggatt

SEQ ID NO: 7311359 - DNA, 20 bp, Homo sapiens
ctgttaaaaggtatgaattc

SEQ ID NO: 7311360 - DNA, 22 bp, Homo sapiens
ctgttaaaatgtggtcttaaaa

SEQ ID NO: 7311361 - DNA, 22 bp, Homo sapiens
ctgttaaatagactgcagtgca

SEQ ID NO: 7311362 - DNA, 22 bp, Homo sapiens
ctgttaaagtgatcctttgtta

SEQ ID NO: 7311363 - DNA, 22 bp, Homo sapiens
ctgttaaagatagttaagcttc

SEQ ID NO: 7311364 - DNA, 22 bp, Homo sapiens
ctgttaaatgagaaagcagact

SEQ ID NO: 7311365 - DNA, 22 bp, Homo sapiens
cttcaaagatttgataaagcca

SEQ ID NO: 7311366 - DNA, 22 bp, Homo sapiens
cttcaaatacaagtagattatg

SEQ ID NO: 7311367 - DNA, 22 bp, Homo sapiens
cttcaaatgtgattttaataac

SEQ ID NO: 7311368 - DNA, 22 bp, Homo sapiens
cttcaaatgtgattttaataac

SEQ ID NO: 7311369 - DNA, 22 bp, Homo sapiens
ctggttttccaatgttttgact

SEQ ID NO: 7311370 - DNA, 22 bp, Homo sapiens
ctggttccagaattgcctgtgg

SEQ ID NO: 7311371 - DNA, 22 bp, Homo sapiens
ctggttcccagcaggagtgtag

SEQ ID NO: 7311372 - DNA, 22 bp, Homo sapiens
ctgtcccagatgttctcagcac

SEQ ID NO: 7311373 - DNA, 22 bp, Homo sapiens
ctgtgaggccctgggtgctgga

SEQ ID NO: 7311374 - DNA, 22 bp, Homo sapiens
ctgtgagctaggaggtaattta

SEQ ID NO: 7311375 - DNA, 22 bp, Homo sapiens
ctgtgaggcgggtggagtggag

SEQ ID NO: 7311376 - DNA, 22 bp, Homo sapiens
ctgtgacttccggatgacatga

SEQ ID NO: 7311377 - DNA, 22 bp, Homo sapiens
ctgtgacagtttctcagaattt

SEQ ID NO: 7311378 - DNA, 22 bp, Homo sapiens
ctgtgacccagttcctggcacc

SEQ ID NO: 7311379 - DNA, 22 bp, Homo sapiens
ctgtccctctcacacctcacca

SEQ ID NO: 7311380 - DNA, 22 bp, Homo sapiens
ctgtctgttgaccatagtttgc

SEQ ID NO: 7311381 - DNA, 22 bp, Homo sapiens
ctgtctgttcagattcattact

SEQ ID NO: 7311382 - DNA, 22 bp, Homo sapiens
ctgtctgttcagattcattact

SEQ ID NO: 7311383 - DNA, 22 bp, Homo sapiens
ctgtctgtttcaaaagtggtta

SEQ ID NO: 7311384 - DNA, 21 bp, Homo sapiens
ctgtccctctttgcttccctc

SEQ ID NO: 7311385 - DNA, 22 bp, Homo sapiens
ctgtctgtggtctcagtaggcc

SEQ ID NO: 7311386 - DNA, 22 bp, Homo sapiens
ctgtctgtgtggacacggctgc

SEQ ID NO: 7311387 - DNA, 22 bp, Homo sapiens
ctgtctgtggtctcagtaggcc

SEQ ID NO: 7311388 - DNA, 22 bp, Homo sapiens
ctgtctgttatctcaccagtcc

SEQ ID NO: 7311389 - DNA, 22 bp, Homo sapiens
ctgtctgtgtggacacggctgc

SEQ ID NO: 7311390 - DNA, 22 bp, Homo sapiens
ctgtggatttacttgagaagct

SEQ ID NO: 7311391 - DNA, 22 bp, Homo sapiens
ctgtggcacatgtggcaaggcc

SEQ ID NO: 7311392 - DNA, 20 bp, Homo sapiens
ctgtggcatcttgaaggagg

SEQ ID NO: 7311393 - DNA, 22 bp, Homo sapiens
ctgtggcattgccgaggctggc

SEQ ID NO: 7311394 - DNA, 22 bp, Homo sapiens
ctgtggcattgtgaggactgca

SEQ ID NO: 7311395 - DNA, 22 bp, Homo sapiens
ctgtggctttctctgcctcctt

SEQ ID NO: 7311396 - DNA, 22 bp, Homo sapiens
ctgtgggagcactggggaccga

SEQ ID NO: 7311397 - DNA, 22 bp, Homo sapiens
ctgtgggatcccatgactttcc

SEQ ID NO: 7311398 - DNA, 22 bp, Homo sapiens
ctgtgggagggtgagagaacca

SEQ ID NO: 7311399 - DNA, 22 bp, Homo sapiens
ctgtgggagggtgagagaacca

SEQ ID NO: 7311400 - DNA, 22 bp, Homo sapiens
ctgtgggagcagcaccaaggac

SEQ ID NO: 7311401 - DNA, 22 bp, Homo sapiens
ctgtgggagggaaggcgcggcc

SEQ ID NO: 7311402 - DNA, 23 bp, Homo sapiens
ctgtggccacccctagctggagg

SEQ ID NO: 7311403 - DNA, 22 bp, Homo sapiens
ctgtggcatttagaggttgcgt

SEQ ID NO: 7311404 - DNA, 17 bp, Homo sapiens
ctgtggccacctggatg

SEQ ID NO: 7311405 - DNA, 22 bp, Homo sapiens
ctgtgggatgggacctcagctg

SEQ ID NO: 7311406 - DNA, 22 bp, Homo sapiens
ctgtgggattcatgacattaat

SEQ ID NO: 7311407 - DNA, 22 bp, Homo sapiens
ctgtgggcagctcctcctgtca

SEQ ID NO: 7311408 - DNA, 22 bp, Homo sapiens
ctgtgggcatttgagtgtgggt

SEQ ID NO: 7311409 - DNA, 22 bp, Homo sapiens
ctgtgtgtgtctgcagcatact

SEQ ID NO: 7311410 - DNA, 22 bp, Homo sapiens
ctgtgtgtgtctgcagcatact

SEQ ID NO: 7311411 - DNA, 22 bp, Homo sapiens
ctgtgtgtgtctgcagcatact

SEQ ID NO: 7311412 - DNA, 22 bp, Homo sapiens
ctgtgtgtgtctgcagcatact

SEQ ID NO: 7311413 - DNA, 22 bp, Homo sapiens
ctgtgtgtgctacaggcttcca

SEQ ID NO: 7311414 - DNA, 22 bp, Homo sapiens
ctgtgtgtgctacaggcttcca

SEQ ID NO: 7311415 - DNA, 23 bp, Homo sapiens
ctgtgtgtgccgagggtggccac

SEQ ID NO: 7311416 - DNA, 23 bp, Homo sapiens
ctgtgtgtgccgagggtggccac

SEQ ID NO: 7311417 - DNA, 23 bp, Homo sapiens
ctgtgtgtgccgagggtggccac

SEQ ID NO: 7311418 - DNA, 22 bp, Homo sapiens
ctgtgtgtgagaagcaggttga

SEQ ID NO: 7311419 - DNA, 22 bp, Homo sapiens
ctgtgtgtgagaagcaggttga

SEQ ID NO: 7311420 - DNA, 22 bp, Homo sapiens
ctgtgtgtgagaagcaggttga

SEQ ID NO: 7311421 - DNA, 22 bp, Homo sapiens
ctgtgtgtttatatcatttcct

SEQ ID NO: 7311422 - DNA, 22 bp, Homo sapiens
ctgtgtgtttatatcatttcct

SEQ ID NO: 7311423 - DNA, 22 bp, Homo sapiens
ctgtgtttctcttgacccaagt

SEQ ID NO: 7311424 - DNA, 22 bp, Homo sapiens
ctgtgtttctgagaagtgggga

SEQ ID NO: 7311425 - DNA, 22 bp, Homo sapiens
ctgtgttctccaggggcagctg

SEQ ID NO: 7311426 - DNA, 22 bp, Homo sapiens
ctgtgtttctaagtaaaggagc

SEQ ID NO: 7311427 - DNA, 22 bp, Homo sapiens
ctgtgtttttggtctgatctat

SEQ ID NO: 7311428 - DNA, 22 bp, Homo sapiens
ctgtgtttttggtctgatctat

SEQ ID NO: 7311429 - DNA, 22 bp, Homo sapiens
ctgtgttttgattaaaaagcaa

SEQ ID NO: 7311430 - DNA, 22 bp, Homo sapiens
ctgtgtttggacaacttttcag

SEQ ID NO: 7311431 - DNA, 22 bp, Homo sapiens
ctgtgtttgctatgcaaagaca

SEQ ID NO: 7311432 - DNA, 22 bp, Homo sapiens
ctgtgtttgacaggcggtctcc

SEQ ID NO: 7311433 - DNA, 22 bp, Homo sapiens
ctgtgtgcaacttgcagttttg

SEQ ID NO: 7311434 - DNA, 22 bp, Homo sapiens
ctgtgtcttctgttttgaagtt

SEQ ID NO: 7311435 - DNA, 22 bp, Homo sapiens
ctgtgtctttcctactttgtgg

SEQ ID NO: 7311436 - DNA, 22 bp, Homo sapiens
ctgtgtcttgagtaattcggtg

SEQ ID NO: 7311437 - DNA, 22 bp, Homo sapiens
ctgtgggtgaagacaagggaga

SEQ ID NO: 7311438 - DNA, 19 bp, Homo sapiens
ctgtgggtgtgcaagggtg

SEQ ID NO: 7311439 - DNA, 22 bp, Homo sapiens
ctgggaggcggaggttgcagtg

SEQ ID NO: 7311440 - DNA, 22 bp, Homo sapiens
ctggagcctgcagttttcactt

SEQ ID NO: 7311441 - DNA, 22 bp, Homo sapiens
ctgggagtctggcctctggtcc

SEQ ID NO: 7311442 - DNA, 22 bp, Homo sapiens
ctgggagtcaccaggagcaagg

SEQ ID NO: 7311443 - DNA, 22 bp, Homo sapiens
ctgggagtcaccaggagcaagg

SEQ ID NO: 7311444 - DNA, 22 bp, Homo sapiens
ctgggcccacgagggctctggg

SEQ ID NO: 7311445 - DNA, 22 bp, Homo sapiens
ctgggatggctccgctgctgct

SEQ ID NO: 7311446 - DNA, 22 bp, Homo sapiens
ctgggatggctttcctgcatta

SEQ ID NO: 7311447 - DNA, 22 bp, Homo sapiens
ctgggatgctccggcctggatg

SEQ ID NO: 7311448 - DNA, 22 bp, Homo sapiens
ctgggatgcggaggttgcggtg

SEQ ID NO: 7311449 - DNA, 22 bp, Homo sapiens
ctgggatgatagtgctagtatt

SEQ ID NO: 7311450 - DNA, 22 bp, Homo sapiens
ctgggagtgtccctctggtaat

SEQ ID NO: 7311451 - DNA, 23 bp, Homo sapiens
ctgggcctatggtctgaatccaa

SEQ ID NO: 7311452 - DNA, 22 bp, Homo sapiens
ctgggcctaacccacagcgttt

SEQ ID NO: 7311453 - DNA, 22 bp, Homo sapiens
ctgggctcagtggctcatggct

SEQ ID NO: 7311454 - DNA, 22 bp, Homo sapiens
ctggtagatgccctgctctgta

SEQ ID NO: 7311455 - DNA, 22 bp, Homo sapiens
ctggtcaccaggtagcattgta

SEQ ID NO: 7311456 - DNA, 22 bp, Homo sapiens
ctggtcacctccttcccagcta

SEQ ID NO: 7311457 - DNA, 22 bp, Homo sapiens
ctggtcacatctctactaccca

SEQ ID NO: 7311458 - DNA, 22 bp, Homo sapiens
ctggttcaagtcctggctctgt

SEQ ID NO: 7311459 - DNA, 22 bp, Homo sapiens
ctggggggctactgacagagga

SEQ ID NO: 7311460 - DNA, 22 bp, Homo sapiens
ctggggggctactgacagagga

SEQ ID NO: 7311461 - DNA, 22 bp, Homo sapiens
ctggggtggtgcaggcctcatg

SEQ ID NO: 7311462 - DNA, 22 bp, Homo sapiens
ctggggtggaggagctcccctg

SEQ ID NO: 7311463 - DNA, 18 bp, Homo sapiens
ctgggctcgagagatcct

SEQ ID NO: 7311464 - DNA, 22 bp, Homo sapiens
ctggggctgtaggaggacttat

SEQ ID NO: 7311465 - DNA, 22 bp, Homo sapiens
gcagacagactgcagtgatttt

SEQ ID NO: 7311466 - DNA, 22 bp, Homo sapiens
gcagacagatgagggtgctggg

SEQ ID NO: 7311467 - DNA, 22 bp, Homo sapiens
gcagacagcatgttgggctatt

SEQ ID NO: 7311468 - DNA, 22 bp, Homo sapiens
gcagacaggcccagtggaggga

SEQ ID NO: 7311469 - DNA, 22 bp, Homo sapiens
gcagacaggattgggttaatag

SEQ ID NO: 7311470 - DNA, 22 bp, Homo sapiens
gcagacaggcccagtggaggga

SEQ ID NO: 7311471 - DNA, 22 bp, Homo sapiens
gcagacagccagactgcactgg

SEQ ID NO: 7311472 - DNA, 20 bp, Homo sapiens
gcacccagcttcttgttcta

SEQ ID NO: 7311473 - DNA, 22 bp, Homo sapiens
gcagagtgatggaatgtgggtg

SEQ ID NO: 7311474 - DNA, 22 bp, Homo sapiens
gcagagtgagccgaggctgctc

SEQ ID NO: 7311475 - DNA, 22 bp, Homo sapiens
gcagcaaacttccacaagtaga

SEQ ID NO: 7311476 - DNA, 22 bp, Homo sapiens
gcacagaataacactctgggct

SEQ ID NO: 7311477 - DNA, 22 bp, Homo sapiens
gcacagaagtaaaatacaagtc

SEQ ID NO: 7311478 - DNA, 22 bp, Homo sapiens
gcacagacagaatccctactcc

SEQ ID NO: 7311479 - DNA, 22 bp, Homo sapiens
gcacagactttgattgcagtca

SEQ ID NO: 7311480 - DNA, 22 bp, Homo sapiens
gcacagaaccagacatgaggca

SEQ ID NO: 7311481 - DNA, 22 bp, Homo sapiens
gcaataaagtagcagctcatca

SEQ ID NO: 7311482 - DNA, 22 bp, Homo sapiens
gcaatacagttgaagagattga

SEQ ID NO: 7311483 - DNA, 22 bp, Homo sapiens
gcaataaaatgtaatgattggg

SEQ ID NO: 7311484 - DNA, 18 bp, Homo sapiens
gagtagcattgaggaaac

SEQ ID NO: 7311485 - DNA, 19 bp, Homo sapiens
gagtattttccaacttggt

SEQ ID NO: 7311486 - DNA, 22 bp, Homo sapiens
gcaaggaggctggtggaggaag

SEQ ID NO: 7311487 - DNA, 22 bp, Homo sapiens
gcaaggagcctggaggtgagtg

SEQ ID NO: 7311488 - DNA, 22 bp, Homo sapiens
gcaggccctcctctagcaaggc

SEQ ID NO: 7311489 - DNA, 22 bp, Homo sapiens
gcagggcagcttagtccctgtc

SEQ ID NO: 7311490 - DNA, 22 bp, Homo sapiens
gcaggcccagagtcgctggcct

SEQ ID NO: 7311491 - DNA, 22 bp, Homo sapiens
gcagggccagtgcagagaggaa

SEQ ID NO: 7311492 - DNA, 22 bp, Homo sapiens
gcaggtctcaatctgagcaggc

SEQ ID NO: 7311493 - DNA, 22 bp, Homo sapiens
gcagcagcccagggctctcaga

SEQ ID NO: 7311494 - DNA, 21 bp, Homo sapiens
gcagccactgccttcaacaat

SEQ ID NO: 7311495 - DNA, 22 bp, Homo sapiens
gcagcagcaggcgctcggccgt

SEQ ID NO: 7311496 - DNA, 22 bp, Homo sapiens
gcagcagccactattctggcat

SEQ ID NO: 7311497 - DNA, 22 bp, Homo sapiens
gcagcagaagtagaagtacagg

SEQ ID NO: 7311498 - DNA, 22 bp, Homo sapiens
gcagcagcaagaaggttggact

SEQ ID NO: 7311499 - DNA, 22 bp, Homo sapiens
gcagcacacggtggtgccctgg

SEQ ID NO: 7311500 - DNA, 21 bp, Homo sapiens
gcagttaatagcagagcacac

SEQ ID NO: 7311501 - DNA, 22 bp, Homo sapiens
gcagttacctattttgtagaaa

SEQ ID NO: 7311502 - DNA, 22 bp, Homo sapiens
gcagttacctattttgtagaaa

SEQ ID NO: 7311503 - DNA, 17 bp, Homo sapiens
gcagttaaattaagatg

SEQ ID NO: 7311504 - DNA, 17 bp, Homo sapiens
gcagttaaattaagatg

SEQ ID NO: 7311505 - DNA, 22 bp, Homo sapiens
gcagttgctcttgaggcacttt

SEQ ID NO: 7311506 - DNA, 23 bp, Homo sapiens
gcagttagtccactttgcagaga

SEQ ID NO: 7311507 - DNA, 22 bp, Homo sapiens
gcagttacttctgagaagtgaa

SEQ ID NO: 7311508 - DNA, 22 bp, Homo sapiens
gcagttactagcaatttgtgaa

SEQ ID NO: 7311509 - DNA, 22 bp, Homo sapiens
gcagttactagcaatttgtgaa

SEQ ID NO: 7311510 - DNA, 22 bp, Homo sapiens
gcaggtgattcaccctgggcct

SEQ ID NO: 7311511 - DNA, 18 bp, Homo sapiens
gcaggtgccactgctgtt

SEQ ID NO: 7311512 - DNA, 22 bp, Homo sapiens
gcagttttagagctttaagatg

SEQ ID NO: 7311513 - DNA, 22 bp, Homo sapiens
gcattacaggaatttgttactg

SEQ ID NO: 7311514 - DNA, 22 bp, Homo sapiens
gcattcttggtatgaaggacag

SEQ ID NO: 7311515 - DNA, 22 bp, Homo sapiens
gcattcttggtggagtgctaaa

SEQ ID NO: 7311516 - DNA, 22 bp, Homo sapiens
gcattcttcgaagtaagtagtg

SEQ ID NO: 7311517 - DNA, 22 bp, Homo sapiens
gccacctctctcttgactcgag

SEQ ID NO: 7311518 - DNA, 21 bp, Homo sapiens
gccactgtgcacactaaccca

SEQ ID NO: 7311519 - DNA, 20 bp, Homo sapiens
gccactgtgcttacactgct

SEQ ID NO: 7311520 - DNA, 22 bp, Homo sapiens
gccactgttccaccatcttgat

SEQ ID NO: 7311521 - DNA, 22 bp, Homo sapiens
gccactgttccaccatcttgat

SEQ ID NO: 7311522 - DNA, 22 bp, Homo sapiens
gccactgttcttctttgttcca

SEQ ID NO: 7311523 - DNA, 22 bp, Homo sapiens
gccactgtgttgatctagcctg

SEQ ID NO: 7311524 - DNA, 22 bp, Homo sapiens
gccactgtggtcctcccatgat

SEQ ID NO: 7311525 - DNA, 22 bp, Homo sapiens
gccactgttgctcctcaggaaa

SEQ ID NO: 7311526 - DNA, 22 bp, Homo sapiens
gcatttatttctttactgcatc

SEQ ID NO: 7311527 - DNA, 22 bp, Homo sapiens
gcatttcaaaattccaggcaag

SEQ ID NO: 7311528 - DNA, 22 bp, Homo sapiens
gcatttcagaaaggttaccaac

SEQ ID NO: 7311529 - DNA, 22 bp, Homo sapiens
gcatttcagaagcatgccctct

SEQ ID NO: 7311530 - DNA, 22 bp, Homo sapiens
gcatttcatgccgtggaagtcc

SEQ ID NO: 7311531 - DNA, 19 bp, Homo sapiens
gcatttcaggcatgtttgc

SEQ ID NO: 7311532 - DNA, 22 bp, Homo sapiens
gcatttcagagaaaatctgctt

SEQ ID NO: 7311533 - DNA, 22 bp, Homo sapiens
gcatttcatgctccttggaacc

SEQ ID NO: 7311534 - DNA, 22 bp, Homo sapiens
gcatttcatgtaagtcagacca

SEQ ID NO: 7311535 - DNA, 22 bp, Homo sapiens
gcccaagactgtacagttaaag

SEQ ID NO: 7311536 - DNA, 22 bp, Homo sapiens
gccatttggcaaaactgacttc

SEQ ID NO: 7311537 - DNA, 22 bp, Homo sapiens
gccattttctgtcttgtttatt

SEQ ID NO: 7311538 - DNA, 23 bp, Homo sapiens
gccaggctccggtctgtggccac

SEQ ID NO: 7311539 - DNA, 22 bp, Homo sapiens
gccaggctccccggatccctgg

SEQ ID NO: 7311540 - DNA, 19 bp, Homo sapiens
gccaggctccatagccggc

SEQ ID NO: 7311541 - DNA, 22 bp, Homo sapiens
gccaggctccaggccctcctga

SEQ ID NO: 7311542 - DNA, 22 bp, Homo sapiens
gccaggctcagtagcgattcct

SEQ ID NO: 7311543 - DNA, 22 bp, Homo sapiens
gccaggctaagaaaggtgtgat

SEQ ID NO: 7311544 - DNA, 22 bp, Homo sapiens
gccaggctcagcagtcaacctg

SEQ ID NO: 7311545 - DNA, 22 bp, Homo sapiens
gccacttgtgtaagcgcctgtc

SEQ ID NO: 7311546 - DNA, 22 bp, Homo sapiens
gccactttgatgatataaaaac

SEQ ID NO: 7311547 - DNA, 21 bp, Homo sapiens
gccagctgggtcttgcaggag

SEQ ID NO: 7311548 - DNA, 22 bp, Homo sapiens
gccagctgaggccgtgcaggct

SEQ ID NO: 7311549 - DNA, 22 bp, Homo sapiens
gccagctgtaggtggtgggttg

SEQ ID NO: 7311550 - DNA, 22 bp, Homo sapiens
gccagctgtaagctggggtgat

SEQ ID NO: 7311551 - DNA, 22 bp, Homo sapiens
gccagctgtctaagagagtaaa

SEQ ID NO: 7311552 - DNA, 22 bp, Homo sapiens
gcctgcagaactgtgaggcaat

SEQ ID NO: 7311553 - DNA, 22 bp, Homo sapiens
gcctgcagcccctctgcagtag

SEQ ID NO: 7311554 - DNA, 22 bp, Homo sapiens
gcctgagggctcctagcaggct

SEQ ID NO: 7311555 - DNA, 22 bp, Homo sapiens
gcctgccaaaagaagctgctgg

SEQ ID NO: 7311556 - DNA, 20 bp, Homo sapiens
gcctgcaggttggatgggat

SEQ ID NO: 7311557 - DNA, 22 bp, Homo sapiens
gcccacagctcgttcctctcct

SEQ ID NO: 7311558 - DNA, 22 bp, Homo sapiens
gcccacagaggcaccaccaggc

SEQ ID NO: 7311559 - DNA, 22 bp, Homo sapiens
gcccctggctggccagctcctc

SEQ ID NO: 7311560 - DNA, 22 bp, Homo sapiens
gccctgagttgagccttccaaa

SEQ ID NO: 7311561 - DNA, 21 bp, Homo sapiens
gccctaggctacctggagcgc

SEQ ID NO: 7311562 - DNA, 22 bp, Homo sapiens
gccctagggcttttgggcctgt

SEQ ID NO: 7311563 - DNA, 22 bp, Homo sapiens
gccctagggggaaccgaggact

SEQ ID NO: 7311564 - DNA, 22 bp, Homo sapiens
gccctggaaaggaacctgggct

SEQ ID NO: 7311565 - DNA, 22 bp, Homo sapiens
gccctggaatctctccatggga

SEQ ID NO: 7311566 - DNA, 22 bp, Homo sapiens
gctgtctgctgtgcactgagca

SEQ ID NO: 7311567 - DNA, 22 bp, Homo sapiens
gctgtcctggggagggagaatg

SEQ ID NO: 7311568 - DNA, 22 bp, Homo sapiens
gctgtgtgctcacgtagtggaa

SEQ ID NO: 7311569 - DNA, 22 bp, Homo sapiens
gctgtgtgctaggatatgtttt

SEQ ID NO: 7311570 - DNA, 22 bp, Homo sapiens
gctgtgtgccaggggaaggctg

SEQ ID NO: 7311571 - DNA, 22 bp, Homo sapiens
gctgtgtgactgagagcctggc

SEQ ID NO: 7311572 - DNA, 22 bp, Homo sapiens
gctgtctggcatggcgtggctg

SEQ ID NO: 7311573 - DNA, 22 bp, Homo sapiens
gctgtctgggttgagggccctg

SEQ ID NO: 7311574 - DNA, 22 bp, Homo sapiens
gctgtctgttcgagcgtgtgtt

SEQ ID NO: 7311575 - DNA, 22 bp, Homo sapiens
gctgtctgtggtgtcagctgac

SEQ ID NO: 7311576 - DNA, 22 bp, Homo sapiens
gctggtcagggagggcacccat

SEQ ID NO: 7311577 - DNA, 22 bp, Homo sapiens
gctgtatgagttcatgtgtaga

SEQ ID NO: 7311578 - DNA, 19 bp, Homo sapiens
gctgtattaaagatacatg

SEQ ID NO: 7311579 - DNA, 22 bp, Homo sapiens
gcttttattgtctttacgacga

SEQ ID NO: 7311580 - DNA, 18 bp, Homo sapiens
gctttttagtgcatcttc

SEQ ID NO: 7311581 - DNA, 22 bp, Homo sapiens
gcttttttgggatgcctgcctt

SEQ ID NO: 7311582 - DNA, 22 bp, Homo sapiens
gctttgggtgtcctctgggcct

SEQ ID NO: 7311583 - DNA, 22 bp, Homo sapiens
gctttgggagtcagatttgcgc

SEQ ID NO: 7311584 - DNA, 22 bp, Homo sapiens
gctttgggggctgcagtgcgtg

SEQ ID NO: 7311585 - DNA, 22 bp, Homo sapiens
gcttaaattgtttgtggatagt

SEQ ID NO: 7311586 - DNA, 22 bp, Homo sapiens
gcttaaatcccaatgctagacc

SEQ ID NO: 7311587 - DNA, 22 bp, Homo sapiens
gcttggaagtaggattgggaga

SEQ ID NO: 7311588 - DNA, 22 bp, Homo sapiens
gctttaaatggcttgcccaagt

SEQ ID NO: 7311589 - DNA, 22 bp, Homo sapiens
gctttacaacaaattgaatatg

SEQ ID NO: 7311590 - DNA, 22 bp, Homo sapiens
gcttaaaagccacttagtctat

SEQ ID NO: 7311591 - DNA, 22 bp, Homo sapiens
gcttaaaatccatgatttttac

SEQ ID NO: 7311592 - DNA, 22 bp, Homo sapiens
gcttaaaatccatgatttttac

SEQ ID NO: 7311593 - DNA, 22 bp, Homo sapiens
gctgtttctggttctgttccta

SEQ ID NO: 7311594 - DNA, 22 bp, Homo sapiens
gctgtgtgctctggtctttctt

SEQ ID NO: 7311595 - DNA, 22 bp, Homo sapiens
gctgtgtgctgggcatggcact

SEQ ID NO: 7311596 - DNA, 22 bp, Homo sapiens
gctgtgttgggaatcatgtggg

SEQ ID NO: 7311597 - DNA, 22 bp, Homo sapiens
gctgtgttcattttgcatatgt

SEQ ID NO: 7311598 - DNA, 22 bp, Homo sapiens
gctgtgtgttcaataatgtgat

SEQ ID NO: 7311599 - DNA, 22 bp, Homo sapiens
gctgtgttggtgaagctgtagc

SEQ ID NO: 7311600 - DNA, 22 bp, Homo sapiens
gctgtgtttgacagtagcagac

SEQ ID NO: 7311601 - DNA, 22 bp, Homo sapiens
gctgttggcgaggagctcagct

SEQ ID NO: 7311602 - DNA, 22 bp, Homo sapiens
gctgttggggccagcaggtcat

SEQ ID NO: 7311603 - DNA, 19 bp, Homo sapiens
ggaaggccacggcaggctt

SEQ ID NO: 7311604 - DNA, 22 bp, Homo sapiens
ggacaggatgctgaagatgaag

SEQ ID NO: 7311605 - DNA, 19 bp, Homo sapiens
ggaaggagagaaatgcatg

SEQ ID NO: 7311606 - DNA, 22 bp, Homo sapiens
ggaaggaattccaagactaaag

SEQ ID NO: 7311607 - DNA, 22 bp, Homo sapiens
ggaaggaattccaagactaaag

SEQ ID NO: 7311608 - DNA, 19 bp, Homo sapiens
ggaaggagagaaatgcatg

SEQ ID NO: 7311609 - DNA, 22 bp, Homo sapiens
ggaaggaagtgcagactttaaa

SEQ ID NO: 7311610 - DNA, 22 bp, Homo sapiens
ggaaggaagtgcagactttaaa

SEQ ID NO: 7311611 - DNA, 22 bp, Homo sapiens
ggaaaaatgacacatatctcaa

SEQ ID NO: 7311612 - DNA, 22 bp, Homo sapiens
ggaaaaatagagtatactttaa

SEQ ID NO: 7311613 - DNA, 22 bp, Homo sapiens
ggaaggatctggctgaaatcca

SEQ ID NO: 7311614 - DNA, 22 bp, Homo sapiens
ggaaggaggggcaaagcagttc

SEQ ID NO: 7311615 - DNA, 22 bp, Homo sapiens
ggaaggagtctttaacacccat

SEQ ID NO: 7311616 - DNA, 22 bp, Homo sapiens
ggaaggaggggcaaagcagttc

SEQ ID NO: 7311617 - DNA, 22 bp, Homo sapiens
ggaaggagggcggcaatgatga

SEQ ID NO: 7311618 - DNA, 22 bp, Homo sapiens
ggaaggaggatgctctggcctt

SEQ ID NO: 7311619 - DNA, 22 bp, Homo sapiens
ggagaaaattgatgaagttggc

SEQ ID NO: 7311620 - DNA, 22 bp, Homo sapiens
ggagaaaggataggaatgtgct

SEQ ID NO: 7311621 - DNA, 22 bp, Homo sapiens
ggacttgctaaggtggctgaac

SEQ ID NO: 7311622 - DNA, 22 bp, Homo sapiens
ggacaggcgcagggccaaggaa

SEQ ID NO: 7311623 - DNA, 22 bp, Homo sapiens
ggacaggcccggggagcctgga

SEQ ID NO: 7311624 - DNA, 22 bp, Homo sapiens
ggagctgggaccctgtcatctg

SEQ ID NO: 7311625 - DNA, 21 bp, Homo sapiens
ggagctggggagctggcccca

SEQ ID NO: 7311626 - DNA, 18 bp, Homo sapiens
ggagctgggccccactcc

SEQ ID NO: 7311627 - DNA, 18 bp, Homo sapiens
ggagctgggcctggttcc

SEQ ID NO: 7311628 - DNA, 22 bp, Homo sapiens
ggagctggctacagagaactcc

SEQ ID NO: 7311629 - DNA, 19 bp, Homo sapiens
ggagcttggtggctgtggc

SEQ ID NO: 7311630 - DNA, 22 bp, Homo sapiens
ggagctggtcagccttgagcat

SEQ ID NO: 7311631 - DNA, 22 bp, Homo sapiens
ggagctggtcagccttgagcat

SEQ ID NO: 7311632 - DNA, 18 bp, Homo sapiens
ggagcccagaggacagga

SEQ ID NO: 7311633 - DNA, 22 bp, Homo sapiens
ggagccagtatttagtggtctt

SEQ ID NO: 7311634 - DNA, 22 bp, Homo sapiens
ggagccctcaccggcgagtgcc

SEQ ID NO: 7311635 - DNA, 22 bp, Homo sapiens
ggagccctagctgtgcatcaga

SEQ ID NO: 7311636 - DNA, 22 bp, Homo sapiens
ggagcccagtcggggtgtaggt

SEQ ID NO: 7311637 - DNA, 18 bp, Homo sapiens
ggagcccagaggtgagtt

SEQ ID NO: 7311638 - DNA, 22 bp, Homo sapiens
ggagccaggcaatctgtacttt

SEQ ID NO: 7311639 - DNA, 22 bp, Homo sapiens
ggagaagattggaattaagcac

SEQ ID NO: 7311640 - DNA, 22 bp, Homo sapiens
ggagaagattggaattaagcac

SEQ ID NO: 7311641 - DNA, 22 bp, Homo sapiens
ggagaaagtcagctccaagcag

SEQ ID NO: 7311642 - DNA, 22 bp, Homo sapiens
ggagaagaggagctggaagcct

SEQ ID NO: 7311643 - DNA, 22 bp, Homo sapiens
ggagaagaggagctggaagcct

SEQ ID NO: 7311644 - DNA, 18 bp, Homo sapiens
ggagaagaacagatgtgg

SEQ ID NO: 7311645 - DNA, 22 bp, Homo sapiens
gctctgtgtccacagctggaaa

SEQ ID NO: 7311646 - DNA, 22 bp, Homo sapiens
gctctgtggtggggcagagttt

SEQ ID NO: 7311647 - DNA, 18 bp, Homo sapiens
gctgcaggcgcctgcggt

SEQ ID NO: 7311648 - DNA, 18 bp, Homo sapiens
gctgcaggcgcctgcggt

SEQ ID NO: 7311649 - DNA, 22 bp, Homo sapiens
gctgcaggcggccgtggtggcg

SEQ ID NO: 7311650 - DNA, 22 bp, Homo sapiens
gctggatccctgtgggagtggt

SEQ ID NO: 7311651 - DNA, 22 bp, Homo sapiens
gctgcctgaaatgttgcctagc

SEQ ID NO: 7311652 - DNA, 22 bp, Homo sapiens
gctgcctgaagtgtctacactg

SEQ ID NO: 7311653 - DNA, 18 bp, Homo sapiens
gctgctggtggagggagc

SEQ ID NO: 7311654 - DNA, 22 bp, Homo sapiens
gctgctgtaacactaagtgcag

SEQ ID NO: 7311655 - DNA, 22 bp, Homo sapiens
gctgctgtaatgtgttaagtca

SEQ ID NO: 7311656 - DNA, 22 bp, Homo sapiens
gctgctgtacttggggggtgct

SEQ ID NO: 7311657 - DNA, 22 bp, Homo sapiens
gctgctgtcagcaggccttgtt

SEQ ID NO: 7311658 - DNA, 22 bp, Homo sapiens
gctgctgtcagtctgaatctga

SEQ ID NO: 7311659 - DNA, 22 bp, Homo sapiens
gctgctgtcacccacatctgtc

SEQ ID NO: 7311660 - DNA, 22 bp, Homo sapiens
gctgctgtcacggtgctaaggg

SEQ ID NO: 7311661 - DNA, 22 bp, Homo sapiens
gctgctgtctcatgcgatgcgg

SEQ ID NO: 7311662 - DNA, 22 bp, Homo sapiens
gctgctgtccttcaagtctgcg

SEQ ID NO: 7311663 - DNA, 22 bp, Homo sapiens
gctgctgtccttagggagttct

SEQ ID NO: 7311664 - DNA, 22 bp, Homo sapiens
gctgctgtcagtggtggcagtt

SEQ ID NO: 7311665 - DNA, 22 bp, Homo sapiens
gctggaggggtaataggatggg

SEQ ID NO: 7311666 - DNA, 22 bp, Homo sapiens
gctctgtgcaaatagcacccct

SEQ ID NO: 7311667 - DNA, 22 bp, Homo sapiens
gctctgtggcattcatgggcag

SEQ ID NO: 7311668 - DNA, 22 bp, Homo sapiens
gctctgtgaccttaggcaagtt

SEQ ID NO: 7311669 - DNA, 22 bp, Homo sapiens
gctctctgggtgtgtctagata

SEQ ID NO: 7311670 - DNA, 22 bp, Homo sapiens
gctctctggctagtccatcggg

SEQ ID NO: 7311671 - DNA, 22 bp, Homo sapiens
gctctctggaggccatggacag

SEQ ID NO: 7311672 - DNA, 22 bp, Homo sapiens
gctctctgttattaagatcttt

SEQ ID NO: 7311673 - DNA, 22 bp, Homo sapiens
gctccccattgatctgcaggct

SEQ ID NO: 7311674 - DNA, 22 bp, Homo sapiens
gctccccaggctggtcccctcg

SEQ ID NO: 7311675 - DNA, 22 bp, Homo sapiens
gctctctgaggtgctggcagag

SEQ ID NO: 7311676 - DNA, 22 bp, Homo sapiens
gctctctgcaagtcagcagcct

SEQ ID NO: 7311677 - DNA, 22 bp, Homo sapiens
gctctctgcagcctccttggag

SEQ ID NO: 7311678 - DNA, 21 bp, Homo sapiens
gctctctgcatggtggctcag

SEQ ID NO: 7311679 - DNA, 19 bp, Homo sapiens
gctctccctctcagttgag

SEQ ID NO: 7311680 - DNA, 22 bp, Homo sapiens
gctctcccgcagcctggtgggc

SEQ ID NO: 7311681 - DNA, 22 bp, Homo sapiens
gctctcccgcagcctggtgggc

SEQ ID NO: 7311682 - DNA, 22 bp, Homo sapiens
gctctccaggtctcatgcactg

SEQ ID NO: 7311683 - DNA, 22 bp, Homo sapiens
gctcatattcaactatcttcac

SEQ ID NO: 7311684 - DNA, 23 bp, Homo sapiens
gctcatcaggcttagagtcaagg

SEQ ID NO: 7311685 - DNA, 22 bp, Homo sapiens
gctatacaagtgtagaatagag

SEQ ID NO: 7311686 - DNA, 22 bp, Homo sapiens
gctcagggagagagggcagccg

SEQ ID NO: 7311687 - DNA, 22 bp, Homo sapiens
gctcagggccatggaccagcag

SEQ ID NO: 7311688 - DNA, 22 bp, Homo sapiens
gctagaggcaacaactttatag

SEQ ID NO: 7311689 - DNA, 22 bp, Homo sapiens
ggctctgcatgtgagtgggtgg

SEQ ID NO: 7311690 - DNA, 22 bp, Homo sapiens
ggctctgacctcccaggcagtt

SEQ ID NO: 7311691 - DNA, 22 bp, Homo sapiens
ggctcactgcaacttccgcctc

SEQ ID NO: 7311692 - DNA, 22 bp, Homo sapiens
ggctcactgcaacttccgcctc

SEQ ID NO: 7311693 - DNA, 22 bp, Homo sapiens
ggctcactgcaaactgtgcctc

SEQ ID NO: 7311694 - DNA, 22 bp, Homo sapiens
ggccagctgctcagtgtctctg

SEQ ID NO: 7311695 - DNA, 21 bp, Homo sapiens
ggccagctgcatatgtcactg

SEQ ID NO: 7311696 - DNA, 22 bp, Homo sapiens
ggccagctggatgtgggtgacg

SEQ ID NO: 7311697 - DNA, 22 bp, Homo sapiens
ggcccagctttcattccttgct

SEQ ID NO: 7311698 - DNA, 17 bp, Homo sapiens
ggccacagagcttgggg

SEQ ID NO: 7311699 - DNA, 22 bp, Homo sapiens
ggccacagcagatgcttcagat

SEQ ID NO: 7311700 - DNA, 22 bp, Homo sapiens
ggccacagcaatgctgtgatgt

SEQ ID NO: 7311701 - DNA, 20 bp, Homo sapiens
ggccacagggtgctggtgga

SEQ ID NO: 7311702 - DNA, 21 bp, Homo sapiens
ggccacagttagggctcagga

SEQ ID NO: 7311703 - DNA, 21 bp, Homo sapiens
ggccagcagcgtccactgtgg

SEQ ID NO: 7311704 - DNA, 18 bp, Homo sapiens
ggcacctctcttgcctta

SEQ ID NO: 7311705 - DNA, 18 bp, Homo sapiens
ggcagcaagaagggaggg

SEQ ID NO: 7311706 - DNA, 22 bp, Homo sapiens
ggcagcactgcagcttgttggg

SEQ ID NO: 7311707 - DNA, 22 bp, Homo sapiens
ggcagcactgcagcttgttggg

SEQ ID NO: 7311708 - DNA, 22 bp, Homo sapiens
ggcagatgttgcagtgagcaga

SEQ ID NO: 7311709 - DNA, 22 bp, Homo sapiens
ggcagatgttatatgatctgag

SEQ ID NO: 7311710 - DNA, 20 bp, Homo sapiens
ggcagggcatcaacagctct

SEQ ID NO: 7311711 - DNA, 22 bp, Homo sapiens
ggcagtgagctggagggaagga

SEQ ID NO: 7311712 - DNA, 22 bp, Homo sapiens
ggcagccatgtgggcagcgagt

SEQ ID NO: 7311713 - DNA, 22 bp, Homo sapiens
ggcagccctttctggccagctc

SEQ ID NO: 7311714 - DNA, 18 bp, Homo sapiens
ggcagggaaaagataggg

SEQ ID NO: 7311715 - DNA, 22 bp, Homo sapiens
gggaggttgaggctgcagtgag

SEQ ID NO: 7311716 - DNA, 22 bp, Homo sapiens
gggagctcgtgcgcccaggtgc

SEQ ID NO: 7311717 - DNA, 22 bp, Homo sapiens
gggagctgaactgctgaagttg

SEQ ID NO: 7311718 - DNA, 22 bp, Homo sapiens
gggagctgaaggagccggcggg

SEQ ID NO: 7311719 - DNA, 22 bp, Homo sapiens
gggagtgtgcagaagctggggg

SEQ ID NO: 7311720 - DNA, 20 bp, Homo sapiens
gggagtggtggtagcctgtg

SEQ ID NO: 7311721 - DNA, 20 bp, Homo sapiens
gggcagagccagccagtccc

SEQ ID NO: 7311722 - DNA, 22 bp, Homo sapiens
gggccctgatctgtgagcgcag

SEQ ID NO: 7311723 - DNA, 22 bp, Homo sapiens
gggctcagctgggcgtgctggt

SEQ ID NO: 7311724 - DNA, 21 bp, Homo sapiens
ggctgtggagccatgactcac

SEQ ID NO: 7311725 - DNA, 18 bp, Homo sapiens
ggctgtggacaagattag

SEQ ID NO: 7311726 - DNA, 22 bp, Homo sapiens
ggctgtgctttgttaggttgtc

SEQ ID NO: 7311727 - DNA, 22 bp, Homo sapiens
ggctgtggcagctggaagtggt

SEQ ID NO: 7311728 - DNA, 22 bp, Homo sapiens
ggctgtggagctgcagagttgg

SEQ ID NO: 7311729 - DNA, 22 bp, Homo sapiens
ggctgtggcattaggtgaggcc

SEQ ID NO: 7311730 - DNA, 22 bp, Homo sapiens
ggctgtggtcattaggaggttg

SEQ ID NO: 7311731 - DNA, 22 bp, Homo sapiens
gggaagagggagctggaatgat

SEQ ID NO: 7311732 - DNA, 22 bp, Homo sapiens
ggctgtggggaccaacaggact

SEQ ID NO: 7311733 - DNA, 22 bp, Homo sapiens
ggctgtggggccgggtacagtg

SEQ ID NO: 7311734 - DNA, 22 bp, Homo sapiens
ggctgtggggccgggtacagtg

SEQ ID NO: 7311735 - DNA, 22 bp, Homo sapiens
ggctgtgggtgtgacaggcctc

SEQ ID NO: 7311736 - DNA, 23 bp, Homo sapiens
gggagatgggaaatgaaggctct

SEQ ID NO: 7311737 - DNA, 22 bp, Homo sapiens
gggagatgactcagtgacctcg

SEQ ID NO: 7311738 - DNA, 22 bp, Homo sapiens
gggaagagtgtcggttgaagtg

SEQ ID NO: 7311739 - DNA, 22 bp, Homo sapiens
gggaagatagtgttgagggccc

SEQ ID NO: 7311740 - DNA, 22 bp, Homo sapiens
ggctgcctgccgcccacttggc

SEQ ID NO: 7311741 - DNA, 22 bp, Homo sapiens
ggctgcctgctcctcctgcacg

SEQ ID NO: 7311742 - DNA, 17 bp, Homo sapiens
ggctggagcagctcccc

SEQ ID NO: 7311743 - DNA, 22 bp, Homo sapiens
ggctgcctggacctcctctttc

SEQ ID NO: 7311744 - DNA, 17 bp, Homo sapiens
ggctggaggggacccgg

SEQ ID NO: 7311745 - DNA, 22 bp, Homo sapiens
ggctgcctccactgcttgtccc

SEQ ID NO: 7311746 - DNA, 20 bp, Homo sapiens
ggctgcctccttcctttcct

SEQ ID NO: 7311747 - DNA, 22 bp, Homo sapiens
gtagtgcgcatggcctgtttgt

SEQ ID NO: 7311748 - DNA, 22 bp, Homo sapiens
gtagtattttctgtgatgtagg

SEQ ID NO: 7311749 - DNA, 22 bp, Homo sapiens
gtagtattttctgtgatgtagg

SEQ ID NO: 7311750 - DNA, 22 bp, Homo sapiens
gtacaattaagtgcacaaatag

SEQ ID NO: 7311751 - DNA, 22 bp, Homo sapiens
gtacaattatttaaatggtgaa

SEQ ID NO: 7311752 - DNA, 22 bp, Homo sapiens
gtaggggtgctgagatctggaa

SEQ ID NO: 7311753 - DNA, 22 bp, Homo sapiens
gtacaaatgagagttctgtttt

SEQ ID NO: 7311754 - DNA, 22 bp, Homo sapiens
gtacaaattaggaagctttgtg

SEQ ID NO: 7311755 - DNA, 22 bp, Homo sapiens
gtacaacaggattgatgtacca

SEQ ID NO: 7311756 - DNA, 22 bp, Homo sapiens
gtacaaggcatttatctgttca

SEQ ID NO: 7311757 - DNA, 22 bp, Homo sapiens
gtatttttcagttaggagctta

SEQ ID NO: 7311758 - DNA, 22 bp, Homo sapiens
gtatttttagtagagtcggggt

SEQ ID NO: 7311759 - DNA, 22 bp, Homo sapiens
gtatttttaggtaaggaaagta

SEQ ID NO: 7311760 - DNA, 22 bp, Homo sapiens
gtatttttcattccaagtgaga

SEQ ID NO: 7311761 - DNA, 22 bp, Homo sapiens
gtagttctgcagtgtcacctga

SEQ ID NO: 7311762 - DNA, 22 bp, Homo sapiens
gtagtgtgtaggcactgtgctc

SEQ ID NO: 7311763 - DNA, 22 bp, Homo sapiens
gtagtgtgtaggcactgtgctc

SEQ ID NO: 7311764 - DNA, 22 bp, Homo sapiens
gtagtgtgtaggcactgtgctc

SEQ ID NO: 7311765 - DNA, 22 bp, Homo sapiens
gtatacatagatgatgaacaag

SEQ ID NO: 7311766 - DNA, 22 bp, Homo sapiens
gtattttgttagggtgtggtat

SEQ ID NO: 7311767 - DNA, 22 bp, Homo sapiens
gtcactttgaagctgtttttag

SEQ ID NO: 7311768 - DNA, 22 bp, Homo sapiens
gtcactttcacactttattgct

SEQ ID NO: 7311769 - DNA, 22 bp, Homo sapiens
gtcactttattaattttggtga

SEQ ID NO: 7311770 - DNA, 22 bp, Homo sapiens
gtcactggggccacatgcagaa

SEQ ID NO: 7311771 - DNA, 22 bp, Homo sapiens
gtcactgactctgggagatgtg

SEQ ID NO: 7311772 - DNA, 22 bp, Homo sapiens
gtcactgacaagagagaagaac

SEQ ID NO: 7311773 - DNA, 22 bp, Homo sapiens
gtcactcatctcatggaggggt

SEQ ID NO: 7311774 - DNA, 22 bp, Homo sapiens
gtcactgacatggtcattggca

SEQ ID NO: 7311775 - DNA, 22 bp, Homo sapiens
gtcacccgtttgactatccacc

SEQ ID NO: 7311776 - DNA, 19 bp, Homo sapiens
gtcactaagttttgggggt

SEQ ID NO: 7311777 - DNA, 22 bp, Homo sapiens
gtcactacctaagtgttgttgg

SEQ ID NO: 7311778 - DNA, 22 bp, Homo sapiens
gtcactactgaagtcaatgttg

SEQ ID NO: 7311779 - DNA, 22 bp, Homo sapiens
gtcactcttccccatagcctac

SEQ ID NO: 7311780 - DNA, 22 bp, Homo sapiens
gtcagagctgtgcaaggctgag

SEQ ID NO: 7311781 - DNA, 22 bp, Homo sapiens
gtcagagcccccagcggcgcgg

SEQ ID NO: 7311782 - DNA, 21 bp, Homo sapiens
gtccagagagccggctcctga

SEQ ID NO: 7311783 - DNA, 22 bp, Homo sapiens
gtccagctctcagatggctgca

SEQ ID NO: 7311784 - DNA, 22 bp, Homo sapiens
gtccagctgggccagggcactc

SEQ ID NO: 7311785 - DNA, 22 bp, Homo sapiens
gtccaggaatcaaaagatggaa

SEQ ID NO: 7311786 - DNA, 22 bp, Homo sapiens
gtcctgctaccatgctgtgtga

SEQ ID NO: 7311787 - DNA, 22 bp, Homo sapiens
gtcctgggaactggacagctaa

SEQ ID NO: 7311788 - DNA, 22 bp, Homo sapiens
gtctatgatattttgttatagc

SEQ ID NO: 7311789 - DNA, 22 bp, Homo sapiens
gtctatgtaaacgtctacatta

SEQ ID NO: 7311790 - DNA, 22 bp, Homo sapiens
gtctccagaggttacatcctgt

SEQ ID NO: 7311791 - DNA, 22 bp, Homo sapiens
gtctccagatatcctacacaac

SEQ ID NO: 7311792 - DNA, 22 bp, Homo sapiens
gtctatgtgtaatagcatgtgt

SEQ ID NO: 7311793 - DNA, 22 bp, Homo sapiens
gtctaattcctgctcttactca

SEQ ID NO: 7311794 - DNA, 22 bp, Homo sapiens
gtctaattcctgctcttactca

SEQ ID NO: 7311795 - DNA, 22 bp, Homo sapiens
gtctttaagggactgaatttgg

SEQ ID NO: 7311796 - DNA, 23 bp, Homo sapiens
gtctttatagtggggcactttgt

SEQ ID NO: 7311797 - DNA, 22 bp, Homo sapiens
gtctccagtgttcaggtgactg

SEQ ID NO: 7311798 - DNA, 22 bp, Homo sapiens
gtctccagggctgctggcgcct

SEQ ID NO: 7311799 - DNA, 22 bp, Homo sapiens
gtctccagggacacactagccg

SEQ ID NO: 7311800 - DNA, 22 bp, Homo sapiens
gtctccagttacagcagccagg

SEQ ID NO: 7311801 - DNA, 22 bp, Homo sapiens
gtcttgatctcctgaccttgtg

SEQ ID NO: 7311802 - DNA, 22 bp, Homo sapiens
gtgagccgagtatagttcatag

SEQ ID NO: 7311803 - DNA, 22 bp, Homo sapiens
gtgagcgtggtcttctgtgggt

SEQ ID NO: 7311804 - DNA, 22 bp, Homo sapiens
gtgaggagctctttgactcacg

SEQ ID NO: 7311805 - DNA, 22 bp, Homo sapiens
gtctttctatgcatagagcaga

SEQ ID NO: 7311806 - DNA, 22 bp, Homo sapiens
gtctttcatggatattcagttt

SEQ ID NO: 7311807 - DNA, 22 bp, Homo sapiens
gtctttctatgatgaactgttg

SEQ ID NO: 7311808 - DNA, 22 bp, Homo sapiens
gtgaaaaatcatcatgacttga

SEQ ID NO: 7311809 - DNA, 22 bp, Homo sapiens
gtgctgccggcatagcagtgaa

SEQ ID NO: 7311810 - DNA, 22 bp, Homo sapiens
gtgcccagctccacctcacaga

SEQ ID NO: 7311811 - DNA, 22 bp, Homo sapiens
gtgccaccttcaaatcacattg

SEQ ID NO: 7311812 - DNA, 22 bp, Homo sapiens
gtgaggatcaaatgaaatagca

SEQ ID NO: 7311813 - DNA, 22 bp, Homo sapiens
gtgaggatgtactgagataaat

SEQ ID NO: 7311814 - DNA, 22 bp, Homo sapiens
gtgcaggagtaggagagggctt

SEQ ID NO: 7311815 - DNA, 22 bp, Homo sapiens
gtgcaggatgttgggaatcagg

SEQ ID NO: 7311816 - DNA, 22 bp, Homo sapiens
gtgcaggatctcagaacaagtg

SEQ ID NO: 7311817 - DNA, 22 bp, Homo sapiens
gtgcaggaggtaacatagcaaa

SEQ ID NO: 7311818 - DNA, 22 bp, Homo sapiens
gtgcaggatttatagcccagct

SEQ ID NO: 7311819 - DNA, 21 bp, Homo sapiens
gggtgcaagttctctgtcttt

SEQ ID NO: 7311820 - DNA, 21 bp, Homo sapiens
gggtgctgtggtcatgcagga

SEQ ID NO: 7311821 - DNA, 22 bp, Homo sapiens
gggtgctgggaggctgacatct

SEQ ID NO: 7311822 - DNA, 22 bp, Homo sapiens
gggtgcaggcagcccaggcagg

SEQ ID NO: 7311823 - DNA, 22 bp, Homo sapiens
gggtggagccagttgactctgt

SEQ ID NO: 7311824 - DNA, 22 bp, Homo sapiens
ggggccagatatcactaaggtt

SEQ ID NO: 7311825 - DNA, 22 bp, Homo sapiens
ggggccagcactgtgcctttgt

SEQ ID NO: 7311826 - DNA, 22 bp, Homo sapiens
ggggccagcaatgttgaggaat

SEQ ID NO: 7311827 - DNA, 22 bp, Homo sapiens
ggggccagcttcgcgtgctctt

SEQ ID NO: 7311828 - DNA, 22 bp, Homo sapiens
ggggccagtaggagtgatgtac

SEQ ID NO: 7311829 - DNA, 22 bp, Homo sapiens
ggggccaggtccagcttccaaa

SEQ ID NO: 7311830 - DNA, 22 bp, Homo sapiens
gggcttctgtacctacctggaa

SEQ ID NO: 7311831 - DNA, 22 bp, Homo sapiens
ggggccagagaggacccaggtg

SEQ ID NO: 7311832 - DNA, 22 bp, Homo sapiens
ggggccagagaggacccaggtg

SEQ ID NO: 7311833 - DNA, 20 bp, Homo sapiens
ggggcaggtttttatggcta

SEQ ID NO: 7311834 - DNA, 22 bp, Homo sapiens
ggggcagggaggttatcgccga

SEQ ID NO: 7311835 - DNA, 22 bp, Homo sapiens
ggggatgagactagagctaaag

SEQ ID NO: 7311836 - DNA, 22 bp, Homo sapiens
ggggatctaggcttatgagggc

SEQ ID NO: 7311837 - DNA, 22 bp, Homo sapiens
ggggagtgttttcatgggcttg

SEQ ID NO: 7311838 - DNA, 22 bp, Homo sapiens
ggggagtggttgcctgtgatcc

SEQ ID NO: 7311839 - DNA, 22 bp, Homo sapiens
ggggagtgacgcagggccatag

SEQ ID NO: 7311840 - DNA, 22 bp, Homo sapiens
ggggagtgacgcagggccatag

SEQ ID NO: 7311841 - DNA, 20 bp, Homo sapiens
gggctgttgctcttggtttg

SEQ ID NO: 7311842 - DNA, 22 bp, Homo sapiens
gggcttctggtcattcctcatc

SEQ ID NO: 7311843 - DNA, 17 bp, Homo sapiens
gggttttgggagcagct

SEQ ID NO: 7311844 - DNA, 22 bp, Homo sapiens
gggttggggcccagcagtctgc

SEQ ID NO: 7311845 - DNA, 22 bp, Homo sapiens
gggtgtgcaggtcatggcgtct

SEQ ID NO: 7311846 - DNA, 22 bp, Homo sapiens
ggtccccccatggtgagcactg

SEQ ID NO: 7311847 - DNA, 22 bp, Homo sapiens
ggtccctacccagctcgggggt

SEQ ID NO: 7311848 - DNA, 22 bp, Homo sapiens
ggtccctagagtgggatgactt

SEQ ID NO: 7311849 - DNA, 22 bp, Homo sapiens
ggtccccgtggaggctggagcg

SEQ ID NO: 7311850 - DNA, 18 bp, Homo sapiens
ggtgagggagctggaagc

SEQ ID NO: 7311851 - DNA, 22 bp, Homo sapiens
ggtgagggagtggaacgaggtg

SEQ ID NO: 7311852 - DNA, 22 bp, Homo sapiens
ggtgaggaaagatggtgacagt

SEQ ID NO: 7311853 - DNA, 20 bp, Homo sapiens
ggttacattgtctacatgtg

SEQ ID NO: 7311854 - DNA, 22 bp, Homo sapiens
gtacaaaagttattgcggtttt

SEQ ID NO: 7311855 - DNA, 17 bp, Homo sapiens
ggttcacttggtttgtc

SEQ ID NO: 7311856 - DNA, 22 bp, Homo sapiens
ggttcactctcaagtctgccta

SEQ ID NO: 7311857 - DNA, 22 bp, Homo sapiens
ggttcactgtcctttggttcag

SEQ ID NO: 7311858 - DNA, 22 bp, Homo sapiens
ggtggatggactctcgggggcc

SEQ ID NO: 7311859 - DNA, 22 bp, Homo sapiens
ggtggatgctgactgttctgct

SEQ ID NO: 7311860 - DNA, 22 bp, Homo sapiens
ggtggatgctgactgttctgct

SEQ ID NO: 7311861 - DNA, 22 bp, Homo sapiens
ggtgggtggaaacagcatgtac

SEQ ID NO: 7311862 - DNA, 22 bp, Homo sapiens
taccagggaacagggatattaa

SEQ ID NO: 7311863 - DNA, 22 bp, Homo sapiens
taccagggaacagggatattaa

SEQ ID NO: 7311864 - DNA, 19 bp, Homo sapiens
taccatgaccctctttccc

SEQ ID NO: 7311865 - DNA, 22 bp, Homo sapiens
taccattattcacatgatcttt

SEQ ID NO: 7311866 - DNA, 22 bp, Homo sapiens
taccatttacttgaaaataaaa

SEQ ID NO: 7311867 - DNA, 22 bp, Homo sapiens
taccagaatcattttatgttgg

SEQ ID NO: 7311868 - DNA, 21 bp, Homo sapiens
taccaattgccttctagttgt

SEQ ID NO: 7311869 - DNA, 21 bp, Homo sapiens
taccaattgccttctagttgt

SEQ ID NO: 7311870 - DNA, 22 bp, Homo sapiens
taccatttcagtaaaaacttag

SEQ ID NO: 7311871 - DNA, 22 bp, Homo sapiens
taccatttgagagagaacataa

SEQ ID NO: 7311872 - DNA, 23 bp, Homo sapiens
tactatggttattatccctctcc

SEQ ID NO: 7311873 - DNA, 22 bp, Homo sapiens
tactataaagtcttaatgagtc

SEQ ID NO: 7311874 - DNA, 22 bp, Homo sapiens
tactgttatatatagcagcagt

SEQ ID NO: 7311875 - DNA, 22 bp, Homo sapiens
tactgttagagcgatttgtcct

SEQ ID NO: 7311876 - DNA, 22 bp, Homo sapiens
tactgtttctactacttaggga

SEQ ID NO: 7311877 - DNA, 22 bp, Homo sapiens
tactgttttaaaaggtacttgt

SEQ ID NO: 7311878 - DNA, 22 bp, Homo sapiens
tactgttttctttatagtacag

SEQ ID NO: 7311879 - DNA, 22 bp, Homo sapiens
tacttaaaaattatcaaagtgg

SEQ ID NO: 7311880 - DNA, 22 bp, Homo sapiens
tacttaaaactgatagaatctc

SEQ ID NO: 7311881 - DNA, 22 bp, Homo sapiens
tacttaaataattgctgctatt

SEQ ID NO: 7311882 - DNA, 22 bp, Homo sapiens
tactctgccactaggagttctg

SEQ ID NO: 7311883 - DNA, 22 bp, Homo sapiens
tactcctgctgatcctgccagc

SEQ ID NO: 7311884 - DNA, 22 bp, Homo sapiens
tactgtgtgattccatttacgt

SEQ ID NO: 7311885 - DNA, 22 bp, Homo sapiens
tactgtgtgcccagccgagctg

SEQ ID NO: 7311886 - DNA, 22 bp, Homo sapiens
tactgtgtcttaggatgtggaa

SEQ ID NO: 7311887 - DNA, 22 bp, Homo sapiens
tactgtgtgaccctgggtaggt

SEQ ID NO: 7311888 - DNA, 22 bp, Homo sapiens
tactgtgtgaccctgggtaggt

SEQ ID NO: 7311889 - DNA, 22 bp, Homo sapiens
tactgtgtggtgagctgtctcc

SEQ ID NO: 7311890 - DNA, 22 bp, Homo sapiens
tactgtgttgtgctgaaaggga

SEQ ID NO: 7311891 - DNA, 22 bp, Homo sapiens
tactgttaatgttaaattcagg

SEQ ID NO: 7311892 - DNA, 22 bp, Homo sapiens
tactgaaagaatacataatttc

SEQ ID NO: 7311893 - DNA, 22 bp, Homo sapiens
tacagagtaatttgcatgggga

SEQ ID NO: 7311894 - DNA, 22 bp, Homo sapiens
tacagtaggattttcagggtct

SEQ ID NO: 7311895 - DNA, 22 bp, Homo sapiens
tacagagggtaattgatcaagg

SEQ ID NO: 7311896 - DNA, 22 bp, Homo sapiens
tacagtatggaaaatgtatagt

SEQ ID NO: 7311897 - DNA, 22 bp, Homo sapiens
tacagtatatactgtgtgtaga

SEQ ID NO: 7311898 - DNA, 22 bp, Homo sapiens
tacagtattatgagtgattgaa

SEQ ID NO: 7311899 - DNA, 22 bp, Homo sapiens
tacagagatttattgctaaggc

SEQ ID NO: 7311900 - DNA, 22 bp, Homo sapiens
tacagacagtttttcagatatt

SEQ ID NO: 7311901 - DNA, 22 bp, Homo sapiens
tacagtcaagcataagaagtca

SEQ ID NO: 7311902 - DNA, 22 bp, Homo sapiens
tacagtctctttgagtgattgt

SEQ ID NO: 7311903 - DNA, 22 bp, Homo sapiens
tacagtgaccctatttccaaat

SEQ ID NO: 7311904 - DNA, 22 bp, Homo sapiens
tacagtgacctagaataaatac

SEQ ID NO: 7311905 - DNA, 22 bp, Homo sapiens
tacagtgcttggtatctagtaa

SEQ ID NO: 7311906 - DNA, 20 bp, Homo sapiens
tacagtgtatgtatttaggc

SEQ ID NO: 7311907 - DNA, 22 bp, Homo sapiens
tacatgcatacttgtgtgtgta

SEQ ID NO: 7311908 - DNA, 19 bp, Homo sapiens
tacatgcacatgtgcgtgc

SEQ ID NO: 7311909 - DNA, 22 bp, Homo sapiens
tacatgcaaggatatttgtgcg

SEQ ID NO: 7311910 - DNA, 22 bp, Homo sapiens
tacatgaatttgagtcagagga

SEQ ID NO: 7311911 - DNA, 22 bp, Homo sapiens
tacatgaacaaaatagcagaaa

SEQ ID NO: 7311912 - DNA, 22 bp, Homo sapiens
tacatgaatgtttcaatattgt

SEQ ID NO: 7311913 - DNA, 22 bp, Homo sapiens
tacatgaatgtttcaatattgt

SEQ ID NO: 7311914 - DNA, 22 bp, Homo sapiens
tacatgaagttgtctaaactgg

SEQ ID NO: 7311915 - DNA, 22 bp, Homo sapiens
tacatgaagatgaatgtatggc

SEQ ID NO: 7311916 - DNA, 22 bp, Homo sapiens
tacatgaacctttatgtgtgat

SEQ ID NO: 7311917 - DNA, 22 bp, Homo sapiens
tacatgtatgtgttaatatctg

SEQ ID NO: 7311918 - DNA, 22 bp, Homo sapiens
tacatgcattggatggcaatag

SEQ ID NO: 7311919 - DNA, 22 bp, Homo sapiens
taattgcagggtgtcagaatac

SEQ ID NO: 7311920 - DNA, 22 bp, Homo sapiens
taattgcagctatcattttagt

SEQ ID NO: 7311921 - DNA, 22 bp, Homo sapiens
taattgaactaacatgcaaaca

SEQ ID NO: 7311922 - DNA, 22 bp, Homo sapiens
taatttatgatgcaaagaaaag

SEQ ID NO: 7311923 - DNA, 22 bp, Homo sapiens
taatttatatggaattgttgct

SEQ ID NO: 7311924 - DNA, 22 bp, Homo sapiens
taatttatatggaattgttgct

SEQ ID NO: 7311925 - DNA, 22 bp, Homo sapiens
taatttatagaatttcttggat

SEQ ID NO: 7311926 - DNA, 22 bp, Homo sapiens
taattccaagttgagacatgca

SEQ ID NO: 7311927 - DNA, 22 bp, Homo sapiens
taattccacctttttccaactt

SEQ ID NO: 7311928 - DNA, 22 bp, Homo sapiens
taattcctagaaattattctca

SEQ ID NO: 7311929 - DNA, 22 bp, Homo sapiens
taatatctacttcatagagttt

SEQ ID NO: 7311930 - DNA, 22 bp, Homo sapiens
taagctaacgtccatggaaatg

SEQ ID NO: 7311931 - DNA, 22 bp, Homo sapiens
taaggaaaatggacatcaaaca

SEQ ID NO: 7311932 - DNA, 21 bp, Homo sapiens
taaggaagagcattttaggtc

SEQ ID NO: 7311933 - DNA, 22 bp, Homo sapiens
taaggaagagcttggtaatagg

SEQ ID NO: 7311934 - DNA, 22 bp, Homo sapiens
taaggaaggggaaagacatgtc

SEQ ID NO: 7311935 - DNA, 22 bp, Homo sapiens
taaggaaggggaaagacatgtc

SEQ ID NO: 7311936 - DNA, 22 bp, Homo sapiens
taaggaagtcacaagaatcgct

SEQ ID NO: 7311937 - DNA, 18 bp, Homo sapiens
taaggaagggggtgaaga

SEQ ID NO: 7311938 - DNA, 22 bp, Homo sapiens
taaggaagtacccattcttagg

SEQ ID NO: 7311939 - DNA, 22 bp, Homo sapiens
taaggaggcagtcattatcagg

SEQ ID NO: 7311940 - DNA, 22 bp, Homo sapiens
taaggaggcgaggtggtgagca

SEQ ID NO: 7311941 - DNA, 22 bp, Homo sapiens
taaggaggctgctgtgaagaaa

SEQ ID NO: 7311942 - DNA, 22 bp, Homo sapiens
taaggagggggaatgattggca

SEQ ID NO: 7311943 - DNA, 22 bp, Homo sapiens
taaggaggtgcccactctcagg

SEQ ID NO: 7311944 - DNA, 22 bp, Homo sapiens
taaggaggttggtgggttggat

SEQ ID NO: 7311945 - DNA, 22 bp, Homo sapiens
taatagttgtgactttgtaaag

SEQ ID NO: 7311946 - DNA, 22 bp, Homo sapiens
taaggacaatcaggttagtagc

SEQ ID NO: 7311947 - DNA, 21 bp, Homo sapiens
taatataggttcacaactagt

SEQ ID NO: 7311948 - DNA, 22 bp, Homo sapiens
taatatacttcccatagtttga

SEQ ID NO: 7311949 - DNA, 22 bp, Homo sapiens
taatataccaaactgtaatttt

SEQ ID NO: 7311950 - DNA, 22 bp, Homo sapiens
tacagaatctatgcttcacagt

SEQ ID NO: 7311951 - DNA, 22 bp, Homo sapiens
tacacataggagggtaataaaa

SEQ ID NO: 7311952 - DNA, 22 bp, Homo sapiens
tacacatacattgcttacaagg

SEQ ID NO: 7311953 - DNA, 22 bp, Homo sapiens
tacacacatgcatttgccttat

SEQ ID NO: 7311954 - DNA, 22 bp, Homo sapiens
tacacacagaggccatgggatt

SEQ ID NO: 7311955 - DNA, 22 bp, Homo sapiens
tacacagttttgctcccatgat

SEQ ID NO: 7311956 - DNA, 22 bp, Homo sapiens
tacacatacaccaatgtggtca

SEQ ID NO: 7311957 - DNA, 22 bp, Homo sapiens
tacacatacaccaatgtggtca

SEQ ID NO: 7311958 - DNA, 22 bp, Homo sapiens
tacacatacattgcttacaagg

SEQ ID NO: 7311959 - DNA, 22 bp, Homo sapiens
tacacagaacctggtgtacagt

SEQ ID NO: 7311960 - DNA, 22 bp, Homo sapiens
taatttcaaatttcttagcgtg

SEQ ID NO: 7311961 - DNA, 21 bp, Homo sapiens
taatttattcagcacagtgtt

SEQ ID NO: 7311962 - DNA, 22 bp, Homo sapiens
taatttatggtatgtgtgtaat

SEQ ID NO: 7311963 - DNA, 22 bp, Homo sapiens
taatttatttcaactgccaagg

SEQ ID NO: 7311964 - DNA, 22 bp, Homo sapiens
tacaacattgtgttgcttcata

SEQ ID NO: 7311965 - DNA, 22 bp, Homo sapiens
tacaacttacttgaatggcttt

SEQ ID NO: 7311966 - DNA, 22 bp, Homo sapiens
tacaagaaatttctgcatatat

SEQ ID NO: 7311967 - DNA, 22 bp, Homo sapiens
tacaagctcacaaatttttaag

SEQ ID NO: 7311968 - DNA, 20 bp, Homo sapiens
tacaagaatccccagttgtc

SEQ ID NO: 7311969 - DNA, 22 bp, Homo sapiens
tacaagaatgtcttaaaagctc

SEQ ID NO: 7311970 - DNA, 22 bp, Homo sapiens
tacaagaaggaaaactagcaat

SEQ ID NO: 7311971 - DNA, 22 bp, Homo sapiens
tacaagaaggaaaactagcaat

SEQ ID NO: 7311972 - DNA, 22 bp, Homo sapiens
taaagacatgcaaagtctaatt

SEQ ID NO: 7311973 - DNA, 22 bp, Homo sapiens
taaagacatggtgtaggtgaac

SEQ ID NO: 7311974 - DNA, 22 bp, Homo sapiens
taaaagttagctaggacaaagt

SEQ ID NO: 7311975 - DNA, 22 bp, Homo sapiens
taaaagtatactttcaaaggag

SEQ ID NO: 7311976 - DNA, 22 bp, Homo sapiens
taaaagtatactttcaaaggag

SEQ ID NO: 7311977 - DNA, 22 bp, Homo sapiens
taaaaggaggttgaagctgtca

SEQ ID NO: 7311978 - DNA, 22 bp, Homo sapiens
taaaaggattagcaggatgggc

SEQ ID NO: 7311979 - DNA, 19 bp, Homo sapiens
taaaaggatgtggaaggat

SEQ ID NO: 7311980 - DNA, 22 bp, Homo sapiens
taaaactgaatacatactgagg

SEQ ID NO: 7311981 - DNA, 22 bp, Homo sapiens
taaaacttctcatttttatggt

SEQ ID NO: 7311982 - DNA, 22 bp, Homo sapiens
taaagcaaggcaaattgttggt

SEQ ID NO: 7311983 - DNA, 22 bp, Homo sapiens
taaatgcagcagtttctgttct

SEQ ID NO: 7311984 - DNA, 22 bp, Homo sapiens
taagacaaatactatttcaaga

SEQ ID NO: 7311985 - DNA, 22 bp, Homo sapiens
taagacagggagggctctcagc

SEQ ID NO: 7311986 - DNA, 22 bp, Homo sapiens
taacatgctaggaagagtgatt

SEQ ID NO: 7311987 - DNA, 22 bp, Homo sapiens
taagacatttgacaaaccattt

SEQ ID NO: 7311988 - DNA, 22 bp, Homo sapiens
taagacatttgacaaaccattt

SEQ ID NO: 7311989 - DNA, 22 bp, Homo sapiens
taagacatgtccaggctgtgag

SEQ ID NO: 7311990 - DNA, 22 bp, Homo sapiens
taagacatggttgatctagtgt

SEQ ID NO: 7311991 - DNA, 22 bp, Homo sapiens
taagacatgagactcagccagt

SEQ ID NO: 7311992 - DNA, 22 bp, Homo sapiens
taagacatagccaagagcatcc

SEQ ID NO: 7311993 - DNA, 22 bp, Homo sapiens
taagacataaataggcttttta

SEQ ID NO: 7311994 - DNA, 22 bp, Homo sapiens
taagacatagccaagagcatcc

SEQ ID NO: 7311995 - DNA, 21 bp, Homo sapiens
taagacagtatgaatactttc

SEQ ID NO: 7311996 - DNA, 22 bp, Homo sapiens
taagacataaataggcttttta

SEQ ID NO: 7311997 - DNA, 22 bp, Homo sapiens
taagacagggtctattcttagt

SEQ ID NO: 7311998 - DNA, 22 bp, Homo sapiens
taagacatcctggatgttcaaa

SEQ ID NO: 7311999 - DNA, 22 bp, Homo sapiens
taagacatcattaaacagcaat

SEQ ID NO: 7312000 - DNA, 22 bp, Homo sapiens
taagacatccgttgcttataat

SEQ ID NO: 7312001 - DNA, 22 bp, Homo sapiens
taagacatccgttgcttataat

SEQ ID NO: 7312002 - DNA, 22 bp, Homo sapiens
taagagcataggcttgaaaata

SEQ ID NO: 7312003 - DNA, 21 bp, Homo sapiens
taagcatatcagatagactct

SEQ ID NO: 7312004 - DNA, 22 bp, Homo sapiens
taagaggatatttggccagaag

SEQ ID NO: 7312005 - DNA, 22 bp, Homo sapiens
taagacttgatccaaagaacta

SEQ ID NO: 7312006 - DNA, 22 bp, Homo sapiens
taagacttccaggaaaaggtgg

SEQ ID NO: 7312007 - DNA, 22 bp, Homo sapiens
taagaccatacatttccacaga

SEQ ID NO: 7312008 - DNA, 22 bp, Homo sapiens
taagacttcattagtaatatgg

SEQ ID NO: 7312009 - DNA, 22 bp, Homo sapiens
taacagtatagcctaacatttc

SEQ ID NO: 7312010 - DNA, 22 bp, Homo sapiens
taacagtatccccatttgcaag

SEQ ID NO: 7312011 - DNA, 20 bp, Homo sapiens
taacatagtccagagaacga

SEQ ID NO: 7312012 - DNA, 22 bp, Homo sapiens
taacagttttgagttttgcttc

SEQ ID NO: 7312013 - DNA, 22 bp, Homo sapiens
taacatgagagctaagacatta

SEQ ID NO: 7312014 - DNA, 22 bp, Homo sapiens
taacatgatttgctatttagat

SEQ ID NO: 7312015 - DNA, 22 bp, Homo sapiens
taacatctgggctgcgtcctga

SEQ ID NO: 7312016 - DNA, 22 bp, Homo sapiens
taacatcctacactgttgtctt

SEQ ID NO: 7312017 - DNA, 22 bp, Homo sapiens
gttctggagtggtgccaggcct

SEQ ID NO: 7312018 - DNA, 21 bp, Homo sapiens
gttctggaggctgcaagtcca

SEQ ID NO: 7312019 - DNA, 22 bp, Homo sapiens
gttctggaagcttttgagcaac

SEQ ID NO: 7312020 - DNA, 22 bp, Homo sapiens
gttctggaggagagcctggtgt

SEQ ID NO: 7312021 - DNA, 22 bp, Homo sapiens
gttatcatgcttcatcatcact

SEQ ID NO: 7312022 - DNA, 22 bp, Homo sapiens
gttatattgccaagtatattgt

SEQ ID NO: 7312023 - DNA, 22 bp, Homo sapiens
gttatgatggccctttcctggt

SEQ ID NO: 7312024 - DNA, 22 bp, Homo sapiens
gttatattcaaaatgaggctgt

SEQ ID NO: 7312025 - DNA, 22 bp, Homo sapiens
gttatataagacaaatcagagt

SEQ ID NO: 7312026 - DNA, 22 bp, Homo sapiens
gttatataattcctgtggtagt

SEQ ID NO: 7312027 - DNA, 22 bp, Homo sapiens
gtgtttgacttaggtacattaa

SEQ ID NO: 7312028 - DNA, 22 bp, Homo sapiens
gttaaataacctcatgtccgtt

SEQ ID NO: 7312029 - DNA, 22 bp, Homo sapiens
gttaaatgcactattgaaagct

SEQ ID NO: 7312030 - DNA, 22 bp, Homo sapiens
gttaacaaatgtaaagcaatta

SEQ ID NO: 7312031 - DNA, 22 bp, Homo sapiens
gttaacaacactgtgagtgctg

SEQ ID NO: 7312032 - DNA, 22 bp, Homo sapiens
gttaacaacactgtgagtgctg

SEQ ID NO: 7312033 - DNA, 22 bp, Homo sapiens
gttaacaaccaaacagaagttc

SEQ ID NO: 7312034 - DNA, 22 bp, Homo sapiens
gttaacacatgcaattgcactt

SEQ ID NO: 7312035 - DNA, 22 bp, Homo sapiens
gttaacataggagtttgttgta

SEQ ID NO: 7312036 - DNA, 21 bp, Homo sapiens
gtgctgggacacagccaggct

SEQ ID NO: 7312037 - DNA, 22 bp, Homo sapiens
gtgttgtggagcttgtcagggg

SEQ ID NO: 7312038 - DNA, 22 bp, Homo sapiens
gtgttgtggagcttgtcagggg

SEQ ID NO: 7312039 - DNA, 22 bp, Homo sapiens
gtgttgtggagcttgtcagggg

SEQ ID NO: 7312040 - DNA, 22 bp, Homo sapiens
gtgttctgggatgattgtagtg

SEQ ID NO: 7312041 - DNA, 22 bp, Homo sapiens
gtttgtgtaacatgatgatgat

SEQ ID NO: 7312042 - DNA, 22 bp, Homo sapiens
gtttgtgtaacatgatgatgat

SEQ ID NO: 7312043 - DNA, 22 bp, Homo sapiens
gtttgtgtaacatgatgatgat

SEQ ID NO: 7312044 - DNA, 22 bp, Homo sapiens
gtttgtgcgggacatgatccgg

SEQ ID NO: 7312045 - DNA, 22 bp, Homo sapiens
gtttgtgtaacatgatgatgat

SEQ ID NO: 7312046 - DNA, 22 bp, Homo sapiens
gtttgtcatttgtacttctagc

SEQ ID NO: 7312047 - DNA, 21 bp, Homo sapiens
gttttaagggagaaaacctag

SEQ ID NO: 7312048 - DNA, 22 bp, Homo sapiens
gtttgtgtcaatgacttctgca

SEQ ID NO: 7312049 - DNA, 22 bp, Homo sapiens
gtttgtgtcaatgacttctgca

SEQ ID NO: 7312050 - DNA, 22 bp, Homo sapiens
gtttgattcaagaacaaagagt

SEQ ID NO: 7312051 - DNA, 22 bp, Homo sapiens
gtttgcaaagatcattttctcc

SEQ ID NO: 7312052 - DNA, 22 bp, Homo sapiens
gtttgcaaattatgttaaaagt

SEQ ID NO: 7312053 - DNA, 22 bp, Homo sapiens
gtttgcaaattatgttaaaagt

SEQ ID NO: 7312054 - DNA, 22 bp, Homo sapiens
gtttgcaaattgtgttaaagct

SEQ ID NO: 7312055 - DNA, 22 bp, Homo sapiens
gtttgcaaattgtgttaaagct

SEQ ID NO: 7312056 - DNA, 22 bp, Homo sapiens
gtttgacactgagataaataaa

SEQ ID NO: 7312057 - DNA, 22 bp, Homo sapiens
gtttgaaagttcaacaggaaaa

SEQ ID NO: 7312058 - DNA, 20 bp, Homo sapiens
gtttgaaatgattggttggt

SEQ ID NO: 7312059 - DNA, 22 bp, Homo sapiens
gtttgaaatgtctgcaagggaa

SEQ ID NO: 7312060 - DNA, 22 bp, Homo sapiens
gtttgaaagtggcaagtccttg

SEQ ID NO: 7312061 - DNA, 22 bp, Homo sapiens
gtttcacagtctgcagaatttt

SEQ ID NO: 7312062 - DNA, 22 bp, Homo sapiens
gtttcacagcaaagttccctgt

SEQ ID NO: 7312063 - DNA, 22 bp, Homo sapiens
gtttcacacatcctgcacatag

SEQ ID NO: 7312064 - DNA, 22 bp, Homo sapiens
gtttcaaagtcagaaaaggagg

SEQ ID NO: 7312065 - DNA, 22 bp, Homo sapiens
gtttcaaataggtttcagcaaa

SEQ ID NO: 7312066 - DNA, 22 bp, Homo sapiens
gtttcttttgtgatcaccaacc

SEQ ID NO: 7312067 - DNA, 22 bp, Homo sapiens
gtttgaaaaaagcagtatgtaa

SEQ ID NO: 7312068 - DNA, 22 bp, Homo sapiens
gtttcttttaaaatatgtagac

SEQ ID NO: 7312069 - DNA, 22 bp, Homo sapiens
gtttctttctattgactgaaca

SEQ ID NO: 7312070 - DNA, 22 bp, Homo sapiens
gttcttttggtagagtgtgcat

SEQ ID NO: 7312071 - DNA, 22 bp, Homo sapiens
gttcttctcttgtaatggaatc

SEQ ID NO: 7312072 - DNA, 22 bp, Homo sapiens
gtttatgaatgttactatagag

SEQ ID NO: 7312073 - DNA, 22 bp, Homo sapiens
gtttatgaatgtgtcagacata

SEQ ID NO: 7312074 - DNA, 22 bp, Homo sapiens
gtttcaaaggtgtcaggcagtt

SEQ ID NO: 7312075 - DNA, 22 bp, Homo sapiens
gtttcaaagggaagacgctgga

SEQ ID NO: 7312076 - DNA, 22 bp, Homo sapiens
tatggaaagtgttttcttctgt

SEQ ID NO: 7312077 - DNA, 22 bp, Homo sapiens
tatgtactcatcaactattgaa

SEQ ID NO: 7312078 - DNA, 22 bp, Homo sapiens
tatgtacatatacacgtgtgtg

SEQ ID NO: 7312079 - DNA, 22 bp, Homo sapiens
tatggtcatttgttagtgcttt

SEQ ID NO: 7312080 - DNA, 22 bp, Homo sapiens
tatgtaagtgagatcatggagt

SEQ ID NO: 7312081 - DNA, 22 bp, Homo sapiens
tatgtacatacatgtgcatacg

SEQ ID NO: 7312082 - DNA, 22 bp, Homo sapiens
tattaacattttatgaaaataa

SEQ ID NO: 7312083 - DNA, 22 bp, Homo sapiens
tattaacatgaactgacttttc

SEQ ID NO: 7312084 - DNA, 22 bp, Homo sapiens
tattaagatacgtagttgtaaa

SEQ ID NO: 7312085 - DNA, 22 bp, Homo sapiens
tatgtcaaagttaagaaatagg

SEQ ID NO: 7312086 - DNA, 22 bp, Homo sapiens
tatgtttctgggcttgatattt

SEQ ID NO: 7312087 - DNA, 22 bp, Homo sapiens
tatgtttcttccttttcataca

SEQ ID NO: 7312088 - DNA, 22 bp, Homo sapiens
tatgtttgttatcacaactagg

SEQ ID NO: 7312089 - DNA, 22 bp, Homo sapiens
tattaacacgtataaagtgttt

SEQ ID NO: 7312090 - DNA, 18 bp, Homo sapiens
tatgtagtatatgtgtat

SEQ ID NO: 7312091 - DNA, 22 bp, Homo sapiens
tatgtagtcaagtggatatatg

SEQ ID NO: 7312092 - DNA, 22 bp, Homo sapiens
tatgtagagataaaatccaaat

SEQ ID NO: 7312093 - DNA, 22 bp, Homo sapiens
tatgtagatgtcatataaattg

SEQ ID NO: 7312094 - DNA, 18 bp, Homo sapiens
tatgtataacatagttca

SEQ ID NO: 7312095 - DNA, 22 bp, Homo sapiens
tatgtataaatgcatgtgtgga

SEQ ID NO: 7312096 - DNA, 22 bp, Homo sapiens
tatgtataaatgcatgtgtgga

SEQ ID NO: 7312097 - DNA, 18 bp, Homo sapiens
tatgtataacatagttca

SEQ ID NO: 7312098 - DNA, 22 bp, Homo sapiens
tatgtataatcacagagtgtca

SEQ ID NO: 7312099 - DNA, 22 bp, Homo sapiens
tatgtataatcacagagtgtca

SEQ ID NO: 7312100 - DNA, 22 bp, Homo sapiens
tatgtatagagtcttttaaatt

SEQ ID NO: 7312101 - DNA, 22 bp, Homo sapiens
tatgtatataggtgtgtgtctc

SEQ ID NO: 7312102 - DNA, 22 bp, Homo sapiens
tatgtatataggtgtgtgtctc

SEQ ID NO: 7312103 - DNA, 23 bp, Homo sapiens
tatgtatgtatgtttgtatggaa

SEQ ID NO: 7312104 - DNA, 22 bp, Homo sapiens
tatgtatccgtgtgtgtacaga

SEQ ID NO: 7312105 - DNA, 22 bp, Homo sapiens
tatgtatatgtatacacacaca

SEQ ID NO: 7312106 - DNA, 22 bp, Homo sapiens
tatgtatatggtagaagtatgt

SEQ ID NO: 7312107 - DNA, 22 bp, Homo sapiens
tatgtatatgtgtgttgacaac

SEQ ID NO: 7312108 - DNA, 22 bp, Homo sapiens
tatgtatatgtgtgttgacaac

SEQ ID NO: 7312109 - DNA, 22 bp, Homo sapiens
tatgtatatggtagaagtatgt

SEQ ID NO: 7312110 - DNA, 22 bp, Homo sapiens
tatgtatatatgttgggtagaa

SEQ ID NO: 7312111 - DNA, 22 bp, Homo sapiens
tatgtatatatgttgggtagaa

SEQ ID NO: 7312112 - DNA, 22 bp, Homo sapiens
tatcacatacttctcatccagg

SEQ ID NO: 7312113 - DNA, 22 bp, Homo sapiens
tatcacatagtgtttagtaaat

SEQ ID NO: 7312114 - DNA, 22 bp, Homo sapiens
tatcagataatcttttacaagc

SEQ ID NO: 7312115 - DNA, 22 bp, Homo sapiens
tagttttttcaacaaatggtgc

SEQ ID NO: 7312116 - DNA, 22 bp, Homo sapiens
tagttttttcaacaaatggtgc

SEQ ID NO: 7312117 - DNA, 18 bp, Homo sapiens
tataaacacacttaggtt

SEQ ID NO: 7312118 - DNA, 18 bp, Homo sapiens
tataaacacacttaggtt

SEQ ID NO: 7312119 - DNA, 22 bp, Homo sapiens
tataaactcctcttgcattcct

SEQ ID NO: 7312120 - DNA, 22 bp, Homo sapiens
tatgaaatttctagttctgctt

SEQ ID NO: 7312121 - DNA, 22 bp, Homo sapiens
tatgaaattgccatttttatgg

SEQ ID NO: 7312122 - DNA, 22 bp, Homo sapiens
tatgacaaggtggagtatgagt

SEQ ID NO: 7312123 - DNA, 22 bp, Homo sapiens
tatgacaagaaatacagaggta

SEQ ID NO: 7312124 - DNA, 20 bp, Homo sapiens
tatgacaacgcagcaaggca

SEQ ID NO: 7312125 - DNA, 22 bp, Homo sapiens
tatgaattctgttcattgatga

SEQ ID NO: 7312126 - DNA, 22 bp, Homo sapiens
tatcatttgttattattagtgg

SEQ ID NO: 7312127 - DNA, 22 bp, Homo sapiens
tatctttgtgtcccttttgatg

SEQ ID NO: 7312128 - DNA, 22 bp, Homo sapiens
tatgaaaatttagctgaagcat

SEQ ID NO: 7312129 - DNA, 22 bp, Homo sapiens
tatgaaaaggtggccaatgtag

SEQ ID NO: 7312130 - DNA, 22 bp, Homo sapiens
tatgaaacattcatacaaataa

SEQ ID NO: 7312131 - DNA, 22 bp, Homo sapiens
tatgaaacattcatacaaataa

SEQ ID NO: 7312132 - DNA, 22 bp, Homo sapiens
tatttgcaggacatagatatgg

SEQ ID NO: 7312133 - DNA, 22 bp, Homo sapiens
tatttgcaggcttttgtcatgg

SEQ ID NO: 7312134 - DNA, 22 bp, Homo sapiens
tatttcttgttattctcgttga

SEQ ID NO: 7312135 - DNA, 22 bp, Homo sapiens
tatttgaaggcatacattttga

SEQ ID NO: 7312136 - DNA, 22 bp, Homo sapiens
tatttgaagggagaaagtgcca

SEQ ID NO: 7312137 - DNA, 22 bp, Homo sapiens
tatttggacaccaagtagaagt

SEQ ID NO: 7312138 - DNA, 22 bp, Homo sapiens
tatttggaaatagggctttgta

SEQ ID NO: 7312139 - DNA, 22 bp, Homo sapiens
tatttgctgaatctgattcaga

SEQ ID NO: 7312140 - DNA, 22 bp, Homo sapiens
tattttgaaagtctgttttgaa

SEQ ID NO: 7312141 - DNA, 22 bp, Homo sapiens
tattttctgtggaggaccagat

SEQ ID NO: 7312142 - DNA, 23 bp, Homo sapiens
tattacaattggtcttattaaga

SEQ ID NO: 7312143 - DNA, 23 bp, Homo sapiens
tattacaattggtcttattaaga

SEQ ID NO: 7312144 - DNA, 22 bp, Homo sapiens
tattacaaattataatgggaga

SEQ ID NO: 7312145 - DNA, 22 bp, Homo sapiens
tattgtctgtttgaatgactat

SEQ ID NO: 7312146 - DNA, 22 bp, Homo sapiens
tattgtcacgtcttaattctag

SEQ ID NO: 7312147 - DNA, 22 bp, Homo sapiens
tattgtccatgtgtctgttagc

SEQ ID NO: 7312148 - DNA, 22 bp, Homo sapiens
tattgtccaataggatgttcct

SEQ ID NO: 7312149 - DNA, 22 bp, Homo sapiens
tattgtcaagaagtttatagtg

SEQ ID NO: 7312150 - DNA, 22 bp, Homo sapiens
tattgtgttttctctgtgcgga

SEQ ID NO: 7312151 - DNA, 22 bp, Homo sapiens
tattgtgcccctcccaggaaca

SEQ ID NO: 7312152 - DNA, 22 bp, Homo sapiens
tattgtgctcaccattacatcc

SEQ ID NO: 7312153 - DNA, 22 bp, Homo sapiens
tattgtgctcaccattacatcc

SEQ ID NO: 7312154 - DNA, 22 bp, Homo sapiens
tattgtgcttctgttgtgcaat

SEQ ID NO: 7312155 - DNA, 22 bp, Homo sapiens
tattgtgcacccttgcgttctg

SEQ ID NO: 7312156 - DNA, 22 bp, Homo sapiens
tattgtgcatgttgaataacta

SEQ ID NO: 7312157 - DNA, 22 bp, Homo sapiens
tattgtgcatgttgaataacta

SEQ ID NO: 7312158 - DNA, 22 bp, Homo sapiens
tattgtgccaggtaatgtgttc

SEQ ID NO: 7312159 - DNA, 22 bp, Homo sapiens
tattgtgccaggtaatgtgttc

SEQ ID NO: 7312160 - DNA, 22 bp, Homo sapiens
tatttaaaatagtgctccagca

SEQ ID NO: 7312161 - DNA, 22 bp, Homo sapiens
tatttaaaataagccccagtgg

SEQ ID NO: 7312162 - DNA, 22 bp, Homo sapiens
tcaaataccagcaatttcatgt

SEQ ID NO: 7312163 - DNA, 22 bp, Homo sapiens
tcaaatacagaagatcctttcc

SEQ ID NO: 7312164 - DNA, 22 bp, Homo sapiens
tcaaataccagcttttccagaa

SEQ ID NO: 7312165 - DNA, 22 bp, Homo sapiens
tcaaatcagcaagcagcttccc

SEQ ID NO: 7312166 - DNA, 22 bp, Homo sapiens
tcaaatctcactctgcatttct

SEQ ID NO: 7312167 - DNA, 22 bp, Homo sapiens
tcaaatctcactctgcatttct

SEQ ID NO: 7312168 - DNA, 22 bp, Homo sapiens
tcaaatctcatcttgaattgta

SEQ ID NO: 7312169 - DNA, 22 bp, Homo sapiens
tcaaatctcattgcctaaaact

SEQ ID NO: 7312170 - DNA, 22 bp, Homo sapiens
tcaaatctcattgcctaaaact

SEQ ID NO: 7312171 - DNA, 22 bp, Homo sapiens
tcaaagtttgtggcaatttatt

SEQ ID NO: 7312172 - DNA, 22 bp, Homo sapiens
tcaaagtttttgagaattacat

SEQ ID NO: 7312173 - DNA, 22 bp, Homo sapiens
tcaaagttacttgtggttttct

SEQ ID NO: 7312174 - DNA, 22 bp, Homo sapiens
tcaaagttggaaaagctggccc

SEQ ID NO: 7312175 - DNA, 22 bp, Homo sapiens
tcaaagtttgtggcaatttatt

SEQ ID NO: 7312176 - DNA, 22 bp, Homo sapiens
tcaaataatgccattcatcatc

SEQ ID NO: 7312177 - DNA, 22 bp, Homo sapiens
tcaaagtactactcagttcagc

SEQ ID NO: 7312178 - DNA, 22 bp, Homo sapiens
tcaaagtaagaatttattacaa

SEQ ID NO: 7312179 - DNA, 22 bp, Homo sapiens
tcaaagatagatgttgagaaat

SEQ ID NO: 7312180 - DNA, 22 bp, Homo sapiens
tcaaacttctattctctgtttt

SEQ ID NO: 7312181 - DNA, 22 bp, Homo sapiens
tcaaacttctattctctgtttt

SEQ ID NO: 7312182 - DNA, 22 bp, Homo sapiens
tattttgtatttatgcaagaaa

SEQ ID NO: 7312183 - DNA, 22 bp, Homo sapiens
tattttgtatttatgcaagaaa

SEQ ID NO: 7312184 - DNA, 22 bp, Homo sapiens
tattttgtcttctgctcatcac

SEQ ID NO: 7312185 - DNA, 22 bp, Homo sapiens
tattttgtgccatgcactgcct

SEQ ID NO: 7312186 - DNA, 22 bp, Homo sapiens
tattttgttttgtatccactgt

SEQ ID NO: 7312187 - DNA, 22 bp, Homo sapiens
tattttgtaattggtcatagct

SEQ ID NO: 7312188 - DNA, 20 bp, Homo sapiens
tattttgcaattatggttca

SEQ ID NO: 7312189 - DNA, 22 bp, Homo sapiens
tattttgcgttgagtcagattt

SEQ ID NO: 7312190 - DNA, 22 bp, Homo sapiens
tagatacctgctggacctcatt

SEQ ID NO: 7312191 - DNA, 22 bp, Homo sapiens
tagatacagtgttaagtgtgga

SEQ ID NO: 7312192 - DNA, 22 bp, Homo sapiens
tagagaaaaccactggtgagct

SEQ ID NO: 7312193 - DNA, 22 bp, Homo sapiens
tagagaaaaccactggtgagct

SEQ ID NO: 7312194 - DNA, 22 bp, Homo sapiens
tagagaaataagctttgccttg

SEQ ID NO: 7312195 - DNA, 23 bp, Homo sapiens
tagagaaagccaccgagtctctc

SEQ ID NO: 7312196 - DNA, 22 bp, Homo sapiens
tagagaaaagcagggatcagga

SEQ ID NO: 7312197 - DNA, 22 bp, Homo sapiens
tagaacatgctcatgtataaat

SEQ ID NO: 7312198 - DNA, 22 bp, Homo sapiens
tagaacttatttggcattattt

SEQ ID NO: 7312199 - DNA, 22 bp, Homo sapiens
tagaactgctctcatacttgct

SEQ ID NO: 7312200 - DNA, 22 bp, Homo sapiens
tagaagaaaagcacttagagat

SEQ ID NO: 7312201 - DNA, 22 bp, Homo sapiens
tagaagagacatagcctgtggt

SEQ ID NO: 7312202 - DNA, 21 bp, Homo sapiens
tagaagcacataggttcaaag

SEQ ID NO: 7312203 - DNA, 22 bp, Homo sapiens
tagctgccaaaagggtgggcta

SEQ ID NO: 7312204 - DNA, 22 bp, Homo sapiens
tagctgccagaccattcttact

SEQ ID NO: 7312205 - DNA, 19 bp, Homo sapiens
tagctgcctgttacctcca

SEQ ID NO: 7312206 - DNA, 22 bp, Homo sapiens
tagctgcctttgggctcctgct

SEQ ID NO: 7312207 - DNA, 22 bp, Homo sapiens
tagcaaaatgtggatgtagttg

SEQ ID NO: 7312208 - DNA, 22 bp, Homo sapiens
tagatgaattagcaattatctt

SEQ ID NO: 7312209 - DNA, 23 bp, Homo sapiens
tagatcttcatctaattctgtag

SEQ ID NO: 7312210 - DNA, 22 bp, Homo sapiens
tagttacagcaggcaggatata

SEQ ID NO: 7312211 - DNA, 22 bp, Homo sapiens
tagtgcaacagggaaagagtgt

SEQ ID NO: 7312212 - DNA, 22 bp, Homo sapiens
tagtgcataacatttaaaggtc

SEQ ID NO: 7312213 - DNA, 23 bp, Homo sapiens
taggggctggcgtggagcctgcg

SEQ ID NO: 7312214 - DNA, 22 bp, Homo sapiens
taggggctcagaacatgtcctt

SEQ ID NO: 7312215 - DNA, 22 bp, Homo sapiens
tagtttttaagtgtacaatttc

SEQ ID NO: 7312216 - DNA, 22 bp, Homo sapiens
tagtttaggatccaatctaaga

SEQ ID NO: 7312217 - DNA, 22 bp, Homo sapiens
tagtttaggtggggtagacaga

SEQ ID NO: 7312218 - DNA, 22 bp, Homo sapiens
tagtttcatatgcaaaatagta

SEQ ID NO: 7312219 - DNA, 22 bp, Homo sapiens
tagtttcatatgcaaaatagta

SEQ ID NO: 7312220 - DNA, 22 bp, Homo sapiens
tagttattgcctaggagcagct

SEQ ID NO: 7312221 - DNA, 22 bp, Homo sapiens
tagtttagaatgttgcaataca

SEQ ID NO: 7312222 - DNA, 22 bp, Homo sapiens
tagggcagccacccaggctgct

SEQ ID NO: 7312223 - DNA, 22 bp, Homo sapiens
tagggcttagaaaagaatttac

SEQ ID NO: 7312224 - DNA, 22 bp, Homo sapiens
tagggctttgctcatcctaggt

SEQ ID NO: 7312225 - DNA, 22 bp, Homo sapiens
tagctgttaagttgtttggaaa

SEQ ID NO: 7312226 - DNA, 22 bp, Homo sapiens
tcagccaagcgtaggatattgg

SEQ ID NO: 7312227 - DNA, 22 bp, Homo sapiens
tcagccagagggggcaaaggaa

SEQ ID NO: 7312228 - DNA, 22 bp, Homo sapiens
tcagccagcattacccctgact

SEQ ID NO: 7312229 - DNA, 20 bp, Homo sapiens
tcagcatgctcctcagacat

SEQ ID NO: 7312230 - DNA, 22 bp, Homo sapiens
tcagccagccagctacaggctt

SEQ ID NO: 7312231 - DNA, 22 bp, Homo sapiens
tcagccaggcagccccctggtc

SEQ ID NO: 7312232 - DNA, 22 bp, Homo sapiens
tcagccaggcacaatggcagct

SEQ ID NO: 7312233 - DNA, 22 bp, Homo sapiens
tcagctgctcaaatttatgtca

SEQ ID NO: 7312234 - DNA, 22 bp, Homo sapiens
tcagctgctgtggtatgtacat

SEQ ID NO: 7312235 - DNA, 20 bp, Homo sapiens
tcagatttttctaactttga

SEQ ID NO: 7312236 - DNA, 22 bp, Homo sapiens
tcagcagtgtcagttcccagag

SEQ ID NO: 7312237 - DNA, 22 bp, Homo sapiens
tcagacagagaagtacaatgag

SEQ ID NO: 7312238 - DNA, 22 bp, Homo sapiens
tcagacagaaagatgagtatgg

SEQ ID NO: 7312239 - DNA, 22 bp, Homo sapiens
tcagacagaaagatgagtatgg

SEQ ID NO: 7312240 - DNA, 22 bp, Homo sapiens
tcagacagaaggactatttgaa

SEQ ID NO: 7312241 - DNA, 22 bp, Homo sapiens
tcagagtgtggtgagatgtgca

SEQ ID NO: 7312242 - DNA, 22 bp, Homo sapiens
tcagagtgtgagacatattgga

SEQ ID NO: 7312243 - DNA, 22 bp, Homo sapiens
tcagagtgtgacttggtcatga

SEQ ID NO: 7312244 - DNA, 22 bp, Homo sapiens
tcagacagaggagctcgtgcag

SEQ ID NO: 7312245 - DNA, 20 bp, Homo sapiens
tcagatgggagtgagccatc

SEQ ID NO: 7312246 - DNA, 22 bp, Homo sapiens
tcagatttggacacaggaactt

SEQ ID NO: 7312247 - DNA, 22 bp, Homo sapiens
tcacatttaaacaggaggatta

SEQ ID NO: 7312248 - DNA, 22 bp, Homo sapiens
tcacatttatactccatttgca

SEQ ID NO: 7312249 - DNA, 22 bp, Homo sapiens
tcacatgctgtgggatctgtat

SEQ ID NO: 7312250 - DNA, 22 bp, Homo sapiens
tcacatgctactgagccagacc

SEQ ID NO: 7312251 - DNA, 22 bp, Homo sapiens
tcacatacattgcctttggaag

SEQ ID NO: 7312252 - DNA, 18 bp, Homo sapiens
tcacatacttaggccctc

SEQ ID NO: 7312253 - DNA, 22 bp, Homo sapiens
tcacatttctcagcactgatga

SEQ ID NO: 7312254 - DNA, 22 bp, Homo sapiens
tcacatttatttcaaagttact

SEQ ID NO: 7312255 - DNA, 22 bp, Homo sapiens
tcacatttatttcaaagttact

SEQ ID NO: 7312256 - DNA, 22 bp, Homo sapiens
tcacatttctgattataccaaa

SEQ ID NO: 7312257 - DNA, 22 bp, Homo sapiens
tcacatttctgattataccaaa

SEQ ID NO: 7312258 - DNA, 21 bp, Homo sapiens
tcacatttctcatgggtaaat

SEQ ID NO: 7312259 - DNA, 22 bp, Homo sapiens
tcacatttctttatgtagtctt

SEQ ID NO: 7312260 - DNA, 22 bp, Homo sapiens
tcacatttctttatgtagtctt

SEQ ID NO: 7312261 - DNA, 22 bp, Homo sapiens
tcacagttttagaaaatagata

SEQ ID NO: 7312262 - DNA, 22 bp, Homo sapiens
tcacagtttcttttctgataaa

SEQ ID NO: 7312263 - DNA, 22 bp, Homo sapiens
tcacataaattatacaatttca

SEQ ID NO: 7312264 - DNA, 22 bp, Homo sapiens
tcaacaataggatatagcaggt

SEQ ID NO: 7312265 - DNA, 22 bp, Homo sapiens
tcaacactaaagaataatcttt

SEQ ID NO: 7312266 - DNA, 22 bp, Homo sapiens
tcaaatgcacgtagagaaaata

SEQ ID NO: 7312267 - DNA, 22 bp, Homo sapiens
tcaacagttctgtccaattaat

SEQ ID NO: 7312268 - DNA, 22 bp, Homo sapiens
tcaacatacatacatggtcagg

SEQ ID NO: 7312269 - DNA, 22 bp, Homo sapiens
tcaacatttatgaagctgtggc

SEQ ID NO: 7312270 - DNA, 22 bp, Homo sapiens
tcaacatataggcaacctgtaa

SEQ ID NO: 7312271 - DNA, 22 bp, Homo sapiens
tcaacattcatatatagccaca

SEQ ID NO: 7312272 - DNA, 22 bp, Homo sapiens
tcaacattggaggcaacattca

SEQ ID NO: 7312273 - DNA, 22 bp, Homo sapiens
tcaacagaagtgatagctatta

SEQ ID NO: 7312274 - DNA, 22 bp, Homo sapiens
tcaagaaactgtgctacagagt

SEQ ID NO: 7312275 - DNA, 22 bp, Homo sapiens
tcacagtgacagccaatgtttt

SEQ ID NO: 7312276 - DNA, 22 bp, Homo sapiens
tcacattttatctattttaagt

SEQ ID NO: 7312277 - DNA, 22 bp, Homo sapiens
tcacatttggagaaagcctgcc

SEQ ID NO: 7312278 - DNA, 22 bp, Homo sapiens
tcacatttgtgttttattagag

SEQ ID NO: 7312279 - DNA, 22 bp, Homo sapiens
tcacattttagtaccatgattt

SEQ ID NO: 7312280 - DNA, 22 bp, Homo sapiens
tcacatttgtgttttattagag

SEQ ID NO: 7312281 - DNA, 22 bp, Homo sapiens
tcacatttgttcttgaatctaa

SEQ ID NO: 7312282 - DNA, 22 bp, Homo sapiens
tcacatttgttcttgaatctaa

SEQ ID NO: 7312283 - DNA, 22 bp, Homo sapiens
tcactgctgctgccatgatgga

SEQ ID NO: 7312284 - DNA, 22 bp, Homo sapiens
tcactgctatattggatactga

SEQ ID NO: 7312285 - DNA, 22 bp, Homo sapiens
tcactgctctccaatgtggagt

SEQ ID NO: 7312286 - DNA, 22 bp, Homo sapiens
tcagaataagttatgaaatgaa

SEQ ID NO: 7312287 - DNA, 22 bp, Homo sapiens
tcagaacaggactggctgccat

SEQ ID NO: 7312288 - DNA, 22 bp, Homo sapiens
tcagaacagcagggtgtggctg

SEQ ID NO: 7312289 - DNA, 22 bp, Homo sapiens
tcagaacagcgagaatattcac

SEQ ID NO: 7312290 - DNA, 22 bp, Homo sapiens
tcagaacagctctcagatatcc

SEQ ID NO: 7312291 - DNA, 22 bp, Homo sapiens
tcagaacagctctcagatatcc

SEQ ID NO: 7312292 - DNA, 20 bp, Homo sapiens
tcagaacagtagaggagcta

SEQ ID NO: 7312293 - DNA, 22 bp, Homo sapiens
tcagaaagacgaaacagatggg

SEQ ID NO: 7312294 - DNA, 22 bp, Homo sapiens
tcagaaagaacacaggcagtag

SEQ ID NO: 7312295 - DNA, 22 bp, Homo sapiens
tcagaacagaagaaggaacacg

SEQ ID NO: 7312296 - DNA, 22 bp, Homo sapiens
tcagaacagcacagggtgattt

SEQ ID NO: 7312297 - DNA, 22 bp, Homo sapiens
tcagaacagaagctggctataa

SEQ ID NO: 7312298 - DNA, 22 bp, Homo sapiens
tcagaaagcttttacttaaaca

SEQ ID NO: 7312299 - DNA, 21 bp, Homo sapiens
tcatttcagggccttggcttc

SEQ ID NO: 7312300 - DNA, 22 bp, Homo sapiens
tcatttcagccatttttaaatg

SEQ ID NO: 7312301 - DNA, 22 bp, Homo sapiens
tcatttcagatgcatttagaat

SEQ ID NO: 7312302 - DNA, 22 bp, Homo sapiens
tcatttcagatgcatttagaat

SEQ ID NO: 7312303 - DNA, 22 bp, Homo sapiens
tcatttcagatgcatttagaat

SEQ ID NO: 7312304 - DNA, 22 bp, Homo sapiens
tcatttcagatgcatttagaat

SEQ ID NO: 7312305 - DNA, 22 bp, Homo sapiens
tcatttcacttctctagggaga

SEQ ID NO: 7312306 - DNA, 22 bp, Homo sapiens
tcatttcaatgatactactaag

SEQ ID NO: 7312307 - DNA, 23 bp, Homo sapiens
tcatttcacagtgagcttcctag

SEQ ID NO: 7312308 - DNA, 22 bp, Homo sapiens
tcatttcaatgatactactaag

SEQ ID NO: 7312309 - DNA, 23 bp, Homo sapiens
tcatttcaggttgcatggtacca

SEQ ID NO: 7312310 - DNA, 23 bp, Homo sapiens
tcatttcaggttgcatggtacca

SEQ ID NO: 7312311 - DNA, 22 bp, Homo sapiens
tcatttcagtggcacagaagat

SEQ ID NO: 7312312 - DNA, 22 bp, Homo sapiens
tcatttcagtggcacagaagat

SEQ ID NO: 7312313 - DNA, 22 bp, Homo sapiens
tcatttcagtcctctgtgtgag

SEQ ID NO: 7312314 - DNA, 17 bp, Homo sapiens
tcatttcagtaaatcca

SEQ ID NO: 7312315 - DNA, 17 bp, Homo sapiens
tcatttcagtaaatcca

SEQ ID NO: 7312316 - DNA, 22 bp, Homo sapiens
tcatttcagtggcacagaagat

SEQ ID NO: 7312317 - DNA, 22 bp, Homo sapiens
tcatttcagttcagaggccttt

SEQ ID NO: 7312318 - DNA, 23 bp, Homo sapiens
tcatttcatccagccttgagagt

SEQ ID NO: 7312319 - DNA, 22 bp, Homo sapiens
tcatttcagttgttccctggtt

SEQ ID NO: 7312320 - DNA, 22 bp, Homo sapiens
tcatttcagttcagaggccttt

SEQ ID NO: 7312321 - DNA, 22 bp, Homo sapiens
tcatttcagttgttccctggtt

SEQ ID NO: 7312322 - DNA, 22 bp, Homo sapiens
tcatttctatctatgcagcttc

SEQ ID NO: 7312323 - DNA, 22 bp, Homo sapiens
tcatttctatctatgcagcttc

SEQ ID NO: 7312324 - DNA, 17 bp, Homo sapiens
tcatttctaggcactcc

SEQ ID NO: 7312325 - DNA, 17 bp, Homo sapiens
tcatttctaggcactcc

SEQ ID NO: 7312326 - DNA, 22 bp, Homo sapiens
tcatttcatgtctcaggcactg

SEQ ID NO: 7312327 - DNA, 23 bp, Homo sapiens
tcatttcatccagccttgagagt

SEQ ID NO: 7312328 - DNA, 22 bp, Homo sapiens
tcatttggtattaattttcaga

SEQ ID NO: 7312329 - DNA, 22 bp, Homo sapiens
tcatttggccttctttgcattg

SEQ ID NO: 7312330 - DNA, 22 bp, Homo sapiens
tcatttggaagcctgagagtgt

SEQ ID NO: 7312331 - DNA, 22 bp, Homo sapiens
tcatttggagccttcctgtttt

SEQ ID NO: 7312332 - DNA, 22 bp, Homo sapiens
tcatttctgttgtgcatcactg

SEQ ID NO: 7312333 - DNA, 22 bp, Homo sapiens
tcatttctcccggccaaaaact

SEQ ID NO: 7312334 - DNA, 22 bp, Homo sapiens
tcatttctcctaagtgaaatat

SEQ ID NO: 7312335 - DNA, 22 bp, Homo sapiens
tcatttataaggatgcaattaa

SEQ ID NO: 7312336 - DNA, 22 bp, Homo sapiens
tcatttatagctaaccttgaat

SEQ ID NO: 7312337 - DNA, 22 bp, Homo sapiens
tcatttaattggttttgctcgt

SEQ ID NO: 7312338 - DNA, 22 bp, Homo sapiens
tcatttaataatttttgagtag

SEQ ID NO: 7312339 - DNA, 22 bp, Homo sapiens
tcattgccatggcatttgcaga

SEQ ID NO: 7312340 - DNA, 22 bp, Homo sapiens
tcattgtcagctcttgacttct

SEQ ID NO: 7312341 - DNA, 23 bp, Homo sapiens
tcattgtgactgtgccacataac

SEQ ID NO: 7312342 - DNA, 19 bp, Homo sapiens
tcattgtgctgagcaaggt

SEQ ID NO: 7312343 - DNA, 21 bp, Homo sapiens
tcattggtaagttttgtttgc

SEQ ID NO: 7312344 - DNA, 20 bp, Homo sapiens
tcattgtgttgccaattccc

SEQ ID NO: 7312345 - DNA, 22 bp, Homo sapiens
tccaaagaatagaggtgacatt

SEQ ID NO: 7312346 - DNA, 19 bp, Homo sapiens
tccaaagaagttcacattt

SEQ ID NO: 7312347 - DNA, 22 bp, Homo sapiens
tccaaagaggttaagaacgaga

SEQ ID NO: 7312348 - DNA, 22 bp, Homo sapiens
tccaaagaggattcagggacct

SEQ ID NO: 7312349 - DNA, 23 bp, Homo sapiens
tccaaactcaagacattaataag

SEQ ID NO: 7312350 - DNA, 22 bp, Homo sapiens
tcatttgtaccattttttaaga

SEQ ID NO: 7312351 - DNA, 22 bp, Homo sapiens
tcatttgtctggcacagggaat

SEQ ID NO: 7312352 - DNA, 22 bp, Homo sapiens
tcatttgtgctgtcagcatgca

SEQ ID NO: 7312353 - DNA, 22 bp, Homo sapiens
tcatttgttacagccacatacc

SEQ ID NO: 7312354 - DNA, 22 bp, Homo sapiens
tcatttgttctcattctctact

SEQ ID NO: 7312355 - DNA, 22 bp, Homo sapiens
tccaatattcattaaaatgcag

SEQ ID NO: 7312356 - DNA, 22 bp, Homo sapiens
tccaatatttctcacatatgga

SEQ ID NO: 7312357 - DNA, 22 bp, Homo sapiens
tccaatatttctcatatatgga

SEQ ID NO: 7312358 - DNA, 20 bp, Homo sapiens
tccaatttaagaatttagag

SEQ ID NO: 7312359 - DNA, 22 bp, Homo sapiens
tccaatctagtatgataaatga

SEQ ID NO: 7312360 - DNA, 20 bp, Homo sapiens
tccaatgtaggataaatgtg

SEQ ID NO: 7312361 - DNA, 22 bp, Homo sapiens
tccaatttgaaatggtatatgt

SEQ ID NO: 7312362 - DNA, 22 bp, Homo sapiens
tccaattttctgatttcacttg

SEQ ID NO: 7312363 - DNA, 22 bp, Homo sapiens
tccaatttgtttgatgatggaa

SEQ ID NO: 7312364 - DNA, 22 bp, Homo sapiens
tccaattttacgtctgtataaa

SEQ ID NO: 7312365 - DNA, 22 bp, Homo sapiens
tccaaggggaaaggcgccggcg

SEQ ID NO: 7312366 - DNA, 22 bp, Homo sapiens
tccaagggttcatgtgcattca

SEQ ID NO: 7312367 - DNA, 22 bp, Homo sapiens
tccaagggctttggcgtgaagt

SEQ ID NO: 7312368 - DNA, 22 bp, Homo sapiens
tccaagggctcatggacacttt

SEQ ID NO: 7312369 - DNA, 23 bp, Homo sapiens
tccaagggctacaaacacagacc

SEQ ID NO: 7312370 - DNA, 22 bp, Homo sapiens
tccaagggcatgctgaaataag

SEQ ID NO: 7312371 - DNA, 22 bp, Homo sapiens
tccaagggaaactgcacttcta

SEQ ID NO: 7312372 - DNA, 20 bp, Homo sapiens
tccaagggcagcagaatcag

SEQ ID NO: 7312373 - DNA, 22 bp, Homo sapiens
tccaagggcagccatagaactt

SEQ ID NO: 7312374 - DNA, 22 bp, Homo sapiens
tccaagggcagcagccatagcc

SEQ ID NO: 7312375 - DNA, 22 bp, Homo sapiens
tccaagggaatgtgggcaatgc

SEQ ID NO: 7312376 - DNA, 22 bp, Homo sapiens
tccaagggcaacaatggaacac

SEQ ID NO: 7312377 - DNA, 22 bp, Homo sapiens
tccaagggaatttaaagttgct

SEQ ID NO: 7312378 - DNA, 22 bp, Homo sapiens
tccaaattctatgttctttcca

SEQ ID NO: 7312379 - DNA, 22 bp, Homo sapiens
tccaacttctgcaatcagtttg

SEQ ID NO: 7312380 - DNA, 22 bp, Homo sapiens
tccaactaggcacacagctggt

SEQ ID NO: 7312381 - DNA, 22 bp, Homo sapiens
tcagggccctggcaggaaacag

SEQ ID NO: 7312382 - DNA, 22 bp, Homo sapiens
tcagggccggggctgtggcgag

SEQ ID NO: 7312383 - DNA, 22 bp, Homo sapiens
tcagggccgccggggatctcgc

SEQ ID NO: 7312384 - DNA, 23 bp, Homo sapiens
tcagtactctgctgggtatagag

SEQ ID NO: 7312385 - DNA, 22 bp, Homo sapiens
tcagtacttcccattctgagct

SEQ ID NO: 7312386 - DNA, 22 bp, Homo sapiens
tcagttacctgacagtggttat

SEQ ID NO: 7312387 - DNA, 22 bp, Homo sapiens
tcataaagttacccaaatttta

SEQ ID NO: 7312388 - DNA, 22 bp, Homo sapiens
tcataaagttatcaccaaatcc

SEQ ID NO: 7312389 - DNA, 22 bp, Homo sapiens
tcagtgttttaactgtctttta

SEQ ID NO: 7312390 - DNA, 22 bp, Homo sapiens
tcatctttaccccttgcttcaa

SEQ ID NO: 7312391 - DNA, 22 bp, Homo sapiens
tcatctttaccccttgcttcaa

SEQ ID NO: 7312392 - DNA, 22 bp, Homo sapiens
tcatctttcctcaaaagatcca

SEQ ID NO: 7312393 - DNA, 22 bp, Homo sapiens
tcatctttgtatccctaacaca

SEQ ID NO: 7312394 - DNA, 22 bp, Homo sapiens
tcatacattcagcagatatttg

SEQ ID NO: 7312395 - DNA, 22 bp, Homo sapiens
tcatagaaatggaaagtatatt

SEQ ID NO: 7312396 - DNA, 22 bp, Homo sapiens
tcatagaagcaccagaagatat

SEQ ID NO: 7312397 - DNA, 22 bp, Homo sapiens
tcatacatcttgtatatctatc

SEQ ID NO: 7312398 - DNA, 22 bp, Homo sapiens
tcatacatcttgtatatctatc

SEQ ID NO: 7312399 - DNA, 22 bp, Homo sapiens
tcctcttctaagctcattcagg

SEQ ID NO: 7312400 - DNA, 22 bp, Homo sapiens
tcctcttctgcccatcagaggc

SEQ ID NO: 7312401 - DNA, 22 bp, Homo sapiens
tcctcttctgtggattccctga

SEQ ID NO: 7312402 - DNA, 22 bp, Homo sapiens
tcctctttaaatgcttttatct

SEQ ID NO: 7312403 - DNA, 22 bp, Homo sapiens
tcctgagacatctctgctggtc

SEQ ID NO: 7312404 - DNA, 22 bp, Homo sapiens
tcctgagagcagagtccaggtg

SEQ ID NO: 7312405 - DNA, 22 bp, Homo sapiens
tcctgaaattctggttgtcact

SEQ ID NO: 7312406 - DNA, 22 bp, Homo sapiens
tcctgaagaggctacactgctt

SEQ ID NO: 7312407 - DNA, 22 bp, Homo sapiens
tcctgagataaatctcatgtga

SEQ ID NO: 7312408 - DNA, 22 bp, Homo sapiens
tcctgagaggtgtgaggtgcag

SEQ ID NO: 7312409 - DNA, 22 bp, Homo sapiens
tcctgagatgtggagctccatg

SEQ ID NO: 7312410 - DNA, 22 bp, Homo sapiens
tcctgaggaatgtgaagagaac

SEQ ID NO: 7312411 - DNA, 22 bp, Homo sapiens
tcctgaggaaagttcatgaatg

SEQ ID NO: 7312412 - DNA, 22 bp, Homo sapiens
tcctgccgtcctccggggcctc

SEQ ID NO: 7312413 - DNA, 22 bp, Homo sapiens
tcctgcacattagtatttttta

SEQ ID NO: 7312414 - DNA, 22 bp, Homo sapiens
tcctcagcaaacacttcactct

SEQ ID NO: 7312415 - DNA, 22 bp, Homo sapiens
tcctcagcatggaatctggact

SEQ ID NO: 7312416 - DNA, 22 bp, Homo sapiens
tcctcagcaggtctgtgtacca

SEQ ID NO: 7312417 - DNA, 23 bp, Homo sapiens
tcctcagcatgttttgtcatgta

SEQ ID NO: 7312418 - DNA, 22 bp, Homo sapiens
tcctagtcacaggaaaatttca

SEQ ID NO: 7312419 - DNA, 22 bp, Homo sapiens
tcctcacatggtgagccacaca

SEQ ID NO: 7312420 - DNA, 22 bp, Homo sapiens
tcctcactgcagtgctccgagc

SEQ ID NO: 7312421 - DNA, 22 bp, Homo sapiens
tcctcactgcagtgctccgagc

SEQ ID NO: 7312422 - DNA, 22 bp, Homo sapiens
tccctgagactctggagtgtaa

SEQ ID NO: 7312423 - DNA, 22 bp, Homo sapiens
tccctgagaaagcccaggaggt

SEQ ID NO: 7312424 - DNA, 22 bp, Homo sapiens
tccctgaatctcgaactagcct

SEQ ID NO: 7312425 - DNA, 22 bp, Homo sapiens
tccatggagtttttatttggta

SEQ ID NO: 7312426 - DNA, 22 bp, Homo sapiens
tccatggggcccaggatgagag

SEQ ID NO: 7312427 - DNA, 22 bp, Homo sapiens
tccattatacttctgattcaaa

SEQ ID NO: 7312428 - DNA, 22 bp, Homo sapiens
tccattctatgcttacatttat

SEQ ID NO: 7312429 - DNA, 22 bp, Homo sapiens
tcccaaatataatgcaagagac

SEQ ID NO: 7312430 - DNA, 22 bp, Homo sapiens
tcccagcctcctgacagttttg

SEQ ID NO: 7312431 - DNA, 22 bp, Homo sapiens
tcccagaggctccagtctctat

SEQ ID NO: 7312432 - DNA, 22 bp, Homo sapiens
tcccagaggttgagtcacttat

SEQ ID NO: 7312433 - DNA, 22 bp, Homo sapiens
tccaggttttctgaaggcagga

SEQ ID NO: 7312434 - DNA, 23 bp, Homo sapiens
tccaggctgggacttcaactggc

SEQ ID NO: 7312435 - DNA, 22 bp, Homo sapiens
tccaggctttttcatgctgtct

SEQ ID NO: 7312436 - DNA, 22 bp, Homo sapiens
tccaggcctgactataaatgta

SEQ ID NO: 7312437 - DNA, 18 bp, Homo sapiens
tccaggcctgaagtgtcc

SEQ ID NO: 7312438 - DNA, 22 bp, Homo sapiens
tccaggcctgcaatgacaaagc

SEQ ID NO: 7312439 - DNA, 22 bp, Homo sapiens
tccaggcctgcctggtgtttgc

SEQ ID NO: 7312440 - DNA, 21 bp, Homo sapiens
tccaatttttaagactatggc

SEQ ID NO: 7312441 - DNA, 21 bp, Homo sapiens
tccacaatagggaaattcacc

SEQ ID NO: 7312442 - DNA, 22 bp, Homo sapiens
tccaggcctctagccctctctt

SEQ ID NO: 7312443 - DNA, 22 bp, Homo sapiens
tccaggcctctagcccctatct

SEQ ID NO: 7312444 - DNA, 20 bp, Homo sapiens
tccaggccttgttctcagat

SEQ ID NO: 7312445 - DNA, 22 bp, Homo sapiens
tccaggccttgacaggtcagtt

SEQ ID NO: 7312446 - DNA, 22 bp, Homo sapiens
tccaggcctggctccattcagt

SEQ ID NO: 7312447 - DNA, 22 bp, Homo sapiens
tccaggcctttgcacatgttgt

SEQ ID NO: 7312448 - DNA, 22 bp, Homo sapiens
tccaggctaattttgcattgtt

SEQ ID NO: 7312449 - DNA, 22 bp, Homo sapiens
tccaggctacttggattcctgg

SEQ ID NO: 7312450 - DNA, 22 bp, Homo sapiens
tccaggctaattttgcattgtt

SEQ ID NO: 7312451 - DNA, 22 bp, Homo sapiens
tccaggctagaagtcacaggcc

SEQ ID NO: 7312452 - DNA, 22 bp, Homo sapiens
tccaggctagagtgcagtggcc

SEQ ID NO: 7312453 - DNA, 22 bp, Homo sapiens
tccaggctacttggattcctgg

SEQ ID NO: 7312454 - DNA, 22 bp, Homo sapiens
tccaggctagcctggtagagaa

SEQ ID NO: 7312455 - DNA, 21 bp, Homo sapiens
tccaggctggaaggggcgttg

SEQ ID NO: 7312456 - DNA, 22 bp, Homo sapiens
tccaggctggacatgaggcggg

SEQ ID NO: 7312457 - DNA, 22 bp, Homo sapiens
tccaggctggagtgcagtggca

SEQ ID NO: 7312458 - DNA, 18 bp, Homo sapiens
tccaggctggattgatga

SEQ ID NO: 7312459 - DNA, 22 bp, Homo sapiens
tccaggctggagtgcagtggcg

SEQ ID NO: 7312460 - DNA, 22 bp, Homo sapiens
tccaggctggctcttcaaaatt

SEQ ID NO: 7312461 - DNA, 22 bp, Homo sapiens
tccaggctggcctcgcgtgaca

SEQ ID NO: 7312462 - DNA, 22 bp, Homo sapiens
tttcctctaaacgcatttgctt

SEQ ID NO: 7312463 - DNA, 22 bp, Homo sapiens
tttcctcctagcctccagccgc

SEQ ID NO: 7312464 - DNA, 22 bp, Homo sapiens
tttcctctccggggcctccagg

SEQ ID NO: 7312465 - DNA, 22 bp, Homo sapiens
tttcctctccaccaggaggtct

SEQ ID NO: 7312466 - DNA, 22 bp, Homo sapiens
tttcctctgagtgagctgggag

SEQ ID NO: 7312467 - DNA, 22 bp, Homo sapiens
tttcctctgatgctgacttgga

SEQ ID NO: 7312468 - DNA, 22 bp, Homo sapiens
tttcttttgccctgtgggttag

SEQ ID NO: 7312469 - DNA, 22 bp, Homo sapiens
tttgaaaaaggcctttggtatg

SEQ ID NO: 7312470 - DNA, 22 bp, Homo sapiens
tttcttttgaatagtgtgtggt

SEQ ID NO: 7312471 - DNA, 22 bp, Homo sapiens
tttcttttacagtgtggctatt

SEQ ID NO: 7312472 - DNA, 22 bp, Homo sapiens
tttcttttacagtgtggctatt

SEQ ID NO: 7312473 - DNA, 19 bp, Homo sapiens
tttgaaaggattgttattt

SEQ ID NO: 7312474 - DNA, 19 bp, Homo sapiens
tttgaaaggattgttattt

SEQ ID NO: 7312475 - DNA, 22 bp, Homo sapiens
tttgaaagggttatgagactga

SEQ ID NO: 7312476 - DNA, 22 bp, Homo sapiens
tttgaaagggaaataaactcct

SEQ ID NO: 7312477 - DNA, 17 bp, Homo sapiens
tttgaaaggatgtcagt

SEQ ID NO: 7312478 - DNA, 21 bp, Homo sapiens
tttgaaagccctatgttttca

SEQ ID NO: 7312479 - DNA, 22 bp, Homo sapiens
tttgaaagcaccatttgagtag

SEQ ID NO: 7312480 - DNA, 22 bp, Homo sapiens
tttgaaagcctggcttttctct

SEQ ID NO: 7312481 - DNA, 21 bp, Homo sapiens
tttgaaagctacatctatagc

SEQ ID NO: 7312482 - DNA, 22 bp, Homo sapiens
tttgaaagctactttcgggtca

SEQ ID NO: 7312483 - DNA, 22 bp, Homo sapiens
tttgaaaggaagttaatacttt

SEQ ID NO: 7312484 - DNA, 22 bp, Homo sapiens
tttgaatctgatatggcagcat

SEQ ID NO: 7312485 - DNA, 22 bp, Homo sapiens
tttgaatatgtgcttgttaaat

SEQ ID NO: 7312486 - DNA, 22 bp, Homo sapiens
tttgaagataaatatggagaaa

SEQ ID NO: 7312487 - DNA, 22 bp, Homo sapiens
tttgacaattcatgacatttat

SEQ ID NO: 7312488 - DNA, 22 bp, Homo sapiens
tttgacaattcatgacatttat

SEQ ID NO: 7312489 - DNA, 22 bp, Homo sapiens
tttgacagacatttactacatt

SEQ ID NO: 7312490 - DNA, 22 bp, Homo sapiens
tttgacaagagggcatcttcag

SEQ ID NO: 7312491 - DNA, 23 bp, Homo sapiens
tttgaatgggtctatttttctta

SEQ ID NO: 7312492 - DNA, 22 bp, Homo sapiens
tttgacaaaattatgctaatat

SEQ ID NO: 7312493 - DNA, 22 bp, Homo sapiens
tttgacaaaggaaaaatgcaca

SEQ ID NO: 7312494 - DNA, 22 bp, Homo sapiens
tttgacaacagcaaatgtcaca

SEQ ID NO: 7312495 - DNA, 22 bp, Homo sapiens
tttgacaaatgtatctgcatta

SEQ ID NO: 7312496 - DNA, 22 bp, Homo sapiens
tttgataacagtgaatatcatg

SEQ ID NO: 7312497 - DNA, 22 bp, Homo sapiens
tttgataacagtgaatatcatg

SEQ ID NO: 7312498 - DNA, 22 bp, Homo sapiens
tttgataacagtgaatatcatg

SEQ ID NO: 7312499 - DNA, 22 bp, Homo sapiens
tttgatctatgcgtggtttccc

SEQ ID NO: 7312500 - DNA, 22 bp, Homo sapiens
tttgataatacacaagagaaag

SEQ ID NO: 7312501 - DNA, 22 bp, Homo sapiens
tttgatttactggatattctca

SEQ ID NO: 7312502 - DNA, 22 bp, Homo sapiens
tttgctttctgttgaacagagt

SEQ ID NO: 7312503 - DNA, 22 bp, Homo sapiens
tttgattctaagttctgtcaac

SEQ ID NO: 7312504 - DNA, 22 bp, Homo sapiens
tttggtttttacctgctgagag

SEQ ID NO: 7312505 - DNA, 22 bp, Homo sapiens
tttgtaaaagcccaagctgtag

SEQ ID NO: 7312506 - DNA, 22 bp, Homo sapiens
tttggtcaaatattatcctgag

SEQ ID NO: 7312507 - DNA, 22 bp, Homo sapiens
tttggtcaatatggtagcagca

SEQ ID NO: 7312508 - DNA, 22 bp, Homo sapiens
tttggtcactggatttggctgt

SEQ ID NO: 7312509 - DNA, 22 bp, Homo sapiens
tttggaaatttcatcaatagcc

SEQ ID NO: 7312510 - DNA, 22 bp, Homo sapiens
tttggtcatgtcgtcatttggg

SEQ ID NO: 7312511 - DNA, 22 bp, Homo sapiens
tttggtcatgtgcccacccctg

SEQ ID NO: 7312512 - DNA, 22 bp, Homo sapiens
tttggtcattgaggaagtaaag

SEQ ID NO: 7312513 - DNA, 22 bp, Homo sapiens
tttggtcatttgcactgccaat

SEQ ID NO: 7312514 - DNA, 22 bp, Homo sapiens
tttggtcagcaatattgtgggg

SEQ ID NO: 7312515 - DNA, 22 bp, Homo sapiens
tttggtcagataagtcaatgta

SEQ ID NO: 7312516 - DNA, 22 bp, Homo sapiens
tttggtcagcagttggtggcgt

SEQ ID NO: 7312517 - DNA, 22 bp, Homo sapiens
tttggtcagggtaggacagttg

SEQ ID NO: 7312518 - DNA, 22 bp, Homo sapiens
tttggtcataagcttttggggt

SEQ ID NO: 7312519 - DNA, 22 bp, Homo sapiens
tttggtcatagattgcgaacat

SEQ ID NO: 7312520 - DNA, 22 bp, Homo sapiens
tttggaaaaagacagcttatga

SEQ ID NO: 7312521 - DNA, 22 bp, Homo sapiens
tttgcttttgtgctctagtggt

SEQ ID NO: 7312522 - DNA, 22 bp, Homo sapiens
tttgctttgtttaaaagtggta

SEQ ID NO: 7312523 - DNA, 22 bp, Homo sapiens
tttgctttgtttaaaagtggta

SEQ ID NO: 7312524 - DNA, 22 bp, Homo sapiens
tttggaaaaagcctgaacatag

SEQ ID NO: 7312525 - DNA, 22 bp, Homo sapiens
tttggaaacacggtcatcttcc

SEQ ID NO: 7312526 - DNA, 22 bp, Homo sapiens
tttggaaacacggtcatcttcc

SEQ ID NO: 7312527 - DNA, 22 bp, Homo sapiens
tttggaaagacacacagtttta

SEQ ID NO: 7312528 - DNA, 22 bp, Homo sapiens
tttggaaagtgtacaaatttga

SEQ ID NO: 7312529 - DNA, 22 bp, Homo sapiens
tttggaaagttgtcactttaga

SEQ ID NO: 7312530 - DNA, 22 bp, Homo sapiens
ttttatgttcctctttatgcga

SEQ ID NO: 7312531 - DNA, 22 bp, Homo sapiens
ttttatgttcctctttatgcga

SEQ ID NO: 7312532 - DNA, 22 bp, Homo sapiens
ttttatgttcctgaagctatct

SEQ ID NO: 7312533 - DNA, 22 bp, Homo sapiens
ttttattgcaataaagtgtgta

SEQ ID NO: 7312534 - DNA, 22 bp, Homo sapiens
ttttattggagtgataccaagc

SEQ ID NO: 7312535 - DNA, 22 bp, Homo sapiens
ttttcattgtaaatcaggaaac

SEQ ID NO: 7312536 - DNA, 22 bp, Homo sapiens
ttttcatgtgatgtgacatttc

SEQ ID NO: 7312537 - DNA, 22 bp, Homo sapiens
ttttctgaagtttaagacattt

SEQ ID NO: 7312538 - DNA, 22 bp, Homo sapiens
ttttcatttttgtagatgcaag

SEQ ID NO: 7312539 - DNA, 22 bp, Homo sapiens
ttttccaaagtaccatgtccct

SEQ ID NO: 7312540 - DNA, 22 bp, Homo sapiens
ttttctggtcacatgttattaa

SEQ ID NO: 7312541 - DNA, 21 bp, Homo sapiens
ttttctggagtatgtctcctc

SEQ ID NO: 7312542 - DNA, 22 bp, Homo sapiens
ttttctgtttgcttcaagacat

SEQ ID NO: 7312543 - DNA, 22 bp, Homo sapiens
ttttcttatgtgcagctatatg

SEQ ID NO: 7312544 - DNA, 22 bp, Homo sapiens
ttttcttatgtgcagctatatg

SEQ ID NO: 7312545 - DNA, 22 bp, Homo sapiens
ttttcttatggtgaagcacaaa

SEQ ID NO: 7312546 - DNA, 22 bp, Homo sapiens
ttttcttactgtctgtgatcct

SEQ ID NO: 7312547 - DNA, 22 bp, Homo sapiens
ttttaaagagatgctgtgcata

SEQ ID NO: 7312548 - DNA, 22 bp, Homo sapiens
ttttaaaggcagattatggctt

SEQ ID NO: 7312549 - DNA, 22 bp, Homo sapiens
ttttaaaggatactcttgtcta

SEQ ID NO: 7312550 - DNA, 22 bp, Homo sapiens
ttttaaaggatagctctggttg

SEQ ID NO: 7312551 - DNA, 22 bp, Homo sapiens
tttgttcacatgtcatgtacaa

SEQ ID NO: 7312552 - DNA, 22 bp, Homo sapiens
tttgttcaatatgtgtttgtcc

SEQ ID NO: 7312553 - DNA, 22 bp, Homo sapiens
ttttaaactgcagaatttagaa

SEQ ID NO: 7312554 - DNA, 22 bp, Homo sapiens
ttttaacactcagcactatctc

SEQ ID NO: 7312555 - DNA, 22 bp, Homo sapiens
ttttaagaaatgtatgactgtc

SEQ ID NO: 7312556 - DNA, 22 bp, Homo sapiens
ttttaaaggctgtatgaccaag

SEQ ID NO: 7312557 - DNA, 22 bp, Homo sapiens
ttttaaaggctgtatgaccaag

SEQ ID NO: 7312558 - DNA, 22 bp, Homo sapiens
ttttaaatctccagttgacccc

SEQ ID NO: 7312559 - DNA, 21 bp, Homo sapiens
ttttaacaaggatttccctag

SEQ ID NO: 7312560 - DNA, 22 bp, Homo sapiens
ttttaatgggcgactattatgg

SEQ ID NO: 7312561 - DNA, 22 bp, Homo sapiens
ttttaatcctcttggtatctta

SEQ ID NO: 7312562 - DNA, 22 bp, Homo sapiens
ttttaagaaatgtatgactgtc

SEQ ID NO: 7312563 - DNA, 22 bp, Homo sapiens
ttttaatgtgctctgcaatgat

SEQ ID NO: 7312564 - DNA, 22 bp, Homo sapiens
tttgtgtgtatatgtatataga

SEQ ID NO: 7312565 - DNA, 22 bp, Homo sapiens
tttgtgtgtatatccttccaga

SEQ ID NO: 7312566 - DNA, 22 bp, Homo sapiens
tttgtgtgtgtataggaaagga

SEQ ID NO: 7312567 - DNA, 22 bp, Homo sapiens
tttgtgtgtgctcacatagatg

SEQ ID NO: 7312568 - DNA, 21 bp, Homo sapiens
tttgtgtgtcacgtgcacagg

SEQ ID NO: 7312569 - DNA, 22 bp, Homo sapiens
tttgtgtggtggatactgggta

SEQ ID NO: 7312570 - DNA, 22 bp, Homo sapiens
tttgtgtggtggatactgggta

SEQ ID NO: 7312571 - DNA, 22 bp, Homo sapiens
tttgtgtgggggaaacaaggta

SEQ ID NO: 7312572 - DNA, 22 bp, Homo sapiens
tttgtgtggatggaaggcagta

SEQ ID NO: 7312573 - DNA, 22 bp, Homo sapiens
tttgtgtggcgttggccggcgg

SEQ ID NO: 7312574 - DNA, 22 bp, Homo sapiens
tttgtgtgcttggtattgaaga

SEQ ID NO: 7312575 - DNA, 22 bp, Homo sapiens
tttgtgtgcttggtattgaaga

SEQ ID NO: 7312576 - DNA, 22 bp, Homo sapiens
tttgtgtgcgtctggcctgggg

SEQ ID NO: 7312577 - DNA, 22 bp, Homo sapiens
tttgtgtgcaacgcatggagtc

SEQ ID NO: 7312578 - DNA, 22 bp, Homo sapiens
tttgtgtgaaaatatttaagtt

SEQ ID NO: 7312579 - DNA, 22 bp, Homo sapiens
tttgtaagcagtgtttttacag

SEQ ID NO: 7312580 - DNA, 22 bp, Homo sapiens
tttgtaaggctaaataatattc

SEQ ID NO: 7312581 - DNA, 19 bp, Homo sapiens
tttgtaagtccttactgat

SEQ ID NO: 7312582 - DNA, 22 bp, Homo sapiens
tttgtaagcaagttaacatttt

SEQ ID NO: 7312583 - DNA, 22 bp, Homo sapiens
tttgtaagagcatatgtaaagg

SEQ ID NO: 7312584 - DNA, 22 bp, Homo sapiens
tttgtaagagcatatgtaaagg

SEQ ID NO: 7312585 - DNA, 22 bp, Homo sapiens
tttgtaacatcccaacaaattt

SEQ ID NO: 7312586 - DNA, 22 bp, Homo sapiens
tttgtaactctccctttgtata

SEQ ID NO: 7312587 - DNA, 22 bp, Homo sapiens
tttgtaactttagaattgatcc

SEQ ID NO: 7312588 - DNA, 22 bp, Homo sapiens
tttgtaaaggcctgaatttcag

SEQ ID NO: 7312589 - DNA, 22 bp, Homo sapiens
tttgtaacaagttgatctggta

SEQ ID NO: 7312590 - DNA, 22 bp, Homo sapiens
tttgtaaatagcagtactcatg

SEQ ID NO: 7312591 - DNA, 22 bp, Homo sapiens
tttgtaaaattagggaattcaa

SEQ ID NO: 7312592 - DNA, 22 bp, Homo sapiens
tttgtaaaaggaggaagcatgg

SEQ ID NO: 7312593 - DNA, 22 bp, Homo sapiens
tttgttaattcttatgttagag

SEQ ID NO: 7312594 - DNA, 22 bp, Homo sapiens
tttgttaaaatgcagattctgt

SEQ ID NO: 7312595 - DNA, 22 bp, Homo sapiens
tttgtgttttcccatactattg

SEQ ID NO: 7312596 - DNA, 22 bp, Homo sapiens
tttgtgttggaagaaatgctac

SEQ ID NO: 7312597 - DNA, 22 bp, Homo sapiens
tttgtgttggaagaaatgctac

SEQ ID NO: 7312598 - DNA, 22 bp, Homo sapiens
tttttataccacctctcactta

SEQ ID NO: 7312599 - DNA, 22 bp, Homo sapiens
tttttataccacctctcactta

SEQ ID NO: 7312600 - DNA, 22 bp, Homo sapiens
tttttatactttgctcaagatt

SEQ ID NO: 7312601 - DNA, 22 bp, Homo sapiens
tttttatgcctacgctgaaaag

SEQ ID NO: 7312602 - DNA, 22 bp, Homo sapiens
tttttatgcctacgctgaaaag

SEQ ID NO: 7312603 - DNA, 22 bp, Homo sapiens
tttttatcttgtatgtgtctct

SEQ ID NO: 7312604 - DNA, 22 bp, Homo sapiens
tttttatctacagattctcagc

SEQ ID NO: 7312605 - DNA, 22 bp, Homo sapiens
tttttagagtgttaccagtata

SEQ ID NO: 7312606 - DNA, 22 bp, Homo sapiens
tttttagaattggctgagaatt

SEQ ID NO: 7312607 - DNA, 22 bp, Homo sapiens
tttttataactcttttgtgaca

SEQ ID NO: 7312608 - DNA, 22 bp, Homo sapiens
ttgtcatatttataaaatgtaa

SEQ ID NO: 7312609 - DNA, 22 bp, Homo sapiens
ttgtcacaggaaagggtgcaag

SEQ ID NO: 7312610 - DNA, 22 bp, Homo sapiens
ttgtcacctatactgagcttaa

SEQ ID NO: 7312611 - DNA, 22 bp, Homo sapiens
ttgtcaccatatttcattttga

SEQ ID NO: 7312612 - DNA, 22 bp, Homo sapiens
ttgtcacccctagaggaattct

SEQ ID NO: 7312613 - DNA, 22 bp, Homo sapiens
ttgtcaccctaaccaaacaccc

SEQ ID NO: 7312614 - DNA, 22 bp, Homo sapiens
ttgtccattgtgacaagtgtgg

SEQ ID NO: 7312615 - DNA, 22 bp, Homo sapiens
ttgtcccattgcgaatgtgagt

SEQ ID NO: 7312616 - DNA, 22 bp, Homo sapiens
ttgtccctgcccctgcttgctt

SEQ ID NO: 7312617 - DNA, 22 bp, Homo sapiens
ttgtcccttcagtaagagtgga

SEQ ID NO: 7312618 - DNA, 22 bp, Homo sapiens
ttgtgtatttcctgaaggtaag

SEQ ID NO: 7312619 - DNA, 22 bp, Homo sapiens
ttgtgtattttttgatactaac

SEQ ID NO: 7312620 - DNA, 22 bp, Homo sapiens
ttgtgtcaggggcccatactca

SEQ ID NO: 7312621 - DNA, 22 bp, Homo sapiens
ttgtgggatggctcttcccaaa

SEQ ID NO: 7312622 - DNA, 22 bp, Homo sapiens
ttgtgggatctccctgttgctc

SEQ ID NO: 7312623 - DNA, 22 bp, Homo sapiens
ttgtgtcatgttccattgaaaa

SEQ ID NO: 7312624 - DNA, 23 bp, Homo sapiens
ttgtgtctacttcctatctaggg

SEQ ID NO: 7312625 - DNA, 22 bp, Homo sapiens
ttgtgtctggaatgcgtggagc

SEQ ID NO: 7312626 - DNA, 22 bp, Homo sapiens
ttgtgtctatggtttgagcatc

SEQ ID NO: 7312627 - DNA, 22 bp, Homo sapiens
ttgtgtcttaaagattaaatgg

SEQ ID NO: 7312628 - DNA, 22 bp, Homo sapiens
ttgtgtctgggggagtgacatc

SEQ ID NO: 7312629 - DNA, 22 bp, Homo sapiens
ttgtgtctggatttcagctttc

SEQ ID NO: 7312630 - DNA, 22 bp, Homo sapiens
ttgtgtctaaataaggagacct

SEQ ID NO: 7312631 - DNA, 22 bp, Homo sapiens
ttgtaaacatctgttgcttaga

SEQ ID NO: 7312632 - DNA, 22 bp, Homo sapiens
ttgtaaagtacttagcacagca

SEQ ID NO: 7312633 - DNA, 21 bp, Homo sapiens
ttgtaaaggtttagaagaatg

SEQ ID NO: 7312634 - DNA, 22 bp, Homo sapiens
ttgtaaaggctgttattgactt

SEQ ID NO: 7312635 - DNA, 22 bp, Homo sapiens
ttgtaaaggctgttattgactt

SEQ ID NO: 7312636 - DNA, 22 bp, Homo sapiens
ttgtaaagggcatttgcacagt

SEQ ID NO: 7312637 - DNA, 22 bp, Homo sapiens
ttgtaaagctttgagactacat

SEQ ID NO: 7312638 - DNA, 22 bp, Homo sapiens
ttgtaaagctgattagaaagcc

SEQ ID NO: 7312639 - DNA, 22 bp, Homo sapiens
ttgtaagactgtagaatgcaaa

SEQ ID NO: 7312640 - DNA, 22 bp, Homo sapiens
ttgtaagagagaattgcaaatt

SEQ ID NO: 7312641 - DNA, 22 bp, Homo sapiens
ttgtaagaatatgaatacaaat

SEQ ID NO: 7312642 - DNA, 22 bp, Homo sapiens
ttgtaactctgaatacatccta

SEQ ID NO: 7312643 - DNA, 22 bp, Homo sapiens
ttgtaacagctgtttatatagt

SEQ ID NO: 7312644 - DNA, 22 bp, Homo sapiens
ttgtaacactcccactcttctt

SEQ ID NO: 7312645 - DNA, 22 bp, Homo sapiens
ttgtaacaaagacactccaaaa

SEQ ID NO: 7312646 - DNA, 22 bp, Homo sapiens
ttgtacagaaactgcatttgga

SEQ ID NO: 7312647 - DNA, 22 bp, Homo sapiens
ttgtacaagtattatgtgaaca

SEQ ID NO: 7312648 - DNA, 22 bp, Homo sapiens
ttgtaagggttacaagaaaaca

SEQ ID NO: 7312649 - DNA, 22 bp, Homo sapiens
ttgtaagatggataggaacagc

SEQ ID NO: 7312650 - DNA, 22 bp, Homo sapiens
ttgtacagtttaagtgggtgaa

SEQ ID NO: 7312651 - DNA, 22 bp, Homo sapiens
ttgtacagggaagtaatacaag

SEQ ID NO: 7312652 - DNA, 23 bp, Homo sapiens
ttgtacagcccagattcctcttc

SEQ ID NO: 7312653 - DNA, 22 bp, Homo sapiens
ttgtatttctccactttctgtt

SEQ ID NO: 7312654 - DNA, 22 bp, Homo sapiens
ttgggaaggcgtggaagcagaa

SEQ ID NO: 7312655 - DNA, 22 bp, Homo sapiens
ttggagatatcacaccttcaca

SEQ ID NO: 7312656 - DNA, 22 bp, Homo sapiens
ttggaaagaagggctgagcaag

SEQ ID NO: 7312657 - DNA, 22 bp, Homo sapiens
ttggaaacgtcaccttttcctt

SEQ ID NO: 7312658 - DNA, 21 bp, Homo sapiens
ttggacactccctgtgctgtg

SEQ ID NO: 7312659 - DNA, 22 bp, Homo sapiens
ttggaaatgcatttgttattat

SEQ ID NO: 7312660 - DNA, 22 bp, Homo sapiens
ttgctctgaaccacaccatcac

SEQ ID NO: 7312661 - DNA, 22 bp, Homo sapiens
ttgctctatgtttgtaaacaga

SEQ ID NO: 7312662 - DNA, 22 bp, Homo sapiens
ttgcatttatagactgccattt

SEQ ID NO: 7312663 - DNA, 22 bp, Homo sapiens
ttgctctgtccagccagcaggt

SEQ ID NO: 7312664 - DNA, 22 bp, Homo sapiens
ttgctctgactggagtgcagtg

SEQ ID NO: 7312665 - DNA, 22 bp, Homo sapiens
ttgctctgcagtccagacagta

SEQ ID NO: 7312666 - DNA, 22 bp, Homo sapiens
ttgctctgtaataatctggggt

SEQ ID NO: 7312667 - DNA, 22 bp, Homo sapiens
ttgcattctgttaaaatgtatt

SEQ ID NO: 7312668 - DNA, 22 bp, Homo sapiens
ttgcatgtgtaatttttctaaa

SEQ ID NO: 7312669 - DNA, 22 bp, Homo sapiens
ttgcatgtggtaggtcgttcta

SEQ ID NO: 7312670 - DNA, 22 bp, Homo sapiens
ttgcatgtgtaaggttgtttat

SEQ ID NO: 7312671 - DNA, 22 bp, Homo sapiens
ttgcatgtgactctatttatgc

SEQ ID NO: 7312672 - DNA, 22 bp, Homo sapiens
ttgcatgtcttgcggatgccag

SEQ ID NO: 7312673 - DNA, 22 bp, Homo sapiens
ttgcatgtgccagtggcatgtc

SEQ ID NO: 7312674 - DNA, 22 bp, Homo sapiens
ttgcatgtgtataaaagttgga

SEQ ID NO: 7312675 - DNA, 22 bp, Homo sapiens
ttgcatgtgtgcatatatttgc

SEQ ID NO: 7312676 - DNA, 22 bp, Homo sapiens
ttgcatgttatttaatctgtat

SEQ ID NO: 7312677 - DNA, 22 bp, Homo sapiens
ttgcatgttccaaagaattttg

SEQ ID NO: 7312678 - DNA, 22 bp, Homo sapiens
ttgcatgttgggctcatcctct

SEQ ID NO: 7312679 - DNA, 22 bp, Homo sapiens
ttgcatgttgtttaatttcgag

SEQ ID NO: 7312680 - DNA, 22 bp, Homo sapiens
ttgcatgtttttgtaatacacc

SEQ ID NO: 7312681 - DNA, 22 bp, Homo sapiens
ttgctgttttacttacaagctc

SEQ ID NO: 7312682 - DNA, 21 bp, Homo sapiens
ttgctgttttcccaatgcagt

SEQ ID NO: 7312683 - DNA, 22 bp, Homo sapiens
ttgcttatgcctcttgacaaag

SEQ ID NO: 7312684 - DNA, 22 bp, Homo sapiens
ttgctgttacaattatttaccc

SEQ ID NO: 7312685 - DNA, 22 bp, Homo sapiens
ttgctgttgatgatgtgataca

SEQ ID NO: 7312686 - DNA, 22 bp, Homo sapiens
ttgctgacctttgctctccgtt

SEQ ID NO: 7312687 - DNA, 22 bp, Homo sapiens
ttgctgaattgaatcctttggt

SEQ ID NO: 7312688 - DNA, 22 bp, Homo sapiens
ttgctgaagaaaaaatatgtta

SEQ ID NO: 7312689 - DNA, 22 bp, Homo sapiens
ttgctgaaaagctggcctttgt

SEQ ID NO: 7312690 - DNA, 22 bp, Homo sapiens
ttgcacaaaaaattgttgaata

SEQ ID NO: 7312691 - DNA, 22 bp, Homo sapiens
ttgcaattgctatggagagcgt

SEQ ID NO: 7312692 - DNA, 22 bp, Homo sapiens
ttgacagagctaggtcaactct

SEQ ID NO: 7312693 - DNA, 22 bp, Homo sapiens
ttgacaatgcactgtgctaagt

SEQ ID NO: 7312694 - DNA, 22 bp, Homo sapiens
ttgacaattgggagatataaag

SEQ ID NO: 7312695 - DNA, 22 bp, Homo sapiens
ttgacaatccctgttagaagtg

SEQ ID NO: 7312696 - DNA, 22 bp, Homo sapiens
ttgacaaagtttagtaataatc

SEQ ID NO: 7312697 - DNA, 22 bp, Homo sapiens
ttgacaaaggaccttgctattt

SEQ ID NO: 7312698 - DNA, 22 bp, Homo sapiens
ttgcatgtagaatactcaactt

SEQ ID NO: 7312699 - DNA, 23 bp, Homo sapiens
ttgcatgtagcccatgagtaact

SEQ ID NO: 7312700 - DNA, 22 bp, Homo sapiens
ttgcatgtatgtgatctgttca

SEQ ID NO: 7312701 - DNA, 22 bp, Homo sapiens
ttgcatgtccagggtattgtgg

SEQ ID NO: 7312702 - DNA, 22 bp, Homo sapiens
ttgcatgtcctacatctgtgtc

SEQ ID NO: 7312703 - DNA, 22 bp, Homo sapiens
ttgcatgtacgtacagagagag

SEQ ID NO: 7312704 - DNA, 22 bp, Homo sapiens
ttgcatgtctgcttctcctcct

SEQ ID NO: 7312705 - DNA, 22 bp, Homo sapiens
ttgcaggacaatgatggtccct

SEQ ID NO: 7312706 - DNA, 22 bp, Homo sapiens
tttaatctattccctaaacacc

SEQ ID NO: 7312707 - DNA, 22 bp, Homo sapiens
tttaaggatgtaaaggaagaag

SEQ ID NO: 7312708 - DNA, 19 bp, Homo sapiens
tttaagcaatagtatcttg

SEQ ID NO: 7312709 - DNA, 19 bp, Homo sapiens
tttaagcaatagtatcttg

SEQ ID NO: 7312710 - DNA, 22 bp, Homo sapiens
tttaagcacagggataaagtta

SEQ ID NO: 7312711 - DNA, 22 bp, Homo sapiens
tttaagcagagaaatgatgtat

SEQ ID NO: 7312712 - DNA, 22 bp, Homo sapiens
tttaaggaggggctcacgtggg

SEQ ID NO: 7312713 - DNA, 22 bp, Homo sapiens
tttaatgtagcgtgaaatgatt

SEQ ID NO: 7312714 - DNA, 22 bp, Homo sapiens
tttaatgtagcgtgaaatgatt

SEQ ID NO: 7312715 - DNA, 22 bp, Homo sapiens
tttacagcttctatactatgtg

SEQ ID NO: 7312716 - DNA, 22 bp, Homo sapiens
tttaatgtattctttggaacca

SEQ ID NO: 7312717 - DNA, 22 bp, Homo sapiens
ttgtgtgtagactcagccattg

SEQ ID NO: 7312718 - DNA, 17 bp, Homo sapiens
ttgtgtgtagttctgat

SEQ ID NO: 7312719 - DNA, 17 bp, Homo sapiens
ttgtgtgtagttctgat

SEQ ID NO: 7312720 - DNA, 17 bp, Homo sapiens
ttgtgtgtagttctgat

SEQ ID NO: 7312721 - DNA, 17 bp, Homo sapiens
ttgtgtgtagttctgat

SEQ ID NO: 7312722 - DNA, 22 bp, Homo sapiens
ttgtgtgctgagggcctgctgt

SEQ ID NO: 7312723 - DNA, 22 bp, Homo sapiens
ttgtgtgcataaattctgatgt

SEQ ID NO: 7312724 - DNA, 22 bp, Homo sapiens
ttgtgtgtactggttatgggca

SEQ ID NO: 7312725 - DNA, 22 bp, Homo sapiens
ttgtgtgctgagggcctgctgt

SEQ ID NO: 7312726 - DNA, 22 bp, Homo sapiens
ttgtgtgcataaattctgatgt

SEQ ID NO: 7312727 - DNA, 22 bp, Homo sapiens
ttgtgtgtactggttatgggca

SEQ ID NO: 7312728 - DNA, 22 bp, Homo sapiens
ttgtgtgtactggttatgggca

SEQ ID NO: 7312729 - DNA, 22 bp, Homo sapiens
ttgtgtgtagactcagccattg

SEQ ID NO: 7312730 - DNA, 22 bp, Homo sapiens
ttgtgtgtagactcagccattg

SEQ ID NO: 7312731 - DNA, 22 bp, Homo sapiens
tttaaactaacagtacacgttg

SEQ ID NO: 7312732 - DNA, 22 bp, Homo sapiens
tttaaactgttgattttatgaa

SEQ ID NO: 7312733 - DNA, 22 bp, Homo sapiens
tttaaagagaatgtgaaggagt

SEQ ID NO: 7312734 - DNA, 21 bp, Homo sapiens
tttaaagaataggaagggagg

SEQ ID NO: 7312735 - DNA, 22 bp, Homo sapiens
tttaaagaaattcctcatcttt

SEQ ID NO: 7312736 - DNA, 22 bp, Homo sapiens
tttaaataggactcctgggggt

SEQ ID NO: 7312737 - DNA, 22 bp, Homo sapiens
tttaaagtttttgcacattctg

SEQ ID NO: 7312738 - DNA, 22 bp, Homo sapiens
tttaaagtgctgctcctatcct

SEQ ID NO: 7312739 - DNA, 19 bp, Homo sapiens
tttaaagtgactggtattt

SEQ ID NO: 7312740 - DNA, 22 bp, Homo sapiens
tttaaagtggtccatttcagaa

SEQ ID NO: 7312741 - DNA, 22 bp, Homo sapiens
tttaaatgtgttcttagtagct

SEQ ID NO: 7312742 - DNA, 22 bp, Homo sapiens
tttaaatgttcatgatactgaa

SEQ ID NO: 7312743 - DNA, 22 bp, Homo sapiens
tttaaatgttcatgatactgaa

SEQ ID NO: 7312744 - DNA, 22 bp, Homo sapiens
tttaaatgtttaaaactcgtga

SEQ ID NO: 7312745 - DNA, 22 bp, Homo sapiens
tttatcagaggctatgtttcat

SEQ ID NO: 7312746 - DNA, 20 bp, Homo sapiens
tttatcaggcacttactatt

SEQ ID NO: 7312747 - DNA, 22 bp, Homo sapiens
tttagcatccaaggttatgact

SEQ ID NO: 7312748 - DNA, 22 bp, Homo sapiens
tttatatagagatttgtgcatg

SEQ ID NO: 7312749 - DNA, 22 bp, Homo sapiens
tttagcatatcctataaaacta

SEQ ID NO: 7312750 - DNA, 22 bp, Homo sapiens
tttagcagatctatgtatgtga

SEQ ID NO: 7312751 - DNA, 22 bp, Homo sapiens
tttagcagcaaataagtagtgc

SEQ ID NO: 7312752 - DNA, 21 bp, Homo sapiens
tttagagaatactcactattt

SEQ ID NO: 7312753 - DNA, 22 bp, Homo sapiens
tttagagaccctctgctatttt

SEQ ID NO: 7312754 - DNA, 22 bp, Homo sapiens
tttagagacacactggcatttg

SEQ ID NO: 7312755 - DNA, 22 bp, Homo sapiens
tttagagagtgtaaaaatatat

SEQ ID NO: 7312756 - DNA, 22 bp, Homo sapiens
tttagaggtctgtttcacatca

SEQ ID NO: 7312757 - DNA, 22 bp, Homo sapiens
tttagaagttcacacatttaaa

SEQ ID NO: 7312758 - DNA, 22 bp, Homo sapiens
tttaccaaggcatagtaatctc

SEQ ID NO: 7312759 - DNA, 22 bp, Homo sapiens
tttacagtctgtctagcaatgt

SEQ ID NO: 7312760 - DNA, 20 bp, Homo sapiens
tttacattttgaaacagtga

SEQ ID NO: 7312761 - DNA, 20 bp, Homo sapiens
tttacattttgaaacagtga

SEQ ID NO: 7312762 - DNA, 22 bp, Homo sapiens
tttcagagcctttatctctcta

SEQ ID NO: 7312763 - DNA, 22 bp, Homo sapiens
tttcagactgctgtgtgaaact

SEQ ID NO: 7312764 - DNA, 22 bp, Homo sapiens
tttcagaaagctgaacatatga

SEQ ID NO: 7312765 - DNA, 22 bp, Homo sapiens
tttcagaaatggcactgaaatc

SEQ ID NO: 7312766 - DNA, 22 bp, Homo sapiens
tttcagaaagcatcatcaaagt

SEQ ID NO: 7312767 - DNA, 22 bp, Homo sapiens
tttcacatttgttttaagaagt

SEQ ID NO: 7312768 - DNA, 22 bp, Homo sapiens
tttcacattttatacttaagcc

SEQ ID NO: 7312769 - DNA, 22 bp, Homo sapiens
tttcactcagctctcattgtct

SEQ ID NO: 7312770 - DNA, 22 bp, Homo sapiens
tttcagaaaacttatcatcagt

SEQ ID NO: 7312771 - DNA, 22 bp, Homo sapiens
tttcacagcatataggtgtact

SEQ ID NO: 7312772 - DNA, 22 bp, Homo sapiens
tttcacagctgatacctcttcc

SEQ ID NO: 7312773 - DNA, 22 bp, Homo sapiens
tttcacagctgggaagagatat

SEQ ID NO: 7312774 - DNA, 22 bp, Homo sapiens
tttcacagcgtctttctcttgc

SEQ ID NO: 7312775 - DNA, 21 bp, Homo sapiens
tttcattgaatgagataaggt

SEQ ID NO: 7312776 - DNA, 22 bp, Homo sapiens
tttcattgagaatataagattt

SEQ ID NO: 7312777 - DNA, 22 bp, Homo sapiens
tttcattgagactatagacatc

SEQ ID NO: 7312778 - DNA, 22 bp, Homo sapiens
tttcattatacagcttcataaa

SEQ ID NO: 7312779 - DNA, 22 bp, Homo sapiens
tttcattgaactaaagaatctg

SEQ ID NO: 7312780 - DNA, 22 bp, Homo sapiens
tttcatgaggggcaaaatctca

SEQ ID NO: 7312781 - DNA, 22 bp, Homo sapiens
tttcatggctaggactagagtg

SEQ ID NO: 7312782 - DNA, 22 bp, Homo sapiens
tttcatgcctggaattgccctt

SEQ ID NO: 7312783 - DNA, 22 bp, Homo sapiens
tttcatgtacttttttgataga

SEQ ID NO: 7312784 - DNA, 22 bp, Homo sapiens
tttcacagaactcactaaggag

SEQ ID NO: 7312785 - DNA, 22 bp, Homo sapiens
tttcacagatgttttggagtct

SEQ ID NO: 7312786 - DNA, 20 bp, Homo sapiens
tttcacaatgaacatgtctc

SEQ ID NO: 7312787 - DNA, 20 bp, Homo sapiens
tttcacaatgaacatgtctc

SEQ ID NO: 7312788 - DNA, 22 bp, Homo sapiens
tttcacaatgcaatcctacttc

SEQ ID NO: 7312789 - DNA, 22 bp, Homo sapiens
tttcaagactcattgagtattg

SEQ ID NO: 7312790 - DNA, 22 bp, Homo sapiens
tttcaagactcattgagtattg

SEQ ID NO: 7312791 - DNA, 22 bp, Homo sapiens
tttcaagacgttaagtcagctt

SEQ ID NO: 7312792 - DNA, 22 bp, Homo sapiens
tttcaagagggaactgaacaca

SEQ ID NO: 7312793 - DNA, 22 bp, Homo sapiens
tttcaagaacagcagcattcca

SEQ ID NO: 7312794 - DNA, 22 bp, Homo sapiens
tttcaagaacaacattcattca

SEQ ID NO: 7312795 - DNA, 22 bp, Homo sapiens
tttattgacccaaagcgagagt

SEQ ID NO: 7312796 - DNA, 22 bp, Homo sapiens
tttcaaaggttttgtcatgtct

SEQ ID NO: 7312797 - DNA, 22 bp, Homo sapiens
tttcaaagtaaggattttcatc

SEQ ID NO: 7312798 - DNA, 22 bp, Homo sapiens
tttattctgtgctacatgaaga

SEQ ID NO: 7312799 - DNA, 22 bp, Homo sapiens
tttattctctagttggtcagat

SEQ ID NO: 7312800 - DNA, 21 bp, Homo sapiens
tttattctcagatacagggag

SEQ ID NO: 7312801 - DNA, 21 bp, Homo sapiens
tttattctcagatacagggag

SEQ ID NO: 7312802 - DNA, 22 bp, Homo sapiens
tttattctataggcattaagca

SEQ ID NO: 7312803 - DNA, 20 bp, Homo sapiens
tttattcacagagaagagtt

SEQ ID NO: 7312804 - DNA, 22 bp, Homo sapiens
ttcagttttctttagaatgtag

SEQ ID NO: 7312805 - DNA, 22 bp, Homo sapiens
ttcagttttattgtactgctat

SEQ ID NO: 7312806 - DNA, 22 bp, Homo sapiens
ttcagttttattgtactgctat

SEQ ID NO: 7312807 - DNA, 22 bp, Homo sapiens
ttcagttttctttagaatgtag

SEQ ID NO: 7312808 - DNA, 22 bp, Homo sapiens
ttcagtttgtttgactgttaga

SEQ ID NO: 7312809 - DNA, 22 bp, Homo sapiens
ttcagtttgtttgactgttaga

SEQ ID NO: 7312810 - DNA, 22 bp, Homo sapiens
ttcagtttgctacaagcaacat

SEQ ID NO: 7312811 - DNA, 22 bp, Homo sapiens
ttcagtttcaaatcctgtgaag

SEQ ID NO: 7312812 - DNA, 22 bp, Homo sapiens
ttcagtttcaaatcctggatgc

SEQ ID NO: 7312813 - DNA, 22 bp, Homo sapiens
ttcagttggccatacccctaga

SEQ ID NO: 7312814 - DNA, 22 bp, Homo sapiens
ttcagtgtggtgcacagttttg

SEQ ID NO: 7312815 - DNA, 22 bp, Homo sapiens
ttcatttattcagcaggtattt

SEQ ID NO: 7312816 - DNA, 23 bp, Homo sapiens
ttcatttaggagttcataagagc

SEQ ID NO: 7312817 - DNA, 22 bp, Homo sapiens
ttcatttaatttgtgtattaac

SEQ ID NO: 7312818 - DNA, 22 bp, Homo sapiens
ttcatttaatttgtgtattaac

SEQ ID NO: 7312819 - DNA, 22 bp, Homo sapiens
ttcatacaatgggatattatga

SEQ ID NO: 7312820 - DNA, 22 bp, Homo sapiens
ttccagttcagatgcaacaggg

SEQ ID NO: 7312821 - DNA, 22 bp, Homo sapiens
ttccagttcactccatttctgg

SEQ ID NO: 7312822 - DNA, 22 bp, Homo sapiens
ttccagttcccatgaggattaa

SEQ ID NO: 7312823 - DNA, 22 bp, Homo sapiens
ttccagttaaggaagctattct

SEQ ID NO: 7312824 - DNA, 22 bp, Homo sapiens
ttccagtgaccatagagtatgg

SEQ ID NO: 7312825 - DNA, 22 bp, Homo sapiens
ttcatttgggatgagtcagaag

SEQ ID NO: 7312826 - DNA, 20 bp, Homo sapiens
ttcatttgggaaaatctgcg

SEQ ID NO: 7312827 - DNA, 22 bp, Homo sapiens
ttcatttgggatgagtcagaag

SEQ ID NO: 7312828 - DNA, 22 bp, Homo sapiens
ttcatttgtggtgaatgaagtg

SEQ ID NO: 7312829 - DNA, 22 bp, Homo sapiens
ttcagtgtccctagtagaagtt

SEQ ID NO: 7312830 - DNA, 22 bp, Homo sapiens
ttcacagattgactggattcct

SEQ ID NO: 7312831 - DNA, 22 bp, Homo sapiens
ttcacagatttccctgcacatg

SEQ ID NO: 7312832 - DNA, 22 bp, Homo sapiens
ttcacagctaagagctaagtaa

SEQ ID NO: 7312833 - DNA, 22 bp, Homo sapiens
ttcacagctccttttactcaac

SEQ ID NO: 7312834 - DNA, 22 bp, Homo sapiens
ttcacagctccttttactcaac

SEQ ID NO: 7312835 - DNA, 19 bp, Homo sapiens
ttcacagctctgtgtcagt

SEQ ID NO: 7312836 - DNA, 19 bp, Homo sapiens
ttcacagctctgtgtcagt

SEQ ID NO: 7312837 - DNA, 22 bp, Homo sapiens
ttcacagagagtatgcagagaa

SEQ ID NO: 7312838 - DNA, 22 bp, Homo sapiens
ttcacagatgcctgatgtgtgg

SEQ ID NO: 7312839 - DNA, 22 bp, Homo sapiens
ttcacagatgcctgatgtgtgg

SEQ ID NO: 7312840 - DNA, 22 bp, Homo sapiens
ttcacagagagaactcaaacca

SEQ ID NO: 7312841 - DNA, 22 bp, Homo sapiens
ttcacaatctggcttagcattg

SEQ ID NO: 7312842 - DNA, 22 bp, Homo sapiens
ttcaaagattagcatacgcaat

SEQ ID NO: 7312843 - DNA, 22 bp, Homo sapiens
ttcaaagataatgtagcatttt

SEQ ID NO: 7312844 - DNA, 22 bp, Homo sapiens
ttcaaagataatgtagcatttt

SEQ ID NO: 7312845 - DNA, 22 bp, Homo sapiens
ttcaaagagttgggtgtctggg

SEQ ID NO: 7312846 - DNA, 22 bp, Homo sapiens
ttcaaagagaaattgtattttc

SEQ ID NO: 7312847 - DNA, 22 bp, Homo sapiens
ttcaaactgtgtaatttataaa

SEQ ID NO: 7312848 - DNA, 22 bp, Homo sapiens
ttagctttcttggagaattaca

SEQ ID NO: 7312849 - DNA, 22 bp, Homo sapiens
ttagctttggattgcatttagt

SEQ ID NO: 7312850 - DNA, 22 bp, Homo sapiens
ttatacatgtgttttgagatga

SEQ ID NO: 7312851 - DNA, 22 bp, Homo sapiens
ttatacatgtttataaggttga

SEQ ID NO: 7312852 - DNA, 22 bp, Homo sapiens
ttatagttatgaaagactgagg

SEQ ID NO: 7312853 - DNA, 22 bp, Homo sapiens
ttatatactgtggtagtactgt

SEQ ID NO: 7312854 - DNA, 22 bp, Homo sapiens
ttatatactgtggtagtactgt

SEQ ID NO: 7312855 - DNA, 22 bp, Homo sapiens
ttatagttagtaggtcattaaa

SEQ ID NO: 7312856 - DNA, 22 bp, Homo sapiens
tcctgctgctacctggcccacg

SEQ ID NO: 7312857 - DNA, 22 bp, Homo sapiens
ttattaatacatgcacctgcat

SEQ ID NO: 7312858 - DNA, 22 bp, Homo sapiens
ttattaagtgcctacaataaag

SEQ ID NO: 7312859 - DNA, 22 bp, Homo sapiens
ttatatatatgtagaggtcacg

SEQ ID NO: 7312860 - DNA, 22 bp, Homo sapiens
ttatatatatgtagaggtcacg

SEQ ID NO: 7312861 - DNA, 22 bp, Homo sapiens
ttatatatcttgatttgttcca

SEQ ID NO: 7312862 - DNA, 22 bp, Homo sapiens
ttatatatcttgatttgttcca

SEQ ID NO: 7312863 - DNA, 22 bp, Homo sapiens
ttattatggtatttctttgcag

SEQ ID NO: 7312864 - DNA, 22 bp, Homo sapiens
ttattgtggactactgttctgg

SEQ ID NO: 7312865 - DNA, 22 bp, Homo sapiens
ttattgtgaggaataagtgaga

SEQ ID NO: 7312866 - DNA, 22 bp, Homo sapiens
ttcaaactagttaaaagtcaga

SEQ ID NO: 7312867 - DNA, 22 bp, Homo sapiens
ttcaaactatgacttcagctac

SEQ ID NO: 7312868 - DNA, 22 bp, Homo sapiens
ttattggattcttgccccaggt

SEQ ID NO: 7312869 - DNA, 22 bp, Homo sapiens
ttctgtgtcttcttgttctgtg

SEQ ID NO: 7312870 - DNA, 22 bp, Homo sapiens
ttctgtgtgccagagttgtgct

SEQ ID NO: 7312871 - DNA, 22 bp, Homo sapiens
ttctgtgcccattttaaaatgg

SEQ ID NO: 7312872 - DNA, 22 bp, Homo sapiens
ttctgtgaatcttttttcccac

SEQ ID NO: 7312873 - DNA, 22 bp, Homo sapiens
ttctgtgttgtgacattctaga

SEQ ID NO: 7312874 - DNA, 22 bp, Homo sapiens
ttctgtgttgtgacattctaga

SEQ ID NO: 7312875 - DNA, 22 bp, Homo sapiens
ttctgtgtgcttactggtgttc

SEQ ID NO: 7312876 - DNA, 19 bp, Homo sapiens
ttctgtgttaattccttta

SEQ ID NO: 7312877 - DNA, 22 bp, Homo sapiens
ttctggaagttttctcctgtgg

SEQ ID NO: 7312878 - DNA, 22 bp, Homo sapiens
ttctggaatcctcaaaacatga

SEQ ID NO: 7312879 - DNA, 22 bp, Homo sapiens
ttctggagccgggcctgggcag

SEQ ID NO: 7312880 - DNA, 22 bp, Homo sapiens
ttctttggtgttacccagctca

SEQ ID NO: 7312881 - DNA, 22 bp, Homo sapiens
ttcttttaatgtctggctttca

SEQ ID NO: 7312882 - DNA, 22 bp, Homo sapiens
ttcttttaatgtctggctttca

SEQ ID NO: 7312883 - DNA, 22 bp, Homo sapiens
ttcttttaatagagatcctgtg

SEQ ID NO: 7312884 - DNA, 22 bp, Homo sapiens
ttcttttaaaagagagcagaaa

SEQ ID NO: 7312885 - DNA, 22 bp, Homo sapiens
ttcttttaaaagagagcagaaa

SEQ ID NO: 7312886 - DNA, 22 bp, Homo sapiens
ttcttttaatgttctgaagttt

SEQ ID NO: 7312887 - DNA, 22 bp, Homo sapiens
ttcttttaatgttctgaagttt

SEQ ID NO: 7312888 - DNA, 17 bp, Homo sapiens
ttcttttctgagccttg

SEQ ID NO: 7312889 - DNA, 22 bp, Homo sapiens
ttcttattgggagaccttttct

SEQ ID NO: 7312890 - DNA, 22 bp, Homo sapiens
ttcttattatgtgctctgtgaa

SEQ ID NO: 7312891 - DNA, 22 bp, Homo sapiens
ttcttcaacaaggacactgtta

SEQ ID NO: 7312892 - DNA, 19 bp, Homo sapiens
ttctttggtggtggtgacc

SEQ ID NO: 7312893 - DNA, 20 bp, Homo sapiens
ttgaaattggatggtagcta

SEQ ID NO: 7312894 - DNA, 20 bp, Homo sapiens
ttgaaattggatggtagcta

SEQ ID NO: 7312895 - DNA, 19 bp, Homo sapiens
ttgaaattgtttgatatgg

SEQ ID NO: 7312896 - DNA, 22 bp, Homo sapiens
ttgaaattttaggccttgcaat

SEQ ID NO: 7312897 - DNA, 22 bp, Homo sapiens
ttgaaatcaccactagcatttg

SEQ ID NO: 7312898 - DNA, 22 bp, Homo sapiens
ttgaaatcaccactagcatttg

SEQ ID NO: 7312899 - DNA, 22 bp, Homo sapiens
ttgaaatccaattatcatatgt

SEQ ID NO: 7312900 - DNA, 22 bp, Homo sapiens
ttgaaatatttgggagtgtttg

SEQ ID NO: 7312901 - DNA, 22 bp, Homo sapiens
ttgaaatatggattgaccttga

SEQ ID NO: 7312902 - DNA, 22 bp, Homo sapiens
ttctttttaaagtgtgtatgca

SEQ ID NO: 7312903 - DNA, 22 bp, Homo sapiens
ttcttttctttaggcattgtgt

SEQ ID NO: 7312904 - DNA, 22 bp, Homo sapiens
ttcttttggactcaaagagaac

SEQ ID NO: 7312905 - DNA, 19 bp, Homo sapiens
ttccagttctaatctcttc

SEQ ID NO: 7312906 - DNA, 22 bp, Homo sapiens
ttccagttcttctgtaagcact

SEQ ID NO: 7312907 - DNA, 22 bp, Homo sapiens
ttccagttggcactgcaattta

SEQ ID NO: 7312908 - DNA, 22 bp, Homo sapiens
ttccagtttgcagttgacacta

SEQ ID NO: 7312909 - DNA, 17 bp, Homo sapiens
ttccagtttagtattgt

SEQ ID NO: 7312910 - DNA, 22 bp, Homo sapiens
ttcctgccctgcctgtgccact

SEQ ID NO: 7312911 - DNA, 22 bp, Homo sapiens
ttcctgctccatttgctgagct

SEQ ID NO: 7312912 - DNA, 22 bp, Homo sapiens
ttccttcttgtaatgatctgcc

SEQ ID NO: 7312913 - DNA, 22 bp, Homo sapiens
ttccttcttccagaggctgccc

SEQ ID NO: 7312914 - DNA, 22 bp, Homo sapiens
ttccttgattagtacatgaagg

SEQ ID NO: 7312915 - DNA, 22 bp, Homo sapiens
ttccttgaaagctggacatggg

SEQ ID NO: 7312916 - DNA, 22 bp, Homo sapiens
ttccttgaccactgcataatga

SEQ ID NO: 7312917 - DNA, 22 bp, Homo sapiens
ttccttgagaaaggcacaagtt

SEQ ID NO: 7312918 - DNA, 18 bp, Homo sapiens
ttccttgattagagagaa

SEQ ID NO: 7312919 - DNA, 22 bp, Homo sapiens
ttcctgggtggtcctggtagag

SEQ ID NO: 7312920 - DNA, 22 bp, Homo sapiens
ttctctaagagttatatgaatt

SEQ ID NO: 7312921 - DNA, 22 bp, Homo sapiens
ttctccagaccactgcctctgt

SEQ ID NO: 7312922 - DNA, 22 bp, Homo sapiens
ttctccagaccctcctgcagac

SEQ ID NO: 7312923 - DNA, 22 bp, Homo sapiens
ttctccagaccttgtgactatg

SEQ ID NO: 7312924 - DNA, 22 bp, Homo sapiens
ttctccagacaacagagggtga

SEQ ID NO: 7312925 - DNA, 22 bp, Homo sapiens
ttccttgttaatagtgtctgga

SEQ ID NO: 7312926 - DNA, 22 bp, Homo sapiens
ttccttgtaagacctatttttg

SEQ ID NO: 7312927 - DNA, 22 bp, Homo sapiens
ttctctaagctggctgaggtct

SEQ ID NO: 7312928 - DNA, 22 bp, Homo sapiens
ttctctacttgagattttaatg

SEQ ID NO: 7312929 - DNA, 22 bp, Homo sapiens
ttctctcccatgaagcttctat

SEQ ID NO: 7312930 - DNA, 22 bp, Homo sapiens
ttctctctggacctgggatgcg

SEQ ID NO: 7312931 - DNA, 22 bp, Homo sapiens
actgtctaatcagattcacttg

SEQ ID NO: 7312932 - DNA, 22 bp, Homo sapiens
actgtctgagtcaggagtcaca

SEQ ID NO: 7312933 - DNA, 22 bp, Homo sapiens
aatagaatttaaatgcagtggc

SEQ ID NO: 7312934 - DNA, 22 bp, Homo sapiens
aatagaatgtaatctaatacat

SEQ ID NO: 7312935 - DNA, 22 bp, Homo sapiens
actggggagtggttttgggaag

SEQ ID NO: 7312936 - DNA, 22 bp, Homo sapiens
aagtttttggtagagaaaagta

SEQ ID NO: 7312937 - DNA, 19 bp, Homo sapiens
aataagcttgggtaaaact

SEQ ID NO: 7312938 - DNA, 22 bp, Homo sapiens
aataagttgcctgttgaatcat

SEQ ID NO: 7312939 - DNA, 22 bp, Homo sapiens
actggggagagtcatgccagca

SEQ ID NO: 7312940 - DNA, 22 bp, Homo sapiens
actggggactctggccttttga

SEQ ID NO: 7312941 - DNA, 22 bp, Homo sapiens
actggggaatggaactgggaat

SEQ ID NO: 7312942 - DNA, 22 bp, Homo sapiens
actggggaatggaactgggaat

SEQ ID NO: 7312943 - DNA, 22 bp, Homo sapiens
actgcagcctttgggctcataa

SEQ ID NO: 7312944 - DNA, 22 bp, Homo sapiens
actgcagctggtggtggctctg

SEQ ID NO: 7312945 - DNA, 18 bp, Homo sapiens
aagttccacaagagatct

SEQ ID NO: 7312946 - DNA, 22 bp, Homo sapiens
aagttcagcctggttttaatgc

SEQ ID NO: 7312947 - DNA, 22 bp, Homo sapiens
aagttcactaagaccatagaat

SEQ ID NO: 7312948 - DNA, 18 bp, Homo sapiens
actctttctgcccacagg

SEQ ID NO: 7312949 - DNA, 18 bp, Homo sapiens
actctttctgcccacagg

SEQ ID NO: 7312950 - DNA, 22 bp, Homo sapiens
actgaaaaagacatcttggtaa

SEQ ID NO: 7312951 - DNA, 22 bp, Homo sapiens
actgaaaaagtatgattcactg

SEQ ID NO: 7312952 - DNA, 22 bp, Homo sapiens
actgaaaatgaattagaaacag

SEQ ID NO: 7312953 - DNA, 22 bp, Homo sapiens
acctgcctcagtgcagctggat

SEQ ID NO: 7312954 - DNA, 22 bp, Homo sapiens
aagtgtcttaactccttttggg

SEQ ID NO: 7312955 - DNA, 22 bp, Homo sapiens
actcttcttgctgctcattaat

SEQ ID NO: 7312956 - DNA, 22 bp, Homo sapiens
actcttcttgctgctcattaat

SEQ ID NO: 7312957 - DNA, 16 bp, Homo sapiens
actcttcatttagggt

SEQ ID NO: 7312958 - DNA, 22 bp, Homo sapiens
actcttggtcagaacaattcag

SEQ ID NO: 7312959 - DNA, 22 bp, Homo sapiens
aagtgtttacttaaagtcatgg

SEQ ID NO: 7312960 - DNA, 22 bp, Homo sapiens
aagtgtttatggttattgttaa

SEQ ID NO: 7312961 - DNA, 22 bp, Homo sapiens
aagtgtttaaattatttgcagg

SEQ ID NO: 7312962 - DNA, 22 bp, Homo sapiens
aagtgtttaatggttttgatga

SEQ ID NO: 7312963 - DNA, 22 bp, Homo sapiens
agaagcagctttcaaggtgatt

SEQ ID NO: 7312964 - DNA, 22 bp, Homo sapiens
agaagcagctttcaaggtgatt

SEQ ID NO: 7312965 - DNA, 22 bp, Homo sapiens
aatgaagattatggtgattaag

SEQ ID NO: 7312966 - DNA, 22 bp, Homo sapiens
agaacacactgggggaaacaag

SEQ ID NO: 7312967 - DNA, 21 bp, Homo sapiens
agaactgattaaataagcagt

SEQ ID NO: 7312968 - DNA, 22 bp, Homo sapiens
agaactctttatctgtggaatg

SEQ ID NO: 7312969 - DNA, 22 bp, Homo sapiens
agaactgtcacgagtgacaaag

SEQ ID NO: 7312970 - DNA, 22 bp, Homo sapiens
agaagaaagattgaaggttcct

SEQ ID NO: 7312971 - DNA, 22 bp, Homo sapiens
aatgaagaaatggacatcttta

SEQ ID NO: 7312972 - DNA, 22 bp, Homo sapiens
agaagaaactgtcggggatatt

SEQ ID NO: 7312973 - DNA, 22 bp, Homo sapiens
agaagaaagattgaaggttcct

SEQ ID NO: 7312974 - DNA, 22 bp, Homo sapiens
agaacttttggagacttttagt

SEQ ID NO: 7312975 - DNA, 22 bp, Homo sapiens
aatgccattttctataaaaaga

SEQ ID NO: 7312976 - DNA, 22 bp, Homo sapiens
aatgccttcaagtatctgagga

SEQ ID NO: 7312977 - DNA, 22 bp, Homo sapiens
aatgccatcagagaaaactctt

SEQ ID NO: 7312978 - DNA, 22 bp, Homo sapiens
agaagccagccttgcctccttt

SEQ ID NO: 7312979 - DNA, 22 bp, Homo sapiens
agaagccagtcgctctcccgca

SEQ ID NO: 7312980 - DNA, 22 bp, Homo sapiens
agaaggaaaacctgtcttatgt

SEQ ID NO: 7312981 - DNA, 22 bp, Homo sapiens
agaaggaagccaggagggtgca

SEQ ID NO: 7312982 - DNA, 22 bp, Homo sapiens
agaaggaagccaggagggtgca

SEQ ID NO: 7312983 - DNA, 22 bp, Homo sapiens
agaaggaaggaagcattctgtt

SEQ ID NO: 7312984 - DNA, 22 bp, Homo sapiens
agaaggaaggctgagtgctgat

SEQ ID NO: 7312985 - DNA, 22 bp, Homo sapiens
agaaggaaggctgagtgctgat

SEQ ID NO: 7312986 - DNA, 22 bp, Homo sapiens
aatctacatagagatcaaatga

SEQ ID NO: 7312987 - DNA, 22 bp, Homo sapiens
agaaagggatgaggtagctgct

SEQ ID NO: 7312988 - DNA, 22 bp, Homo sapiens
agaaagggagcgtggatcaatt

SEQ ID NO: 7312989 - DNA, 22 bp, Homo sapiens
agaaagggatgaggtagctgct

SEQ ID NO: 7312990 - DNA, 22 bp, Homo sapiens
agaaagggaactggcaaagcca

SEQ ID NO: 7312991 - DNA, 22 bp, Homo sapiens
aatcacatctcattcaacagcc

SEQ ID NO: 7312992 - DNA, 22 bp, Homo sapiens
agaaactgaattatttctgagg

SEQ ID NO: 7312993 - DNA, 22 bp, Homo sapiens
agaaaggaagggaggagtttat

SEQ ID NO: 7312994 - DNA, 22 bp, Homo sapiens
agaaaggacatctccctttaag

SEQ ID NO: 7312995 - DNA, 22 bp, Homo sapiens
agaaaggacatctccctttaag

SEQ ID NO: 7312996 - DNA, 22 bp, Homo sapiens
agaaaggagaccagctctgccc

SEQ ID NO: 7312997 - DNA, 22 bp, Homo sapiens
agaaaggagcaccgtgggggat

SEQ ID NO: 7312998 - DNA, 22 bp, Homo sapiens
agaaaggaggaagaatgacctc

SEQ ID NO: 7312999 - DNA, 22 bp, Homo sapiens
agaaaggattagtttggtataa

SEQ ID NO: 7313000 - DNA, 22 bp, Homo sapiens
aatcacatcactgagaatgagg

SEQ ID NO: 7313001 - DNA, 22 bp, Homo sapiens
aatagcatcttctgagacaaag

SEQ ID NO: 7313002 - DNA, 22 bp, Homo sapiens
aatagcatgttaataaccagag

SEQ ID NO: 7313003 - DNA, 22 bp, Homo sapiens
aatagcatgttcatgataaaat

SEQ ID NO: 7313004 - DNA, 22 bp, Homo sapiens
aatagctgattaatgtactacc

SEQ ID NO: 7313005 - DNA, 22 bp, Homo sapiens
actttgaaggggaacattttaa

SEQ ID NO: 7313006 - DNA, 22 bp, Homo sapiens
actttgttgaagaatatgttag

SEQ ID NO: 7313007 - DNA, 22 bp, Homo sapiens
acttttaaatgagtttcagttg

SEQ ID NO: 7313008 - DNA, 22 bp, Homo sapiens
acttttaaatgagtttcagttg

SEQ ID NO: 7313009 - DNA, 22 bp, Homo sapiens
actttgttgttccttgtctaaa

SEQ ID NO: 7313010 - DNA, 22 bp, Homo sapiens
actttgtttccatatttgtagc

SEQ ID NO: 7313011 - DNA, 22 bp, Homo sapiens
aatcaatgttagtcatgaattt

SEQ ID NO: 7313012 - DNA, 22 bp, Homo sapiens
acttttatcaaggaagtgatct

SEQ ID NO: 7313013 - DNA, 22 bp, Homo sapiens
acttttaaggggccttgattta

SEQ ID NO: 7313014 - DNA, 22 bp, Homo sapiens
acttttaaggggccttgattta

SEQ ID NO: 7313015 - DNA, 22 bp, Homo sapiens
acttttaaggggccttgattta

SEQ ID NO: 7313016 - DNA, 22 bp, Homo sapiens
aagggcagaaagggacgctttg

SEQ ID NO: 7313017 - DNA, 20 bp, Homo sapiens
aagggagaataatgattgta

SEQ ID NO: 7313018 - DNA, 22 bp, Homo sapiens
acatttcagattcatgaagtga

SEQ ID NO: 7313019 - DNA, 22 bp, Homo sapiens
acatttcagatgtaatgtgatg

SEQ ID NO: 7313020 - DNA, 22 bp, Homo sapiens
acatttcagcgtgcatgacatg

SEQ ID NO: 7313021 - DNA, 23 bp, Homo sapiens
acatttcatataaaagggatcag

SEQ ID NO: 7313022 - DNA, 22 bp, Homo sapiens
acatttcagtaagtgttaattt

SEQ ID NO: 7313023 - DNA, 22 bp, Homo sapiens
acatttcagtgagctattgaag

SEQ ID NO: 7313024 - DNA, 22 bp, Homo sapiens
aaggtacaaagtattatttaaa

SEQ ID NO: 7313025 - DNA, 22 bp, Homo sapiens
aaggtacaaagttatacagcgt

SEQ ID NO: 7313026 - DNA, 22 bp, Homo sapiens
accagaggcagtttcggctggt

SEQ ID NO: 7313027 - DNA, 22 bp, Homo sapiens
aagggggcggcagccagtggaa

SEQ ID NO: 7313028 - DNA, 22 bp, Homo sapiens
aaggggggcacctgcatgcccg

SEQ ID NO: 7313029 - DNA, 22 bp, Homo sapiens
aagtatatttagctgagcttgt

SEQ ID NO: 7313030 - DNA, 20 bp, Homo sapiens
aagtatatgtccgtgtactt

SEQ ID NO: 7313031 - DNA, 22 bp, Homo sapiens
aagtataagctattcttcatga

SEQ ID NO: 7313032 - DNA, 22 bp, Homo sapiens
aagtagatgatctttctgcata

SEQ ID NO: 7313033 - DNA, 22 bp, Homo sapiens
aagtagcaatctcattagttgg

SEQ ID NO: 7313034 - DNA, 18 bp, Homo sapiens
aagtccttcctttgcttt

SEQ ID NO: 7313035 - DNA, 22 bp, Homo sapiens
aagtccttgaagaaacagttct

SEQ ID NO: 7313036 - DNA, 22 bp, Homo sapiens
aagtccttctttatatgagagt

SEQ ID NO: 7313037 - DNA, 22 bp, Homo sapiens
acctcctggcttatcatggaca

SEQ ID NO: 7313038 - DNA, 22 bp, Homo sapiens
acctcctggtgcccaagtgttt

SEQ ID NO: 7313039 - DNA, 22 bp, Homo sapiens
acctcctggcctcaagcaatcc

SEQ ID NO: 7313040 - DNA, 20 bp, Homo sapiens
acctcctggcgggcatcctc

SEQ ID NO: 7313041 - DNA, 22 bp, Homo sapiens
acctcctggctgctcatggaac

SEQ ID NO: 7313042 - DNA, 21 bp, Homo sapiens
acctcctggcatcctgttccc

SEQ ID NO: 7313043 - DNA, 19 bp, Homo sapiens
acctctgagaatgccagtc

SEQ ID NO: 7313044 - DNA, 22 bp, Homo sapiens
acctctggacactgcatccttc

SEQ ID NO: 7313045 - DNA, 22 bp, Homo sapiens
acctctggcaccccctggcttg

SEQ ID NO: 7313046 - DNA, 22 bp, Homo sapiens
acccaggggcagccttgctgtg

SEQ ID NO: 7313047 - DNA, 22 bp, Homo sapiens
aaggtggttgtaggctggtctg

SEQ ID NO: 7313048 - DNA, 22 bp, Homo sapiens
aaggtggtgcttctgctcctct

SEQ ID NO: 7313049 - DNA, 22 bp, Homo sapiens
acatgcatggctgcttaaatta

SEQ ID NO: 7313050 - DNA, 22 bp, Homo sapiens
acatgcatggacatgtatatat

SEQ ID NO: 7313051 - DNA, 22 bp, Homo sapiens
acatgcatatacttaaatatgt

SEQ ID NO: 7313052 - DNA, 22 bp, Homo sapiens
acatgacagtgcttagcaaact

SEQ ID NO: 7313053 - DNA, 22 bp, Homo sapiens
acatgacagtgactttataaga

SEQ ID NO: 7313054 - DNA, 22 bp, Homo sapiens
acatgacaaggtttataaggct

SEQ ID NO: 7313055 - DNA, 22 bp, Homo sapiens
acatgaagcaagaaagatgcta

SEQ ID NO: 7313056 - DNA, 22 bp, Homo sapiens
acatgaagcaagaaagatgcta

SEQ ID NO: 7313057 - DNA, 22 bp, Homo sapiens
acatgaagtggtcagatcaaac

SEQ ID NO: 7313058 - DNA, 22 bp, Homo sapiens
acatgaatatatgaagttcaac

SEQ ID NO: 7313059 - DNA, 22 bp, Homo sapiens
acatgaacattatatcagcaag

SEQ ID NO: 7313060 - DNA, 22 bp, Homo sapiens
aaggacagaaacagattgctgg

SEQ ID NO: 7313061 - DNA, 22 bp, Homo sapiens
aaggaggccctctccttctgga

SEQ ID NO: 7313062 - DNA, 22 bp, Homo sapiens
aaggaattcaaattttctctgg

SEQ ID NO: 7313063 - DNA, 22 bp, Homo sapiens
aaggaagttaagtcttagaatg

SEQ ID NO: 7313064 - DNA, 20 bp, Homo sapiens
aaggaatatttgtatctggg

SEQ ID NO: 7313065 - DNA, 22 bp, Homo sapiens
aaggaagccttgcctgaataca

SEQ ID NO: 7313066 - DNA, 22 bp, Homo sapiens
aaggaagatgctggcctgggga

SEQ ID NO: 7313067 - DNA, 22 bp, Homo sapiens
aaggaagatgctggcctgggga

SEQ ID NO: 7313068 - DNA, 22 bp, Homo sapiens
aaggaagaatcatcacgttggg

SEQ ID NO: 7313069 - DNA, 22 bp, Homo sapiens
aaggaagaatcatcacgttggg

SEQ ID NO: 7313070 - DNA, 22 bp, Homo sapiens
aaggaaggaattgatcatgcgc

SEQ ID NO: 7313071 - DNA, 22 bp, Homo sapiens
aaggaagggaaatagtgatgtc

SEQ ID NO: 7313072 - DNA, 22 bp, Homo sapiens
aaggaagggaaatagtgatgtc

SEQ ID NO: 7313073 - DNA, 22 bp, Homo sapiens
aagctggagagtttcacagatg

SEQ ID NO: 7313074 - DNA, 22 bp, Homo sapiens
aagctggatgtaggatccccct

SEQ ID NO: 7313075 - DNA, 22 bp, Homo sapiens
aagcttacagttccacgtagca

SEQ ID NO: 7313076 - DNA, 22 bp, Homo sapiens
aaggaagaagggaagttactta

SEQ ID NO: 7313077 - DNA, 20 bp, Homo sapiens
acagaatatgctggttgtgg

SEQ ID NO: 7313078 - DNA, 22 bp, Homo sapiens
acagaatattggttactgttgc

SEQ ID NO: 7313079 - DNA, 22 bp, Homo sapiens
acagaatattggttactgttgc

SEQ ID NO: 7313080 - DNA, 22 bp, Homo sapiens
acagaatagtcagctgtaggcc

SEQ ID NO: 7313081 - DNA, 22 bp, Homo sapiens
acagaatagtagcttaaagtca

SEQ ID NO: 7313082 - DNA, 22 bp, Homo sapiens
acagaataggtacagtcagtca

SEQ ID NO: 7313083 - DNA, 22 bp, Homo sapiens
acagaatatttggcatgcgtct

SEQ ID NO: 7313084 - DNA, 22 bp, Homo sapiens
acagaatattgtaagtgccact

SEQ ID NO: 7313085 - DNA, 22 bp, Homo sapiens
acagaataaggtttatctctcc

SEQ ID NO: 7313086 - DNA, 22 bp, Homo sapiens
acagaataactcttgcttgagt

SEQ ID NO: 7313087 - DNA, 22 bp, Homo sapiens
acagaatactcataagaagggg

SEQ ID NO: 7313088 - DNA, 22 bp, Homo sapiens
acagaagtgttgaagttttcat

SEQ ID NO: 7313089 - DNA, 22 bp, Homo sapiens
acagaagtgtgtgtgtaggaat

SEQ ID NO: 7313090 - DNA, 22 bp, Homo sapiens
acagaagtgtctttttcattca

SEQ ID NO: 7313091 - DNA, 22 bp, Homo sapiens
acagaagctcaagagagcagtg

SEQ ID NO: 7313092 - DNA, 22 bp, Homo sapiens
agcggcgccgagcttggccagg

SEQ ID NO: 7313093 - DNA, 22 bp, Homo sapiens
agcgtgtgcctcggggtacacg

SEQ ID NO: 7313094 - DNA, 22 bp, Homo sapiens
agcgtgtgtgcgggtcttcttt

SEQ ID NO: 7313095 - DNA, 22 bp, Homo sapiens
agcgtgtggagaactaagcaga

SEQ ID NO: 7313096 - DNA, 21 bp, Homo sapiens
agcgtcaatatcgtcaacagg

SEQ ID NO: 7313097 - DNA, 22 bp, Homo sapiens
agctaaagagccctacccaaag

SEQ ID NO: 7313098 - DNA, 22 bp, Homo sapiens
agctaaatgtgaaatgtcaacc

SEQ ID NO: 7313099 - DNA, 22 bp, Homo sapiens
acagataataggatgtaccctg

SEQ ID NO: 7313100 - DNA, 22 bp, Homo sapiens
agctgagggcaggatggggtga

SEQ ID NO: 7313101 - DNA, 23 bp, Homo sapiens
agctgaggtgcagatccaaagaa

SEQ ID NO: 7313102 - DNA, 18 bp, Homo sapiens
acagcaggtttcattctt

SEQ ID NO: 7313103 - DNA, 22 bp, Homo sapiens
acagcagtcttaacacattgca

SEQ ID NO: 7313104 - DNA, 22 bp, Homo sapiens
acagcagtcagtgaatatttaa

SEQ ID NO: 7313105 - DNA, 22 bp, Homo sapiens
acagcagtggattagaggatgg

SEQ ID NO: 7313106 - DNA, 22 bp, Homo sapiens
acagcagatctgtggagcttat

SEQ ID NO: 7313107 - DNA, 22 bp, Homo sapiens
acagcagatttccctgggctcc

SEQ ID NO: 7313108 - DNA, 22 bp, Homo sapiens
acagcagattacattctgctat

SEQ ID NO: 7313109 - DNA, 22 bp, Homo sapiens
acagcagatctggctacaggtt

SEQ ID NO: 7313110 - DNA, 22 bp, Homo sapiens
acagcagaccccagtgccatgg

SEQ ID NO: 7313111 - DNA, 22 bp, Homo sapiens
acagatatatgattgtgtaaat

SEQ ID NO: 7313112 - DNA, 22 bp, Homo sapiens
acagatataaactatagtagtg

SEQ ID NO: 7313113 - DNA, 22 bp, Homo sapiens
acagatactataatgtaaagtg

SEQ ID NO: 7313114 - DNA, 22 bp, Homo sapiens
acacagtattgtgactataact

SEQ ID NO: 7313115 - DNA, 22 bp, Homo sapiens
acacaagttctaaagattgcgc

SEQ ID NO: 7313116 - DNA, 22 bp, Homo sapiens
acacaataaatttatcctttga

SEQ ID NO: 7313117 - DNA, 22 bp, Homo sapiens
acacaagtgaatattttaagga

SEQ ID NO: 7313118 - DNA, 22 bp, Homo sapiens
acacaatgattcacaagcagca

SEQ ID NO: 7313119 - DNA, 22 bp, Homo sapiens
acacaatttcataaacaccatg

SEQ ID NO: 7313120 - DNA, 22 bp, Homo sapiens
acacaatttcataaacaccatg

SEQ ID NO: 7313121 - DNA, 22 bp, Homo sapiens
acacaatgtgcaggacacctgt

SEQ ID NO: 7313122 - DNA, 22 bp, Homo sapiens
acacaatgtcatcataatgtca

SEQ ID NO: 7313123 - DNA, 22 bp, Homo sapiens
acacagttctcttcttgtaact

SEQ ID NO: 7313124 - DNA, 22 bp, Homo sapiens
agcagggaatagcggaaagaat

SEQ ID NO: 7313125 - DNA, 22 bp, Homo sapiens
acacatcagaaatatgaatgag

SEQ ID NO: 7313126 - DNA, 22 bp, Homo sapiens
acacatcatgccaagtttcacc

SEQ ID NO: 7313127 - DNA, 22 bp, Homo sapiens
acacatcagcctcagctttggg

SEQ ID NO: 7313128 - DNA, 22 bp, Homo sapiens
acacatctatctctacacaagg

SEQ ID NO: 7313129 - DNA, 22 bp, Homo sapiens
acacatcatgccaagtttcacc

SEQ ID NO: 7313130 - DNA, 22 bp, Homo sapiens
acaccagtttcttaagaatatt

SEQ ID NO: 7313131 - DNA, 22 bp, Homo sapiens
acaccatactcatgttggttcc

SEQ ID NO: 7313132 - DNA, 22 bp, Homo sapiens
agccagaggtcatgagcacagg

SEQ ID NO: 7313133 - DNA, 19 bp, Homo sapiens
agccagagtggcccagggg

SEQ ID NO: 7313134 - DNA, 22 bp, Homo sapiens
acacttcaaatggttggaaaat

SEQ ID NO: 7313135 - DNA, 22 bp, Homo sapiens
acactgttttagggaagaaaat

SEQ ID NO: 7313136 - DNA, 22 bp, Homo sapiens
agcacacagtattagccattgt

SEQ ID NO: 7313137 - DNA, 22 bp, Homo sapiens
agcacacaggacttgattcatg

SEQ ID NO: 7313138 - DNA, 22 bp, Homo sapiens
agcacaaatataaaaatgtctg

SEQ ID NO: 7313139 - DNA, 22 bp, Homo sapiens
agcacaaatataaaaatgtctg

SEQ ID NO: 7313140 - DNA, 23 bp, Homo sapiens
agcacaaagtgttttccttgtag

SEQ ID NO: 7313141 - DNA, 22 bp, Homo sapiens
agcacaaaagcagccacagatg

SEQ ID NO: 7313142 - DNA, 22 bp, Homo sapiens
agcacaggaacatggagatggg

SEQ ID NO: 7313143 - DNA, 22 bp, Homo sapiens
agcacagaaagtattgactgaa

SEQ ID NO: 7313144 - DNA, 22 bp, Homo sapiens
agcacaggacgtagagcttgga

SEQ ID NO: 7313145 - DNA, 22 bp, Homo sapiens
agcacagggcccagcctaggcc

SEQ ID NO: 7313146 - DNA, 22 bp, Homo sapiens
acaatttttcaaagaagcttat

SEQ ID NO: 7313147 - DNA, 19 bp, Homo sapiens
acaatagaaaagtcttttg

SEQ ID NO: 7313148 - DNA, 22 bp, Homo sapiens
acaatactattttcagtatcct

SEQ ID NO: 7313149 - DNA, 19 bp, Homo sapiens
agcaaatataatagtgttc

SEQ ID NO: 7313150 - DNA, 22 bp, Homo sapiens
agcaaatattttgttgaagtgc

SEQ ID NO: 7313151 - DNA, 22 bp, Homo sapiens
acaacagtttaggtatttgtag

SEQ ID NO: 7313152 - DNA, 22 bp, Homo sapiens
acaacattcttaaatacactga

SEQ ID NO: 7313153 - DNA, 22 bp, Homo sapiens
agattttgtctcaatacttctg

SEQ ID NO: 7313154 - DNA, 22 bp, Homo sapiens
agcaaaagatagattaacaaga

SEQ ID NO: 7313155 - DNA, 22 bp, Homo sapiens
agcaaatacatttttagcataa

SEQ ID NO: 7313156 - DNA, 22 bp, Homo sapiens
agcaaagcttccataaagcagc

SEQ ID NO: 7313157 - DNA, 22 bp, Homo sapiens
agcaaagctgattaagagcaca

SEQ ID NO: 7313158 - DNA, 18 bp, Homo sapiens
aatttctttgacaactta

SEQ ID NO: 7313159 - DNA, 22 bp, Homo sapiens
aatttgattcagcaaatgttca

SEQ ID NO: 7313160 - DNA, 22 bp, Homo sapiens
aatttctccaagaatgcttaga

SEQ ID NO: 7313161 - DNA, 20 bp, Homo sapiens
aatttctcctgggtaacaga

SEQ ID NO: 7313162 - DNA, 22 bp, Homo sapiens
agagttaagtgaaatgtaataa

SEQ ID NO: 7313163 - DNA, 22 bp, Homo sapiens
aatttggggaggttcagactct

SEQ ID NO: 7313164 - DNA, 22 bp, Homo sapiens
aatttgggcgaggagggaggca

SEQ ID NO: 7313165 - DNA, 22 bp, Homo sapiens
aatttgtatacatgttacattt

SEQ ID NO: 7313166 - DNA, 22 bp, Homo sapiens
aatttgtatacatgttacattt

SEQ ID NO: 7313167 - DNA, 22 bp, Homo sapiens
agagtgaagtttttgaaagtga

SEQ ID NO: 7313168 - DNA, 22 bp, Homo sapiens
acaacagtaggaaaacatgtct

SEQ ID NO: 7313169 - DNA, 22 bp, Homo sapiens
acaacagtagcctttacaaggc

SEQ ID NO: 7313170 - DNA, 21 bp, Homo sapiens
agatgcagttatgagatgcag

SEQ ID NO: 7313171 - DNA, 20 bp, Homo sapiens
agatctttgggttgtcatat

SEQ ID NO: 7313172 - DNA, 22 bp, Homo sapiens
acaaagtttgtggtattccaag

SEQ ID NO: 7313173 - DNA, 22 bp, Homo sapiens
acaaagtttcttctaacatctg

SEQ ID NO: 7313174 - DNA, 22 bp, Homo sapiens
acaaagtttcttctaacatctg

SEQ ID NO: 7313175 - DNA, 22 bp, Homo sapiens
acaaagttattctttcagagga

SEQ ID NO: 7313176 - DNA, 22 bp, Homo sapiens
acaaagtgtgcggagcccaggg

SEQ ID NO: 7313177 - DNA, 22 bp, Homo sapiens
acaaagttaacagttggatagt

SEQ ID NO: 7313178 - DNA, 22 bp, Homo sapiens
acaaagttattctttcagagga

SEQ ID NO: 7313179 - DNA, 22 bp, Homo sapiens
acaaagtgaaaagcatcgaatt

SEQ ID NO: 7313180 - DNA, 22 bp, Homo sapiens
acaaagtcttttacaacagtca

SEQ ID NO: 7313181 - DNA, 22 bp, Homo sapiens
acaaagtgaaaagcatcgaatt

SEQ ID NO: 7313182 - DNA, 22 bp, Homo sapiens
acaaagtgctgacattacaggc

SEQ ID NO: 7313183 - DNA, 20 bp, Homo sapiens
acaaagtattgaggacaagt

SEQ ID NO: 7313184 - DNA, 22 bp, Homo sapiens
acaaagtatttttaggtttgta

SEQ ID NO: 7313185 - DNA, 22 bp, Homo sapiens
aatgtgtagcatttaatgcagt

SEQ ID NO: 7313186 - DNA, 22 bp, Homo sapiens
aatgtgtagcatttaatgcagt

SEQ ID NO: 7313187 - DNA, 22 bp, Homo sapiens
aatgtgtagcatttaatgcagt

SEQ ID NO: 7313188 - DNA, 22 bp, Homo sapiens
aatgtgtagatgttgcattcct

SEQ ID NO: 7313189 - DNA, 22 bp, Homo sapiens
aatgtgtacatgacagatagaa

SEQ ID NO: 7313190 - DNA, 22 bp, Homo sapiens
agagaaattctcagtggaagat

SEQ ID NO: 7313191 - DNA, 22 bp, Homo sapiens
agagaaatggggtaatctttca

SEQ ID NO: 7313192 - DNA, 22 bp, Homo sapiens
agagcaaagggacatggaagag

SEQ ID NO: 7313193 - DNA, 22 bp, Homo sapiens
aatgtgtataagggagagctaa

SEQ ID NO: 7313194 - DNA, 22 bp, Homo sapiens
aatgtgtatatgaacatacagg

SEQ ID NO: 7313195 - DNA, 22 bp, Homo sapiens
aatgtgtatatgaacatacagg

SEQ ID NO: 7313196 - DNA, 22 bp, Homo sapiens
aatgtgtatgaggaagagagaa

SEQ ID NO: 7313197 - DNA, 22 bp, Homo sapiens
aatgccttggagagcctagagg

SEQ ID NO: 7313198 - DNA, 22 bp, Homo sapiens
aatgcctttccactgggtatca

SEQ ID NO: 7313199 - DNA, 22 bp, Homo sapiens
aatgtataatatttaatgcttt

SEQ ID NO: 7313200 - DNA, 22 bp, Homo sapiens
agacattggctaaaagtagtgt

SEQ ID NO: 7313201 - DNA, 22 bp, Homo sapiens
agacatttattcacacatttat

SEQ ID NO: 7313202 - DNA, 22 bp, Homo sapiens
agacatggatttcttacataaa

SEQ ID NO: 7313203 - DNA, 22 bp, Homo sapiens
agacatggtttattttaatggt

SEQ ID NO: 7313204 - DNA, 22 bp, Homo sapiens
agaggaggtggtgatgctttaa

SEQ ID NO: 7313205 - DNA, 22 bp, Homo sapiens
agaggatgattttaaggacact

SEQ ID NO: 7313206 - DNA, 18 bp, Homo sapiens
aatttccatatgaattgc

SEQ ID NO: 7313207 - DNA, 22 bp, Homo sapiens
aatttcacagctggtctatggg

SEQ ID NO: 7313208 - DNA, 22 bp, Homo sapiens
aatttcacagtgaactttgagg

SEQ ID NO: 7313209 - DNA, 22 bp, Homo sapiens
agaggaagtaatcaggacctgc

SEQ ID NO: 7313210 - DNA, 21 bp, Homo sapiens
agaggaagtgattggtctggc

SEQ ID NO: 7313211 - DNA, 22 bp, Homo sapiens
aattccaaatgttttcaatcca

SEQ ID NO: 7313212 - DNA, 22 bp, Homo sapiens
aattaactaaaattcactttat

SEQ ID NO: 7313213 - DNA, 22 bp, Homo sapiens
aattccaacagacaaagttaga

SEQ ID NO: 7313214 - DNA, 22 bp, Homo sapiens
aattcatagcaacaaagaccca

SEQ ID NO: 7313215 - DNA, 22 bp, Homo sapiens
agagctggaatcagacctcagg

SEQ ID NO: 7313216 - DNA, 22 bp, Homo sapiens
agagctggaatcagacctcagg

SEQ ID NO: 7313217 - DNA, 22 bp, Homo sapiens
aaaagcaattgcagttcttgcc

SEQ ID NO: 7313218 - DNA, 22 bp, Homo sapiens
aaaacagtttaggcatcacagt

SEQ ID NO: 7313219 - DNA, 22 bp, Homo sapiens
aaaacagttataaacagagtca

SEQ ID NO: 7313220 - DNA, 22 bp, Homo sapiens
aaaacagtttttgctaactgct

SEQ ID NO: 7313221 - DNA, 22 bp, Homo sapiens
aaaagcaagttgcctaggttga

SEQ ID NO: 7313222 - DNA, 22 bp, Homo sapiens
aaaagcaaggcagtctgtctga

SEQ ID NO: 7313223 - DNA, 22 bp, Homo sapiens
aaaagcaagaggctggattaaa

SEQ ID NO: 7313224 - DNA, 22 bp, Homo sapiens
aaaaatttatggttcttctctg

SEQ ID NO: 7313225 - DNA, 22 bp, Homo sapiens
aaaaatttatggttcttctctg

SEQ ID NO: 7313226 - DNA, 22 bp, Homo sapiens
aaaaatgaaacggctggttggc

SEQ ID NO: 7313227 - DNA, 22 bp, Homo sapiens
aaaacattttactgccatctca

SEQ ID NO: 7313228 - DNA, 22 bp, Homo sapiens
aaaacattgaattgcacactat

SEQ ID NO: 7313229 - DNA, 22 bp, Homo sapiens
aaaacattgaattgcacactat

SEQ ID NO: 7313230 - DNA, 22 bp, Homo sapiens
aaaacattctgtgaactctcaa

SEQ ID NO: 7313231 - DNA, 22 bp, Homo sapiens
aaaaccaggcgtttcctattat

SEQ ID NO: 7313232 - DNA, 22 bp, Homo sapiens
aaaatacacatactaggggaaa

SEQ ID NO: 7313233 - DNA, 22 bp, Homo sapiens
aaaatacacatactaggggaaa

SEQ ID NO: 7313234 - DNA, 22 bp, Homo sapiens
aaaagtttgtgcaaacactcag

SEQ ID NO: 7313235 - DNA, 22 bp, Homo sapiens
aaaatctggcaacactaagttt

SEQ ID NO: 7313236 - DNA, 22 bp, Homo sapiens
aaaatactactgtcttcttccc

SEQ ID NO: 7313237 - DNA, 22 bp, Homo sapiens
aaaatactgtggagtgttgaaa

SEQ ID NO: 7313238 - DNA, 22 bp, Homo sapiens
aaaagttgcaaaattgctcttc

SEQ ID NO: 7313239 - DNA, 22 bp, Homo sapiens
aaaagtttaagactcattctag

SEQ ID NO: 7313240 - DNA, 22 bp, Homo sapiens
aaaagttattgatgcaggacaa

SEQ ID NO: 7313241 - DNA, 22 bp, Homo sapiens
aaaagttagctattagtaggtg

SEQ ID NO: 7313242 - DNA, 22 bp, Homo sapiens
aaaagttacctctgtaatataa

SEQ ID NO: 7313243 - DNA, 22 bp, Homo sapiens
aaaagctctttctgctgtagat

SEQ ID NO: 7313244 - DNA, 21 bp, Homo sapiens
aaaaggaaggtctgtttgggg

SEQ ID NO: 7313245 - DNA, 19 bp, Homo sapiens
aaaaggaatattctttggg

SEQ ID NO: 7313246 - DNA, 22 bp, Homo sapiens
aaaatgcaaacctacctacata

SEQ ID NO: 7313247 - DNA, 20 bp, Homo sapiens
aaaatgatgggcagggcagg

SEQ ID NO: 7313248 - DNA, 22 bp, Homo sapiens
aaaatgtaaagcttgagtgtag

SEQ ID NO: 7313249 - DNA, 22 bp, Homo sapiens
aaaatgcatgagaatgtgctcg

SEQ ID NO: 7313250 - DNA, 22 bp, Homo sapiens
aaagcagggtccaaggagatgt

SEQ ID NO: 7313251 - DNA, 21 bp, Homo sapiens
aaaatgtagacttttccctga

SEQ ID NO: 7313252 - DNA, 22 bp, Homo sapiens
aaaatgtctgctgttggtttat

SEQ ID NO: 7313253 - DNA, 22 bp, Homo sapiens
aaagttttattcaagcattagt

SEQ ID NO: 7313254 - DNA, 22 bp, Homo sapiens
aaagttttctgccttcattaga

SEQ ID NO: 7313255 - DNA, 22 bp, Homo sapiens
aaagttttctgccttcattaga

SEQ ID NO: 7313256 - DNA, 22 bp, Homo sapiens
aaagttttgttgattgtggaat

SEQ ID NO: 7313257 - DNA, 22 bp, Homo sapiens
aaagtcattgctgttatcaatg

SEQ ID NO: 7313258 - DNA, 22 bp, Homo sapiens
aaagtacacacagagccaagaa

SEQ ID NO: 7313259 - DNA, 22 bp, Homo sapiens
aaagtacatagcatattccaac

SEQ ID NO: 7313260 - DNA, 22 bp, Homo sapiens
aaagtcatcatttcttttcaaa

SEQ ID NO: 7313261 - DNA, 22 bp, Homo sapiens
aaaattttcagcttgacttgat

SEQ ID NO: 7313262 - DNA, 22 bp, Homo sapiens
aaaatttccaccatctttgtgt

SEQ ID NO: 7313263 - DNA, 22 bp, Homo sapiens
aaaattgtcgaacagtagtaac

SEQ ID NO: 7313264 - DNA, 22 bp, Homo sapiens
aaagctcttaaattgacctgct

SEQ ID NO: 7313265 - DNA, 22 bp, Homo sapiens
aaaggaatgagcttctgttagg

SEQ ID NO: 7313266 - DNA, 22 bp, Homo sapiens
aaaggaatgagcttctgttagg

SEQ ID NO: 7313267 - DNA, 22 bp, Homo sapiens
aaaggaggaatggagagatgct

SEQ ID NO: 7313268 - DNA, 22 bp, Homo sapiens
aaaggagagtgagtcagatgcc

SEQ ID NO: 7313269 - DNA, 22 bp, Homo sapiens
aaaggagagtgagtcagatgcc

SEQ ID NO: 7313270 - DNA, 22 bp, Homo sapiens
aaaggagacagtcttacctgga

SEQ ID NO: 7313271 - DNA, 22 bp, Homo sapiens
aaaggagacttcagatctcctt

SEQ ID NO: 7313272 - DNA, 22 bp, Homo sapiens
aaaggagaaaacatacaggact

SEQ ID NO: 7313273 - DNA, 21 bp, Homo sapiens
aaatacagaaacttgttttca

SEQ ID NO: 7313274 - DNA, 21 bp, Homo sapiens
aaatacagaaacttgttttca

SEQ ID NO: 7313275 - DNA, 22 bp, Homo sapiens
aaatacagagttgcttaaaagc

SEQ ID NO: 7313276 - DNA, 22 bp, Homo sapiens
aaatacagagttgcttaaaagc

SEQ ID NO: 7313277 - DNA, 21 bp, Homo sapiens
aaatacagatgcaaatctgtt

SEQ ID NO: 7313278 - DNA, 22 bp, Homo sapiens
aaatacagattccagggtctta

SEQ ID NO: 7313279 - DNA, 21 bp, Homo sapiens
aaatacagatgcaaatctgtt

SEQ ID NO: 7313280 - DNA, 22 bp, Homo sapiens
aaataaactgaagcacagagag

SEQ ID NO: 7313281 - DNA, 22 bp, Homo sapiens
aaataaaggtccactttagggc

SEQ ID NO: 7313282 - DNA, 22 bp, Homo sapiens
aaatacacgtacatgtgtaaaa

SEQ ID NO: 7313283 - DNA, 22 bp, Homo sapiens
aaatacaatttcaggctgtaat

SEQ ID NO: 7313284 - DNA, 22 bp, Homo sapiens
aaatccagtgttcaaagtttga

SEQ ID NO: 7313285 - DNA, 22 bp, Homo sapiens
aaatgacactaggctttttgca

SEQ ID NO: 7313286 - DNA, 22 bp, Homo sapiens
aaatgacactcattcagtgtca

SEQ ID NO: 7313287 - DNA, 22 bp, Homo sapiens
aaatgacaataaaagtccatgc

SEQ ID NO: 7313288 - DNA, 22 bp, Homo sapiens
aaatgacaataaaagtccatgc

SEQ ID NO: 7313289 - DNA, 23 bp, Homo sapiens
aaactgttgcttcaatgtatcct

SEQ ID NO: 7313290 - DNA, 22 bp, Homo sapiens
aaactgttgtggtttatcatta

SEQ ID NO: 7313291 - DNA, 23 bp, Homo sapiens
aaatgacatatggtttctgaagg

SEQ ID NO: 7313292 - DNA, 22 bp, Homo sapiens
aaactgtgagctagtaaatagg

SEQ ID NO: 7313293 - DNA, 22 bp, Homo sapiens
aaatgtctgtatgagaaagaga

SEQ ID NO: 7313294 - DNA, 22 bp, Homo sapiens
aaacttagtagagttcatatta

SEQ ID NO: 7313295 - DNA, 22 bp, Homo sapiens
aaacttcaaggatttgcaaatc

SEQ ID NO: 7313296 - DNA, 22 bp, Homo sapiens
aaacttcatggataatataaag

SEQ ID NO: 7313297 - DNA, 22 bp, Homo sapiens
aaacttcatggataatataaag

SEQ ID NO: 7313298 - DNA, 22 bp, Homo sapiens
aaagacagatggcaaggatgat

SEQ ID NO: 7313299 - DNA, 22 bp, Homo sapiens
aaagacagtggattcaaaatcc

SEQ ID NO: 7313300 - DNA, 22 bp, Homo sapiens
aaagacatcagaaccagctgag

SEQ ID NO: 7313301 - DNA, 22 bp, Homo sapiens
aaagacatatttctaagtttat

SEQ ID NO: 7313302 - DNA, 22 bp, Homo sapiens
aaagacagatggcaaggatgat

SEQ ID NO: 7313303 - DNA, 22 bp, Homo sapiens
aaatcacagggtctctaagtat

SEQ ID NO: 7313304 - DNA, 22 bp, Homo sapiens
aaatcacagggtctctaagtat

SEQ ID NO: 7313305 - DNA, 22 bp, Homo sapiens
aaatcacagggtctctaagtat

SEQ ID NO: 7313306 - DNA, 22 bp, Homo sapiens
aaatcacagggtctctaagtat

SEQ ID NO: 7313307 - DNA, 22 bp, Homo sapiens
aaatcaaggagggattatattt

SEQ ID NO: 7313308 - DNA, 22 bp, Homo sapiens
aaatattggtaggatgcttgtt

SEQ ID NO: 7313309 - DNA, 22 bp, Homo sapiens
aaatcagacacagtgaaagtta

SEQ ID NO: 7313310 - DNA, 23 bp, Homo sapiens
aaatgacatatggtttctgaagg

SEQ ID NO: 7313311 - DNA, 22 bp, Homo sapiens
aaatgaacatcaagaatagcct

SEQ ID NO: 7313312 - DNA, 22 bp, Homo sapiens
aaatggaaaatgctgttttggt

SEQ ID NO: 7313313 - DNA, 22 bp, Homo sapiens
aaatgctgcagctagtgtgttt

SEQ ID NO: 7313314 - DNA, 22 bp, Homo sapiens
aaatgcaaggattttgttaggc

SEQ ID NO: 7313315 - DNA, 22 bp, Homo sapiens
aaatgcaattgtatgtactcca

SEQ ID NO: 7313316 - DNA, 22 bp, Homo sapiens
aaatgcaagttcatattttgtt

SEQ ID NO: 7313317 - DNA, 22 bp, Homo sapiens
aagagagagcattcttctgtta

SEQ ID NO: 7313318 - DNA, 22 bp, Homo sapiens
aagagagaccatgggggacagg

SEQ ID NO: 7313319 - DNA, 22 bp, Homo sapiens
aaatataatttctgcctcaata

SEQ ID NO: 7313320 - DNA, 22 bp, Homo sapiens
aaatatacggtccctaacagtc

SEQ ID NO: 7313321 - DNA, 22 bp, Homo sapiens
aaatatagcaattatgcctact

SEQ ID NO: 7313322 - DNA, 22 bp, Homo sapiens
aaatatacggtccctaacagtc

SEQ ID NO: 7313323 - DNA, 22 bp, Homo sapiens
aaatatgagatgttctctttcg

SEQ ID NO: 7313324 - DNA, 22 bp, Homo sapiens
aaatatagtaaatgcatagttc

SEQ ID NO: 7313325 - DNA, 19 bp, Homo sapiens
aaatatcagagagatgata

SEQ ID NO: 7313326 - DNA, 22 bp, Homo sapiens
aagaagcattctttcattggtt

SEQ ID NO: 7313327 - DNA, 22 bp, Homo sapiens
aagaagcaggtcacagacaggg

SEQ ID NO: 7313328 - DNA, 22 bp, Homo sapiens
aagaagcatgagaagattttat

SEQ ID NO: 7313329 - DNA, 22 bp, Homo sapiens
aagaagcatggctgtagattcc

SEQ ID NO: 7313330 - DNA, 22 bp, Homo sapiens
aagaaggcggaccagaagggag

SEQ ID NO: 7313331 - DNA, 21 bp, Homo sapiens
aaagttgatttagattggtga

SEQ ID NO: 7313332 - DNA, 22 bp, Homo sapiens
aaagttgtgaaaccgaacatgt

SEQ ID NO: 7313333 - DNA, 22 bp, Homo sapiens
aaatacaggagtttggacttct

SEQ ID NO: 7313334 - DNA, 19 bp, Homo sapiens
aaatacagcagctgtttcc

SEQ ID NO: 7313335 - DNA, 22 bp, Homo sapiens
aaatacagcagactcctgttgt

SEQ ID NO: 7313336 - DNA, 19 bp, Homo sapiens
aaatacagcagctgtttcc

SEQ ID NO: 7313337 - DNA, 22 bp, Homo sapiens
aaatacagattctgactcagag

SEQ ID NO: 7313338 - DNA, 22 bp, Homo sapiens
aaatacagattcttgtgtctat

SEQ ID NO: 7313339 - DNA, 22 bp, Homo sapiens
aaatacagattcttgtgtctat

SEQ ID NO: 7313340 - DNA, 22 bp, Homo sapiens
aagaagtggttggaagaagcat

SEQ ID NO: 7313341 - DNA, 22 bp, Homo sapiens
aagaagtggtccttttctttct

SEQ ID NO: 7313342 - DNA, 22 bp, Homo sapiens
aagaagttaaataaatggacca

SEQ ID NO: 7313343 - DNA, 22 bp, Homo sapiens
aaatacagtgtgtgttctttga

SEQ ID NO: 7313344 - DNA, 22 bp, Homo sapiens
aaatacataaaggttgtaccag

SEQ ID NO: 7313345 - DNA, 22 bp, Homo sapiens
aaatacataaaggttgtaccag

SEQ ID NO: 7313346 - DNA, 22 bp, Homo sapiens
aaatacagtggcagcagataat

SEQ ID NO: 7313347 - DNA, 22 bp, Homo sapiens
aagagagaagtctctctggttc

SEQ ID NO: 7313348 - DNA, 21 bp, Homo sapiens
aaagcatcacgaacatttggg

SEQ ID NO: 7313349 - DNA, 22 bp, Homo sapiens
aaagcatcagatctgacacttc

SEQ ID NO: 7313350 - DNA, 22 bp, Homo sapiens
aaagcatgctactttatatagg

SEQ ID NO: 7313351 - DNA, 22 bp, Homo sapiens
aaaggaagtgccactcttcttc

SEQ ID NO: 7313352 - DNA, 22 bp, Homo sapiens
aaaggaagtgccactcttcttc

SEQ ID NO: 7313353 - DNA, 22 bp, Homo sapiens
aacatgaagttttctatagtga

SEQ ID NO: 7313354 - DNA, 22 bp, Homo sapiens
aacatgaaacccaaacagaata

SEQ ID NO: 7313355 - DNA, 22 bp, Homo sapiens
aaaggaggccacatggctagga

SEQ ID NO: 7313356 - DNA, 22 bp, Homo sapiens
aaaggagttactcataaagctt

SEQ ID NO: 7313357 - DNA, 22 bp, Homo sapiens
aaattcagatggctttcttttc

SEQ ID NO: 7313358 - DNA, 22 bp, Homo sapiens
aaattagatatgtgtgagactc

SEQ ID NO: 7313359 - DNA, 22 bp, Homo sapiens
aaattcatttttcttagtgtgc

SEQ ID NO: 7313360 - DNA, 22 bp, Homo sapiens
aaattccaccagaatcagtaat

SEQ ID NO: 7313361 - DNA, 22 bp, Homo sapiens
aaattccattttgtgactattc

SEQ ID NO: 7313362 - DNA, 22 bp, Homo sapiens
aaattccattttgtgactattc

SEQ ID NO: 7313363 - DNA, 22 bp, Homo sapiens
aaattccagaaactcagtatat

SEQ ID NO: 7313364 - DNA, 22 bp, Homo sapiens
aaattccagcaacaccttttta

SEQ ID NO: 7313365 - DNA, 22 bp, Homo sapiens
aaattccattaggaaacttcca

SEQ ID NO: 7313366 - DNA, 22 bp, Homo sapiens
aaattgtcagaattcagaaagt

SEQ ID NO: 7313367 - DNA, 22 bp, Homo sapiens
aaattgtccttttaagaaacag

SEQ ID NO: 7313368 - DNA, 22 bp, Homo sapiens
aaattgtaggatcacatgacct

SEQ ID NO: 7313369 - DNA, 22 bp, Homo sapiens
aaagcaggttgcaattacagtg

SEQ ID NO: 7313370 - DNA, 22 bp, Homo sapiens
aacttctgacctcaagaactgt

SEQ ID NO: 7313371 - DNA, 22 bp, Homo sapiens
aacttctgcagaaaagtgcatg

SEQ ID NO: 7313372 - DNA, 22 bp, Homo sapiens
aacttctgcttttacaggcagt

SEQ ID NO: 7313373 - DNA, 22 bp, Homo sapiens
aacttctggatgtttcaaatgt

SEQ ID NO: 7313374 - DNA, 22 bp, Homo sapiens
aaagttacacatctagtaagtg

SEQ ID NO: 7313375 - DNA, 22 bp, Homo sapiens
aaagttacacatctagtaagtg

SEQ ID NO: 7313376 - DNA, 22 bp, Homo sapiens
aaagttctgggggtgtttctgg

SEQ ID NO: 7313377 - DNA, 22 bp, Homo sapiens
aaagttctcctggattgtgctg

SEQ ID NO: 7313378 - DNA, 22 bp, Homo sapiens
aaagttacacgactatttatgt

SEQ ID NO: 7313379 - DNA, 22 bp, Homo sapiens
aaagttacacgactatttatgt

SEQ ID NO: 7313380 - DNA, 22 bp, Homo sapiens
aaagtcctagcgatccacagaa

SEQ ID NO: 7313381 - DNA, 22 bp, Homo sapiens
aacatgatgacaaaggtatatt

SEQ ID NO: 7313382 - DNA, 22 bp, Homo sapiens
aacatgatgtgaagcatgaact

SEQ ID NO: 7313383 - DNA, 22 bp, Homo sapiens
aacatgattggaaaatgctgtc

SEQ ID NO: 7313384 - DNA, 22 bp, Homo sapiens
aacatgatttagtataatgcag

SEQ ID NO: 7313385 - DNA, 22 bp, Homo sapiens
aacatgatttagtataatgcag

SEQ ID NO: 7313386 - DNA, 22 bp, Homo sapiens
aaagggaactctaattatcttc

SEQ ID NO: 7313387 - DNA, 22 bp, Homo sapiens
aaagggaggggcgataagccgg

SEQ ID NO: 7313388 - DNA, 22 bp, Homo sapiens
aaagggaggggcgataagccgg

SEQ ID NO: 7313389 - DNA, 22 bp, Homo sapiens
aatgaaatgtagcttatccata

SEQ ID NO: 7313390 - DNA, 18 bp, Homo sapiens
aatgaaatgtacaccttt

SEQ ID NO: 7313391 - DNA, 22 bp, Homo sapiens
aatctcatgagcttcttgtccc

SEQ ID NO: 7313392 - DNA, 17 bp, Homo sapiens
aatctcagtggcttaag

SEQ ID NO: 7313393 - DNA, 22 bp, Homo sapiens
aatctcagagatatctgtgtcc

SEQ ID NO: 7313394 - DNA, 22 bp, Homo sapiens
aatctcagaaactggtggattt

SEQ ID NO: 7313395 - DNA, 22 bp, Homo sapiens
aatctcttgggaggaatgaatt

SEQ ID NO: 7313396 - DNA, 22 bp, Homo sapiens
aatctcttggttcagaagcctc

SEQ ID NO: 7313397 - DNA, 22 bp, Homo sapiens
aatctgatgttaaatgtaaggt

SEQ ID NO: 7313398 - DNA, 22 bp, Homo sapiens
aatctgcataagcacagttgga

SEQ ID NO: 7313399 - DNA, 22 bp, Homo sapiens
aatctgcacccactgaaaatgc

SEQ ID NO: 7313400 - DNA, 22 bp, Homo sapiens
aatctctttggctcaaggatcc

SEQ ID NO: 7313401 - DNA, 22 bp, Homo sapiens
aatgcagtgagccattaaatgg

SEQ ID NO: 7313402 - DNA, 22 bp, Homo sapiens
aatgcagtttcatttgtagaat

SEQ ID NO: 7313403 - DNA, 22 bp, Homo sapiens
aatgcttaattcaatactgtgt

SEQ ID NO: 7313404 - DNA, 22 bp, Homo sapiens
aactttacactgctttacatga

SEQ ID NO: 7313405 - DNA, 22 bp, Homo sapiens
aactttaaaaaatatgtctgtt

SEQ ID NO: 7313406 - DNA, 22 bp, Homo sapiens
aactttacttgaaagaacatgt

SEQ ID NO: 7313407 - DNA, 22 bp, Homo sapiens
aatgtaaagttgggcacaaatg

SEQ ID NO: 7313408 - DNA, 22 bp, Homo sapiens
aatgtacaaaccttctttgtag

SEQ ID NO: 7313409 - DNA, 22 bp, Homo sapiens
aatatttcgttgcgtggctaga

SEQ ID NO: 7313410 - DNA, 22 bp, Homo sapiens
aatatttcgttgcgtggctaga

SEQ ID NO: 7313411 - DNA, 22 bp, Homo sapiens
aatatttcaaaaggaaacacag

SEQ ID NO: 7313412 - DNA, 22 bp, Homo sapiens
aatatttctgtagctatgttct

SEQ ID NO: 7313413 - DNA, 22 bp, Homo sapiens
aatccagcacatggacacagtc

SEQ ID NO: 7313414 - DNA, 22 bp, Homo sapiens
aatatctgtctctaatgcatat

SEQ ID NO: 7313415 - DNA, 22 bp, Homo sapiens
aatatctgtctctaatgcatat

SEQ ID NO: 7313416 - DNA, 22 bp, Homo sapiens
aatatctgtggccatacaattt

SEQ ID NO: 7313417 - DNA, 22 bp, Homo sapiens
aatatcagtatattgtatcagt

SEQ ID NO: 7313418 - DNA, 22 bp, Homo sapiens
aatacagtgaaagtgagcaagg

SEQ ID NO: 7313419 - DNA, 22 bp, Homo sapiens
aatacagtcttactagaaaatc

SEQ ID NO: 7313420 - DNA, 22 bp, Homo sapiens
aatacagtaggtaatagttcat

SEQ ID NO: 7313421 - DNA, 22 bp, Homo sapiens
aatacagtaggtaatagttcat

SEQ ID NO: 7313422 - DNA, 22 bp, Homo sapiens
aatacagtaattttgatgagtt

SEQ ID NO: 7313423 - DNA, 19 bp, Homo sapiens
aatacagtgttatagaatt

SEQ ID NO: 7313424 - DNA, 19 bp, Homo sapiens
aatacagtgttatagaatt

SEQ ID NO: 7313425 - DNA, 21 bp, Homo sapiens
aatacagtgaagaatttcttt

SEQ ID NO: 7313426 - DNA, 22 bp, Homo sapiens
aacagtttatgagatatgctat

SEQ ID NO: 7313427 - DNA, 22 bp, Homo sapiens
aacagtttatcaagtttttaca

SEQ ID NO: 7313428 - DNA, 22 bp, Homo sapiens
aacagtttatgagatatgctat

SEQ ID NO: 7313429 - DNA, 22 bp, Homo sapiens
aagttacacattttcattgtaa

SEQ ID NO: 7313430 - DNA, 22 bp, Homo sapiens
aagttacaggagaaagagatca

SEQ ID NO: 7313431 - DNA, 22 bp, Homo sapiens
aagttacaggagaaagagatca

SEQ ID NO: 7313432 - DNA, 22 bp, Homo sapiens
aagttacaagactaaatggaag

SEQ ID NO: 7313433 - DNA, 22 bp, Homo sapiens
aagttaaggcacatgctttgga

SEQ ID NO: 7313434 - DNA, 22 bp, Homo sapiens
aagttacagttatgaaactcac

SEQ ID NO: 7313435 - DNA, 22 bp, Homo sapiens
aagttacagttattatttaaaa

SEQ ID NO: 7313436 - DNA, 22 bp, Homo sapiens
aagttacagttacagaatggag

SEQ ID NO: 7313437 - DNA, 22 bp, Homo sapiens
aagttacagtctgcttgctgac

SEQ ID NO: 7313438 - DNA, 22 bp, Homo sapiens
aagttacagtcagaggttaaca

SEQ ID NO: 7313439 - DNA, 22 bp, Homo sapiens
aagttacataaatgtcctctag

SEQ ID NO: 7313440 - DNA, 20 bp, Homo sapiens
aagttacattgtattgtacc

SEQ ID NO: 7313441 - DNA, 22 bp, Homo sapiens
aagttacagttattatttaaaa

SEQ ID NO: 7313442 - DNA, 22 bp, Homo sapiens
aagttacataaatgtcctctag

SEQ ID NO: 7313443 - DNA, 22 bp, Homo sapiens
aatacagaggggtcacaattca

SEQ ID NO: 7313444 - DNA, 22 bp, Homo sapiens
aagtacaacgcatacagagaaa

SEQ ID NO: 7313445 - DNA, 22 bp, Homo sapiens
aagtaatctggaatttggtttt

SEQ ID NO: 7313446 - DNA, 22 bp, Homo sapiens
aagtaacatgggaacatctgaa

SEQ ID NO: 7313447 - DNA, 22 bp, Homo sapiens
aagtaagtcttacattcacatt

SEQ ID NO: 7313448 - DNA, 22 bp, Homo sapiens
aagtaacatctgaacatgatgt

SEQ ID NO: 7313449 - DNA, 22 bp, Homo sapiens
aaggttacctataatgggaagt

SEQ ID NO: 7313450 - DNA, 23 bp, Homo sapiens
aaggtgtcattgatgggattcta

SEQ ID NO: 7313451 - DNA, 22 bp, Homo sapiens
aacagttacccttaagatcttt

SEQ ID NO: 7313452 - DNA, 22 bp, Homo sapiens
aacagttattatcacattagtg

SEQ ID NO: 7313453 - DNA, 22 bp, Homo sapiens
aacagttatctcacatatggaa

SEQ ID NO: 7313454 - DNA, 22 bp, Homo sapiens
aacagttatctcacatatggaa

SEQ ID NO: 7313455 - DNA, 22 bp, Homo sapiens
aacagttacccttaagatcttt

SEQ ID NO: 7313456 - DNA, 22 bp, Homo sapiens
aacagttacccttaagatcttt

SEQ ID NO: 7313457 - DNA, 22 bp, Homo sapiens
aagtgccatcatagcatggctg

SEQ ID NO: 7313458 - DNA, 22 bp, Homo sapiens
aagtcttatttgtcatgtatgt

SEQ ID NO: 7313459 - DNA, 22 bp, Homo sapiens
aagtcttaggcattttatttct

SEQ ID NO: 7313460 - DNA, 22 bp, Homo sapiens
aaggataagaatggaaggaaca

SEQ ID NO: 7313461 - DNA, 22 bp, Homo sapiens
aaggagtctgggccattcagag

SEQ ID NO: 7313462 - DNA, 22 bp, Homo sapiens
aaggagggttcccaggtcctgg

SEQ ID NO: 7313463 - DNA, 16 bp, Homo sapiens
aaggagggaagagaat

SEQ ID NO: 7313464 - DNA, 22 bp, Homo sapiens
aaggagggaaagcagtgcttct

SEQ ID NO: 7313465 - DNA, 22 bp, Homo sapiens
aaggagaagtctgttgagattg

SEQ ID NO: 7313466 - DNA, 22 bp, Homo sapiens
aaggagaagggtaatcaacaca

SEQ ID NO: 7313467 - DNA, 22 bp, Homo sapiens
aaatggcaacagaagggagttc

SEQ ID NO: 7313468 - DNA, 22 bp, Homo sapiens
aaatggaagctatttatgattc

SEQ ID NO: 7313469 - DNA, 22 bp, Homo sapiens
aaatggaagctatttatgattc

SEQ ID NO: 7313470 - DNA, 22 bp, Homo sapiens
aaatggatggaattgacattta

SEQ ID NO: 7313471 - DNA, 22 bp, Homo sapiens
aagaatcatagagccactgata

SEQ ID NO: 7313472 - DNA, 22 bp, Homo sapiens
aagaatcatagagccactgata

SEQ ID NO: 7313473 - DNA, 22 bp, Homo sapiens
aagaatatttcctgcacttggg

SEQ ID NO: 7313474 - DNA, 21 bp, Homo sapiens
acaaaagaagctgccttttaa

SEQ ID NO: 7313475 - DNA, 22 bp, Homo sapiens
acaaatatttactgaatccact

SEQ ID NO: 7313476 - DNA, 22 bp, Homo sapiens
acaaatctgttttatagacttt

SEQ ID NO: 7313477 - DNA, 22 bp, Homo sapiens
acaaatgaacctgaaatctcag

SEQ ID NO: 7313478 - DNA, 22 bp, Homo sapiens
acaaattgggtatgagctaaga

SEQ ID NO: 7313479 - DNA, 22 bp, Homo sapiens
aatgtacaataagacaaagagg

SEQ ID NO: 7313480 - DNA, 22 bp, Homo sapiens
aatgtacaagggttccagtttt

SEQ ID NO: 7313481 - DNA, 22 bp, Homo sapiens
aatgtacaagggttccagtttt

SEQ ID NO: 7313482 - DNA, 23 bp, Homo sapiens
aagaactgcgaatggagaaagta

SEQ ID NO: 7313483 - DNA, 22 bp, Homo sapiens
aagaagatggttaactttcagt

SEQ ID NO: 7313484 - DNA, 22 bp, Homo sapiens
aagaagatggttaactttcagt

SEQ ID NO: 7313485 - DNA, 21 bp, Homo sapiens
aagaagcaatttattggaagg

SEQ ID NO: 7313486 - DNA, 22 bp, Homo sapiens
aattttatctctaagcaggctt

SEQ ID NO: 7313487 - DNA, 22 bp, Homo sapiens
acaaaacagtgttcctgcccct

SEQ ID NO: 7313488 - DNA, 22 bp, Homo sapiens
aagaagagaaatgtgctgctgg

SEQ ID NO: 7313489 - DNA, 22 bp, Homo sapiens
aagaagagaactggcatcctaa

SEQ ID NO: 7313490 - DNA, 23 bp, Homo sapiens
aagaactttggtcctgcagagtc

SEQ ID NO: 7313491 - DNA, 22 bp, Homo sapiens
acacagccgtgaatctgcttct

SEQ ID NO: 7313492 - DNA, 22 bp, Homo sapiens
aagataatgtgtctgtctttgc

SEQ ID NO: 7313493 - DNA, 22 bp, Homo sapiens
aagatacacggtcaactctcaa

SEQ ID NO: 7313494 - DNA, 20 bp, Homo sapiens
acacagactcagcttggatg

SEQ ID NO: 7313495 - DNA, 22 bp, Homo sapiens
acacacatgcctttcctaagta

SEQ ID NO: 7313496 - DNA, 22 bp, Homo sapiens
acaatgttctctgagttgtgtg

SEQ ID NO: 7313497 - DNA, 22 bp, Homo sapiens
acaatgttctacatatacataa

SEQ ID NO: 7313498 - DNA, 22 bp, Homo sapiens
acaatatagtccatgagcatgc

SEQ ID NO: 7313499 - DNA, 22 bp, Homo sapiens
acaatattgtacccagaagttt

SEQ ID NO: 7313500 - DNA, 22 bp, Homo sapiens
acaatatttgggggcagtttgt

SEQ ID NO: 7313501 - DNA, 22 bp, Homo sapiens
acaatgtaggatatgtacttgt

SEQ ID NO: 7313502 - DNA, 22 bp, Homo sapiens
acaaatttcataggcaaatttt

SEQ ID NO: 7313503 - DNA, 22 bp, Homo sapiens
acaaatttcataggcaaatttt

SEQ ID NO: 7313504 - DNA, 22 bp, Homo sapiens
acaaatttgaatcctgacttct

SEQ ID NO: 7313505 - DNA, 22 bp, Homo sapiens
acaaatttggtgagagtaaata

SEQ ID NO: 7313506 - DNA, 22 bp, Homo sapiens
acaacaaaatcactagtcttcc

SEQ ID NO: 7313507 - DNA, 22 bp, Homo sapiens
acagaccaagtttccagcaggt

SEQ ID NO: 7313508 - DNA, 22 bp, Homo sapiens
acagagcaacttgagtatcctc

SEQ ID NO: 7313509 - DNA, 22 bp, Homo sapiens
acagagcaactttatttcatgg

SEQ ID NO: 7313510 - DNA, 22 bp, Homo sapiens
acagacatttaataaatgctga

SEQ ID NO: 7313511 - DNA, 23 bp, Homo sapiens
acagacattgtacatcttgtttt

SEQ ID NO: 7313512 - DNA, 23 bp, Homo sapiens
acagacattccataatgtacacc

SEQ ID NO: 7313513 - DNA, 23 bp, Homo sapiens
acagacattccataatgtacacc

SEQ ID NO: 7313514 - DNA, 19 bp, Homo sapiens
acagacatttgcaattagc

SEQ ID NO: 7313515 - DNA, 22 bp, Homo sapiens
acagacatttaataaatgctga

SEQ ID NO: 7313516 - DNA, 22 bp, Homo sapiens
acagacattttaattattaaat

SEQ ID NO: 7313517 - DNA, 18 bp, Homo sapiens
acagaaatagctgtgcct

SEQ ID NO: 7313518 - DNA, 18 bp, Homo sapiens
acagaaatagctgtgcct

SEQ ID NO: 7313519 - DNA, 22 bp, Homo sapiens
acagaaatattcgtggtgcttg

SEQ ID NO: 7313520 - DNA, 22 bp, Homo sapiens
acagaaatgatgtttggcaata

SEQ ID NO: 7313521 - DNA, 22 bp, Homo sapiens
acacttcagctccacaaacatt

SEQ ID NO: 7313522 - DNA, 22 bp, Homo sapiens
acacttcatttacattataggc

SEQ ID NO: 7313523 - DNA, 22 bp, Homo sapiens
acacttgtggcctttctagtaa

SEQ ID NO: 7313524 - DNA, 23 bp, Homo sapiens
acagaaagttctgctggacagag

SEQ ID NO: 7313525 - DNA, 22 bp, Homo sapiens
aagatacacgttgtattgaata

SEQ ID NO: 7313526 - DNA, 22 bp, Homo sapiens
aagatacacgttgtattgaata

SEQ ID NO: 7313527 - DNA, 23 bp, Homo sapiens
aagatacaggtgtggaatggttt

SEQ ID NO: 7313528 - DNA, 22 bp, Homo sapiens
aagatacataaaggtagagtct

SEQ ID NO: 7313529 - DNA, 22 bp, Homo sapiens
acacataagcctaatcatctcc

SEQ ID NO: 7313530 - DNA, 22 bp, Homo sapiens
acacatataccactgtaaatga

SEQ ID NO: 7313531 - DNA, 20 bp, Homo sapiens
acacatatagcagcataaac

SEQ ID NO: 7313532 - DNA, 22 bp, Homo sapiens
acagcagggggagctgttggac

SEQ ID NO: 7313533 - DNA, 22 bp, Homo sapiens
aagcagggagaaatttttcttc

SEQ ID NO: 7313534 - DNA, 22 bp, Homo sapiens
aagccctcattagccatagccc

SEQ ID NO: 7313535 - DNA, 22 bp, Homo sapiens
aagccctccgtacgtgctagct

SEQ ID NO: 7313536 - DNA, 22 bp, Homo sapiens
acagccaggacttggccctctt

SEQ ID NO: 7313537 - DNA, 22 bp, Homo sapiens
acagccaggaattctggagaag

SEQ ID NO: 7313538 - DNA, 22 bp, Homo sapiens
atgattttctgataaagaactg

SEQ ID NO: 7313539 - DNA, 22 bp, Homo sapiens
atgcaaatgtcaccacttctaa

SEQ ID NO: 7313540 - DNA, 22 bp, Homo sapiens
atgatttccagttgttgctaag

SEQ ID NO: 7313541 - DNA, 22 bp, Homo sapiens
atgatttctatataaacttaaa

SEQ ID NO: 7313542 - DNA, 22 bp, Homo sapiens
atgattttctgataaagaactg

SEQ ID NO: 7313543 - DNA, 19 bp, Homo sapiens
atgattgtctatggaggaa

SEQ ID NO: 7313544 - DNA, 22 bp, Homo sapiens
atgaggagctgttttaactgct

SEQ ID NO: 7313545 - DNA, 22 bp, Homo sapiens
atgaggaggccagtaagagcct

SEQ ID NO: 7313546 - DNA, 22 bp, Homo sapiens
atgacatttatacagtgagctt

SEQ ID NO: 7313547 - DNA, 22 bp, Homo sapiens
atcttacctcttcctctgcatt

SEQ ID NO: 7313548 - DNA, 22 bp, Homo sapiens
atctggaaaacacagtgtagac

SEQ ID NO: 7313549 - DNA, 22 bp, Homo sapiens
atctggctgactttgtgggaca

SEQ ID NO: 7313550 - DNA, 22 bp, Homo sapiens
atctggggtgaataggttatgt

SEQ ID NO: 7313551 - DNA, 22 bp, Homo sapiens
atctgggggagctgctcatgga

SEQ ID NO: 7313552 - DNA, 22 bp, Homo sapiens
atctggggtcagacagccctgg

SEQ ID NO: 7313553 - DNA, 22 bp, Homo sapiens
atctggggtcagacagccctgg

SEQ ID NO: 7313554 - DNA, 22 bp, Homo sapiens
atctggggaggtatctgtagtc

SEQ ID NO: 7313555 - DNA, 22 bp, Homo sapiens
atctggggcctgggctagccat

SEQ ID NO: 7313556 - DNA, 22 bp, Homo sapiens
atctggggccccggaagttcct

SEQ ID NO: 7313557 - DNA, 22 bp, Homo sapiens
atctggggaggtatctgtagtc

SEQ ID NO: 7313558 - DNA, 21 bp, Homo sapiens
atcttaaaaggtcttaacttt

SEQ ID NO: 7313559 - DNA, 21 bp, Homo sapiens
atcttaaaaggtcttaacttt

SEQ ID NO: 7313560 - DNA, 22 bp, Homo sapiens
atcttaaacagaggaatgactt

SEQ ID NO: 7313561 - DNA, 23 bp, Homo sapiens
atctgttgtgcctcttatatgta

SEQ ID NO: 7313562 - DNA, 22 bp, Homo sapiens
atctgttgtttgtttgctaaag

SEQ ID NO: 7313563 - DNA, 22 bp, Homo sapiens
atctgttgttttctcatatgtt

SEQ ID NO: 7313564 - DNA, 22 bp, Homo sapiens
atgccagaaggcagaatttatc

SEQ ID NO: 7313565 - DNA, 22 bp, Homo sapiens
atgccacttctctaagtcatgt

SEQ ID NO: 7313566 - DNA, 22 bp, Homo sapiens
atgcaacaaatgctacgaatcg

SEQ ID NO: 7313567 - DNA, 22 bp, Homo sapiens
atgcaacagagaaaatattgag

SEQ ID NO: 7313568 - DNA, 22 bp, Homo sapiens
agacataattaattagttctac

SEQ ID NO: 7313569 - DNA, 22 bp, Homo sapiens
agacataagcgagcatcacagg

SEQ ID NO: 7313570 - DNA, 22 bp, Homo sapiens
agacataagcgagcatcacagg

SEQ ID NO: 7313571 - DNA, 22 bp, Homo sapiens
agacataaacttactgaaatac

SEQ ID NO: 7313572 - DNA, 22 bp, Homo sapiens
agacagtgtgtgtatatatggt

SEQ ID NO: 7313573 - DNA, 20 bp, Homo sapiens
agacagtggggagctcctag

SEQ ID NO: 7313574 - DNA, 20 bp, Homo sapiens
agacagtgtggagattcctt

SEQ ID NO: 7313575 - DNA, 22 bp, Homo sapiens
atgccatttgctggaaggaagt

SEQ ID NO: 7313576 - DNA, 22 bp, Homo sapiens
atgccatttcaaaataagattt

SEQ ID NO: 7313577 - DNA, 22 bp, Homo sapiens
atgccatttcaaaataagattt

SEQ ID NO: 7313578 - DNA, 23 bp, Homo sapiens
agacagtggccgagaggtactag

SEQ ID NO: 7313579 - DNA, 22 bp, Homo sapiens
agacagtggatcgggatgcact

SEQ ID NO: 7313580 - DNA, 22 bp, Homo sapiens
atgcgtgtaggaacagtgtcta

SEQ ID NO: 7313581 - DNA, 22 bp, Homo sapiens
atgcgtgtttgtatacacacaa

SEQ ID NO: 7313582 - DNA, 22 bp, Homo sapiens
atgctgaagagagaactactca

SEQ ID NO: 7313583 - DNA, 22 bp, Homo sapiens
atgcgtgtttgtatacacacaa

SEQ ID NO: 7313584 - DNA, 22 bp, Homo sapiens
atgcgtgtgtgcaaaccattgc

SEQ ID NO: 7313585 - DNA, 22 bp, Homo sapiens
atgcgtgtaggaacagtgtcta

SEQ ID NO: 7313586 - DNA, 22 bp, Homo sapiens
atgcgtgcaggggtcctcctgg

SEQ ID NO: 7313587 - DNA, 22 bp, Homo sapiens
atgctgaatagttcactcttct

SEQ ID NO: 7313588 - DNA, 22 bp, Homo sapiens
atgctgaagagttcatgattat

SEQ ID NO: 7313589 - DNA, 22 bp, Homo sapiens
atgctgagtgagtgaaacccag

SEQ ID NO: 7313590 - DNA, 22 bp, Homo sapiens
agagaacaaattaaaggtggtt

SEQ ID NO: 7313591 - DNA, 22 bp, Homo sapiens
atgttacagaaagcaaagatga

SEQ ID NO: 7313592 - DNA, 22 bp, Homo sapiens
atgttacagaaactaagaggct

SEQ ID NO: 7313593 - DNA, 22 bp, Homo sapiens
agagccaggatgtcttctgggg

SEQ ID NO: 7313594 - DNA, 18 bp, Homo sapiens
agagatggtgtagagttt

SEQ ID NO: 7313595 - DNA, 22 bp, Homo sapiens
atgtgcataaacatattgttgg

SEQ ID NO: 7313596 - DNA, 23 bp, Homo sapiens
atgtgcaaagtgctacagtatag

SEQ ID NO: 7313597 - DNA, 22 bp, Homo sapiens
atgtgcaaattattttgccaga

SEQ ID NO: 7313598 - DNA, 22 bp, Homo sapiens
atgtgcaacttcagcagaaagg

SEQ ID NO: 7313599 - DNA, 22 bp, Homo sapiens
atgtgcaattattaagaagaga

SEQ ID NO: 7313600 - DNA, 18 bp, Homo sapiens
atgtgcaattttgtattt

SEQ ID NO: 7313601 - DNA, 21 bp, Homo sapiens
atgttcactgggtcaattaga

SEQ ID NO: 7313602 - DNA, 21 bp, Homo sapiens
atgttcactgggtcaattaga

SEQ ID NO: 7313603 - DNA, 18 bp, Homo sapiens
attaaggaattctttaga

SEQ ID NO: 7313604 - DNA, 22 bp, Homo sapiens
agagctcccgagacaatgtatt

SEQ ID NO: 7313605 - DNA, 22 bp, Homo sapiens
agagctccagggttttgtagtg

SEQ ID NO: 7313606 - DNA, 22 bp, Homo sapiens
agagctccaagaagtcctgcag

SEQ ID NO: 7313607 - DNA, 22 bp, Homo sapiens
agagctcctcacttcgggttca

SEQ ID NO: 7313608 - DNA, 22 bp, Homo sapiens
agagctccgtgcctggctgcca

SEQ ID NO: 7313609 - DNA, 22 bp, Homo sapiens
agagctcctaaatgtagccaac

SEQ ID NO: 7313610 - DNA, 22 bp, Homo sapiens
attaaatactgcaggctaagca

SEQ ID NO: 7313611 - DNA, 22 bp, Homo sapiens
agagctcctgcattcttccctg

SEQ ID NO: 7313612 - DNA, 22 bp, Homo sapiens
agagctctgcagctggcctcag

SEQ ID NO: 7313613 - DNA, 22 bp, Homo sapiens
atgtatatacttacatgtgtgg

SEQ ID NO: 7313614 - DNA, 22 bp, Homo sapiens
atgtatatgaagctagtatttt

SEQ ID NO: 7313615 - DNA, 22 bp, Homo sapiens
atgtagtactgggtatgtttct

SEQ ID NO: 7313616 - DNA, 20 bp, Homo sapiens
atgtatattactggctgtga

SEQ ID NO: 7313617 - DNA, 17 bp, Homo sapiens
atgtatattaactctga

SEQ ID NO: 7313618 - DNA, 22 bp, Homo sapiens
atgtatatgcatgcattcaaag

SEQ ID NO: 7313619 - DNA, 22 bp, Homo sapiens
atgtatatgtgaaagatgttta

SEQ ID NO: 7313620 - DNA, 22 bp, Homo sapiens
atgtatatgtgtgcacgcacag

SEQ ID NO: 7313621 - DNA, 22 bp, Homo sapiens
atgtacatagcatcatctagga

SEQ ID NO: 7313622 - DNA, 22 bp, Homo sapiens
atgtacatactgcattttcaaa

SEQ ID NO: 7313623 - DNA, 17 bp, Homo sapiens
agagagaaaagggccat

SEQ ID NO: 7313624 - DNA, 19 bp, Homo sapiens
agagactgccaccagctgt

SEQ ID NO: 7313625 - DNA, 22 bp, Homo sapiens
agagactgcgtgtcagcgctgg

SEQ ID NO: 7313626 - DNA, 18 bp, Homo sapiens
atgggaggggccaagaga

SEQ ID NO: 7313627 - DNA, 22 bp, Homo sapiens
agagaacattagcaaaaacagc

SEQ ID NO: 7313628 - DNA, 22 bp, Homo sapiens
agagaagacttacagccacagt

SEQ ID NO: 7313629 - DNA, 22 bp, Homo sapiens
attgttaaactgaagcattact

SEQ ID NO: 7313630 - DNA, 22 bp, Homo sapiens
attgttaaagtaataaccatgg

SEQ ID NO: 7313631 - DNA, 22 bp, Homo sapiens
attgtgtatgttaattctgtaa

SEQ ID NO: 7313632 - DNA, 22 bp, Homo sapiens
attgtgtagtagtattctgttt

SEQ ID NO: 7313633 - DNA, 22 bp, Homo sapiens
attgtgtggtgaatgatcagct

SEQ ID NO: 7313634 - DNA, 22 bp, Homo sapiens
attgtggtgtcagttataggca

SEQ ID NO: 7313635 - DNA, 22 bp, Homo sapiens
attgtggaccaggtagagcttt

SEQ ID NO: 7313636 - DNA, 22 bp, Homo sapiens
attgtggccacagagatccaat

SEQ ID NO: 7313637 - DNA, 14 bp, Homo sapiens
attgtgcatgccat

SEQ ID NO: 7313638 - DNA, 22 bp, Homo sapiens
attgtgctttagatcacagtct

SEQ ID NO: 7313639 - DNA, 22 bp, Homo sapiens
attgtgcttcctgaaatttgat

SEQ ID NO: 7313640 - DNA, 22 bp, Homo sapiens
attgtgctgctgctgacgttta

SEQ ID NO: 7313641 - DNA, 22 bp, Homo sapiens
agatacaactgtttaaacatta

SEQ ID NO: 7313642 - DNA, 22 bp, Homo sapiens
agatacaagttaagagaaagga

SEQ ID NO: 7313643 - DNA, 22 bp, Homo sapiens
agatacacagagcatcttcaga

SEQ ID NO: 7313644 - DNA, 22 bp, Homo sapiens
agatacagacctcttattaagg

SEQ ID NO: 7313645 - DNA, 22 bp, Homo sapiens
agatacacttgttccttccact

SEQ ID NO: 7313646 - DNA, 22 bp, Homo sapiens
agatacacagagcatcttcaga

SEQ ID NO: 7313647 - DNA, 22 bp, Homo sapiens
atttacagatgatgctatttga

SEQ ID NO: 7313648 - DNA, 22 bp, Homo sapiens
agatacaaaggcctacagagca

SEQ ID NO: 7313649 - DNA, 22 bp, Homo sapiens
agatacaactgtttaaacatta

SEQ ID NO: 7313650 - DNA, 22 bp, Homo sapiens
agatacaaaaagggagaagatt

SEQ ID NO: 7313651 - DNA, 22 bp, Homo sapiens
agatacaaaagataagatttag

SEQ ID NO: 7313652 - DNA, 22 bp, Homo sapiens
attgttaataactattacattg

SEQ ID NO: 7313653 - DNA, 22 bp, Homo sapiens
attgagaatgcaatctactatg

SEQ ID NO: 7313654 - DNA, 22 bp, Homo sapiens
attgtataacagcatgtatttt

SEQ ID NO: 7313655 - DNA, 22 bp, Homo sapiens
attggtgctctggcacattcct

SEQ ID NO: 7313656 - DNA, 22 bp, Homo sapiens
attggtgctctggcacattcct

SEQ ID NO: 7313657 - DNA, 22 bp, Homo sapiens
attggtgcattttacaaaactc

SEQ ID NO: 7313658 - DNA, 22 bp, Homo sapiens
attgtataacagcatgtatttt

SEQ ID NO: 7313659 - DNA, 22 bp, Homo sapiens
attgtatgatgtgcttcacttt

SEQ ID NO: 7313660 - DNA, 22 bp, Homo sapiens
attgtataagtctatttacaat

SEQ ID NO: 7313661 - DNA, 22 bp, Homo sapiens
attgagaagaaaatctaatata

SEQ ID NO: 7313662 - DNA, 22 bp, Homo sapiens
attgaaaaattcacaattctgg

SEQ ID NO: 7313663 - DNA, 22 bp, Homo sapiens
attgaaaaattcacaattctgg

SEQ ID NO: 7313664 - DNA, 22 bp, Homo sapiens
attgaaaataaggccagaaaca

SEQ ID NO: 7313665 - DNA, 22 bp, Homo sapiens
attgaaaataaggccagaaaca

SEQ ID NO: 7313666 - DNA, 22 bp, Homo sapiens
attgaaaataaggccagaaaca

SEQ ID NO: 7313667 - DNA, 22 bp, Homo sapiens
attgaaaatgacatttgtgccc

SEQ ID NO: 7313668 - DNA, 22 bp, Homo sapiens
attgaaaatataattctaggag

SEQ ID NO: 7313669 - DNA, 22 bp, Homo sapiens
agaggaaaatgagttccagaat

SEQ ID NO: 7313670 - DNA, 22 bp, Homo sapiens
attcgcgggcctggagggtggg

SEQ ID NO: 7313671 - DNA, 22 bp, Homo sapiens
attcgggagataaggcttctgc

SEQ ID NO: 7313672 - DNA, 22 bp, Homo sapiens
attgaaaaatgactattgctta

SEQ ID NO: 7313673 - DNA, 22 bp, Homo sapiens
attcttctgcctactttcatcc

SEQ ID NO: 7313674 - DNA, 22 bp, Homo sapiens
attctctctagaagctgagatg

SEQ ID NO: 7313675 - DNA, 22 bp, Homo sapiens
caaagttttagtaaacatatat

SEQ ID NO: 7313676 - DNA, 22 bp, Homo sapiens
caaagtttaaagtagatttcag

SEQ ID NO: 7313677 - DNA, 22 bp, Homo sapiens
caaagttatgaatgataagatt

SEQ ID NO: 7313678 - DNA, 22 bp, Homo sapiens
agcaatgactttgaaatcatga

SEQ ID NO: 7313679 - DNA, 22 bp, Homo sapiens
caaacatttgacttctctcagg

SEQ ID NO: 7313680 - DNA, 22 bp, Homo sapiens
caaacattttaaataagggata

SEQ ID NO: 7313681 - DNA, 22 bp, Homo sapiens
caaacattttgagtggtttctg

SEQ ID NO: 7313682 - DNA, 22 bp, Homo sapiens
attttgttatcagggctttgca

SEQ ID NO: 7313683 - DNA, 22 bp, Homo sapiens
attttgttatagaactctgtga

SEQ ID NO: 7313684 - DNA, 22 bp, Homo sapiens
attttgtgaaccctcaagcaat

SEQ ID NO: 7313685 - DNA, 20 bp, Homo sapiens
attttgtttatgttcctctc

SEQ ID NO: 7313686 - DNA, 20 bp, Homo sapiens
attttgtttatgttcctctc

SEQ ID NO: 7313687 - DNA, 22 bp, Homo sapiens
attttttagccaagactctgca

SEQ ID NO: 7313688 - DNA, 22 bp, Homo sapiens
agcaaggggcagtgaaagtgtg

SEQ ID NO: 7313689 - DNA, 22 bp, Homo sapiens
agcaaggtgacatcatgctgag

SEQ ID NO: 7313690 - DNA, 22 bp, Homo sapiens
agcaaggtctccctgcacctgg

SEQ ID NO: 7313691 - DNA, 22 bp, Homo sapiens
agcaagttgaatgataatactc

SEQ ID NO: 7313692 - DNA, 22 bp, Homo sapiens
agatttatgtggtcacactcag

SEQ ID NO: 7313693 - DNA, 21 bp, Homo sapiens
attttgtacatagaatttgtc

SEQ ID NO: 7313694 - DNA, 22 bp, Homo sapiens
agattctaccagagctagtttg

SEQ ID NO: 7313695 - DNA, 22 bp, Homo sapiens
agattcctgttgtatggagggg

SEQ ID NO: 7313696 - DNA, 22 bp, Homo sapiens
agattcctcagtcatgaagcct

SEQ ID NO: 7313697 - DNA, 22 bp, Homo sapiens
agattcctgaaactgccattgg

SEQ ID NO: 7313698 - DNA, 22 bp, Homo sapiens
agattcctaaagtaagatatca

SEQ ID NO: 7313699 - DNA, 22 bp, Homo sapiens
agattcctagtgttatttctgt

SEQ ID NO: 7313700 - DNA, 22 bp, Homo sapiens
agatgatgataattgaaaggca

SEQ ID NO: 7313701 - DNA, 22 bp, Homo sapiens
agatgtttcagtaatttatctt

SEQ ID NO: 7313702 - DNA, 22 bp, Homo sapiens
agatgtttgtaaacacactgct

SEQ ID NO: 7313703 - DNA, 21 bp, Homo sapiens
agatgtttcccccttggcttc

SEQ ID NO: 7313704 - DNA, 22 bp, Homo sapiens
atttgaaatcccttctactgta

SEQ ID NO: 7313705 - DNA, 22 bp, Homo sapiens
atttgaaatctgggttactctg

SEQ ID NO: 7313706 - DNA, 19 bp, Homo sapiens
atttgaaagctgtgcttgc

SEQ ID NO: 7313707 - DNA, 22 bp, Homo sapiens
atttgaaatcccttctactgta

SEQ ID NO: 7313708 - DNA, 23 bp, Homo sapiens
agatgaggcttctccatgttggt

SEQ ID NO: 7313709 - DNA, 22 bp, Homo sapiens
agatgaggggtagaaaggactt

SEQ ID NO: 7313710 - DNA, 22 bp, Homo sapiens
atttacagccttgccatctata

SEQ ID NO: 7313711 - DNA, 22 bp, Homo sapiens
atttctcttagcaagacattac

SEQ ID NO: 7313712 - DNA, 23 bp, Homo sapiens
atttacaggttaaatgaaatcag

SEQ ID NO: 7313713 - DNA, 22 bp, Homo sapiens
atttacaggtagaattttaagt

SEQ ID NO: 7313714 - DNA, 22 bp, Homo sapiens
atttctttctggccacggtttt

SEQ ID NO: 7313715 - DNA, 22 bp, Homo sapiens
atttcttttcaagagggtgctt

SEQ ID NO: 7313716 - DNA, 22 bp, Homo sapiens
atttgaaaacctgagcctcccg

SEQ ID NO: 7313717 - DNA, 22 bp, Homo sapiens
atttcttttcaagagggtgctt

SEQ ID NO: 7313718 - DNA, 23 bp, Homo sapiens
atttgaaactttcttgtttccag

SEQ ID NO: 7313719 - DNA, 22 bp, Homo sapiens
agcccttagtacatttctcaag

SEQ ID NO: 7313720 - DNA, 22 bp, Homo sapiens
cagatattaggagctcaataat

SEQ ID NO: 7313721 - DNA, 22 bp, Homo sapiens
agcctattccaggatgagctca

SEQ ID NO: 7313722 - DNA, 22 bp, Homo sapiens
cagatcttgtactcattattga

SEQ ID NO: 7313723 - DNA, 22 bp, Homo sapiens
cagatctgtttgccagatcagc

SEQ ID NO: 7313724 - DNA, 22 bp, Homo sapiens
cagatctgagccaagctcgatg

SEQ ID NO: 7313725 - DNA, 22 bp, Homo sapiens
cagatctgtagtaaaagatctc

SEQ ID NO: 7313726 - DNA, 22 bp, Homo sapiens
cagagctgttactattcatgaa

SEQ ID NO: 7313727 - DNA, 22 bp, Homo sapiens
cagagccatggtatgggcttgt

SEQ ID NO: 7313728 - DNA, 22 bp, Homo sapiens
cagagccatccaggtgcctgtt

SEQ ID NO: 7313729 - DNA, 22 bp, Homo sapiens
cagagccaggtggtgttggggc

SEQ ID NO: 7313730 - DNA, 22 bp, Homo sapiens
agccagggacgctgcaggctac

SEQ ID NO: 7313731 - DNA, 22 bp, Homo sapiens
agccagggaagaggcctacctc

SEQ ID NO: 7313732 - DNA, 22 bp, Homo sapiens
agccaagagctcacctcgtgtg

SEQ ID NO: 7313733 - DNA, 22 bp, Homo sapiens
agccaggggagtcagctgctgg

SEQ ID NO: 7313734 - DNA, 22 bp, Homo sapiens
cagcgcagtgtaggtggggggc

SEQ ID NO: 7313735 - DNA, 22 bp, Homo sapiens
cagcggggcctgtgctggggag

SEQ ID NO: 7313736 - DNA, 22 bp, Homo sapiens
cagcggaggacagatgggagct

SEQ ID NO: 7313737 - DNA, 22 bp, Homo sapiens
cagcctctttccacatcaggca

SEQ ID NO: 7313738 - DNA, 18 bp, Homo sapiens
cagctgccagctcatgga

SEQ ID NO: 7313739 - DNA, 22 bp, Homo sapiens
cagctgagagtagaaatggagg

SEQ ID NO: 7313740 - DNA, 20 bp, Homo sapiens
agctgaggcacctgaggtta

SEQ ID NO: 7313741 - DNA, 19 bp, Homo sapiens
cagctggaatcatctgagg

SEQ ID NO: 7313742 - DNA, 22 bp, Homo sapiens
cagctggatccctgcagaactt

SEQ ID NO: 7313743 - DNA, 22 bp, Homo sapiens
cagctggaggagcagcttccag

SEQ ID NO: 7313744 - DNA, 22 bp, Homo sapiens
agctgaggacgtgaagggcggc

SEQ ID NO: 7313745 - DNA, 22 bp, Homo sapiens
agctgaggaggaatgatgggta

SEQ ID NO: 7313746 - DNA, 22 bp, Homo sapiens
agctctggctaagctgataaat

SEQ ID NO: 7313747 - DNA, 22 bp, Homo sapiens
cagccagtgtgaccgaggagga

SEQ ID NO: 7313748 - DNA, 22 bp, Homo sapiens
cagcccacgtcagggccactca

SEQ ID NO: 7313749 - DNA, 22 bp, Homo sapiens
cagcccacctggcacgtgtgtt

SEQ ID NO: 7313750 - DNA, 22 bp, Homo sapiens
cagcctcctgggacactcaccg

SEQ ID NO: 7313751 - DNA, 22 bp, Homo sapiens
cagcctctaagcacagcctctc

SEQ ID NO: 7313752 - DNA, 22 bp, Homo sapiens
cagcctctctgtatctcaggat

SEQ ID NO: 7313753 - DNA, 22 bp, Homo sapiens
cagccccacacggtctagctct

SEQ ID NO: 7313754 - DNA, 22 bp, Homo sapiens
agcgagggaggtctgaggacag

SEQ ID NO: 7313755 - DNA, 22 bp, Homo sapiens
agcgccactgcactccagcctg

SEQ ID NO: 7313756 - DNA, 22 bp, Homo sapiens
cagcatgtatctttcaggtgtg

SEQ ID NO: 7313757 - DNA, 22 bp, Homo sapiens
cagcatcaccaacttgagcaat

SEQ ID NO: 7313758 - DNA, 22 bp, Homo sapiens
cagcatcaccgccatttctgat

SEQ ID NO: 7313759 - DNA, 22 bp, Homo sapiens
agcaattggaatttagacaaga

SEQ ID NO: 7313760 - DNA, 20 bp, Homo sapiens
agcaattgtgaacttattca

SEQ ID NO: 7313761 - DNA, 22 bp, Homo sapiens
caaggaaaacagatgatcaaca

SEQ ID NO: 7313762 - DNA, 22 bp, Homo sapiens
agcagagaagacacaggcttca

SEQ ID NO: 7313763 - DNA, 22 bp, Homo sapiens
agcagacaggtaggaggataaa

SEQ ID NO: 7313764 - DNA, 22 bp, Homo sapiens
agcagacatatctcatgtcaca

SEQ ID NO: 7313765 - DNA, 22 bp, Homo sapiens
agcagacatatctcatgtcaca

SEQ ID NO: 7313766 - DNA, 21 bp, Homo sapiens
agcagacagatgcacgcacac

SEQ ID NO: 7313767 - DNA, 22 bp, Homo sapiens
caaggaagttttaggagaggaa

SEQ ID NO: 7313768 - DNA, 22 bp, Homo sapiens
caaggaagttttaggagaggaa

SEQ ID NO: 7313769 - DNA, 22 bp, Homo sapiens
caaggaaggagagatgatgggt

SEQ ID NO: 7313770 - DNA, 22 bp, Homo sapiens
caaggaagacccacgcagatat

SEQ ID NO: 7313771 - DNA, 22 bp, Homo sapiens
caagggagttgctgcatgcagg

SEQ ID NO: 7313772 - DNA, 22 bp, Homo sapiens
caagggagttgctgcatgcagg

SEQ ID NO: 7313773 - DNA, 22 bp, Homo sapiens
caagggagttgctgcatgcagg

SEQ ID NO: 7313774 - DNA, 22 bp, Homo sapiens
caatgtttttccttccttaata

SEQ ID NO: 7313775 - DNA, 22 bp, Homo sapiens
caatgattctgcaactgtgtgc

SEQ ID NO: 7313776 - DNA, 22 bp, Homo sapiens
caattacatttattgagcattc

SEQ ID NO: 7313777 - DNA, 22 bp, Homo sapiens
caatttttgtacttatagtact

SEQ ID NO: 7313778 - DNA, 22 bp, Homo sapiens
caatttttgtacttatagtact

SEQ ID NO: 7313779 - DNA, 22 bp, Homo sapiens
caattttattggtccaaataca

SEQ ID NO: 7313780 - DNA, 22 bp, Homo sapiens
caattttactcttcctcttcca

SEQ ID NO: 7313781 - DNA, 22 bp, Homo sapiens
caatttttaaactatgaagttg

SEQ ID NO: 7313782 - DNA, 22 bp, Homo sapiens
cacacatggtagcaggtacaag

SEQ ID NO: 7313783 - DNA, 22 bp, Homo sapiens
cacacttttggcatgtttggtt

SEQ ID NO: 7313784 - DNA, 22 bp, Homo sapiens
cacacttttctggctcaggctc

SEQ ID NO: 7313785 - DNA, 22 bp, Homo sapiens
cacagaaaaaggcttgaaaatc

SEQ ID NO: 7313786 - DNA, 22 bp, Homo sapiens
cacaggaagcaagcctggggcc

SEQ ID NO: 7313787 - DNA, 22 bp, Homo sapiens
cacaggaaatgattctgcagca

SEQ ID NO: 7313788 - DNA, 22 bp, Homo sapiens
cacagaacatccttagctcatg

SEQ ID NO: 7313789 - DNA, 22 bp, Homo sapiens
cacagcagcgttcctccgtgtg

SEQ ID NO: 7313790 - DNA, 20 bp, Homo sapiens
cacagaacaaattgcaggac

SEQ ID NO: 7313791 - DNA, 22 bp, Homo sapiens
cactgcactccagcccgggcaa

SEQ ID NO: 7313792 - DNA, 22 bp, Homo sapiens
cactgcaacctccacctcctgg

SEQ ID NO: 7313793 - DNA, 20 bp, Homo sapiens
agcatttgaaatatgactat

SEQ ID NO: 7313794 - DNA, 22 bp, Homo sapiens
agcatttgatatgtttaaaaag

SEQ ID NO: 7313795 - DNA, 22 bp, Homo sapiens
agcatttatgactaatgtaaaa

SEQ ID NO: 7313796 - DNA, 22 bp, Homo sapiens
cagaaagacctgattggcagtt

SEQ ID NO: 7313797 - DNA, 22 bp, Homo sapiens
cagaaagacctgattggcagtt

SEQ ID NO: 7313798 - DNA, 22 bp, Homo sapiens
cagaaagacctgattggcagtt

SEQ ID NO: 7313799 - DNA, 20 bp, Homo sapiens
cagaaagaaggtagattttt

SEQ ID NO: 7313800 - DNA, 22 bp, Homo sapiens
cactttgatttgtgatgtgaga

SEQ ID NO: 7313801 - DNA, 22 bp, Homo sapiens
cactaaaactacattggaaaca

SEQ ID NO: 7313802 - DNA, 22 bp, Homo sapiens
cacatttaagcagatgtggacc

SEQ ID NO: 7313803 - DNA, 22 bp, Homo sapiens
cacatttaagtgcttgttcaga

SEQ ID NO: 7313804 - DNA, 22 bp, Homo sapiens
cacattgtattgtggaaagtta

SEQ ID NO: 7313805 - DNA, 22 bp, Homo sapiens
cacatttaaaggttgaagctga

SEQ ID NO: 7313806 - DNA, 22 bp, Homo sapiens
cacatttaagcagatgtggacc

SEQ ID NO: 7313807 - DNA, 22 bp, Homo sapiens
cacatttaagcagatgtggacc

SEQ ID NO: 7313808 - DNA, 22 bp, Homo sapiens
cacatttaaaaaatccacgatc

SEQ ID NO: 7313809 - DNA, 22 bp, Homo sapiens
cacatttaaaaaatccacgatc

SEQ ID NO: 7313810 - DNA, 22 bp, Homo sapiens
cacatttaaaggttgaagctga

SEQ ID NO: 7313811 - DNA, 22 bp, Homo sapiens
agcaggtggccacgaggaggag

SEQ ID NO: 7313812 - DNA, 22 bp, Homo sapiens
cactagctccatttctgggagg

SEQ ID NO: 7313813 - DNA, 22 bp, Homo sapiens
cactagaaaggtacagattatg

SEQ ID NO: 7313814 - DNA, 23 bp, Homo sapiens
cacatggattaaatgagaccaca

SEQ ID NO: 7313815 - DNA, 22 bp, Homo sapiens
cacatggaagagatacagtgag

SEQ ID NO: 7313816 - DNA, 22 bp, Homo sapiens
cacatgaagacctaattggatt

SEQ ID NO: 7313817 - DNA, 22 bp, Homo sapiens
agcaggctactcctgtgttcgt

SEQ ID NO: 7313818 - DNA, 19 bp, Homo sapiens
agcaggctaggctgcctct

SEQ ID NO: 7313819 - DNA, 19 bp, Homo sapiens
agcaggctaggctgcctct

SEQ ID NO: 7313820 - DNA, 22 bp, Homo sapiens
aggtggagaagagatgggcagt

SEQ ID NO: 7313821 - DNA, 22 bp, Homo sapiens
aggtgggttcccgactctggct

SEQ ID NO: 7313822 - DNA, 22 bp, Homo sapiens
aggtgtccggctgcataatctt

SEQ ID NO: 7313823 - DNA, 22 bp, Homo sapiens
actcagagcctcgagggactgc

SEQ ID NO: 7313824 - DNA, 22 bp, Homo sapiens
agggtcagtgatgagggagccc

SEQ ID NO: 7313825 - DNA, 23 bp, Homo sapiens
agggtccagggatcaccaggtgt

SEQ ID NO: 7313826 - DNA, 22 bp, Homo sapiens
agggtgcaaaagcaaggacagt

SEQ ID NO: 7313827 - DNA, 21 bp, Homo sapiens
agggtcctacagggctcagga

SEQ ID NO: 7313828 - DNA, 22 bp, Homo sapiens
agggtcctaagcctcagataag

SEQ ID NO: 7313829 - DNA, 22 bp, Homo sapiens
aggtgaggataggtggccaagg

SEQ ID NO: 7313830 - DNA, 22 bp, Homo sapiens
aggtgcttggtaaatattttag

SEQ ID NO: 7313831 - DNA, 22 bp, Homo sapiens
aggtgccagcagggttgatgac

SEQ ID NO: 7313832 - DNA, 22 bp, Homo sapiens
aggtgccaacagtatttctgcc

SEQ ID NO: 7313833 - DNA, 22 bp, Homo sapiens
agtaagacccagtcacttgaga

SEQ ID NO: 7313834 - DNA, 22 bp, Homo sapiens
agtaacagtaacatcttcctag

SEQ ID NO: 7313835 - DNA, 23 bp, Homo sapiens
agtaacatgcaaataacagtctg

SEQ ID NO: 7313836 - DNA, 22 bp, Homo sapiens
agtaataaactctttttatctc

SEQ ID NO: 7313837 - DNA, 22 bp, Homo sapiens
agtcacttgattctcctgagct

SEQ ID NO: 7313838 - DNA, 22 bp, Homo sapiens
agtccagaccccggcagctggt

SEQ ID NO: 7313839 - DNA, 22 bp, Homo sapiens
agtcctgggtgtgcaaggcaga

SEQ ID NO: 7313840 - DNA, 22 bp, Homo sapiens
agtccttcacgtcctgcttatt

SEQ ID NO: 7313841 - DNA, 22 bp, Homo sapiens
agtgaattagcctatttgtaaa

SEQ ID NO: 7313842 - DNA, 22 bp, Homo sapiens
agtccttgaatgttttgaaatc

SEQ ID NO: 7313843 - DNA, 18 bp, Homo sapiens
agtccttcttggttttac

SEQ ID NO: 7313844 - DNA, 22 bp, Homo sapiens
agtccttcttttagttgcttgg

SEQ ID NO: 7313845 - DNA, 21 bp, Homo sapiens
agtccttgaaactctttcttg

SEQ ID NO: 7313846 - DNA, 22 bp, Homo sapiens
agtgagagtattaatgtgaact

SEQ ID NO: 7313847 - DNA, 22 bp, Homo sapiens
agtgattttatcaatttactca

SEQ ID NO: 7313848 - DNA, 20 bp, Homo sapiens
agtgatttgttagtacattg

SEQ ID NO: 7313849 - DNA, 22 bp, Homo sapiens
agtgctgtctccttcccccggg

SEQ ID NO: 7313850 - DNA, 22 bp, Homo sapiens
agtgcaaagcagcctgtacacc

SEQ ID NO: 7313851 - DNA, 22 bp, Homo sapiens
agtgctttcttgctccatcagt

SEQ ID NO: 7313852 - DNA, 22 bp, Homo sapiens
agtgggagcggcagtcggggac

SEQ ID NO: 7313853 - DNA, 20 bp, Homo sapiens
agtgggagagggcagactgc

SEQ ID NO: 7313854 - DNA, 22 bp, Homo sapiens
agtgtgtgaccttttaatttaa

SEQ ID NO: 7313855 - DNA, 17 bp, Homo sapiens
agtgtgtgaaatggtgg

SEQ ID NO: 7313856 - DNA, 22 bp, Homo sapiens
agtgtgtcttatcctgggagaa

SEQ ID NO: 7313857 - DNA, 17 bp, Homo sapiens
agtgtgtgaaatggtgg

SEQ ID NO: 7313858 - DNA, 22 bp, Homo sapiens
agtgtgtcagttgaaagagatt

SEQ ID NO: 7313859 - DNA, 22 bp, Homo sapiens
agtgtgtagcacatggtaagca

SEQ ID NO: 7313860 - DNA, 22 bp, Homo sapiens
agtgtgtccagaaatctgtatt

SEQ ID NO: 7313861 - DNA, 22 bp, Homo sapiens
agtgtgtcgagggagggtccag

SEQ ID NO: 7313862 - DNA, 22 bp, Homo sapiens
agtgtgtccaggaagcagatgg

SEQ ID NO: 7313863 - DNA, 22 bp, Homo sapiens
agtgtgtctgatcacttgtgag

SEQ ID NO: 7313864 - DNA, 20 bp, Homo sapiens
agtgtgtctcggaggtaagt

SEQ ID NO: 7313865 - DNA, 17 bp, Homo sapiens
agtgtgtaacttgtgta

SEQ ID NO: 7313866 - DNA, 22 bp, Homo sapiens
agtgtctgttgcttttgcagtg

SEQ ID NO: 7313867 - DNA, 22 bp, Homo sapiens
agtgtctgttgttcagaactct

SEQ ID NO: 7313868 - DNA, 22 bp, Homo sapiens
agtgggggccaacgagggcagc

SEQ ID NO: 7313869 - DNA, 22 bp, Homo sapiens
agtgtctgtgctttgcagcaaa

SEQ ID NO: 7313870 - DNA, 22 bp, Homo sapiens
agtgtctgtgctttgcagcaaa

SEQ ID NO: 7313871 - DNA, 22 bp, Homo sapiens
agtgtctgtgttttctattgct

SEQ ID NO: 7313872 - DNA, 22 bp, Homo sapiens
agtgtctgttacgcttgcagaa

SEQ ID NO: 7313873 - DNA, 22 bp, Homo sapiens
agtgtctgttgagtttcaaaag

SEQ ID NO: 7313874 - DNA, 22 bp, Homo sapiens
agtgtctgaacctgcagtggga

SEQ ID NO: 7313875 - DNA, 22 bp, Homo sapiens
agtgtctggtgagggctctctc

SEQ ID NO: 7313876 - DNA, 22 bp, Homo sapiens
agtgtctgaaccaccggggcat

SEQ ID NO: 7313877 - DNA, 20 bp, Homo sapiens
agtgtctggtgcagggcctc

SEQ ID NO: 7313878 - DNA, 22 bp, Homo sapiens
agtgtctgtgatgaggtcagga

SEQ ID NO: 7313879 - DNA, 22 bp, Homo sapiens
agtgtctgtgaggggaattcct

SEQ ID NO: 7313880 - DNA, 19 bp, Homo sapiens
agttatttctaaatttacc

SEQ ID NO: 7313881 - DNA, 22 bp, Homo sapiens
agttacattctgagctgagtag

SEQ ID NO: 7313882 - DNA, 22 bp, Homo sapiens
agttacatgtgaatagaaagta

SEQ ID NO: 7313883 - DNA, 22 bp, Homo sapiens
agttaccagccgtaagaagcat

SEQ ID NO: 7313884 - DNA, 22 bp, Homo sapiens
agttacatgtgaatagaaagta

SEQ ID NO: 7313885 - DNA, 21 bp, Homo sapiens
agttacatgtatagataaagt

SEQ ID NO: 7313886 - DNA, 22 bp, Homo sapiens
agttacatgactgccggcggtg

SEQ ID NO: 7313887 - DNA, 21 bp, Homo sapiens
agttacatgtatagataaagt

SEQ ID NO: 7313888 - DNA, 22 bp, Homo sapiens
agttacatctgttatgtgtgtt

SEQ ID NO: 7313889 - DNA, 22 bp, Homo sapiens
agttacatctgttatgtgtgtt

SEQ ID NO: 7313890 - DNA, 22 bp, Homo sapiens
agttacataatctgtgaatttt

SEQ ID NO: 7313891 - DNA, 22 bp, Homo sapiens
agttacatataagaagacagac

SEQ ID NO: 7313892 - DNA, 22 bp, Homo sapiens
agttacataatctgtgaatttt

SEQ ID NO: 7313893 - DNA, 22 bp, Homo sapiens
agttacagaatgtacagaggtt

SEQ ID NO: 7313894 - DNA, 21 bp, Homo sapiens
agttacaagtttattcagagg

SEQ ID NO: 7313895 - DNA, 22 bp, Homo sapiens
agttacaaacactatcagttct

SEQ ID NO: 7313896 - DNA, 22 bp, Homo sapiens
actggtctaagacattgggacc

SEQ ID NO: 7313897 - DNA, 22 bp, Homo sapiens
actggtctagaagggagaagac

SEQ ID NO: 7313898 - DNA, 22 bp, Homo sapiens
actggggcctcctccatgctct

SEQ ID NO: 7313899 - DNA, 22 bp, Homo sapiens
actggggcagtgggcagtggtt

SEQ ID NO: 7313900 - DNA, 22 bp, Homo sapiens
actggggagttgaagcactttc

SEQ ID NO: 7313901 - DNA, 22 bp, Homo sapiens
actggggattagggactcagtg

SEQ ID NO: 7313902 - DNA, 22 bp, Homo sapiens
agaagcaggcagatttcagctc

SEQ ID NO: 7313903 - DNA, 22 bp, Homo sapiens
agaagcaggcctcacagatctg

SEQ ID NO: 7313904 - DNA, 22 bp, Homo sapiens
agaagcagggcagggaaaagca

SEQ ID NO: 7313905 - DNA, 22 bp, Homo sapiens
agaagcaggcctcacagatctg

SEQ ID NO: 7313906 - DNA, 18 bp, Homo sapiens
agaagcaggttctcccag

SEQ ID NO: 7313907 - DNA, 18 bp, Homo sapiens
agaagcaggtaaaattct

SEQ ID NO: 7313908 - DNA, 22 bp, Homo sapiens
agaagcagttattttttgcaca

SEQ ID NO: 7313909 - DNA, 22 bp, Homo sapiens
agaagcagttattttttgcaca

SEQ ID NO: 7313910 - DNA, 22 bp, Homo sapiens
agaagccaaaggggccagatat

SEQ ID NO: 7313911 - DNA, 22 bp, Homo sapiens
agaagccaaatgccagtgacct

SEQ ID NO: 7313912 - DNA, 22 bp, Homo sapiens
agaaatgttgaatacacaaaat

SEQ ID NO: 7313913 - DNA, 22 bp, Homo sapiens
agaaatgtggatcgttttaaaa

SEQ ID NO: 7313914 - DNA, 22 bp, Homo sapiens
agaaatgttacagttgttattt

SEQ ID NO: 7313915 - DNA, 22 bp, Homo sapiens
agaaatgtcaggaaagaagtcc

SEQ ID NO: 7313916 - DNA, 22 bp, Homo sapiens
agaaatgtaggcatataaggaa

SEQ ID NO: 7313917 - DNA, 22 bp, Homo sapiens
agaaatgtatagtgaatttttc

SEQ ID NO: 7313918 - DNA, 22 bp, Homo sapiens
atctgcttgttgcatgtctgtt

SEQ ID NO: 7313919 - DNA, 22 bp, Homo sapiens
agaagctggaggaagactaagc

SEQ ID NO: 7313920 - DNA, 22 bp, Homo sapiens
atctgcttgttgcatgtctgtt

SEQ ID NO: 7313921 - DNA, 22 bp, Homo sapiens
atctgcttttgagaatttactt

SEQ ID NO: 7313922 - DNA, 22 bp, Homo sapiens
atcctgcttgttacttatagag

SEQ ID NO: 7313923 - DNA, 22 bp, Homo sapiens
agaagccatatttagggaggag

SEQ ID NO: 7313924 - DNA, 22 bp, Homo sapiens
agaagccaccagctgaggaaga

SEQ ID NO: 7313925 - DNA, 22 bp, Homo sapiens
atcctgggaatgggagggtcat

SEQ ID NO: 7313926 - DNA, 20 bp, Homo sapiens
agaaatcagcatgtcctctg

SEQ ID NO: 7313927 - DNA, 22 bp, Homo sapiens
atcaagctacaccctttggaaa

SEQ ID NO: 7313928 - DNA, 22 bp, Homo sapiens
atcaagtgaagggctcttgaag

SEQ ID NO: 7313929 - DNA, 22 bp, Homo sapiens
agaaatgcagtttcaagacaaa

SEQ ID NO: 7313930 - DNA, 20 bp, Homo sapiens
agaaatcagaccacacacta

SEQ ID NO: 7313931 - DNA, 20 bp, Homo sapiens
agaaatcagaccacacacta

SEQ ID NO: 7313932 - DNA, 22 bp, Homo sapiens
agaaatcagaaccctgaagttc

SEQ ID NO: 7313933 - DNA, 22 bp, Homo sapiens
agaaatcagaaccctgaagttc

SEQ ID NO: 7313934 - DNA, 22 bp, Homo sapiens
agaaatcacttagaggaagtga

SEQ ID NO: 7313935 - DNA, 22 bp, Homo sapiens
agaaatcacttaatgaacgtag

SEQ ID NO: 7313936 - DNA, 22 bp, Homo sapiens
agaaatcacaggaggcagaagg

SEQ ID NO: 7313937 - DNA, 22 bp, Homo sapiens
agaaatcaatatctatatgttg

SEQ ID NO: 7313938 - DNA, 22 bp, Homo sapiens
agaaatcaatgaagtctgctaa

SEQ ID NO: 7313939 - DNA, 20 bp, Homo sapiens
agaaatattgagttcagagg

SEQ ID NO: 7313940 - DNA, 22 bp, Homo sapiens
agaaagttttgtgctatatatg

SEQ ID NO: 7313941 - DNA, 22 bp, Homo sapiens
agaaagtttgtttttatccata

SEQ ID NO: 7313942 - DNA, 22 bp, Homo sapiens
atatagtcaaacatatatgtgt

SEQ ID NO: 7313943 - DNA, 20 bp, Homo sapiens
agaaacatttcttgagaact

SEQ ID NO: 7313944 - DNA, 22 bp, Homo sapiens
atatagtttaagaaagtacagt

SEQ ID NO: 7313945 - DNA, 19 bp, Homo sapiens
atatagcattattcaattt

SEQ ID NO: 7313946 - DNA, 22 bp, Homo sapiens
agaaagacgtgatgaagaagta

SEQ ID NO: 7313947 - DNA, 22 bp, Homo sapiens
agaaagacaaaatgcagtggct

SEQ ID NO: 7313948 - DNA, 22 bp, Homo sapiens
agaaagagatgaatgctttaag

SEQ ID NO: 7313949 - DNA, 22 bp, Homo sapiens
agaaagaggatgcagatctcat

SEQ ID NO: 7313950 - DNA, 22 bp, Homo sapiens
atattaagatgctattggtttt

SEQ ID NO: 7313951 - DNA, 22 bp, Homo sapiens
ataacagaataagtcattaccg

SEQ ID NO: 7313952 - DNA, 22 bp, Homo sapiens
ataacagacttagagttacaag

SEQ ID NO: 7313953 - DNA, 20 bp, Homo sapiens
agttcacaggccaaatttct

SEQ ID NO: 7313954 - DNA, 22 bp, Homo sapiens
agttcacagcaaagtggggacc

SEQ ID NO: 7313955 - DNA, 19 bp, Homo sapiens
agttgaattaacttgtcac

SEQ ID NO: 7313956 - DNA, 22 bp, Homo sapiens
agttgaatatacttgctgttgc

SEQ ID NO: 7313957 - DNA, 22 bp, Homo sapiens
agttgacatccagagacattct

SEQ ID NO: 7313958 - DNA, 22 bp, Homo sapiens
agttgacatccagagacattct

SEQ ID NO: 7313959 - DNA, 22 bp, Homo sapiens
agttgaattatgagtgtctttg

SEQ ID NO: 7313960 - DNA, 22 bp, Homo sapiens
agttcttttctagattctggat

SEQ ID NO: 7313961 - DNA, 22 bp, Homo sapiens
agttctttgtgatggaaattta

SEQ ID NO: 7313962 - DNA, 22 bp, Homo sapiens
atacaagttgtgataatgtaaa

SEQ ID NO: 7313963 - DNA, 22 bp, Homo sapiens
atacaagttgtgataatgtaaa

SEQ ID NO: 7313964 - DNA, 22 bp, Homo sapiens
atacaagttgtgataatgtaaa

SEQ ID NO: 7313965 - DNA, 22 bp, Homo sapiens
ataaggtaagggtattgtcaga

SEQ ID NO: 7313966 - DNA, 22 bp, Homo sapiens
ataaggaagttgcagaagtgga

SEQ ID NO: 7313967 - DNA, 22 bp, Homo sapiens
ataaggacttgaattagacatt

SEQ ID NO: 7313968 - DNA, 22 bp, Homo sapiens
atacacactgctatcctttttt

SEQ ID NO: 7313969 - DNA, 19 bp, Homo sapiens
atacacgtgtatacataca

SEQ ID NO: 7313970 - DNA, 22 bp, Homo sapiens
atacacgtgtgtgtacatgcac

SEQ ID NO: 7313971 - DNA, 22 bp, Homo sapiens
atacactactaagcacagattg

SEQ ID NO: 7313972 - DNA, 22 bp, Homo sapiens
atacactactaagcacagattg

SEQ ID NO: 7313973 - DNA, 22 bp, Homo sapiens
atacacacatatgtgagttttg

SEQ ID NO: 7313974 - DNA, 22 bp, Homo sapiens
atacacacgtgcacgtgggaaa

SEQ ID NO: 7313975 - DNA, 22 bp, Homo sapiens
atacacacaatcaggttttgta

SEQ ID NO: 7313976 - DNA, 22 bp, Homo sapiens
atacacacatatgtgagttttg

SEQ ID NO: 7313977 - DNA, 17 bp, Homo sapiens
agaaaagagaccagcag

SEQ ID NO: 7313978 - DNA, 17 bp, Homo sapiens
agaaaagagaccagcag

SEQ ID NO: 7313979 - DNA, 22 bp, Homo sapiens
agaaaaggattgatggatcaga

SEQ ID NO: 7313980 - DNA, 22 bp, Homo sapiens
agaaaagggcaggagggataca

SEQ ID NO: 7313981 - DNA, 22 bp, Homo sapiens
agaaaagggcaggagggataca

SEQ ID NO: 7313982 - DNA, 22 bp, Homo sapiens
agaaaaggcttgaagaggtttt

SEQ ID NO: 7313983 - DNA, 22 bp, Homo sapiens
atagttctggatgtacttatag

SEQ ID NO: 7313984 - DNA, 22 bp, Homo sapiens
atagttcctactttgcactaat

SEQ ID NO: 7313985 - DNA, 22 bp, Homo sapiens
atagttcacagccatgcagtgg

SEQ ID NO: 7313986 - DNA, 22 bp, Homo sapiens
atagctgttgccaatttccatg

SEQ ID NO: 7313987 - DNA, 22 bp, Homo sapiens
atagaacagggcactgtcatga

SEQ ID NO: 7313988 - DNA, 22 bp, Homo sapiens
atacttaactgtggagtcattg

SEQ ID NO: 7313989 - DNA, 22 bp, Homo sapiens
atagaaatgtattttggactag

SEQ ID NO: 7313990 - DNA, 22 bp, Homo sapiens
atacttaatgtcagtttgatgt

SEQ ID NO: 7313991 - DNA, 20 bp, Homo sapiens
atacacttgcccagcttgtg

SEQ ID NO: 7313992 - DNA, 22 bp, Homo sapiens
atactgttggctttggtgatgg

SEQ ID NO: 7313993 - DNA, 22 bp, Homo sapiens
atactgtttctcttctacatga

SEQ ID NO: 7313994 - DNA, 22 bp, Homo sapiens
atacacttccaaatattgatta

SEQ ID NO: 7313995 - DNA, 22 bp, Homo sapiens
actttacaggcacttcaagtat

SEQ ID NO: 7313996 - DNA, 22 bp, Homo sapiens
acaggacaggtaggattcgcag

SEQ ID NO: 7313997 - DNA, 22 bp, Homo sapiens
aggaaagaagtacattctcatg

SEQ ID NO: 7313998 - DNA, 22 bp, Homo sapiens
acaggaagtttggaaagcctca

SEQ ID NO: 7313999 - DNA, 22 bp, Homo sapiens
acaggaagaaagtgcagtagat

SEQ ID NO: 7314000 - DNA, 22 bp, Homo sapiens
acaggaagtgctggcacttaca

SEQ ID NO: 7314001 - DNA, 22 bp, Homo sapiens
acaggaagtgggaagaaacagg

SEQ ID NO: 7314002 - DNA, 22 bp, Homo sapiens
acagccagaggagccaggctgg

SEQ ID NO: 7314003 - DNA, 22 bp, Homo sapiens
acagcagtgtctggtactgagt

SEQ ID NO: 7314004 - DNA, 22 bp, Homo sapiens
acagcagtgggttgccagtggg

SEQ ID NO: 7314005 - DNA, 22 bp, Homo sapiens
aggacagtccggggtcctccac

SEQ ID NO: 7314006 - DNA, 22 bp, Homo sapiens
aggaaaggtagcgtgccagcag

SEQ ID NO: 7314007 - DNA, 22 bp, Homo sapiens
aggaaaggttcagtgattgaaa

SEQ ID NO: 7314008 - DNA, 22 bp, Homo sapiens
aggaaaggttcagtgattgaaa

SEQ ID NO: 7314009 - DNA, 17 bp, Homo sapiens
aggaaagtctgctgtcc

SEQ ID NO: 7314010 - DNA, 22 bp, Homo sapiens
aggaaataagggcacttcagat

SEQ ID NO: 7314011 - DNA, 21 bp, Homo sapiens
acagtgagaaataaatggaaa

SEQ ID NO: 7314012 - DNA, 17 bp, Homo sapiens
acagtgagaagtcatct

SEQ ID NO: 7314013 - DNA, 17 bp, Homo sapiens
acagtgagaagtcatct

SEQ ID NO: 7314014 - DNA, 17 bp, Homo sapiens
acagtgagaagtcatct

SEQ ID NO: 7314015 - DNA, 23 bp, Homo sapiens
acagtgaaacacgcagtaagagt

SEQ ID NO: 7314016 - DNA, 22 bp, Homo sapiens
acagtgaaaataatatcttcaa

SEQ ID NO: 7314017 - DNA, 22 bp, Homo sapiens
aggcagactcaatggctagata

SEQ ID NO: 7314018 - DNA, 22 bp, Homo sapiens
acatctttgctcttatagagct

SEQ ID NO: 7314019 - DNA, 22 bp, Homo sapiens
acatctttatactagtccttga

SEQ ID NO: 7314020 - DNA, 22 bp, Homo sapiens
acatctttatactagtccttga

SEQ ID NO: 7314021 - DNA, 22 bp, Homo sapiens
acatcttcccacacttgcaaaa

SEQ ID NO: 7314022 - DNA, 22 bp, Homo sapiens
acatctgtgcacgccctccttg

SEQ ID NO: 7314023 - DNA, 22 bp, Homo sapiens
aggcagtgtgtagctggaagag

SEQ ID NO: 7314024 - DNA, 22 bp, Homo sapiens
acatatatgtgcacatgtgcag

SEQ ID NO: 7314025 - DNA, 22 bp, Homo sapiens
acatatatgtgcacatgtgcag

SEQ ID NO: 7314026 - DNA, 22 bp, Homo sapiens
acatatatgtaaagtactttgt

SEQ ID NO: 7314027 - DNA, 22 bp, Homo sapiens
acatataagggatcagtgacag

SEQ ID NO: 7314028 - DNA, 22 bp, Homo sapiens
acatatatgcgtgggctcatgg

SEQ ID NO: 7314029 - DNA, 22 bp, Homo sapiens
acatatatgcgtgggctcatgg

SEQ ID NO: 7314030 - DNA, 22 bp, Homo sapiens
acatatatgctgggactgtgac

SEQ ID NO: 7314031 - DNA, 22 bp, Homo sapiens
acatatatgtaaagtactttgt

SEQ ID NO: 7314032 - DNA, 22 bp, Homo sapiens
acatctctccaaaggaaggtgc

SEQ ID NO: 7314033 - DNA, 22 bp, Homo sapiens
acatctcttcttaaggctccag

SEQ ID NO: 7314034 - DNA, 22 bp, Homo sapiens
acatctctgggtcctccatgca

SEQ ID NO: 7314035 - DNA, 22 bp, Homo sapiens
acatctgattacatgagaatat

SEQ ID NO: 7314036 - DNA, 20 bp, Homo sapiens
acatctgagaaacacttaaa

SEQ ID NO: 7314037 - DNA, 22 bp, Homo sapiens
acatctgagcaacagaacacta

SEQ ID NO: 7314038 - DNA, 22 bp, Homo sapiens
acatctgaccattacaagacat

SEQ ID NO: 7314039 - DNA, 22 bp, Homo sapiens
acatctgaaagggattgcagaa

SEQ ID NO: 7314040 - DNA, 22 bp, Homo sapiens
aggcagtgtgtagctggaagag

SEQ ID NO: 7314041 - DNA, 22 bp, Homo sapiens
acatgtaaaagataaattaaca

SEQ ID NO: 7314042 - DNA, 22 bp, Homo sapiens
acatgtaaaaggaacatgcatg

SEQ ID NO: 7314043 - DNA, 22 bp, Homo sapiens
acatgtaaacatttacagtatt

SEQ ID NO: 7314044 - DNA, 22 bp, Homo sapiens
acatgtaacatatatgtagcat

SEQ ID NO: 7314045 - DNA, 21 bp, Homo sapiens
acatgtaagagagtttcaaga

SEQ ID NO: 7314046 - DNA, 22 bp, Homo sapiens
acatgtattgacattatattct

SEQ ID NO: 7314047 - DNA, 22 bp, Homo sapiens
acatgtacatacacatatgtaa

SEQ ID NO: 7314048 - DNA, 22 bp, Homo sapiens
acatgtatacaatgtgtaatga

SEQ ID NO: 7314049 - DNA, 22 bp, Homo sapiens
acatgtatacaatgtgtaatga

SEQ ID NO: 7314050 - DNA, 22 bp, Homo sapiens
acatgtaggagagtcacaatgc

SEQ ID NO: 7314051 - DNA, 23 bp, Homo sapiens
acatgtggagagaacagatatct

SEQ ID NO: 7314052 - DNA, 22 bp, Homo sapiens
acattaaaaaatgttgcatgaa

SEQ ID NO: 7314053 - DNA, 22 bp, Homo sapiens
acattaaaatggagaattttga

SEQ ID NO: 7314054 - DNA, 22 bp, Homo sapiens
acattaaatttcatagtgatta

SEQ ID NO: 7314055 - DNA, 22 bp, Homo sapiens
aggctctcaccctctgaccaga

SEQ ID NO: 7314056 - DNA, 22 bp, Homo sapiens
aggctctccagagagctgcttt

SEQ ID NO: 7314057 - DNA, 22 bp, Homo sapiens
aggctgtgagtagttcttgttg

SEQ ID NO: 7314058 - DNA, 22 bp, Homo sapiens
aggctgtgatctcatgatttgt

SEQ ID NO: 7314059 - DNA, 19 bp, Homo sapiens
aggctgtgagggaggactc

SEQ ID NO: 7314060 - DNA, 22 bp, Homo sapiens
accactggctcaggagctggga

SEQ ID NO: 7314061 - DNA, 22 bp, Homo sapiens
accactgtctacacattgactc

SEQ ID NO: 7314062 - DNA, 22 bp, Homo sapiens
accactgtatctccagcacatt

SEQ ID NO: 7314063 - DNA, 22 bp, Homo sapiens
accactgtactatttgagtggc

SEQ ID NO: 7314064 - DNA, 22 bp, Homo sapiens
accactgtacagcagatatagt

SEQ ID NO: 7314065 - DNA, 18 bp, Homo sapiens
acatttctctctgcgtga

SEQ ID NO: 7314066 - DNA, 22 bp, Homo sapiens
acatttctcaggtaagtcattt

SEQ ID NO: 7314067 - DNA, 22 bp, Homo sapiens
acatttctcaggtaagtcattt

SEQ ID NO: 7314068 - DNA, 22 bp, Homo sapiens
acatttctcatctagtagagta

SEQ ID NO: 7314069 - DNA, 18 bp, Homo sapiens
acatttctccttctgacc

SEQ ID NO: 7314070 - DNA, 22 bp, Homo sapiens
acatttctcctacttgttattt

SEQ ID NO: 7314071 - DNA, 22 bp, Homo sapiens
acctcatctggtttgtaaggca

SEQ ID NO: 7314072 - DNA, 22 bp, Homo sapiens
aggggccaccaccaaggaaggt

SEQ ID NO: 7314073 - DNA, 22 bp, Homo sapiens
aggggtgtgcatcctggaggat

SEQ ID NO: 7314074 - DNA, 22 bp, Homo sapiens
aggggtgtgcatcctggaggat

SEQ ID NO: 7314075 - DNA, 20 bp, Homo sapiens
agggtcagtagcacagagct

SEQ ID NO: 7314076 - DNA, 22 bp, Homo sapiens
aggggtggagagtgttgccagt

SEQ ID NO: 7314077 - DNA, 20 bp, Homo sapiens
aggggtgatcgggtgacact

SEQ ID NO: 7314078 - DNA, 22 bp, Homo sapiens
aggggtgacacatatcagtgca

SEQ ID NO: 7314079 - DNA, 22 bp, Homo sapiens
aggggtgatttgggacaggaca

SEQ ID NO: 7314080 - DNA, 22 bp, Homo sapiens
agggctcagttgcctggagccc

SEQ ID NO: 7314081 - DNA, 22 bp, Homo sapiens
agggctttctttgtaaaagaag

SEQ ID NO: 7314082 - DNA, 22 bp, Homo sapiens
aggggcagttccaagttttgtg

SEQ ID NO: 7314083 - DNA, 22 bp, Homo sapiens
aggggcatcagttgcacatttt

SEQ ID NO: 7314084 - DNA, 22 bp, Homo sapiens
aggggagctaacaccagagccc

SEQ ID NO: 7314085 - DNA, 22 bp, Homo sapiens
aggggagcaaggccgtggtgta

SEQ ID NO: 7314086 - DNA, 22 bp, Homo sapiens
agggctttgagaatagtggaac

SEQ ID NO: 7314087 - DNA, 22 bp, Homo sapiens
agggctttgagaatagtggaac

SEQ ID NO: 7314088 - DNA, 22 bp, Homo sapiens
agggctttgatggcattctcat

SEQ ID NO: 7314089 - DNA, 22 bp, Homo sapiens
agggctttgatggcattctcat

SEQ ID NO: 7314090 - DNA, 22 bp, Homo sapiens
agggcaagggttgaagataaga

SEQ ID NO: 7314091 - DNA, 22 bp, Homo sapiens
accagagcccatctgctcctag

SEQ ID NO: 7314092 - DNA, 18 bp, Homo sapiens
accagagccctgttctgg

SEQ ID NO: 7314093 - DNA, 22 bp, Homo sapiens
agggagctgactggctgccatt

SEQ ID NO: 7314094 - DNA, 22 bp, Homo sapiens
agggccagcagcttggccaacc

SEQ ID NO: 7314095 - DNA, 22 bp, Homo sapiens
agggccagcagcttggccaacc

SEQ ID NO: 7314096 - DNA, 22 bp, Homo sapiens
agggccagcccataatgccaaa

SEQ ID NO: 7314097 - DNA, 22 bp, Homo sapiens
agggccagccaggccctacaaa

SEQ ID NO: 7314098 - DNA, 22 bp, Homo sapiens
agggccagcactcctggcagga

SEQ ID NO: 7314099 - DNA, 22 bp, Homo sapiens
agggccagcactcctggcagga

SEQ ID NO: 7314100 - DNA, 22 bp, Homo sapiens
agggccagatgaagccacaagc

SEQ ID NO: 7314101 - DNA, 21 bp, Homo sapiens
agggccagatcaccaaggagc

SEQ ID NO: 7314102 - DNA, 22 bp, Homo sapiens
agggccagttcagaggacatgg

SEQ ID NO: 7314103 - DNA, 22 bp, Homo sapiens
agggcctggttctgtgtaggga

SEQ ID NO: 7314104 - DNA, 22 bp, Homo sapiens
agggccagttctacctctgaat

SEQ ID NO: 7314105 - DNA, 22 bp, Homo sapiens
agggccagtaaatgtttcctca

SEQ ID NO: 7314106 - DNA, 22 bp, Homo sapiens
agggccagtaccaggtgggtgg

SEQ ID NO: 7314107 - DNA, 22 bp, Homo sapiens
agggccagtgggttgaaaggca

SEQ ID NO: 7314108 - DNA, 22 bp, Homo sapiens
agggccagtattaaggtaatta

SEQ ID NO: 7314109 - DNA, 22 bp, Homo sapiens
agggccagtcgtgtattactgt

SEQ ID NO: 7314110 - DNA, 22 bp, Homo sapiens
cagctgtcagccggtgcaggct

SEQ ID NO: 7314111 - DNA, 22 bp, Homo sapiens
cagctgggtttagtggggtgtg

SEQ ID NO: 7314112 - DNA, 22 bp, Homo sapiens
caggacctaactcacctgtctc

SEQ ID NO: 7314113 - DNA, 22 bp, Homo sapiens
caggactcacttctcacatccc

SEQ ID NO: 7314114 - DNA, 22 bp, Homo sapiens
caggatggcagagaaaagggtg

SEQ ID NO: 7314115 - DNA, 22 bp, Homo sapiens
caggcacacatccgtgagagat

SEQ ID NO: 7314116 - DNA, 22 bp, Homo sapiens
caggatgggtgtcggccagcac

SEQ ID NO: 7314117 - DNA, 22 bp, Homo sapiens
caggctcttccatcctgctgag

SEQ ID NO: 7314118 - DNA, 21 bp, Homo sapiens
caggctctgctgggtgctggg

SEQ ID NO: 7314119 - DNA, 21 bp, Homo sapiens
agcttacattaccattgttgc

SEQ ID NO: 7314120 - DNA, 22 bp, Homo sapiens
caggcccagtgatcagggctct

SEQ ID NO: 7314121 - DNA, 22 bp, Homo sapiens
caggcccagtgatcagggctct

SEQ ID NO: 7314122 - DNA, 22 bp, Homo sapiens
caggcccatctgctcccaggct

SEQ ID NO: 7314123 - DNA, 22 bp, Homo sapiens
agctgtctttctgcctcctgat

SEQ ID NO: 7314124 - DNA, 22 bp, Homo sapiens
agctggtggaagggagcccaaa

SEQ ID NO: 7314125 - DNA, 22 bp, Homo sapiens
caggcagtgtcccaggaagcca

SEQ ID NO: 7314126 - DNA, 22 bp, Homo sapiens
agctgtctctctggtgtccata

SEQ ID NO: 7314127 - DNA, 22 bp, Homo sapiens
caggcaggtcagtgaagaagga

SEQ ID NO: 7314128 - DNA, 22 bp, Homo sapiens
cagtatttggaatatagctaag

SEQ ID NO: 7314129 - DNA, 22 bp, Homo sapiens
cagtatttggaatatagctaag

SEQ ID NO: 7314130 - DNA, 22 bp, Homo sapiens
cagtatttcctcttcttaactt

SEQ ID NO: 7314131 - DNA, 22 bp, Homo sapiens
cagtatttcctcttcttaactt

SEQ ID NO: 7314132 - DNA, 22 bp, Homo sapiens
cagtatttgttacagcattagc

SEQ ID NO: 7314133 - DNA, 22 bp, Homo sapiens
cagtatttatggcttgagtatt

SEQ ID NO: 7314134 - DNA, 22 bp, Homo sapiens
cagtatttaggattaggagaga

SEQ ID NO: 7314135 - DNA, 22 bp, Homo sapiens
aggacagagggaccagagccca

SEQ ID NO: 7314136 - DNA, 22 bp, Homo sapiens
aggacagagggaccagagccca

SEQ ID NO: 7314137 - DNA, 22 bp, Homo sapiens
cagtaaaggttttatggggctt

SEQ ID NO: 7314138 - DNA, 22 bp, Homo sapiens
aggacacttaggttattcaact

SEQ ID NO: 7314139 - DNA, 22 bp, Homo sapiens
aggaatctgggcccaactgtgc

SEQ ID NO: 7314140 - DNA, 22 bp, Homo sapiens
aggaatatggatttgctcagct

SEQ ID NO: 7314141 - DNA, 22 bp, Homo sapiens
aggaagtgctaagagaacatca

SEQ ID NO: 7314142 - DNA, 22 bp, Homo sapiens
aggaagaaacctactagagttt

SEQ ID NO: 7314143 - DNA, 22 bp, Homo sapiens
aggaagaaacctactagagttt

SEQ ID NO: 7314144 - DNA, 22 bp, Homo sapiens
aggaagaaaactaattagatgg

SEQ ID NO: 7314145 - DNA, 22 bp, Homo sapiens
aggaagaaaactaattagatgg

SEQ ID NO: 7314146 - DNA, 21 bp, Homo sapiens
aggaaaggccagcacgtaggg

SEQ ID NO: 7314147 - DNA, 22 bp, Homo sapiens
aggaaaggcctcagcagaaacc

SEQ ID NO: 7314148 - DNA, 19 bp, Homo sapiens
aggaaaggatcaaaatagc

SEQ ID NO: 7314149 - DNA, 23 bp, Homo sapiens
aggaagaggcaatttctcttaga

SEQ ID NO: 7314150 - DNA, 22 bp, Homo sapiens
aggaagagctggaccagaggac

SEQ ID NO: 7314151 - DNA, 22 bp, Homo sapiens
aggaagagcccgggtgacataa

SEQ ID NO: 7314152 - DNA, 22 bp, Homo sapiens
cagggcagtaacgggaacatct

SEQ ID NO: 7314153 - DNA, 22 bp, Homo sapiens
cagggattcagctgaaggaggc

SEQ ID NO: 7314154 - DNA, 21 bp, Homo sapiens
agctttgctttgtactcattt

SEQ ID NO: 7314155 - DNA, 22 bp, Homo sapiens
ccacatcatggatacagttatg

SEQ ID NO: 7314156 - DNA, 22 bp, Homo sapiens
ccaccatgggaagagagactaa

SEQ ID NO: 7314157 - DNA, 21 bp, Homo sapiens
ccaccaggtcttctgctcggg

SEQ ID NO: 7314158 - DNA, 22 bp, Homo sapiens
ccactcagcacagtggatgcag

SEQ ID NO: 7314159 - DNA, 23 bp, Homo sapiens
ccacgtctgcactgtagctgttg

SEQ ID NO: 7314160 - DNA, 22 bp, Homo sapiens
ccactactctctgagctttact

SEQ ID NO: 7314161 - DNA, 22 bp, Homo sapiens
ccactactttgtttttggtgct

SEQ ID NO: 7314162 - DNA, 22 bp, Homo sapiens
catttctgcagaattgctcttc

SEQ ID NO: 7314163 - DNA, 23 bp, Homo sapiens
catttctgggagatttataaaat

SEQ ID NO: 7314164 - DNA, 22 bp, Homo sapiens
catttgaaacctggaatctacc

SEQ ID NO: 7314165 - DNA, 22 bp, Homo sapiens
catttcaatacagtttgtaaat

SEQ ID NO: 7314166 - DNA, 22 bp, Homo sapiens
catttcaatactatctgagaat

SEQ ID NO: 7314167 - DNA, 22 bp, Homo sapiens
catttcaatgccttcaacatag

SEQ ID NO: 7314168 - DNA, 22 bp, Homo sapiens
catttcaattatttgctcttct

SEQ ID NO: 7314169 - DNA, 22 bp, Homo sapiens
catttcaattatttgctcttct

SEQ ID NO: 7314170 - DNA, 22 bp, Homo sapiens
catttctccgccgagatcactg

SEQ ID NO: 7314171 - DNA, 22 bp, Homo sapiens
catttctgattacagaatacta

SEQ ID NO: 7314172 - DNA, 22 bp, Homo sapiens
catttcacagtaaagtgatttc

SEQ ID NO: 7314173 - DNA, 22 bp, Homo sapiens
catttcaaacagttacagctgc

SEQ ID NO: 7314174 - DNA, 22 bp, Homo sapiens
catttcaaacagttacagctgc

SEQ ID NO: 7314175 - DNA, 22 bp, Homo sapiens
catttcaaaagaattgccagaa

SEQ ID NO: 7314176 - DNA, 22 bp, Homo sapiens
catttcaagcattgacttctat

SEQ ID NO: 7314177 - DNA, 22 bp, Homo sapiens
catttcaagcattgacttctat

SEQ ID NO: 7314178 - DNA, 22 bp, Homo sapiens
cattgtaagaggctttgcagca

SEQ ID NO: 7314179 - DNA, 22 bp, Homo sapiens
cattgctgcttccaggcacagg

SEQ ID NO: 7314180 - DNA, 22 bp, Homo sapiens
cattgctgtagtccagatgagg

SEQ ID NO: 7314181 - DNA, 22 bp, Homo sapiens
aggcaaggtgctacagacagtg

SEQ ID NO: 7314182 - DNA, 22 bp, Homo sapiens
cagtatttgttccctatcaatg

SEQ ID NO: 7314183 - DNA, 22 bp, Homo sapiens
cagtatttgttccctatcaatg

SEQ ID NO: 7314184 - DNA, 22 bp, Homo sapiens
cagtgtgctgcagagaacattt

SEQ ID NO: 7314185 - DNA, 22 bp, Homo sapiens
aggagccagattctctcacttt

SEQ ID NO: 7314186 - DNA, 22 bp, Homo sapiens
cagtgtgtgactctgggggtac

SEQ ID NO: 7314187 - DNA, 22 bp, Homo sapiens
cagtgtttaatcattgtgaatt

SEQ ID NO: 7314188 - DNA, 22 bp, Homo sapiens
cagtgtttagcacagtgcttgg

SEQ ID NO: 7314189 - DNA, 22 bp, Homo sapiens
cataatatctccgattacttgc

SEQ ID NO: 7314190 - DNA, 22 bp, Homo sapiens
cataatatactacattgatgaa

SEQ ID NO: 7314191 - DNA, 19 bp, Homo sapiens
cataatacagtggatctga

SEQ ID NO: 7314192 - DNA, 22 bp, Homo sapiens
cataacttggtgttggaaactg

SEQ ID NO: 7314193 - DNA, 22 bp, Homo sapiens
cataacatgtacatataaatgc

SEQ ID NO: 7314194 - DNA, 22 bp, Homo sapiens
cagttttattggttgaaatctg

SEQ ID NO: 7314195 - DNA, 22 bp, Homo sapiens
aggagctgtgaatgggaggggt

SEQ ID NO: 7314196 - DNA, 22 bp, Homo sapiens
aggagctgggttcctttggtgg

SEQ ID NO: 7314197 - DNA, 22 bp, Homo sapiens
aggagctgtcatttgattcaca

SEQ ID NO: 7314198 - DNA, 22 bp, Homo sapiens
aggagctgtcagagtgccagag

SEQ ID NO: 7314199 - DNA, 22 bp, Homo sapiens
aggagctgtcagagtgccagag

SEQ ID NO: 7314200 - DNA, 22 bp, Homo sapiens
catctcctttggtctacttcca

SEQ ID NO: 7314201 - DNA, 22 bp, Homo sapiens
catctcctttggtctacttcca

SEQ ID NO: 7314202 - DNA, 20 bp, Homo sapiens
catctcctgcctccatgttc

SEQ ID NO: 7314203 - DNA, 22 bp, Homo sapiens
catccaataccagtttgcaggc

SEQ ID NO: 7314204 - DNA, 22 bp, Homo sapiens
catccaataccagtttgcaggc

SEQ ID NO: 7314205 - DNA, 22 bp, Homo sapiens
catctctgagacctcagctggg

SEQ ID NO: 7314206 - DNA, 22 bp, Homo sapiens
catcttcacatatttccaatga

SEQ ID NO: 7314207 - DNA, 22 bp, Homo sapiens
catacaatcaagttctttatta

SEQ ID NO: 7314208 - DNA, 22 bp, Homo sapiens
catacagaaaatatattttgat

SEQ ID NO: 7314209 - DNA, 22 bp, Homo sapiens
catacagaaaatatattttgat

SEQ ID NO: 7314210 - DNA, 22 bp, Homo sapiens
catacaatcaagttctttatta

SEQ ID NO: 7314211 - DNA, 22 bp, Homo sapiens
catacaagcgtgcatgtgcttg

SEQ ID NO: 7314212 - DNA, 22 bp, Homo sapiens
catacataccactgctgtcttt

SEQ ID NO: 7314213 - DNA, 22 bp, Homo sapiens
catacagttttccctagatgtg

SEQ ID NO: 7314214 - DNA, 22 bp, Homo sapiens
catacagtcactgtggtaccac

SEQ ID NO: 7314215 - DNA, 22 bp, Homo sapiens
catacagtgtggcatgtagtct

SEQ ID NO: 7314216 - DNA, 22 bp, Homo sapiens
aggaggctctcaggtcctcccc

SEQ ID NO: 7314217 - DNA, 18 bp, Homo sapiens
catgagctgcccctagac

SEQ ID NO: 7314218 - DNA, 17 bp, Homo sapiens
aggatgtggagaaaatt

SEQ ID NO: 7314219 - DNA, 22 bp, Homo sapiens
catgagactgccttttcaaacc

SEQ ID NO: 7314220 - DNA, 22 bp, Homo sapiens
catgagactgccttttcaaacc

SEQ ID NO: 7314221 - DNA, 22 bp, Homo sapiens
aggatgtgagtggacacagtcc

SEQ ID NO: 7314222 - DNA, 22 bp, Homo sapiens
catcttgcctgctattctgttg

SEQ ID NO: 7314223 - DNA, 22 bp, Homo sapiens
catcttcaggggctacatctgt

SEQ ID NO: 7314224 - DNA, 22 bp, Homo sapiens
catcttcaggtgttttccatca

SEQ ID NO: 7314225 - DNA, 23 bp, Homo sapiens
aggatgtaggatgtatggcagag

SEQ ID NO: 7314226 - DNA, 23 bp, Homo sapiens
aggatgggtggcaatagaaagac

SEQ ID NO: 7314227 - DNA, 22 bp, Homo sapiens
cccagaggtgcttcagaggtgc

SEQ ID NO: 7314228 - DNA, 22 bp, Homo sapiens
aggctgtggtgatgattgggtc

SEQ ID NO: 7314229 - DNA, 22 bp, Homo sapiens
aggctgtgggtgatttactgtg

SEQ ID NO: 7314230 - DNA, 22 bp, Homo sapiens
aggctgtggggttctgctttca

SEQ ID NO: 7314231 - DNA, 22 bp, Homo sapiens
cccagaggtgcttcagaggtgc

SEQ ID NO: 7314232 - DNA, 22 bp, Homo sapiens
aggctgtggcatcacatcagga

SEQ ID NO: 7314233 - DNA, 22 bp, Homo sapiens
aggctgtgggaatggctgcttg

SEQ ID NO: 7314234 - DNA, 22 bp, Homo sapiens
cccacgtcgaacttgctccaga

SEQ ID NO: 7314235 - DNA, 22 bp, Homo sapiens
cccactccctgcacgcctgccg

SEQ ID NO: 7314236 - DNA, 22 bp, Homo sapiens
cccactccctacgacacgctcc

SEQ ID NO: 7314237 - DNA, 22 bp, Homo sapiens
cccacgttgaaccgcttacaga

SEQ ID NO: 7314238 - DNA, 22 bp, Homo sapiens
cccactcctggagctagggctc

SEQ ID NO: 7314239 - DNA, 22 bp, Homo sapiens
aggctgtgactacgcagggaag

SEQ ID NO: 7314240 - DNA, 22 bp, Homo sapiens
aggctgtgcacagggcacctgc

SEQ ID NO: 7314241 - DNA, 22 bp, Homo sapiens
ccagtgggtgctgggctctgcc

SEQ ID NO: 7314242 - DNA, 22 bp, Homo sapiens
ccagtggtgaatccagggatgt

SEQ ID NO: 7314243 - DNA, 22 bp, Homo sapiens
cccacacactggctgctgccaa

SEQ ID NO: 7314244 - DNA, 18 bp, Homo sapiens
cccacacagcagtagctc

SEQ ID NO: 7314245 - DNA, 22 bp, Homo sapiens
ccaggtgtttggcctgcatgat

SEQ ID NO: 7314246 - DNA, 22 bp, Homo sapiens
ccaggccttctgaggacactct

SEQ ID NO: 7314247 - DNA, 22 bp, Homo sapiens
ccaggcctttcttcttggtctg

SEQ ID NO: 7314248 - DNA, 20 bp, Homo sapiens
ccaggcctgggcctgctcta

SEQ ID NO: 7314249 - DNA, 22 bp, Homo sapiens
ccactccccacgtgctgtcaga

SEQ ID NO: 7314250 - DNA, 22 bp, Homo sapiens
ccagaggcagacttacactcca

SEQ ID NO: 7314251 - DNA, 19 bp, Homo sapiens
ccagaggcagcttctgtaa

SEQ ID NO: 7314252 - DNA, 18 bp, Homo sapiens
ccagaggcccgggcaggc

SEQ ID NO: 7314253 - DNA, 22 bp, Homo sapiens
ccagagtcattttgagtcataa

SEQ ID NO: 7314254 - DNA, 19 bp, Homo sapiens
ccagagtcatgtctccccc

SEQ ID NO: 7314255 - DNA, 22 bp, Homo sapiens
ccagaggctggcaagggctcct

SEQ ID NO: 7314256 - DNA, 21 bp, Homo sapiens
ccagaggcctctcttggccac

SEQ ID NO: 7314257 - DNA, 22 bp, Homo sapiens
ccagaggcggaggtttgcagtg

SEQ ID NO: 7314258 - DNA, 22 bp, Homo sapiens
ccagccagtatattccaaagcc

SEQ ID NO: 7314259 - DNA, 22 bp, Homo sapiens
aggccctgagaaaatccctgca

SEQ ID NO: 7314260 - DNA, 22 bp, Homo sapiens
ccagccagccttgatctgagta

SEQ ID NO: 7314261 - DNA, 22 bp, Homo sapiens
ccagccagtatattccaaagcc

SEQ ID NO: 7314262 - DNA, 22 bp, Homo sapiens
ccagccaggctggctgtggagg

SEQ ID NO: 7314263 - DNA, 22 bp, Homo sapiens
ccagccaggcattgcaaactga

SEQ ID NO: 7314264 - DNA, 22 bp, Homo sapiens
ccagctccctgaagcctggtct

SEQ ID NO: 7314265 - DNA, 22 bp, Homo sapiens
ccagctccgggagttgctgctg

SEQ ID NO: 7314266 - DNA, 22 bp, Homo sapiens
ccagctcccattcttcacctgt

SEQ ID NO: 7314267 - DNA, 22 bp, Homo sapiens
ccagctcccgcaggctgcacag

SEQ ID NO: 7314268 - DNA, 22 bp, Homo sapiens
ccagctcccctcagcaggtaat

SEQ ID NO: 7314269 - DNA, 22 bp, Homo sapiens
aggccctgctttccagagctca

SEQ ID NO: 7314270 - DNA, 22 bp, Homo sapiens
ccagctccattgcttagtgtaa

SEQ ID NO: 7314271 - DNA, 23 bp, Homo sapiens
ccagctcccaggtctgaggactg

SEQ ID NO: 7314272 - DNA, 22 bp, Homo sapiens
ccagctccaggtagatgggcag

SEQ ID NO: 7314273 - DNA, 22 bp, Homo sapiens
aggccctggcactgcctgggag

SEQ ID NO: 7314274 - DNA, 22 bp, Homo sapiens
ccaggagggaggagttcctgag

SEQ ID NO: 7314275 - DNA, 22 bp, Homo sapiens
ccagctccggtgtgcttatttc

SEQ ID NO: 7314276 - DNA, 22 bp, Homo sapiens
aggcctgggtgttcaccagaag

SEQ ID NO: 7314277 - DNA, 20 bp, Homo sapiens
ccaggcactgtcccatgcag

SEQ ID NO: 7314278 - DNA, 22 bp, Homo sapiens
ccaggcacggtggctcatgcct

SEQ ID NO: 7314279 - DNA, 22 bp, Homo sapiens
agggcatgctggaggagagaca

SEQ ID NO: 7314280 - DNA, 22 bp, Homo sapiens
agggcatgtgggagaggagcct

SEQ ID NO: 7314281 - DNA, 23 bp, Homo sapiens
agggccaggtgcggaaacagctc

SEQ ID NO: 7314282 - DNA, 22 bp, Homo sapiens
agggccagggaagctgtatttt

SEQ ID NO: 7314283 - DNA, 22 bp, Homo sapiens
agggcccaccttggtgctgagg

SEQ ID NO: 7314284 - DNA, 22 bp, Homo sapiens
cccaggtctgtgccagctctga

SEQ ID NO: 7314285 - DNA, 22 bp, Homo sapiens
agggagctttaccccagatcac

SEQ ID NO: 7314286 - DNA, 22 bp, Homo sapiens
cccaggaaggtggtctgtggct

SEQ ID NO: 7314287 - DNA, 22 bp, Homo sapiens
agggaaagtaagcatttcatta

SEQ ID NO: 7314288 - DNA, 23 bp, Homo sapiens
agggaaagtagtaatggcctttg

SEQ ID NO: 7314289 - DNA, 22 bp, Homo sapiens
cccagagtatttgtgatgttag

SEQ ID NO: 7314290 - DNA, 22 bp, Homo sapiens
agggaaaggtagtgaggtcaca

SEQ ID NO: 7314291 - DNA, 22 bp, Homo sapiens
agggaaaggctgatgctgtggg

SEQ ID NO: 7314292 - DNA, 21 bp, Homo sapiens
agggaaagaaaatgagctaat

SEQ ID NO: 7314293 - DNA, 21 bp, Homo sapiens
agggaaagaaaatgagctaat

SEQ ID NO: 7314294 - DNA, 22 bp, Homo sapiens
cccaggccctggcagagcttgt

SEQ ID NO: 7314295 - DNA, 22 bp, Homo sapiens
cccaggcctggtctgggccagt

SEQ ID NO: 7314296 - DNA, 17 bp, Homo sapiens
cccaggccgccgggagc

SEQ ID NO: 7314297 - DNA, 22 bp, Homo sapiens
agggagccctgaaccagagggt

SEQ ID NO: 7314298 - DNA, 22 bp, Homo sapiens
agggagccttcctggctgtggt

SEQ ID NO: 7314299 - DNA, 22 bp, Homo sapiens
cccaggcctggtctgggccagt

SEQ ID NO: 7314300 - DNA, 22 bp, Homo sapiens
agggagcttctggcctcagcct

SEQ ID NO: 7314301 - DNA, 22 bp, Homo sapiens
agggagctgtggtcagctcagt

SEQ ID NO: 7314302 - DNA, 22 bp, Homo sapiens
agggagctgggccacactgatc

SEQ ID NO: 7314303 - DNA, 22 bp, Homo sapiens
agggagctgctctgcttccgtg

SEQ ID NO: 7314304 - DNA, 21 bp, Homo sapiens
agggagctggccacacagcct

SEQ ID NO: 7314305 - DNA, 22 bp, Homo sapiens
cccaggccccagggcttgtcag

SEQ ID NO: 7314306 - DNA, 22 bp, Homo sapiens
cccaggccagaacttggttgct

SEQ ID NO: 7314307 - DNA, 22 bp, Homo sapiens
agggacctgctcactgcctggc

SEQ ID NO: 7314308 - DNA, 22 bp, Homo sapiens
agggacctcttcttgcagctga

SEQ ID NO: 7314309 - DNA, 22 bp, Homo sapiens
agggaatggatgatggcaggtt

SEQ ID NO: 7314310 - DNA, 22 bp, Homo sapiens
cctctgtggtctgtctaatgca

SEQ ID NO: 7314311 - DNA, 22 bp, Homo sapiens
cctctgtgtgtgcatgcatgcg

SEQ ID NO: 7314312 - DNA, 22 bp, Homo sapiens
cctcttaattgtactccttcag

SEQ ID NO: 7314313 - DNA, 22 bp, Homo sapiens
agggggtgatcaaggtgcggcg

SEQ ID NO: 7314314 - DNA, 22 bp, Homo sapiens
aggggtagagattgctggtgta

SEQ ID NO: 7314315 - DNA, 22 bp, Homo sapiens
agggggtgcatttgtgaatgaa

SEQ ID NO: 7314316 - DNA, 22 bp, Homo sapiens
cctcgacctccccaggctcagg

SEQ ID NO: 7314317 - DNA, 22 bp, Homo sapiens
cctccttctggggccttctgct

SEQ ID NO: 7314318 - DNA, 22 bp, Homo sapiens
cctcctggtgggcgcttctggc

SEQ ID NO: 7314319 - DNA, 22 bp, Homo sapiens
cctcctggttgcaatgaaatgg

SEQ ID NO: 7314320 - DNA, 22 bp, Homo sapiens
aggggaagattatacttttgaa

SEQ ID NO: 7314321 - DNA, 22 bp, Homo sapiens
cctcctggtgacaaggcaaagc

SEQ ID NO: 7314322 - DNA, 22 bp, Homo sapiens
cctcctggtgggcgcttctggc

SEQ ID NO: 7314323 - DNA, 22 bp, Homo sapiens
aggggctcaaagtgtgcaggga

SEQ ID NO: 7314324 - DNA, 22 bp, Homo sapiens
aggggcaggtgctgcacttaga

SEQ ID NO: 7314325 - DNA, 22 bp, Homo sapiens
cctctgtgggccgggcctgctg

SEQ ID NO: 7314326 - DNA, 22 bp, Homo sapiens
aggggctcctggcctggagagc

SEQ ID NO: 7314327 - DNA, 22 bp, Homo sapiens
aggggctctgagtgggccagga

SEQ ID NO: 7314328 - DNA, 22 bp, Homo sapiens
cctactctgagcgcctccgcat

SEQ ID NO: 7314329 - DNA, 22 bp, Homo sapiens
cctactctgagcgcctccgcat

SEQ ID NO: 7314330 - DNA, 22 bp, Homo sapiens
agggctttgatgtccatgagga

SEQ ID NO: 7314331 - DNA, 22 bp, Homo sapiens
agggctttgatgtccatgagga

SEQ ID NO: 7314332 - DNA, 22 bp, Homo sapiens
agggctttgcaatgcacagtgg

SEQ ID NO: 7314333 - DNA, 22 bp, Homo sapiens
agggctttgcaatgcacagtgg

SEQ ID NO: 7314334 - DNA, 22 bp, Homo sapiens
agggctttgtttaggtgaccac

SEQ ID NO: 7314335 - DNA, 22 bp, Homo sapiens
agggcttttgagcgcacgtctg

SEQ ID NO: 7314336 - DNA, 22 bp, Homo sapiens
agggcttttgcaatccaagtct

SEQ ID NO: 7314337 - DNA, 22 bp, Homo sapiens
agggcttttgcaatccaagtct

SEQ ID NO: 7314338 - DNA, 22 bp, Homo sapiens
agggctttggccccctgctgca

SEQ ID NO: 7314339 - DNA, 22 bp, Homo sapiens
agggctttggccccctgctgca

SEQ ID NO: 7314340 - DNA, 22 bp, Homo sapiens
agggctttgtggcagtcactat

SEQ ID NO: 7314341 - DNA, 22 bp, Homo sapiens
agggctttgtggcagtcactat

SEQ ID NO: 7314342 - DNA, 19 bp, Homo sapiens
agggctttgtgtgctgctc

SEQ ID NO: 7314343 - DNA, 19 bp, Homo sapiens
agggctttgtgtgctgctc

SEQ ID NO: 7314344 - DNA, 22 bp, Homo sapiens
agggctttgtttaggtgaccac

SEQ ID NO: 7314345 - DNA, 22 bp, Homo sapiens
ccctggcactagcgacggccat

SEQ ID NO: 7314346 - DNA, 22 bp, Homo sapiens
agggcccagtggagagctgagc

SEQ ID NO: 7314347 - DNA, 19 bp, Homo sapiens
ccctggcaggcaagcctgg

SEQ ID NO: 7314348 - DNA, 22 bp, Homo sapiens
ccctggcataaaacttctccag

SEQ ID NO: 7314349 - DNA, 22 bp, Homo sapiens
ccctggcagagggggcaggtgc

SEQ ID NO: 7314350 - DNA, 22 bp, Homo sapiens
ccctggcagaatgtctctgggc

SEQ ID NO: 7314351 - DNA, 22 bp, Homo sapiens
ccctggcatgcatgtccctggc

SEQ ID NO: 7314352 - DNA, 22 bp, Homo sapiens
agggcctgtcagcggtgtcctg

SEQ ID NO: 7314353 - DNA, 22 bp, Homo sapiens
cctgtgagagggcgagtgtaga

SEQ ID NO: 7314354 - DNA, 22 bp, Homo sapiens
cctgtgaggtcatctgtggtaa

SEQ ID NO: 7314355 - DNA, 22 bp, Homo sapiens
cctgtcccccaggcctgtacca

SEQ ID NO: 7314356 - DNA, 22 bp, Homo sapiens
cctgtcagttgctgtcagggat

SEQ ID NO: 7314357 - DNA, 23 bp, Homo sapiens
aggtaggttattgctgctacctg

SEQ ID NO: 7314358 - DNA, 22 bp, Homo sapiens
aggtaggatagataggaagacc

SEQ ID NO: 7314359 - DNA, 22 bp, Homo sapiens
aggtaggatagataggaagacc

SEQ ID NO: 7314360 - DNA, 22 bp, Homo sapiens
aggtaggatgggtggagatgat

SEQ ID NO: 7314361 - DNA, 22 bp, Homo sapiens
aggtaggatgggtggagatgat

SEQ ID NO: 7314362 - DNA, 22 bp, Homo sapiens
cctggatctcctctattcatat

SEQ ID NO: 7314363 - DNA, 22 bp, Homo sapiens
cctggatcagtcactgttgctg

SEQ ID NO: 7314364 - DNA, 22 bp, Homo sapiens
aggtccctgcagcagactgcca

SEQ ID NO: 7314365 - DNA, 22 bp, Homo sapiens
ctaggtgatccactgctctctt

SEQ ID NO: 7314366 - DNA, 22 bp, Homo sapiens
ctagggtgtgcagattttgcct

SEQ ID NO: 7314367 - DNA, 22 bp, Homo sapiens
ctagggtctgttttccaggtgt

SEQ ID NO: 7314368 - DNA, 22 bp, Homo sapiens
ctagggtcaggggcctgcgtcg

SEQ ID NO: 7314369 - DNA, 22 bp, Homo sapiens
ctacatttgttctatagctttt

SEQ ID NO: 7314370 - DNA, 22 bp, Homo sapiens
ctacagaattcaacaaatggtt

SEQ ID NO: 7314371 - DNA, 22 bp, Homo sapiens
ctacatttgttcaaataagctg

SEQ ID NO: 7314372 - DNA, 22 bp, Homo sapiens
ctacatttggagagtataggaa

SEQ ID NO: 7314373 - DNA, 20 bp, Homo sapiens
ctaagcactttgataaactg

SEQ ID NO: 7314374 - DNA, 22 bp, Homo sapiens
ctaagcataatggtgctttaag

SEQ ID NO: 7314375 - DNA, 22 bp, Homo sapiens
agtatgaattgctttgcctgta

SEQ ID NO: 7314376 - DNA, 22 bp, Homo sapiens
agtatttcctggcttatctgct

SEQ ID NO: 7314377 - DNA, 22 bp, Homo sapiens
agtatttcctggcttatctgct

SEQ ID NO: 7314378 - DNA, 22 bp, Homo sapiens
agtatttcagttactttaaaat

SEQ ID NO: 7314379 - DNA, 22 bp, Homo sapiens
agtatgttgacttattcttgga

SEQ ID NO: 7314380 - DNA, 22 bp, Homo sapiens
cctgtgtttctgttggaattaa

SEQ ID NO: 7314381 - DNA, 22 bp, Homo sapiens
cctgtgtttagatatgatgctg

SEQ ID NO: 7314382 - DNA, 22 bp, Homo sapiens
cctgtgttctaatccatctcag

SEQ ID NO: 7314383 - DNA, 19 bp, Homo sapiens
cctgtgttgggagtgtgag

SEQ ID NO: 7314384 - DNA, 22 bp, Homo sapiens
cctgttcaatattcttccttgt

SEQ ID NO: 7314385 - DNA, 22 bp, Homo sapiens
cctgttcaatgccctggcttca

SEQ ID NO: 7314386 - DNA, 17 bp, Homo sapiens
cctgtgtttgctccttc

SEQ ID NO: 7314387 - DNA, 22 bp, Homo sapiens
cctgttcacggtgtgttgttag

SEQ ID NO: 7314388 - DNA, 22 bp, Homo sapiens
cctgttcactttgacttctcca

SEQ ID NO: 7314389 - DNA, 22 bp, Homo sapiens
cctgttcatgaaactgctttcc

SEQ ID NO: 7314390 - DNA, 22 bp, Homo sapiens
cctgttcatttgtatttgtctt

SEQ ID NO: 7314391 - DNA, 22 bp, Homo sapiens
cctgttcattttttgactctgc

SEQ ID NO: 7314392 - DNA, 22 bp, Homo sapiens
cgggcagtgtggctccagagtc

SEQ ID NO: 7314393 - DNA, 17 bp, Homo sapiens
cgggcatggagggcagg

SEQ ID NO: 7314394 - DNA, 17 bp, Homo sapiens
cgggcatggagggcagg

SEQ ID NO: 7314395 - DNA, 20 bp, Homo sapiens
ctaagaggtccttccacatc

SEQ ID NO: 7314396 - DNA, 18 bp, Homo sapiens
ctaagaggtcgtttctca

SEQ ID NO: 7314397 - DNA, 22 bp, Homo sapiens
ctaagaggaagtactctgttat

SEQ ID NO: 7314398 - DNA, 20 bp, Homo sapiens
ctaagaggaggactaggttt

SEQ ID NO: 7314399 - DNA, 20 bp, Homo sapiens
ctaagaggaggactaggttt

SEQ ID NO: 7314400 - DNA, 22 bp, Homo sapiens
ctaagacatgccctgcatgata

SEQ ID NO: 7314401 - DNA, 22 bp, Homo sapiens
agtacagatttagacacgatag

SEQ ID NO: 7314402 - DNA, 22 bp, Homo sapiens
agtacacagtagactttctcat

SEQ ID NO: 7314403 - DNA, 22 bp, Homo sapiens
agtacacagaattctacttgtt

SEQ ID NO: 7314404 - DNA, 22 bp, Homo sapiens
agtacacaagacacatttaaaa

SEQ ID NO: 7314405 - DNA, 22 bp, Homo sapiens
ctgagaaaatttcaggaagtgt

SEQ ID NO: 7314406 - DNA, 22 bp, Homo sapiens
ctgaattctatctctggatgtc

SEQ ID NO: 7314407 - DNA, 22 bp, Homo sapiens
agtgtctgcttatcagttcttg

SEQ ID NO: 7314408 - DNA, 22 bp, Homo sapiens
agtgtctgctcagacagctaca

SEQ ID NO: 7314409 - DNA, 22 bp, Homo sapiens
agtgtctgcgggcagaggagcg

SEQ ID NO: 7314410 - DNA, 22 bp, Homo sapiens
agtgtctgcggcggggaggcgg

SEQ ID NO: 7314411 - DNA, 22 bp, Homo sapiens
agtgtctgctaggttcatcaac

SEQ ID NO: 7314412 - DNA, 23 bp, Homo sapiens
ctgaaattcagatgctaaagata

SEQ ID NO: 7314413 - DNA, 22 bp, Homo sapiens
ctgaaatgttaaatacttggct

SEQ ID NO: 7314414 - DNA, 22 bp, Homo sapiens
agtgtctgctttgagtcaggtg

SEQ ID NO: 7314415 - DNA, 18 bp, Homo sapiens
agtgtctggatatttggg

SEQ ID NO: 7314416 - DNA, 22 bp, Homo sapiens
agtgtctggaggcattcttggt

SEQ ID NO: 7314417 - DNA, 20 bp, Homo sapiens
agtgtctgggcctcaggccc

SEQ ID NO: 7314418 - DNA, 20 bp, Homo sapiens
agtgtctggattttgtaacc

SEQ ID NO: 7314419 - DNA, 22 bp, Homo sapiens
agttaagaatacacatcataat

SEQ ID NO: 7314420 - DNA, 22 bp, Homo sapiens
agttaagagtgtgaaaatgtta

SEQ ID NO: 7314421 - DNA, 22 bp, Homo sapiens
agttagtagacttttccattta

SEQ ID NO: 7314422 - DNA, 22 bp, Homo sapiens
agttagcaaataccacaatctg

SEQ ID NO: 7314423 - DNA, 22 bp, Homo sapiens
agttagcagcttattagaaaca

SEQ ID NO: 7314424 - DNA, 22 bp, Homo sapiens
ctgagcagcaccttcaagaaac

SEQ ID NO: 7314425 - DNA, 22 bp, Homo sapiens
ctctgcaggcacccagggtggg

SEQ ID NO: 7314426 - DNA, 22 bp, Homo sapiens
ctctcatgagcattcctaaggg

SEQ ID NO: 7314427 - DNA, 19 bp, Homo sapiens
ctctcagcctgtctccttg

SEQ ID NO: 7314428 - DNA, 18 bp, Homo sapiens
ctctgctaatgggcagct

SEQ ID NO: 7314429 - DNA, 22 bp, Homo sapiens
ctctgctcaccagccatgtgat

SEQ ID NO: 7314430 - DNA, 22 bp, Homo sapiens
ctctgcctgtctcatcctgcaa

SEQ ID NO: 7314431 - DNA, 22 bp, Homo sapiens
ctctgcctgtgtcgccaccaca

SEQ ID NO: 7314432 - DNA, 22 bp, Homo sapiens
ctctgcctgccactgttcaggc

SEQ ID NO: 7314433 - DNA, 22 bp, Homo sapiens
ctctgcatcaggcattatggat

SEQ ID NO: 7314434 - DNA, 22 bp, Homo sapiens
ctctggctttaaggatgccaca

SEQ ID NO: 7314435 - DNA, 22 bp, Homo sapiens
ctgaaatgggcaaaagtagatt

SEQ ID NO: 7314436 - DNA, 22 bp, Homo sapiens
ctgaaatattttaatctcagga

SEQ ID NO: 7314437 - DNA, 22 bp, Homo sapiens
ctctggggttaagcttccatgg

SEQ ID NO: 7314438 - DNA, 22 bp, Homo sapiens
ctctttggttaatcacacagat

SEQ ID NO: 7314439 - DNA, 22 bp, Homo sapiens
ctctggggtggaggaggctgac

SEQ ID NO: 7314440 - DNA, 22 bp, Homo sapiens
ctctggggtgcttcgacacttc

SEQ ID NO: 7314441 - DNA, 17 bp, Homo sapiens
ctctggggacagttcta

SEQ ID NO: 7314442 - DNA, 22 bp, Homo sapiens
ctctggggaaatggatatgtac

SEQ ID NO: 7314443 - DNA, 22 bp, Homo sapiens
ctctggggaagcagccagctgg

SEQ ID NO: 7314444 - DNA, 22 bp, Homo sapiens
ctctggggaagcagccagctgg

SEQ ID NO: 7314445 - DNA, 22 bp, Homo sapiens
agtcctcccttggggccacctt

SEQ ID NO: 7314446 - DNA, 22 bp, Homo sapiens
agtcctgcatccagttacatct

SEQ ID NO: 7314447 - DNA, 22 bp, Homo sapiens
agtcctggccccaaggaaggat

SEQ ID NO: 7314448 - DNA, 22 bp, Homo sapiens
agtccggggtctggacacctgg

SEQ ID NO: 7314449 - DNA, 22 bp, Homo sapiens
agtccctgtactttccactgcc

SEQ ID NO: 7314450 - DNA, 18 bp, Homo sapiens
agtcctggctctaccacc

SEQ ID NO: 7314451 - DNA, 22 bp, Homo sapiens
ctcattaaaggaaatcacctgc

SEQ ID NO: 7314452 - DNA, 22 bp, Homo sapiens
ctcattgcccagatccccacag

SEQ ID NO: 7314453 - DNA, 22 bp, Homo sapiens
ctcattgcaacctccgcctccc

SEQ ID NO: 7314454 - DNA, 22 bp, Homo sapiens
ctccagcttctgcccagagact

SEQ ID NO: 7314455 - DNA, 22 bp, Homo sapiens
agtggcagaggttgactgcagt

SEQ ID NO: 7314456 - DNA, 22 bp, Homo sapiens
agtggcagagtgcactcaggca

SEQ ID NO: 7314457 - DNA, 22 bp, Homo sapiens
ctctcagacacccatttggaaa

SEQ ID NO: 7314458 - DNA, 19 bp, Homo sapiens
ctcctggctctgtcatttt

SEQ ID NO: 7314459 - DNA, 22 bp, Homo sapiens
atatgctaattagagggcatta

SEQ ID NO: 7314460 - DNA, 22 bp, Homo sapiens
atatgcgtactatatactgtgt

SEQ ID NO: 7314461 - DNA, 22 bp, Homo sapiens
atatgccattagctagaaataa

SEQ ID NO: 7314462 - DNA, 22 bp, Homo sapiens
atatgctacaaataaactttta

SEQ ID NO: 7314463 - DNA, 22 bp, Homo sapiens
atatgctatgtatgtaaatgag

SEQ ID NO: 7314464 - DNA, 22 bp, Homo sapiens
atatgctatgttgaataatttg

SEQ ID NO: 7314465 - DNA, 22 bp, Homo sapiens
atatgctattgctgtaatttaa

SEQ ID NO: 7314466 - DNA, 22 bp, Homo sapiens
atatgcatttacctggcatata

SEQ ID NO: 7314467 - DNA, 20 bp, Homo sapiens
atatgcatgtgttttcactt

SEQ ID NO: 7314468 - DNA, 22 bp, Homo sapiens
atatgccatactgtacaatact

SEQ ID NO: 7314469 - DNA, 21 bp, Homo sapiens
atatgccaaatgccagtaacc

SEQ ID NO: 7314470 - DNA, 22 bp, Homo sapiens
atatgcatatgtcaaaacttat

SEQ ID NO: 7314471 - DNA, 22 bp, Homo sapiens
atatgcatgtacgtgtgcacaa

SEQ ID NO: 7314472 - DNA, 22 bp, Homo sapiens
atattacataaacatgagtgaa

SEQ ID NO: 7314473 - DNA, 22 bp, Homo sapiens
atattacataaacatgagtgaa

SEQ ID NO: 7314474 - DNA, 22 bp, Homo sapiens
atattactctgatttagtaaat

SEQ ID NO: 7314475 - DNA, 22 bp, Homo sapiens
atattacttcctggtataaaat

SEQ ID NO: 7314476 - DNA, 22 bp, Homo sapiens
atattcttgaaagatcctggta

SEQ ID NO: 7314477 - DNA, 22 bp, Homo sapiens
atattcactgggtactaaaaag

SEQ ID NO: 7314478 - DNA, 22 bp, Homo sapiens
ctgggctgagcctgggctgtgt

SEQ ID NO: 7314479 - DNA, 22 bp, Homo sapiens
ctggctgggagcgagctgctca

SEQ ID NO: 7314480 - DNA, 19 bp, Homo sapiens
ctggcttcaagcagtcctc

SEQ ID NO: 7314481 - DNA, 22 bp, Homo sapiens
ctggctgtttcaaatgtataga

SEQ ID NO: 7314482 - DNA, 22 bp, Homo sapiens
ctggcttcctgagtccattacc

SEQ ID NO: 7314483 - DNA, 22 bp, Homo sapiens
ctggcttctgggccagggcaga

SEQ ID NO: 7314484 - DNA, 22 bp, Homo sapiens
atatgcagtctcttgcccttct

SEQ ID NO: 7314485 - DNA, 22 bp, Homo sapiens
atatgcacatacatacataggt

SEQ ID NO: 7314486 - DNA, 22 bp, Homo sapiens
atatgcataatacaaagagtat

SEQ ID NO: 7314487 - DNA, 22 bp, Homo sapiens
atatgcatatacacacatgcgt

SEQ ID NO: 7314488 - DNA, 22 bp, Homo sapiens
atcagaaggggaggtaaagaag

SEQ ID NO: 7314489 - DNA, 22 bp, Homo sapiens
atcagaagcaggaggaatgaag

SEQ ID NO: 7314490 - DNA, 22 bp, Homo sapiens
atcaaattggaatgaaaggctc

SEQ ID NO: 7314491 - DNA, 22 bp, Homo sapiens
atcaaagtttcccagaagttgt

SEQ ID NO: 7314492 - DNA, 22 bp, Homo sapiens
atcaaagtttcccagaagttgt

SEQ ID NO: 7314493 - DNA, 22 bp, Homo sapiens
atcaaataaaggtacctagctt

SEQ ID NO: 7314494 - DNA, 22 bp, Homo sapiens
atcaacttaaagaaaagatact

SEQ ID NO: 7314495 - DNA, 22 bp, Homo sapiens
atcaacatttgcatccttccac

SEQ ID NO: 7314496 - DNA, 22 bp, Homo sapiens
atcaacatgtgagagcaccagt

SEQ ID NO: 7314497 - DNA, 22 bp, Homo sapiens
atcaacatgtcataaagtgaaa

SEQ ID NO: 7314498 - DNA, 22 bp, Homo sapiens
atcaacattccaatgtggtaga

SEQ ID NO: 7314499 - DNA, 21 bp, Homo sapiens
atcaacattgaaagagctgga

SEQ ID NO: 7314500 - DNA, 22 bp, Homo sapiens
atcaacatatgcatgggaaagt

SEQ ID NO: 7314501 - DNA, 22 bp, Homo sapiens
atcaacatagccactccttaga

SEQ ID NO: 7314502 - DNA, 22 bp, Homo sapiens
atcaacatgaatttctctgaag

SEQ ID NO: 7314503 - DNA, 22 bp, Homo sapiens
atcaacataaagaagtcctcag

SEQ ID NO: 7314504 - DNA, 22 bp, Homo sapiens
atcaacatactgctcaggcatt

SEQ ID NO: 7314505 - DNA, 22 bp, Homo sapiens
atcaacatggcaatgcccatct

SEQ ID NO: 7314506 - DNA, 22 bp, Homo sapiens
atcaacatgacaggagaagaga

SEQ ID NO: 7314507 - DNA, 22 bp, Homo sapiens
atcaacttttagcatggtacct

SEQ ID NO: 7314508 - DNA, 22 bp, Homo sapiens
atcaaaatggaagaatttggct

SEQ ID NO: 7314509 - DNA, 22 bp, Homo sapiens
atattttggggtgatgtgcatc

SEQ ID NO: 7314510 - DNA, 22 bp, Homo sapiens
atcaaagtaattaacactgaga

SEQ ID NO: 7314511 - DNA, 22 bp, Homo sapiens
atcaaagtagtaggttttggac

SEQ ID NO: 7314512 - DNA, 22 bp, Homo sapiens
atcaaagtaggcatatgttttt

SEQ ID NO: 7314513 - DNA, 22 bp, Homo sapiens
atcaaagttcgtaactgataac

SEQ ID NO: 7314514 - DNA, 22 bp, Homo sapiens
atcaaagtggaagtttactagg

SEQ ID NO: 7314515 - DNA, 22 bp, Homo sapiens
atcaaagtatctcaatatggta

SEQ ID NO: 7314516 - DNA, 22 bp, Homo sapiens
atcaaagtccatcagaaggtag

SEQ ID NO: 7314517 - DNA, 22 bp, Homo sapiens
atcaaagtccatcagaaggtag

SEQ ID NO: 7314518 - DNA, 22 bp, Homo sapiens
atcaaagtgaaaagtgctgatg

SEQ ID NO: 7314519 - DNA, 22 bp, Homo sapiens
atcaaagtgatttgtaaacagg

SEQ ID NO: 7314520 - DNA, 22 bp, Homo sapiens
atatttaaacagggtaccaata

SEQ ID NO: 7314521 - DNA, 22 bp, Homo sapiens
atattgaaccctacagactgta

SEQ ID NO: 7314522 - DNA, 22 bp, Homo sapiens
atattcttgtgattataaagta

SEQ ID NO: 7314523 - DNA, 22 bp, Homo sapiens
atattcttgtgattataaagta

SEQ ID NO: 7314524 - DNA, 22 bp, Homo sapiens
atctgagtctctgacagcatgt

SEQ ID NO: 7314525 - DNA, 22 bp, Homo sapiens
atctgcaggatgttaggatgat

SEQ ID NO: 7314526 - DNA, 22 bp, Homo sapiens
cttcttaatgcataaactgtgt

SEQ ID NO: 7314527 - DNA, 22 bp, Homo sapiens
cttcctctatgttcaggtagaa

SEQ ID NO: 7314528 - DNA, 22 bp, Homo sapiens
atctgaaactctgacattgtct

SEQ ID NO: 7314529 - DNA, 22 bp, Homo sapiens
atctgaaactctgacattgtct

SEQ ID NO: 7314530 - DNA, 22 bp, Homo sapiens
atctgaataaatttcttttagt

SEQ ID NO: 7314531 - DNA, 21 bp, Homo sapiens
atctgaaaggttagtgttgag

SEQ ID NO: 7314532 - DNA, 22 bp, Homo sapiens
cttcattaaccaaaatgcaata

SEQ ID NO: 7314533 - DNA, 22 bp, Homo sapiens
cttagatgaagtcacagaaccc

SEQ ID NO: 7314534 - DNA, 22 bp, Homo sapiens
cttagatacagtagaaagactc

SEQ ID NO: 7314535 - DNA, 22 bp, Homo sapiens
cttagagatgggttttacttag

SEQ ID NO: 7314536 - DNA, 22 bp, Homo sapiens
cttagagatgggttttacttag

SEQ ID NO: 7314537 - DNA, 22 bp, Homo sapiens
cttagaatgtctactcttacca

SEQ ID NO: 7314538 - DNA, 22 bp, Homo sapiens
cttagaattttaatccagaaag

SEQ ID NO: 7314539 - DNA, 22 bp, Homo sapiens
ctgtgtgtcctcggacgagttt

SEQ ID NO: 7314540 - DNA, 22 bp, Homo sapiens
ctgtgtgtcctcggacgagttt

SEQ ID NO: 7314541 - DNA, 22 bp, Homo sapiens
ctgtgtgtcctcggacgagttt

SEQ ID NO: 7314542 - DNA, 22 bp, Homo sapiens
ctgtgtgtcatttgtcaatcct

SEQ ID NO: 7314543 - DNA, 22 bp, Homo sapiens
ctgtgtgtcatttgtcaatcct

SEQ ID NO: 7314544 - DNA, 22 bp, Homo sapiens
ctgtgtgtcatttgtcaatcct

SEQ ID NO: 7314545 - DNA, 22 bp, Homo sapiens
ctgtgtgctgaaatgcagtgag

SEQ ID NO: 7314546 - DNA, 22 bp, Homo sapiens
ctgtgtgctcggatggactcgt

SEQ ID NO: 7314547 - DNA, 22 bp, Homo sapiens
ctgtgtgcctcctgtgatcagg

SEQ ID NO: 7314548 - DNA, 22 bp, Homo sapiens
ctgtgtgcctcctgtgatcagg

SEQ ID NO: 7314549 - DNA, 22 bp, Homo sapiens
ctgtgtgctgttagggagctgc

SEQ ID NO: 7314550 - DNA, 22 bp, Homo sapiens
ctgtgggagaggtgcctggatt

SEQ ID NO: 7314551 - DNA, 22 bp, Homo sapiens
atccaggtatgaattgtgtgac

SEQ ID NO: 7314552 - DNA, 19 bp, Homo sapiens
atccaggtcatgtagttct

SEQ ID NO: 7314553 - DNA, 22 bp, Homo sapiens
atccagtctgtctaccttctca

SEQ ID NO: 7314554 - DNA, 22 bp, Homo sapiens
atccagtcccacacatgctctg

SEQ ID NO: 7314555 - DNA, 22 bp, Homo sapiens
ctgtgtgcaggtgctgggtacc

SEQ ID NO: 7314556 - DNA, 22 bp, Homo sapiens
ctgtgtgcctagagggtggccg

SEQ ID NO: 7314557 - DNA, 22 bp, Homo sapiens
ctgtgtgcatagttgtgctcaa

SEQ ID NO: 7314558 - DNA, 22 bp, Homo sapiens
ctgtgtgcagggcacaatggaa

SEQ ID NO: 7314559 - DNA, 22 bp, Homo sapiens
ctgtggctaggattattcctga

SEQ ID NO: 7314560 - DNA, 22 bp, Homo sapiens
ctgtggcttttccggggagcct

SEQ ID NO: 7314561 - DNA, 18 bp, Homo sapiens
ctgtgggaaggctttcta

SEQ ID NO: 7314562 - DNA, 23 bp, Homo sapiens
ctgtgggaagtcggggagcgcgc

SEQ ID NO: 7314563 - DNA, 22 bp, Homo sapiens
ctgtgggaatactgcgagtgta

SEQ ID NO: 7314564 - DNA, 18 bp, Homo sapiens
ctgtgggaagagtttggg

SEQ ID NO: 7314565 - DNA, 22 bp, Homo sapiens
ctgtgggaaaggatgagattgc

SEQ ID NO: 7314566 - DNA, 22 bp, Homo sapiens
ctgtgggaacactgaggacttc

SEQ ID NO: 7314567 - DNA, 22 bp, Homo sapiens
ctgtgggagaagggctttttct

SEQ ID NO: 7314568 - DNA, 22 bp, Homo sapiens
ctgtgggagaagttgctggagt

SEQ ID NO: 7314569 - DNA, 22 bp, Homo sapiens
ctgtgggagaagttgctggagt

SEQ ID NO: 7314570 - DNA, 22 bp, Homo sapiens
ctgtgggactctgaggaaaagc

SEQ ID NO: 7314571 - DNA, 22 bp, Homo sapiens
ctgtgggactctgaggaaaagc

SEQ ID NO: 7314572 - DNA, 22 bp, Homo sapiens
ctgtgggagaagctagcacagg

SEQ ID NO: 7314573 - DNA, 21 bp, Homo sapiens
ctgtgggaccaagcactggga

SEQ ID NO: 7314574 - DNA, 22 bp, Homo sapiens
ctgtggcctttgttggaggtcc

SEQ ID NO: 7314575 - DNA, 22 bp, Homo sapiens
ctgtggccttggaccagcatct

SEQ ID NO: 7314576 - DNA, 22 bp, Homo sapiens
ctgtggccctgtgatctggcac

SEQ ID NO: 7314577 - DNA, 19 bp, Homo sapiens
ctgtggcctccaggaggga

SEQ ID NO: 7314578 - DNA, 22 bp, Homo sapiens
atcagacagggagttctgtgtc

SEQ ID NO: 7314579 - DNA, 22 bp, Homo sapiens
ctgcagggtttttcaaggacaa

SEQ ID NO: 7314580 - DNA, 22 bp, Homo sapiens
ctgcagggtttcgccagttgtg

SEQ ID NO: 7314581 - DNA, 22 bp, Homo sapiens
ctgcatgtggtgcaggtgcccc

SEQ ID NO: 7314582 - DNA, 22 bp, Homo sapiens
ctgcatgtgatgtggttagcta

SEQ ID NO: 7314583 - DNA, 22 bp, Homo sapiens
ctgcatgtgttatatttggttc

SEQ ID NO: 7314584 - DNA, 22 bp, Homo sapiens
ctgcatgtgtttctgctgggtt

SEQ ID NO: 7314585 - DNA, 22 bp, Homo sapiens
ctgcatgtttacatttttgaga

SEQ ID NO: 7314586 - DNA, 20 bp, Homo sapiens
ctgcatgttggaggtgtacc

SEQ ID NO: 7314587 - DNA, 19 bp, Homo sapiens
ctgcatgtagagcatcgtt

SEQ ID NO: 7314588 - DNA, 22 bp, Homo sapiens
ctgcatgtgttatatttggttc

SEQ ID NO: 7314589 - DNA, 23 bp, Homo sapiens
ctgcatgtccactggtgtaaatg

SEQ ID NO: 7314590 - DNA, 22 bp, Homo sapiens
ctgcatgtcactctgctgtccc

SEQ ID NO: 7314591 - DNA, 22 bp, Homo sapiens
ctgcatgtttacatttttgaga

SEQ ID NO: 7314592 - DNA, 22 bp, Homo sapiens
ctgcatgttttcttaattgtga

SEQ ID NO: 7314593 - DNA, 22 bp, Homo sapiens
ctgcatgttttcttaattgtga

SEQ ID NO: 7314594 - DNA, 22 bp, Homo sapiens
ctgcatctgcataatcaacttc

SEQ ID NO: 7314595 - DNA, 22 bp, Homo sapiens
agttatttactcctttgtctct

SEQ ID NO: 7314596 - DNA, 22 bp, Homo sapiens
ctgatcatgtgggaggatatgt

SEQ ID NO: 7314597 - DNA, 22 bp, Homo sapiens
ctgcaaatccctactgggcaca

SEQ ID NO: 7314598 - DNA, 22 bp, Homo sapiens
agttatttaaaatgattgtcct

SEQ ID NO: 7314599 - DNA, 22 bp, Homo sapiens
agttatcaagacagtgtggtac

SEQ ID NO: 7314600 - DNA, 22 bp, Homo sapiens
ataaatgattcagcaggaaata

SEQ ID NO: 7314601 - DNA, 22 bp, Homo sapiens
ctgcctctccccagagtggccc

SEQ ID NO: 7314602 - DNA, 22 bp, Homo sapiens
ataacattttgacaactggtga

SEQ ID NO: 7314603 - DNA, 22 bp, Homo sapiens
ataacatggagtttgtcattta

SEQ ID NO: 7314604 - DNA, 22 bp, Homo sapiens
ataaattatgaatggccctttt

SEQ ID NO: 7314605 - DNA, 22 bp, Homo sapiens
ctgctgaggtatactatgtgac

SEQ ID NO: 7314606 - DNA, 22 bp, Homo sapiens
ctgctgaggtggagattgcagt

SEQ ID NO: 7314607 - DNA, 22 bp, Homo sapiens
ctgctgagcctggtgcgggatg

SEQ ID NO: 7314608 - DNA, 22 bp, Homo sapiens
atacaactgccttagaaggaaa

SEQ ID NO: 7314609 - DNA, 22 bp, Homo sapiens
atacaacagaaaatgattattc

SEQ ID NO: 7314610 - DNA, 22 bp, Homo sapiens
atacaacagaaaatgattattc

SEQ ID NO: 7314611 - DNA, 22 bp, Homo sapiens
atacaaagtattgatcctgagt

SEQ ID NO: 7314612 - DNA, 22 bp, Homo sapiens
ataagcatgttagaatatttga

SEQ ID NO: 7314613 - DNA, 21 bp, Homo sapiens
ataagcatgctgattacattt

SEQ ID NO: 7314614 - DNA, 22 bp, Homo sapiens
ataagaggaattacagaagagg

SEQ ID NO: 7314615 - DNA, 22 bp, Homo sapiens
ataacttcagggctgtgacaga

SEQ ID NO: 7314616 - DNA, 22 bp, Homo sapiens
ataagacacgcaaataggtacg

SEQ ID NO: 7314617 - DNA, 17 bp, Homo sapiens
ataagacagaagacaat

SEQ ID NO: 7314618 - DNA, 22 bp, Homo sapiens
ataagacacgccccactcactc

SEQ ID NO: 7314619 - DNA, 22 bp, Homo sapiens
atagcaatgatcaagacagaca

SEQ ID NO: 7314620 - DNA, 22 bp, Homo sapiens
atagcaatcagtgtatttgaaa

SEQ ID NO: 7314621 - DNA, 22 bp, Homo sapiens
atagcagcatttcttccaagga

SEQ ID NO: 7314622 - DNA, 19 bp, Homo sapiens
atagcagctatacccagat

SEQ ID NO: 7314623 - DNA, 22 bp, Homo sapiens
ctggctccatccttgagctctg

SEQ ID NO: 7314624 - DNA, 22 bp, Homo sapiens
ctggctccattactcagcatct

SEQ ID NO: 7314625 - DNA, 22 bp, Homo sapiens
atagatttgaatttaagacttg

SEQ ID NO: 7314626 - DNA, 22 bp, Homo sapiens
atagacttgaggatataatgaa

SEQ ID NO: 7314627 - DNA, 22 bp, Homo sapiens
atagacttggttagtaaatttg

SEQ ID NO: 7314628 - DNA, 22 bp, Homo sapiens
atactacacattgactatattt

SEQ ID NO: 7314629 - DNA, 22 bp, Homo sapiens
atactacatactatgtaaacat

SEQ ID NO: 7314630 - DNA, 22 bp, Homo sapiens
atactacacattgactatattt

SEQ ID NO: 7314631 - DNA, 22 bp, Homo sapiens
atactacaatcataattgtaca

SEQ ID NO: 7314632 - DNA, 22 bp, Homo sapiens
atactacaatcataattgtaca

SEQ ID NO: 7314633 - DNA, 22 bp, Homo sapiens
atactacaaggtatgtgctaaa

SEQ ID NO: 7314634 - DNA, 22 bp, Homo sapiens
atactacaaggtatgtgctaaa

SEQ ID NO: 7314635 - DNA, 22 bp, Homo sapiens
atagcaaaggacaatagtcagt

SEQ ID NO: 7314636 - DNA, 22 bp, Homo sapiens
atagcaaaaggcaccagagtga

SEQ ID NO: 7314637 - DNA, 22 bp, Homo sapiens
ctggccccagagtttcacttgg

SEQ ID NO: 7314638 - DNA, 22 bp, Homo sapiens
ctggccccaggcagcctgctgg

SEQ ID NO: 7314639 - DNA, 22 bp, Homo sapiens
ctggcccccacacctgtcaggg

SEQ ID NO: 7314640 - DNA, 22 bp, Homo sapiens
ctggccccggttcctaaaaacc

SEQ ID NO: 7314641 - DNA, 22 bp, Homo sapiens
ctggcccctgtggctaaaatca

SEQ ID NO: 7314642 - DNA, 22 bp, Homo sapiens
ctggccccatctggagtctgag

SEQ ID NO: 7314643 - DNA, 22 bp, Homo sapiens
ctggagaattctatgaaatatt

SEQ ID NO: 7314644 - DNA, 19 bp, Homo sapiens
atacagatgtatccatgat

SEQ ID NO: 7314645 - DNA, 22 bp, Homo sapiens
atacagatgttaaagcaatttc

SEQ ID NO: 7314646 - DNA, 18 bp, Homo sapiens
ctgctgcaggcactcagg

SEQ ID NO: 7314647 - DNA, 22 bp, Homo sapiens
ataccacaacatggctcagagg

SEQ ID NO: 7314648 - DNA, 22 bp, Homo sapiens
ataccaccatctatgaaaggta

SEQ ID NO: 7314649 - DNA, 22 bp, Homo sapiens
ataccattgtttctaccagctg

SEQ ID NO: 7314650 - DNA, 22 bp, Homo sapiens
ataccatttatcaagtacagtg

SEQ ID NO: 7314651 - DNA, 22 bp, Homo sapiens
atacgtaagttgaacatcagaa

SEQ ID NO: 7314652 - DNA, 22 bp, Homo sapiens
atacgtgctgttttaagataca

SEQ ID NO: 7314653 - DNA, 22 bp, Homo sapiens
atacattcagcagtgctcatga

SEQ ID NO: 7314654 - DNA, 22 bp, Homo sapiens
atacatatatggtacttcctgg

SEQ ID NO: 7314655 - DNA, 22 bp, Homo sapiens
atacatatatggtacttcctgg

SEQ ID NO: 7314656 - DNA, 22 bp, Homo sapiens
atacatgtgtgtgcatacatgt

SEQ ID NO: 7314657 - DNA, 22 bp, Homo sapiens
atacagtttaccacactccttg

SEQ ID NO: 7314658 - DNA, 17 bp, Homo sapiens
atacagtttattttaca

SEQ ID NO: 7314659 - DNA, 22 bp, Homo sapiens
atacatacatgtacacataaat

SEQ ID NO: 7314660 - DNA, 22 bp, Homo sapiens
atacatacatgtacacataaat

SEQ ID NO: 7314661 - DNA, 22 bp, Homo sapiens
atacatacatgtatgcacatac

SEQ ID NO: 7314662 - DNA, 22 bp, Homo sapiens
atacatacatgtatgcacatac

SEQ ID NO: 7314663 - DNA, 22 bp, Homo sapiens
atacatacgtacatacgtatgt

SEQ ID NO: 7314664 - DNA, 22 bp, Homo sapiens
atacagttagaaaaaaagcctt

SEQ ID NO: 7314665 - DNA, 22 bp, Homo sapiens
atacagtattacctgttcagga

SEQ ID NO: 7314666 - DNA, 22 bp, Homo sapiens
atacagtataactaataaaccc

SEQ ID NO: 7314667 - DNA, 22 bp, Homo sapiens
gctgacccctacaggttgtgtt

SEQ ID NO: 7314668 - DNA, 22 bp, Homo sapiens
gctgaaaggggtgacattcttt

SEQ ID NO: 7314669 - DNA, 22 bp, Homo sapiens
gctctttctgtccgcagggcct

SEQ ID NO: 7314670 - DNA, 22 bp, Homo sapiens
gctctttagacatagtctgaag

SEQ ID NO: 7314671 - DNA, 22 bp, Homo sapiens
caaatgcatgagaaataagagg

SEQ ID NO: 7314672 - DNA, 22 bp, Homo sapiens
caaaggaaatactaatctggaa

SEQ ID NO: 7314673 - DNA, 22 bp, Homo sapiens
caaaggaagctccttgatggcg

SEQ ID NO: 7314674 - DNA, 22 bp, Homo sapiens
caaaggaggtaatgggtgtgag

SEQ ID NO: 7314675 - DNA, 22 bp, Homo sapiens
caaaggaggtgataggccctct

SEQ ID NO: 7314676 - DNA, 22 bp, Homo sapiens
caaatactacgattcttgcagt

SEQ ID NO: 7314677 - DNA, 22 bp, Homo sapiens
caaatactaaacataagatttt

SEQ ID NO: 7314678 - DNA, 22 bp, Homo sapiens
caaatacaaatacgggcagctt

SEQ ID NO: 7314679 - DNA, 22 bp, Homo sapiens
caaatactttatatacttcaaa

SEQ ID NO: 7314680 - DNA, 22 bp, Homo sapiens
caaatacttttagcctattgag

SEQ ID NO: 7314681 - DNA, 21 bp, Homo sapiens
caaatacttagaaacttaaga

SEQ ID NO: 7314682 - DNA, 22 bp, Homo sapiens
caaatactgagtttattttcaa

SEQ ID NO: 7314683 - DNA, 22 bp, Homo sapiens
caaatactctggatgtgtttgt

SEQ ID NO: 7314684 - DNA, 22 bp, Homo sapiens
caaatactgtactgaacactgt

SEQ ID NO: 7314685 - DNA, 22 bp, Homo sapiens
caaatactgtactgaacactgt

SEQ ID NO: 7314686 - DNA, 22 bp, Homo sapiens
caaatactgtactgaacactgt

SEQ ID NO: 7314687 - DNA, 22 bp, Homo sapiens
caaatacttactgaacctgtgc

SEQ ID NO: 7314688 - DNA, 18 bp, Homo sapiens
caaatactgttgtcttat

SEQ ID NO: 7314689 - DNA, 22 bp, Homo sapiens
attttagagctccaagtacagc

SEQ ID NO: 7314690 - DNA, 22 bp, Homo sapiens
attttagagctccaagtacagc

SEQ ID NO: 7314691 - DNA, 22 bp, Homo sapiens
attttacttcatttgaaatgcc

SEQ ID NO: 7314692 - DNA, 22 bp, Homo sapiens
attttactttgtgaatattgac

SEQ ID NO: 7314693 - DNA, 19 bp, Homo sapiens
atttttcttcctctgtgca

SEQ ID NO: 7314694 - DNA, 19 bp, Homo sapiens
atttttcttcctctgtgca

SEQ ID NO: 7314695 - DNA, 19 bp, Homo sapiens
atttttcttcctctgtgca

SEQ ID NO: 7314696 - DNA, 22 bp, Homo sapiens
atttttctctcacacttaccag

SEQ ID NO: 7314697 - DNA, 22 bp, Homo sapiens
atttttctctccactccattaa

SEQ ID NO: 7314698 - DNA, 22 bp, Homo sapiens
atttttctctccactccattaa

SEQ ID NO: 7314699 - DNA, 22 bp, Homo sapiens
atttttctctttccactgagat

SEQ ID NO: 7314700 - DNA, 22 bp, Homo sapiens
caaacaatttgcatttccttag

SEQ ID NO: 7314701 - DNA, 22 bp, Homo sapiens
caaacatagtgaagcaatgaca

SEQ ID NO: 7314702 - DNA, 22 bp, Homo sapiens
caaaatgttctggcacctttaa

SEQ ID NO: 7314703 - DNA, 22 bp, Homo sapiens
gcctcacagactgactgaaagc

SEQ ID NO: 7314704 - DNA, 22 bp, Homo sapiens
atttggaaatgtaagaatgcaa

SEQ ID NO: 7314705 - DNA, 22 bp, Homo sapiens
gcccccgaggaggtgatgtcgc

SEQ ID NO: 7314706 - DNA, 22 bp, Homo sapiens
gcccccagctctcaagctcaaa

SEQ ID NO: 7314707 - DNA, 22 bp, Homo sapiens
gcccccaggcactacatgtgaa

SEQ ID NO: 7314708 - DNA, 22 bp, Homo sapiens
gcccccaggctctggagaacct

SEQ ID NO: 7314709 - DNA, 22 bp, Homo sapiens
gcccccaggctctggagaacct

SEQ ID NO: 7314710 - DNA, 22 bp, Homo sapiens
gcccccagaagggccacagatt

SEQ ID NO: 7314711 - DNA, 22 bp, Homo sapiens
gcccccagaagggccacagatt

SEQ ID NO: 7314712 - DNA, 18 bp, Homo sapiens
gcccccagatgctactga

SEQ ID NO: 7314713 - DNA, 22 bp, Homo sapiens
gcccccagagaatgaggtacga

SEQ ID NO: 7314714 - DNA, 22 bp, Homo sapiens
gcccccagacctcagtgggctg

SEQ ID NO: 7314715 - DNA, 22 bp, Homo sapiens
gcctggattccttgtttctcag

SEQ ID NO: 7314716 - DNA, 22 bp, Homo sapiens
atttggaaggagctgcacagca

SEQ ID NO: 7314717 - DNA, 22 bp, Homo sapiens
atttggaaggtttacaaagaga

SEQ ID NO: 7314718 - DNA, 22 bp, Homo sapiens
gcctgacctcttctgccctggg

SEQ ID NO: 7314719 - DNA, 17 bp, Homo sapiens
gcccccagaaatctcag

SEQ ID NO: 7314720 - DNA, 22 bp, Homo sapiens
atttctgttgcttataaattac

SEQ ID NO: 7314721 - DNA, 22 bp, Homo sapiens
atttctgtaacttatgaaagtt

SEQ ID NO: 7314722 - DNA, 22 bp, Homo sapiens
atttctgtaacttatgaaagtt

SEQ ID NO: 7314723 - DNA, 22 bp, Homo sapiens
gcccacagttaatgggggctct

SEQ ID NO: 7314724 - DNA, 22 bp, Homo sapiens
gcccacagtgtagcaggtactc

SEQ ID NO: 7314725 - DNA, 22 bp, Homo sapiens
gcccacagtctatcagtttgcg

SEQ ID NO: 7314726 - DNA, 22 bp, Homo sapiens
atttccattatcatgacaaatt

SEQ ID NO: 7314727 - DNA, 22 bp, Homo sapiens
atttccattatcatgacaaatt

SEQ ID NO: 7314728 - DNA, 22 bp, Homo sapiens
atttccatgtccaaaaattagt

SEQ ID NO: 7314729 - DNA, 22 bp, Homo sapiens
atttccatgtccaaaaattagt

SEQ ID NO: 7314730 - DNA, 22 bp, Homo sapiens
atttccatgtcggtattttata

SEQ ID NO: 7314731 - DNA, 22 bp, Homo sapiens
atttccaggctgttttgtgaat

SEQ ID NO: 7314732 - DNA, 22 bp, Homo sapiens
atttcatgtttcatctacctaa

SEQ ID NO: 7314733 - DNA, 22 bp, Homo sapiens
atttcatgttaactgaacagaa

SEQ ID NO: 7314734 - DNA, 22 bp, Homo sapiens
gccaggtgagaggactgaggct

SEQ ID NO: 7314735 - DNA, 22 bp, Homo sapiens
gccaggctggtgcaaggatatt

SEQ ID NO: 7314736 - DNA, 22 bp, Homo sapiens
gccaggctggcaaaaggaaacc

SEQ ID NO: 7314737 - DNA, 22 bp, Homo sapiens
gccaggctggaaagaacagaca

SEQ ID NO: 7314738 - DNA, 22 bp, Homo sapiens
gccaggctgctggctgctgtcc

SEQ ID NO: 7314739 - DNA, 22 bp, Homo sapiens
gccaggctggccagcaccttct

SEQ ID NO: 7314740 - DNA, 22 bp, Homo sapiens
gccaggctggggggagatgtct

SEQ ID NO: 7314741 - DNA, 22 bp, Homo sapiens
gccaggctggtcttgaactcct

SEQ ID NO: 7314742 - DNA, 22 bp, Homo sapiens
gccacaggtactatgggagaga

SEQ ID NO: 7314743 - DNA, 22 bp, Homo sapiens
gccacaggtgggctctgggaaa

SEQ ID NO: 7314744 - DNA, 22 bp, Homo sapiens
attactgtgactagccatctgg

SEQ ID NO: 7314745 - DNA, 22 bp, Homo sapiens
gatttccaggtcattaataaag

SEQ ID NO: 7314746 - DNA, 22 bp, Homo sapiens
gatttctcactgtggatttcct

SEQ ID NO: 7314747 - DNA, 22 bp, Homo sapiens
gatttctcatttgtggattgaa

SEQ ID NO: 7314748 - DNA, 22 bp, Homo sapiens
gatttctctgcacccactcagg

SEQ ID NO: 7314749 - DNA, 22 bp, Homo sapiens
attagaggttgttttgtaaaga

SEQ ID NO: 7314750 - DNA, 22 bp, Homo sapiens
gatttctagtaagtcatgaagg

SEQ ID NO: 7314751 - DNA, 22 bp, Homo sapiens
gatttcctcactaacatccatc

SEQ ID NO: 7314752 - DNA, 19 bp, Homo sapiens
gatattgcttgagtaactg

SEQ ID NO: 7314753 - DNA, 22 bp, Homo sapiens
gatattgcatattggatgagtt

SEQ ID NO: 7314754 - DNA, 22 bp, Homo sapiens
gatattgccagatgtccccgga

SEQ ID NO: 7314755 - DNA, 22 bp, Homo sapiens
gatattgcacctctaatacatt

SEQ ID NO: 7314756 - DNA, 22 bp, Homo sapiens
gatatttaactctcacaggtcc

SEQ ID NO: 7314757 - DNA, 22 bp, Homo sapiens
gatattctacctgctgaccaag

SEQ ID NO: 7314758 - DNA, 22 bp, Homo sapiens
attacatatgttggcaacattt

SEQ ID NO: 7314759 - DNA, 22 bp, Homo sapiens
attagcttaggcatgaagagaa

SEQ ID NO: 7314760 - DNA, 22 bp, Homo sapiens
attagctttggattcagaagat

SEQ ID NO: 7314761 - DNA, 22 bp, Homo sapiens
attcaaattaagttaattcagc

SEQ ID NO: 7314762 - DNA, 22 bp, Homo sapiens
attcaaagtctagatgtagtgt

SEQ ID NO: 7314763 - DNA, 22 bp, Homo sapiens
attcaaagtagatgaagtttca

SEQ ID NO: 7314764 - DNA, 20 bp, Homo sapiens
attagtgcatctggacatgc

SEQ ID NO: 7314765 - DNA, 22 bp, Homo sapiens
attcacattgagcttcactgtg

SEQ ID NO: 7314766 - DNA, 22 bp, Homo sapiens
attcacatgtgcttcttatcac

SEQ ID NO: 7314767 - DNA, 22 bp, Homo sapiens
attcacattttatttcactgga

SEQ ID NO: 7314768 - DNA, 22 bp, Homo sapiens
attcacccacgtcttagtctgt

SEQ ID NO: 7314769 - DNA, 22 bp, Homo sapiens
attcacatttacaaagcactca

SEQ ID NO: 7314770 - DNA, 22 bp, Homo sapiens
attcaccccctatttgcaatgc

SEQ ID NO: 7314771 - DNA, 22 bp, Homo sapiens
attcagaaagatatgcctggtt

SEQ ID NO: 7314772 - DNA, 22 bp, Homo sapiens
attcagaaagggttgcctggtt

SEQ ID NO: 7314773 - DNA, 22 bp, Homo sapiens
attcagaaagcaagtgctgggt

SEQ ID NO: 7314774 - DNA, 22 bp, Homo sapiens
attcagttctgctggttctgct

SEQ ID NO: 7314775 - DNA, 22 bp, Homo sapiens
attcagttgtaatctttgttag

SEQ ID NO: 7314776 - DNA, 22 bp, Homo sapiens
gcagcagatgctttcatggaca

SEQ ID NO: 7314777 - DNA, 22 bp, Homo sapiens
attcataacggcaaatgtcacc

SEQ ID NO: 7314778 - DNA, 23 bp, Homo sapiens
attcagaattgtgtgtttgtata

SEQ ID NO: 7314779 - DNA, 22 bp, Homo sapiens
attcagaagctattcttagttc

SEQ ID NO: 7314780 - DNA, 21 bp, Homo sapiens
gcagcagaggcttgacagaca

SEQ ID NO: 7314781 - DNA, 17 bp, Homo sapiens
gcatcacagataacacg

SEQ ID NO: 7314782 - DNA, 17 bp, Homo sapiens
gcatcacagataacacg

SEQ ID NO: 7314783 - DNA, 22 bp, Homo sapiens
attgtagcccatgcataaaccg

SEQ ID NO: 7314784 - DNA, 22 bp, Homo sapiens
attgtccatctccacattaatg

SEQ ID NO: 7314785 - DNA, 17 bp, Homo sapiens
attgtctcttcacttat

SEQ ID NO: 7314786 - DNA, 22 bp, Homo sapiens
gcagtgtgcatggcttttggcc

SEQ ID NO: 7314787 - DNA, 22 bp, Homo sapiens
gcatacaaaggtttacaactga

SEQ ID NO: 7314788 - DNA, 22 bp, Homo sapiens
attgtctgtactttaaaaatgt

SEQ ID NO: 7314789 - DNA, 22 bp, Homo sapiens
attgtcttggcattcaaattag

SEQ ID NO: 7314790 - DNA, 20 bp, Homo sapiens
attgtgaatactgcatatgt

SEQ ID NO: 7314791 - DNA, 22 bp, Homo sapiens
attgtgaataatgctgcaataa

SEQ ID NO: 7314792 - DNA, 22 bp, Homo sapiens
attgtctttccactgagaagtt

SEQ ID NO: 7314793 - DNA, 22 bp, Homo sapiens
attgtgcaaaacctcaggcctc

SEQ ID NO: 7314794 - DNA, 22 bp, Homo sapiens
attgtgcaaatattatctgtag

SEQ ID NO: 7314795 - DNA, 22 bp, Homo sapiens
attgtgcaatgttttacaattt

SEQ ID NO: 7314796 - DNA, 22 bp, Homo sapiens
attgtgcaatgttttacaattt

SEQ ID NO: 7314797 - DNA, 22 bp, Homo sapiens
attgtgcaccaccttgtggcag

SEQ ID NO: 7314798 - DNA, 22 bp, Homo sapiens
attgtgactttgagctgaaagc

SEQ ID NO: 7314799 - DNA, 22 bp, Homo sapiens
attgtgacaaatgtgccatact

SEQ ID NO: 7314800 - DNA, 22 bp, Homo sapiens
attgtgactcctgatatagaaa

SEQ ID NO: 7314801 - DNA, 22 bp, Homo sapiens
attgtgaatagtgctgcaataa

SEQ ID NO: 7314802 - DNA, 22 bp, Homo sapiens
gccacagggcagatgcgcagag

SEQ ID NO: 7314803 - DNA, 22 bp, Homo sapiens
gccaagaaatgcccctcacaga

SEQ ID NO: 7314804 - DNA, 22 bp, Homo sapiens
gccaagaaagtggcacccctag

SEQ ID NO: 7314805 - DNA, 22 bp, Homo sapiens
attctttagccagcaggtatat

SEQ ID NO: 7314806 - DNA, 22 bp, Homo sapiens
attctttattgctgatggttat

SEQ ID NO: 7314807 - DNA, 22 bp, Homo sapiens
attcttgcagtatacaactact

SEQ ID NO: 7314808 - DNA, 22 bp, Homo sapiens
gcagctgctggaagttcctgcc

SEQ ID NO: 7314809 - DNA, 22 bp, Homo sapiens
gcagctgcgaagaagtctatct

SEQ ID NO: 7314810 - DNA, 22 bp, Homo sapiens
gcagcgaggtgatgaaatagct

SEQ ID NO: 7314811 - DNA, 22 bp, Homo sapiens
attgcaaagaaatacatgctta

SEQ ID NO: 7314812 - DNA, 22 bp, Homo sapiens
atggtggacgggagacaggact

SEQ ID NO: 7314813 - DNA, 22 bp, Homo sapiens
atggtggactcttgattcaggc

SEQ ID NO: 7314814 - DNA, 22 bp, Homo sapiens
atggtggaggtgtattctggat

SEQ ID NO: 7314815 - DNA, 22 bp, Homo sapiens
atggtggatttgtgattcagct

SEQ ID NO: 7314816 - DNA, 22 bp, Homo sapiens
atggttatgcaaacatgatgca

SEQ ID NO: 7314817 - DNA, 22 bp, Homo sapiens
gaggcagcatctatggtgggaa

SEQ ID NO: 7314818 - DNA, 22 bp, Homo sapiens
gaggagaagctaagaaacacag

SEQ ID NO: 7314819 - DNA, 22 bp, Homo sapiens
gaggagaaatttggggacctga

SEQ ID NO: 7314820 - DNA, 22 bp, Homo sapiens
atggtctgaatgtgtgctccaa

SEQ ID NO: 7314821 - DNA, 22 bp, Homo sapiens
atggtggaagagcatcagaaag

SEQ ID NO: 7314822 - DNA, 22 bp, Homo sapiens
atggtggaatcggcgtgaatgg

SEQ ID NO: 7314823 - DNA, 22 bp, Homo sapiens
gaggagaatgcgcaccacatat

SEQ ID NO: 7314824 - DNA, 18 bp, Homo sapiens
atggtctcatactgggag

SEQ ID NO: 7314825 - DNA, 22 bp, Homo sapiens
atggggctagacaaccagtgcc

SEQ ID NO: 7314826 - DNA, 22 bp, Homo sapiens
atggggaagcaattggatttcc

SEQ ID NO: 7314827 - DNA, 22 bp, Homo sapiens
atgggcttgaccctacagaaag

SEQ ID NO: 7314828 - DNA, 22 bp, Homo sapiens
atgggaaggttttgagagcggg

SEQ ID NO: 7314829 - DNA, 21 bp, Homo sapiens
atggagggaccagggaagcag

SEQ ID NO: 7314830 - DNA, 21 bp, Homo sapiens
atggagggaccagggaagcag

SEQ ID NO: 7314831 - DNA, 22 bp, Homo sapiens
atggagggtggtaagacagaga

SEQ ID NO: 7314832 - DNA, 22 bp, Homo sapiens
atggagggtgtcagagagcgaa

SEQ ID NO: 7314833 - DNA, 22 bp, Homo sapiens
gagagagctctgtgcctgggat

SEQ ID NO: 7314834 - DNA, 22 bp, Homo sapiens
gagagaggcctccatgtactga

SEQ ID NO: 7314835 - DNA, 22 bp, Homo sapiens
gagagcagactctcaaagctgg

SEQ ID NO: 7314836 - DNA, 22 bp, Homo sapiens
atggcttttgatgctaagccaa

SEQ ID NO: 7314837 - DNA, 22 bp, Homo sapiens
atggcatttgtcaagataagta

SEQ ID NO: 7314838 - DNA, 22 bp, Homo sapiens
atggccaactgaaatgaaagat

SEQ ID NO: 7314839 - DNA, 22 bp, Homo sapiens
atggccaagcatatacagattg

SEQ ID NO: 7314840 - DNA, 22 bp, Homo sapiens
gagatggtgttccactgccagt

SEQ ID NO: 7314841 - DNA, 22 bp, Homo sapiens
atgtcctgggctgggttatgtt

SEQ ID NO: 7314842 - DNA, 22 bp, Homo sapiens
atgtccttaatctgaatgttag

SEQ ID NO: 7314843 - DNA, 22 bp, Homo sapiens
atgtccttggagtccactttcc

SEQ ID NO: 7314844 - DNA, 22 bp, Homo sapiens
atgtccttcttgagggcttgtt

SEQ ID NO: 7314845 - DNA, 22 bp, Homo sapiens
atgtccttgggccagggtgcct

SEQ ID NO: 7314846 - DNA, 22 bp, Homo sapiens
atgtccttggaacacctgaggt

SEQ ID NO: 7314847 - DNA, 22 bp, Homo sapiens
atgtccttgagaccctcctcgg

SEQ ID NO: 7314848 - DNA, 22 bp, Homo sapiens
atgtccttcctgagatccctgt

SEQ ID NO: 7314849 - DNA, 22 bp, Homo sapiens
atgtccttctctggggcccaga

SEQ ID NO: 7314850 - DNA, 22 bp, Homo sapiens
atgtcctttgcttctctggtcc

SEQ ID NO: 7314851 - DNA, 22 bp, Homo sapiens
atgtcctttaaatgacttaata

SEQ ID NO: 7314852 - DNA, 21 bp, Homo sapiens
atgtcctttgctctcccacat

SEQ ID NO: 7314853 - DNA, 22 bp, Homo sapiens
atgtccttgttttggtgacact

SEQ ID NO: 7314854 - DNA, 22 bp, Homo sapiens
atgtccttggggctggggaact

SEQ ID NO: 7314855 - DNA, 22 bp, Homo sapiens
atgtccttgtgagtaaatgatg

SEQ ID NO: 7314856 - DNA, 22 bp, Homo sapiens
atgtccttgtgagtaaatgatg

SEQ ID NO: 7314857 - DNA, 22 bp, Homo sapiens
atgtccttcggacaaaattctt

SEQ ID NO: 7314858 - DNA, 22 bp, Homo sapiens
atgtccttctcctcttacctgc

SEQ ID NO: 7314859 - DNA, 22 bp, Homo sapiens
atgtccttcgtaggggcagcag

SEQ ID NO: 7314860 - DNA, 22 bp, Homo sapiens
atgtccttcggacaaaattctt

SEQ ID NO: 7314861 - DNA, 22 bp, Homo sapiens
atgtccttccattttgatctgt

SEQ ID NO: 7314862 - DNA, 22 bp, Homo sapiens
atgtccttcatctaggagatgg

SEQ ID NO: 7314863 - DNA, 22 bp, Homo sapiens
atgtccttcatctaggagatgg

SEQ ID NO: 7314864 - DNA, 22 bp, Homo sapiens
atgtctatgttctttactgtgt

SEQ ID NO: 7314865 - DNA, 22 bp, Homo sapiens
atgtctatggaatttccacaca

SEQ ID NO: 7314866 - DNA, 22 bp, Homo sapiens
atgtctatatagtcaataatca

SEQ ID NO: 7314867 - DNA, 22 bp, Homo sapiens
atgtccttttatttaaagcagg

SEQ ID NO: 7314868 - DNA, 22 bp, Homo sapiens
atgtcctttgttctgagggagt

SEQ ID NO: 7314869 - DNA, 22 bp, Homo sapiens
atgtcctttgtgtgtagctctc

SEQ ID NO: 7314870 - DNA, 22 bp, Homo sapiens
atgtccttttaaaatgtgagaa

SEQ ID NO: 7314871 - DNA, 22 bp, Homo sapiens
atgtcctttgtatgcttgtact

SEQ ID NO: 7314872 - DNA, 22 bp, Homo sapiens
atgtcctttgtatccctaggca

SEQ ID NO: 7314873 - DNA, 22 bp, Homo sapiens
atgtctcagagtggtcactggg

SEQ ID NO: 7314874 - DNA, 22 bp, Homo sapiens
atgtctctgccccagagagctt

SEQ ID NO: 7314875 - DNA, 22 bp, Homo sapiens
atgtctctcaggtttaacttta

SEQ ID NO: 7314876 - DNA, 22 bp, Homo sapiens
atgtctctgctgtggttagctt

SEQ ID NO: 7314877 - DNA, 22 bp, Homo sapiens
atgtctctgccccagagagctt

SEQ ID NO: 7314878 - DNA, 20 bp, Homo sapiens
atgtagatgaaagcaaaggc

SEQ ID NO: 7314879 - DNA, 22 bp, Homo sapiens
gagggcagaaaattatgcggtg

SEQ ID NO: 7314880 - DNA, 22 bp, Homo sapiens
atgtctctttactcttagaacc

SEQ ID NO: 7314881 - DNA, 22 bp, Homo sapiens
atgtgactccaggcagttttgt

SEQ ID NO: 7314882 - DNA, 22 bp, Homo sapiens
atgtgacagtgtttgacagatg

SEQ ID NO: 7314883 - DNA, 21 bp, Homo sapiens
atgtgaaatatcatcagagca

SEQ ID NO: 7314884 - DNA, 22 bp, Homo sapiens
atgtgaaactgaagcatccata

SEQ ID NO: 7314885 - DNA, 22 bp, Homo sapiens
atgtgaaacgcaatgggatcat

SEQ ID NO: 7314886 - DNA, 20 bp, Homo sapiens
atgtgaaagatcagttgtct

SEQ ID NO: 7314887 - DNA, 22 bp, Homo sapiens
gataatgtgccgataatttcta

SEQ ID NO: 7314888 - DNA, 22 bp, Homo sapiens
gatacaaaatataaatggagag

SEQ ID NO: 7314889 - DNA, 22 bp, Homo sapiens
gatacacaagtggaaggagacg

SEQ ID NO: 7314890 - DNA, 22 bp, Homo sapiens
gatacacaagtggaaggagacg

SEQ ID NO: 7314891 - DNA, 22 bp, Homo sapiens
gatatatttggaccagagcatt

SEQ ID NO: 7314892 - DNA, 22 bp, Homo sapiens
gatacacaaaagtctagtgagg

SEQ ID NO: 7314893 - DNA, 22 bp, Homo sapiens
gatacacaaaagtctagtgagg

SEQ ID NO: 7314894 - DNA, 22 bp, Homo sapiens
atgttggagtcgtaaggcatgg

SEQ ID NO: 7314895 - DNA, 22 bp, Homo sapiens
atgtttaaggaactggtttgct

SEQ ID NO: 7314896 - DNA, 22 bp, Homo sapiens
atgtttaaagggttgagaaata

SEQ ID NO: 7314897 - DNA, 22 bp, Homo sapiens
gataatattagaagatacaaat

SEQ ID NO: 7314898 - DNA, 22 bp, Homo sapiens
gagttccttctgcctcagcttg

SEQ ID NO: 7314899 - DNA, 22 bp, Homo sapiens
atgtgtctaattccaggagcac

SEQ ID NO: 7314900 - DNA, 22 bp, Homo sapiens
atgtgtctaattccaggagcac

SEQ ID NO: 7314901 - DNA, 22 bp, Homo sapiens
atgtgtctctaaaatttagtaa

SEQ ID NO: 7314902 - DNA, 17 bp, Homo sapiens
atgtgtctagtgcaacc

SEQ ID NO: 7314903 - DNA, 17 bp, Homo sapiens
atgtgtctagtgcaacc

SEQ ID NO: 7314904 - DNA, 22 bp, Homo sapiens
atgtgtctagattgctgtaccg

SEQ ID NO: 7314905 - DNA, 22 bp, Homo sapiens
atgtgtctgaccactgtattgg

SEQ ID NO: 7314906 - DNA, 22 bp, Homo sapiens
atgtgtctgaccactgtattgg

SEQ ID NO: 7314907 - DNA, 17 bp, Homo sapiens
atgtgtctgagtgtcct

SEQ ID NO: 7314908 - DNA, 22 bp, Homo sapiens
atgtgtctctaccaatgcaatt

SEQ ID NO: 7314909 - DNA, 22 bp, Homo sapiens
atgtgtctctaaaatttagtaa

SEQ ID NO: 7314910 - DNA, 22 bp, Homo sapiens
atgtgtctgatggccctgaatt

SEQ ID NO: 7314911 - DNA, 20 bp, Homo sapiens
atgtgtctgcctctgtgttc

SEQ ID NO: 7314912 - DNA, 20 bp, Homo sapiens
atgtgtctgcctctgtgttc

SEQ ID NO: 7314913 - DNA, 22 bp, Homo sapiens
atgtgtctggcatggaaagtgt

SEQ ID NO: 7314914 - DNA, 20 bp, Homo sapiens
atgtgtctgtaaacaactct

SEQ ID NO: 7314915 - DNA, 22 bp, Homo sapiens
atgtgtctggttattgacatgc

SEQ ID NO: 7314916 - DNA, 22 bp, Homo sapiens
atgtgtctggcatggctctatt

SEQ ID NO: 7314917 - DNA, 22 bp, Homo sapiens
atgtgtctggcatggctctatt

SEQ ID NO: 7314918 - DNA, 22 bp, Homo sapiens
atgtgtcttctaagccaagcct

SEQ ID NO: 7314919 - DNA, 22 bp, Homo sapiens
atgtgtcttatttgattccaca

SEQ ID NO: 7314920 - DNA, 20 bp, Homo sapiens
atgtgtcttagagcatcagg

SEQ ID NO: 7314921 - DNA, 22 bp, Homo sapiens
atgtgtctgtgggcacacacac

SEQ ID NO: 7314922 - DNA, 22 bp, Homo sapiens
atgtgtcttctgtgggtttgaa

SEQ ID NO: 7314923 - DNA, 22 bp, Homo sapiens
atgttattttggaaaatacaaa

SEQ ID NO: 7314924 - DNA, 22 bp, Homo sapiens
gaccctggagttagtcctgtgt

SEQ ID NO: 7314925 - DNA, 22 bp, Homo sapiens
gaccctggagccgtctgaggca

SEQ ID NO: 7314926 - DNA, 22 bp, Homo sapiens
atgctctgggcaggagccctgg

SEQ ID NO: 7314927 - DNA, 22 bp, Homo sapiens
atgctctggagtacgtgaaatt

SEQ ID NO: 7314928 - DNA, 22 bp, Homo sapiens
atgctctgatgctgttaaatgt

SEQ ID NO: 7314929 - DNA, 22 bp, Homo sapiens
atgctctctgtcctgctcagag

SEQ ID NO: 7314930 - DNA, 22 bp, Homo sapiens
gaccttgtgatccgcccgcctt

SEQ ID NO: 7314931 - DNA, 22 bp, Homo sapiens
gaccttgtgctccgaggcgggc

SEQ ID NO: 7314932 - DNA, 22 bp, Homo sapiens
gacgggtgtccctatgtccatt

SEQ ID NO: 7314933 - DNA, 19 bp, Homo sapiens
gactaaataataatagcag

SEQ ID NO: 7314934 - DNA, 22 bp, Homo sapiens
gacacaaagtttgtcagaaatt

SEQ ID NO: 7314935 - DNA, 22 bp, Homo sapiens
gacacaaagtttgtcagaaatt

SEQ ID NO: 7314936 - DNA, 21 bp, Homo sapiens
gacacaaagggtagtaatggt

SEQ ID NO: 7314937 - DNA, 22 bp, Homo sapiens
gacaatttctcaatatagaaac

SEQ ID NO: 7314938 - DNA, 22 bp, Homo sapiens
gacacatgaccataaatgctaa

SEQ ID NO: 7314939 - DNA, 16 bp, Homo sapiens
gacacatgggggaaaa

SEQ ID NO: 7314940 - DNA, 22 bp, Homo sapiens
gacactatatgacacttcagtt

SEQ ID NO: 7314941 - DNA, 22 bp, Homo sapiens
gacatttatgaaggagatatgc

SEQ ID NO: 7314942 - DNA, 22 bp, Homo sapiens
gacatttattggattttacgag

SEQ ID NO: 7314943 - DNA, 22 bp, Homo sapiens
gacatttattagaaaactatca

SEQ ID NO: 7314944 - DNA, 22 bp, Homo sapiens
gaccaaggaagaggggagccag

SEQ ID NO: 7314945 - DNA, 22 bp, Homo sapiens
gacatttgtatgacactttaaa

SEQ ID NO: 7314946 - DNA, 22 bp, Homo sapiens
gacatttgtatcttaggggaaa

SEQ ID NO: 7314947 - DNA, 22 bp, Homo sapiens
gaccaaggccctcagtgggagg

SEQ ID NO: 7314948 - DNA, 22 bp, Homo sapiens
gaccacagcagtgcaagaggag

SEQ ID NO: 7314949 - DNA, 22 bp, Homo sapiens
atgcacacaagcttatgtatta

SEQ ID NO: 7314950 - DNA, 22 bp, Homo sapiens
gaaggctgtggctggtctcagt

SEQ ID NO: 7314951 - DNA, 22 bp, Homo sapiens
gaacaaattctcatcaacttgt

SEQ ID NO: 7314952 - DNA, 22 bp, Homo sapiens
gaaggcaagcagcataaatgtc

SEQ ID NO: 7314953 - DNA, 22 bp, Homo sapiens
gaataacattttttcctttaca

SEQ ID NO: 7314954 - DNA, 22 bp, Homo sapiens
gaataatattgactttgcaggc

SEQ ID NO: 7314955 - DNA, 22 bp, Homo sapiens
gaatattttcagtacagatggt

SEQ ID NO: 7314956 - DNA, 22 bp, Homo sapiens
gaatattttcagtacagatggt

SEQ ID NO: 7314957 - DNA, 22 bp, Homo sapiens
atgaacagtatgcaacatgatt

SEQ ID NO: 7314958 - DNA, 22 bp, Homo sapiens
atgaacagtacaaagcacagac

SEQ ID NO: 7314959 - DNA, 22 bp, Homo sapiens
atgaaacagtgtgtatagcaaa

SEQ ID NO: 7314960 - DNA, 22 bp, Homo sapiens
atgaaaattgacagcggaagta

SEQ ID NO: 7314961 - DNA, 22 bp, Homo sapiens
atgaaaatactgtggttgatag

SEQ ID NO: 7314962 - DNA, 22 bp, Homo sapiens
atgaaaattctatgcaggccag

SEQ ID NO: 7314963 - DNA, 22 bp, Homo sapiens
atgaaaatgtacatgtgtataa

SEQ ID NO: 7314964 - DNA, 22 bp, Homo sapiens
atgaagacaaactgggtagaaa

SEQ ID NO: 7314965 - DNA, 22 bp, Homo sapiens
atgaactagccaggttgtgctg

SEQ ID NO: 7314966 - DNA, 22 bp, Homo sapiens
atgaactaagagtcattagtgt

SEQ ID NO: 7314967 - DNA, 22 bp, Homo sapiens
ctttctgaagtttaagttctaa

SEQ ID NO: 7314968 - DNA, 22 bp, Homo sapiens
ctttctgaaagacattttaact

SEQ ID NO: 7314969 - DNA, 22 bp, Homo sapiens
ctttctgattttaagctctaat

SEQ ID NO: 7314970 - DNA, 22 bp, Homo sapiens
ctttctgatccctgcaaccctc

SEQ ID NO: 7314971 - DNA, 22 bp, Homo sapiens
ctttctggcacagccgcgggat

SEQ ID NO: 7314972 - DNA, 22 bp, Homo sapiens
ctttcaaagagtaggaggtttt

SEQ ID NO: 7314973 - DNA, 22 bp, Homo sapiens
ctttcaaagaccttggcatggg

SEQ ID NO: 7314974 - DNA, 22 bp, Homo sapiens
cttctttaatgtatacaaaaga

SEQ ID NO: 7314975 - DNA, 22 bp, Homo sapiens
cttctttactttctagaaataa

SEQ ID NO: 7314976 - DNA, 22 bp, Homo sapiens
atgatattttagtaaagtgata

SEQ ID NO: 7314977 - DNA, 22 bp, Homo sapiens
atgatcagcagttttcagtgtt

SEQ ID NO: 7314978 - DNA, 22 bp, Homo sapiens
atgatatttgcaatgtgcttgc

SEQ ID NO: 7314979 - DNA, 22 bp, Homo sapiens
gaaatttattatctacatcatt

SEQ ID NO: 7314980 - DNA, 22 bp, Homo sapiens
atgatcagggcagaagcagaag

SEQ ID NO: 7314981 - DNA, 22 bp, Homo sapiens
gaaagtacagattcctggccag

SEQ ID NO: 7314982 - DNA, 23 bp, Homo sapiens
gaaagtcaatatggtagctttga

SEQ ID NO: 7314983 - DNA, 22 bp, Homo sapiens
gaaatactgtaaagttattatt

SEQ ID NO: 7314984 - DNA, 22 bp, Homo sapiens
gaaaatgttagcttcatagtca

SEQ ID NO: 7314985 - DNA, 22 bp, Homo sapiens
gaaacaggtggcaggctagatt

SEQ ID NO: 7314986 - DNA, 22 bp, Homo sapiens
ctttctttcgaagacgtgatta

SEQ ID NO: 7314987 - DNA, 22 bp, Homo sapiens
gaaacattgtgttctacagatt

SEQ ID NO: 7314988 - DNA, 22 bp, Homo sapiens
gaaacatgtctgacaatttacc

SEQ ID NO: 7314989 - DNA, 22 bp, Homo sapiens
gaaacatagttgagacactgct

SEQ ID NO: 7314990 - DNA, 22 bp, Homo sapiens
atgacagcattcaagacataga

SEQ ID NO: 7314991 - DNA, 22 bp, Homo sapiens
atgacagtaggtaaatgatagc

SEQ ID NO: 7314992 - DNA, 22 bp, Homo sapiens
atgacagtactggtgacaatac

SEQ ID NO: 7314993 - DNA, 22 bp, Homo sapiens
atgacagtgggtcttgcaaaga

SEQ ID NO: 7314994 - DNA, 18 bp, Homo sapiens
cagaaagttatttactct

SEQ ID NO: 7314995 - DNA, 23 bp, Homo sapiens
cagaaagtttgagaagatacatc

SEQ ID NO: 7314996 - DNA, 22 bp, Homo sapiens
cagaaaggcacccactgggtct

SEQ ID NO: 7314997 - DNA, 22 bp, Homo sapiens
cagaaaggtatgtgtgcctttg

SEQ ID NO: 7314998 - DNA, 22 bp, Homo sapiens
cagaaaggacagagtgagggtg

SEQ ID NO: 7314999 - DNA, 22 bp, Homo sapiens
cagaaaggactttggttggctt

SEQ ID NO: 7315000 - DNA, 22 bp, Homo sapiens
cagaaataaagtggacagagta

SEQ ID NO: 7315001 - DNA, 22 bp, Homo sapiens
cagaaatagacaatggcagtgg

SEQ ID NO: 7315002 - DNA, 23 bp, Homo sapiens
cagaaataaactggtttgtagat

SEQ ID NO: 7315003 - DNA, 22 bp, Homo sapiens
cagaaataaacttctcacatcg

SEQ ID NO: 7315004 - DNA, 22 bp, Homo sapiens
ggctgtgaacactcttagcatc

SEQ ID NO: 7315005 - DNA, 22 bp, Homo sapiens
ggctgtctctgtgactgccacc

SEQ ID NO: 7315006 - DNA, 22 bp, Homo sapiens
ggctgtctgtggtggagcgttg

SEQ ID NO: 7315007 - DNA, 22 bp, Homo sapiens
ggctgtgtttctgtttgacatt

SEQ ID NO: 7315008 - DNA, 22 bp, Homo sapiens
ggctgcctactttcccagagtt

SEQ ID NO: 7315009 - DNA, 22 bp, Homo sapiens
cagaaaagggtgtttgttcagg

SEQ ID NO: 7315010 - DNA, 23 bp, Homo sapiens
cagaaaacccagagctcagtccc

SEQ ID NO: 7315011 - DNA, 22 bp, Homo sapiens
ggcctgtggcaaggtgagaatg

SEQ ID NO: 7315012 - DNA, 22 bp, Homo sapiens
ggcctgtgggaggacagctggg

SEQ ID NO: 7315013 - DNA, 22 bp, Homo sapiens
ggcctgtgctgagaacctggct

SEQ ID NO: 7315014 - DNA, 22 bp, Homo sapiens
ggcctgtgctgtcagccctagt

SEQ ID NO: 7315015 - DNA, 22 bp, Homo sapiens
ggcctgtggatctgatgaacca

SEQ ID NO: 7315016 - DNA, 22 bp, Homo sapiens
ggcctgtgtcctccttgccctg

SEQ ID NO: 7315017 - DNA, 22 bp, Homo sapiens
ggcctgtgtcggccccgggttc

SEQ ID NO: 7315018 - DNA, 22 bp, Homo sapiens
ggcctgtgtctgtgcctgtcct

SEQ ID NO: 7315019 - DNA, 17 bp, Homo sapiens
ggcctgtgtggctgcag

SEQ ID NO: 7315020 - DNA, 22 bp, Homo sapiens
ggcctgtgcacatgtgcaggaa

SEQ ID NO: 7315021 - DNA, 22 bp, Homo sapiens
ggcctgtaatcccagctactca

SEQ ID NO: 7315022 - DNA, 22 bp, Homo sapiens
ggcctgtgagaatcaaggaaaa

SEQ ID NO: 7315023 - DNA, 22 bp, Homo sapiens
ggcctgaggcgtcccagctgtg

SEQ ID NO: 7315024 - DNA, 22 bp, Homo sapiens
ggctctggtggcaattgactgg

SEQ ID NO: 7315025 - DNA, 22 bp, Homo sapiens
ggctccagggtctctccttgtg

SEQ ID NO: 7315026 - DNA, 22 bp, Homo sapiens
ggctccagggtacccctggatg

SEQ ID NO: 7315027 - DNA, 21 bp, Homo sapiens
ggccgccgccttgtgctctgc

SEQ ID NO: 7315028 - DNA, 22 bp, Homo sapiens
cacgagaacctctcatttgatt

SEQ ID NO: 7315029 - DNA, 22 bp, Homo sapiens
caccttttgtgtctgcgtttgt

SEQ ID NO: 7315030 - DNA, 22 bp, Homo sapiens
cacataaatggtgccatgtttt

SEQ ID NO: 7315031 - DNA, 22 bp, Homo sapiens
cacataatacatgttccactta

SEQ ID NO: 7315032 - DNA, 22 bp, Homo sapiens
cacatacaatggtgttatttgg

SEQ ID NO: 7315033 - DNA, 22 bp, Homo sapiens
cacatacaaggcacactggagg

SEQ ID NO: 7315034 - DNA, 22 bp, Homo sapiens
cacatacaatggtgttatttgg

SEQ ID NO: 7315035 - DNA, 19 bp, Homo sapiens
cacatacagaaaagagtaa

SEQ ID NO: 7315036 - DNA, 22 bp, Homo sapiens
cacatacatacgtatgtataca

SEQ ID NO: 7315037 - DNA, 22 bp, Homo sapiens
cacatacatacgtatgtataca

SEQ ID NO: 7315038 - DNA, 22 bp, Homo sapiens
cacatacatgcacacctaaata

SEQ ID NO: 7315039 - DNA, 22 bp, Homo sapiens
cacatacttgtgtgtacatatg

SEQ ID NO: 7315040 - DNA, 22 bp, Homo sapiens
cacatacattcatgttactcta

SEQ ID NO: 7315041 - DNA, 22 bp, Homo sapiens
cacagttttatcttatactgat

SEQ ID NO: 7315042 - DNA, 22 bp, Homo sapiens
cacagtttggttttgctgtaat

SEQ ID NO: 7315043 - DNA, 22 bp, Homo sapiens
cacatttaggttcctatagcca

SEQ ID NO: 7315044 - DNA, 22 bp, Homo sapiens
cacatttaggttcctatagcca

SEQ ID NO: 7315045 - DNA, 22 bp, Homo sapiens
cacatttaggttcctatagcca

SEQ ID NO: 7315046 - DNA, 22 bp, Homo sapiens
cacatttatctgttctttctag

SEQ ID NO: 7315047 - DNA, 22 bp, Homo sapiens
cacatttatctgttctttctag

SEQ ID NO: 7315048 - DNA, 22 bp, Homo sapiens
cacatttatctctctccggtga

SEQ ID NO: 7315049 - DNA, 22 bp, Homo sapiens
cacatttatctctctccggtga

SEQ ID NO: 7315050 - DNA, 22 bp, Homo sapiens
cacatttatgggctgggaggca

SEQ ID NO: 7315051 - DNA, 18 bp, Homo sapiens
cacatttacctggctccc

SEQ ID NO: 7315052 - DNA, 22 bp, Homo sapiens
cacatttacttttatcccttgg

SEQ ID NO: 7315053 - DNA, 22 bp, Homo sapiens
cacatttacttttatcccttgg

SEQ ID NO: 7315054 - DNA, 22 bp, Homo sapiens
cacatttagaggttagcatggt

SEQ ID NO: 7315055 - DNA, 22 bp, Homo sapiens
cacatttaggaggtggggaagc

SEQ ID NO: 7315056 - DNA, 22 bp, Homo sapiens
cacatttagaggttagcatggt

SEQ ID NO: 7315057 - DNA, 18 bp, Homo sapiens
cacatttacctggctccc

SEQ ID NO: 7315058 - DNA, 22 bp, Homo sapiens
cacatttacatataaaactttc

SEQ ID NO: 7315059 - DNA, 22 bp, Homo sapiens
cacatttaattggtttagggtg

SEQ ID NO: 7315060 - DNA, 22 bp, Homo sapiens
cacatataccagccgcggtacg

SEQ ID NO: 7315061 - DNA, 22 bp, Homo sapiens
cacatataacctagacaaggcc

SEQ ID NO: 7315062 - DNA, 23 bp, Homo sapiens
cacatatagcagccactaaggtc

SEQ ID NO: 7315063 - DNA, 23 bp, Homo sapiens
cacatatagcagccactaaggtc

SEQ ID NO: 7315064 - DNA, 22 bp, Homo sapiens
cacatactattttggttgggtt

SEQ ID NO: 7315065 - DNA, 22 bp, Homo sapiens
cacatatacctcttcttgagtt

SEQ ID NO: 7315066 - DNA, 22 bp, Homo sapiens
ggcagggaggaggtgaaagtga

SEQ ID NO: 7315067 - DNA, 22 bp, Homo sapiens
cacatttcattggcttacgtaa

SEQ ID NO: 7315068 - DNA, 22 bp, Homo sapiens
cacatttatttgaggctaattg

SEQ ID NO: 7315069 - DNA, 22 bp, Homo sapiens
cacatttatttgaggctaattg

SEQ ID NO: 7315070 - DNA, 22 bp, Homo sapiens
ggcaggcaggtcttcatggccc

SEQ ID NO: 7315071 - DNA, 22 bp, Homo sapiens
caagttttagaaatatctggat

SEQ ID NO: 7315072 - DNA, 21 bp, Homo sapiens
gctttctgtggactctgcacc

SEQ ID NO: 7315073 - DNA, 22 bp, Homo sapiens
caatgtcagaattacagttgat

SEQ ID NO: 7315074 - DNA, 22 bp, Homo sapiens
caatgtcatgattttccattag

SEQ ID NO: 7315075 - DNA, 22 bp, Homo sapiens
caatgtcatttcactgggctta

SEQ ID NO: 7315076 - DNA, 22 bp, Homo sapiens
caatgtttcttgtaaccagtga

SEQ ID NO: 7315077 - DNA, 22 bp, Homo sapiens
caatgtttactggggacccaga

SEQ ID NO: 7315078 - DNA, 22 bp, Homo sapiens
caatgtttgagtaggagcataa

SEQ ID NO: 7315079 - DNA, 22 bp, Homo sapiens
gctttcttcatactcaagcatc

SEQ ID NO: 7315080 - DNA, 22 bp, Homo sapiens
gctttgccttgaactctcatgt

SEQ ID NO: 7315081 - DNA, 22 bp, Homo sapiens
gctttgcccaagggccctaccc

SEQ ID NO: 7315082 - DNA, 22 bp, Homo sapiens
caagtttacaatgtgtatgtgt

SEQ ID NO: 7315083 - DNA, 22 bp, Homo sapiens
gctgtggcggcagcagctggtg

SEQ ID NO: 7315084 - DNA, 22 bp, Homo sapiens
caagtagagattacagtgtgca

SEQ ID NO: 7315085 - DNA, 22 bp, Homo sapiens
caaggtcagcgtgaagttctgt

SEQ ID NO: 7315086 - DNA, 22 bp, Homo sapiens
caaggtcagcgtgaagttctgt

SEQ ID NO: 7315087 - DNA, 22 bp, Homo sapiens
caaggtcacataacttgtcaaa

SEQ ID NO: 7315088 - DNA, 21 bp, Homo sapiens
caagccagaccaatagcagcc

SEQ ID NO: 7315089 - DNA, 22 bp, Homo sapiens
caagccagtttgtagttctctc

SEQ ID NO: 7315090 - DNA, 22 bp, Homo sapiens
gctggaggatggactggaagaa

SEQ ID NO: 7315091 - DNA, 22 bp, Homo sapiens
gctggaggatggactggaagaa

SEQ ID NO: 7315092 - DNA, 22 bp, Homo sapiens
caaatgtataaatgtactttct

SEQ ID NO: 7315093 - DNA, 22 bp, Homo sapiens
caaatgtatgttttcctatgta

SEQ ID NO: 7315094 - DNA, 22 bp, Homo sapiens
caaggcctgactgcttgtctaa

SEQ ID NO: 7315095 - DNA, 22 bp, Homo sapiens
caagggtggtattgggagcata

SEQ ID NO: 7315096 - DNA, 22 bp, Homo sapiens
gctggctgtatcacctggccag

SEQ ID NO: 7315097 - DNA, 22 bp, Homo sapiens
gctggctgggtccctgagaggc

SEQ ID NO: 7315098 - DNA, 22 bp, Homo sapiens
ggaggcattatggggaagactt

SEQ ID NO: 7315099 - DNA, 22 bp, Homo sapiens
cacaggaatcagcattaatggc

SEQ ID NO: 7315100 - DNA, 22 bp, Homo sapiens
cacaggaatataagtttgagtt

SEQ ID NO: 7315101 - DNA, 22 bp, Homo sapiens
cacaggaataagtcaaacttca

SEQ ID NO: 7315102 - DNA, 22 bp, Homo sapiens
cacagataaggatgttaatttt

SEQ ID NO: 7315103 - DNA, 19 bp, Homo sapiens
ggagccgccgcccttcatt

SEQ ID NO: 7315104 - DNA, 22 bp, Homo sapiens
ggagccctgccctaggcagctc

SEQ ID NO: 7315105 - DNA, 22 bp, Homo sapiens
cacagatttctggtcttcaccc

SEQ ID NO: 7315106 - DNA, 22 bp, Homo sapiens
ggagcctattattagcatggca

SEQ ID NO: 7315107 - DNA, 20 bp, Homo sapiens
cacagactgtatgggcacca

SEQ ID NO: 7315108 - DNA, 22 bp, Homo sapiens
cacagagaactgtgggagtgtg

SEQ ID NO: 7315109 - DNA, 22 bp, Homo sapiens
cacagagctggaaaggctgggc

SEQ ID NO: 7315110 - DNA, 22 bp, Homo sapiens
ggaagggcaataaaatctcagg

SEQ ID NO: 7315111 - DNA, 22 bp, Homo sapiens
cacacagctagtgacaggagaa

SEQ ID NO: 7315112 - DNA, 22 bp, Homo sapiens
cacaattttaatacacagtcaa

SEQ ID NO: 7315113 - DNA, 22 bp, Homo sapiens
cacaattttaatacacagtcaa

SEQ ID NO: 7315114 - DNA, 22 bp, Homo sapiens
caatgtttgtgatctactgact

SEQ ID NO: 7315115 - DNA, 22 bp, Homo sapiens
caatgtttgttagagctctaga

SEQ ID NO: 7315116 - DNA, 18 bp, Homo sapiens
caatgttttagatctcta

SEQ ID NO: 7315117 - DNA, 22 bp, Homo sapiens
cacacagatggtaagggaggga

SEQ ID NO: 7315118 - DNA, 22 bp, Homo sapiens
cacagaactggttaatagcaga

SEQ ID NO: 7315119 - DNA, 22 bp, Homo sapiens
cacagaagtgtgtataactctt

SEQ ID NO: 7315120 - DNA, 21 bp, Homo sapiens
ggaagggctctgaggacggct

SEQ ID NO: 7315121 - DNA, 22 bp, Homo sapiens
ggggagcagaagcagcaacaac

SEQ ID NO: 7315122 - DNA, 22 bp, Homo sapiens
cagaggtagaactggccctcac

SEQ ID NO: 7315123 - DNA, 22 bp, Homo sapiens
ggtcatacaaggcactggtgat

SEQ ID NO: 7315124 - DNA, 22 bp, Homo sapiens
ggtcatacaggtatctggtact

SEQ ID NO: 7315125 - DNA, 22 bp, Homo sapiens
ggtcatctcaggtgtgcttgat

SEQ ID NO: 7315126 - DNA, 22 bp, Homo sapiens
ggtcatctgtaattctgttcct

SEQ ID NO: 7315127 - DNA, 22 bp, Homo sapiens
ggtcatactctttgagtggagg

SEQ ID NO: 7315128 - DNA, 22 bp, Homo sapiens
ggtcattatagtggggaggtgg

SEQ ID NO: 7315129 - DNA, 19 bp, Homo sapiens
cagagtccttgaccagtcc

SEQ ID NO: 7315130 - DNA, 22 bp, Homo sapiens
cagcacatagtaggtattcact

SEQ ID NO: 7315131 - DNA, 22 bp, Homo sapiens
cagcacatctccaagaatttct

SEQ ID NO: 7315132 - DNA, 22 bp, Homo sapiens
cagcacatctgattatatgact

SEQ ID NO: 7315133 - DNA, 22 bp, Homo sapiens
cagcacataagccgaagactgt

SEQ ID NO: 7315134 - DNA, 22 bp, Homo sapiens
cagcacatctgattatatgact

SEQ ID NO: 7315135 - DNA, 22 bp, Homo sapiens
cagcacagtgcagatgctgact

SEQ ID NO: 7315136 - DNA, 22 bp, Homo sapiens
ggtgctgcctatagtctgaaac

SEQ ID NO: 7315137 - DNA, 22 bp, Homo sapiens
cagcaagacaaggaacaaactg

SEQ ID NO: 7315138 - DNA, 22 bp, Homo sapiens
cagcaaagtaagctgacatgta

SEQ ID NO: 7315139 - DNA, 22 bp, Homo sapiens
cagcaagacagtttcctaagtg

SEQ ID NO: 7315140 - DNA, 18 bp, Homo sapiens
ggtcctgggcctggctca

SEQ ID NO: 7315141 - DNA, 22 bp, Homo sapiens
ggtctgccctgggtggaggcgc

SEQ ID NO: 7315142 - DNA, 22 bp, Homo sapiens
cagactgaaaatccctggtagt

SEQ ID NO: 7315143 - DNA, 22 bp, Homo sapiens
cagaccagccatttgcctcttc

SEQ ID NO: 7315144 - DNA, 22 bp, Homo sapiens
cagaccagtagggctcatccca

SEQ ID NO: 7315145 - DNA, 22 bp, Homo sapiens
cagaccagaaggaagccgacaa

SEQ ID NO: 7315146 - DNA, 22 bp, Homo sapiens
gggcagcattctgtgggcaggt

SEQ ID NO: 7315147 - DNA, 22 bp, Homo sapiens
cagagacagcctgggagggaca

SEQ ID NO: 7315148 - DNA, 22 bp, Homo sapiens
cagagacaggatctcgaagact

SEQ ID NO: 7315149 - DNA, 22 bp, Homo sapiens
gggccagcctactgctagaccc

SEQ ID NO: 7315150 - DNA, 22 bp, Homo sapiens
gggccagcagtatcggaggcat

SEQ ID NO: 7315151 - DNA, 22 bp, Homo sapiens
gggccagagcacagaggatgtt

SEQ ID NO: 7315152 - DNA, 22 bp, Homo sapiens
gggctgacaccacccaggcgca

SEQ ID NO: 7315153 - DNA, 22 bp, Homo sapiens
gggctgacgaaggccatgtgtg

SEQ ID NO: 7315154 - DNA, 22 bp, Homo sapiens
cagagcctccctcctctgccat

SEQ ID NO: 7315155 - DNA, 22 bp, Homo sapiens
cagagcctctcagccccttggg

SEQ ID NO: 7315156 - DNA, 22 bp, Homo sapiens
cagagctgggcatggtgaaagg

SEQ ID NO: 7315157 - DNA, 22 bp, Homo sapiens
gggctgaggggtatctcatggg

SEQ ID NO: 7315158 - DNA, 18 bp, Homo sapiens
gtctgtgtggcttgggga

SEQ ID NO: 7315159 - DNA, 22 bp, Homo sapiens
gtctgtgtgcacagcgagtgcc

SEQ ID NO: 7315160 - DNA, 18 bp, Homo sapiens
gtctgtgtggcttgggga

SEQ ID NO: 7315161 - DNA, 22 bp, Homo sapiens
gtctgtgtgcacagcgagtgcc

SEQ ID NO: 7315162 - DNA, 22 bp, Homo sapiens
gtctgtgtgcacagagctttgg

SEQ ID NO: 7315163 - DNA, 22 bp, Homo sapiens
gtctgtggtagacaggaaggca

SEQ ID NO: 7315164 - DNA, 22 bp, Homo sapiens
gtctgtgtgcacagagctttgg

SEQ ID NO: 7315165 - DNA, 19 bp, Homo sapiens
gtctgtgtatttgttgctg

SEQ ID NO: 7315166 - DNA, 19 bp, Homo sapiens
gtctgtgtatttgttgctg

SEQ ID NO: 7315167 - DNA, 19 bp, Homo sapiens
gtctgtgtatttgttgctg

SEQ ID NO: 7315168 - DNA, 22 bp, Homo sapiens
gtctgtctctctccagagtgca

SEQ ID NO: 7315169 - DNA, 22 bp, Homo sapiens
gtctgtggcaggggagaagttt

SEQ ID NO: 7315170 - DNA, 22 bp, Homo sapiens
gtctgtgagggcttgatggggt

SEQ ID NO: 7315171 - DNA, 22 bp, Homo sapiens
gtctgtagtcacacaggtgaca

SEQ ID NO: 7315172 - DNA, 22 bp, Homo sapiens
cagccctcaggtcctcagcagc

SEQ ID NO: 7315173 - DNA, 22 bp, Homo sapiens
gtctgtaattattaaagaaagg

SEQ ID NO: 7315174 - DNA, 22 bp, Homo sapiens
cagcccccatggggaggtcaag

SEQ ID NO: 7315175 - DNA, 19 bp, Homo sapiens
gtcccttcactcctgctgg

SEQ ID NO: 7315176 - DNA, 22 bp, Homo sapiens
gtccctgggtctaaggcagtaa

SEQ ID NO: 7315177 - DNA, 22 bp, Homo sapiens
gtcagcatagttcacacacagt

SEQ ID NO: 7315178 - DNA, 22 bp, Homo sapiens
gtcagctaatagggtgtgtgtc

SEQ ID NO: 7315179 - DNA, 22 bp, Homo sapiens
cagcaggaaagacatctgagca

SEQ ID NO: 7315180 - DNA, 20 bp, Homo sapiens
cagcaggaaaagtgcctcag

SEQ ID NO: 7315181 - DNA, 22 bp, Homo sapiens
cagcaccattttcctggtcagc

SEQ ID NO: 7315182 - DNA, 22 bp, Homo sapiens
cagcagctgcctcagctgggga

SEQ ID NO: 7315183 - DNA, 22 bp, Homo sapiens
cagcagctcactcaggtggctc

SEQ ID NO: 7315184 - DNA, 22 bp, Homo sapiens
cagcagctggtgagacacagcc

SEQ ID NO: 7315185 - DNA, 22 bp, Homo sapiens
gtcataatataaaaactgactt

SEQ ID NO: 7315186 - DNA, 22 bp, Homo sapiens
gtcataggtagggggaaggatg

SEQ ID NO: 7315187 - DNA, 22 bp, Homo sapiens
gtcataggcatggatgtgggtt

SEQ ID NO: 7315188 - DNA, 22 bp, Homo sapiens
gtcatatacactgcatgtaatc

SEQ ID NO: 7315189 - DNA, 22 bp, Homo sapiens
gtcataggttcaaaaggcagat

SEQ ID NO: 7315190 - DNA, 22 bp, Homo sapiens
gtcatgtgaataagtgtggggt

SEQ ID NO: 7315191 - DNA, 22 bp, Homo sapiens
gtcattaaaggttttaaatgct

SEQ ID NO: 7315192 - DNA, 20 bp, Homo sapiens
cagcctccactcactcagct

SEQ ID NO: 7315193 - DNA, 22 bp, Homo sapiens
cagcctgactatggctgcaggt

SEQ ID NO: 7315194 - DNA, 22 bp, Homo sapiens
cagccctgcagccatggcctgt

SEQ ID NO: 7315195 - DNA, 22 bp, Homo sapiens
cagccctgctgacactgtctga

SEQ ID NO: 7315196 - DNA, 22 bp, Homo sapiens
cagcctggtccccggctcaccc

SEQ ID NO: 7315197 - DNA, 22 bp, Homo sapiens
cagcctgggctccagagtccct

SEQ ID NO: 7315198 - DNA, 22 bp, Homo sapiens
cagcctgggctccagagtccct

SEQ ID NO: 7315199 - DNA, 22 bp, Homo sapiens
cagccttcaaggcttagctcag

SEQ ID NO: 7315200 - DNA, 22 bp, Homo sapiens
cagcctggattgcagaatgcta

SEQ ID NO: 7315201 - DNA, 22 bp, Homo sapiens
cagctacaaatacttttgtatg

SEQ ID NO: 7315202 - DNA, 22 bp, Homo sapiens
cagctaagttccaggggctttc

SEQ ID NO: 7315203 - DNA, 22 bp, Homo sapiens
cagctaggaaaccagagggcag

SEQ ID NO: 7315204 - DNA, 22 bp, Homo sapiens
gtgcccagtaaatgaaagcttt

SEQ ID NO: 7315205 - DNA, 22 bp, Homo sapiens
gtgcccagtgcaggcccgcagg

SEQ ID NO: 7315206 - DNA, 22 bp, Homo sapiens
gtgcccagttgaggccaggact

SEQ ID NO: 7315207 - DNA, 22 bp, Homo sapiens
gtgctgtgcgctttttctgtat

SEQ ID NO: 7315208 - DNA, 22 bp, Homo sapiens
gtgctgtgcgctttttctgtat

SEQ ID NO: 7315209 - DNA, 18 bp, Homo sapiens
gtgctgtgggcagtggcc

SEQ ID NO: 7315210 - DNA, 18 bp, Homo sapiens
gtgctgtgggcagtggcc

SEQ ID NO: 7315211 - DNA, 22 bp, Homo sapiens
gtgctgtgtgatccatgctggc

SEQ ID NO: 7315212 - DNA, 22 bp, Homo sapiens
gtgctgtgtgatccatgctggc

SEQ ID NO: 7315213 - DNA, 22 bp, Homo sapiens
gtgctgttaaatggggaggagc

SEQ ID NO: 7315214 - DNA, 22 bp, Homo sapiens
gtgctgtgtgatccatgctggc

SEQ ID NO: 7315215 - DNA, 22 bp, Homo sapiens
gtgctgtttgggagaaggttct

SEQ ID NO: 7315216 - DNA, 22 bp, Homo sapiens
cagggacagacagatatatttg

SEQ ID NO: 7315217 - DNA, 20 bp, Homo sapiens
cagggacagcagtgggtttt

SEQ ID NO: 7315218 - DNA, 22 bp, Homo sapiens
tagattcctctacaataaatga

SEQ ID NO: 7315219 - DNA, 18 bp, Homo sapiens
caggctttgattttggag

SEQ ID NO: 7315220 - DNA, 22 bp, Homo sapiens
caggctgccaaggctggggagg

SEQ ID NO: 7315221 - DNA, 22 bp, Homo sapiens
tactttattgtaaatgctgatg

SEQ ID NO: 7315222 - DNA, 22 bp, Homo sapiens
tacatttacagagccttctctg

SEQ ID NO: 7315223 - DNA, 22 bp, Homo sapiens
tacattgttttttcttgccatc

SEQ ID NO: 7315224 - DNA, 22 bp, Homo sapiens
tacattgttttttcttgccatc

SEQ ID NO: 7315225 - DNA, 22 bp, Homo sapiens
tacatttcctgtcagagatata

SEQ ID NO: 7315226 - DNA, 22 bp, Homo sapiens
tacatttataaggcttctctgt

SEQ ID NO: 7315227 - DNA, 22 bp, Homo sapiens
tacatttataaggcttctctgt

SEQ ID NO: 7315228 - DNA, 22 bp, Homo sapiens
tacattgttcatgcatgagaaa

SEQ ID NO: 7315229 - DNA, 22 bp, Homo sapiens
tacattgtgttaaaacagaaga

SEQ ID NO: 7315230 - DNA, 22 bp, Homo sapiens
tacattgtatcaaccctcaact

SEQ ID NO: 7315231 - DNA, 22 bp, Homo sapiens
tacattgtgatgtttcaataca

SEQ ID NO: 7315232 - DNA, 18 bp, Homo sapiens
caggcctcttgatcttcc

SEQ ID NO: 7315233 - DNA, 22 bp, Homo sapiens
tacattgtacttacaaatagtg

SEQ ID NO: 7315234 - DNA, 22 bp, Homo sapiens
tacatgttcaaatttgtctttc

SEQ ID NO: 7315235 - DNA, 22 bp, Homo sapiens
tacatgttcaaatttgtctttc

SEQ ID NO: 7315236 - DNA, 22 bp, Homo sapiens
tacatgtttggtaaatgatggc

SEQ ID NO: 7315237 - DNA, 22 bp, Homo sapiens
caggcccagggagggagaccaa

SEQ ID NO: 7315238 - DNA, 22 bp, Homo sapiens
caggcctctatggtcagctgag

SEQ ID NO: 7315239 - DNA, 22 bp, Homo sapiens
taatatttctaccctgctgcct

SEQ ID NO: 7315240 - DNA, 22 bp, Homo sapiens
taatatttctaccctgctgcct

SEQ ID NO: 7315241 - DNA, 22 bp, Homo sapiens
taatatttctaccctgctgcct

SEQ ID NO: 7315242 - DNA, 22 bp, Homo sapiens
tacaaaaggaagagggatctta

SEQ ID NO: 7315243 - DNA, 22 bp, Homo sapiens
tacaaaagtaattacggttttt

SEQ ID NO: 7315244 - DNA, 22 bp, Homo sapiens
tacaaaacagtgctctggtcct

SEQ ID NO: 7315245 - DNA, 22 bp, Homo sapiens
caggcatttcgcaaaggctgag

SEQ ID NO: 7315246 - DNA, 22 bp, Homo sapiens
caggccagggttgagaagagaa

SEQ ID NO: 7315247 - DNA, 19 bp, Homo sapiens
caggccagtgtcagggggc

SEQ ID NO: 7315248 - DNA, 22 bp, Homo sapiens
caggcccagaggcctcttccca

SEQ ID NO: 7315249 - DNA, 22 bp, Homo sapiens
taagtattggcctatagctaga

SEQ ID NO: 7315250 - DNA, 19 bp, Homo sapiens
taagtatgtactatcttgc

SEQ ID NO: 7315251 - DNA, 22 bp, Homo sapiens
caggcaccaatagggatcgtgg

SEQ ID NO: 7315252 - DNA, 22 bp, Homo sapiens
cagctcagacgcaggtcgagca

SEQ ID NO: 7315253 - DNA, 22 bp, Homo sapiens
gtgcttaagcttctgctttatg

SEQ ID NO: 7315254 - DNA, 22 bp, Homo sapiens
gtgcttaaaacagaaaacattg

SEQ ID NO: 7315255 - DNA, 22 bp, Homo sapiens
gtgcttaaaacagaaaacattg

SEQ ID NO: 7315256 - DNA, 19 bp, Homo sapiens
gtgcttaacattttattgt

SEQ ID NO: 7315257 - DNA, 22 bp, Homo sapiens
caggcacctttgtgcatgggca

SEQ ID NO: 7315258 - DNA, 22 bp, Homo sapiens
caggcagagctgaagatagatg

SEQ ID NO: 7315259 - DNA, 22 bp, Homo sapiens
caggcagagttagagcaactgg

SEQ ID NO: 7315260 - DNA, 22 bp, Homo sapiens
caggcagagttagagcaactgg

SEQ ID NO: 7315261 - DNA, 22 bp, Homo sapiens
caggcaccccaggtgagcactg

SEQ ID NO: 7315262 - DNA, 22 bp, Homo sapiens
caggcacctttgtgcatgggca

SEQ ID NO: 7315263 - DNA, 22 bp, Homo sapiens
caggcaccccaggtgagcactg

SEQ ID NO: 7315264 - DNA, 22 bp, Homo sapiens
caggcagatttgctgccctcca

SEQ ID NO: 7315265 - DNA, 22 bp, Homo sapiens
taatacagaagtgtattaaaat

SEQ ID NO: 7315266 - DNA, 22 bp, Homo sapiens
cagggtagggcaagggaacctg

SEQ ID NO: 7315267 - DNA, 22 bp, Homo sapiens
cagggtagacagtaggtgtctg

SEQ ID NO: 7315268 - DNA, 22 bp, Homo sapiens
caggggtgtttttggccaggag

SEQ ID NO: 7315269 - DNA, 22 bp, Homo sapiens
cagggtcaagagactccagcag

SEQ ID NO: 7315270 - DNA, 22 bp, Homo sapiens
cagggtcccaggagctgctttc

SEQ ID NO: 7315271 - DNA, 22 bp, Homo sapiens
caggggcttaagtgacagaagg

SEQ ID NO: 7315272 - DNA, 22 bp, Homo sapiens
caggggcttttcctctataagg

SEQ ID NO: 7315273 - DNA, 17 bp, Homo sapiens
cagggctgtctgcctag

SEQ ID NO: 7315274 - DNA, 22 bp, Homo sapiens
cagggctggtttgtcgaagaaa

SEQ ID NO: 7315275 - DNA, 22 bp, Homo sapiens
taggcatgtggcatacctatgg

SEQ ID NO: 7315276 - DNA, 22 bp, Homo sapiens
taggcatgcaaataaatgtgca

SEQ ID NO: 7315277 - DNA, 22 bp, Homo sapiens
taggagggccctgaaaatggca

SEQ ID NO: 7315278 - DNA, 22 bp, Homo sapiens
taggcaggtgtgcactgcccac

SEQ ID NO: 7315279 - DNA, 18 bp, Homo sapiens
taggaggatactgagatg

SEQ ID NO: 7315280 - DNA, 22 bp, Homo sapiens
cagggcctcatcctcagagatt

SEQ ID NO: 7315281 - DNA, 22 bp, Homo sapiens
cagggccccagggatgtctgct

SEQ ID NO: 7315282 - DNA, 22 bp, Homo sapiens
cagggcccatggctcaggtagg

SEQ ID NO: 7315283 - DNA, 22 bp, Homo sapiens
cagggcccagtccctgctgtca

SEQ ID NO: 7315284 - DNA, 22 bp, Homo sapiens
cagggagcagcccctagaagta

SEQ ID NO: 7315285 - DNA, 22 bp, Homo sapiens
cagggagcaggctctgtccatc

SEQ ID NO: 7315286 - DNA, 22 bp, Homo sapiens
cagggagcagcatgggcaaagg

SEQ ID NO: 7315287 - DNA, 22 bp, Homo sapiens
cagggagcactgcgagcggcag

SEQ ID NO: 7315288 - DNA, 22 bp, Homo sapiens
tagatttctaacagtgtgcttg

SEQ ID NO: 7315289 - DNA, 22 bp, Homo sapiens
cagggccaggctgatggcctgg

SEQ ID NO: 7315290 - DNA, 22 bp, Homo sapiens
cagggagccccaattccatgcc

SEQ ID NO: 7315291 - DNA, 22 bp, Homo sapiens
cagggagcctccaaagctttca

SEQ ID NO: 7315292 - DNA, 22 bp, Homo sapiens
caggtaagaccgtttaggcagt

SEQ ID NO: 7315293 - DNA, 22 bp, Homo sapiens
caggtaaagcttcaaatcactt

SEQ ID NO: 7315294 - DNA, 22 bp, Homo sapiens
caggtataacgtgcatgttgta

SEQ ID NO: 7315295 - DNA, 22 bp, Homo sapiens
caggtatatgtgcatccataga

SEQ ID NO: 7315296 - DNA, 22 bp, Homo sapiens
caggtaggtatggtgcagtctt

SEQ ID NO: 7315297 - DNA, 22 bp, Homo sapiens
caggtgaatcacttgagtccag

SEQ ID NO: 7315298 - DNA, 22 bp, Homo sapiens
tattatgtaaaggttattgcag

SEQ ID NO: 7315299 - DNA, 22 bp, Homo sapiens
tattagttgcaaaacattgact

SEQ ID NO: 7315300 - DNA, 22 bp, Homo sapiens
caggtggagctgactgagggca

SEQ ID NO: 7315301 - DNA, 22 bp, Homo sapiens
tcaatagataaagctacataaa

SEQ ID NO: 7315302 - DNA, 22 bp, Homo sapiens
tcaaaacactattacctttaat

SEQ ID NO: 7315303 - DNA, 19 bp, Homo sapiens
tcaaaacacaaatggttga

SEQ ID NO: 7315304 - DNA, 22 bp, Homo sapiens
tcaaaacaacactcaggtgtaa

SEQ ID NO: 7315305 - DNA, 22 bp, Homo sapiens
tcaaaacaatcattggatgtgc

SEQ ID NO: 7315306 - DNA, 22 bp, Homo sapiens
cagtcatcagagactcttgatt

SEQ ID NO: 7315307 - DNA, 22 bp, Homo sapiens
cagtcacttacaaaaatataat

SEQ ID NO: 7315308 - DNA, 22 bp, Homo sapiens
tatttgaagattcttctgatgt

SEQ ID NO: 7315309 - DNA, 22 bp, Homo sapiens
tatttgtttctagtggcagcaa

SEQ ID NO: 7315310 - DNA, 22 bp, Homo sapiens
tattttaaagactgccagccta

SEQ ID NO: 7315311 - DNA, 22 bp, Homo sapiens
tattttaaagtgaagggtcttg

SEQ ID NO: 7315312 - DNA, 21 bp, Homo sapiens
cagtattttaagcagtgagtt

SEQ ID NO: 7315313 - DNA, 21 bp, Homo sapiens
cagtattttaagcagtgagtt

SEQ ID NO: 7315314 - DNA, 22 bp, Homo sapiens
cagtatttttaagctgctttgt

SEQ ID NO: 7315315 - DNA, 22 bp, Homo sapiens
cagtattttccttgttaactta

SEQ ID NO: 7315316 - DNA, 21 bp, Homo sapiens
catctcagtgggttggtggat

SEQ ID NO: 7315317 - DNA, 22 bp, Homo sapiens
tcagggattgcaaaattcatcc

SEQ ID NO: 7315318 - DNA, 22 bp, Homo sapiens
catgaaaataacattgttgtga

SEQ ID NO: 7315319 - DNA, 22 bp, Homo sapiens
catgaaatttgaagtacagcaa

SEQ ID NO: 7315320 - DNA, 22 bp, Homo sapiens
catgaacaaatcctgcgagtat

SEQ ID NO: 7315321 - DNA, 22 bp, Homo sapiens
catcttaaaatgtgtcataact

SEQ ID NO: 7315322 - DNA, 22 bp, Homo sapiens
catctgtgccgggtgtttgtca

SEQ ID NO: 7315323 - DNA, 22 bp, Homo sapiens
catctgtcttttgttacaaggc

SEQ ID NO: 7315324 - DNA, 22 bp, Homo sapiens
catgaagatcctgtatgttttt

SEQ ID NO: 7315325 - DNA, 22 bp, Homo sapiens
catgaagatcctgtatgttttt

SEQ ID NO: 7315326 - DNA, 22 bp, Homo sapiens
catgaacatttgtttacatctg

SEQ ID NO: 7315327 - DNA, 22 bp, Homo sapiens
catgaacagattcttcatttct

SEQ ID NO: 7315328 - DNA, 22 bp, Homo sapiens
catgaacattcagaaatacagc

SEQ ID NO: 7315329 - DNA, 22 bp, Homo sapiens
catgaacattcagaaatacagc

SEQ ID NO: 7315330 - DNA, 22 bp, Homo sapiens
catgaacaaattctgtttgagg

SEQ ID NO: 7315331 - DNA, 22 bp, Homo sapiens
catctgatgggaatataagagc

SEQ ID NO: 7315332 - DNA, 22 bp, Homo sapiens
catctgctgttccttggactca

SEQ ID NO: 7315333 - DNA, 22 bp, Homo sapiens
catctgctgttccttggactca

SEQ ID NO: 7315334 - DNA, 22 bp, Homo sapiens
catctgctgtaattaacaagcc

SEQ ID NO: 7315335 - DNA, 22 bp, Homo sapiens
catctgctgacttgacaagtac

SEQ ID NO: 7315336 - DNA, 22 bp, Homo sapiens
catctgctctgtctgccatgtt

SEQ ID NO: 7315337 - DNA, 19 bp, Homo sapiens
catctggatgattctcctg

SEQ ID NO: 7315338 - DNA, 22 bp, Homo sapiens
catctgtcaggcagaacccaga

SEQ ID NO: 7315339 - DNA, 22 bp, Homo sapiens
catgcaggtctggagcttgggg

SEQ ID NO: 7315340 - DNA, 22 bp, Homo sapiens
catgcaggcctatggagcagtg

SEQ ID NO: 7315341 - DNA, 22 bp, Homo sapiens
catgacattttaaaaagaacat

SEQ ID NO: 7315342 - DNA, 22 bp, Homo sapiens
catgacagtcctgaagagaacg

SEQ ID NO: 7315343 - DNA, 22 bp, Homo sapiens
catgacagatgcaaaggattgg

SEQ ID NO: 7315344 - DNA, 22 bp, Homo sapiens
catgacaatatgttctttcatt

SEQ ID NO: 7315345 - DNA, 22 bp, Homo sapiens
catgacacccaggcatagcacc

SEQ ID NO: 7315346 - DNA, 22 bp, Homo sapiens
catgaaggctgccagcaggcat

SEQ ID NO: 7315347 - DNA, 22 bp, Homo sapiens
tccagctggggacatgggcttc

SEQ ID NO: 7315348 - DNA, 22 bp, Homo sapiens
catggcagggctgtgggcaggt

SEQ ID NO: 7315349 - DNA, 22 bp, Homo sapiens
catggcaggaaggacatgcact

SEQ ID NO: 7315350 - DNA, 22 bp, Homo sapiens
catgcatttctaccaaggaata

SEQ ID NO: 7315351 - DNA, 22 bp, Homo sapiens
tcagatatagtcatttaaataa

SEQ ID NO: 7315352 - DNA, 22 bp, Homo sapiens
tcagatatagtcatttaaataa

SEQ ID NO: 7315353 - DNA, 22 bp, Homo sapiens
tcagatatgaattcatatctct

SEQ ID NO: 7315354 - DNA, 22 bp, Homo sapiens
tcagatattcaattaagttaaa

SEQ ID NO: 7315355 - DNA, 22 bp, Homo sapiens
tcagaggatcatgtccctactc

SEQ ID NO: 7315356 - DNA, 22 bp, Homo sapiens
tcagaggagggactcagaccca

SEQ ID NO: 7315357 - DNA, 22 bp, Homo sapiens
cataaaagccacctatttaaag

SEQ ID NO: 7315358 - DNA, 22 bp, Homo sapiens
cagttttctaaagtctctttaa

SEQ ID NO: 7315359 - DNA, 22 bp, Homo sapiens
tcagatgagtgctttcagctgc

SEQ ID NO: 7315360 - DNA, 22 bp, Homo sapiens
cagtttgtcttgattcagaaca

SEQ ID NO: 7315361 - DNA, 22 bp, Homo sapiens
tcagatcatggatctattactt

SEQ ID NO: 7315362 - DNA, 22 bp, Homo sapiens
tcagatcacaaaagtttctatt

SEQ ID NO: 7315363 - DNA, 22 bp, Homo sapiens
tcagatattctctaagaacaat

SEQ ID NO: 7315364 - DNA, 22 bp, Homo sapiens
cagttgcctactacatggcagg

SEQ ID NO: 7315365 - DNA, 22 bp, Homo sapiens
cagttctggtttgcagatatat

SEQ ID NO: 7315366 - DNA, 22 bp, Homo sapiens
cagttctggagtttcattcttt

SEQ ID NO: 7315367 - DNA, 22 bp, Homo sapiens
cagttactgtatgtcaaagact

SEQ ID NO: 7315368 - DNA, 22 bp, Homo sapiens
tcaatcattcttgccatttatt

SEQ ID NO: 7315369 - DNA, 22 bp, Homo sapiens
tcaggcccttctcccaggactc

SEQ ID NO: 7315370 - DNA, 22 bp, Homo sapiens
catagaaacttgcagcaagcac

SEQ ID NO: 7315371 - DNA, 22 bp, Homo sapiens
cataattttccatggtttgcta

SEQ ID NO: 7315372 - DNA, 18 bp, Homo sapiens
cataattttctttcttta

SEQ ID NO: 7315373 - DNA, 22 bp, Homo sapiens
tcaggcagagttaatttgctcc

SEQ ID NO: 7315374 - DNA, 22 bp, Homo sapiens
cataatgtatgcattttccagc

SEQ ID NO: 7315375 - DNA, 22 bp, Homo sapiens
cataatatctccgattacttgc

SEQ ID NO: 7315376 - DNA, 22 bp, Homo sapiens
cataatatctccgattacttgc

SEQ ID NO: 7315377 - DNA, 22 bp, Homo sapiens
tcctgggcttaagtgatcctcc

SEQ ID NO: 7315378 - DNA, 22 bp, Homo sapiens
tcctggctccagcagctcttcc

SEQ ID NO: 7315379 - DNA, 22 bp, Homo sapiens
tcctggcaggtcagcaggagca

SEQ ID NO: 7315380 - DNA, 22 bp, Homo sapiens
tcctggcagggtggcagcgggt

SEQ ID NO: 7315381 - DNA, 22 bp, Homo sapiens
ccacactgaacctcagtgtctt

SEQ ID NO: 7315382 - DNA, 22 bp, Homo sapiens
ccacagaaaataaagcacgatt

SEQ ID NO: 7315383 - DNA, 22 bp, Homo sapiens
tcctggcagagagcatgaggcc

SEQ ID NO: 7315384 - DNA, 22 bp, Homo sapiens
ccaaggatctggttctttttac

SEQ ID NO: 7315385 - DNA, 20 bp, Homo sapiens
ccaaggattggcaagcagca

SEQ ID NO: 7315386 - DNA, 22 bp, Homo sapiens
ccaaggaggccccaggtcagct

SEQ ID NO: 7315387 - DNA, 22 bp, Homo sapiens
ccaaggatccagcccttcactc

SEQ ID NO: 7315388 - DNA, 22 bp, Homo sapiens
ccaaggccacaaacagcctggc

SEQ ID NO: 7315389 - DNA, 22 bp, Homo sapiens
ccacttaagagaacagctatag

SEQ ID NO: 7315390 - DNA, 22 bp, Homo sapiens
tctaagacactgtactttcagt

SEQ ID NO: 7315391 - DNA, 22 bp, Homo sapiens
ccactgtaagtttgaaaataac

SEQ ID NO: 7315392 - DNA, 22 bp, Homo sapiens
tctaatctacaaaaggaaattc

SEQ ID NO: 7315393 - DNA, 19 bp, Homo sapiens
tctaatatctacttccctg

SEQ ID NO: 7315394 - DNA, 22 bp, Homo sapiens
ccagacagttccttgaggttca

SEQ ID NO: 7315395 - DNA, 22 bp, Homo sapiens
tcctgggcttcacagactctgt

SEQ ID NO: 7315396 - DNA, 22 bp, Homo sapiens
tcctgggcttgctcctccagct

SEQ ID NO: 7315397 - DNA, 22 bp, Homo sapiens
tccttcccaggtgtcgccgcct

SEQ ID NO: 7315398 - DNA, 22 bp, Homo sapiens
tccttaaaggactagaagtcaa

SEQ ID NO: 7315399 - DNA, 22 bp, Homo sapiens
tccttcctgcaggccaagtcct

SEQ ID NO: 7315400 - DNA, 22 bp, Homo sapiens
tcctttatgtgagttgtttccc

SEQ ID NO: 7315401 - DNA, 22 bp, Homo sapiens
tccttgtaaaggagctctaaca

SEQ ID NO: 7315402 - DNA, 19 bp, Homo sapiens
tccttgtgactgtgtgaaa

SEQ ID NO: 7315403 - DNA, 22 bp, Homo sapiens
cattgttgtgagatcaagcagt

SEQ ID NO: 7315404 - DNA, 22 bp, Homo sapiens
cattgttgttaaacatagtaat

SEQ ID NO: 7315405 - DNA, 22 bp, Homo sapiens
cattgttaattggtatcttaca

SEQ ID NO: 7315406 - DNA, 22 bp, Homo sapiens
cattgtgctttcattcaatata

SEQ ID NO: 7315407 - DNA, 22 bp, Homo sapiens
tcccactcccaggcaggcctct

SEQ ID NO: 7315408 - DNA, 22 bp, Homo sapiens
cattgtgcagggataatgcagc

SEQ ID NO: 7315409 - DNA, 22 bp, Homo sapiens
cattgtccctcaatgtctatga

SEQ ID NO: 7315410 - DNA, 22 bp, Homo sapiens
cattgtccctcaatgtctatga

SEQ ID NO: 7315411 - DNA, 22 bp, Homo sapiens
cattgtcctttggctttgcaaa

SEQ ID NO: 7315412 - DNA, 22 bp, Homo sapiens
cattgtattgaggatacttaag

SEQ ID NO: 7315413 - DNA, 22 bp, Homo sapiens
tccctcctggccgtcaccgctg

SEQ ID NO: 7315414 - DNA, 22 bp, Homo sapiens
tccctctcttgggcgtggctca

SEQ ID NO: 7315415 - DNA, 22 bp, Homo sapiens
tccctctctggctggggtgcgg

SEQ ID NO: 7315416 - DNA, 22 bp, Homo sapiens
tccctctctagcctgttcagta

SEQ ID NO: 7315417 - DNA, 22 bp, Homo sapiens
tccctctccctattgcctggag

SEQ ID NO: 7315418 - DNA, 22 bp, Homo sapiens
catttattgagtggccacagtg

SEQ ID NO: 7315419 - DNA, 22 bp, Homo sapiens
cattacatggtccaggatatat

SEQ ID NO: 7315420 - DNA, 22 bp, Homo sapiens
cattagcagtcattactgtgct

SEQ ID NO: 7315421 - DNA, 22 bp, Homo sapiens
cattcttacacaatattttaat

SEQ ID NO: 7315422 - DNA, 22 bp, Homo sapiens
cattctgaccctatgatttaag

SEQ ID NO: 7315423 - DNA, 22 bp, Homo sapiens
cattctgcgatcctcaagcaca

SEQ ID NO: 7315424 - DNA, 22 bp, Homo sapiens
cattctgcgatcctcaagcaca

SEQ ID NO: 7315425 - DNA, 22 bp, Homo sapiens
tcccacattaccctgactgaca

SEQ ID NO: 7315426 - DNA, 22 bp, Homo sapiens
tccaggagaggcctgaccaggt

SEQ ID NO: 7315427 - DNA, 22 bp, Homo sapiens
catgggaggcctgctgctggtg

SEQ ID NO: 7315428 - DNA, 22 bp, Homo sapiens
tccattttagagatgaagaaac

SEQ ID NO: 7315429 - DNA, 22 bp, Homo sapiens
catgggccatggtgaagccagg

SEQ ID NO: 7315430 - DNA, 23 bp, Homo sapiens
ccctgcagtcagggtgagatggt

SEQ ID NO: 7315431 - DNA, 22 bp, Homo sapiens
tggagcaggccggaagtggctt

SEQ ID NO: 7315432 - DNA, 22 bp, Homo sapiens
ccctgcagccttgcatgccttc

SEQ ID NO: 7315433 - DNA, 19 bp, Homo sapiens
tggagcagggcccttgttt

SEQ ID NO: 7315434 - DNA, 22 bp, Homo sapiens
cctagccccagatatctcacac

SEQ ID NO: 7315435 - DNA, 22 bp, Homo sapiens
cctcagttttctcatctgtaaa

SEQ ID NO: 7315436 - DNA, 21 bp, Homo sapiens
cctcatcaaactttcacttgc

SEQ ID NO: 7315437 - DNA, 22 bp, Homo sapiens
cctcatctgtcatcctagggaa

SEQ ID NO: 7315438 - DNA, 19 bp, Homo sapiens
cctcatcttggtgtgtgca

SEQ ID NO: 7315439 - DNA, 22 bp, Homo sapiens
cctccaagctggtcctctgtgt

SEQ ID NO: 7315440 - DNA, 22 bp, Homo sapiens
tggcctgggcctgccggtgcaa

SEQ ID NO: 7315441 - DNA, 22 bp, Homo sapiens
tggctctgagacacaggctctc

SEQ ID NO: 7315442 - DNA, 22 bp, Homo sapiens
tggctctggtaacattgggtag

SEQ ID NO: 7315443 - DNA, 21 bp, Homo sapiens
tggctctgggtaggagagtgc

SEQ ID NO: 7315444 - DNA, 22 bp, Homo sapiens
tggcccagcactccaagtaggg

SEQ ID NO: 7315445 - DNA, 22 bp, Homo sapiens
tgggaaggataccttggaacat

SEQ ID NO: 7315446 - DNA, 22 bp, Homo sapiens
tgggaaggataccttggaacat

SEQ ID NO: 7315447 - DNA, 22 bp, Homo sapiens
cctcttcctcaccatctacaac

SEQ ID NO: 7315448 - DNA, 19 bp, Homo sapiens
cctctgtgggagtcagtga

SEQ ID NO: 7315449 - DNA, 22 bp, Homo sapiens
tgggaaggaactgcctttagct

SEQ ID NO: 7315450 - DNA, 22 bp, Homo sapiens
cctctgagtagactggacatga

SEQ ID NO: 7315451 - DNA, 20 bp, Homo sapiens
cctctgcctttctagtctga

SEQ ID NO: 7315452 - DNA, 21 bp, Homo sapiens
cctctgctcgggcatgcgttt

SEQ ID NO: 7315453 - DNA, 22 bp, Homo sapiens
tggctctgtcactgtgagctat

SEQ ID NO: 7315454 - DNA, 19 bp, Homo sapiens
tggctctgtcgaaggcaca

SEQ ID NO: 7315455 - DNA, 22 bp, Homo sapiens
tggctgggagctggaactgggc

SEQ ID NO: 7315456 - DNA, 17 bp, Homo sapiens
cctcttcctctcagctg

SEQ ID NO: 7315457 - DNA, 19 bp, Homo sapiens
tgggagtggggaaggtcct

SEQ ID NO: 7315458 - DNA, 22 bp, Homo sapiens
tgggagtgttcttggcttgctt

SEQ ID NO: 7315459 - DNA, 22 bp, Homo sapiens
tgggccagtttctcattgaaat

SEQ ID NO: 7315460 - DNA, 22 bp, Homo sapiens
cctgagcctgagtggtgcaggg

SEQ ID NO: 7315461 - DNA, 23 bp, Homo sapiens
tgggagtgttgggatctctgctc

SEQ ID NO: 7315462 - DNA, 22 bp, Homo sapiens
tgggcccaggtcctgggagaag

SEQ ID NO: 7315463 - DNA, 22 bp, Homo sapiens
ccctgaacaaagcccaggctct

SEQ ID NO: 7315464 - DNA, 18 bp, Homo sapiens
ccctctcctgctagtggg

SEQ ID NO: 7315465 - DNA, 22 bp, Homo sapiens
ccctctcctggctgcatggagc

SEQ ID NO: 7315466 - DNA, 22 bp, Homo sapiens
ccctgagaggttgagtgtctgc

SEQ ID NO: 7315467 - DNA, 22 bp, Homo sapiens
tggagcagaaatggcctcttgt

SEQ ID NO: 7315468 - DNA, 22 bp, Homo sapiens
tggaatgtcagctacaagaggg

SEQ ID NO: 7315469 - DNA, 22 bp, Homo sapiens
tggaatggaaacaaactgagga

SEQ ID NO: 7315470 - DNA, 22 bp, Homo sapiens
tggaatgtggtatcagtagaaa

SEQ ID NO: 7315471 - DNA, 22 bp, Homo sapiens
ccctcctggaggcggatgccca

SEQ ID NO: 7315472 - DNA, 22 bp, Homo sapiens
ccctcctggaggcggatgccca

SEQ ID NO: 7315473 - DNA, 22 bp, Homo sapiens
ccctcctgtgcctgaggccagc

SEQ ID NO: 7315474 - DNA, 22 bp, Homo sapiens
tgctgtgtggatgtgaagaatc

SEQ ID NO: 7315475 - DNA, 22 bp, Homo sapiens
tggaagggagctggaatttgga

SEQ ID NO: 7315476 - DNA, 22 bp, Homo sapiens
tgctgtgtaaaaggtgattgaa

SEQ ID NO: 7315477 - DNA, 22 bp, Homo sapiens
tgctgtgtctttctgtgaaaag

SEQ ID NO: 7315478 - DNA, 22 bp, Homo sapiens
tgctgtgtaaaaggtgattgaa

SEQ ID NO: 7315479 - DNA, 22 bp, Homo sapiens
tgctgtgtaaaaggtgattgaa

SEQ ID NO: 7315480 - DNA, 22 bp, Homo sapiens
tgctgtgggatatatgttcaaa

SEQ ID NO: 7315481 - DNA, 22 bp, Homo sapiens
tgctgtgctccattgtcttcac

SEQ ID NO: 7315482 - DNA, 22 bp, Homo sapiens
tgctggcccatgaagacgcagt

SEQ ID NO: 7315483 - DNA, 22 bp, Homo sapiens
tgctggcccatgaagacgcagt

SEQ ID NO: 7315484 - DNA, 22 bp, Homo sapiens
tgctggccgtgagctctcggga

SEQ ID NO: 7315485 - DNA, 22 bp, Homo sapiens
tgctggccggccaggtgctgag

SEQ ID NO: 7315486 - DNA, 23 bp, Homo sapiens
cccctctggtggctcagctcctg

SEQ ID NO: 7315487 - DNA, 22 bp, Homo sapiens
cccgagtgtctactcactccca

SEQ ID NO: 7315488 - DNA, 22 bp, Homo sapiens
cccgcaggggcagccctcatcc

SEQ ID NO: 7315489 - DNA, 22 bp, Homo sapiens
ccccaccaccaaggctcagttt

SEQ ID NO: 7315490 - DNA, 22 bp, Homo sapiens
tgctggccaatggcagaggcgg

SEQ ID NO: 7315491 - DNA, 22 bp, Homo sapiens
tgctggccaatggcagaggcgg

SEQ ID NO: 7315492 - DNA, 22 bp, Homo sapiens
ccccaccaccaaggctcagttt

SEQ ID NO: 7315493 - DNA, 22 bp, Homo sapiens
ccccaaggtgctcactgtctgg

SEQ ID NO: 7315494 - DNA, 22 bp, Homo sapiens
cccaggtcgtcagcagtgtggt

SEQ ID NO: 7315495 - DNA, 22 bp, Homo sapiens
cccaggtcgtcagcagtgtggt

SEQ ID NO: 7315496 - DNA, 22 bp, Homo sapiens
cccaggtctatgccagctctga

SEQ ID NO: 7315497 - DNA, 22 bp, Homo sapiens
tgcctgtgtggggtctgccgcc

SEQ ID NO: 7315498 - DNA, 22 bp, Homo sapiens
tgcctgtgtggggtctgccgcc

SEQ ID NO: 7315499 - DNA, 22 bp, Homo sapiens
cccagggacagctaggtggggc

SEQ ID NO: 7315500 - DNA, 22 bp, Homo sapiens
cccagggtagctgagctggcag

SEQ ID NO: 7315501 - DNA, 22 bp, Homo sapiens
cccagggtggatgcaagcagca

SEQ ID NO: 7315502 - DNA, 22 bp, Homo sapiens
tgccctggttacactggagtcc

SEQ ID NO: 7315503 - DNA, 22 bp, Homo sapiens
tgccctggtagacacagactgt

SEQ ID NO: 7315504 - DNA, 22 bp, Homo sapiens
tgccctggtatcatgtggaatt

SEQ ID NO: 7315505 - DNA, 22 bp, Homo sapiens
cccaggctggaattccaggcct

SEQ ID NO: 7315506 - DNA, 22 bp, Homo sapiens
cccaggctggagtgcaatggca

SEQ ID NO: 7315507 - DNA, 22 bp, Homo sapiens
cccaggctggagggcagtgtca

SEQ ID NO: 7315508 - DNA, 22 bp, Homo sapiens
cccaggctggagtgcaatggtg

SEQ ID NO: 7315509 - DNA, 22 bp, Homo sapiens
cccaggctggagtgcagtggcg

SEQ ID NO: 7315510 - DNA, 22 bp, Homo sapiens
cccaggctggggctcctccagc

SEQ ID NO: 7315511 - DNA, 22 bp, Homo sapiens
cccaggctggatttcggtggca

SEQ ID NO: 7315512 - DNA, 22 bp, Homo sapiens
cccaggctggagtgtaatggtg

SEQ ID NO: 7315513 - DNA, 22 bp, Homo sapiens
cccaggctgggaacgattctag

SEQ ID NO: 7315514 - DNA, 22 bp, Homo sapiens
cccaggctggcactgctgaagt

SEQ ID NO: 7315515 - DNA, 22 bp, Homo sapiens
cccaggctggcctccgcagtgc

SEQ ID NO: 7315516 - DNA, 22 bp, Homo sapiens
cccaggagagaggccagttggc

SEQ ID NO: 7315517 - DNA, 22 bp, Homo sapiens
tgccaggagtgtagagtggttt

SEQ ID NO: 7315518 - DNA, 22 bp, Homo sapiens
cccaggagacctagatctgttt

SEQ ID NO: 7315519 - DNA, 22 bp, Homo sapiens
cccaggagacctagatctgttt

SEQ ID NO: 7315520 - DNA, 22 bp, Homo sapiens
cccaggagagagacttgaatct

SEQ ID NO: 7315521 - DNA, 22 bp, Homo sapiens
tgccaggacaaggaccacatgg

SEQ ID NO: 7315522 - DNA, 22 bp, Homo sapiens
tgccaggaggcggcttgggaaa

SEQ ID NO: 7315523 - DNA, 22 bp, Homo sapiens
tgcacagagcaggcaccagcgg

SEQ ID NO: 7315524 - DNA, 22 bp, Homo sapiens
tgcccagcccctatccctggga

SEQ ID NO: 7315525 - DNA, 23 bp, Homo sapiens
cccaggctacaaattatgctctg

SEQ ID NO: 7315526 - DNA, 22 bp, Homo sapiens
tgcccagctgtcaaagtagata

SEQ ID NO: 7315527 - DNA, 22 bp, Homo sapiens
tgcccagcctaaacttggcaag

SEQ ID NO: 7315528 - DNA, 21 bp, Homo sapiens
tgccctggggctcttccctca

SEQ ID NO: 7315529 - DNA, 21 bp, Homo sapiens
tgccctggggctcttccctca

SEQ ID NO: 7315530 - DNA, 22 bp, Homo sapiens
cccaggctcccaggtgggacaa

SEQ ID NO: 7315531 - DNA, 22 bp, Homo sapiens
cccaggctcagactggcttgtt

SEQ ID NO: 7315532 - DNA, 22 bp, Homo sapiens
cccaggctcccaggtgggacaa

SEQ ID NO: 7315533 - DNA, 22 bp, Homo sapiens
cccaggctcactgtccgcttcc

SEQ ID NO: 7315534 - DNA, 22 bp, Homo sapiens
cccaggctagtatgatatcagt

SEQ ID NO: 7315535 - DNA, 22 bp, Homo sapiens
cccaggctagaaaggccaacaa

SEQ ID NO: 7315536 - DNA, 19 bp, Homo sapiens
cccaggctacatggagagg

SEQ ID NO: 7315537 - DNA, 22 bp, Homo sapiens
tgagaaggcctgtgtgacaggg

SEQ ID NO: 7315538 - DNA, 22 bp, Homo sapiens
ccaggggctgcagatccatggt

SEQ ID NO: 7315539 - DNA, 22 bp, Homo sapiens
ccagggtcacaaataactgcag

SEQ ID NO: 7315540 - DNA, 21 bp, Homo sapiens
ccagggtccagctgccatggt

SEQ ID NO: 7315541 - DNA, 22 bp, Homo sapiens
tgagaccatttgacatacagtg

SEQ ID NO: 7315542 - DNA, 22 bp, Homo sapiens
ccaggtgtccccgtcactgcag

SEQ ID NO: 7315543 - DNA, 22 bp, Homo sapiens
ccaggtgtgtacagaacagcac

SEQ ID NO: 7315544 - DNA, 22 bp, Homo sapiens
ccaggtgtggccacatggctgg

SEQ ID NO: 7315545 - DNA, 22 bp, Homo sapiens
ccaggtgtgccagcagggactg

SEQ ID NO: 7315546 - DNA, 22 bp, Homo sapiens
tgaatgcaagaaggaacatgaa

SEQ ID NO: 7315547 - DNA, 22 bp, Homo sapiens
tgaatgcaagtcacacatttct

SEQ ID NO: 7315548 - DNA, 22 bp, Homo sapiens
tgaatgcaagtcacacatttct

SEQ ID NO: 7315549 - DNA, 22 bp, Homo sapiens
tgacaactctagttaatgaatt

SEQ ID NO: 7315550 - DNA, 22 bp, Homo sapiens
tgaagttgttaaggttgccatt

SEQ ID NO: 7315551 - DNA, 20 bp, Homo sapiens
ccaggctggcaaatgggggc

SEQ ID NO: 7315552 - DNA, 22 bp, Homo sapiens
tgagaaaaggttgagatgataa

SEQ ID NO: 7315553 - DNA, 22 bp, Homo sapiens
tgagaaaagtacatggagaagc

SEQ ID NO: 7315554 - DNA, 22 bp, Homo sapiens
tgacatcattagtaacatagct

SEQ ID NO: 7315555 - DNA, 22 bp, Homo sapiens
tgacatcacgtcctttcagaga

SEQ ID NO: 7315556 - DNA, 22 bp, Homo sapiens
tgacagtgcgggtacatcatag

SEQ ID NO: 7315557 - DNA, 22 bp, Homo sapiens
tgacagttaaggtatacattca

SEQ ID NO: 7315558 - DNA, 22 bp, Homo sapiens
tgacagtgtttgcacttcaggt

SEQ ID NO: 7315559 - DNA, 22 bp, Homo sapiens
tgacagttgagcatgtaagaga

SEQ ID NO: 7315560 - DNA, 22 bp, Homo sapiens
tgacagtttagtgtaatagtta

SEQ ID NO: 7315561 - DNA, 22 bp, Homo sapiens
tgacaatagcgatttatcttgc

SEQ ID NO: 7315562 - DNA, 20 bp, Homo sapiens
tgagggctaaccagactctg

SEQ ID NO: 7315563 - DNA, 22 bp, Homo sapiens
tgagggccgaggagctgtgggt

SEQ ID NO: 7315564 - DNA, 22 bp, Homo sapiens
tgagggcagagcactggggagc

SEQ ID NO: 7315565 - DNA, 22 bp, Homo sapiens
tgagggctccccgctgctgtgt

SEQ ID NO: 7315566 - DNA, 22 bp, Homo sapiens
tgagggctgcttccagagctag

SEQ ID NO: 7315567 - DNA, 22 bp, Homo sapiens
tgagggctgcttccagagctag

SEQ ID NO: 7315568 - DNA, 22 bp, Homo sapiens
ccagtctcttccctcctgccag

SEQ ID NO: 7315569 - DNA, 22 bp, Homo sapiens
tgaggcagcattcttcaagaca

SEQ ID NO: 7315570 - DNA, 22 bp, Homo sapiens
ccatggcctgaaggagtgcatc

SEQ ID NO: 7315571 - DNA, 22 bp, Homo sapiens
ccatgccttcctttccctggaa

SEQ ID NO: 7315572 - DNA, 19 bp, Homo sapiens
ccattgtaaagaaaaatgt

SEQ ID NO: 7315573 - DNA, 22 bp, Homo sapiens
ccatgttgtatctcttatcggc

SEQ ID NO: 7315574 - DNA, 22 bp, Homo sapiens
ccatgttgtcaaacttagagta

SEQ ID NO: 7315575 - DNA, 23 bp, Homo sapiens
tgattttaaaaagtaagttatca

SEQ ID NO: 7315576 - DNA, 22 bp, Homo sapiens
tgatttgtttagtgccaagttt

SEQ ID NO: 7315577 - DNA, 22 bp, Homo sapiens
ccattgtaaagagtatactttg

SEQ ID NO: 7315578 - DNA, 22 bp, Homo sapiens
tgatttcttccttgtcattaga

SEQ ID NO: 7315579 - DNA, 22 bp, Homo sapiens
tgatttctcttggcaatatgtt

SEQ ID NO: 7315580 - DNA, 22 bp, Homo sapiens
cccagaatgattcagcgacagt

SEQ ID NO: 7315581 - DNA, 22 bp, Homo sapiens
tgcacagaataatatatgttct

SEQ ID NO: 7315582 - DNA, 22 bp, Homo sapiens
tgcacagaataatatatgttct

SEQ ID NO: 7315583 - DNA, 22 bp, Homo sapiens
tgcacacatgtatgtatatgtg

SEQ ID NO: 7315584 - DNA, 22 bp, Homo sapiens
tgcacacatgtatgtatatgtg

SEQ ID NO: 7315585 - DNA, 22 bp, Homo sapiens
cccactgtttccctgaggctct

SEQ ID NO: 7315586 - DNA, 22 bp, Homo sapiens
cccactgtgttgcagtctagtg

SEQ ID NO: 7315587 - DNA, 22 bp, Homo sapiens
cccactgtgttgctgttaatct

SEQ ID NO: 7315588 - DNA, 22 bp, Homo sapiens
cccactgttgcctcaaatatca

SEQ ID NO: 7315589 - DNA, 22 bp, Homo sapiens
cccactgtggaagaaaggggag

SEQ ID NO: 7315590 - DNA, 22 bp, Homo sapiens
tgcaaagtcgcaaaattcttct

SEQ ID NO: 7315591 - DNA, 22 bp, Homo sapiens
ccaggaccctgcaaaccctgtt

SEQ ID NO: 7315592 - DNA, 22 bp, Homo sapiens
tctggcctgggcctgccggtgc

SEQ ID NO: 7315593 - DNA, 22 bp, Homo sapiens
tctggcaggggttctgcacttg

SEQ ID NO: 7315594 - DNA, 21 bp, Homo sapiens
tctggcaggaagacggatggg

SEQ ID NO: 7315595 - DNA, 21 bp, Homo sapiens
tctggcagcagtttgttgagt

SEQ ID NO: 7315596 - DNA, 22 bp, Homo sapiens
tctggcaggacatgctgaccat

SEQ ID NO: 7315597 - DNA, 22 bp, Homo sapiens
tctggcaggcaatcggctctgg

SEQ ID NO: 7315598 - DNA, 22 bp, Homo sapiens
ccaggagaataatggcagatta

SEQ ID NO: 7315599 - DNA, 22 bp, Homo sapiens
tctggtgtcagtattctttgaa

SEQ ID NO: 7315600 - DNA, 19 bp, Homo sapiens
tctggttcatttctgctgt

SEQ ID NO: 7315601 - DNA, 22 bp, Homo sapiens
tctgggagcctgaaagtgaatg

SEQ ID NO: 7315602 - DNA, 22 bp, Homo sapiens
tctgggagccatgccttggagt

SEQ ID NO: 7315603 - DNA, 22 bp, Homo sapiens
tctggggatgaggtccagtgat

SEQ ID NO: 7315604 - DNA, 20 bp, Homo sapiens
tctggggatgaggtctagga

SEQ ID NO: 7315605 - DNA, 22 bp, Homo sapiens
tctgggagatccaagcagaact

SEQ ID NO: 7315606 - DNA, 22 bp, Homo sapiens
tctgggagcagatgatggtata

SEQ ID NO: 7315607 - DNA, 22 bp, Homo sapiens
ccagagagagaggtcaatggca

SEQ ID NO: 7315608 - DNA, 22 bp, Homo sapiens
tctgctacaaatacgctgggag

SEQ ID NO: 7315609 - DNA, 22 bp, Homo sapiens
tctgctttcttactaaaaatga

SEQ ID NO: 7315610 - DNA, 22 bp, Homo sapiens
tctgctttagtgcaaagtctta

SEQ ID NO: 7315611 - DNA, 23 bp, Homo sapiens
tctgcttctgtattttttcccat

SEQ ID NO: 7315612 - DNA, 22 bp, Homo sapiens
tctgcttctgtgaaggcagtct

SEQ ID NO: 7315613 - DNA, 22 bp, Homo sapiens
tctgcttctcctacttcatggg

SEQ ID NO: 7315614 - DNA, 22 bp, Homo sapiens
tctgctgtttactgtgtgatat

SEQ ID NO: 7315615 - DNA, 22 bp, Homo sapiens
tctgctgtttactgtgtgatat

SEQ ID NO: 7315616 - DNA, 21 bp, Homo sapiens
tctggaagaaaaaagtattat

SEQ ID NO: 7315617 - DNA, 22 bp, Homo sapiens
ccagctctcttcaagcccactc

SEQ ID NO: 7315618 - DNA, 22 bp, Homo sapiens
tctggaggccatagggaaggat

SEQ ID NO: 7315619 - DNA, 22 bp, Homo sapiens
tctggcagcaagtctgtttctc

SEQ ID NO: 7315620 - DNA, 22 bp, Homo sapiens
ccagctgctgtgaggaccacag

SEQ ID NO: 7315621 - DNA, 22 bp, Homo sapiens
ccagctgctatcatgccatttc

SEQ ID NO: 7315622 - DNA, 22 bp, Homo sapiens
ccaggcccaccttggccactta

SEQ ID NO: 7315623 - DNA, 22 bp, Homo sapiens
ccaggccccagggctggctttc

SEQ ID NO: 7315624 - DNA, 22 bp, Homo sapiens
ccaggcccagggtactgaccaa

SEQ ID NO: 7315625 - DNA, 22 bp, Homo sapiens
ccaggcccagggtactgaccaa

SEQ ID NO: 7315626 - DNA, 22 bp, Homo sapiens
tctttcaatgagcattctttcc

SEQ ID NO: 7315627 - DNA, 22 bp, Homo sapiens
tctttcaatccattcatatgtc

SEQ ID NO: 7315628 - DNA, 22 bp, Homo sapiens
ccaggccccagggctggctttc

SEQ ID NO: 7315629 - DNA, 22 bp, Homo sapiens
tctttgaaagctgttctagagt

SEQ ID NO: 7315630 - DNA, 22 bp, Homo sapiens
tctttgaaacaccctaaccttt

SEQ ID NO: 7315631 - DNA, 22 bp, Homo sapiens
tctttgaaaagggagatagaaa

SEQ ID NO: 7315632 - DNA, 22 bp, Homo sapiens
ccaggcctgcattccctctcag

SEQ ID NO: 7315633 - DNA, 22 bp, Homo sapiens
ccaggctgaatatgttccaggg

SEQ ID NO: 7315634 - DNA, 23 bp, Homo sapiens
ccaggctctttcacctgctattc

SEQ ID NO: 7315635 - DNA, 22 bp, Homo sapiens
ccaggctgagcatgattggagc

SEQ ID NO: 7315636 - DNA, 22 bp, Homo sapiens
tctttggggcatctgggagatt

SEQ ID NO: 7315637 - DNA, 22 bp, Homo sapiens
tctttgggccgacactcgtcaa

SEQ ID NO: 7315638 - DNA, 22 bp, Homo sapiens
tctttgggctaggagtttggat

SEQ ID NO: 7315639 - DNA, 22 bp, Homo sapiens
tctttgggagaaggggtcccag

SEQ ID NO: 7315640 - DNA, 22 bp, Homo sapiens
tctttgggagatgttatttata

SEQ ID NO: 7315641 - DNA, 22 bp, Homo sapiens
ccaggctggagtgcaatggtgc

SEQ ID NO: 7315642 - DNA, 22 bp, Homo sapiens
tcttcctagaaggaagaaatct

SEQ ID NO: 7315643 - DNA, 22 bp, Homo sapiens
tcttcagactgttgttcttttg

SEQ ID NO: 7315644 - DNA, 20 bp, Homo sapiens
tcttcagatgcttttggagt

SEQ ID NO: 7315645 - DNA, 20 bp, Homo sapiens
tcttccaggtacagtctgca

SEQ ID NO: 7315646 - DNA, 22 bp, Homo sapiens
ccaggattggaggctgtggtga

SEQ ID NO: 7315647 - DNA, 22 bp, Homo sapiens
ccaggatggggagcagatagaa

SEQ ID NO: 7315648 - DNA, 22 bp, Homo sapiens
ctgcacaggggatgagggcagt

SEQ ID NO: 7315649 - DNA, 20 bp, Homo sapiens
ctgcaaaatgacattaggaa

SEQ ID NO: 7315650 - DNA, 22 bp, Homo sapiens
ctgcaggggcctcgagcacagg

SEQ ID NO: 7315651 - DNA, 22 bp, Homo sapiens
ctgcaccatccttcatgctctg

SEQ ID NO: 7315652 - DNA, 20 bp, Homo sapiens
ctgcactgaacatgtctgag

SEQ ID NO: 7315653 - DNA, 22 bp, Homo sapiens
ctgcactgtgtaacagataact

SEQ ID NO: 7315654 - DNA, 22 bp, Homo sapiens
ctgacagggtagacagagggca

SEQ ID NO: 7315655 - DNA, 22 bp, Homo sapiens
ctgaccagccctgcccagggaa

SEQ ID NO: 7315656 - DNA, 22 bp, Homo sapiens
ctctttggatgtttatgataag

SEQ ID NO: 7315657 - DNA, 22 bp, Homo sapiens
ctctttggccagaaaatgtttt

SEQ ID NO: 7315658 - DNA, 19 bp, Homo sapiens
ctctttggagatccttgga

SEQ ID NO: 7315659 - DNA, 22 bp, Homo sapiens
ctctttggatagaattacaaag

SEQ ID NO: 7315660 - DNA, 22 bp, Homo sapiens
ctctttggagaagcacgtatta

SEQ ID NO: 7315661 - DNA, 22 bp, Homo sapiens
ctgactccctgattctgggttt

SEQ ID NO: 7315662 - DNA, 22 bp, Homo sapiens
ctgactcccaagctagtgctct

SEQ ID NO: 7315663 - DNA, 22 bp, Homo sapiens
ctgactccaaagtttgggctct

SEQ ID NO: 7315664 - DNA, 22 bp, Homo sapiens
ctgacctgtaactgtaagagac

SEQ ID NO: 7315665 - DNA, 22 bp, Homo sapiens
ctgagccataagggaggctggg

SEQ ID NO: 7315666 - DNA, 22 bp, Homo sapiens
tttgggaaatagtagaaaatgt

SEQ ID NO: 7315667 - DNA, 22 bp, Homo sapiens
tttgggaatagcagggactgag

SEQ ID NO: 7315668 - DNA, 22 bp, Homo sapiens
tttgggaacttggttcagggaa

SEQ ID NO: 7315669 - DNA, 22 bp, Homo sapiens
tttgggaactctatcatggaaa

SEQ ID NO: 7315670 - DNA, 22 bp, Homo sapiens
tttgccatgtaggttaatcatt

SEQ ID NO: 7315671 - DNA, 22 bp, Homo sapiens
tttgctaaaagtgatgaagaca

SEQ ID NO: 7315672 - DNA, 22 bp, Homo sapiens
tttgctaaataagtgattaagt

SEQ ID NO: 7315673 - DNA, 22 bp, Homo sapiens
ctctgctttcctcttacacact

SEQ ID NO: 7315674 - DNA, 20 bp, Homo sapiens
ctctgctttccacctttcag

SEQ ID NO: 7315675 - DNA, 22 bp, Homo sapiens
tttgctctgctgttgccaggtg

SEQ ID NO: 7315676 - DNA, 22 bp, Homo sapiens
ctctgctttttaaaaggagtcc

SEQ ID NO: 7315677 - DNA, 22 bp, Homo sapiens
ctctgcccgcggatgccacgtc

SEQ ID NO: 7315678 - DNA, 22 bp, Homo sapiens
ctctgcccgtgcctttcccagt

SEQ ID NO: 7315679 - DNA, 19 bp, Homo sapiens
ctctgccctacagaaagct

SEQ ID NO: 7315680 - DNA, 22 bp, Homo sapiens
ctctgccctcgcacatctgcca

SEQ ID NO: 7315681 - DNA, 22 bp, Homo sapiens
ctctgccctcacttggggcctg

SEQ ID NO: 7315682 - DNA, 20 bp, Homo sapiens
ctctgcccccagactgacag

SEQ ID NO: 7315683 - DNA, 22 bp, Homo sapiens
ctctgcccccagctggtgcttg

SEQ ID NO: 7315684 - DNA, 22 bp, Homo sapiens
ctctgcccagtgcccacaggag

SEQ ID NO: 7315685 - DNA, 22 bp, Homo sapiens
tttgcaaataaataagtgctcg

SEQ ID NO: 7315686 - DNA, 22 bp, Homo sapiens
tttgcaaagttatttagactca

SEQ ID NO: 7315687 - DNA, 22 bp, Homo sapiens
tttgccacattctatacatttg

SEQ ID NO: 7315688 - DNA, 21 bp, Homo sapiens
ctctgcccagggcctcctgcc

SEQ ID NO: 7315689 - DNA, 22 bp, Homo sapiens
ctctgcccacgtcttgcccaga

SEQ ID NO: 7315690 - DNA, 22 bp, Homo sapiens
tttccttgttattatttgtcct

SEQ ID NO: 7315691 - DNA, 22 bp, Homo sapiens
tttcctttatgacatcaccact

SEQ ID NO: 7315692 - DNA, 22 bp, Homo sapiens
tttccttgttcatttgccctat

SEQ ID NO: 7315693 - DNA, 22 bp, Homo sapiens
tttcctttccaaaattctgcct

SEQ ID NO: 7315694 - DNA, 22 bp, Homo sapiens
ctctgccaccatgcttcctgac

SEQ ID NO: 7315695 - DNA, 22 bp, Homo sapiens
ttttagatagtttaactgcact

SEQ ID NO: 7315696 - DNA, 22 bp, Homo sapiens
ttttagatagtttaactgcact

SEQ ID NO: 7315697 - DNA, 22 bp, Homo sapiens
ttttagattataagtctaattc

SEQ ID NO: 7315698 - DNA, 22 bp, Homo sapiens
ttttagattgggaaatgtaaag

SEQ ID NO: 7315699 - DNA, 22 bp, Homo sapiens
ttttagattgggaaatgtaaag

SEQ ID NO: 7315700 - DNA, 20 bp, Homo sapiens
ttttagcacttgttatggtg

SEQ ID NO: 7315701 - DNA, 22 bp, Homo sapiens
ttttaagtgcaatctgaatgcg

SEQ ID NO: 7315702 - DNA, 22 bp, Homo sapiens
ttttaatactgctattgtagga

SEQ ID NO: 7315703 - DNA, 22 bp, Homo sapiens
ttttaatactgctattgtagga

SEQ ID NO: 7315704 - DNA, 22 bp, Homo sapiens
tttgtacacaggtcattcaggg

SEQ ID NO: 7315705 - DNA, 22 bp, Homo sapiens
tttgtacacaggtcattcaggg

SEQ ID NO: 7315706 - DNA, 22 bp, Homo sapiens
tttgtacactgtctactatgaa

SEQ ID NO: 7315707 - DNA, 22 bp, Homo sapiens
tttgtacagtgatgttgtatgc

SEQ ID NO: 7315708 - DNA, 23 bp, Homo sapiens
tttgtacagaattttgccttcag

SEQ ID NO: 7315709 - DNA, 22 bp, Homo sapiens
tttgtacatataaatcttgtat

SEQ ID NO: 7315710 - DNA, 22 bp, Homo sapiens
tttgtacatataaatcttgtat

SEQ ID NO: 7315711 - DNA, 22 bp, Homo sapiens
tttgtacatcctaattctgagt

SEQ ID NO: 7315712 - DNA, 22 bp, Homo sapiens
tttgtacatatttgtggggcac

SEQ ID NO: 7315713 - DNA, 22 bp, Homo sapiens
tttgtacatatataaaatctgt

SEQ ID NO: 7315714 - DNA, 22 bp, Homo sapiens
tttgttctgaaaactcaagtcc

SEQ ID NO: 7315715 - DNA, 22 bp, Homo sapiens
ctcttcttggcccccatgaggg

SEQ ID NO: 7315716 - DNA, 22 bp, Homo sapiens
ttttcagttactgtttatgtga

SEQ ID NO: 7315717 - DNA, 22 bp, Homo sapiens
ttttcagaaagatgagaaatta

SEQ ID NO: 7315718 - DNA, 20 bp, Homo sapiens
ctcttcaaatattttattct

SEQ ID NO: 7315719 - DNA, 22 bp, Homo sapiens
ctcttattcctacagtaacagg

SEQ ID NO: 7315720 - DNA, 18 bp, Homo sapiens
ctctgtgttggtgtgaag

SEQ ID NO: 7315721 - DNA, 22 bp, Homo sapiens
ctcttcaggatggcttgtgatg

SEQ ID NO: 7315722 - DNA, 22 bp, Homo sapiens
ctcttcagtaaatgacactgtt

SEQ ID NO: 7315723 - DNA, 22 bp, Homo sapiens
ctcttcagcaatgctttagtcc

SEQ ID NO: 7315724 - DNA, 22 bp, Homo sapiens
ctcttcaggtttctgctctgga

SEQ ID NO: 7315725 - DNA, 22 bp, Homo sapiens
ctcttcagatatacagtactct

SEQ ID NO: 7315726 - DNA, 22 bp, Homo sapiens
ctcttcaggaatatgtcagtca

SEQ ID NO: 7315727 - DNA, 22 bp, Homo sapiens
ctcttccatttctacttcacag

SEQ ID NO: 7315728 - DNA, 22 bp, Homo sapiens
ctcttccatattactcagggta

SEQ ID NO: 7315729 - DNA, 21 bp, Homo sapiens
ctcttcagtggtgagctcttc

SEQ ID NO: 7315730 - DNA, 22 bp, Homo sapiens
ctcttcagttcacccctaagca

SEQ ID NO: 7315731 - DNA, 22 bp, Homo sapiens
ctcttcagttggtcactattct

SEQ ID NO: 7315732 - DNA, 22 bp, Homo sapiens
ctctccaggagctcagagtcta

SEQ ID NO: 7315733 - DNA, 22 bp, Homo sapiens
ctctccaggctgggacaggacc

SEQ ID NO: 7315734 - DNA, 21 bp, Homo sapiens
ctctccaggtaggataaatgt

SEQ ID NO: 7315735 - DNA, 22 bp, Homo sapiens
ctctccaggggtagatgccttc

SEQ ID NO: 7315736 - DNA, 22 bp, Homo sapiens
ctctccagggcatgagttccac

SEQ ID NO: 7315737 - DNA, 22 bp, Homo sapiens
ctctctcttgtgttgctgcaga

SEQ ID NO: 7315738 - DNA, 22 bp, Homo sapiens
tttcacaaagcatagcacttta

SEQ ID NO: 7315739 - DNA, 22 bp, Homo sapiens
tttcacaaatgtctttaacttg

SEQ ID NO: 7315740 - DNA, 22 bp, Homo sapiens
tttcaattgactttggaagaaa

SEQ ID NO: 7315741 - DNA, 22 bp, Homo sapiens
tttcaatttccaggctagaatt

SEQ ID NO: 7315742 - DNA, 21 bp, Homo sapiens
tttcaatttgccttgagtcat

SEQ ID NO: 7315743 - DNA, 21 bp, Homo sapiens
tttcaatgtgttctttgtagt

SEQ ID NO: 7315744 - DNA, 22 bp, Homo sapiens
tttcaaatggagtcgtgaaatg

SEQ ID NO: 7315745 - DNA, 22 bp, Homo sapiens
tttcacagtcaatttggagtca

SEQ ID NO: 7315746 - DNA, 22 bp, Homo sapiens
tttcacagttagcatgaggact

SEQ ID NO: 7315747 - DNA, 22 bp, Homo sapiens
tttcacatagaaagtgatttac

SEQ ID NO: 7315748 - DNA, 22 bp, Homo sapiens
tttcacatagaaagtgatttac

SEQ ID NO: 7315749 - DNA, 22 bp, Homo sapiens
tttcacataaatattatgccta

SEQ ID NO: 7315750 - DNA, 22 bp, Homo sapiens
tttcacataaatggagtaaaga

SEQ ID NO: 7315751 - DNA, 22 bp, Homo sapiens
tttcacataaatggagtaaaga

SEQ ID NO: 7315752 - DNA, 22 bp, Homo sapiens
tttcacatagaaagtgatttac

SEQ ID NO: 7315753 - DNA, 22 bp, Homo sapiens
tttcctaaggctcattttaaaa

SEQ ID NO: 7315754 - DNA, 22 bp, Homo sapiens
tttcctaaggtagtgataattt

SEQ ID NO: 7315755 - DNA, 22 bp, Homo sapiens
ctccccattatgcagtcattat

SEQ ID NO: 7315756 - DNA, 22 bp, Homo sapiens
tttagacatttgtggtttgcaa

SEQ ID NO: 7315757 - DNA, 22 bp, Homo sapiens
tttagtatcctatctcatttaa

SEQ ID NO: 7315758 - DNA, 22 bp, Homo sapiens
ctcctccacagagtccttgcca

SEQ ID NO: 7315759 - DNA, 18 bp, Homo sapiens
ctcctccacagcccctgc

SEQ ID NO: 7315760 - DNA, 22 bp, Homo sapiens
tttattgtgttgaaactgaatt

SEQ ID NO: 7315761 - DNA, 22 bp, Homo sapiens
tttattgttgggtcttaagctg

SEQ ID NO: 7315762 - DNA, 22 bp, Homo sapiens
tttattgttgttagtcataagt

SEQ ID NO: 7315763 - DNA, 22 bp, Homo sapiens
ctcctccagctctccctggggg

SEQ ID NO: 7315764 - DNA, 22 bp, Homo sapiens
ctcctccagtgggtccctcagg

SEQ ID NO: 7315765 - DNA, 22 bp, Homo sapiens
ctcctggcactcagtgtggaag

SEQ ID NO: 7315766 - DNA, 22 bp, Homo sapiens
ctccagtgcgtcttagtaaacc

SEQ ID NO: 7315767 - DNA, 22 bp, Homo sapiens
ttgtgtaatctcttccctgccc

SEQ ID NO: 7315768 - DNA, 22 bp, Homo sapiens
ttgtgtaacttgagcaaacaca

SEQ ID NO: 7315769 - DNA, 22 bp, Homo sapiens
ttgtgtaagatgcaatatggta

SEQ ID NO: 7315770 - DNA, 22 bp, Homo sapiens
ttgtgtaaaacctgtgatcttt

SEQ ID NO: 7315771 - DNA, 22 bp, Homo sapiens
ttgtgaaacattcatggatttg

SEQ ID NO: 7315772 - DNA, 22 bp, Homo sapiens
ttgtctttcccagcttctagag

SEQ ID NO: 7315773 - DNA, 23 bp, Homo sapiens
ttgtctgtgcttttccagttgct

SEQ ID NO: 7315774 - DNA, 22 bp, Homo sapiens
ttgtctgtgaaatggaaatagt

SEQ ID NO: 7315775 - DNA, 22 bp, Homo sapiens
ctccagcctcatctcctggctg

SEQ ID NO: 7315776 - DNA, 22 bp, Homo sapiens
ttgtctgtcccagcttgtgcat

SEQ ID NO: 7315777 - DNA, 23 bp, Homo sapiens
ttgtatttttagtagagacaggg

SEQ ID NO: 7315778 - DNA, 23 bp, Homo sapiens
ttgtatttttagtagagacaggg

SEQ ID NO: 7315779 - DNA, 22 bp, Homo sapiens
ctccagcaggtgcgtctcagag

SEQ ID NO: 7315780 - DNA, 22 bp, Homo sapiens
ctcccaaggggtaagggagctg

SEQ ID NO: 7315781 - DNA, 22 bp, Homo sapiens
ctcccagaaaattctcagacaa

SEQ ID NO: 7315782 - DNA, 22 bp, Homo sapiens
tttaacagatgctatgtctacc

SEQ ID NO: 7315783 - DNA, 22 bp, Homo sapiens
ctcccagggccatcgagtcact

SEQ ID NO: 7315784 - DNA, 22 bp, Homo sapiens
tttaacagatgtgaaattttca

SEQ ID NO: 7315785 - DNA, 22 bp, Homo sapiens
ctcccaggccatgctctagcca

SEQ ID NO: 7315786 - DNA, 22 bp, Homo sapiens
tttaatatccagtggatacaaa

SEQ ID NO: 7315787 - DNA, 22 bp, Homo sapiens
tttaatatctcacacttccatg

SEQ ID NO: 7315788 - DNA, 22 bp, Homo sapiens
tttaatatttctttcctgaagc

SEQ ID NO: 7315789 - DNA, 22 bp, Homo sapiens
tttaatattctgcattctcctt

SEQ ID NO: 7315790 - DNA, 22 bp, Homo sapiens
ttggtcacttgctatgtgccaa

SEQ ID NO: 7315791 - DNA, 22 bp, Homo sapiens
ttgtacaacgttttaaatttga

SEQ ID NO: 7315792 - DNA, 22 bp, Homo sapiens
ctccacagcccctccagtggca

SEQ ID NO: 7315793 - DNA, 22 bp, Homo sapiens
ttgaaatactgcattgttcagt

SEQ ID NO: 7315794 - DNA, 22 bp, Homo sapiens
ttgaaagtgatggggaagatgg

SEQ ID NO: 7315795 - DNA, 22 bp, Homo sapiens
ttgaaataaggaagctcgaaat

SEQ ID NO: 7315796 - DNA, 22 bp, Homo sapiens
ctcattgttgggctttgctgga

SEQ ID NO: 7315797 - DNA, 22 bp, Homo sapiens
ctcatttatgtaatgattaagg

SEQ ID NO: 7315798 - DNA, 22 bp, Homo sapiens
ttcttttcctacacagcgattt

SEQ ID NO: 7315799 - DNA, 22 bp, Homo sapiens
ttcttttcccaatattttgctg

SEQ ID NO: 7315800 - DNA, 22 bp, Homo sapiens
ttcttttaatttctgtctgcag

SEQ ID NO: 7315801 - DNA, 22 bp, Homo sapiens
ttcttttaattgtgggggagtg

SEQ ID NO: 7315802 - DNA, 22 bp, Homo sapiens
ttcttttaatttctgtctgcag

SEQ ID NO: 7315803 - DNA, 22 bp, Homo sapiens
ttctttcttagcaatctatggt

SEQ ID NO: 7315804 - DNA, 22 bp, Homo sapiens
ttcttttacattaagatttcag

SEQ ID NO: 7315805 - DNA, 22 bp, Homo sapiens
ttcttttacattaagatttcag

SEQ ID NO: 7315806 - DNA, 22 bp, Homo sapiens
ttcttttagaatttcctaaggt

SEQ ID NO: 7315807 - DNA, 22 bp, Homo sapiens
ttcttttagtcattcagggaag

SEQ ID NO: 7315808 - DNA, 22 bp, Homo sapiens
ttcttttagtcattcagggaag

SEQ ID NO: 7315809 - DNA, 22 bp, Homo sapiens
tgttacaggaaatagaattacc

SEQ ID NO: 7315810 - DNA, 22 bp, Homo sapiens
tgttacaatattatcaactgag

SEQ ID NO: 7315811 - DNA, 22 bp, Homo sapiens
tgttccaataaggagttgaaat

SEQ ID NO: 7315812 - DNA, 22 bp, Homo sapiens
tgttccaagctgctggataagc

SEQ ID NO: 7315813 - DNA, 22 bp, Homo sapiens
tgtgtctgcccttagtacatct

SEQ ID NO: 7315814 - DNA, 22 bp, Homo sapiens
tgtgtctgcccttagtacatct

SEQ ID NO: 7315815 - DNA, 22 bp, Homo sapiens
tgtgtctggaccggggaggagc

SEQ ID NO: 7315816 - DNA, 22 bp, Homo sapiens
tgtgtctggataggtaatggat

SEQ ID NO: 7315817 - DNA, 22 bp, Homo sapiens
tgtgtctggaccggggaggagc

SEQ ID NO: 7315818 - DNA, 22 bp, Homo sapiens
tgtgtctggataggtaatggat

SEQ ID NO: 7315819 - DNA, 22 bp, Homo sapiens
cctgggctgctcatggggatga

SEQ ID NO: 7315820 - DNA, 22 bp, Homo sapiens
tgttaatatactaaaatccact

SEQ ID NO: 7315821 - DNA, 22 bp, Homo sapiens
tgttacaaactgttgtttctat

SEQ ID NO: 7315822 - DNA, 22 bp, Homo sapiens
tgtgtctgaacatgctttgtaa

SEQ ID NO: 7315823 - DNA, 22 bp, Homo sapiens
tgtgtctgaactagttgctctc

SEQ ID NO: 7315824 - DNA, 22 bp, Homo sapiens
tgtgtctgaacatgctttgtaa

SEQ ID NO: 7315825 - DNA, 23 bp, Homo sapiens
tgtgtctgaggatatatgtgcat

SEQ ID NO: 7315826 - DNA, 23 bp, Homo sapiens
tgtgtctgaggatatatgtgcat

SEQ ID NO: 7315827 - DNA, 22 bp, Homo sapiens
tgtgtctgcactgagtcctcac

SEQ ID NO: 7315828 - DNA, 22 bp, Homo sapiens
tgtgtctgcccttagtacatct

SEQ ID NO: 7315829 - DNA, 22 bp, Homo sapiens
tgtgtattaatgtttgtatatg

SEQ ID NO: 7315830 - DNA, 22 bp, Homo sapiens
tgtgtatgttttgaggttgcta

SEQ ID NO: 7315831 - DNA, 20 bp, Homo sapiens
tgtgtatgtgcacatgcgaa

SEQ ID NO: 7315832 - DNA, 20 bp, Homo sapiens
tgtgtatgtgcacatgcgaa

SEQ ID NO: 7315833 - DNA, 22 bp, Homo sapiens
tgtgtatgtgtatacactatat

SEQ ID NO: 7315834 - DNA, 20 bp, Homo sapiens
tgtgtatgtgcacatgcgaa

SEQ ID NO: 7315835 - DNA, 22 bp, Homo sapiens
tgtgtatgtctgtatgcacaca

SEQ ID NO: 7315836 - DNA, 22 bp, Homo sapiens
tgtgtatgtaagcatgtgcata

SEQ ID NO: 7315837 - DNA, 22 bp, Homo sapiens
tgtgtatgtaagcatgtgcata

SEQ ID NO: 7315838 - DNA, 23 bp, Homo sapiens
tgtgtatgtatctatgcataggt

SEQ ID NO: 7315839 - DNA, 23 bp, Homo sapiens
tgtgtatgtatctatgcataggt

SEQ ID NO: 7315840 - DNA, 23 bp, Homo sapiens
tgtgtatgtatctatgcataggt

SEQ ID NO: 7315841 - DNA, 21 bp, Homo sapiens
tgtgtatgtccaatgccctac

SEQ ID NO: 7315842 - DNA, 22 bp, Homo sapiens
tgtgtatattaggacacattct

SEQ ID NO: 7315843 - DNA, 22 bp, Homo sapiens
tgtgtatatgtaaatatagttg

SEQ ID NO: 7315844 - DNA, 22 bp, Homo sapiens
tgtgtatatgtaaatatagttg

SEQ ID NO: 7315845 - DNA, 22 bp, Homo sapiens
tgtgtatgcatacacacataga

SEQ ID NO: 7315846 - DNA, 22 bp, Homo sapiens
tgtgtatgcatacacacataga

SEQ ID NO: 7315847 - DNA, 22 bp, Homo sapiens
tgtgggtgatgaatttgttctt

SEQ ID NO: 7315848 - DNA, 22 bp, Homo sapiens
tgtgggtgatgaatttgttctt

SEQ ID NO: 7315849 - DNA, 20 bp, Homo sapiens
tgtgtataaatatatgtttc

SEQ ID NO: 7315850 - DNA, 20 bp, Homo sapiens
tgtgtataaatatatgtttc

SEQ ID NO: 7315851 - DNA, 22 bp, Homo sapiens
tgtgtataaacaagagtctgtg

SEQ ID NO: 7315852 - DNA, 20 bp, Homo sapiens
tgtgtataaatatatgtttc

SEQ ID NO: 7315853 - DNA, 22 bp, Homo sapiens
tgtgtataagtgagaatgctgt

SEQ ID NO: 7315854 - DNA, 22 bp, Homo sapiens
tgtgtataattagaccatttac

SEQ ID NO: 7315855 - DNA, 22 bp, Homo sapiens
tgtgtataactcttaattcatt

SEQ ID NO: 7315856 - DNA, 22 bp, Homo sapiens
tgtgtatacatacatacacacg

SEQ ID NO: 7315857 - DNA, 22 bp, Homo sapiens
tgtgtatacaacttataggagc

SEQ ID NO: 7315858 - DNA, 22 bp, Homo sapiens
tgtgtatacgagtatgaatatg

SEQ ID NO: 7315859 - DNA, 22 bp, Homo sapiens
tgtgtatatatgtgcacatgta

SEQ ID NO: 7315860 - DNA, 22 bp, Homo sapiens
tgtgtatagcagtttccagtct

SEQ ID NO: 7315861 - DNA, 22 bp, Homo sapiens
tgtgtataggttgtgctaatag

SEQ ID NO: 7315862 - DNA, 22 bp, Homo sapiens
tgtgtatagaaagtaggaaagg

SEQ ID NO: 7315863 - DNA, 22 bp, Homo sapiens
tgtgtatagatgcatgcatata

SEQ ID NO: 7315864 - DNA, 22 bp, Homo sapiens
tgtgtatagatgcatgcatata

SEQ ID NO: 7315865 - DNA, 22 bp, Homo sapiens
tgtgtatagatgcatgcatata

SEQ ID NO: 7315866 - DNA, 19 bp, Homo sapiens
cctgggagtcagctgaagg

SEQ ID NO: 7315867 - DNA, 19 bp, Homo sapiens
cctgggagtcagctgaagg

SEQ ID NO: 7315868 - DNA, 22 bp, Homo sapiens
cctgggaggtggatgttgcggt

SEQ ID NO: 7315869 - DNA, 21 bp, Homo sapiens
tgggggagaattggttgcttt

SEQ ID NO: 7315870 - DNA, 22 bp, Homo sapiens
tgggggaagagcttgttaaagt

SEQ ID NO: 7315871 - DNA, 23 bp, Homo sapiens
tggggccaagtgaggaagggtct

SEQ ID NO: 7315872 - DNA, 22 bp, Homo sapiens
tggggccaagaaggtctcatgt

SEQ ID NO: 7315873 - DNA, 22 bp, Homo sapiens
tggggccaagaaggtctcatgt

SEQ ID NO: 7315874 - DNA, 22 bp, Homo sapiens
tggggccacacatctctttcta

SEQ ID NO: 7315875 - DNA, 22 bp, Homo sapiens
tggggcagctccatctattcca

SEQ ID NO: 7315876 - DNA, 22 bp, Homo sapiens
cctgtgtggtagccagcggtgc

SEQ ID NO: 7315877 - DNA, 22 bp, Homo sapiens
cctgtgtggccaggctggagtc

SEQ ID NO: 7315878 - DNA, 22 bp, Homo sapiens
ccttccctaaagcgtcgcttag

SEQ ID NO: 7315879 - DNA, 22 bp, Homo sapiens
ccttcctcatccatttctcttg

SEQ ID NO: 7315880 - DNA, 22 bp, Homo sapiens
ccttcctggagcccatgcagat

SEQ ID NO: 7315881 - DNA, 22 bp, Homo sapiens
ccttcctggctgtccgcctgat

SEQ ID NO: 7315882 - DNA, 22 bp, Homo sapiens
ttacttttgcaccaaactaata

SEQ ID NO: 7315883 - DNA, 22 bp, Homo sapiens
ttagaaaaaacgtcttctagtg

SEQ ID NO: 7315884 - DNA, 22 bp, Homo sapiens
ttagaatctaacattcttatct

SEQ ID NO: 7315885 - DNA, 22 bp, Homo sapiens
ttagaatcaggtgttataatca

SEQ ID NO: 7315886 - DNA, 22 bp, Homo sapiens
ttagaaaaatgttcagtagttt

SEQ ID NO: 7315887 - DNA, 22 bp, Homo sapiens
ttagaaaacataagtggtaaag

SEQ ID NO: 7315888 - DNA, 22 bp, Homo sapiens
ttagaaaatttgcttctttgga

SEQ ID NO: 7315889 - DNA, 22 bp, Homo sapiens
ttagaaaatggaggtgggaggg

SEQ ID NO: 7315890 - DNA, 22 bp, Homo sapiens
ttagaaaatttgcttctttgga

SEQ ID NO: 7315891 - DNA, 21 bp, Homo sapiens
cctgtgctatcagcttgggtt

SEQ ID NO: 7315892 - DNA, 22 bp, Homo sapiens
cctgtgctcccatagcttctgt

SEQ ID NO: 7315893 - DNA, 22 bp, Homo sapiens
cctgtgccctcagcctggctct

SEQ ID NO: 7315894 - DNA, 22 bp, Homo sapiens
cctgtgctccctatgtatctgg

SEQ ID NO: 7315895 - DNA, 22 bp, Homo sapiens
cctgtgctggacagggctgggc

SEQ ID NO: 7315896 - DNA, 22 bp, Homo sapiens
ttaaagctggcgttacagtttg

SEQ ID NO: 7315897 - DNA, 22 bp, Homo sapiens
ttaaaggatctttgtcattaat

SEQ ID NO: 7315898 - DNA, 22 bp, Homo sapiens
ttaaaggaattgagtttcttgt

SEQ ID NO: 7315899 - DNA, 21 bp, Homo sapiens
cctgtggtctggagggagcac

SEQ ID NO: 7315900 - DNA, 22 bp, Homo sapiens
ttaaagtttgcctatgtgttgt

SEQ ID NO: 7315901 - DNA, 22 bp, Homo sapiens
ttaaagtttcagaaacttggtc

SEQ ID NO: 7315902 - DNA, 22 bp, Homo sapiens
ttaaagttcattaaatgagcca

SEQ ID NO: 7315903 - DNA, 22 bp, Homo sapiens
ttaaagttcattaaatgagcca

SEQ ID NO: 7315904 - DNA, 22 bp, Homo sapiens
ttaaagtatagaggacaaaaac

SEQ ID NO: 7315905 - DNA, 22 bp, Homo sapiens
ttaaaggctgatcttaatatta

SEQ ID NO: 7315906 - DNA, 22 bp, Homo sapiens
ttaaagtaatctgtgtgaattt

SEQ ID NO: 7315907 - DNA, 22 bp, Homo sapiens
ttaaagtaatctgtgtgaattt

SEQ ID NO: 7315908 - DNA, 22 bp, Homo sapiens
cctgtctgaggaggtgctcttt

SEQ ID NO: 7315909 - DNA, 22 bp, Homo sapiens
cctgtctgcatgatccctgcca

SEQ ID NO: 7315910 - DNA, 22 bp, Homo sapiens
tgtttataaattttcttgccat

SEQ ID NO: 7315911 - DNA, 22 bp, Homo sapiens
tgtttagatctcattcttccca

SEQ ID NO: 7315912 - DNA, 18 bp, Homo sapiens
cctgtctggggtccccac

SEQ ID NO: 7315913 - DNA, 22 bp, Homo sapiens
cctgtctggccttccacggggg

SEQ ID NO: 7315914 - DNA, 22 bp, Homo sapiens
cctgtctgtcctttgcattctt

SEQ ID NO: 7315915 - DNA, 22 bp, Homo sapiens
ttaggaggtctatggacatcct

SEQ ID NO: 7315916 - DNA, 22 bp, Homo sapiens
cgcccagctgaaatctccaggc

SEQ ID NO: 7315917 - DNA, 22 bp, Homo sapiens
ttcaagtttgtatttctgtatt

SEQ ID NO: 7315918 - DNA, 22 bp, Homo sapiens
ttcaagtttactttgaagttta

SEQ ID NO: 7315919 - DNA, 22 bp, Homo sapiens
ttcaagttttatattgaagcaa

SEQ ID NO: 7315920 - DNA, 22 bp, Homo sapiens
ttcaagttagagatatatttag

SEQ ID NO: 7315921 - DNA, 22 bp, Homo sapiens
ttcaagttaatgattctggttt

SEQ ID NO: 7315922 - DNA, 22 bp, Homo sapiens
ttcaagttctagtgttcacttc

SEQ ID NO: 7315923 - DNA, 22 bp, Homo sapiens
ttcaagttctgtggagagctgt

SEQ ID NO: 7315924 - DNA, 20 bp, Homo sapiens
ttcaagttgggtctctggct

SEQ ID NO: 7315925 - DNA, 19 bp, Homo sapiens
ttcacaattatgaaattag

SEQ ID NO: 7315926 - DNA, 19 bp, Homo sapiens
ttcacaattatgaaattag

SEQ ID NO: 7315927 - DNA, 22 bp, Homo sapiens
ttcacacagcaactgtatgaat

SEQ ID NO: 7315928 - DNA, 22 bp, Homo sapiens
ttcacacagcaactgtatgaat

SEQ ID NO: 7315929 - DNA, 22 bp, Homo sapiens
ttcacaatttcccttcatcagg

SEQ ID NO: 7315930 - DNA, 22 bp, Homo sapiens
ttcaaatttggtatgcaagcca

SEQ ID NO: 7315931 - DNA, 22 bp, Homo sapiens
ttcaaatttggtatgcaagcca

SEQ ID NO: 7315932 - DNA, 22 bp, Homo sapiens
ttcaagtgaggctgtctttaga

SEQ ID NO: 7315933 - DNA, 22 bp, Homo sapiens
ttcaggattatactctcttccc

SEQ ID NO: 7315934 - DNA, 22 bp, Homo sapiens
ttcagggagagcgggacgggtg

SEQ ID NO: 7315935 - DNA, 22 bp, Homo sapiens
ttcacagaattgtcttgactgg

SEQ ID NO: 7315936 - DNA, 22 bp, Homo sapiens
ttcacagacattgcagactgaa

SEQ ID NO: 7315937 - DNA, 22 bp, Homo sapiens
ttcagaggctgtatgactagat

SEQ ID NO: 7315938 - DNA, 22 bp, Homo sapiens
ttcagaggtttccgggccatgc

SEQ ID NO: 7315939 - DNA, 22 bp, Homo sapiens
ttcagaggtttccgggccatgc

SEQ ID NO: 7315940 - DNA, 22 bp, Homo sapiens
ttcatgaatgttccatgtgagt

SEQ ID NO: 7315941 - DNA, 22 bp, Homo sapiens
ttcatgaagggtgaatatagtc

SEQ ID NO: 7315942 - DNA, 22 bp, Homo sapiens
ttcatgaataccccttctgtaa

SEQ ID NO: 7315943 - DNA, 22 bp, Homo sapiens
ctaaatactagccttcagattt

SEQ ID NO: 7315944 - DNA, 22 bp, Homo sapiens
cgtaagaaatagcttgtcaaag

SEQ ID NO: 7315945 - DNA, 22 bp, Homo sapiens
cggtctcccgtgtgtgtgcgct

SEQ ID NO: 7315946 - DNA, 22 bp, Homo sapiens
cgtcacttcttagtctattttc

SEQ ID NO: 7315947 - DNA, 22 bp, Homo sapiens
cgtcactaccttaatgtatgca

SEQ ID NO: 7315948 - DNA, 22 bp, Homo sapiens
ttctctaagagatgcagaagtt

SEQ ID NO: 7315949 - DNA, 22 bp, Homo sapiens
ttctcctttgtaattctcatcc

SEQ ID NO: 7315950 - DNA, 22 bp, Homo sapiens
ctagaaactccatctcactaca

SEQ ID NO: 7315951 - DNA, 22 bp, Homo sapiens
ctagaaacgcctttagcacaac

SEQ ID NO: 7315952 - DNA, 17 bp, Homo sapiens
ctacttcttctattctt

SEQ ID NO: 7315953 - DNA, 22 bp, Homo sapiens
ctacttctgtggctctaagaga

SEQ ID NO: 7315954 - DNA, 22 bp, Homo sapiens
ctacttcttgatctgtcgacct

SEQ ID NO: 7315955 - DNA, 22 bp, Homo sapiens
ctacttggtacctgaagatcgg

SEQ ID NO: 7315956 - DNA, 22 bp, Homo sapiens
ctacttctaagtacatggtgat

SEQ ID NO: 7315957 - DNA, 21 bp, Homo sapiens
ctacttaagtaggggattagg

SEQ ID NO: 7315958 - DNA, 22 bp, Homo sapiens
ctactttaacaattcgcaagaa

SEQ ID NO: 7315959 - DNA, 22 bp, Homo sapiens
ctactgtcttccttggtaacaa

SEQ ID NO: 7315960 - DNA, 22 bp, Homo sapiens
ctactcttttgagtcttcagat

SEQ ID NO: 7315961 - DNA, 22 bp, Homo sapiens
ctactctgtggtgtatttgcat

SEQ ID NO: 7315962 - DNA, 22 bp, Homo sapiens
ctactcttttgagtcttcagat

SEQ ID NO: 7315963 - DNA, 22 bp, Homo sapiens
ctactctgaattgaagtgatat

SEQ ID NO: 7315964 - DNA, 22 bp, Homo sapiens
ctaccttcaagttcctccctct

SEQ ID NO: 7315965 - DNA, 22 bp, Homo sapiens
ctacccttaagtttctgtgggg

SEQ ID NO: 7315966 - DNA, 22 bp, Homo sapiens
ttcctgggctttcccctctggt

SEQ ID NO: 7315967 - DNA, 22 bp, Homo sapiens
ttcctgggaggctgtgtacttg

SEQ ID NO: 7315968 - DNA, 22 bp, Homo sapiens
ttcctgggattattgtcaagca

SEQ ID NO: 7315969 - DNA, 22 bp, Homo sapiens
ctacagagtatctaaagaggta

SEQ ID NO: 7315970 - DNA, 21 bp, Homo sapiens
ctacagaggagagggaaaggc

SEQ ID NO: 7315971 - DNA, 22 bp, Homo sapiens
ctcacagagctcatactgggag

SEQ ID NO: 7315972 - DNA, 22 bp, Homo sapiens
ctcacagatgtcctggcacttc

SEQ ID NO: 7315973 - DNA, 22 bp, Homo sapiens
ctagatttctagttcattatcc

SEQ ID NO: 7315974 - DNA, 22 bp, Homo sapiens
ctagattctttctactattatc

SEQ ID NO: 7315975 - DNA, 22 bp, Homo sapiens
ctagattcaatatttttctgcc

SEQ ID NO: 7315976 - DNA, 22 bp, Homo sapiens
ctagattcatatatttttggag

SEQ ID NO: 7315977 - DNA, 22 bp, Homo sapiens
ctatatatatcatcttccagtt

SEQ ID NO: 7315978 - DNA, 22 bp, Homo sapiens
ctatatacttttcacagatgtt

SEQ ID NO: 7315979 - DNA, 22 bp, Homo sapiens
ctatatacttttcacagatgtt

SEQ ID NO: 7315980 - DNA, 22 bp, Homo sapiens
ctatgcatctgaacaatagaga

SEQ ID NO: 7315981 - DNA, 22 bp, Homo sapiens
ctatatatatcatcttccagtt

SEQ ID NO: 7315982 - DNA, 22 bp, Homo sapiens
ctattacaatctgctactatga

SEQ ID NO: 7315983 - DNA, 22 bp, Homo sapiens
ctatgtgtcttgaaacaagact

SEQ ID NO: 7315984 - DNA, 22 bp, Homo sapiens
ctgggaggcagaggttgcagtg

SEQ ID NO: 7315985 - DNA, 22 bp, Homo sapiens
ctgggaggcggagcttgcagtg

SEQ ID NO: 7315986 - DNA, 22 bp, Homo sapiens
ctgggaggcagtctctctagaa

SEQ ID NO: 7315987 - DNA, 22 bp, Homo sapiens
ctggcttttagtgtgaagactt

SEQ ID NO: 7315988 - DNA, 22 bp, Homo sapiens
ctgggaagaaattgtgggaggc

SEQ ID NO: 7315989 - DNA, 22 bp, Homo sapiens
ctggctttcatttcaagcacgt

SEQ ID NO: 7315990 - DNA, 19 bp, Homo sapiens
ctgggccagagctgtcctc

SEQ ID NO: 7315991 - DNA, 19 bp, Homo sapiens
ctgggccagagctgtcctc

SEQ ID NO: 7315992 - DNA, 22 bp, Homo sapiens
ctgggctgcaggagtggggcaa

SEQ ID NO: 7315993 - DNA, 22 bp, Homo sapiens
ctgggctgctgtccactagggt

SEQ ID NO: 7315994 - DNA, 20 bp, Homo sapiens
ctggggaggaggatgtgttc

SEQ ID NO: 7315995 - DNA, 22 bp, Homo sapiens
ctggggctggtgaggcaggctc

SEQ ID NO: 7315996 - DNA, 22 bp, Homo sapiens
ctggggctgcggtggaggagcc

SEQ ID NO: 7315997 - DNA, 22 bp, Homo sapiens
ctggggctgcggacgggagccc

SEQ ID NO: 7315998 - DNA, 22 bp, Homo sapiens
ctggggctctctggaatgcttg

SEQ ID NO: 7315999 - DNA, 23 bp, Homo sapiens
ctggggctcattgcagtagccat

SEQ ID NO: 7316000 - DNA, 22 bp, Homo sapiens
ctggggctcactttggtcaggc

SEQ ID NO: 7316001 - DNA, 22 bp, Homo sapiens
ctggggcccgagccttgggcca

SEQ ID NO: 7316002 - DNA, 22 bp, Homo sapiens
ctgccaagtaatgcctgggctc

SEQ ID NO: 7316003 - DNA, 19 bp, Homo sapiens
ctggcagcctgtctgtgtc

SEQ ID NO: 7316004 - DNA, 22 bp, Homo sapiens
ctggcaggcggaggttgcagtg

SEQ ID NO: 7316005 - DNA, 22 bp, Homo sapiens
ctggcaggcggcagagcccagg

SEQ ID NO: 7316006 - DNA, 22 bp, Homo sapiens
ctggccaggcatcccctgatcc

SEQ ID NO: 7316007 - DNA, 22 bp, Homo sapiens
ctggccagcatggctgaagtac

SEQ ID NO: 7316008 - DNA, 22 bp, Homo sapiens
ctggccctgctccgcgccgcgg

SEQ ID NO: 7316009 - DNA, 22 bp, Homo sapiens
ctggccctggagggctgtgcga

SEQ ID NO: 7316010 - DNA, 16 bp, Homo sapiens
ctggccctggctctgg

SEQ ID NO: 7316011 - DNA, 22 bp, Homo sapiens
ctggccctcagactcatgggca

SEQ ID NO: 7316012 - DNA, 22 bp, Homo sapiens
ctggccctgtaggatgtgagtt

SEQ ID NO: 7316013 - DNA, 22 bp, Homo sapiens
ctggccctgtcagcacagaatc

SEQ ID NO: 7316014 - DNA, 22 bp, Homo sapiens
ctggccctgtggaggcaggaac

SEQ ID NO: 7316015 - DNA, 22 bp, Homo sapiens
ctggccctggtaaggacaccca

SEQ ID NO: 7316016 - DNA, 23 bp, Homo sapiens
ctggccctggctctgtgatcatg

SEQ ID NO: 7316017 - DNA, 22 bp, Homo sapiens
ctggccctggctggagcccagg

SEQ ID NO: 7316018 - DNA, 22 bp, Homo sapiens
ctggcctgtgggctgtctccgg

SEQ ID NO: 7316019 - DNA, 22 bp, Homo sapiens
ctggcctgtgggctgtctccgg

SEQ ID NO: 7316020 - DNA, 22 bp, Homo sapiens
ctggctcatagagcagctccaa

SEQ ID NO: 7316021 - DNA, 22 bp, Homo sapiens
cttcctctgtgtcctgggcttg

SEQ ID NO: 7316022 - DNA, 22 bp, Homo sapiens
cttcctctgtgtcctgggcttc

SEQ ID NO: 7316023 - DNA, 22 bp, Homo sapiens
cttcctctgtggccagagtgta

SEQ ID NO: 7316024 - DNA, 22 bp, Homo sapiens
cttcctgaggtgctgagcacag

SEQ ID NO: 7316025 - DNA, 22 bp, Homo sapiens
cttcctgaagaggttggtcagg

SEQ ID NO: 7316026 - DNA, 22 bp, Homo sapiens
cttcagtgttcccatctgtaaa

SEQ ID NO: 7316027 - DNA, 22 bp, Homo sapiens
cttcagtgttgccagggcctag

SEQ ID NO: 7316028 - DNA, 18 bp, Homo sapiens
cttcagtggctgctctgc

SEQ ID NO: 7316029 - DNA, 22 bp, Homo sapiens
cttcagtgtcctctctagtaga

SEQ ID NO: 7316030 - DNA, 22 bp, Homo sapiens
cttcctctgaggcttctgagtc

SEQ ID NO: 7316031 - DNA, 22 bp, Homo sapiens
cttcctctgaggcttctgagtc

SEQ ID NO: 7316032 - DNA, 22 bp, Homo sapiens
cttccgtgtcagttccaggtgg

SEQ ID NO: 7316033 - DNA, 22 bp, Homo sapiens
cttcagtccttaagccaagcaa

SEQ ID NO: 7316034 - DNA, 22 bp, Homo sapiens
cttcagtctccaatgctctgtg

SEQ ID NO: 7316035 - DNA, 22 bp, Homo sapiens
cttcagtccccagcaagctgtt

SEQ ID NO: 7316036 - DNA, 22 bp, Homo sapiens
cttcagtctagggtgcacttga

SEQ ID NO: 7316037 - DNA, 22 bp, Homo sapiens
cttcagggaggagcatgggttc

SEQ ID NO: 7316038 - DNA, 22 bp, Homo sapiens
cttcagtgatataggcttctcc

SEQ ID NO: 7316039 - DNA, 22 bp, Homo sapiens
cttcagtgcatgtttataatca

SEQ ID NO: 7316040 - DNA, 18 bp, Homo sapiens
cttcagtgacagtctggc

SEQ ID NO: 7316041 - DNA, 22 bp, Homo sapiens
cttcagctgcagttatgtttag

SEQ ID NO: 7316042 - DNA, 22 bp, Homo sapiens
cttcagctgacgtcaaaacacc

SEQ ID NO: 7316043 - DNA, 22 bp, Homo sapiens
cttcagctacctctgatgcaag

SEQ ID NO: 7316044 - DNA, 22 bp, Homo sapiens
cttcagctaggatccctgcagc

SEQ ID NO: 7316045 - DNA, 22 bp, Homo sapiens
cttcagctttcagcttccctga

SEQ ID NO: 7316046 - DNA, 22 bp, Homo sapiens
cttcaaagattattgaaaacaa

SEQ ID NO: 7316047 - DNA, 22 bp, Homo sapiens
cttcagaactataaaaagtact

SEQ ID NO: 7316048 - DNA, 22 bp, Homo sapiens
cttcaaaccacatgctgaaaat

SEQ ID NO: 7316049 - DNA, 22 bp, Homo sapiens
cttattttaagtcagtttgggt

SEQ ID NO: 7316050 - DNA, 22 bp, Homo sapiens
cttgatctacatagtgaaaccc

SEQ ID NO: 7316051 - DNA, 22 bp, Homo sapiens
cttgatctacatagtgaaaccc

SEQ ID NO: 7316052 - DNA, 22 bp, Homo sapiens
cttgcaaacactcaaagccatc

SEQ ID NO: 7316053 - DNA, 22 bp, Homo sapiens
cttgattgcttctacgtgactg

SEQ ID NO: 7316054 - DNA, 22 bp, Homo sapiens
cttcctggctcggtgcctcacc

SEQ ID NO: 7316055 - DNA, 19 bp, Homo sapiens
cttcctggaggagagcctc

SEQ ID NO: 7316056 - DNA, 22 bp, Homo sapiens
cttgtagaattgaaatggtctc

SEQ ID NO: 7316057 - DNA, 22 bp, Homo sapiens
cttgtagaattgaaatggtctc

SEQ ID NO: 7316058 - DNA, 22 bp, Homo sapiens
cttgtctgtgtcggataaaact

SEQ ID NO: 7316059 - DNA, 22 bp, Homo sapiens
ctttatggagtgacacaatggg

SEQ ID NO: 7316060 - DNA, 22 bp, Homo sapiens
ctttatgtccttgaagagttgt

SEQ ID NO: 7316061 - DNA, 22 bp, Homo sapiens
cttgtctgataatggggccaac

SEQ ID NO: 7316062 - DNA, 22 bp, Homo sapiens
cttgtctagttcctggtgatgt

SEQ ID NO: 7316063 - DNA, 21 bp, Homo sapiens
cttgtcacttcctcactgacc

SEQ ID NO: 7316064 - DNA, 22 bp, Homo sapiens
cttgtcacagcacctcagtctc

SEQ ID NO: 7316065 - DNA, 22 bp, Homo sapiens
cttgtcactctggctccagagc

SEQ ID NO: 7316066 - DNA, 22 bp, Homo sapiens
cttgtcagccaattgtggattt

SEQ ID NO: 7316067 - DNA, 22 bp, Homo sapiens
cttgtattgctgttttgcatct

SEQ ID NO: 7316068 - DNA, 22 bp, Homo sapiens
cttgtattgcaaactggccagg

SEQ ID NO: 7316069 - DNA, 22 bp, Homo sapiens
cttgtattgcaaactggccagg

SEQ ID NO: 7316070 - DNA, 22 bp, Homo sapiens
cttgtattcttccacttaagat

SEQ ID NO: 7316071 - DNA, 22 bp, Homo sapiens
cttgtattcttccacttaagat

SEQ ID NO: 7316072 - DNA, 22 bp, Homo sapiens
cttgtattatggttcgcttagt

SEQ ID NO: 7316073 - DNA, 22 bp, Homo sapiens
cttgtattaagcttagagaggc

SEQ ID NO: 7316074 - DNA, 22 bp, Homo sapiens
cttgtatacagtgtacacattg

SEQ ID NO: 7316075 - DNA, 22 bp, Homo sapiens
cttgtattaagcttagagaggc

SEQ ID NO: 7316076 - DNA, 22 bp, Homo sapiens
cttgtatagggaaagataaatc

SEQ ID NO: 7316077 - DNA, 22 bp, Homo sapiens
cttgtattcagagtggacatga

SEQ ID NO: 7316078 - DNA, 23 bp, Homo sapiens
cttgtattcactcatttgggaac

SEQ ID NO: 7316079 - DNA, 22 bp, Homo sapiens
cttgtattcagcatcttaacta

SEQ ID NO: 7316080 - DNA, 22 bp, Homo sapiens
cttgtattcagcatcttaacta

SEQ ID NO: 7316081 - DNA, 22 bp, Homo sapiens
cttgtattcccctatctctaaa

SEQ ID NO: 7316082 - DNA, 22 bp, Homo sapiens
ctgtggctggcctgtctgacat

SEQ ID NO: 7316083 - DNA, 22 bp, Homo sapiens
ctgtggctggccttattgctgc

SEQ ID NO: 7316084 - DNA, 22 bp, Homo sapiens
ctgtggctgtctctttcccatg

SEQ ID NO: 7316085 - DNA, 22 bp, Homo sapiens
ctgtgtacccacgtgggcaccc

SEQ ID NO: 7316086 - DNA, 22 bp, Homo sapiens
ctgtggtggcctccctgccatg

SEQ ID NO: 7316087 - DNA, 22 bp, Homo sapiens
ctgtgtctcatccgcctctggc

SEQ ID NO: 7316088 - DNA, 22 bp, Homo sapiens
ctgtgtctaatcttatacatca

SEQ ID NO: 7316089 - DNA, 23 bp, Homo sapiens
ctgtgtctatgcagccatatcca

SEQ ID NO: 7316090 - DNA, 22 bp, Homo sapiens
ctgtgtctaatcaggtcagtca

SEQ ID NO: 7316091 - DNA, 22 bp, Homo sapiens
ctgtgtctaatcttatacatca

SEQ ID NO: 7316092 - DNA, 22 bp, Homo sapiens
ctgtgtctaatcaggtcagtca

SEQ ID NO: 7316093 - DNA, 22 bp, Homo sapiens
ctgtggctgcgccatcgaaaac

SEQ ID NO: 7316094 - DNA, 22 bp, Homo sapiens
ctgtggctctctgcagggtccc

SEQ ID NO: 7316095 - DNA, 22 bp, Homo sapiens
ctgtggctctcagaggctgctg

SEQ ID NO: 7316096 - DNA, 16 bp, Homo sapiens
ctgtggctcccaggtt

SEQ ID NO: 7316097 - DNA, 22 bp, Homo sapiens
ctgttcaatttgtttcagttat

SEQ ID NO: 7316098 - DNA, 20 bp, Homo sapiens
ctgttcctgtcccatgaagc

SEQ ID NO: 7316099 - DNA, 22 bp, Homo sapiens
ctgtgtctcgttaaagcattgg

SEQ ID NO: 7316100 - DNA, 22 bp, Homo sapiens
ctgtgtctctacctccccatcc

SEQ ID NO: 7316101 - DNA, 22 bp, Homo sapiens
ctgtgtctcgttaaagcattgg

SEQ ID NO: 7316102 - DNA, 22 bp, Homo sapiens
ctgtgtctccttggtgggatat

SEQ ID NO: 7316103 - DNA, 22 bp, Homo sapiens
ctgtgtctccttggtgggatat

SEQ ID NO: 7316104 - DNA, 22 bp, Homo sapiens
ctgtgtctcccaaggagggtca

SEQ ID NO: 7316105 - DNA, 22 bp, Homo sapiens
ctgtgtctctccttacaagact

SEQ ID NO: 7316106 - DNA, 22 bp, Homo sapiens
ctgtgtctctccttacaagact

SEQ ID NO: 7316107 - DNA, 22 bp, Homo sapiens
ctgtgtctgaataactctgtgt

SEQ ID NO: 7316108 - DNA, 22 bp, Homo sapiens
ctgtgtctgcctgggatccatt

SEQ ID NO: 7316109 - DNA, 22 bp, Homo sapiens
ctgtgtctgcctgggatccatt

SEQ ID NO: 7316110 - DNA, 22 bp, Homo sapiens
ctgtgtcttcaatgtactggga

SEQ ID NO: 7316111 - DNA, 22 bp, Homo sapiens
ctgtgtctgtggaatagcgaat

SEQ ID NO: 7316112 - DNA, 22 bp, Homo sapiens
ctgtgtcttcaatgtactggga

SEQ ID NO: 7316113 - DNA, 22 bp, Homo sapiens
ctgtgtcttcctctgcccaggc

SEQ ID NO: 7316114 - DNA, 22 bp, Homo sapiens
ctgtgtcttctgcttacagtct

SEQ ID NO: 7316115 - DNA, 22 bp, Homo sapiens
ctgtgtcttcctctgcccaggc

SEQ ID NO: 7316116 - DNA, 22 bp, Homo sapiens
ctgtgtcttcacatttgtgtgc

SEQ ID NO: 7316117 - DNA, 22 bp, Homo sapiens
ctgttacatagcttttcttaac

SEQ ID NO: 7316118 - DNA, 23 bp, Homo sapiens
ctgttaaattccttaagagcagg

SEQ ID NO: 7316119 - DNA, 22 bp, Homo sapiens
ctgttaatggaggactacagga

SEQ ID NO: 7316120 - DNA, 22 bp, Homo sapiens
ctgtgcatcttcttcctggagg

SEQ ID NO: 7316121 - DNA, 22 bp, Homo sapiens
ctgtgccatctttttgctacct

SEQ ID NO: 7316122 - DNA, 22 bp, Homo sapiens
ctgtgcccagctccctgactgc

SEQ ID NO: 7316123 - DNA, 22 bp, Homo sapiens
ctgtgccatccgcttgacctgg

SEQ ID NO: 7316124 - DNA, 23 bp, Homo sapiens
ctgtgcccggggctccacctgat

SEQ ID NO: 7316125 - DNA, 22 bp, Homo sapiens
ctgtgcccataatctggtattt

SEQ ID NO: 7316126 - DNA, 22 bp, Homo sapiens
ctgtgccccacagagctccaca

SEQ ID NO: 7316127 - DNA, 22 bp, Homo sapiens
ctgtggccccaccctcttggcc

SEQ ID NO: 7316128 - DNA, 23 bp, Homo sapiens
ctgtggccctgcttcatgcagcc

SEQ ID NO: 7316129 - DNA, 22 bp, Homo sapiens
ctgtggccagtcccacacctcc

SEQ ID NO: 7316130 - DNA, 22 bp, Homo sapiens
ctgtggccagatggtgccagtt

SEQ ID NO: 7316131 - DNA, 22 bp, Homo sapiens
ctgggtgagtataggaaaggga

SEQ ID NO: 7316132 - DNA, 22 bp, Homo sapiens
ctgggtgccaattcatgtttat

SEQ ID NO: 7316133 - DNA, 22 bp, Homo sapiens
ctgggtgagttgatgaaggaga

SEQ ID NO: 7316134 - DNA, 22 bp, Homo sapiens
ctgggtgaatttgaaggaaagg

SEQ ID NO: 7316135 - DNA, 22 bp, Homo sapiens
ctgggtgcgtgagcgcatgcgt

SEQ ID NO: 7316136 - DNA, 22 bp, Homo sapiens
ctgtcctgatggtgccactggt

SEQ ID NO: 7316137 - DNA, 22 bp, Homo sapiens
gaagttgatagagtacatgatt

SEQ ID NO: 7316138 - DNA, 22 bp, Homo sapiens
gaaggaagactggtttaaatgt

SEQ ID NO: 7316139 - DNA, 22 bp, Homo sapiens
gaaggaagactggtttaaatgt

SEQ ID NO: 7316140 - DNA, 22 bp, Homo sapiens
gaaggaagattctgttggaatc

SEQ ID NO: 7316141 - DNA, 22 bp, Homo sapiens
gaaggaagattctgttggaatc

SEQ ID NO: 7316142 - DNA, 22 bp, Homo sapiens
gaatacaggcaggtggctgtgc

SEQ ID NO: 7316143 - DNA, 22 bp, Homo sapiens
gaatacaggcaggtggctgtgc

SEQ ID NO: 7316144 - DNA, 22 bp, Homo sapiens
gaatacatatcagatgtgtttc

SEQ ID NO: 7316145 - DNA, 19 bp, Homo sapiens
gaatacagataataagcag

SEQ ID NO: 7316146 - DNA, 19 bp, Homo sapiens
gaatacagataataagcag

SEQ ID NO: 7316147 - DNA, 22 bp, Homo sapiens
gaatacatctgaaggctatgaa

SEQ ID NO: 7316148 - DNA, 22 bp, Homo sapiens
gaatacatgatacatgaactgc

SEQ ID NO: 7316149 - DNA, 23 bp, Homo sapiens
gaatacagagataaatagaacac

SEQ ID NO: 7316150 - DNA, 22 bp, Homo sapiens
gaataacagcaagtttgcaggc

SEQ ID NO: 7316151 - DNA, 22 bp, Homo sapiens
gaatatatttctcttaccttta

SEQ ID NO: 7316152 - DNA, 22 bp, Homo sapiens
gaatactgacactcaggtggga

SEQ ID NO: 7316153 - DNA, 22 bp, Homo sapiens
gaatacattggaaatcagaata

SEQ ID NO: 7316154 - DNA, 18 bp, Homo sapiens
gaatactgagagcacaaa

SEQ ID NO: 7316155 - DNA, 22 bp, Homo sapiens
gaatactgatgctcagccccct

SEQ ID NO: 7316156 - DNA, 22 bp, Homo sapiens
gaatactgatgctcagccccct

SEQ ID NO: 7316157 - DNA, 22 bp, Homo sapiens
gaatactggaaaactcatttta

SEQ ID NO: 7316158 - DNA, 22 bp, Homo sapiens
gaatacatgattaaagtttgat

SEQ ID NO: 7316159 - DNA, 22 bp, Homo sapiens
gaatacatgtgtgtatagaggt

SEQ ID NO: 7316160 - DNA, 22 bp, Homo sapiens
gaatacatgtgtgtatagaggt

SEQ ID NO: 7316161 - DNA, 22 bp, Homo sapiens
gaatatgaactattcctagccc

SEQ ID NO: 7316162 - DNA, 23 bp, Homo sapiens
gacaggtaagggttgggagaatc

SEQ ID NO: 7316163 - DNA, 22 bp, Homo sapiens
gacaggtaaagatggtggcagg

SEQ ID NO: 7316164 - DNA, 22 bp, Homo sapiens
gacaggtaccggtcagactacg

SEQ ID NO: 7316165 - DNA, 22 bp, Homo sapiens
gaccctggtgggcactggcacc

SEQ ID NO: 7316166 - DNA, 22 bp, Homo sapiens
gacacagagacttgcagttgta

SEQ ID NO: 7316167 - DNA, 22 bp, Homo sapiens
gacaggcctagattcactgctg

SEQ ID NO: 7316168 - DNA, 18 bp, Homo sapiens
gacacacttgcagtagtc

SEQ ID NO: 7316169 - DNA, 22 bp, Homo sapiens
gacaataaaatgatcttacagt

SEQ ID NO: 7316170 - DNA, 22 bp, Homo sapiens
gacagggaaacattgaagtgtc

SEQ ID NO: 7316171 - DNA, 22 bp, Homo sapiens
gaaatcaaacccttttctgata

SEQ ID NO: 7316172 - DNA, 22 bp, Homo sapiens
gaaatcaaacccttttctgata

SEQ ID NO: 7316173 - DNA, 22 bp, Homo sapiens
gaaatcacttttttcatagttg

SEQ ID NO: 7316174 - DNA, 22 bp, Homo sapiens
gaaatcaatttcttggttgata

SEQ ID NO: 7316175 - DNA, 22 bp, Homo sapiens
gaaatcaatttcttggttgata

SEQ ID NO: 7316176 - DNA, 22 bp, Homo sapiens
ctttcatttgataagaatgcca

SEQ ID NO: 7316177 - DNA, 22 bp, Homo sapiens
ctttccaactctagtgaaattt

SEQ ID NO: 7316178 - DNA, 23 bp, Homo sapiens
ctttcattgtggtttcacagagc

SEQ ID NO: 7316179 - DNA, 22 bp, Homo sapiens
ctttcattcttagatattagtg

SEQ ID NO: 7316180 - DNA, 22 bp, Homo sapiens
ctttcaatgtcatctgtgaatg

SEQ ID NO: 7316181 - DNA, 22 bp, Homo sapiens
ctttcaatgtgcctgccttggg

SEQ ID NO: 7316182 - DNA, 22 bp, Homo sapiens
ctttcacagcttgaaaagtatt

SEQ ID NO: 7316183 - DNA, 22 bp, Homo sapiens
ctttcagggcaacacttctttt

SEQ ID NO: 7316184 - DNA, 22 bp, Homo sapiens
ctttcaggtcacataacgccaa

SEQ ID NO: 7316185 - DNA, 22 bp, Homo sapiens
ctttcaggttctataggaagcc

SEQ ID NO: 7316186 - DNA, 22 bp, Homo sapiens
ctttcataaggggttttataat

SEQ ID NO: 7316187 - DNA, 22 bp, Homo sapiens
gaaatggtagagtaggaagatt

SEQ ID NO: 7316188 - DNA, 22 bp, Homo sapiens
gaaatcattatatggtattgct

SEQ ID NO: 7316189 - DNA, 22 bp, Homo sapiens
gaaatcatctgagtaataatct

SEQ ID NO: 7316190 - DNA, 22 bp, Homo sapiens
gaaatcatgagatctcttggac

SEQ ID NO: 7316191 - DNA, 22 bp, Homo sapiens
gaaatcattagcaaagatatgt

SEQ ID NO: 7316192 - DNA, 22 bp, Homo sapiens
gaaatcattagcaaagatatgt

SEQ ID NO: 7316193 - DNA, 22 bp, Homo sapiens
gaacatttggcatgagaatttg

SEQ ID NO: 7316194 - DNA, 22 bp, Homo sapiens
gaacatttggatttgtaaattt

SEQ ID NO: 7316195 - DNA, 22 bp, Homo sapiens
gaacatttggatttgtaaattt

SEQ ID NO: 7316196 - DNA, 22 bp, Homo sapiens
gaacagtttccctgtagaaaat

SEQ ID NO: 7316197 - DNA, 22 bp, Homo sapiens
gaagccagtactgtgctctgca

SEQ ID NO: 7316198 - DNA, 22 bp, Homo sapiens
gaagccagcatccctctcccat

SEQ ID NO: 7316199 - DNA, 22 bp, Homo sapiens
gaagaggctttcctagggcaag

SEQ ID NO: 7316200 - DNA, 22 bp, Homo sapiens
gaagataactttaaaaagtggc

SEQ ID NO: 7316201 - DNA, 22 bp, Homo sapiens
gaagataattcctacttataac

SEQ ID NO: 7316202 - DNA, 22 bp, Homo sapiens
gaagatcaagtgtcattctgtg

SEQ ID NO: 7316203 - DNA, 22 bp, Homo sapiens
gaagatttaagcacaatagtct

SEQ ID NO: 7316204 - DNA, 22 bp, Homo sapiens
gaagatttctttatgaaagatg

SEQ ID NO: 7316205 - DNA, 22 bp, Homo sapiens
gaagatgtgcaatacaaagaaa

SEQ ID NO: 7316206 - DNA, 22 bp, Homo sapiens
gaagacatcgtgtggactaaca

SEQ ID NO: 7316207 - DNA, 22 bp, Homo sapiens
gaagacattaagtctatgtcac

SEQ ID NO: 7316208 - DNA, 21 bp, Homo sapiens
gaacatttgggttgtttctac

SEQ ID NO: 7316209 - DNA, 20 bp, Homo sapiens
gaacatttggccatactgag

SEQ ID NO: 7316210 - DNA, 22 bp, Homo sapiens
gaagaggactgtggcatcctag

SEQ ID NO: 7316211 - DNA, 22 bp, Homo sapiens
gaagagctgtagcctgctcttt

SEQ ID NO: 7316212 - DNA, 22 bp, Homo sapiens
gaagagaagcatcaataggtaa

SEQ ID NO: 7316213 - DNA, 22 bp, Homo sapiens
gaagagaaaggcaaggagtttt

SEQ ID NO: 7316214 - DNA, 22 bp, Homo sapiens
gaagactttaagccgagattag

SEQ ID NO: 7316215 - DNA, 22 bp, Homo sapiens
gagcagcaaagggagggtaaat

SEQ ID NO: 7316216 - DNA, 22 bp, Homo sapiens
gagcagagtctatttccacact

SEQ ID NO: 7316217 - DNA, 22 bp, Homo sapiens
gagatttagagagacttaaaca

SEQ ID NO: 7316218 - DNA, 18 bp, Homo sapiens
gagcagcaggatcaagaa

SEQ ID NO: 7316219 - DNA, 22 bp, Homo sapiens
gagatggagtctttttctgtca

SEQ ID NO: 7316220 - DNA, 22 bp, Homo sapiens
gagatggaaaactgctggtagt

SEQ ID NO: 7316221 - DNA, 22 bp, Homo sapiens
gagatggaatctgtgtggaggg

SEQ ID NO: 7316222 - DNA, 22 bp, Homo sapiens
gagattgggtcttgctctgtca

SEQ ID NO: 7316223 - DNA, 22 bp, Homo sapiens
gagatgttttgctgagaatggg

SEQ ID NO: 7316224 - DNA, 22 bp, Homo sapiens
gagccacagcaacctcaaagga

SEQ ID NO: 7316225 - DNA, 22 bp, Homo sapiens
gagccacagtggattgattcca

SEQ ID NO: 7316226 - DNA, 22 bp, Homo sapiens
gagccacagtggtggcccacgt

SEQ ID NO: 7316227 - DNA, 22 bp, Homo sapiens
gagccaagatcgcaccactgca

SEQ ID NO: 7316228 - DNA, 22 bp, Homo sapiens
gagccaagcaatatacccaacc

SEQ ID NO: 7316229 - DNA, 22 bp, Homo sapiens
gagccagagctacaagtgtctg

SEQ ID NO: 7316230 - DNA, 22 bp, Homo sapiens
gagacaaaagttggagtgcaag

SEQ ID NO: 7316231 - DNA, 22 bp, Homo sapiens
gagaggctggtaaagtctgaac

SEQ ID NO: 7316232 - DNA, 22 bp, Homo sapiens
gagagggagccagccaggaacc

SEQ ID NO: 7316233 - DNA, 22 bp, Homo sapiens
gagaattagggcgtaattcaga

SEQ ID NO: 7316234 - DNA, 22 bp, Homo sapiens
gagaatgggaatgaaagtagca

SEQ ID NO: 7316235 - DNA, 22 bp, Homo sapiens
gagaaggcttcttttcctctga

SEQ ID NO: 7316236 - DNA, 22 bp, Homo sapiens
gacctcatgatccacctgcctt

SEQ ID NO: 7316237 - DNA, 22 bp, Homo sapiens
gacctcgtgatctgccagcctt

SEQ ID NO: 7316238 - DNA, 22 bp, Homo sapiens
gacctcgtgatccgcccgcttt

SEQ ID NO: 7316239 - DNA, 22 bp, Homo sapiens
gacctcgtgatccgccctcctt

SEQ ID NO: 7316240 - DNA, 22 bp, Homo sapiens
gacctcgtgatccgccctcctt

SEQ ID NO: 7316241 - DNA, 22 bp, Homo sapiens
gacctcgtgatccgcccgcttt

SEQ ID NO: 7316242 - DNA, 22 bp, Homo sapiens
gacctcaggcttctgtaattaa

SEQ ID NO: 7316243 - DNA, 17 bp, Homo sapiens
gacctcaggtgatctgc

SEQ ID NO: 7316244 - DNA, 22 bp, Homo sapiens
gagaaggaggcgaagcgtgtgc

SEQ ID NO: 7316245 - DNA, 22 bp, Homo sapiens
gagaaggagctcaaatatggct

SEQ ID NO: 7316246 - DNA, 22 bp, Homo sapiens
gacctcgtgatctgccggcctt

SEQ ID NO: 7316247 - DNA, 22 bp, Homo sapiens
gagcctcctcctggtgtgccga

SEQ ID NO: 7316248 - DNA, 22 bp, Homo sapiens
gagcctgatgaaacaggcagac

SEQ ID NO: 7316249 - DNA, 22 bp, Homo sapiens
gagcctggagctggaacgaagc

SEQ ID NO: 7316250 - DNA, 22 bp, Homo sapiens
gagctctatgtggctggcatgt

SEQ ID NO: 7316251 - DNA, 22 bp, Homo sapiens
gagctctgactgctgggtgaca

SEQ ID NO: 7316252 - DNA, 22 bp, Homo sapiens
gagctactgaaatattgatttt

SEQ ID NO: 7316253 - DNA, 22 bp, Homo sapiens
gagctacactgattcatttgtt

SEQ ID NO: 7316254 - DNA, 22 bp, Homo sapiens
gagctaaggcacaggcaggctt

SEQ ID NO: 7316255 - DNA, 22 bp, Homo sapiens
gagctaaggtcacaagaagcag

SEQ ID NO: 7316256 - DNA, 22 bp, Homo sapiens
gagctaagtttctggaggcaga

SEQ ID NO: 7316257 - DNA, 22 bp, Homo sapiens
gagctaagaactgtgccaggtg

SEQ ID NO: 7316258 - DNA, 22 bp, Homo sapiens
gagctaagaagcaaataaatca

SEQ ID NO: 7316259 - DNA, 22 bp, Homo sapiens
gagctaagacctgagggcaagt

SEQ ID NO: 7316260 - DNA, 22 bp, Homo sapiens
gagctaagagtctagaaaggct

SEQ ID NO: 7316261 - DNA, 22 bp, Homo sapiens
gagctaagccctggagaggtcg

SEQ ID NO: 7316262 - DNA, 22 bp, Homo sapiens
gagctaagctatgttatgcagc

SEQ ID NO: 7316263 - DNA, 22 bp, Homo sapiens
gagcttggacaccttggcaggt

SEQ ID NO: 7316264 - DNA, 22 bp, Homo sapiens
gaggcaatgggctatagcattg

SEQ ID NO: 7316265 - DNA, 22 bp, Homo sapiens
gaggcactctcgacaagggtgg

SEQ ID NO: 7316266 - DNA, 22 bp, Homo sapiens
gaggcagaagttgcagtgagca

SEQ ID NO: 7316267 - DNA, 22 bp, Homo sapiens
gaggcagaggaaggtggtctct

SEQ ID NO: 7316268 - DNA, 22 bp, Homo sapiens
gaggcagaggttgcagtgagct

SEQ ID NO: 7316269 - DNA, 22 bp, Homo sapiens
gaggccagcccctcttgaaggc

SEQ ID NO: 7316270 - DNA, 22 bp, Homo sapiens
gaggccagctagtccaggaagt

SEQ ID NO: 7316271 - DNA, 22 bp, Homo sapiens
gaggccagcgcgcagcactttt

SEQ ID NO: 7316272 - DNA, 22 bp, Homo sapiens
gaggaaaatattcagggaggtt

SEQ ID NO: 7316273 - DNA, 22 bp, Homo sapiens
gaggaaaatattcagggaggtt

SEQ ID NO: 7316274 - DNA, 22 bp, Homo sapiens
gaggaaaatgcaacaggaatgc

SEQ ID NO: 7316275 - DNA, 22 bp, Homo sapiens
gaggaaaatgcaacaggaatgc

SEQ ID NO: 7316276 - DNA, 22 bp, Homo sapiens
gaggaaaataacaactaagggc

SEQ ID NO: 7316277 - DNA, 22 bp, Homo sapiens
gaggaaaataacaactaagggc

SEQ ID NO: 7316278 - DNA, 22 bp, Homo sapiens
gaggaaaagagacaggttattg

SEQ ID NO: 7316279 - DNA, 20 bp, Homo sapiens
gaggaaaagctgccaggcct

SEQ ID NO: 7316280 - DNA, 20 bp, Homo sapiens
gaggaaaagctgccaggcct

SEQ ID NO: 7316281 - DNA, 19 bp, Homo sapiens
gaggagctatcggagacag

SEQ ID NO: 7316282 - DNA, 22 bp, Homo sapiens
gaggagctgtctttgtgatctt

SEQ ID NO: 7316283 - DNA, 22 bp, Homo sapiens
gaggagctgttccctcacctct

SEQ ID NO: 7316284 - DNA, 19 bp, Homo sapiens
gaggagctatcggagacag

SEQ ID NO: 7316285 - DNA, 22 bp, Homo sapiens
gaggagcttgtgagaagatgtc

SEQ ID NO: 7316286 - DNA, 22 bp, Homo sapiens
gaggagcttgcatttaagtgcc

SEQ ID NO: 7316287 - DNA, 22 bp, Homo sapiens
gaggagcttgtgagaagatgtc

SEQ ID NO: 7316288 - DNA, 22 bp, Homo sapiens
gaggagcttcagaggaatctta

SEQ ID NO: 7316289 - DNA, 22 bp, Homo sapiens
gaggagcttgaggctaggagcc

SEQ ID NO: 7316290 - DNA, 22 bp, Homo sapiens
gaggagcttcagaggaatctta

SEQ ID NO: 7316291 - DNA, 22 bp, Homo sapiens
gggatggggtcgggaccctgct

SEQ ID NO: 7316292 - DNA, 22 bp, Homo sapiens
gggatggggtcgggaccctgct

SEQ ID NO: 7316293 - DNA, 22 bp, Homo sapiens
gggcaaagtggtggaggcagtt

SEQ ID NO: 7316294 - DNA, 22 bp, Homo sapiens
gggattgaattgggggatcaca

SEQ ID NO: 7316295 - DNA, 22 bp, Homo sapiens
gggcacagcctaactatggaga

SEQ ID NO: 7316296 - DNA, 22 bp, Homo sapiens
gggcaagcacagcgagcgtgcg

SEQ ID NO: 7316297 - DNA, 22 bp, Homo sapiens
gggatggggggaagcgtccatg

SEQ ID NO: 7316298 - DNA, 22 bp, Homo sapiens
gggatggggtcaacatgtacct

SEQ ID NO: 7316299 - DNA, 22 bp, Homo sapiens
gggagctgtgggattggttgag

SEQ ID NO: 7316300 - DNA, 21 bp, Homo sapiens
gggaggaagctgcttctctct

SEQ ID NO: 7316301 - DNA, 22 bp, Homo sapiens
gggcacaggaatttgggatgtg

SEQ ID NO: 7316302 - DNA, 22 bp, Homo sapiens
gggcaggaacaaatcaaatgat

SEQ ID NO: 7316303 - DNA, 23 bp, Homo sapiens
gggcatggagtgtaggtggaagg

SEQ ID NO: 7316304 - DNA, 22 bp, Homo sapiens
gggcaggatgcagtttcagaga

SEQ ID NO: 7316305 - DNA, 22 bp, Homo sapiens
gggcaggagagaacagtcatgg

SEQ ID NO: 7316306 - DNA, 16 bp, Homo sapiens
gggcaggaatcagggt

SEQ ID NO: 7316307 - DNA, 22 bp, Homo sapiens
gggagacccccaatgccaggtc

SEQ ID NO: 7316308 - DNA, 22 bp, Homo sapiens
gggagctggttcctgccctcca

SEQ ID NO: 7316309 - DNA, 19 bp, Homo sapiens
gggagctgtctgcccgtgg

SEQ ID NO: 7316310 - DNA, 18 bp, Homo sapiens
gggagctgggaagctggt

SEQ ID NO: 7316311 - DNA, 22 bp, Homo sapiens
gggagatgaatcagaagtgatc

SEQ ID NO: 7316312 - DNA, 22 bp, Homo sapiens
gggacagcagaaagaaggcaag

SEQ ID NO: 7316313 - DNA, 22 bp, Homo sapiens
gggaccagaggctgtgcacaat

SEQ ID NO: 7316314 - DNA, 22 bp, Homo sapiens
gggaccagaagaaggatggtga

SEQ ID NO: 7316315 - DNA, 22 bp, Homo sapiens
gggagaagtggaaatctcatta

SEQ ID NO: 7316316 - DNA, 23 bp, Homo sapiens
gggaccagctagggctgtgacct

SEQ ID NO: 7316317 - DNA, 22 bp, Homo sapiens
gggacaggctgagacttgagct

SEQ ID NO: 7316318 - DNA, 22 bp, Homo sapiens
gggacatctttctagtcagggt

SEQ ID NO: 7316319 - DNA, 22 bp, Homo sapiens
gggacatgaggccatagtgatt

SEQ ID NO: 7316320 - DNA, 22 bp, Homo sapiens
ggctctggcgagctttagtaca

SEQ ID NO: 7316321 - DNA, 22 bp, Homo sapiens
ggctctggcggctctttcaata

SEQ ID NO: 7316322 - DNA, 22 bp, Homo sapiens
ggctctggcggctctttcaata

SEQ ID NO: 7316323 - DNA, 22 bp, Homo sapiens
ggctctggcgtccaatggagcg

SEQ ID NO: 7316324 - DNA, 22 bp, Homo sapiens
ggctctggctactccaccctgt

SEQ ID NO: 7316325 - DNA, 22 bp, Homo sapiens
ggctccagatgtcccctggcaa

SEQ ID NO: 7316326 - DNA, 22 bp, Homo sapiens
ggcttctctcccccagctccac

SEQ ID NO: 7316327 - DNA, 22 bp, Homo sapiens
ggcttctgagtgctctgctgtt

SEQ ID NO: 7316328 - DNA, 22 bp, Homo sapiens
ggctgctggggacgtgggagag

SEQ ID NO: 7316329 - DNA, 21 bp, Homo sapiens
ggctgctgggagagctgcgtg

SEQ ID NO: 7316330 - DNA, 22 bp, Homo sapiens
ggctgctggcagatgtagttta

SEQ ID NO: 7316331 - DNA, 22 bp, Homo sapiens
ggctgctgcccacccctgcatg

SEQ ID NO: 7316332 - DNA, 17 bp, Homo sapiens
ggcctgcacctcctgct

SEQ ID NO: 7316333 - DNA, 22 bp, Homo sapiens
ggcctgcacagaggtggctcta

SEQ ID NO: 7316334 - DNA, 22 bp, Homo sapiens
ggcctgagtcacatcaggagag

SEQ ID NO: 7316335 - DNA, 22 bp, Homo sapiens
ggccttttgtgtccttgcccgt

SEQ ID NO: 7316336 - DNA, 22 bp, Homo sapiens
ggccttggttccaaagcaggca

SEQ ID NO: 7316337 - DNA, 22 bp, Homo sapiens
ggcctcagagaaggctgtgcgg

SEQ ID NO: 7316338 - DNA, 18 bp, Homo sapiens
ggcatgtgagtgctgagg

SEQ ID NO: 7316339 - DNA, 22 bp, Homo sapiens
ggccagtgtgcaggtcagagat

SEQ ID NO: 7316340 - DNA, 22 bp, Homo sapiens
ggcagtgaacagaaatgcagaa

SEQ ID NO: 7316341 - DNA, 22 bp, Homo sapiens
ggcagtgaatctgagagcctgg

SEQ ID NO: 7316342 - DNA, 22 bp, Homo sapiens
ggcagtgaacagaaatgcagaa

SEQ ID NO: 7316343 - DNA, 22 bp, Homo sapiens
ggcaggaggtgagtggcgggtg

SEQ ID NO: 7316344 - DNA, 22 bp, Homo sapiens
ggcaggcactgtgctaggcgct

SEQ ID NO: 7316345 - DNA, 21 bp, Homo sapiens
ggagtccaaaaattagccatg

SEQ ID NO: 7316346 - DNA, 22 bp, Homo sapiens
ggagtccaacgtgcagccagga

SEQ ID NO: 7316347 - DNA, 23 bp, Homo sapiens
ggagccagcctgtggggagcggg

SEQ ID NO: 7316348 - DNA, 19 bp, Homo sapiens
ggagccagctgtggaaggc

SEQ ID NO: 7316349 - DNA, 22 bp, Homo sapiens
ggagccagagtctgcagtgtaa

SEQ ID NO: 7316350 - DNA, 22 bp, Homo sapiens
ggagccagaggctgctgctgtg

SEQ ID NO: 7316351 - DNA, 23 bp, Homo sapiens
ggagtgcaatggcgccatctcgg

SEQ ID NO: 7316352 - DNA, 22 bp, Homo sapiens
ggtctcctgaggctgccacacc

SEQ ID NO: 7316353 - DNA, 22 bp, Homo sapiens
ggtctctgctcagatgccactt

SEQ ID NO: 7316354 - DNA, 22 bp, Homo sapiens
ggtctagatttctgttataggg

SEQ ID NO: 7316355 - DNA, 22 bp, Homo sapiens
ggtctccagctgggaccctgca

SEQ ID NO: 7316356 - DNA, 22 bp, Homo sapiens
ggtcgctgtgtaggttcagcta

SEQ ID NO: 7316357 - DNA, 22 bp, Homo sapiens
ggtccttgggtctcctgtgttt

SEQ ID NO: 7316358 - DNA, 22 bp, Homo sapiens
ggtctagatgaaattaaatgtt

SEQ ID NO: 7316359 - DNA, 22 bp, Homo sapiens
ggtctagacgaattcctatcag

SEQ ID NO: 7316360 - DNA, 22 bp, Homo sapiens
ggtctagagcttgattggcagc

SEQ ID NO: 7316361 - DNA, 22 bp, Homo sapiens
ggtctagaggatgttcctttcc

SEQ ID NO: 7316362 - DNA, 22 bp, Homo sapiens
ggtctaatgttatcactactct

SEQ ID NO: 7316363 - DNA, 22 bp, Homo sapiens
ggtccctggggaactaggctgt

SEQ ID NO: 7316364 - DNA, 19 bp, Homo sapiens
ggtcagagagatccaggct

SEQ ID NO: 7316365 - DNA, 22 bp, Homo sapiens
ggtcactttaccccttggagcc

SEQ ID NO: 7316366 - DNA, 20 bp, Homo sapiens
ggtcactgtggctgcaggat

SEQ ID NO: 7316367 - DNA, 22 bp, Homo sapiens
ggtcactgtctgaggtactgga

SEQ ID NO: 7316368 - DNA, 22 bp, Homo sapiens
ggtcacatctaaatggagcatt

SEQ ID NO: 7316369 - DNA, 22 bp, Homo sapiens
ggtcacgtgaccgcacctgcct

SEQ ID NO: 7316370 - DNA, 23 bp, Homo sapiens
ggtttagccactcaaggcttgcc

SEQ ID NO: 7316371 - DNA, 22 bp, Homo sapiens
ggtgttgtacattctgtggatt

SEQ ID NO: 7316372 - DNA, 22 bp, Homo sapiens
ggtgttgcagttgaagactggt

SEQ ID NO: 7316373 - DNA, 22 bp, Homo sapiens
ggtgtgtgtggattagcatgcc

SEQ ID NO: 7316374 - DNA, 22 bp, Homo sapiens
ggtgtgtgtggattagcatgcc

SEQ ID NO: 7316375 - DNA, 22 bp, Homo sapiens
ggtgtgtggtcctctcacttag

SEQ ID NO: 7316376 - DNA, 22 bp, Homo sapiens
ggtgtgtggttttgatacagtc

SEQ ID NO: 7316377 - DNA, 22 bp, Homo sapiens
ggtgtgtggttttgatacagtc

SEQ ID NO: 7316378 - DNA, 22 bp, Homo sapiens
ggtgtgtggttttgatacagtc

SEQ ID NO: 7316379 - DNA, 19 bp, Homo sapiens
ggtgtgtgctggggcctgt

SEQ ID NO: 7316380 - DNA, 19 bp, Homo sapiens
ggtgtgtgctggggcctgt

SEQ ID NO: 7316381 - DNA, 22 bp, Homo sapiens
ggtgtgtctgccaggaactgca

SEQ ID NO: 7316382 - DNA, 18 bp, Homo sapiens
ggtgtgtaacgtgttttc

SEQ ID NO: 7316383 - DNA, 22 bp, Homo sapiens
ggtgtgtgaggagtcacttagt

SEQ ID NO: 7316384 - DNA, 22 bp, Homo sapiens
ggtctggatgctgaggttccca

SEQ ID NO: 7316385 - DNA, 22 bp, Homo sapiens
ggtctggagtaggatgatggct

SEQ ID NO: 7316386 - DNA, 22 bp, Homo sapiens
ggggaagatggccctccatgtg

SEQ ID NO: 7316387 - DNA, 22 bp, Homo sapiens
ggggaagaggcgtgatggatcc

SEQ ID NO: 7316388 - DNA, 22 bp, Homo sapiens
ggggccgaccgcggttcaggcc

SEQ ID NO: 7316389 - DNA, 22 bp, Homo sapiens
ggggctgagaattcagtctcgg

SEQ ID NO: 7316390 - DNA, 20 bp, Homo sapiens
gggtggagttgcggtctgtg

SEQ ID NO: 7316391 - DNA, 22 bp, Homo sapiens
ggggtgggcgtgcagggacacc

SEQ ID NO: 7316392 - DNA, 22 bp, Homo sapiens
gggccaaggggagctggaaggg

SEQ ID NO: 7316393 - DNA, 22 bp, Homo sapiens
gggccaaggggagctggaaggg

SEQ ID NO: 7316394 - DNA, 22 bp, Homo sapiens
gggctgagagctggaatctgag

SEQ ID NO: 7316395 - DNA, 22 bp, Homo sapiens
gggctgaggctaccactggtct

SEQ ID NO: 7316396 - DNA, 22 bp, Homo sapiens
gggctgagttcctgcctcactc

SEQ ID NO: 7316397 - DNA, 23 bp, Homo sapiens
gtatttcagcattctcagttaaa

SEQ ID NO: 7316398 - DNA, 23 bp, Homo sapiens
gtatttcagcattctcagttaaa

SEQ ID NO: 7316399 - DNA, 19 bp, Homo sapiens
gtatttcaggacaagacgt

SEQ ID NO: 7316400 - DNA, 22 bp, Homo sapiens
gtatttcatcttgaaaaccagt

SEQ ID NO: 7316401 - DNA, 22 bp, Homo sapiens
gtatttcatcttgaaaaccagt

SEQ ID NO: 7316402 - DNA, 22 bp, Homo sapiens
gtcattttgctgcatatttaga

SEQ ID NO: 7316403 - DNA, 22 bp, Homo sapiens
gtcattttgctgcatatttaga

SEQ ID NO: 7316404 - DNA, 22 bp, Homo sapiens
gtccacaagcaggaagtgagcc

SEQ ID NO: 7316405 - DNA, 22 bp, Homo sapiens
gtccacaacatcagactaactg

SEQ ID NO: 7316406 - DNA, 22 bp, Homo sapiens
gtccacaaaattactatcttac

SEQ ID NO: 7316407 - DNA, 22 bp, Homo sapiens
gtccccagaaaggtgaggcagg

SEQ ID NO: 7316408 - DNA, 22 bp, Homo sapiens
gtccccagagctggtggtggtt

SEQ ID NO: 7316409 - DNA, 22 bp, Homo sapiens
gtccacattattatatgtctgt

SEQ ID NO: 7316410 - DNA, 22 bp, Homo sapiens
gtccccagctaatctctttgcc

SEQ ID NO: 7316411 - DNA, 22 bp, Homo sapiens
gtccccagctgtgacgagagcc

SEQ ID NO: 7316412 - DNA, 22 bp, Homo sapiens
gtccccagctgtgacgagagcc

SEQ ID NO: 7316413 - DNA, 22 bp, Homo sapiens
gtccctcacccagatgctccca

SEQ ID NO: 7316414 - DNA, 22 bp, Homo sapiens
gtccctggaatggactctgcgc

SEQ ID NO: 7316415 - DNA, 17 bp, Homo sapiens
gtcctgggaggagagag

SEQ ID NO: 7316416 - DNA, 22 bp, Homo sapiens
gtatttaattccattaagttag

SEQ ID NO: 7316417 - DNA, 22 bp, Homo sapiens
gtattgtatttatttatgtgac

SEQ ID NO: 7316418 - DNA, 22 bp, Homo sapiens
gtattgtattgggatgagctct

SEQ ID NO: 7316419 - DNA, 22 bp, Homo sapiens
gtattgcattgtttcaagctgt

SEQ ID NO: 7316420 - DNA, 22 bp, Homo sapiens
gtattcttggttatcaaaatac

SEQ ID NO: 7316421 - DNA, 21 bp, Homo sapiens
gtattctttatgaagtgaaaa

SEQ ID NO: 7316422 - DNA, 22 bp, Homo sapiens
gtattcttgagtggcaactagg

SEQ ID NO: 7316423 - DNA, 22 bp, Homo sapiens
gtagacaagcacaggactcaga

SEQ ID NO: 7316424 - DNA, 22 bp, Homo sapiens
gtagaactctttcctgcgtggg

SEQ ID NO: 7316425 - DNA, 22 bp, Homo sapiens
gtagaactccagttctgtggca

SEQ ID NO: 7316426 - DNA, 22 bp, Homo sapiens
gtacgtgcatgcacgtgtgcct

SEQ ID NO: 7316427 - DNA, 22 bp, Homo sapiens
ggtttgctgcagtctcgtcatc

SEQ ID NO: 7316428 - DNA, 22 bp, Homo sapiens
gtaaaacaagctttatggttcc

SEQ ID NO: 7316429 - DNA, 22 bp, Homo sapiens
gtacatttcatttaaatgatgt

SEQ ID NO: 7316430 - DNA, 22 bp, Homo sapiens
gtacatttctcccaacactaaa

SEQ ID NO: 7316431 - DNA, 23 bp, Homo sapiens
gtaaaatacgcagtgcagtgtga

SEQ ID NO: 7316432 - DNA, 22 bp, Homo sapiens
gtaccattgtttgaagtactca

SEQ ID NO: 7316433 - DNA, 22 bp, Homo sapiens
gtgcatttaggtcacatgatgt

SEQ ID NO: 7316434 - DNA, 22 bp, Homo sapiens
gtgcatatgtacctgtgatcat

SEQ ID NO: 7316435 - DNA, 22 bp, Homo sapiens
gtgcagttgatagttttagtga

SEQ ID NO: 7316436 - DNA, 22 bp, Homo sapiens
gtgcatactttattttaatact

SEQ ID NO: 7316437 - DNA, 22 bp, Homo sapiens
gtgcatatatgcacatatgtgt

SEQ ID NO: 7316438 - DNA, 22 bp, Homo sapiens
gtgcatttgtgcatgcacatgt

SEQ ID NO: 7316439 - DNA, 22 bp, Homo sapiens
gtgccaaggtgctaagggcatg

SEQ ID NO: 7316440 - DNA, 22 bp, Homo sapiens
gtgcaggtttaggaagcagctc

SEQ ID NO: 7316441 - DNA, 22 bp, Homo sapiens
gtgcaggtggatttgggctcaa

SEQ ID NO: 7316442 - DNA, 22 bp, Homo sapiens
gtgcagtgagcagtgcagcacc

SEQ ID NO: 7316443 - DNA, 22 bp, Homo sapiens
gtgcagtggcagatcctagctc

SEQ ID NO: 7316444 - DNA, 20 bp, Homo sapiens
gtgcagaggcagcctgtggg

SEQ ID NO: 7316445 - DNA, 22 bp, Homo sapiens
gtgcagagcaagggctgagggc

SEQ ID NO: 7316446 - DNA, 22 bp, Homo sapiens
gtgcacagagcccagggccgcg

SEQ ID NO: 7316447 - DNA, 23 bp, Homo sapiens
gtgcacagtcaagcccagcttag

SEQ ID NO: 7316448 - DNA, 21 bp, Homo sapiens
gtgcacagtcctgcacacagg

SEQ ID NO: 7316449 - DNA, 21 bp, Homo sapiens
gtgcacagtcctgcacacagg

SEQ ID NO: 7316450 - DNA, 22 bp, Homo sapiens
gtgcaccagtcacatgggcaga

SEQ ID NO: 7316451 - DNA, 22 bp, Homo sapiens
gtgacgtgaggggctcctgttg

SEQ ID NO: 7316452 - DNA, 22 bp, Homo sapiens
gtgactctcaaaagtgcagtct

SEQ ID NO: 7316453 - DNA, 22 bp, Homo sapiens
gtgactgtgagtcgctgtgaca

SEQ ID NO: 7316454 - DNA, 22 bp, Homo sapiens
gtgactgtgaactgtttctgat

SEQ ID NO: 7316455 - DNA, 22 bp, Homo sapiens
gtgagactcgcctttgtgtagc

SEQ ID NO: 7316456 - DNA, 22 bp, Homo sapiens
gtgagagaaattggagggaatg

SEQ ID NO: 7316457 - DNA, 22 bp, Homo sapiens
gtctgccctcacgccagctggg

SEQ ID NO: 7316458 - DNA, 22 bp, Homo sapiens
gtctgccctgcagacatgcctc

SEQ ID NO: 7316459 - DNA, 22 bp, Homo sapiens
gtctgcccttggcctgggactt

SEQ ID NO: 7316460 - DNA, 22 bp, Homo sapiens
gtctgcccggccttcctccacc

SEQ ID NO: 7316461 - DNA, 22 bp, Homo sapiens
gtcctggggatacagaagtgaa

SEQ ID NO: 7316462 - DNA, 22 bp, Homo sapiens
gtcctggggattatagagtgtt

SEQ ID NO: 7316463 - DNA, 22 bp, Homo sapiens
gtctgctgcagagcatggcttt

SEQ ID NO: 7316464 - DNA, 22 bp, Homo sapiens
gtctgctgacagagcatggacc

SEQ ID NO: 7316465 - DNA, 22 bp, Homo sapiens
gtctgctcatgctaccgcgggc

SEQ ID NO: 7316466 - DNA, 22 bp, Homo sapiens
gtctgcccttggctcagccata

SEQ ID NO: 7316467 - DNA, 22 bp, Homo sapiens
gtctgctttctgggaactcttt

SEQ ID NO: 7316468 - DNA, 22 bp, Homo sapiens
gtctggaggaggaagaaggcac

SEQ ID NO: 7316469 - DNA, 22 bp, Homo sapiens
gtctggaggaaaaggttaaatg

SEQ ID NO: 7316470 - DNA, 22 bp, Homo sapiens
gtgaaagacagcattaatggct

SEQ ID NO: 7316471 - DNA, 18 bp, Homo sapiens
gtgaaagagacagggcag

SEQ ID NO: 7316472 - DNA, 22 bp, Homo sapiens
gtgaaattgtatttggcattga

SEQ ID NO: 7316473 - DNA, 22 bp, Homo sapiens
gtgaaatgaatctggaaatatt

SEQ ID NO: 7316474 - DNA, 22 bp, Homo sapiens
gtctggagggtgggtagagacc

SEQ ID NO: 7316475 - DNA, 22 bp, Homo sapiens
gtgaccatcatctcagctagtt

SEQ ID NO: 7316476 - DNA, 22 bp, Homo sapiens
gtgaaggactagcatggagggc

SEQ ID NO: 7316477 - DNA, 22 bp, Homo sapiens
gtgaactgctgagttttatcat

SEQ ID NO: 7316478 - DNA, 22 bp, Homo sapiens
gtgaagatgcctcaggtgaccc

SEQ ID NO: 7316479 - DNA, 22 bp, Homo sapiens
gtgaagataaggatgctgcagt

SEQ ID NO: 7316480 - DNA, 21 bp, Homo sapiens
gcaaagtgtgggcataaacag

SEQ ID NO: 7316481 - DNA, 22 bp, Homo sapiens
gcaaagttcctactttactgga

SEQ ID NO: 7316482 - DNA, 22 bp, Homo sapiens
gcacacatatatatgagcatgt

SEQ ID NO: 7316483 - DNA, 22 bp, Homo sapiens
gcacacatatatatgagcatgt

SEQ ID NO: 7316484 - DNA, 20 bp, Homo sapiens
gcacacatagaaatgcatat

SEQ ID NO: 7316485 - DNA, 20 bp, Homo sapiens
gcacacatagaaatgcatat

SEQ ID NO: 7316486 - DNA, 19 bp, Homo sapiens
gcacacatacaccctttgg

SEQ ID NO: 7316487 - DNA, 19 bp, Homo sapiens
gcacacatacaccctttgg

SEQ ID NO: 7316488 - DNA, 22 bp, Homo sapiens
gcacacatgcatgtgtgcatcc

SEQ ID NO: 7316489 - DNA, 22 bp, Homo sapiens
gcacacatgcatgtgtgcatcc

SEQ ID NO: 7316490 - DNA, 22 bp, Homo sapiens
gcacacatcttgtaatcctgag

SEQ ID NO: 7316491 - DNA, 22 bp, Homo sapiens
gcacacatgcatgcacaggagt

SEQ ID NO: 7316492 - DNA, 22 bp, Homo sapiens
gcacacattcggattcttaacc

SEQ ID NO: 7316493 - DNA, 22 bp, Homo sapiens
gcacacatgcgtgtatatgggt

SEQ ID NO: 7316494 - DNA, 22 bp, Homo sapiens
gcacacatgtgagtgtcctttc

SEQ ID NO: 7316495 - DNA, 22 bp, Homo sapiens
gcaaatatttctaattcctgaa

SEQ ID NO: 7316496 - DNA, 22 bp, Homo sapiens
gcacagaacactggtgagtccc

SEQ ID NO: 7316497 - DNA, 22 bp, Homo sapiens
gcacacattctagccttttgtg

SEQ ID NO: 7316498 - DNA, 22 bp, Homo sapiens
gcagagggtcctgtgccagcag

SEQ ID NO: 7316499 - DNA, 22 bp, Homo sapiens
gcagaggcacagccccagatga

SEQ ID NO: 7316500 - DNA, 22 bp, Homo sapiens
gcagagcagtactctcttgact

SEQ ID NO: 7316501 - DNA, 22 bp, Homo sapiens
gcagagcagagcctgcattggc

SEQ ID NO: 7316502 - DNA, 22 bp, Homo sapiens
gcagagcagaggtgcaggttgg

SEQ ID NO: 7316503 - DNA, 19 bp, Homo sapiens
gcagacaggtccagagagg

SEQ ID NO: 7316504 - DNA, 22 bp, Homo sapiens
gcagacaggggcttaggaaagg

SEQ ID NO: 7316505 - DNA, 22 bp, Homo sapiens
gcacatgagctgctgggatggg

SEQ ID NO: 7316506 - DNA, 22 bp, Homo sapiens
gcagacatgggatctattcaca

SEQ ID NO: 7316507 - DNA, 22 bp, Homo sapiens
gcagagattggtgcactgatga

SEQ ID NO: 7316508 - DNA, 22 bp, Homo sapiens
gcagggacctgccactgctgtc

SEQ ID NO: 7316509 - DNA, 22 bp, Homo sapiens
gcagggaccagggccagatcca

SEQ ID NO: 7316510 - DNA, 21 bp, Homo sapiens
gcagggaccgcgacttctggg

SEQ ID NO: 7316511 - DNA, 18 bp, Homo sapiens
gcagggacacagggtcac

SEQ ID NO: 7316512 - DNA, 19 bp, Homo sapiens
gcaggcagctggggtatcc

SEQ ID NO: 7316513 - DNA, 22 bp, Homo sapiens
gcagggaagacccggagcagcg

SEQ ID NO: 7316514 - DNA, 22 bp, Homo sapiens
gcaggaagggaaaggttgactc

SEQ ID NO: 7316515 - DNA, 22 bp, Homo sapiens
gcaggaagccttaccaagccca

SEQ ID NO: 7316516 - DNA, 22 bp, Homo sapiens
gcaggaagcatagaagaatgcc

SEQ ID NO: 7316517 - DNA, 22 bp, Homo sapiens
gcaggaagaggctcgaagcccc

SEQ ID NO: 7316518 - DNA, 22 bp, Homo sapiens
gcagcctcaaactccccagctc

SEQ ID NO: 7316519 - DNA, 20 bp, Homo sapiens
gcagcctcaacaggcacagc

SEQ ID NO: 7316520 - DNA, 22 bp, Homo sapiens
gcagcctctgatgatggccgta

SEQ ID NO: 7316521 - DNA, 22 bp, Homo sapiens
gcagcccaggaggcgggagccc

SEQ ID NO: 7316522 - DNA, 22 bp, Homo sapiens
gcagcccaggaccctggacaga

SEQ ID NO: 7316523 - DNA, 22 bp, Homo sapiens
gcagcccaggctcgctcactgc

SEQ ID NO: 7316524 - DNA, 22 bp, Homo sapiens
gcagcccaggtctctctcactc

SEQ ID NO: 7316525 - DNA, 22 bp, Homo sapiens
gcagcccagagcgcaggacccc

SEQ ID NO: 7316526 - DNA, 22 bp, Homo sapiens
gcagccctgcagctccacaccg

SEQ ID NO: 7316527 - DNA, 22 bp, Homo sapiens
gcagccctcgctagctctcccc

SEQ ID NO: 7316528 - DNA, 22 bp, Homo sapiens
gcagatggtggaggcaagaggc

SEQ ID NO: 7316529 - DNA, 23 bp, Homo sapiens
gcagatggccccagagtgctgcc

SEQ ID NO: 7316530 - DNA, 22 bp, Homo sapiens
gcagatggcagcccaggctggg

SEQ ID NO: 7316531 - DNA, 22 bp, Homo sapiens
gcccagcacattgctgaggacc

SEQ ID NO: 7316532 - DNA, 22 bp, Homo sapiens
gcccagcacatctggccttgaa

SEQ ID NO: 7316533 - DNA, 22 bp, Homo sapiens
gccagggttgccaatgggggca

SEQ ID NO: 7316534 - DNA, 22 bp, Homo sapiens
gccagggttcgaatccgtatgg

SEQ ID NO: 7316535 - DNA, 22 bp, Homo sapiens
gccagggtgtgcagggacagga

SEQ ID NO: 7316536 - DNA, 22 bp, Homo sapiens
gccagggtgagggctgagaggt

SEQ ID NO: 7316537 - DNA, 22 bp, Homo sapiens
gcccagccctgaggtcacagct

SEQ ID NO: 7316538 - DNA, 22 bp, Homo sapiens
gcccagcagatctcagtgtctc

SEQ ID NO: 7316539 - DNA, 22 bp, Homo sapiens
gcccagcacctctctcagggtt

SEQ ID NO: 7316540 - DNA, 22 bp, Homo sapiens
gcccaggaagtgactcagatgt

SEQ ID NO: 7316541 - DNA, 22 bp, Homo sapiens
gcccaggaaatgccccgtggtg

SEQ ID NO: 7316542 - DNA, 22 bp, Homo sapiens
gcccaggagaggccagggctga

SEQ ID NO: 7316543 - DNA, 22 bp, Homo sapiens
gccccagccctgtggaccatgg

SEQ ID NO: 7316544 - DNA, 17 bp, Homo sapiens
gccctggagccaggcta

SEQ ID NO: 7316545 - DNA, 22 bp, Homo sapiens
gccctggatgtacaggcatgtt

SEQ ID NO: 7316546 - DNA, 22 bp, Homo sapiens
gccctgtggacagtgagaagtg

SEQ ID NO: 7316547 - DNA, 22 bp, Homo sapiens
gccctgtgcgactctagaggtt

SEQ ID NO: 7316548 - DNA, 22 bp, Homo sapiens
gcctcctggggtgccatcatct

SEQ ID NO: 7316549 - DNA, 22 bp, Homo sapiens
gcctcctggttgcttctccaac

SEQ ID NO: 7316550 - DNA, 22 bp, Homo sapiens
gcctcctgggttcatgccattc

SEQ ID NO: 7316551 - DNA, 22 bp, Homo sapiens
gcctctggagttgcttgtaaat

SEQ ID NO: 7316552 - DNA, 22 bp, Homo sapiens
gcctcctgcccagatgagtgat

SEQ ID NO: 7316553 - DNA, 22 bp, Homo sapiens
gcctcctggattttagtgccat

SEQ ID NO: 7316554 - DNA, 22 bp, Homo sapiens
gcctcctggaagtcacatgttt

SEQ ID NO: 7316555 - DNA, 22 bp, Homo sapiens
gcctcctggcctttgctcctca

SEQ ID NO: 7316556 - DNA, 22 bp, Homo sapiens
gcctcctgagaagccacaggct

SEQ ID NO: 7316557 - DNA, 22 bp, Homo sapiens
gcctcctgagtagctgggattg

SEQ ID NO: 7316558 - DNA, 23 bp, Homo sapiens
gcctcctagcagtaaacatgtta

SEQ ID NO: 7316559 - DNA, 22 bp, Homo sapiens
gcctcctcacaatgtacccacg

SEQ ID NO: 7316560 - DNA, 22 bp, Homo sapiens
gcctcctattaaaatttacctt

SEQ ID NO: 7316561 - DNA, 22 bp, Homo sapiens
gcctcctcttgagggtcaggga

SEQ ID NO: 7316562 - DNA, 22 bp, Homo sapiens
gcctcctgaaaggaagagctcc

SEQ ID NO: 7316563 - DNA, 22 bp, Homo sapiens
gcctcctgacttacactgagct

SEQ ID NO: 7316564 - DNA, 22 bp, Homo sapiens
gcctcctgaagtgctgggatta

SEQ ID NO: 7316565 - DNA, 22 bp, Homo sapiens
gcctccggagtcacagtgtctt

SEQ ID NO: 7316566 - DNA, 22 bp, Homo sapiens
gcctccggagtcacagtgtctt

SEQ ID NO: 7316567 - DNA, 22 bp, Homo sapiens
gcctccggagttgcagtgtctt

SEQ ID NO: 7316568 - DNA, 22 bp, Homo sapiens
gcctccggagttgcagtgtctt

SEQ ID NO: 7316569 - DNA, 22 bp, Homo sapiens
gcagtggatggccagcaggggc

SEQ ID NO: 7316570 - DNA, 22 bp, Homo sapiens
gcaggggagtggatgatggatt

SEQ ID NO: 7316571 - DNA, 22 bp, Homo sapiens
gcagtgacagacaactgtttga

SEQ ID NO: 7316572 - DNA, 22 bp, Homo sapiens
gcatgcagagaatacctgtgat

SEQ ID NO: 7316573 - DNA, 22 bp, Homo sapiens
gccaccagggggctccagtgag

SEQ ID NO: 7316574 - DNA, 22 bp, Homo sapiens
gcatggccttcagggacagctg

SEQ ID NO: 7316575 - DNA, 22 bp, Homo sapiens
gccagctcagatgcaggaagga

SEQ ID NO: 7316576 - DNA, 17 bp, Homo sapiens
gccagggagaggaagcc

SEQ ID NO: 7316577 - DNA, 22 bp, Homo sapiens
gccagggcaggggagcatctgc

SEQ ID NO: 7316578 - DNA, 22 bp, Homo sapiens
gctgagaatgttcctactggta

SEQ ID NO: 7316579 - DNA, 17 bp, Homo sapiens
gctgagaaggggaagag

SEQ ID NO: 7316580 - DNA, 22 bp, Homo sapiens
gctgagaatcaagatggagagg

SEQ ID NO: 7316581 - DNA, 22 bp, Homo sapiens
gctctggggttggaaagtgatc

SEQ ID NO: 7316582 - DNA, 22 bp, Homo sapiens
gctctgggccgggcaccagcct

SEQ ID NO: 7316583 - DNA, 20 bp, Homo sapiens
gctctgggagggatgtgatg

SEQ ID NO: 7316584 - DNA, 22 bp, Homo sapiens
gctgcctgttgaagggtctgtg

SEQ ID NO: 7316585 - DNA, 22 bp, Homo sapiens
gctgcctgtgtggccactcact

SEQ ID NO: 7316586 - DNA, 22 bp, Homo sapiens
gctgcctgtgcactttctcgta

SEQ ID NO: 7316587 - DNA, 19 bp, Homo sapiens
gctgcctgtcttagccagt

SEQ ID NO: 7316588 - DNA, 22 bp, Homo sapiens
gctgcctgtggcccttctgggt

SEQ ID NO: 7316589 - DNA, 22 bp, Homo sapiens
gctgcctgtggcccttctgggt

SEQ ID NO: 7316590 - DNA, 22 bp, Homo sapiens
gctgcctgtgcgggtcgctagg

SEQ ID NO: 7316591 - DNA, 22 bp, Homo sapiens
gctgcctgtctgtttcttttat

SEQ ID NO: 7316592 - DNA, 22 bp, Homo sapiens
gctgcctgtctgctgacccagg

SEQ ID NO: 7316593 - DNA, 20 bp, Homo sapiens
gctgcctgtttctgtaagta

SEQ ID NO: 7316594 - DNA, 18 bp, Homo sapiens
gctgcgtgggatgtgacc

SEQ ID NO: 7316595 - DNA, 22 bp, Homo sapiens
gctgctgttccggctacagccc

SEQ ID NO: 7316596 - DNA, 22 bp, Homo sapiens
gctgctgtgttggccactgctt

SEQ ID NO: 7316597 - DNA, 22 bp, Homo sapiens
gctgctgttcctccagtggatc

SEQ ID NO: 7316598 - DNA, 22 bp, Homo sapiens
gctgctgtgttggagagggact

SEQ ID NO: 7316599 - DNA, 22 bp, Homo sapiens
gctgctgtgttggccactgctt

SEQ ID NO: 7316600 - DNA, 22 bp, Homo sapiens
gctgctgttatgatgttacttt

SEQ ID NO: 7316601 - DNA, 22 bp, Homo sapiens
gctgctgtgttctcttgaccca

SEQ ID NO: 7316602 - DNA, 22 bp, Homo sapiens
gctgctgtgtgggagacaggcg

SEQ ID NO: 7316603 - DNA, 22 bp, Homo sapiens
gctgcttcctttcctgctgacc

SEQ ID NO: 7316604 - DNA, 22 bp, Homo sapiens
gctgcttcagggacgtgccagc

SEQ ID NO: 7316605 - DNA, 22 bp, Homo sapiens
gctgctgttgatttagtccaat

SEQ ID NO: 7316606 - DNA, 21 bp, Homo sapiens
gctgctgtgggccagggaggc

SEQ ID NO: 7316607 - DNA, 22 bp, Homo sapiens
gctgctgtggcagattggattc

SEQ ID NO: 7316608 - DNA, 22 bp, Homo sapiens
gctgctgtgcctggcgtcctgt

SEQ ID NO: 7316609 - DNA, 22 bp, Homo sapiens
gctgctgtgccccatctgcaga

SEQ ID NO: 7316610 - DNA, 22 bp, Homo sapiens
gctgctgtctggtctgagggct

SEQ ID NO: 7316611 - DNA, 22 bp, Homo sapiens
gctgctgtgaattttttaaatg

SEQ ID NO: 7316612 - DNA, 22 bp, Homo sapiens
gctgcctgtcctgaggagtccg

SEQ ID NO: 7316613 - DNA, 22 bp, Homo sapiens
gctgcctgtcctgaggagtccg

SEQ ID NO: 7316614 - DNA, 22 bp, Homo sapiens
gctccagtggatacagcagtgg

SEQ ID NO: 7316615 - DNA, 22 bp, Homo sapiens
gctcccaactcaggcctcctcc

SEQ ID NO: 7316616 - DNA, 23 bp, Homo sapiens
gctccctgtgctccaggagatgc

SEQ ID NO: 7316617 - DNA, 22 bp, Homo sapiens
gctccctgtctctggggtccat

SEQ ID NO: 7316618 - DNA, 21 bp, Homo sapiens
gctccctgctcagctcctggg

SEQ ID NO: 7316619 - DNA, 22 bp, Homo sapiens
gctccctgactcagttcctgag

SEQ ID NO: 7316620 - DNA, 22 bp, Homo sapiens
gcctctgtaggagtgagagcat

SEQ ID NO: 7316621 - DNA, 22 bp, Homo sapiens
gcctctgggttggtgacaggct

SEQ ID NO: 7316622 - DNA, 22 bp, Homo sapiens
gcgtattttagtctatgtgcat

SEQ ID NO: 7316623 - DNA, 22 bp, Homo sapiens
gcgtctcaaggcccccaggcca

SEQ ID NO: 7316624 - DNA, 23 bp, Homo sapiens
gcgtgcatgcatatcacatttcc

SEQ ID NO: 7316625 - DNA, 22 bp, Homo sapiens
gcgtgcatgcatgtatatgtgt

SEQ ID NO: 7316626 - DNA, 22 bp, Homo sapiens
gcgtgcatggccgtgtgtatgc

SEQ ID NO: 7316627 - DNA, 22 bp, Homo sapiens
gcgtgcatggccgtgtgtatgc

SEQ ID NO: 7316628 - DNA, 22 bp, Homo sapiens
gccttgtttcattacacgtggt

SEQ ID NO: 7316629 - DNA, 22 bp, Homo sapiens
ggaagatttcccgtagctgtgc

SEQ ID NO: 7316630 - DNA, 22 bp, Homo sapiens
ggaagagggaaccacgactgta

SEQ ID NO: 7316631 - DNA, 22 bp, Homo sapiens
ggaagcagcctgaagccaaggg

SEQ ID NO: 7316632 - DNA, 22 bp, Homo sapiens
ggaatctcagtggagctgttag

SEQ ID NO: 7316633 - DNA, 18 bp, Homo sapiens
ggaatgtggacaggctgg

SEQ ID NO: 7316634 - DNA, 22 bp, Homo sapiens
ggaatgtgctgacacgcgagag

SEQ ID NO: 7316635 - DNA, 22 bp, Homo sapiens
ggaatgtgcgtactcagtgtca

SEQ ID NO: 7316636 - DNA, 22 bp, Homo sapiens
ggaatgaagaaatagatggtgt

SEQ ID NO: 7316637 - DNA, 22 bp, Homo sapiens
ggaatgaaacacttctgattct

SEQ ID NO: 7316638 - DNA, 21 bp, Homo sapiens
ggaattgcaggctgtcttttg

SEQ ID NO: 7316639 - DNA, 22 bp, Homo sapiens
ggaattgctaacattctgaagg

SEQ ID NO: 7316640 - DNA, 20 bp, Homo sapiens
ggaattgctttcctgtcttt

SEQ ID NO: 7316641 - DNA, 22 bp, Homo sapiens
ggacaaaacttcttgcatttct

SEQ ID NO: 7316642 - DNA, 22 bp, Homo sapiens
ggacacagctgcagccacaccc

SEQ ID NO: 7316643 - DNA, 21 bp, Homo sapiens
gctttcagaagtctcatagtt

SEQ ID NO: 7316644 - DNA, 22 bp, Homo sapiens
gctttcagccactgtgtttctg

SEQ ID NO: 7316645 - DNA, 22 bp, Homo sapiens
gctttattttgtgagggattac

SEQ ID NO: 7316646 - DNA, 22 bp, Homo sapiens
gctttggaaataagaggctaaa

SEQ ID NO: 7316647 - DNA, 22 bp, Homo sapiens
ggaagacaagcagtggctgagc

SEQ ID NO: 7316648 - DNA, 22 bp, Homo sapiens
ggaagaagcagggcatttgaat

SEQ ID NO: 7316649 - DNA, 22 bp, Homo sapiens
ggaagaagcagggcatttgaat

SEQ ID NO: 7316650 - DNA, 17 bp, Homo sapiens
gctttggaagggtagac

SEQ ID NO: 7316651 - DNA, 22 bp, Homo sapiens
ggaagaggctgagccaggtccc

SEQ ID NO: 7316652 - DNA, 22 bp, Homo sapiens
ggagagaaattgaggtagcaag

SEQ ID NO: 7316653 - DNA, 22 bp, Homo sapiens
ggagagaactgacctgaaagga

SEQ ID NO: 7316654 - DNA, 22 bp, Homo sapiens
ggagagaattcagcttaagatt

SEQ ID NO: 7316655 - DNA, 22 bp, Homo sapiens
ggagagaattccatggacatgt

SEQ ID NO: 7316656 - DNA, 22 bp, Homo sapiens
ggagagaattcagcttaagatt

SEQ ID NO: 7316657 - DNA, 22 bp, Homo sapiens
ggagacccaggttaggaagtaa

SEQ ID NO: 7316658 - DNA, 22 bp, Homo sapiens
ggagaccaggtcagagatggtg

SEQ ID NO: 7316659 - DNA, 22 bp, Homo sapiens
ggagagagagctcattagctgc

SEQ ID NO: 7316660 - DNA, 22 bp, Homo sapiens
ggagccagaaatgctgtggttg

SEQ ID NO: 7316661 - DNA, 22 bp, Homo sapiens
ggagccagagcactggggagcc

SEQ ID NO: 7316662 - DNA, 20 bp, Homo sapiens
ggaccagctgtctgaggggc

SEQ ID NO: 7316663 - DNA, 19 bp, Homo sapiens
ggaccaggtcctgggcagc

SEQ ID NO: 7316664 - DNA, 22 bp, Homo sapiens
ggacacagtggaagacagcttg

SEQ ID NO: 7316665 - DNA, 22 bp, Homo sapiens
ggacacaggtaaataccactga

SEQ ID NO: 7316666 - DNA, 22 bp, Homo sapiens
ggacacaggtaaataccactga

SEQ ID NO: 7316667 - DNA, 22 bp, Homo sapiens
ggacacagggctcactctctct

SEQ ID NO: 7316668 - DNA, 23 bp, Homo sapiens
ggacacaggccttgtctgcgcct

SEQ ID NO: 7316669 - DNA, 22 bp, Homo sapiens
ggacagtgcgagacacagtaac

SEQ ID NO: 7316670 - DNA, 20 bp, Homo sapiens
ggacagtgagacatatctca

SEQ ID NO: 7316671 - DNA, 22 bp, Homo sapiens
gctgtgtatcagatgccacggg

SEQ ID NO: 7316672 - DNA, 22 bp, Homo sapiens
gctgtgtcagaaactctgggga

SEQ ID NO: 7316673 - DNA, 22 bp, Homo sapiens
gctgtgtgaccctagccagtag

SEQ ID NO: 7316674 - DNA, 22 bp, Homo sapiens
gcttgcatttggaatagattaa

SEQ ID NO: 7316675 - DNA, 22 bp, Homo sapiens
gcttgcattctggatctatggt

SEQ ID NO: 7316676 - DNA, 18 bp, Homo sapiens
gctttatttcttggggaa

SEQ ID NO: 7316677 - DNA, 22 bp, Homo sapiens
gctggggcctgaacagtcagct

SEQ ID NO: 7316678 - DNA, 22 bp, Homo sapiens
gctggggagggcgtcaaggcca

SEQ ID NO: 7316679 - DNA, 20 bp, Homo sapiens
gctgtgcctccagctggtgg

SEQ ID NO: 7316680 - DNA, 22 bp, Homo sapiens
gctggggctgggctgaggaaga

SEQ ID NO: 7316681 - DNA, 19 bp, Homo sapiens
gctggggcctgaccagaca

SEQ ID NO: 7316682 - DNA, 22 bp, Homo sapiens
gctgtggcttgcagctggggct

SEQ ID NO: 7316683 - DNA, 22 bp, Homo sapiens
gctgtggctgtacagagaccat

SEQ ID NO: 7316684 - DNA, 22 bp, Homo sapiens
gctgtggctttctgtttctgtt

SEQ ID NO: 7316685 - DNA, 22 bp, Homo sapiens
gctgtggctccaatggtgagcc

SEQ ID NO: 7316686 - DNA, 22 bp, Homo sapiens
gctgtggctgacattgcagaca

SEQ ID NO: 7316687 - DNA, 22 bp, Homo sapiens
gctgtggctgaagatgcaggga

SEQ ID NO: 7316688 - DNA, 22 bp, Homo sapiens
tccaggagtcagacagatggtg

SEQ ID NO: 7316689 - DNA, 22 bp, Homo sapiens
tccaggagggggagccgtgccg

SEQ ID NO: 7316690 - DNA, 22 bp, Homo sapiens
tccaggagtggggcagaggtct

SEQ ID NO: 7316691 - DNA, 22 bp, Homo sapiens
tccaggccacgacctcctggat

SEQ ID NO: 7316692 - DNA, 22 bp, Homo sapiens
tccaggccacatggatggcgat

SEQ ID NO: 7316693 - DNA, 22 bp, Homo sapiens
tccaggccaatgtagcaggccc

SEQ ID NO: 7316694 - DNA, 22 bp, Homo sapiens
tccaggccaatgtagcaggccc

SEQ ID NO: 7316695 - DNA, 22 bp, Homo sapiens
tccaggccactgcagaggctct

SEQ ID NO: 7316696 - DNA, 22 bp, Homo sapiens
tccaggctaggtttacaggaca

SEQ ID NO: 7316697 - DNA, 22 bp, Homo sapiens
tccaggctcagcacttgctact

SEQ ID NO: 7316698 - DNA, 22 bp, Homo sapiens
tccaggctctaggctgctctcc

SEQ ID NO: 7316699 - DNA, 22 bp, Homo sapiens
tccaggctctaggctgctctcc

SEQ ID NO: 7316700 - DNA, 22 bp, Homo sapiens
tccaggctctaggctgctctcc

SEQ ID NO: 7316701 - DNA, 22 bp, Homo sapiens
tccaggctcagcacttgctact

SEQ ID NO: 7316702 - DNA, 22 bp, Homo sapiens
tccaggctcctgactttttggg

SEQ ID NO: 7316703 - DNA, 19 bp, Homo sapiens
tccaggctgagagtcagct

SEQ ID NO: 7316704 - DNA, 22 bp, Homo sapiens
tccaggctgatccatgaagaat

SEQ ID NO: 7316705 - DNA, 21 bp, Homo sapiens
tccaggctgatgatgtcaact

SEQ ID NO: 7316706 - DNA, 22 bp, Homo sapiens
tccaggctgacgcagctattta

SEQ ID NO: 7316707 - DNA, 23 bp, Homo sapiens
tccaggctgaaggagcagatttt

SEQ ID NO: 7316708 - DNA, 22 bp, Homo sapiens
tccaggctctcaggtgtcagca

SEQ ID NO: 7316709 - DNA, 22 bp, Homo sapiens
tccagttgcctgtctctgatta

SEQ ID NO: 7316710 - DNA, 22 bp, Homo sapiens
tccagttgtttgtattaactct

SEQ ID NO: 7316711 - DNA, 22 bp, Homo sapiens
tccagggctccccaacatccag

SEQ ID NO: 7316712 - DNA, 22 bp, Homo sapiens
tccaggctgcagtcttgccctc

SEQ ID NO: 7316713 - DNA, 22 bp, Homo sapiens
tccaggctgcagtcttgccctc

SEQ ID NO: 7316714 - DNA, 22 bp, Homo sapiens
tccaggctgcaaggccacaggg

SEQ ID NO: 7316715 - DNA, 22 bp, Homo sapiens
tccaggctgccacagtgcaacg

SEQ ID NO: 7316716 - DNA, 22 bp, Homo sapiens
tccaggctggaaatgtcaaact

SEQ ID NO: 7316717 - DNA, 20 bp, Homo sapiens
tcccaaggatgcctgggtgt

SEQ ID NO: 7316718 - DNA, 22 bp, Homo sapiens
tccagcagtgctcaggactcac

SEQ ID NO: 7316719 - DNA, 16 bp, Homo sapiens
tccagcagtctctgta

SEQ ID NO: 7316720 - DNA, 22 bp, Homo sapiens
tccagcctttctactcactgag

SEQ ID NO: 7316721 - DNA, 22 bp, Homo sapiens
tccagctcacagatagcgtggg

SEQ ID NO: 7316722 - DNA, 22 bp, Homo sapiens
tccagctcagatgcagggatca

SEQ ID NO: 7316723 - DNA, 22 bp, Homo sapiens
tccagctcatctgtctccatta

SEQ ID NO: 7316724 - DNA, 22 bp, Homo sapiens
tccagctccacagcctccctgt

SEQ ID NO: 7316725 - DNA, 22 bp, Homo sapiens
tccagctcctgagttcactgct

SEQ ID NO: 7316726 - DNA, 21 bp, Homo sapiens
tccagctcctgccactcctta

SEQ ID NO: 7316727 - DNA, 22 bp, Homo sapiens
tccagctctaacatgctgggcc

SEQ ID NO: 7316728 - DNA, 22 bp, Homo sapiens
tccagctctgattctcactagc

SEQ ID NO: 7316729 - DNA, 22 bp, Homo sapiens
tccagctctgcttcacagtctc

SEQ ID NO: 7316730 - DNA, 22 bp, Homo sapiens
tccagctctggcttggctagct

SEQ ID NO: 7316731 - DNA, 22 bp, Homo sapiens
tccagctgtactttgtcctggc

SEQ ID NO: 7316732 - DNA, 20 bp, Homo sapiens
tccagctgtctttcagagac

SEQ ID NO: 7316733 - DNA, 22 bp, Homo sapiens
tccagctgtgctccaggaggtg

SEQ ID NO: 7316734 - DNA, 22 bp, Homo sapiens
tccaggagggattgggctgtgg

SEQ ID NO: 7316735 - DNA, 22 bp, Homo sapiens
tccagagatcacactgggcagg

SEQ ID NO: 7316736 - DNA, 22 bp, Homo sapiens
tccagagctaattcagcagctg

SEQ ID NO: 7316737 - DNA, 22 bp, Homo sapiens
tccagagaggtttctccatgct

SEQ ID NO: 7316738 - DNA, 23 bp, Homo sapiens
tcattgatcttgtcagagcattt

SEQ ID NO: 7316739 - DNA, 22 bp, Homo sapiens
tccagcagactcatcagcaagg

SEQ ID NO: 7316740 - DNA, 22 bp, Homo sapiens
tccagcagagtctctgaggggg

SEQ ID NO: 7316741 - DNA, 22 bp, Homo sapiens
tccagcaggtccgagacaagtt

SEQ ID NO: 7316742 - DNA, 22 bp, Homo sapiens
tccagagctgagcagtcattct

SEQ ID NO: 7316743 - DNA, 22 bp, Homo sapiens
tccagcagaccatcaaggctca

SEQ ID NO: 7316744 - DNA, 22 bp, Homo sapiens
tccagagggcgatggctggggg

SEQ ID NO: 7316745 - DNA, 20 bp, Homo sapiens
tccagaggccacatccagtg

SEQ ID NO: 7316746 - DNA, 22 bp, Homo sapiens
tccccactcaccactggccaaa

SEQ ID NO: 7316747 - DNA, 22 bp, Homo sapiens
tccccaggaaattctgattctt

SEQ ID NO: 7316748 - DNA, 22 bp, Homo sapiens
tccccaggaaggcccttcctgg

SEQ ID NO: 7316749 - DNA, 22 bp, Homo sapiens
tccccaggaatcaggtggttgc

SEQ ID NO: 7316750 - DNA, 22 bp, Homo sapiens
tccccaggactaagttgcaatc

SEQ ID NO: 7316751 - DNA, 20 bp, Homo sapiens
tccccagggcatcaggagca

SEQ ID NO: 7316752 - DNA, 22 bp, Homo sapiens
tccccagggctgcagagggtgt

SEQ ID NO: 7316753 - DNA, 22 bp, Homo sapiens
tccccaggagcaatgattcagt

SEQ ID NO: 7316754 - DNA, 22 bp, Homo sapiens
tccccaggggcatctctctgct

SEQ ID NO: 7316755 - DNA, 22 bp, Homo sapiens
tccccaggggcctgggcacagt

SEQ ID NO: 7316756 - DNA, 22 bp, Homo sapiens
tccccagggtccctgcttccat

SEQ ID NO: 7316757 - DNA, 22 bp, Homo sapiens
tcccatatatgtttatattgga

SEQ ID NO: 7316758 - DNA, 22 bp, Homo sapiens
tcccaggtgatgctgaggccac

SEQ ID NO: 7316759 - DNA, 22 bp, Homo sapiens
tcagagcagactttgaaggagg

SEQ ID NO: 7316760 - DNA, 22 bp, Homo sapiens
tcagagcttcacctgttacatt

SEQ ID NO: 7316761 - DNA, 22 bp, Homo sapiens
tcagcaatcctcccacaggtgg

SEQ ID NO: 7316762 - DNA, 22 bp, Homo sapiens
tcagaggaacactgtttcatgc

SEQ ID NO: 7316763 - DNA, 22 bp, Homo sapiens
tcagaggaaaggtcagatggct

SEQ ID NO: 7316764 - DNA, 22 bp, Homo sapiens
tcacttttgatccctatgcagt

SEQ ID NO: 7316765 - DNA, 22 bp, Homo sapiens
tcactttttgatatcattctgc

SEQ ID NO: 7316766 - DNA, 22 bp, Homo sapiens
tcagaaaagagaaaatcttata

SEQ ID NO: 7316767 - DNA, 22 bp, Homo sapiens
tcagacagattttgacacttgc

SEQ ID NO: 7316768 - DNA, 22 bp, Homo sapiens
tcagacagcttgggataactga

SEQ ID NO: 7316769 - DNA, 22 bp, Homo sapiens
tcagacagcttgcagggaggtg

SEQ ID NO: 7316770 - DNA, 22 bp, Homo sapiens
tcagacaggcctctccagcctc

SEQ ID NO: 7316771 - DNA, 22 bp, Homo sapiens
tcagacaggctggacagcttgc

SEQ ID NO: 7316772 - DNA, 22 bp, Homo sapiens
tcagacaggcttctttctccct

SEQ ID NO: 7316773 - DNA, 22 bp, Homo sapiens
tcagacagggagtcagaaaata

SEQ ID NO: 7316774 - DNA, 22 bp, Homo sapiens
tcagacagggcttctcaaactt

SEQ ID NO: 7316775 - DNA, 22 bp, Homo sapiens
tcagacagtcatcagagcttgt

SEQ ID NO: 7316776 - DNA, 22 bp, Homo sapiens
tcagacagtcatcagagcttgt

SEQ ID NO: 7316777 - DNA, 20 bp, Homo sapiens
tcagacagtcgcagttctgg

SEQ ID NO: 7316778 - DNA, 22 bp, Homo sapiens
tcagacagtgtgatcagtctct

SEQ ID NO: 7316779 - DNA, 22 bp, Homo sapiens
tcagacagtgtgatcagtctct

SEQ ID NO: 7316780 - DNA, 22 bp, Homo sapiens
tcagacagtttgcagtgtgcct

SEQ ID NO: 7316781 - DNA, 22 bp, Homo sapiens
tcagacatctcataatgtatta

SEQ ID NO: 7316782 - DNA, 19 bp, Homo sapiens
tcacttgaagttcagaaat

SEQ ID NO: 7316783 - DNA, 22 bp, Homo sapiens
tcactttggaagatagcacatc

SEQ ID NO: 7316784 - DNA, 22 bp, Homo sapiens
tcactttaatgatttgtagaat

SEQ ID NO: 7316785 - DNA, 22 bp, Homo sapiens
tcactgtgcacatatgataggt

SEQ ID NO: 7316786 - DNA, 22 bp, Homo sapiens
tcactctttatcttttatgtct

SEQ ID NO: 7316787 - DNA, 22 bp, Homo sapiens
tcactctgttttactcactgtt

SEQ ID NO: 7316788 - DNA, 22 bp, Homo sapiens
tcacccaggatattgaagtcag

SEQ ID NO: 7316789 - DNA, 22 bp, Homo sapiens
tcactagtcgcggggggaggta

SEQ ID NO: 7316790 - DNA, 22 bp, Homo sapiens
tcactagtggtttctggtggtt

SEQ ID NO: 7316791 - DNA, 22 bp, Homo sapiens
tcactagtggaatctgggagca

SEQ ID NO: 7316792 - DNA, 22 bp, Homo sapiens
tcactactgtggaacaactgat

SEQ ID NO: 7316793 - DNA, 22 bp, Homo sapiens
tcactactgacagagatgtgta

SEQ ID NO: 7316794 - DNA, 22 bp, Homo sapiens
tcactacattttagacagtaaa

SEQ ID NO: 7316795 - DNA, 22 bp, Homo sapiens
tcactagcattgttgaaggact

SEQ ID NO: 7316796 - DNA, 22 bp, Homo sapiens
tcaccagatctctctgtaatgg

SEQ ID NO: 7316797 - DNA, 23 bp, Homo sapiens
tcaccagaaggggtcaataaaga

SEQ ID NO: 7316798 - DNA, 22 bp, Homo sapiens
tcacattttcatattctctgag

SEQ ID NO: 7316799 - DNA, 22 bp, Homo sapiens
tcacattttccttggtatctgt

SEQ ID NO: 7316800 - DNA, 22 bp, Homo sapiens
tcacattttcttaggaaactta

SEQ ID NO: 7316801 - DNA, 22 bp, Homo sapiens
tcacattttctactactgtacg

SEQ ID NO: 7316802 - DNA, 22 bp, Homo sapiens
tcacattttgttcaaggctagt

SEQ ID NO: 7316803 - DNA, 22 bp, Homo sapiens
tcacattttgttcaaggctagt

SEQ ID NO: 7316804 - DNA, 20 bp, Homo sapiens
tcacacatggtaagctatga

SEQ ID NO: 7316805 - DNA, 22 bp, Homo sapiens
tcacacatgctaagccagagat

SEQ ID NO: 7316806 - DNA, 20 bp, Homo sapiens
tcacagaaacaaatagagaa

SEQ ID NO: 7316807 - DNA, 22 bp, Homo sapiens
tcacacatgagtaaatacaggg

SEQ ID NO: 7316808 - DNA, 22 bp, Homo sapiens
tcacacatgagtaaatacaggg

SEQ ID NO: 7316809 - DNA, 22 bp, Homo sapiens
tcacagaaataagatagttatt

SEQ ID NO: 7316810 - DNA, 22 bp, Homo sapiens
tcacagaaataagatagttatt

SEQ ID NO: 7316811 - DNA, 22 bp, Homo sapiens
tcacaaagctttgataagcaga

SEQ ID NO: 7316812 - DNA, 22 bp, Homo sapiens
tcacaaaagcttttgaatttgg

SEQ ID NO: 7316813 - DNA, 22 bp, Homo sapiens
tcacaggctctccaccatgagg

SEQ ID NO: 7316814 - DNA, 22 bp, Homo sapiens
tcacaggcttgtgaacattgca

SEQ ID NO: 7316815 - DNA, 22 bp, Homo sapiens
tcacaggctctagggattaaga

SEQ ID NO: 7316816 - DNA, 22 bp, Homo sapiens
tcacagggtatctgggatggat

SEQ ID NO: 7316817 - DNA, 20 bp, Homo sapiens
tcacaggggaccaggagcag

SEQ ID NO: 7316818 - DNA, 22 bp, Homo sapiens
tcacagaaggcatcacagaaga

SEQ ID NO: 7316819 - DNA, 22 bp, Homo sapiens
tcaagtttctctcagattatgg

SEQ ID NO: 7316820 - DNA, 22 bp, Homo sapiens
tcaatttatgtggctattcatt

SEQ ID NO: 7316821 - DNA, 22 bp, Homo sapiens
tcaagtatttatttctgctggc

SEQ ID NO: 7316822 - DNA, 22 bp, Homo sapiens
tcaagtattatattctcatttt

SEQ ID NO: 7316823 - DNA, 22 bp, Homo sapiens
tcaaggttcaaggctggcttct

SEQ ID NO: 7316824 - DNA, 22 bp, Homo sapiens
tcaaggaggtgcttggcttcac

SEQ ID NO: 7316825 - DNA, 20 bp, Homo sapiens
tatttctgggcaaccattta

SEQ ID NO: 7316826 - DNA, 22 bp, Homo sapiens
tatttctgattgctcatgaggc

SEQ ID NO: 7316827 - DNA, 22 bp, Homo sapiens
tatttctgtttatttgtacatc

SEQ ID NO: 7316828 - DNA, 22 bp, Homo sapiens
tatttctgtttatttgtacatc

SEQ ID NO: 7316829 - DNA, 22 bp, Homo sapiens
tatttcttgagtggtcagtttc

SEQ ID NO: 7316830 - DNA, 22 bp, Homo sapiens
tatttcttgagactcgtcttcc

SEQ ID NO: 7316831 - DNA, 22 bp, Homo sapiens
tatttcttcgggattcaagcta

SEQ ID NO: 7316832 - DNA, 22 bp, Homo sapiens
tatttcttcgggattcaagcta

SEQ ID NO: 7316833 - DNA, 22 bp, Homo sapiens
tcaagctggctgttgctatttc

SEQ ID NO: 7316834 - DNA, 22 bp, Homo sapiens
tcaagacagatgggtaacttgg

SEQ ID NO: 7316835 - DNA, 21 bp, Homo sapiens
tcaagacagcatatttaagaa

SEQ ID NO: 7316836 - DNA, 22 bp, Homo sapiens
tcaagacatattaaatgtgcga

SEQ ID NO: 7316837 - DNA, 22 bp, Homo sapiens
tcaagacatcactgtgcatttt

SEQ ID NO: 7316838 - DNA, 22 bp, Homo sapiens
tcaggccttgtcctgacctcct

SEQ ID NO: 7316839 - DNA, 22 bp, Homo sapiens
tcaggcatggctcttcctcagg

SEQ ID NO: 7316840 - DNA, 22 bp, Homo sapiens
tcaggaaggcgccccatcagga

SEQ ID NO: 7316841 - DNA, 22 bp, Homo sapiens
tcaggaaggcacttggtgtgtt

SEQ ID NO: 7316842 - DNA, 22 bp, Homo sapiens
tcaggaagaagacggggcagga

SEQ ID NO: 7316843 - DNA, 22 bp, Homo sapiens
tcaggaagaaagaagggagtgt

SEQ ID NO: 7316844 - DNA, 22 bp, Homo sapiens
tcagctctgcaaggtcacctcc

SEQ ID NO: 7316845 - DNA, 22 bp, Homo sapiens
tcaggaagctactgccagcagc

SEQ ID NO: 7316846 - DNA, 22 bp, Homo sapiens
tcaggaagctcttgctgattct

SEQ ID NO: 7316847 - DNA, 22 bp, Homo sapiens
tcaggaagcatcctgaggtgtc

SEQ ID NO: 7316848 - DNA, 22 bp, Homo sapiens
tcagctccatccctgcttttgc

SEQ ID NO: 7316849 - DNA, 22 bp, Homo sapiens
tcagctcctatactttgtcctg

SEQ ID NO: 7316850 - DNA, 22 bp, Homo sapiens
tcagcctggtgattcctctgtc

SEQ ID NO: 7316851 - DNA, 22 bp, Homo sapiens
tcagctccacagctcctctgcc

SEQ ID NO: 7316852 - DNA, 22 bp, Homo sapiens
tcagcagaaaggcactagatga

SEQ ID NO: 7316853 - DNA, 21 bp, Homo sapiens
tcagcagaaggaccactaggg

SEQ ID NO: 7316854 - DNA, 22 bp, Homo sapiens
tcagcctgctccaagtgctgcc

SEQ ID NO: 7316855 - DNA, 22 bp, Homo sapiens
tcatatttaggcctttaattca

SEQ ID NO: 7316856 - DNA, 22 bp, Homo sapiens
tcatatttaggcctttaattca

SEQ ID NO: 7316857 - DNA, 22 bp, Homo sapiens
tcatattagggtaatgataaga

SEQ ID NO: 7316858 - DNA, 22 bp, Homo sapiens
tcatattagggtaatgataaga

SEQ ID NO: 7316859 - DNA, 21 bp, Homo sapiens
tcatatttctcttgctattgt

SEQ ID NO: 7316860 - DNA, 22 bp, Homo sapiens
tcatatttatatgttggcacag

SEQ ID NO: 7316861 - DNA, 22 bp, Homo sapiens
tcatatttatatgttggcacag

SEQ ID NO: 7316862 - DNA, 21 bp, Homo sapiens
tcatatttctcttgctattgt

SEQ ID NO: 7316863 - DNA, 22 bp, Homo sapiens
tcagtgttattagatgaggttt

SEQ ID NO: 7316864 - DNA, 22 bp, Homo sapiens
tcatagttatggagattaagga

SEQ ID NO: 7316865 - DNA, 22 bp, Homo sapiens
tcatatactgccttgtagatta

SEQ ID NO: 7316866 - DNA, 22 bp, Homo sapiens
tcatatacctgcatgtgcatgt

SEQ ID NO: 7316867 - DNA, 22 bp, Homo sapiens
tcatataccagagagtttatat

SEQ ID NO: 7316868 - DNA, 21 bp, Homo sapiens
tcatatattccagctgcagct

SEQ ID NO: 7316869 - DNA, 22 bp, Homo sapiens
tcatatattttggcagtgatca

SEQ ID NO: 7316870 - DNA, 22 bp, Homo sapiens
tcatatgcatatgaaatttttg

SEQ ID NO: 7316871 - DNA, 20 bp, Homo sapiens
tcatatgtggttgtatacaa

SEQ ID NO: 7316872 - DNA, 22 bp, Homo sapiens
tcattatttgctttagttatgt

SEQ ID NO: 7316873 - DNA, 22 bp, Homo sapiens
tcattcactttgaaataaacga

SEQ ID NO: 7316874 - DNA, 22 bp, Homo sapiens
tcattatagagttgtattttag

SEQ ID NO: 7316875 - DNA, 22 bp, Homo sapiens
tcattactttttttgtgtctac

SEQ ID NO: 7316876 - DNA, 22 bp, Homo sapiens
tcattagaaatgcagattctca

SEQ ID NO: 7316877 - DNA, 22 bp, Homo sapiens
tcattagataactccaccattt

SEQ ID NO: 7316878 - DNA, 20 bp, Homo sapiens
tcattacagtgctaagatgt

SEQ ID NO: 7316879 - DNA, 22 bp, Homo sapiens
tcatggccaaagtcaggagtgt

SEQ ID NO: 7316880 - DNA, 21 bp, Homo sapiens
tcatggccagcaagtggcaga

SEQ ID NO: 7316881 - DNA, 21 bp, Homo sapiens
tcatggccagcaagtggcaga

SEQ ID NO: 7316882 - DNA, 22 bp, Homo sapiens
tcatggccaaagtcaggagtgt

SEQ ID NO: 7316883 - DNA, 22 bp, Homo sapiens
tcatggcacatgccctccaggg

SEQ ID NO: 7316884 - DNA, 20 bp, Homo sapiens
tcatggaatctcactctagt

SEQ ID NO: 7316885 - DNA, 22 bp, Homo sapiens
tcatggaaacagcaatgctaat

SEQ ID NO: 7316886 - DNA, 22 bp, Homo sapiens
tcagtcttccctccagtgcaac

SEQ ID NO: 7316887 - DNA, 22 bp, Homo sapiens
tcagtctttccctccctcagtt

SEQ ID NO: 7316888 - DNA, 22 bp, Homo sapiens
tcagtgactgggtattaaatca

SEQ ID NO: 7316889 - DNA, 22 bp, Homo sapiens
tcagtgacaactatgaatattt

SEQ ID NO: 7316890 - DNA, 22 bp, Homo sapiens
tcagtgtaagttatgtagatgt

SEQ ID NO: 7316891 - DNA, 21 bp, Homo sapiens
tcagtgtatttaagaatgttg

SEQ ID NO: 7316892 - DNA, 22 bp, Homo sapiens
tcagtgtgttattctactttca

SEQ ID NO: 7316893 - DNA, 22 bp, Homo sapiens
gtgctctcctggctgccctgac

SEQ ID NO: 7316894 - DNA, 22 bp, Homo sapiens
gtgctctccagccccacgtgga

SEQ ID NO: 7316895 - DNA, 22 bp, Homo sapiens
gtgctctgagtttgcatgtcag

SEQ ID NO: 7316896 - DNA, 22 bp, Homo sapiens
gtgctctgatctgtctgacatc

SEQ ID NO: 7316897 - DNA, 22 bp, Homo sapiens
gtgctcagcccggatgagatca

SEQ ID NO: 7316898 - DNA, 22 bp, Homo sapiens
gtgctccctccttcctcaagga

SEQ ID NO: 7316899 - DNA, 22 bp, Homo sapiens
gtgtgcatgtggaagcatgtat

SEQ ID NO: 7316900 - DNA, 22 bp, Homo sapiens
gtgtgcatgtgcttgcacagat

SEQ ID NO: 7316901 - DNA, 22 bp, Homo sapiens
gtgtgccaccactgacaggatt

SEQ ID NO: 7316902 - DNA, 18 bp, Homo sapiens
gtgtgcagttgcaggggt

SEQ ID NO: 7316903 - DNA, 22 bp, Homo sapiens
gtgtgcatatgtgtggctctcc

SEQ ID NO: 7316904 - DNA, 22 bp, Homo sapiens
gtgtgcatatgtgtggctctcc

SEQ ID NO: 7316905 - DNA, 22 bp, Homo sapiens
gttaatgtgatataaagtattt

SEQ ID NO: 7316906 - DNA, 22 bp, Homo sapiens
gtgtgcctcccattagggtgta

SEQ ID NO: 7316907 - DNA, 22 bp, Homo sapiens
gtgtgcctcccattagggtgta

SEQ ID NO: 7316908 - DNA, 23 bp, Homo sapiens
gtgtgcctttatcttctgtactc

SEQ ID NO: 7316909 - DNA, 22 bp, Homo sapiens
gtgtggccttgggagaggtctg

SEQ ID NO: 7316910 - DNA, 22 bp, Homo sapiens
gttaagaagctagagatgaaca

SEQ ID NO: 7316911 - DNA, 22 bp, Homo sapiens
gtgtgggaaggctaggatgctg

SEQ ID NO: 7316912 - DNA, 22 bp, Homo sapiens
gtgtgggacgggtgagtggcca

SEQ ID NO: 7316913 - DNA, 22 bp, Homo sapiens
gtgtgggaatggcggtcgtgca

SEQ ID NO: 7316914 - DNA, 22 bp, Homo sapiens
gttcacatgtgttatcttcttt

SEQ ID NO: 7316915 - DNA, 22 bp, Homo sapiens
gttcacatggcattttcacatc

SEQ ID NO: 7316916 - DNA, 22 bp, Homo sapiens
gttcacaaagtactgtatgcat

SEQ ID NO: 7316917 - DNA, 22 bp, Homo sapiens
gttcacatgctctcatgctttt

SEQ ID NO: 7316918 - DNA, 22 bp, Homo sapiens
gttcataatttgaaggaatagg

SEQ ID NO: 7316919 - DNA, 19 bp, Homo sapiens
gttcattgttcaggaaaat

SEQ ID NO: 7316920 - DNA, 20 bp, Homo sapiens
gttcatgtctcaaatagaaa

SEQ ID NO: 7316921 - DNA, 22 bp, Homo sapiens
gttgggaaggcaagaagtagaa

SEQ ID NO: 7316922 - DNA, 22 bp, Homo sapiens
gttgggaagtatccccaaagtt

SEQ ID NO: 7316923 - DNA, 22 bp, Homo sapiens
gttgggaagtgtagctccacct

SEQ ID NO: 7316924 - DNA, 22 bp, Homo sapiens
gttgggaagtgtagctccacct

SEQ ID NO: 7316925 - DNA, 22 bp, Homo sapiens
gttgctcaggcaggagtacagt

SEQ ID NO: 7316926 - DNA, 22 bp, Homo sapiens
gttggggaaggtgggagaatgt

SEQ ID NO: 7316927 - DNA, 22 bp, Homo sapiens
gttggtcatatcattgaagctt

SEQ ID NO: 7316928 - DNA, 19 bp, Homo sapiens
gttggtcattctacacaac

SEQ ID NO: 7316929 - DNA, 20 bp, Homo sapiens
gttggtcactttgagcagga

SEQ ID NO: 7316930 - DNA, 22 bp, Homo sapiens
gttggtcaaggacagaggttca

SEQ ID NO: 7316931 - DNA, 22 bp, Homo sapiens
gttggtcaggatggtctcaaac

SEQ ID NO: 7316932 - DNA, 22 bp, Homo sapiens
gttgcagatgtggaactcgtgc

SEQ ID NO: 7316933 - DNA, 22 bp, Homo sapiens
taaattaaagattggagaagga

SEQ ID NO: 7316934 - DNA, 20 bp, Homo sapiens
taaattagccttgaagatta

SEQ ID NO: 7316935 - DNA, 22 bp, Homo sapiens
taaattagagccaggtaagttt

SEQ ID NO: 7316936 - DNA, 22 bp, Homo sapiens
taaattactcaatgcacataaa

SEQ ID NO: 7316937 - DNA, 20 bp, Homo sapiens
taaattagccttgaagatta

SEQ ID NO: 7316938 - DNA, 22 bp, Homo sapiens
taaattcagtgagtaatttctg

SEQ ID NO: 7316939 - DNA, 22 bp, Homo sapiens
taaattctacaacttcaaagat

SEQ ID NO: 7316940 - DNA, 22 bp, Homo sapiens
taaatttacccaaggaacatgt

SEQ ID NO: 7316941 - DNA, 22 bp, Homo sapiens
taaattgcataagtacaaatga

SEQ ID NO: 7316942 - DNA, 22 bp, Homo sapiens
taaattgctgattttagatgct

SEQ ID NO: 7316943 - DNA, 22 bp, Homo sapiens
taaatttttgttaacagcctct

SEQ ID NO: 7316944 - DNA, 23 bp, Homo sapiens
taaatttcttgattcttatgtga

SEQ ID NO: 7316945 - DNA, 22 bp, Homo sapiens
taacattacggacatctgtcag

SEQ ID NO: 7316946 - DNA, 22 bp, Homo sapiens
taactgaatgtattacaacaga

SEQ ID NO: 7316947 - DNA, 22 bp, Homo sapiens
taactgaatgtattacaacaga

SEQ ID NO: 7316948 - DNA, 22 bp, Homo sapiens
taactgaacagcctaattcttt

SEQ ID NO: 7316949 - DNA, 22 bp, Homo sapiens
taactgaacatctcaaatcaag

SEQ ID NO: 7316950 - DNA, 22 bp, Homo sapiens
taactgaacatctcaaatcaag

SEQ ID NO: 7316951 - DNA, 22 bp, Homo sapiens
taactcttccaacactccttcc

SEQ ID NO: 7316952 - DNA, 22 bp, Homo sapiens
taactagatatagactttctac

SEQ ID NO: 7316953 - DNA, 22 bp, Homo sapiens
taaacaagctgtctgatattct

SEQ ID NO: 7316954 - DNA, 22 bp, Homo sapiens
taaacaagctgtctgatattct

SEQ ID NO: 7316955 - DNA, 22 bp, Homo sapiens
taaacaagaaacattttctgtt

SEQ ID NO: 7316956 - DNA, 22 bp, Homo sapiens
taaacaattcctctctaggcat

SEQ ID NO: 7316957 - DNA, 22 bp, Homo sapiens
taaagggtaggttttactgtaa

SEQ ID NO: 7316958 - DNA, 22 bp, Homo sapiens
taaagggtaggttttactgtaa

SEQ ID NO: 7316959 - DNA, 22 bp, Homo sapiens
taaaattgcggtgaatatttcc

SEQ ID NO: 7316960 - DNA, 22 bp, Homo sapiens
taaaatttgtccctgagtgttg

SEQ ID NO: 7316961 - DNA, 22 bp, Homo sapiens
gtttttattgtgtaaatgtggg

SEQ ID NO: 7316962 - DNA, 22 bp, Homo sapiens
taaaagttttagttgtacataa

SEQ ID NO: 7316963 - DNA, 22 bp, Homo sapiens
taaaagttttagttgtacataa

SEQ ID NO: 7316964 - DNA, 22 bp, Homo sapiens
taaaatgatctctcatgttctt

SEQ ID NO: 7316965 - DNA, 22 bp, Homo sapiens
taaaatgatctctcatgttctt

SEQ ID NO: 7316966 - DNA, 22 bp, Homo sapiens
gttttgatatatgcatacatta

SEQ ID NO: 7316967 - DNA, 18 bp, Homo sapiens
gttttgaattgtcttaca

SEQ ID NO: 7316968 - DNA, 21 bp, Homo sapiens
gttttctttgatagagggaag

SEQ ID NO: 7316969 - DNA, 22 bp, Homo sapiens
gttttgaagaagaccttgaaac

SEQ ID NO: 7316970 - DNA, 22 bp, Homo sapiens
gttttgaatactactagaactt

SEQ ID NO: 7316971 - DNA, 22 bp, Homo sapiens
gttttctttgaatgcttctaga

SEQ ID NO: 7316972 - DNA, 20 bp, Homo sapiens
gtttccaaattgtgcatttt

SEQ ID NO: 7316973 - DNA, 22 bp, Homo sapiens
gtttccaaccccaccaaagtgc

SEQ ID NO: 7316974 - DNA, 22 bp, Homo sapiens
taatggtatttgttgaaaaact

SEQ ID NO: 7316975 - DNA, 22 bp, Homo sapiens
taatgtttccagtctatgatgg

SEQ ID NO: 7316976 - DNA, 22 bp, Homo sapiens
taatgtttagaagcagacagct

SEQ ID NO: 7316977 - DNA, 22 bp, Homo sapiens
taatgtttagaagcagacagct

SEQ ID NO: 7316978 - DNA, 22 bp, Homo sapiens
taatactgatgtctgagcccca

SEQ ID NO: 7316979 - DNA, 22 bp, Homo sapiens
taatactgagccaccaggtagg

SEQ ID NO: 7316980 - DNA, 22 bp, Homo sapiens
taatactgctgtgcttgagttg

SEQ ID NO: 7316981 - DNA, 23 bp, Homo sapiens
taatactgcttcagaggcttaga

SEQ ID NO: 7316982 - DNA, 19 bp, Homo sapiens
taatactggctgtagctgg

SEQ ID NO: 7316983 - DNA, 22 bp, Homo sapiens
taatactgggaaatacttgggt

SEQ ID NO: 7316984 - DNA, 22 bp, Homo sapiens
taatactgtaacttggtgggtc

SEQ ID NO: 7316985 - DNA, 22 bp, Homo sapiens
taatactgtgcttcattttcct

SEQ ID NO: 7316986 - DNA, 22 bp, Homo sapiens
taatactgtatactgcaaattt

SEQ ID NO: 7316987 - DNA, 22 bp, Homo sapiens
taatactgtatactgcaaattt

SEQ ID NO: 7316988 - DNA, 22 bp, Homo sapiens
taatagaatagtggaaacattg

SEQ ID NO: 7316989 - DNA, 22 bp, Homo sapiens
taatgtttttctcaacattgct

SEQ ID NO: 7316990 - DNA, 22 bp, Homo sapiens
taatgtttgggaaggtgctttg

SEQ ID NO: 7316991 - DNA, 22 bp, Homo sapiens
taatgtttgagatgttggattt

SEQ ID NO: 7316992 - DNA, 22 bp, Homo sapiens
taattacaaagcaagcacaggg

SEQ ID NO: 7316993 - DNA, 22 bp, Homo sapiens
taattacaggtccaaaacaatc

SEQ ID NO: 7316994 - DNA, 22 bp, Homo sapiens
taattatagccgctattttgct

SEQ ID NO: 7316995 - DNA, 22 bp, Homo sapiens
tacaaactgttattattattgt

SEQ ID NO: 7316996 - DNA, 22 bp, Homo sapiens
tacaaaaaattgatactgacga

SEQ ID NO: 7316997 - DNA, 22 bp, Homo sapiens
tacaaagaggcagctccatttt

SEQ ID NO: 7316998 - DNA, 22 bp, Homo sapiens
tacaaagaggtaattgcatata

SEQ ID NO: 7316999 - DNA, 22 bp, Homo sapiens
tacaaagaggtaattgcatata

SEQ ID NO: 7317000 - DNA, 22 bp, Homo sapiens
tacaaagtaatgtataatatcg

SEQ ID NO: 7317001 - DNA, 22 bp, Homo sapiens
tacaaagtcacattgaaatgaa

SEQ ID NO: 7317002 - DNA, 22 bp, Homo sapiens
tacaaagtatatttctagctgt

SEQ ID NO: 7317003 - DNA, 22 bp, Homo sapiens
tacaaagtagaaattcagtaaa

SEQ ID NO: 7317004 - DNA, 22 bp, Homo sapiens
tacaaaggcttaaagagatttc

SEQ ID NO: 7317005 - DNA, 22 bp, Homo sapiens
tacaaagtaatgtataatatcg

SEQ ID NO: 7317006 - DNA, 22 bp, Homo sapiens
tacaaaggaggtgcatagaaca

SEQ ID NO: 7317007 - DNA, 22 bp, Homo sapiens
tacaaaggcttaaagagatttc

SEQ ID NO: 7317008 - DNA, 22 bp, Homo sapiens
tacaaagatagtgttagagtaa

SEQ ID NO: 7317009 - DNA, 21 bp, Homo sapiens
taatactgaaagtgacatctg

SEQ ID NO: 7317010 - DNA, 21 bp, Homo sapiens
taatactgaaagtgacatctg

SEQ ID NO: 7317011 - DNA, 22 bp, Homo sapiens
taatactgaaggtaaaatttct

SEQ ID NO: 7317012 - DNA, 22 bp, Homo sapiens
taatactgactaaagatatcaa

SEQ ID NO: 7317013 - DNA, 22 bp, Homo sapiens
taatactgaaagggaaatgtcc

SEQ ID NO: 7317014 - DNA, 22 bp, Homo sapiens
taatactgaaagggaaatgtcc

SEQ ID NO: 7317015 - DNA, 22 bp, Homo sapiens
taatactgaaaggagtatcagc

SEQ ID NO: 7317016 - DNA, 22 bp, Homo sapiens
taatactgaaaggagtatcagc

SEQ ID NO: 7317017 - DNA, 22 bp, Homo sapiens
taatacagggcactttgagtga

SEQ ID NO: 7317018 - DNA, 22 bp, Homo sapiens
taatacagtagcttttacacag

SEQ ID NO: 7317019 - DNA, 22 bp, Homo sapiens
taatacagtttccaagccagct

SEQ ID NO: 7317020 - DNA, 22 bp, Homo sapiens
taagtgagatctgaaatgaaat

SEQ ID NO: 7317021 - DNA, 22 bp, Homo sapiens
taaggtttgtggggagcaaaag

SEQ ID NO: 7317022 - DNA, 22 bp, Homo sapiens
taaggtgagctgtataacaggg

SEQ ID NO: 7317023 - DNA, 22 bp, Homo sapiens
taagggctgacttggaactgtc

SEQ ID NO: 7317024 - DNA, 22 bp, Homo sapiens
taaggcaaaggggaagttatca

SEQ ID NO: 7317025 - DNA, 22 bp, Homo sapiens
taaggcaaagaaccatagtaat

SEQ ID NO: 7317026 - DNA, 22 bp, Homo sapiens
taactgctcagtgagtattttt

SEQ ID NO: 7317027 - DNA, 22 bp, Homo sapiens
taaggcaggactggatagctat

SEQ ID NO: 7317028 - DNA, 22 bp, Homo sapiens
tacatagattttgaaactggac

SEQ ID NO: 7317029 - DNA, 22 bp, Homo sapiens
tacatagaacatgtttaatgtc

SEQ ID NO: 7317030 - DNA, 22 bp, Homo sapiens
tacatagaatatttcacttaaa

SEQ ID NO: 7317031 - DNA, 22 bp, Homo sapiens
tacatacattacctcatttagt

SEQ ID NO: 7317032 - DNA, 22 bp, Homo sapiens
tacatacattacctcatttagt

SEQ ID NO: 7317033 - DNA, 22 bp, Homo sapiens
tacatacatggtggaatggtta

SEQ ID NO: 7317034 - DNA, 22 bp, Homo sapiens
tacatacatgtatgtgtgtatt

SEQ ID NO: 7317035 - DNA, 22 bp, Homo sapiens
tacagggaatgggacataaatc

SEQ ID NO: 7317036 - DNA, 22 bp, Homo sapiens
tacagtaagatgaaatagcaat

SEQ ID NO: 7317037 - DNA, 22 bp, Homo sapiens
tacagggaccaataataactat

SEQ ID NO: 7317038 - DNA, 22 bp, Homo sapiens
tacagcacggtgcatttactac

SEQ ID NO: 7317039 - DNA, 22 bp, Homo sapiens
tacatcattttggagatgagca

SEQ ID NO: 7317040 - DNA, 22 bp, Homo sapiens
tacatgaacaaaatagcagaaa

SEQ ID NO: 7317041 - DNA, 22 bp, Homo sapiens
tacatctttgtctatgaccagc

SEQ ID NO: 7317042 - DNA, 22 bp, Homo sapiens
tacatctttgtctatgaccagc

SEQ ID NO: 7317043 - DNA, 22 bp, Homo sapiens
tacatcatggcttcatgctgca

SEQ ID NO: 7317044 - DNA, 22 bp, Homo sapiens
tacatatagacagttactctag

SEQ ID NO: 7317045 - DNA, 22 bp, Homo sapiens
tacatatagacagttactctag

SEQ ID NO: 7317046 - DNA, 22 bp, Homo sapiens
tacatatactgagtgatttgct

SEQ ID NO: 7317047 - DNA, 22 bp, Homo sapiens
tacatagctcctagtgatgcat

SEQ ID NO: 7317048 - DNA, 22 bp, Homo sapiens
tacatatactgagtgatttgct

SEQ ID NO: 7317049 - DNA, 23 bp, Homo sapiens
tacattctgtatttttatagagt

SEQ ID NO: 7317050 - DNA, 22 bp, Homo sapiens
tacagataaaaatgctgttctt

SEQ ID NO: 7317051 - DNA, 22 bp, Homo sapiens
tacagagttttcctgccaagaa

SEQ ID NO: 7317052 - DNA, 22 bp, Homo sapiens
tacagagtgttattacagaatc

SEQ ID NO: 7317053 - DNA, 22 bp, Homo sapiens
tacagagttttcctgccaagaa

SEQ ID NO: 7317054 - DNA, 22 bp, Homo sapiens
tacagaaattgccaccagctct

SEQ ID NO: 7317055 - DNA, 22 bp, Homo sapiens
tacagcaatgcctgaaatagta

SEQ ID NO: 7317056 - DNA, 22 bp, Homo sapiens
tacagatatttctcttcaacaa

SEQ ID NO: 7317057 - DNA, 21 bp, Homo sapiens
tacagatgaggagaccaaggc

SEQ ID NO: 7317058 - DNA, 22 bp, Homo sapiens
tacagattgaggtttttaatat

SEQ ID NO: 7317059 - DNA, 18 bp, Homo sapiens
tacagattatagatacat

SEQ ID NO: 7317060 - DNA, 22 bp, Homo sapiens
tacagatatagagatttataga

SEQ ID NO: 7317061 - DNA, 22 bp, Homo sapiens
tacagatatatagtgtgtgcct

SEQ ID NO: 7317062 - DNA, 22 bp, Homo sapiens
tacaaagttttcttggattgag

SEQ ID NO: 7317063 - DNA, 20 bp, Homo sapiens
tacaacaagtagagacatac

SEQ ID NO: 7317064 - DNA, 22 bp, Homo sapiens
tacaacaatttccacattagaa

SEQ ID NO: 7317065 - DNA, 22 bp, Homo sapiens
tacaacaatttccacattagaa

SEQ ID NO: 7317066 - DNA, 22 bp, Homo sapiens
tacaaagtcttgggttctaggc

SEQ ID NO: 7317067 - DNA, 22 bp, Homo sapiens
tacaaagtcccattgccatgga

SEQ ID NO: 7317068 - DNA, 22 bp, Homo sapiens
tacaaagtcccattgccatgga

SEQ ID NO: 7317069 - DNA, 22 bp, Homo sapiens
tacaaagtcagaataacaggtg

SEQ ID NO: 7317070 - DNA, 22 bp, Homo sapiens
tacaaagtgattttggaattga

SEQ ID NO: 7317071 - DNA, 22 bp, Homo sapiens
tacaaagtgagcaacctctttt

SEQ ID NO: 7317072 - DNA, 22 bp, Homo sapiens
tacaaagtgaaataattctgag

SEQ ID NO: 7317073 - DNA, 22 bp, Homo sapiens
tacaaagtttgagaatgctttc

SEQ ID NO: 7317074 - DNA, 22 bp, Homo sapiens
tacaaagtgggaaacgaaggtt

SEQ ID NO: 7317075 - DNA, 22 bp, Homo sapiens
tacaaagtgctttagaaatgaa

SEQ ID NO: 7317076 - DNA, 22 bp, Homo sapiens
tacaacagtaatcaaggttttt

SEQ ID NO: 7317077 - DNA, 22 bp, Homo sapiens
tacactttttactacagattct

SEQ ID NO: 7317078 - DNA, 22 bp, Homo sapiens
tacagaaaaactggcattgaag

SEQ ID NO: 7317079 - DNA, 22 bp, Homo sapiens
tatctacagttaatatgtcatc

SEQ ID NO: 7317080 - DNA, 22 bp, Homo sapiens
tatctacattcttgtatcttct

SEQ ID NO: 7317081 - DNA, 22 bp, Homo sapiens
tatctacatgtaggtatgtatg

SEQ ID NO: 7317082 - DNA, 22 bp, Homo sapiens
tatgacatgtgatctcaagagg

SEQ ID NO: 7317083 - DNA, 22 bp, Homo sapiens
tatgacagtgaaaaaaatcaga

SEQ ID NO: 7317084 - DNA, 22 bp, Homo sapiens
tatgactttggaaaaattactt

SEQ ID NO: 7317085 - DNA, 23 bp, Homo sapiens
tatccagtagggcccagagctga

SEQ ID NO: 7317086 - DNA, 22 bp, Homo sapiens
tatccacactcaaggggagggg

SEQ ID NO: 7317087 - DNA, 22 bp, Homo sapiens
tatccacactgggatgttttga

SEQ ID NO: 7317088 - DNA, 22 bp, Homo sapiens
tatccaggaggaactcattttg

SEQ ID NO: 7317089 - DNA, 22 bp, Homo sapiens
tatatccatttgtctgctaatt

SEQ ID NO: 7317090 - DNA, 19 bp, Homo sapiens
tatatattttggggttgtg

SEQ ID NO: 7317091 - DNA, 22 bp, Homo sapiens
tatatattcttaagtagtgtag

SEQ ID NO: 7317092 - DNA, 22 bp, Homo sapiens
tatatattcttaagtagtgtag

SEQ ID NO: 7317093 - DNA, 22 bp, Homo sapiens
tataggactgatcacattttca

SEQ ID NO: 7317094 - DNA, 22 bp, Homo sapiens
tataggaccgacttgtttatag

SEQ ID NO: 7317095 - DNA, 22 bp, Homo sapiens
tataggtacttggaaaataagg

SEQ ID NO: 7317096 - DNA, 21 bp, Homo sapiens
tatagtgtggatatgctgatg

SEQ ID NO: 7317097 - DNA, 22 bp, Homo sapiens
tatagtacatggaatcttcata

SEQ ID NO: 7317098 - DNA, 22 bp, Homo sapiens
tatagcacacagtttataaaag

SEQ ID NO: 7317099 - DNA, 22 bp, Homo sapiens
tataaattattaggctgctaaa

SEQ ID NO: 7317100 - DNA, 22 bp, Homo sapiens
taggtgaggttacaagagttca

SEQ ID NO: 7317101 - DNA, 20 bp, Homo sapiens
taggtgagggcagatagagg

SEQ ID NO: 7317102 - DNA, 22 bp, Homo sapiens
taggtgagggagcattgtgaga

SEQ ID NO: 7317103 - DNA, 22 bp, Homo sapiens
taggggtgtttcgagagaggtt

SEQ ID NO: 7317104 - DNA, 22 bp, Homo sapiens
taggggtgggatccaggaatta

SEQ ID NO: 7317105 - DNA, 22 bp, Homo sapiens
taggggtggagctaagagtccc

SEQ ID NO: 7317106 - DNA, 22 bp, Homo sapiens
taggggtgaggccaggcatcag

SEQ ID NO: 7317107 - DNA, 22 bp, Homo sapiens
taggtgagtttggggaagatag

SEQ ID NO: 7317108 - DNA, 22 bp, Homo sapiens
tatacaatgagtacattctggg

SEQ ID NO: 7317109 - DNA, 22 bp, Homo sapiens
tatacaatggctgaatcatcca

SEQ ID NO: 7317110 - DNA, 22 bp, Homo sapiens
tatacaatggctgaatcatcca

SEQ ID NO: 7317111 - DNA, 22 bp, Homo sapiens
tatacacaaacaaggggttaag

SEQ ID NO: 7317112 - DNA, 22 bp, Homo sapiens
tatacacaaacaaggggttaag

SEQ ID NO: 7317113 - DNA, 22 bp, Homo sapiens
tatacacaaggtgtgcatttgt

SEQ ID NO: 7317114 - DNA, 22 bp, Homo sapiens
tatacacaaggtgtgcatttgt

SEQ ID NO: 7317115 - DNA, 22 bp, Homo sapiens
tatacacacatgctccggcctt

SEQ ID NO: 7317116 - DNA, 22 bp, Homo sapiens
tatacacacatgctccggcctt

SEQ ID NO: 7317117 - DNA, 22 bp, Homo sapiens
tatacacacctccaaagcagga

SEQ ID NO: 7317118 - DNA, 22 bp, Homo sapiens
tatacacacctccaaagcagga

SEQ ID NO: 7317119 - DNA, 22 bp, Homo sapiens
tatacacatcctccaaagatag

SEQ ID NO: 7317120 - DNA, 22 bp, Homo sapiens
tatacacatatcttctaggcct

SEQ ID NO: 7317121 - DNA, 22 bp, Homo sapiens
tatacacatatcttctaggcct

SEQ ID NO: 7317122 - DNA, 23 bp, Homo sapiens
tatacacatgtggcagtatagtg

SEQ ID NO: 7317123 - DNA, 23 bp, Homo sapiens
tatacacatgtggcagtatagtg

SEQ ID NO: 7317124 - DNA, 22 bp, Homo sapiens
tatacacatcctccaaagatag

SEQ ID NO: 7317125 - DNA, 17 bp, Homo sapiens
tatacacagacagactg

SEQ ID NO: 7317126 - DNA, 17 bp, Homo sapiens
tatacacagacagactg

SEQ ID NO: 7317127 - DNA, 22 bp, Homo sapiens
tatacacaggaatctgtgaaaa

SEQ ID NO: 7317128 - DNA, 22 bp, Homo sapiens
tatacacaggaatctgtgaaaa

SEQ ID NO: 7317129 - DNA, 22 bp, Homo sapiens
tatacacatatacgtttgtgtg

SEQ ID NO: 7317130 - DNA, 22 bp, Homo sapiens
tatacacatatacgtttgtgtg

SEQ ID NO: 7317131 - DNA, 23 bp, Homo sapiens
tatacacatgtggcagtatagtg

SEQ ID NO: 7317132 - DNA, 22 bp, Homo sapiens
tatacacattacagtttcagga

SEQ ID NO: 7317133 - DNA, 22 bp, Homo sapiens
tatacacattacagtttcagga

SEQ ID NO: 7317134 - DNA, 22 bp, Homo sapiens
tatacacatgtgtgtattcata

SEQ ID NO: 7317135 - DNA, 22 bp, Homo sapiens
tatacacatgtgtgtattcata

SEQ ID NO: 7317136 - DNA, 22 bp, Homo sapiens
tatacacatttttacctatagt

SEQ ID NO: 7317137 - DNA, 22 bp, Homo sapiens
tatacacatttttacctatagt

SEQ ID NO: 7317138 - DNA, 22 bp, Homo sapiens
tatacagaaagaattcaagtct

SEQ ID NO: 7317139 - DNA, 22 bp, Homo sapiens
tatttattcattcagcaagcat

SEQ ID NO: 7317140 - DNA, 22 bp, Homo sapiens
tatttattggacagtgttgctg

SEQ ID NO: 7317141 - DNA, 22 bp, Homo sapiens
tatttattctttgtactgcctt

SEQ ID NO: 7317142 - DNA, 22 bp, Homo sapiens
tatttctcagcattttacatcc

SEQ ID NO: 7317143 - DNA, 22 bp, Homo sapiens
tatttctcttcaaaattgatgt

SEQ ID NO: 7317144 - DNA, 22 bp, Homo sapiens
tatttctctcacggttgcctgg

SEQ ID NO: 7317145 - DNA, 22 bp, Homo sapiens
tattgacaggtgcctgcagaca

SEQ ID NO: 7317146 - DNA, 22 bp, Homo sapiens
tatttaatttgctcattgtgat

SEQ ID NO: 7317147 - DNA, 22 bp, Homo sapiens
tatttataatctgccaaagaga

SEQ ID NO: 7317148 - DNA, 22 bp, Homo sapiens
tattctcagtgctataagtaga

SEQ ID NO: 7317149 - DNA, 22 bp, Homo sapiens
tattctactagcattgttcact

SEQ ID NO: 7317150 - DNA, 22 bp, Homo sapiens
tattctcattagtctgtattcc

SEQ ID NO: 7317151 - DNA, 22 bp, Homo sapiens
tattctgatttcaagtgagagt

SEQ ID NO: 7317152 - DNA, 22 bp, Homo sapiens
tattctctgcagctgaatgttt

SEQ ID NO: 7317153 - DNA, 22 bp, Homo sapiens
tattgaaattcttcatgtcctc

SEQ ID NO: 7317154 - DNA, 22 bp, Homo sapiens
tattcttgactgcttactatgt

SEQ ID NO: 7317155 - DNA, 22 bp, Homo sapiens
tattcttgtaccttaaatgatt

SEQ ID NO: 7317156 - DNA, 22 bp, Homo sapiens
tattcttgtaccttaaatgatt

SEQ ID NO: 7317157 - DNA, 22 bp, Homo sapiens
tattgaaatccattacgttctt

SEQ ID NO: 7317158 - DNA, 22 bp, Homo sapiens
tattcttgtcttttccagaaat

SEQ ID NO: 7317159 - DNA, 22 bp, Homo sapiens
tattcttgtatactacaatctt

SEQ ID NO: 7317160 - DNA, 22 bp, Homo sapiens
tattcaaagtaccttcattgcc

SEQ ID NO: 7317161 - DNA, 22 bp, Homo sapiens
tattattatgcatagcatgaaa

SEQ ID NO: 7317162 - DNA, 22 bp, Homo sapiens
tattacagctttgattatctgg

SEQ ID NO: 7317163 - DNA, 22 bp, Homo sapiens
tatgtgtgctttttccatgcat

SEQ ID NO: 7317164 - DNA, 22 bp, Homo sapiens
tatgtgtgctttttccatgcat

SEQ ID NO: 7317165 - DNA, 22 bp, Homo sapiens
tatgtgtggcagctgggagtgt

SEQ ID NO: 7317166 - DNA, 22 bp, Homo sapiens
tatgtgtggagccagcctggag

SEQ ID NO: 7317167 - DNA, 22 bp, Homo sapiens
tatgtgtggcagctgggagtgt

SEQ ID NO: 7317168 - DNA, 22 bp, Homo sapiens
tatgtgtgctttttccatgcat

SEQ ID NO: 7317169 - DNA, 19 bp, Homo sapiens
tatgtgtgcatttgtgcat

SEQ ID NO: 7317170 - DNA, 19 bp, Homo sapiens
tatgtgtgcatttgtgcat

SEQ ID NO: 7317171 - DNA, 20 bp, Homo sapiens
tattacacacaatgagcagt

SEQ ID NO: 7317172 - DNA, 20 bp, Homo sapiens
tattacacacaatgagcagt

SEQ ID NO: 7317173 - DNA, 22 bp, Homo sapiens
tattacacagtgaaagcatgga

SEQ ID NO: 7317174 - DNA, 22 bp, Homo sapiens
tatgtgcagtttgctcttaaca

SEQ ID NO: 7317175 - DNA, 22 bp, Homo sapiens
tatgtgcactttgggtctggga

SEQ ID NO: 7317176 - DNA, 22 bp, Homo sapiens
tatgtgcagcacttgccattac

SEQ ID NO: 7317177 - DNA, 22 bp, Homo sapiens
tatgtgcaaattaattgctaga

SEQ ID NO: 7317178 - DNA, 22 bp, Homo sapiens
tatgtgtgcatgtatacattaa

SEQ ID NO: 7317179 - DNA, 22 bp, Homo sapiens
tatgtgtgcatgtatacattaa

SEQ ID NO: 7317180 - DNA, 19 bp, Homo sapiens
tatgtgtgcatttgtgcat

SEQ ID NO: 7317181 - DNA, 22 bp, Homo sapiens
tatgtgtgcatgtatacattaa

SEQ ID NO: 7317182 - DNA, 22 bp, Homo sapiens
tatgtacaagcacacatgtgac

SEQ ID NO: 7317183 - DNA, 22 bp, Homo sapiens
tatgtacaatttgttgtatgtc

SEQ ID NO: 7317184 - DNA, 22 bp, Homo sapiens
tatgagatcccttttcctagag

SEQ ID NO: 7317185 - DNA, 22 bp, Homo sapiens
tatgaggtaggtattatactta

SEQ ID NO: 7317186 - DNA, 22 bp, Homo sapiens
tatgtacatacatgtgcatacg

SEQ ID NO: 7317187 - DNA, 22 bp, Homo sapiens
tatgtctagacccaagaatatg

SEQ ID NO: 7317188 - DNA, 22 bp, Homo sapiens
tatgtctagacccaagaatatg

SEQ ID NO: 7317189 - DNA, 22 bp, Homo sapiens
tatgtctggaagtgtacttgtc

SEQ ID NO: 7317190 - DNA, 22 bp, Homo sapiens
tatgtacacatacacttgtaat

SEQ ID NO: 7317191 - DNA, 22 bp, Homo sapiens
tatgtacacatacacttgtaat

SEQ ID NO: 7317192 - DNA, 22 bp, Homo sapiens
tatgtacacacacatgcatgta

SEQ ID NO: 7317193 - DNA, 22 bp, Homo sapiens
tatgtacacttaagtttgagaa

SEQ ID NO: 7317194 - DNA, 22 bp, Homo sapiens
taggaaaatatctcttattggg

SEQ ID NO: 7317195 - DNA, 22 bp, Homo sapiens
taggatttaataaaagaataga

SEQ ID NO: 7317196 - DNA, 22 bp, Homo sapiens
taggatttactttgacaatatt

SEQ ID NO: 7317197 - DNA, 22 bp, Homo sapiens
taggaaaagtctagattgatga

SEQ ID NO: 7317198 - DNA, 22 bp, Homo sapiens
taggaaaagcacaggatgttct

SEQ ID NO: 7317199 - DNA, 22 bp, Homo sapiens
taggaaaacgtgattttctcac

SEQ ID NO: 7317200 - DNA, 22 bp, Homo sapiens
taggaaaaagaggctggcaagg

SEQ ID NO: 7317201 - DNA, 22 bp, Homo sapiens
taggaaaaatacagaattatat

SEQ ID NO: 7317202 - DNA, 22 bp, Homo sapiens
taggatttattctacaatattg

SEQ ID NO: 7317203 - DNA, 22 bp, Homo sapiens
tagcagagaggggacagtggca

SEQ ID NO: 7317204 - DNA, 22 bp, Homo sapiens
tagcagaagaacaacatgatct

SEQ ID NO: 7317205 - DNA, 22 bp, Homo sapiens
tagcagagaggtttcagctaat

SEQ ID NO: 7317206 - DNA, 21 bp, Homo sapiens
tagcagagagttaacttctcc

SEQ ID NO: 7317207 - DNA, 21 bp, Homo sapiens
tagcagagagttaacttctcc

SEQ ID NO: 7317208 - DNA, 22 bp, Homo sapiens
tagcagagatatgggcatagat

SEQ ID NO: 7317209 - DNA, 22 bp, Homo sapiens
tagcagagtatcttgcaaatta

SEQ ID NO: 7317210 - DNA, 22 bp, Homo sapiens
tagcagagtgattggccatgag

SEQ ID NO: 7317211 - DNA, 22 bp, Homo sapiens
tagcagagtagtgcctccagat

SEQ ID NO: 7317212 - DNA, 22 bp, Homo sapiens
tagcagagtaatactttggagc

SEQ ID NO: 7317213 - DNA, 22 bp, Homo sapiens
tagcagaggtaagtgtggcaat

SEQ ID NO: 7317214 - DNA, 22 bp, Homo sapiens
tagcagagggtagtgccggggc

SEQ ID NO: 7317215 - DNA, 19 bp, Homo sapiens
tagcagagatgactccagc

SEQ ID NO: 7317216 - DNA, 21 bp, Homo sapiens
tagcagagatcattttctcct

SEQ ID NO: 7317217 - DNA, 22 bp, Homo sapiens
tagcagagcacatcttcattct

SEQ ID NO: 7317218 - DNA, 22 bp, Homo sapiens
tagcagagctgcaatatagacc

SEQ ID NO: 7317219 - DNA, 22 bp, Homo sapiens
tagcagagcgggtgcgaggcgg

SEQ ID NO: 7317220 - DNA, 22 bp, Homo sapiens
tagcagagcagggatcagagcc

SEQ ID NO: 7317221 - DNA, 22 bp, Homo sapiens
tagcagaggaaatccagagtaa

SEQ ID NO: 7317222 - DNA, 22 bp, Homo sapiens
tagcagaggaaaagagaacatt

SEQ ID NO: 7317223 - DNA, 22 bp, Homo sapiens
tagcagagctgggactagatta

SEQ ID NO: 7317224 - DNA, 22 bp, Homo sapiens
tagcagaggctactgctccttg

SEQ ID NO: 7317225 - DNA, 22 bp, Homo sapiens
tagcagaggcaaggatgtgaat

SEQ ID NO: 7317226 - DNA, 22 bp, Homo sapiens
tagcagaggctgtctgacttaa

SEQ ID NO: 7317227 - DNA, 22 bp, Homo sapiens
tagctcttcaatcactgtctcc

SEQ ID NO: 7317228 - DNA, 22 bp, Homo sapiens
tagctctgtgctctggatctgt

SEQ ID NO: 7317229 - DNA, 22 bp, Homo sapiens
tagctctgaggccatctccggt

SEQ ID NO: 7317230 - DNA, 22 bp, Homo sapiens
tagctcttcatttcatctgatt

SEQ ID NO: 7317231 - DNA, 22 bp, Homo sapiens
tagctcttgccatctgtcttat

SEQ ID NO: 7317232 - DNA, 22 bp, Homo sapiens
tagctgttggcttacatctgtt

SEQ ID NO: 7317233 - DNA, 22 bp, Homo sapiens
tagccctctttaatccttccct

SEQ ID NO: 7317234 - DNA, 22 bp, Homo sapiens
tagaaaggaagctacttagggg

SEQ ID NO: 7317235 - DNA, 22 bp, Homo sapiens
tagaaaggagcattttagacta

SEQ ID NO: 7317236 - DNA, 22 bp, Homo sapiens
tagaaaggatattgagatgaat

SEQ ID NO: 7317237 - DNA, 22 bp, Homo sapiens
tagaaaggcaagcgtgaaatat

SEQ ID NO: 7317238 - DNA, 22 bp, Homo sapiens
tagaaaggaacaggtcagcgtt

SEQ ID NO: 7317239 - DNA, 22 bp, Homo sapiens
tagaaaggctgctgccaaccca

SEQ ID NO: 7317240 - DNA, 22 bp, Homo sapiens
tagaaaggcaatcattcttgga

SEQ ID NO: 7317241 - DNA, 22 bp, Homo sapiens
tagaaatccccagtctcatagt

SEQ ID NO: 7317242 - DNA, 22 bp, Homo sapiens
tagaaatcatttagaagtattg

SEQ ID NO: 7317243 - DNA, 22 bp, Homo sapiens
tagaaatcacagaaaatcaggg

SEQ ID NO: 7317244 - DNA, 22 bp, Homo sapiens
tagaaatcttgttactatgtgt

SEQ ID NO: 7317245 - DNA, 22 bp, Homo sapiens
tagacacatcttcatccacaat

SEQ ID NO: 7317246 - DNA, 22 bp, Homo sapiens
tagacacatcaagtatagttaa

SEQ ID NO: 7317247 - DNA, 22 bp, Homo sapiens
tagacaaactgatacttggcga

SEQ ID NO: 7317248 - DNA, 22 bp, Homo sapiens
tagaattttctgctttgatagt

SEQ ID NO: 7317249 - DNA, 22 bp, Homo sapiens
tagacacaggggaatgtgaggt

SEQ ID NO: 7317250 - DNA, 22 bp, Homo sapiens
tagaaaagaattttatttgata

SEQ ID NO: 7317251 - DNA, 19 bp, Homo sapiens
tactttttcaggacagagt

SEQ ID NO: 7317252 - DNA, 22 bp, Homo sapiens
tactttttgtctctttgaatgt

SEQ ID NO: 7317253 - DNA, 22 bp, Homo sapiens
tagaaaactaatacatgcttga

SEQ ID NO: 7317254 - DNA, 22 bp, Homo sapiens
tactttttatgataagaactga

SEQ ID NO: 7317255 - DNA, 22 bp, Homo sapiens
tactttttagcacagtgtgtgc

SEQ ID NO: 7317256 - DNA, 22 bp, Homo sapiens
taccaaagatacataaatgtga

SEQ ID NO: 7317257 - DNA, 22 bp, Homo sapiens
taccaaaagcttgtttcataca

SEQ ID NO: 7317258 - DNA, 22 bp, Homo sapiens
tacattttctaggggaccaaga

SEQ ID NO: 7317259 - DNA, 22 bp, Homo sapiens
tagaaacattcagttgcagtcc

SEQ ID NO: 7317260 - DNA, 22 bp, Homo sapiens
tagaaactactagaataagaga

SEQ ID NO: 7317261 - DNA, 22 bp, Homo sapiens
tagaaacatgagagaaactctt

SEQ ID NO: 7317262 - DNA, 22 bp, Homo sapiens
tgtggccattcttgaggtcgac

SEQ ID NO: 7317263 - DNA, 20 bp, Homo sapiens
tgtggccatgttccaactca

SEQ ID NO: 7317264 - DNA, 19 bp, Homo sapiens
tgtggccatggttcagctg

SEQ ID NO: 7317265 - DNA, 22 bp, Homo sapiens
tgtggccagccacaggcatggt

SEQ ID NO: 7317266 - DNA, 22 bp, Homo sapiens
tgtggccaggaaaaggagatgg

SEQ ID NO: 7317267 - DNA, 22 bp, Homo sapiens
tgtggccagaggtactatttta

SEQ ID NO: 7317268 - DNA, 22 bp, Homo sapiens
tgtggccaccagagctgctatt

SEQ ID NO: 7317269 - DNA, 22 bp, Homo sapiens
tgtggatgaataaagtgcagac

SEQ ID NO: 7317270 - DNA, 22 bp, Homo sapiens
tgtggcaaagaccatttctttc

SEQ ID NO: 7317271 - DNA, 22 bp, Homo sapiens
tgtggcacagaaagatgaaggg

SEQ ID NO: 7317272 - DNA, 22 bp, Homo sapiens
tgtggacgtcattaaagcagtg

SEQ ID NO: 7317273 - DNA, 22 bp, Homo sapiens
tccccaggtcctgtcggctcct

SEQ ID NO: 7317274 - DNA, 22 bp, Homo sapiens
tgtgtgagacaattggctgtgg

SEQ ID NO: 7317275 - DNA, 22 bp, Homo sapiens
tgtgtgacctggggtgagatag

SEQ ID NO: 7317276 - DNA, 22 bp, Homo sapiens
tgtgtgacacattgatatgtgc

SEQ ID NO: 7317277 - DNA, 22 bp, Homo sapiens
tgtgtgaattctgagcagttta

SEQ ID NO: 7317278 - DNA, 19 bp, Homo sapiens
tgtgtgcaaatggaagcca

SEQ ID NO: 7317279 - DNA, 22 bp, Homo sapiens
tgtgtgcaagtgacattagaaa

SEQ ID NO: 7317280 - DNA, 22 bp, Homo sapiens
tgtgtgattgcaggagatgtgg

SEQ ID NO: 7317281 - DNA, 22 bp, Homo sapiens
tgtgtgattgcaggagatgtgg

SEQ ID NO: 7317282 - DNA, 22 bp, Homo sapiens
tgtgtctgttttgctcaccatt

SEQ ID NO: 7317283 - DNA, 22 bp, Homo sapiens
tgtgtctttggcgatgtctgga

SEQ ID NO: 7317284 - DNA, 22 bp, Homo sapiens
tgtgtctttggcgatgtctgga

SEQ ID NO: 7317285 - DNA, 22 bp, Homo sapiens
tgtgtccttatgaaaatactgt

SEQ ID NO: 7317286 - DNA, 22 bp, Homo sapiens
tgtgtcctttcttaagagtgag

SEQ ID NO: 7317287 - DNA, 22 bp, Homo sapiens
tgtgtctgttttgctcaccatt

SEQ ID NO: 7317288 - DNA, 22 bp, Homo sapiens
tgtgtcctgtgatctctagggt

SEQ ID NO: 7317289 - DNA, 22 bp, Homo sapiens
tgtgtcctcatgtggcagagag

SEQ ID NO: 7317290 - DNA, 22 bp, Homo sapiens
tgtgtccactgaatgtgtatta

SEQ ID NO: 7317291 - DNA, 22 bp, Homo sapiens
tgtggtcagctactggtcatct

SEQ ID NO: 7317292 - DNA, 22 bp, Homo sapiens
tgtgggtggtaaaatacaatga

SEQ ID NO: 7317293 - DNA, 22 bp, Homo sapiens
tgtgggtggcatcgtcctggcc

SEQ ID NO: 7317294 - DNA, 22 bp, Homo sapiens
tgtggtctggccattcagggac

SEQ ID NO: 7317295 - DNA, 22 bp, Homo sapiens
tgtggtgccgagagtctggacg

SEQ ID NO: 7317296 - DNA, 22 bp, Homo sapiens
tgtgtaaaatctgattaatact

SEQ ID NO: 7317297 - DNA, 22 bp, Homo sapiens
tgtgtaaaagattagtttacta

SEQ ID NO: 7317298 - DNA, 21 bp, Homo sapiens
tgtgtaaagttgaaatcctgt

SEQ ID NO: 7317299 - DNA, 21 bp, Homo sapiens
tgtgtaaagttgaaatcctgt

SEQ ID NO: 7317300 - DNA, 22 bp, Homo sapiens
tgtgtaaatttatttacataaa

SEQ ID NO: 7317301 - DNA, 22 bp, Homo sapiens
tgtgtaaatggcatctctcagc

SEQ ID NO: 7317302 - DNA, 22 bp, Homo sapiens
tgtgtaaattatttttaatgat

SEQ ID NO: 7317303 - DNA, 22 bp, Homo sapiens
tgtgtacaaactaacaacatat

SEQ ID NO: 7317304 - DNA, 21 bp, Homo sapiens
tgtgtttgagactatgtttcc

SEQ ID NO: 7317305 - DNA, 22 bp, Homo sapiens
tgtgtttgaggcatgttgcaga

SEQ ID NO: 7317306 - DNA, 22 bp, Homo sapiens
tgtgtttgaggcatgttgcaga

SEQ ID NO: 7317307 - DNA, 22 bp, Homo sapiens
tgtgtttgaggcatgttgcaga

SEQ ID NO: 7317308 - DNA, 22 bp, Homo sapiens
tgtgtttcagaaccttctttca

SEQ ID NO: 7317309 - DNA, 21 bp, Homo sapiens
tgtgtttgagactatgtttcc

SEQ ID NO: 7317310 - DNA, 22 bp, Homo sapiens
tgtgtttctctgaggggtccct

SEQ ID NO: 7317311 - DNA, 22 bp, Homo sapiens
tgtgttgttttaagctgctgca

SEQ ID NO: 7317312 - DNA, 22 bp, Homo sapiens
tgtgttgttttaagctgctgca

SEQ ID NO: 7317313 - DNA, 22 bp, Homo sapiens
tgtgtttagagagcacattcag

SEQ ID NO: 7317314 - DNA, 22 bp, Homo sapiens
tgtgttttgtgtgacccagctc

SEQ ID NO: 7317315 - DNA, 20 bp, Homo sapiens
tgtgttttgcagggcattta

SEQ ID NO: 7317316 - DNA, 22 bp, Homo sapiens
tgtgttttggaaggaacatgca

SEQ ID NO: 7317317 - DNA, 22 bp, Homo sapiens
tgtgttttgaactcatctactg

SEQ ID NO: 7317318 - DNA, 22 bp, Homo sapiens
tgtgttttgaactcatctactg

SEQ ID NO: 7317319 - DNA, 21 bp, Homo sapiens
tgtgttttctctctgggaggt

SEQ ID NO: 7317320 - DNA, 22 bp, Homo sapiens
tgtgttttcctccctggcgttt

SEQ ID NO: 7317321 - DNA, 22 bp, Homo sapiens
tgtgttttccagaatggtgttt

SEQ ID NO: 7317322 - DNA, 22 bp, Homo sapiens
tgtgttttccagaatggtgttt

SEQ ID NO: 7317323 - DNA, 22 bp, Homo sapiens
tgtgttttatctattgtatctt

SEQ ID NO: 7317324 - DNA, 22 bp, Homo sapiens
tgtgttttaaatggaaatttga

SEQ ID NO: 7317325 - DNA, 22 bp, Homo sapiens
tgtgtttgttagactaatgtta

SEQ ID NO: 7317326 - DNA, 22 bp, Homo sapiens
tgtgtttgggggagatgcattt

SEQ ID NO: 7317327 - DNA, 22 bp, Homo sapiens
tgtgtttgggggagatgcattt

SEQ ID NO: 7317328 - DNA, 22 bp, Homo sapiens
tgtgttttacaaattctcttaa

SEQ ID NO: 7317329 - DNA, 22 bp, Homo sapiens
tgtgttttacaaattctcttaa

SEQ ID NO: 7317330 - DNA, 21 bp, Homo sapiens
tgtgttttaatgatattctgt

SEQ ID NO: 7317331 - DNA, 21 bp, Homo sapiens
tgtgttttaatgatattctgt

SEQ ID NO: 7317332 - DNA, 22 bp, Homo sapiens
tgtgtgcagcggcaggtgaagt

SEQ ID NO: 7317333 - DNA, 22 bp, Homo sapiens
tgtgtgcagcctctgtctttgg

SEQ ID NO: 7317334 - DNA, 22 bp, Homo sapiens
tgtgtgcaggcactgtgccaga

SEQ ID NO: 7317335 - DNA, 22 bp, Homo sapiens
tgtgtgcacttaatgcaatcat

SEQ ID NO: 7317336 - DNA, 22 bp, Homo sapiens
tgtgtgcagcctctgtctttgg

SEQ ID NO: 7317337 - DNA, 20 bp, Homo sapiens
tgtgtgcatctgtatgtatt

SEQ ID NO: 7317338 - DNA, 20 bp, Homo sapiens
tgtgtgcatctgtatgtatt

SEQ ID NO: 7317339 - DNA, 21 bp, Homo sapiens
tgtgtgcatatgcatgtacat

SEQ ID NO: 7317340 - DNA, 22 bp, Homo sapiens
tgtgtgcacatgatttgaaatg

SEQ ID NO: 7317341 - DNA, 22 bp, Homo sapiens
tgtgtgcacatgatttgaaatg

SEQ ID NO: 7317342 - DNA, 18 bp, Homo sapiens
tgtgtgcacctgccttga

SEQ ID NO: 7317343 - DNA, 22 bp, Homo sapiens
tgtgtgcacgctgggagctgga

SEQ ID NO: 7317344 - DNA, 22 bp, Homo sapiens
tgtgtgcacttaatgcaatcat

SEQ ID NO: 7317345 - DNA, 22 bp, Homo sapiens
tgtgtgcactgccttttgtgga

SEQ ID NO: 7317346 - DNA, 22 bp, Homo sapiens
tgtgtgcacgtacatactgtat

SEQ ID NO: 7317347 - DNA, 22 bp, Homo sapiens
tgtgtgcacaggagtgtttgaa

SEQ ID NO: 7317348 - DNA, 22 bp, Homo sapiens
tgtgttcttaaaagcagtgata

SEQ ID NO: 7317349 - DNA, 22 bp, Homo sapiens
tgtgttgtgacattcttggatg

SEQ ID NO: 7317350 - DNA, 22 bp, Homo sapiens
tgtgttgtgacattcttggatg

SEQ ID NO: 7317351 - DNA, 22 bp, Homo sapiens
tgtgttaattttccctttctct

SEQ ID NO: 7317352 - DNA, 22 bp, Homo sapiens
tgttatatctaaatagccacat

SEQ ID NO: 7317353 - DNA, 22 bp, Homo sapiens
tgttattctctgcctacaagtc

SEQ ID NO: 7317354 - DNA, 22 bp, Homo sapiens
tgttatttatctgagcatttat

SEQ ID NO: 7317355 - DNA, 22 bp, Homo sapiens
tgttattatgtttccagagcct

SEQ ID NO: 7317356 - DNA, 22 bp, Homo sapiens
tgttattctgatgtgcaggata

SEQ ID NO: 7317357 - DNA, 22 bp, Homo sapiens
tgttatttgggaaagttgtaca

SEQ ID NO: 7317358 - DNA, 22 bp, Homo sapiens
tgttatttatctgagcatttat

SEQ ID NO: 7317359 - DNA, 22 bp, Homo sapiens
tgttcaaatcttttgcttattt

SEQ ID NO: 7317360 - DNA, 22 bp, Homo sapiens
tgttcaaatgatcttcttaaat

SEQ ID NO: 7317361 - DNA, 22 bp, Homo sapiens
tgttcaaatgatcttcttaaat

SEQ ID NO: 7317362 - DNA, 22 bp, Homo sapiens
tgttcaaatcttttgcttattt

SEQ ID NO: 7317363 - DNA, 22 bp, Homo sapiens
tgttcaaatcttttgcttattt

SEQ ID NO: 7317364 - DNA, 21 bp, Homo sapiens
tgttcaaacgtacacatttct

SEQ ID NO: 7317365 - DNA, 22 bp, Homo sapiens
tgttcaaaaatatcttctgcaa

SEQ ID NO: 7317366 - DNA, 22 bp, Homo sapiens
tgttcagaacaaaggtaaatga

SEQ ID NO: 7317367 - DNA, 22 bp, Homo sapiens
tgttcagaacaaaggtaaatga

SEQ ID NO: 7317368 - DNA, 22 bp, Homo sapiens
tgtttgacaacaggctcacaga

SEQ ID NO: 7317369 - DNA, 22 bp, Homo sapiens
tgtttgacacctcagtgtttct

SEQ ID NO: 7317370 - DNA, 22 bp, Homo sapiens
tgtttgaaaagtggagatttat

SEQ ID NO: 7317371 - DNA, 22 bp, Homo sapiens
tgtttgaaaagtggagatttat

SEQ ID NO: 7317372 - DNA, 22 bp, Homo sapiens
tgtttccaaatggtataaagac

SEQ ID NO: 7317373 - DNA, 22 bp, Homo sapiens
tgtttccaaagtcttttcttaa

SEQ ID NO: 7317374 - DNA, 19 bp, Homo sapiens
tgtttacatgtttcttcag

SEQ ID NO: 7317375 - DNA, 22 bp, Homo sapiens
tgttctggggttgagagacaat

SEQ ID NO: 7317376 - DNA, 22 bp, Homo sapiens
tgttctggagataagaggtaga

SEQ ID NO: 7317377 - DNA, 22 bp, Homo sapiens
tgttctggagataagaggtaga

SEQ ID NO: 7317378 - DNA, 21 bp, Homo sapiens
tgtttaatacatatttgtgga

SEQ ID NO: 7317379 - DNA, 22 bp, Homo sapiens
tgtttacaaaaccgtggtactg

SEQ ID NO: 7317380 - DNA, 22 bp, Homo sapiens
tgtttacaagccacttgttaag

SEQ ID NO: 7317381 - DNA, 22 bp, Homo sapiens
tgtttacaaggagaatttgagg

SEQ ID NO: 7317382 - DNA, 22 bp, Homo sapiens
tgtttacaaggagtttatattg

SEQ ID NO: 7317383 - DNA, 22 bp, Homo sapiens
tgtttacagtttttagtaccct

SEQ ID NO: 7317384 - DNA, 22 bp, Homo sapiens
tgtttacagggtgattttacct

SEQ ID NO: 7317385 - DNA, 22 bp, Homo sapiens
tgtttacagggtgattttacct

SEQ ID NO: 7317386 - DNA, 22 bp, Homo sapiens
tgtttacagggtgattttacct

SEQ ID NO: 7317387 - DNA, 22 bp, Homo sapiens
tgtttacacttcaaggttaagg

SEQ ID NO: 7317388 - DNA, 22 bp, Homo sapiens
tgtttacagcactgcacactgc

SEQ ID NO: 7317389 - DNA, 22 bp, Homo sapiens
ttaacacttgaactctacatgt

SEQ ID NO: 7317390 - DNA, 22 bp, Homo sapiens
ttaacactcctaactacagtct

SEQ ID NO: 7317391 - DNA, 22 bp, Homo sapiens
ttaacagaggacacatcaaact

SEQ ID NO: 7317392 - DNA, 22 bp, Homo sapiens
ttaacagacatatatatttgta

SEQ ID NO: 7317393 - DNA, 22 bp, Homo sapiens
ttaacatacatcatgaacaatg

SEQ ID NO: 7317394 - DNA, 22 bp, Homo sapiens
ttaacagtaaagaattgtgcaa

SEQ ID NO: 7317395 - DNA, 22 bp, Homo sapiens
ttaacagtggctaagactgagg

SEQ ID NO: 7317396 - DNA, 22 bp, Homo sapiens
ttaacattgtccttagcagatt

SEQ ID NO: 7317397 - DNA, 22 bp, Homo sapiens
ttaacatttgtgaagcatttag

SEQ ID NO: 7317398 - DNA, 22 bp, Homo sapiens
ttaacatttgtgaagcatttag

SEQ ID NO: 7317399 - DNA, 22 bp, Homo sapiens
ttaacttttatttctgctcgcc

SEQ ID NO: 7317400 - DNA, 22 bp, Homo sapiens
ttaacttgtcagaaaatacagt

SEQ ID NO: 7317401 - DNA, 20 bp, Homo sapiens
ttaagaaaagcacatcctgc

SEQ ID NO: 7317402 - DNA, 22 bp, Homo sapiens
ttaagacacatttctcagacgg

SEQ ID NO: 7317403 - DNA, 21 bp, Homo sapiens
ttaagacacacagattaagga

SEQ ID NO: 7317404 - DNA, 22 bp, Homo sapiens
ttaagaagtgattttcctcatt

SEQ ID NO: 7317405 - DNA, 22 bp, Homo sapiens
ttaagaagtgagtagaagtaat

SEQ ID NO: 7317406 - DNA, 22 bp, Homo sapiens
ttaagactattgtaatagggga

SEQ ID NO: 7317407 - DNA, 23 bp, Homo sapiens
ttaagactggctgaacttagtag

SEQ ID NO: 7317408 - DNA, 22 bp, Homo sapiens
ttaagactaaatgaggtcataa

SEQ ID NO: 7317409 - DNA, 22 bp, Homo sapiens
ttaagacatttttggagattat

SEQ ID NO: 7317410 - DNA, 22 bp, Homo sapiens
ttaagacagtgtatttgttttc

SEQ ID NO: 7317411 - DNA, 22 bp, Homo sapiens
ttaagacatgtgagcataactt

SEQ ID NO: 7317412 - DNA, 22 bp, Homo sapiens
ttaagacattcagatatttcta

SEQ ID NO: 7317413 - DNA, 22 bp, Homo sapiens
ttaagacttttcaaaggcaaac

SEQ ID NO: 7317414 - DNA, 22 bp, Homo sapiens
ttaagtagattcagtgttaagg

SEQ ID NO: 7317415 - DNA, 22 bp, Homo sapiens
ttaagtcacttatctaaagaca

SEQ ID NO: 7317416 - DNA, 22 bp, Homo sapiens
ttaagtcaatatcaatctcagc

SEQ ID NO: 7317417 - DNA, 22 bp, Homo sapiens
ttaagttttaaagctagagtct

SEQ ID NO: 7317418 - DNA, 22 bp, Homo sapiens
ttaaggcaactgggtccaagat

SEQ ID NO: 7317419 - DNA, 22 bp, Homo sapiens
ttaaggaattacgaaaatattt

SEQ ID NO: 7317420 - DNA, 22 bp, Homo sapiens
ttaaggagcacagtgtattaat

SEQ ID NO: 7317421 - DNA, 22 bp, Homo sapiens
ttaaatgaacgagatatgcaac

SEQ ID NO: 7317422 - DNA, 22 bp, Homo sapiens
ttaaatgacttttattattctc

SEQ ID NO: 7317423 - DNA, 22 bp, Homo sapiens
ttaaatgatgcatatcatttag

SEQ ID NO: 7317424 - DNA, 22 bp, Homo sapiens
ttaaatgtgatttcatttatgt

SEQ ID NO: 7317425 - DNA, 22 bp, Homo sapiens
ttaacaaaaatatcaggcatca

SEQ ID NO: 7317426 - DNA, 22 bp, Homo sapiens
ttaaattaggactctagttctg

SEQ ID NO: 7317427 - DNA, 22 bp, Homo sapiens
ttaaattaggactctagttctg

SEQ ID NO: 7317428 - DNA, 22 bp, Homo sapiens
ttaacaaggtgactgcattaaa

SEQ ID NO: 7317429 - DNA, 22 bp, Homo sapiens
ttaacaaagctctgttcctttt

SEQ ID NO: 7317430 - DNA, 22 bp, Homo sapiens
ttaacaaatatttcccatgccc

SEQ ID NO: 7317431 - DNA, 22 bp, Homo sapiens
ttaacaaagtaacgggaaaaga

SEQ ID NO: 7317432 - DNA, 22 bp, Homo sapiens
tgttttctgtgtagagatcaca

SEQ ID NO: 7317433 - DNA, 22 bp, Homo sapiens
ttaaagcatcctgtcagtctgt

SEQ ID NO: 7317434 - DNA, 22 bp, Homo sapiens
tgtttttatctctgtgtacaac

SEQ ID NO: 7317435 - DNA, 22 bp, Homo sapiens
tgtttttaaataatgatagaaa

SEQ ID NO: 7317436 - DNA, 22 bp, Homo sapiens
tgtttttaaaatgtcctggtta

SEQ ID NO: 7317437 - DNA, 22 bp, Homo sapiens
tgtttttaaataatgatagaaa

SEQ ID NO: 7317438 - DNA, 22 bp, Homo sapiens
ttaaatattatgttgtctgcaa

SEQ ID NO: 7317439 - DNA, 22 bp, Homo sapiens
ttagagagaaccatcaggatct

SEQ ID NO: 7317440 - DNA, 20 bp, Homo sapiens
ttagaagggccagatgaagg

SEQ ID NO: 7317441 - DNA, 22 bp, Homo sapiens
ttagaagtaaggtcagatttct

SEQ ID NO: 7317442 - DNA, 22 bp, Homo sapiens
ttagagaaattctggtaatgta

SEQ ID NO: 7317443 - DNA, 22 bp, Homo sapiens
ttactttgggtcctgcttataa

SEQ ID NO: 7317444 - DNA, 22 bp, Homo sapiens
ttactttggcaaactcctgccc

SEQ ID NO: 7317445 - DNA, 22 bp, Homo sapiens
ttagaaagagtataccagaaac

SEQ ID NO: 7317446 - DNA, 20 bp, Homo sapiens
ttagaaagagcgtgataaga

SEQ ID NO: 7317447 - DNA, 22 bp, Homo sapiens
ttactcttaatggcaacaactg

SEQ ID NO: 7317448 - DNA, 22 bp, Homo sapiens
ttactcattgctggatctagaa

SEQ ID NO: 7317449 - DNA, 19 bp, Homo sapiens
ttactcattctaaatgggc

SEQ ID NO: 7317450 - DNA, 22 bp, Homo sapiens
ttactctgaatgtttctactga

SEQ ID NO: 7317451 - DNA, 22 bp, Homo sapiens
ttactgatcccccaggtgaccc

SEQ ID NO: 7317452 - DNA, 22 bp, Homo sapiens
ttactgatggaacagagataga

SEQ ID NO: 7317453 - DNA, 22 bp, Homo sapiens
ttactgatgtcattagaaacag

SEQ ID NO: 7317454 - DNA, 21 bp, Homo sapiens
ttactttagaaattgcctttt

SEQ ID NO: 7317455 - DNA, 22 bp, Homo sapiens
ttacttgaaatgtgataagaga

SEQ ID NO: 7317456 - DNA, 22 bp, Homo sapiens
ttacttgaaaggaaattaaggt

SEQ ID NO: 7317457 - DNA, 22 bp, Homo sapiens
ttacttgatgatgtataaagtc

SEQ ID NO: 7317458 - DNA, 22 bp, Homo sapiens
ttacttgatttgaaaatcatag

SEQ ID NO: 7317459 - DNA, 22 bp, Homo sapiens
ttacttgaaaaccaccagtatt

SEQ ID NO: 7317460 - DNA, 19 bp, Homo sapiens
ttacttcaggagtgaaatt

SEQ ID NO: 7317461 - DNA, 22 bp, Homo sapiens
ttacttattaccaccaatgccg

SEQ ID NO: 7317462 - DNA, 19 bp, Homo sapiens
ttacttcaggagtgaaatt

SEQ ID NO: 7317463 - DNA, 22 bp, Homo sapiens
ttacttaaaaattctaagcccc

SEQ ID NO: 7317464 - DNA, 22 bp, Homo sapiens
ttactgtttgaaaaatgaatgt

SEQ ID NO: 7317465 - DNA, 22 bp, Homo sapiens
ttactgttcctctctcaaagag

SEQ ID NO: 7317466 - DNA, 18 bp, Homo sapiens
ttactgttatcaaaacag

SEQ ID NO: 7317467 - DNA, 22 bp, Homo sapiens
ttacacaagttctttaacctat

SEQ ID NO: 7317468 - DNA, 22 bp, Homo sapiens
ttacacatgaaggtccaatgtt

SEQ ID NO: 7317469 - DNA, 22 bp, Homo sapiens
ttacacatgaaggtccaatgtt

SEQ ID NO: 7317470 - DNA, 22 bp, Homo sapiens
ttacacatgctcacttatttgt

SEQ ID NO: 7317471 - DNA, 22 bp, Homo sapiens
ttacacatgctttgtgtgtatg

SEQ ID NO: 7317472 - DNA, 22 bp, Homo sapiens
ttacactgacagctgaaaagca

SEQ ID NO: 7317473 - DNA, 22 bp, Homo sapiens
ttacacattgcagatcaaaatg

SEQ ID NO: 7317474 - DNA, 21 bp, Homo sapiens
ttacacactgcttctagaatg

SEQ ID NO: 7317475 - DNA, 22 bp, Homo sapiens
ttacacactctgccctgctgtt

SEQ ID NO: 7317476 - DNA, 21 bp, Homo sapiens
ttacacactgcttctagaatg

SEQ ID NO: 7317477 - DNA, 22 bp, Homo sapiens
ttacacacaattagcatagtaa

SEQ ID NO: 7317478 - DNA, 22 bp, Homo sapiens
ttacacacagagctgggcctgg

SEQ ID NO: 7317479 - DNA, 22 bp, Homo sapiens
ttacacacaattagcatagtaa

SEQ ID NO: 7317480 - DNA, 22 bp, Homo sapiens
ttacatcatgcttatccctttc

SEQ ID NO: 7317481 - DNA, 22 bp, Homo sapiens
ttacatcagcaagagtgtatgt

SEQ ID NO: 7317482 - DNA, 22 bp, Homo sapiens
ttacatcactttacttaataat

SEQ ID NO: 7317483 - DNA, 22 bp, Homo sapiens
ttacatcagaaggaaacagcgt

SEQ ID NO: 7317484 - DNA, 22 bp, Homo sapiens
ttacatcagaatcacccaggaa

SEQ ID NO: 7317485 - DNA, 22 bp, Homo sapiens
ttacatcagaaggaaacagcgt

SEQ ID NO: 7317486 - DNA, 22 bp, Homo sapiens
ttacatattgtctattgttcaa

SEQ ID NO: 7317487 - DNA, 22 bp, Homo sapiens
ttacatctgcactccaggacag

SEQ ID NO: 7317488 - DNA, 19 bp, Homo sapiens
ttacatctgcaacactggt

SEQ ID NO: 7317489 - DNA, 22 bp, Homo sapiens
ttacatcattgagacatacata

SEQ ID NO: 7317490 - DNA, 22 bp, Homo sapiens
ttacatcattgagacatacata

SEQ ID NO: 7317491 - DNA, 22 bp, Homo sapiens
ttacatcatggagggtattgaa

SEQ ID NO: 7317492 - DNA, 22 bp, Homo sapiens
ttacatcatgtaactggatata

SEQ ID NO: 7317493 - DNA, 22 bp, Homo sapiens
ttacatcattgagacatacata

SEQ ID NO: 7317494 - DNA, 22 bp, Homo sapiens
ttacatctaaactgtgaacaat

SEQ ID NO: 7317495 - DNA, 22 bp, Homo sapiens
ttacacttctaaaaaaagcagg

SEQ ID NO: 7317496 - DNA, 22 bp, Homo sapiens
ttacagtagatacaatgagtaa

SEQ ID NO: 7317497 - DNA, 22 bp, Homo sapiens
ttacagtagattttgaatgtgg

SEQ ID NO: 7317498 - DNA, 22 bp, Homo sapiens
ttctagttaatgtagcatcttg

SEQ ID NO: 7317499 - DNA, 22 bp, Homo sapiens
ttctagttttgccacaggatac

SEQ ID NO: 7317500 - DNA, 22 bp, Homo sapiens
ttctataagactcatatttctt

SEQ ID NO: 7317501 - DNA, 20 bp, Homo sapiens
ttctatacatatcactgaaa

SEQ ID NO: 7317502 - DNA, 20 bp, Homo sapiens
ttctatacatatcactgaaa

SEQ ID NO: 7317503 - DNA, 22 bp, Homo sapiens
ttctgagatgtgaatctgtcaa

SEQ ID NO: 7317504 - DNA, 22 bp, Homo sapiens
ttctgagaaatgggttcacata

SEQ ID NO: 7317505 - DNA, 22 bp, Homo sapiens
ttctgagaaggctgtggacaca

SEQ ID NO: 7317506 - DNA, 22 bp, Homo sapiens
ttctgagaaggctgtggacaca

SEQ ID NO: 7317507 - DNA, 22 bp, Homo sapiens
ttctgagaatgcttctggaatc

SEQ ID NO: 7317508 - DNA, 22 bp, Homo sapiens
ttctgctttggttccatggatg

SEQ ID NO: 7317509 - DNA, 22 bp, Homo sapiens
ttctgctttcagttcttctggg

SEQ ID NO: 7317510 - DNA, 22 bp, Homo sapiens
ttctgcttttctctgtctgagt

SEQ ID NO: 7317511 - DNA, 20 bp, Homo sapiens
ttctgcttgcaaatatcaag

SEQ ID NO: 7317512 - DNA, 22 bp, Homo sapiens
ttctgcttattctgtagccttt

SEQ ID NO: 7317513 - DNA, 22 bp, Homo sapiens
ttctggaaagatttgcgtgtaa

SEQ ID NO: 7317514 - DNA, 22 bp, Homo sapiens
ttctggaaaccctcagccagtg

SEQ ID NO: 7317515 - DNA, 21 bp, Homo sapiens
ttctgctaagaaaacattatt

SEQ ID NO: 7317516 - DNA, 22 bp, Homo sapiens
ttctgctgcctactcctgggga

SEQ ID NO: 7317517 - DNA, 22 bp, Homo sapiens
ttcttgatgaatgctaagaact

SEQ ID NO: 7317518 - DNA, 22 bp, Homo sapiens
ttcttgattcttccttgaagga

SEQ ID NO: 7317519 - DNA, 22 bp, Homo sapiens
ttcttgatttcatgcagttaag

SEQ ID NO: 7317520 - DNA, 22 bp, Homo sapiens
ttctttaaaatagtgagaaaga

SEQ ID NO: 7317521 - DNA, 22 bp, Homo sapiens
ttctttatagctattggatgag

SEQ ID NO: 7317522 - DNA, 22 bp, Homo sapiens
ttctttatcagttactcatagg

SEQ ID NO: 7317523 - DNA, 22 bp, Homo sapiens
ttctttatcagttactcatagg

SEQ ID NO: 7317524 - DNA, 18 bp, Homo sapiens
ttctttaattcagtttga

SEQ ID NO: 7317525 - DNA, 18 bp, Homo sapiens
ttctttaattcagtttga

SEQ ID NO: 7317526 - DNA, 22 bp, Homo sapiens
ttcttgaaaatagccatgtaca

SEQ ID NO: 7317527 - DNA, 22 bp, Homo sapiens
ttctggtctctctgacctagga

SEQ ID NO: 7317528 - DNA, 21 bp, Homo sapiens
ttctgggttgttaatctgaac

SEQ ID NO: 7317529 - DNA, 18 bp, Homo sapiens
ttctgggtgttatgttta

SEQ ID NO: 7317530 - DNA, 22 bp, Homo sapiens
ttctgggtggccagtatttaga

SEQ ID NO: 7317531 - DNA, 22 bp, Homo sapiens
ttctgggggccaggacagtggt

SEQ ID NO: 7317532 - DNA, 22 bp, Homo sapiens
ttctggggccaattgccactgc

SEQ ID NO: 7317533 - DNA, 22 bp, Homo sapiens
ttctggggttatgggtgattct

SEQ ID NO: 7317534 - DNA, 22 bp, Homo sapiens
ttctggggctaatacagaggtc

SEQ ID NO: 7317535 - DNA, 19 bp, Homo sapiens
ttctggggcctggccttgg

SEQ ID NO: 7317536 - DNA, 22 bp, Homo sapiens
ttctgggggaatacagctatga

SEQ ID NO: 7317537 - DNA, 22 bp, Homo sapiens
ttctggggccccagtgtcctcg

SEQ ID NO: 7317538 - DNA, 22 bp, Homo sapiens
ttctggggacataacagtaagc

SEQ ID NO: 7317539 - DNA, 22 bp, Homo sapiens
ttcttaaaacttatggacaggt

SEQ ID NO: 7317540 - DNA, 22 bp, Homo sapiens
ttctgtttctggggtctctgac

SEQ ID NO: 7317541 - DNA, 22 bp, Homo sapiens
ttctgtttactcagaaatacaa

SEQ ID NO: 7317542 - DNA, 22 bp, Homo sapiens
ttctgttacatggggcacagtg

SEQ ID NO: 7317543 - DNA, 22 bp, Homo sapiens
ttctgttatcattaagcattat

SEQ ID NO: 7317544 - DNA, 22 bp, Homo sapiens
ttgatgttcataaatgatacag

SEQ ID NO: 7317545 - DNA, 22 bp, Homo sapiens
ttgattctacttaaaacatatg

SEQ ID NO: 7317546 - DNA, 22 bp, Homo sapiens
ttgattccttgaaatatccttg

SEQ ID NO: 7317547 - DNA, 22 bp, Homo sapiens
ttgattctgatcctttgctagc

SEQ ID NO: 7317548 - DNA, 22 bp, Homo sapiens
ttgattctgatcctgtctggag

SEQ ID NO: 7317549 - DNA, 22 bp, Homo sapiens
ttgattctatgttgttgtctca

SEQ ID NO: 7317550 - DNA, 22 bp, Homo sapiens
ttgatctctgttgctgtctttg

SEQ ID NO: 7317551 - DNA, 22 bp, Homo sapiens
ttgagtgtaaggaatgtggggc

SEQ ID NO: 7317552 - DNA, 22 bp, Homo sapiens
ttgagtctgtgccctatgctgt

SEQ ID NO: 7317553 - DNA, 22 bp, Homo sapiens
ttgatctttataatagttttga

SEQ ID NO: 7317554 - DNA, 22 bp, Homo sapiens
ttgatcttggactttccagcct

SEQ ID NO: 7317555 - DNA, 22 bp, Homo sapiens
ttgatcttcatcgaaatattgt

SEQ ID NO: 7317556 - DNA, 22 bp, Homo sapiens
ttgatcttacagtgttcttcca

SEQ ID NO: 7317557 - DNA, 22 bp, Homo sapiens
ttgatctgcctcattcttgttc

SEQ ID NO: 7317558 - DNA, 22 bp, Homo sapiens
ttgatgcactatgtaacttaca

SEQ ID NO: 7317559 - DNA, 22 bp, Homo sapiens
ttgattttaaaatagtgacact

SEQ ID NO: 7317560 - DNA, 22 bp, Homo sapiens
ttgattttcaattcattgacaa

SEQ ID NO: 7317561 - DNA, 22 bp, Homo sapiens
ttgattttgcctgatctgagag

SEQ ID NO: 7317562 - DNA, 22 bp, Homo sapiens
ttgatttttccagcttctagag

SEQ ID NO: 7317563 - DNA, 22 bp, Homo sapiens
ttgcaaagactggcttaacagt

SEQ ID NO: 7317564 - DNA, 22 bp, Homo sapiens
ttgcaaataatagcctgaaact

SEQ ID NO: 7317565 - DNA, 22 bp, Homo sapiens
ttgcaaatctttgccagaaggc

SEQ ID NO: 7317566 - DNA, 22 bp, Homo sapiens
ttgcaaatattgtttacctttc

SEQ ID NO: 7317567 - DNA, 22 bp, Homo sapiens
ttgagatattcagttccattga

SEQ ID NO: 7317568 - DNA, 22 bp, Homo sapiens
ttgaattatttgtttgcaagct

SEQ ID NO: 7317569 - DNA, 22 bp, Homo sapiens
ttctttatgcttctgtttaggc

SEQ ID NO: 7317570 - DNA, 22 bp, Homo sapiens
ttctttatggaatggtgatagt

SEQ ID NO: 7317571 - DNA, 22 bp, Homo sapiens
ttctttatgcttctgtttaggc

SEQ ID NO: 7317572 - DNA, 22 bp, Homo sapiens
ttctttatgttaatgaatctat

SEQ ID NO: 7317573 - DNA, 22 bp, Homo sapiens
ttctttattgagacttcattgt

SEQ ID NO: 7317574 - DNA, 22 bp, Homo sapiens
ttgaagagacgatttttccacc

SEQ ID NO: 7317575 - DNA, 22 bp, Homo sapiens
ttgaagagcaccagcattttga

SEQ ID NO: 7317576 - DNA, 22 bp, Homo sapiens
ttgaagatctttgcattgcagg

SEQ ID NO: 7317577 - DNA, 22 bp, Homo sapiens
ttgaagactaatttagataatg

SEQ ID NO: 7317578 - DNA, 22 bp, Homo sapiens
ttgaagactaatttagataatg

SEQ ID NO: 7317579 - DNA, 22 bp, Homo sapiens
ttgaagacacagacatatagag

SEQ ID NO: 7317580 - DNA, 22 bp, Homo sapiens
ttgaagacctttagtgctatgt

SEQ ID NO: 7317581 - DNA, 22 bp, Homo sapiens
ttgaagacacagacatatagag

SEQ ID NO: 7317582 - DNA, 22 bp, Homo sapiens
ttgaagaagtaattttaagtct

SEQ ID NO: 7317583 - DNA, 22 bp, Homo sapiens
ttctttctcaacatgaatgttt

SEQ ID NO: 7317584 - DNA, 20 bp, Homo sapiens
ttccacatctttgcacatgc

SEQ ID NO: 7317585 - DNA, 22 bp, Homo sapiens
ttccacagtggctgtagttctg

SEQ ID NO: 7317586 - DNA, 22 bp, Homo sapiens
ttccacaattcagattgttgcc

SEQ ID NO: 7317587 - DNA, 22 bp, Homo sapiens
ttccacaatgtatgaataagat

SEQ ID NO: 7317588 - DNA, 22 bp, Homo sapiens
ttccacaatgccaggggcatca

SEQ ID NO: 7317589 - DNA, 22 bp, Homo sapiens
ttccacaatggttaagctcgtt

SEQ ID NO: 7317590 - DNA, 23 bp, Homo sapiens
ttccacaatgaaaataaagcagg

SEQ ID NO: 7317591 - DNA, 17 bp, Homo sapiens
ttccacaatagtttgtc

SEQ ID NO: 7317592 - DNA, 22 bp, Homo sapiens
ttccacaagtgatatctagctg

SEQ ID NO: 7317593 - DNA, 22 bp, Homo sapiens
ttccacaaggccttgtcctgct

SEQ ID NO: 7317594 - DNA, 22 bp, Homo sapiens
ttccacaagatgtttcttagaa

SEQ ID NO: 7317595 - DNA, 22 bp, Homo sapiens
ttccacaagacttgggttaaga

SEQ ID NO: 7317596 - DNA, 22 bp, Homo sapiens
ttccacaacaaccaagcatata

SEQ ID NO: 7317597 - DNA, 22 bp, Homo sapiens
ttccacaaatcaattctgctga

SEQ ID NO: 7317598 - DNA, 22 bp, Homo sapiens
ttccacaaacacatcctgagca

SEQ ID NO: 7317599 - DNA, 22 bp, Homo sapiens
ttccacaaatacactccacatt

SEQ ID NO: 7317600 - DNA, 22 bp, Homo sapiens
ttcctaatcacgaacattattt

SEQ ID NO: 7317601 - DNA, 22 bp, Homo sapiens
ttcctaatggcaaaacatgttt

SEQ ID NO: 7317602 - DNA, 22 bp, Homo sapiens
ttccagaacttttgttaatttc

SEQ ID NO: 7317603 - DNA, 20 bp, Homo sapiens
ttccagagatctgcatttta

SEQ ID NO: 7317604 - DNA, 22 bp, Homo sapiens
ttccagagcccatgctctaggc

SEQ ID NO: 7317605 - DNA, 22 bp, Homo sapiens
ttcctcttattttcccagtgat

SEQ ID NO: 7317606 - DNA, 22 bp, Homo sapiens
ttcctatccttttatgtttatg

SEQ ID NO: 7317607 - DNA, 22 bp, Homo sapiens
ttcctatggctcagttgcattt

SEQ ID NO: 7317608 - DNA, 22 bp, Homo sapiens
ttctaatagctgcctatgtatt

SEQ ID NO: 7317609 - DNA, 22 bp, Homo sapiens
ttctacaatatgaataatgaag

SEQ ID NO: 7317610 - DNA, 22 bp, Homo sapiens
ttctagaaacacatgcaaacag

SEQ ID NO: 7317611 - DNA, 22 bp, Homo sapiens
ttctagaaactggagcaaacag

SEQ ID NO: 7317612 - DNA, 22 bp, Homo sapiens
ttctagaaccatgacttcaggg

SEQ ID NO: 7317613 - DNA, 22 bp, Homo sapiens
ttctagcttgagtgaataaagg

SEQ ID NO: 7317614 - DNA, 22 bp, Homo sapiens
ttctagagccagggcagctgca

SEQ ID NO: 7317615 - DNA, 22 bp, Homo sapiens
ttccttctattcagctccaaga

SEQ ID NO: 7317616 - DNA, 20 bp, Homo sapiens
ttctaaggttttggtgcaca

SEQ ID NO: 7317617 - DNA, 22 bp, Homo sapiens
ttccttctgaagcctttgtgtt

SEQ ID NO: 7317618 - DNA, 22 bp, Homo sapiens
ttcctgttcaggaaagttgtgt

SEQ ID NO: 7317619 - DNA, 22 bp, Homo sapiens
ttcctgaatataaagacactag

SEQ ID NO: 7317620 - DNA, 22 bp, Homo sapiens
ttcctctttagggctggccagg

SEQ ID NO: 7317621 - DNA, 22 bp, Homo sapiens
ttcctcttccatcttcccaggg

SEQ ID NO: 7317622 - DNA, 22 bp, Homo sapiens
ttcacagtggccctctctgagt

SEQ ID NO: 7317623 - DNA, 22 bp, Homo sapiens
ttcacattagtggttctatata

SEQ ID NO: 7317624 - DNA, 22 bp, Homo sapiens
ttcacattccgcggctattttc

SEQ ID NO: 7317625 - DNA, 22 bp, Homo sapiens
ttcacattctcacaagaggaaa

SEQ ID NO: 7317626 - DNA, 22 bp, Homo sapiens
ttcacattgaaggtgctttctt

SEQ ID NO: 7317627 - DNA, 19 bp, Homo sapiens
ttcacattggaagaagtag

SEQ ID NO: 7317628 - DNA, 21 bp, Homo sapiens
ttcagggtttcacaatactaa

SEQ ID NO: 7317629 - DNA, 22 bp, Homo sapiens
ttccaatttgtggtgagttaat

SEQ ID NO: 7317630 - DNA, 20 bp, Homo sapiens
ttcatgggagcaaagaggcc

SEQ ID NO: 7317631 - DNA, 18 bp, Homo sapiens
ttcatcatgactctgtgg

SEQ ID NO: 7317632 - DNA, 22 bp, Homo sapiens
ttcatggagttgagaaggctaa

SEQ ID NO: 7317633 - DNA, 22 bp, Homo sapiens
ttcatcatcagaactgttcact

SEQ ID NO: 7317634 - DNA, 22 bp, Homo sapiens
ttcaacaagtcttttttcactg

SEQ ID NO: 7317635 - DNA, 22 bp, Homo sapiens
ttcaaagtaccgtacttaatgg

SEQ ID NO: 7317636 - DNA, 17 bp, Homo sapiens
ttcaaagcttatcaagg

SEQ ID NO: 7317637 - DNA, 22 bp, Homo sapiens
ttagagttgagtttctatgaga

SEQ ID NO: 7317638 - DNA, 22 bp, Homo sapiens
ttagataaattaagactttaca

SEQ ID NO: 7317639 - DNA, 22 bp, Homo sapiens
ttagataaaagtgttcaataaa

SEQ ID NO: 7317640 - DNA, 22 bp, Homo sapiens
ttcaacaattaagtatcagcct

SEQ ID NO: 7317641 - DNA, 22 bp, Homo sapiens
ttcaacatcttggagctggaac

SEQ ID NO: 7317642 - DNA, 22 bp, Homo sapiens
ttcaacatcattgtaagcctct

SEQ ID NO: 7317643 - DNA, 22 bp, Homo sapiens
ttcaacatagctgaggcatata

SEQ ID NO: 7317644 - DNA, 22 bp, Homo sapiens
ttcaacatatgaattttgggtg

SEQ ID NO: 7317645 - DNA, 22 bp, Homo sapiens
ttcaacatcaagaatgcatgga

SEQ ID NO: 7317646 - DNA, 22 bp, Homo sapiens
ttcaacatcaagaatgcatgga

SEQ ID NO: 7317647 - DNA, 19 bp, Homo sapiens
ttcaacatgctgaggcagc

SEQ ID NO: 7317648 - DNA, 22 bp, Homo sapiens
ttcaacatgcaaacatgtttgt

SEQ ID NO: 7317649 - DNA, 22 bp, Homo sapiens
ttcaacatgcaaactttgggag

SEQ ID NO: 7317650 - DNA, 22 bp, Homo sapiens
ttcaacatgctttatttctaaa

SEQ ID NO: 7317651 - DNA, 22 bp, Homo sapiens
ttcaactttggagatttaataa

SEQ ID NO: 7317652 - DNA, 22 bp, Homo sapiens
ttcaactttatgcatatgtatt

SEQ ID NO: 7317653 - DNA, 22 bp, Homo sapiens
ttcaactttatgcatatgtatt

SEQ ID NO: 7317654 - DNA, 22 bp, Homo sapiens
ttcaactttaggcaaagaaaac

SEQ ID NO: 7317655 - DNA, 22 bp, Homo sapiens
ttcaacatttttgagtttaggt

SEQ ID NO: 7317656 - DNA, 22 bp, Homo sapiens
ttcaacatttgatacaagtcag

SEQ ID NO: 7317657 - DNA, 22 bp, Homo sapiens
ttcaacatttgaaatgaatgaa

SEQ ID NO: 7317658 - DNA, 22 bp, Homo sapiens
ttcaacatttatcagtttatca

SEQ ID NO: 7317659 - DNA, 22 bp, Homo sapiens
ttcaacattacacaggcaattc

SEQ ID NO: 7317660 - DNA, 23 bp, Homo sapiens
ttcaacatttattgagcgtccgt

SEQ ID NO: 7317661 - DNA, 22 bp, Homo sapiens
ttcaacatgttctacataaggg

SEQ ID NO: 7317662 - DNA, 22 bp, Homo sapiens
ttcacagtgctcacagttcagt

SEQ ID NO: 7317663 - DNA, 22 bp, Homo sapiens
ttcacagtcacccttctccatg

SEQ ID NO: 7317664 - DNA, 22 bp, Homo sapiens
ttcacagtaagtaggatagttg

SEQ ID NO: 7317665 - DNA, 22 bp, Homo sapiens
ttcacaatagctggcatcatct

SEQ ID NO: 7317666 - DNA, 22 bp, Homo sapiens
ttcacaaagctggagcatttcc

SEQ ID NO: 7317667 - DNA, 22 bp, Homo sapiens
ttcacaaagctggttccttctg

SEQ ID NO: 7317668 - DNA, 22 bp, Homo sapiens
ttcaatttagtgatgttgttgg

SEQ ID NO: 7317669 - DNA, 22 bp, Homo sapiens
ttcacaaaatggtttgttgatg

SEQ ID NO: 7317670 - DNA, 22 bp, Homo sapiens
ttgttttattctgcaatttccc

SEQ ID NO: 7317671 - DNA, 22 bp, Homo sapiens
ttgtttttaaacatgtgactga

SEQ ID NO: 7317672 - DNA, 22 bp, Homo sapiens
ttgttttagtaggtacactgag

SEQ ID NO: 7317673 - DNA, 22 bp, Homo sapiens
ttgtttcttcaggcttttagga

SEQ ID NO: 7317674 - DNA, 22 bp, Homo sapiens
ttgttattattactaagtcttc

SEQ ID NO: 7317675 - DNA, 22 bp, Homo sapiens
ttgttaaaaatagatttccagg

SEQ ID NO: 7317676 - DNA, 19 bp, Homo sapiens
ttgtgtgtcagtcagagtt

SEQ ID NO: 7317677 - DNA, 19 bp, Homo sapiens
ttgtgtgtcagtcagagtt

SEQ ID NO: 7317678 - DNA, 22 bp, Homo sapiens
ttgtgacattgattaaactatg

SEQ ID NO: 7317679 - DNA, 19 bp, Homo sapiens
ttgtgtgtcagtcagagtt

SEQ ID NO: 7317680 - DNA, 22 bp, Homo sapiens
ttgtgacaatacagcatggaga

SEQ ID NO: 7317681 - DNA, 22 bp, Homo sapiens
ttgtgtgtgagccttcaccaca

SEQ ID NO: 7317682 - DNA, 22 bp, Homo sapiens
ttgtgtgtgagccttcaccaca

SEQ ID NO: 7317683 - DNA, 22 bp, Homo sapiens
ttgtgtgtgagccttcaccaca

SEQ ID NO: 7317684 - DNA, 22 bp, Homo sapiens
ttgtgtgtcttcttcactgccc

SEQ ID NO: 7317685 - DNA, 22 bp, Homo sapiens
ttgtgtgtcttcttcactgccc

SEQ ID NO: 7317686 - DNA, 22 bp, Homo sapiens
ttgtgtgtcttcttcactgccc

SEQ ID NO: 7317687 - DNA, 22 bp, Homo sapiens
ttgtgtgtttgtagaaaatcca

SEQ ID NO: 7317688 - DNA, 22 bp, Homo sapiens
ttgtgtgtgtaactttatgaga

SEQ ID NO: 7317689 - DNA, 22 bp, Homo sapiens
ttgtgtgtgtaactttatgaga

SEQ ID NO: 7317690 - DNA, 22 bp, Homo sapiens
ttgtgtgtgtaactttatgaga

SEQ ID NO: 7317691 - DNA, 22 bp, Homo sapiens
ttgtgtgtgtaactttatgaga

SEQ ID NO: 7317692 - DNA, 22 bp, Homo sapiens
ttgtgtgtttgtagaaaatcca

SEQ ID NO: 7317693 - DNA, 22 bp, Homo sapiens
ttgtgtgtttgtagaaaatcca

SEQ ID NO: 7317694 - DNA, 22 bp, Homo sapiens
ttgtgtttctggccaagatgga

SEQ ID NO: 7317695 - DNA, 22 bp, Homo sapiens
ttgtgtttgatgctgacacgca

SEQ ID NO: 7317696 - DNA, 22 bp, Homo sapiens
ttgtgtttctgtgatatgtaaa

SEQ ID NO: 7317697 - DNA, 22 bp, Homo sapiens
ttgcaactcttgaaaagcattg

SEQ ID NO: 7317698 - DNA, 20 bp, Homo sapiens
ttgcaactgtaagaagcagg

SEQ ID NO: 7317699 - DNA, 22 bp, Homo sapiens
ttgcaagatgttaccattgtta

SEQ ID NO: 7317700 - DNA, 22 bp, Homo sapiens
ttgcaaggagccactctgcctg

SEQ ID NO: 7317701 - DNA, 22 bp, Homo sapiens
ttgcaaggctaggttcacccac

SEQ ID NO: 7317702 - DNA, 22 bp, Homo sapiens
ttgcaagggataccatactaag

SEQ ID NO: 7317703 - DNA, 22 bp, Homo sapiens
ttgcaagggcatgtgtgcgtgt

SEQ ID NO: 7317704 - DNA, 22 bp, Homo sapiens
ttgcaagggtgttttgaggtgt

SEQ ID NO: 7317705 - DNA, 22 bp, Homo sapiens
ttgcaaggtcatcatgcattgg

SEQ ID NO: 7317706 - DNA, 22 bp, Homo sapiens
ttgcaaggtttctctctgccta

SEQ ID NO: 7317707 - DNA, 22 bp, Homo sapiens
ttgcaacatctgaacatttatc

SEQ ID NO: 7317708 - DNA, 22 bp, Homo sapiens
ttgcaacattgtaagtttatat

SEQ ID NO: 7317709 - DNA, 21 bp, Homo sapiens
ttgcaacaacctatatatttt

SEQ ID NO: 7317710 - DNA, 21 bp, Homo sapiens
ttgcaacaacctatatatttt

SEQ ID NO: 7317711 - DNA, 22 bp, Homo sapiens
ttggtgtgactaaggcagtgtg

SEQ ID NO: 7317712 - DNA, 22 bp, Homo sapiens
ttggttacaagtttgctctgcc

SEQ ID NO: 7317713 - DNA, 22 bp, Homo sapiens
ttggttacacagactggtgctt

SEQ ID NO: 7317714 - DNA, 22 bp, Homo sapiens
ttggttacagactcttctctaa

SEQ ID NO: 7317715 - DNA, 22 bp, Homo sapiens
ttggtgcaaattcctgtaagag

SEQ ID NO: 7317716 - DNA, 19 bp, Homo sapiens
ttggtgcacacatgggccc

SEQ ID NO: 7317717 - DNA, 22 bp, Homo sapiens
ttggtcagctcaatggagaggg

SEQ ID NO: 7317718 - DNA, 22 bp, Homo sapiens
ttggtcatttttcctgtgctca

SEQ ID NO: 7317719 - DNA, 20 bp, Homo sapiens
ttggtcatttacttgttctt

SEQ ID NO: 7317720 - DNA, 22 bp, Homo sapiens
ttggtcatcatgcttgggtcta

SEQ ID NO: 7317721 - DNA, 22 bp, Homo sapiens
ttggggtgttggatggagcaag

SEQ ID NO: 7317722 - DNA, 18 bp, Homo sapiens
ttggtctgggtggaaacc

SEQ ID NO: 7317723 - DNA, 22 bp, Homo sapiens
ttggtctgtagttttcttatgt

SEQ ID NO: 7317724 - DNA, 22 bp, Homo sapiens
ttggtctggagtatgatgataa

SEQ ID NO: 7317725 - DNA, 22 bp, Homo sapiens
ttggtctgcagggagggctgga

SEQ ID NO: 7317726 - DNA, 22 bp, Homo sapiens
ttggtcctgcagaggggtctgg

SEQ ID NO: 7317727 - DNA, 22 bp, Homo sapiens
ttggtccaaagtcctctgagta

SEQ ID NO: 7317728 - DNA, 22 bp, Homo sapiens
ttggtccaggatggcgtgggtg

SEQ ID NO: 7317729 - DNA, 22 bp, Homo sapiens
ttgtctaatgagctccacttca

SEQ ID NO: 7317730 - DNA, 22 bp, Homo sapiens
ttgtctatacatcaataatgat

SEQ ID NO: 7317731 - DNA, 21 bp, Homo sapiens
ttgtcctttagggcttgtctg

SEQ ID NO: 7317732 - DNA, 22 bp, Homo sapiens
ttgtccttcatgttggatttat

SEQ ID NO: 7317733 - DNA, 23 bp, Homo sapiens
ttgtaaaacagtgtgacggttcc

SEQ ID NO: 7317734 - DNA, 23 bp, Homo sapiens
ttgtccttctgaaatatatctgg

SEQ ID NO: 7317735 - DNA, 22 bp, Homo sapiens
ttgtccttccagactcttccac

SEQ ID NO: 7317736 - DNA, 22 bp, Homo sapiens
ttggttcagtaggcatgcctgg

SEQ ID NO: 7317737 - DNA, 22 bp, Homo sapiens
ttggttcagatgggatctgcga

SEQ ID NO: 7317738 - DNA, 22 bp, Homo sapiens
ttggttactaaaaactgtttgg

SEQ ID NO: 7317739 - DNA, 23 bp, Homo sapiens
ttggttactggatttgaggggcc

SEQ ID NO: 7317740 - DNA, 22 bp, Homo sapiens
ttggttacttaagttggtgcga

SEQ ID NO: 7317741 - DNA, 22 bp, Homo sapiens
ttggttacttcagtggagaaag

SEQ ID NO: 7317742 - DNA, 22 bp, Homo sapiens
ttggttacttttaaacttgtct

SEQ ID NO: 7317743 - DNA, 22 bp, Homo sapiens
ttggttcaaaacatggaagggt

SEQ ID NO: 7317744 - DNA, 22 bp, Homo sapiens
ttggtttatttcttcctatgag

SEQ ID NO: 7317745 - DNA, 22 bp, Homo sapiens
ttggtttagtacctgccagcgt

SEQ ID NO: 7317746 - DNA, 22 bp, Homo sapiens
ttgtctgaagtcacacagatgc

SEQ ID NO: 7317747 - DNA, 22 bp, Homo sapiens
ttgtctgagggtttgagagaat

SEQ ID NO: 7317748 - DNA, 22 bp, Homo sapiens
ttgtgaatagtgctgcaataaa

SEQ ID NO: 7317749 - DNA, 22 bp, Homo sapiens
ttgtctgtccaggcaccccaag

SEQ ID NO: 7317750 - DNA, 22 bp, Homo sapiens
ttgtgaaatcgtgtttggaagc

SEQ ID NO: 7317751 - DNA, 22 bp, Homo sapiens
ttgtctgtaaagacggccacca

SEQ ID NO: 7317752 - DNA, 22 bp, Homo sapiens
tttaattttcctcttcctggag

SEQ ID NO: 7317753 - DNA, 22 bp, Homo sapiens
tttaatttgtatttctagaggg

SEQ ID NO: 7317754 - DNA, 22 bp, Homo sapiens
tttaattttcctcttcctggag

SEQ ID NO: 7317755 - DNA, 22 bp, Homo sapiens
tttaattatgttaagccactga

SEQ ID NO: 7317756 - DNA, 22 bp, Homo sapiens
tttaattagcaagccagagagc

SEQ ID NO: 7317757 - DNA, 23 bp, Homo sapiens
tttaaaagttgtaatgtaggctt

SEQ ID NO: 7317758 - DNA, 22 bp, Homo sapiens
tttaaaagttatcatctgtcca

SEQ ID NO: 7317759 - DNA, 22 bp, Homo sapiens
ttgtttttagagaagccctgaa

SEQ ID NO: 7317760 - DNA, 22 bp, Homo sapiens
ttgtttttgtgaggcagcccat

SEQ ID NO: 7317761 - DNA, 22 bp, Homo sapiens
ttgtttttatgaacatccagga

SEQ ID NO: 7317762 - DNA, 23 bp, Homo sapiens
ttgtttttagaggtggcatgaga

SEQ ID NO: 7317763 - DNA, 23 bp, Homo sapiens
ttgtttttagaggtggcatgaga

SEQ ID NO: 7317764 - DNA, 22 bp, Homo sapiens
tttaaaatcagatgggagttgg

SEQ ID NO: 7317765 - DNA, 19 bp, Homo sapiens
tttaatgtgtgctgcaatc

SEQ ID NO: 7317766 - DNA, 22 bp, Homo sapiens
tttaatgttaaatttgtagatg

SEQ ID NO: 7317767 - DNA, 22 bp, Homo sapiens
tttaccattattaaaattaagt

SEQ ID NO: 7317768 - DNA, 22 bp, Homo sapiens
tttaccatcctcttttagaatt

SEQ ID NO: 7317769 - DNA, 22 bp, Homo sapiens
tttaccatataagaaaggcatg

SEQ ID NO: 7317770 - DNA, 22 bp, Homo sapiens
tttacaaggcagaactgattaa

SEQ ID NO: 7317771 - DNA, 22 bp, Homo sapiens
tttacaaggcagaactgattaa

SEQ ID NO: 7317772 - DNA, 22 bp, Homo sapiens
tttacaaggcagttattttcct

SEQ ID NO: 7317773 - DNA, 22 bp, Homo sapiens
tttaccatacatcaaaatattt

SEQ ID NO: 7317774 - DNA, 22 bp, Homo sapiens
tttacaacgttcctggtgctaa

SEQ ID NO: 7317775 - DNA, 22 bp, Homo sapiens
tttacaactttctgttctgtat

SEQ ID NO: 7317776 - DNA, 22 bp, Homo sapiens
tttacttcatttccagtgagga

SEQ ID NO: 7317777 - DNA, 22 bp, Homo sapiens
tttatataacagagactgctat

SEQ ID NO: 7317778 - DNA, 22 bp, Homo sapiens
tttatataacagagactgctat

SEQ ID NO: 7317779 - DNA, 22 bp, Homo sapiens
tttatagttatatacagatgtt

SEQ ID NO: 7317780 - DNA, 22 bp, Homo sapiens
tttatagtcgtctcagtaataa

SEQ ID NO: 7317781 - DNA, 20 bp, Homo sapiens
tttatagtgatcaatttata

SEQ ID NO: 7317782 - DNA, 23 bp, Homo sapiens
tttatagcagcatgatttataat

SEQ ID NO: 7317783 - DNA, 23 bp, Homo sapiens
tttatagcagcatgatttatagt

SEQ ID NO: 7317784 - DNA, 22 bp, Homo sapiens
tttatagtcgtctcagtaataa

SEQ ID NO: 7317785 - DNA, 22 bp, Homo sapiens
tttatagatgtctgtattataa

SEQ ID NO: 7317786 - DNA, 22 bp, Homo sapiens
tttatagatgtctgtattataa

SEQ ID NO: 7317787 - DNA, 22 bp, Homo sapiens
tttatacttcataatgtctatt

SEQ ID NO: 7317788 - DNA, 22 bp, Homo sapiens
tttatactccactctgcaagcg

SEQ ID NO: 7317789 - DNA, 23 bp, Homo sapiens
tttatacaagaaaccgctggcct

SEQ ID NO: 7317790 - DNA, 22 bp, Homo sapiens
tttatacatggagaatttttgc

SEQ ID NO: 7317791 - DNA, 22 bp, Homo sapiens
tttatacatggagaatttttgc

SEQ ID NO: 7317792 - DNA, 22 bp, Homo sapiens
tttataagaagcaatgtctgag

SEQ ID NO: 7317793 - DNA, 22 bp, Homo sapiens
tttataattatctctactctta

SEQ ID NO: 7317794 - DNA, 22 bp, Homo sapiens
tttataacatttcttacctgtg

SEQ ID NO: 7317795 - DNA, 22 bp, Homo sapiens
tttagtttgatgttctactcct

SEQ ID NO: 7317796 - DNA, 22 bp, Homo sapiens
tttagttattgttacagtatga

SEQ ID NO: 7317797 - DNA, 22 bp, Homo sapiens
tttcaaacttaaatacctttcc

SEQ ID NO: 7317798 - DNA, 22 bp, Homo sapiens
tttcaaaattttgcagtggtaa

SEQ ID NO: 7317799 - DNA, 22 bp, Homo sapiens
tttatttggcatctctgccaag

SEQ ID NO: 7317800 - DNA, 22 bp, Homo sapiens
tttatttgtcttgccatttagt

SEQ ID NO: 7317801 - DNA, 22 bp, Homo sapiens
tttattatccagtgttgtcatg

SEQ ID NO: 7317802 - DNA, 22 bp, Homo sapiens
tttcttgtacactggaatttat

SEQ ID NO: 7317803 - DNA, 22 bp, Homo sapiens
tttcttctctaatctcaatgat

SEQ ID NO: 7317804 - DNA, 22 bp, Homo sapiens
tttctttaaaggaactctgttt

SEQ ID NO: 7317805 - DNA, 22 bp, Homo sapiens
tttctttatcatagcatctttg

SEQ ID NO: 7317806 - DNA, 22 bp, Homo sapiens
tttctttaggctgtgttgccaa

SEQ ID NO: 7317807 - DNA, 22 bp, Homo sapiens
tttctttatcatagcatctttg

SEQ ID NO: 7317808 - DNA, 22 bp, Homo sapiens
tttcttcctggattcctacttc

SEQ ID NO: 7317809 - DNA, 22 bp, Homo sapiens
tttcttctcacccaggacagag

SEQ ID NO: 7317810 - DNA, 22 bp, Homo sapiens
tttcttatgagcaagactctat

SEQ ID NO: 7317811 - DNA, 21 bp, Homo sapiens
tttcttcactttgccccatgt

SEQ ID NO: 7317812 - DNA, 22 bp, Homo sapiens
tttcttccccaagtgaatttta

SEQ ID NO: 7317813 - DNA, 22 bp, Homo sapiens
tttctgtattttgtcataacct

SEQ ID NO: 7317814 - DNA, 22 bp, Homo sapiens
tttctgttgtacttaaactagg

SEQ ID NO: 7317815 - DNA, 21 bp, Homo sapiens
tttcttatctgtaaagtggga

SEQ ID NO: 7317816 - DNA, 23 bp, Homo sapiens
tttctgttgggtatatatccaag

SEQ ID NO: 7317817 - DNA, 23 bp, Homo sapiens
tttctgttgggtatatatccaag

SEQ ID NO: 7317818 - DNA, 23 bp, Homo sapiens
tttctgaagttgagatggacttt

SEQ ID NO: 7317819 - DNA, 22 bp, Homo sapiens
tttctgaataactctatgatat

SEQ ID NO: 7317820 - DNA, 22 bp, Homo sapiens
tttctgctcgctctcaatcagg

SEQ ID NO: 7317821 - DNA, 22 bp, Homo sapiens
tttctgctcgctctcaatcagg

SEQ ID NO: 7317822 - DNA, 22 bp, Homo sapiens
tttctggcagcgggacaggggt

SEQ ID NO: 7317823 - DNA, 22 bp, Homo sapiens
tttctgctgtgtaaaatgaggg

SEQ ID NO: 7317824 - DNA, 22 bp, Homo sapiens
tttctgctttcagagtgagaca

SEQ ID NO: 7317825 - DNA, 22 bp, Homo sapiens
tttctgcttccttgagaaggag

SEQ ID NO: 7317826 - DNA, 22 bp, Homo sapiens
tttctgcttgagagaattgctg

SEQ ID NO: 7317827 - DNA, 22 bp, Homo sapiens
tttctggacagcaagatcagtt

SEQ ID NO: 7317828 - DNA, 17 bp, Homo sapiens
tttctggaatgggcaaa

SEQ ID NO: 7317829 - DNA, 22 bp, Homo sapiens
tttctggacccttctgtgagtg

SEQ ID NO: 7317830 - DNA, 22 bp, Homo sapiens
tttctggaggcccaagggcaga

SEQ ID NO: 7317831 - DNA, 22 bp, Homo sapiens
tttctggattcatacagatgta

SEQ ID NO: 7317832 - DNA, 22 bp, Homo sapiens
tttctggaaagcaagatacatt

SEQ ID NO: 7317833 - DNA, 22 bp, Homo sapiens
tttctggaaacgggttcaagct

SEQ ID NO: 7317834 - DNA, 22 bp, Homo sapiens
tttctggaaactgtaaagagga

SEQ ID NO: 7317835 - DNA, 22 bp, Homo sapiens
tttctggaacagtaattgaaga

SEQ ID NO: 7317836 - DNA, 22 bp, Homo sapiens
tttctggaaccacaaaagtatg

SEQ ID NO: 7317837 - DNA, 22 bp, Homo sapiens
tttctccttgtgtctcctttga

SEQ ID NO: 7317838 - DNA, 22 bp, Homo sapiens
tttctcttaatgtctctgtgct

SEQ ID NO: 7317839 - DNA, 22 bp, Homo sapiens
tttctctgggctgttggcagcc

SEQ ID NO: 7317840 - DNA, 22 bp, Homo sapiens
tttctgaaaactgaagtagtgc

SEQ ID NO: 7317841 - DNA, 21 bp, Homo sapiens
tttctgaaggcaacatctatc

SEQ ID NO: 7317842 - DNA, 22 bp, Homo sapiens
tttctgaagggcagcagactct

SEQ ID NO: 7317843 - DNA, 22 bp, Homo sapiens
tttctcttgcgatatgctacac

SEQ ID NO: 7317844 - DNA, 22 bp, Homo sapiens
tttctcttgcgatatgctacac

SEQ ID NO: 7317845 - DNA, 22 bp, Homo sapiens
tttctctttcaatctgcagtac

SEQ ID NO: 7317846 - DNA, 22 bp, Homo sapiens
tttctctttgacaggaatcaga

SEQ ID NO: 7317847 - DNA, 22 bp, Homo sapiens
tttctaagtaaacacagcatac

SEQ ID NO: 7317848 - DNA, 22 bp, Homo sapiens
tttctaagtaaacacagcatac

SEQ ID NO: 7317849 - DNA, 22 bp, Homo sapiens
tttctaagtaagattaacttct

SEQ ID NO: 7317850 - DNA, 22 bp, Homo sapiens
tttctaatctttagttacaaaa

SEQ ID NO: 7317851 - DNA, 22 bp, Homo sapiens
tttctactcatcctttggagaa

SEQ ID NO: 7317852 - DNA, 23 bp, Homo sapiens
tttctaaggtttttatctgctac

SEQ ID NO: 7317853 - DNA, 22 bp, Homo sapiens
tttctccaatgtatcagcacac

SEQ ID NO: 7317854 - DNA, 18 bp, Homo sapiens
tttctcagactctctttc

SEQ ID NO: 7317855 - DNA, 22 bp, Homo sapiens
tttctatttacagtgctaggta

SEQ ID NO: 7317856 - DNA, 22 bp, Homo sapiens
tttctagaatgactcatctgag

SEQ ID NO: 7317857 - DNA, 22 bp, Homo sapiens
tttctagaaacattatctctat

SEQ ID NO: 7317858 - DNA, 22 bp, Homo sapiens
tttctacttctcctgaatgtct

SEQ ID NO: 7317859 - DNA, 22 bp, Homo sapiens
tttctagaaagttcatgtgttt

SEQ ID NO: 7317860 - DNA, 22 bp, Homo sapiens
tttctagaatgactcatctgag

SEQ ID NO: 7317861 - DNA, 19 bp, Homo sapiens
tttctcaggaagtttgtgt

SEQ ID NO: 7317862 - DNA, 22 bp, Homo sapiens
tttcaaagacagccatatttgt

SEQ ID NO: 7317863 - DNA, 22 bp, Homo sapiens
tttcaaagacagccatatttgt

SEQ ID NO: 7317864 - DNA, 22 bp, Homo sapiens
tttcaaagaccattaactatca

SEQ ID NO: 7317865 - DNA, 22 bp, Homo sapiens
tttcaaagaccattaactatca

SEQ ID NO: 7317866 - DNA, 22 bp, Homo sapiens
tttcaaagagttgtaaattact

SEQ ID NO: 7317867 - DNA, 22 bp, Homo sapiens
tttcaaagagttgtaaattact

SEQ ID NO: 7317868 - DNA, 22 bp, Homo sapiens
tttcaaagagttgtaaattact

SEQ ID NO: 7317869 - DNA, 22 bp, Homo sapiens
tttcaaaggaggctgagaggat

SEQ ID NO: 7317870 - DNA, 22 bp, Homo sapiens
tttcaaagggaagttatgaagt

SEQ ID NO: 7317871 - DNA, 22 bp, Homo sapiens
tttcagagttgtcttcttgacc

SEQ ID NO: 7317872 - DNA, 22 bp, Homo sapiens
tttcagggtacatggagcaaat

SEQ ID NO: 7317873 - DNA, 22 bp, Homo sapiens
tttcagggtgctccagacaccc

SEQ ID NO: 7317874 - DNA, 22 bp, Homo sapiens
tttcagtgaaagctactgttag

SEQ ID NO: 7317875 - DNA, 22 bp, Homo sapiens
tttcagtgcacgtagtttattt

SEQ ID NO: 7317876 - DNA, 22 bp, Homo sapiens
tttcaggaaggtgaggcacatg

SEQ ID NO: 7317877 - DNA, 22 bp, Homo sapiens
tttcattgtcatctatcttaga

SEQ ID NO: 7317878 - DNA, 22 bp, Homo sapiens
tttcattgtccccaggcaagac

SEQ ID NO: 7317879 - DNA, 22 bp, Homo sapiens
tttcattttggttatgccataa

SEQ ID NO: 7317880 - DNA, 22 bp, Homo sapiens
tttcattttggttatgccataa

SEQ ID NO: 7317881 - DNA, 22 bp, Homo sapiens
tttccaaataaggtcacactca

SEQ ID NO: 7317882 - DNA, 22 bp, Homo sapiens
tttccaaaggtggcaggaacaa

SEQ ID NO: 7317883 - DNA, 22 bp, Homo sapiens
tttccaaaggctaaactcagtt

SEQ ID NO: 7317884 - DNA, 22 bp, Homo sapiens
tttccaaaggaggaaccagttt

SEQ ID NO: 7317885 - DNA, 22 bp, Homo sapiens
tttcctctgggccctgccaccc

SEQ ID NO: 7317886 - DNA, 22 bp, Homo sapiens
tttcctctgtcatgacagctga

SEQ ID NO: 7317887 - DNA, 22 bp, Homo sapiens
tttcctcttatacagtgtttat

SEQ ID NO: 7317888 - DNA, 22 bp, Homo sapiens
tttcctcttcttcccatgtcat

SEQ ID NO: 7317889 - DNA, 22 bp, Homo sapiens
tttcctcttcgattaagtttgg

SEQ ID NO: 7317890 - DNA, 22 bp, Homo sapiens
tttcctcttccgagggggaggc

SEQ ID NO: 7317891 - DNA, 22 bp, Homo sapiens
tttttgatctgagcagttggag

SEQ ID NO: 7317892 - DNA, 22 bp, Homo sapiens
tttttgggtccaggctgtatct

SEQ ID NO: 7317893 - DNA, 22 bp, Homo sapiens
tttttggcagctcagaaacttc

SEQ ID NO: 7317894 - DNA, 22 bp, Homo sapiens
tttttgggtccaggctgtatct

SEQ ID NO: 7317895 - DNA, 22 bp, Homo sapiens
ttttgaataattcagaaacagc

SEQ ID NO: 7317896 - DNA, 22 bp, Homo sapiens
ttttgaagaagatgggaattta

SEQ ID NO: 7317897 - DNA, 20 bp, Homo sapiens
ttttgatagcaaagacggta

SEQ ID NO: 7317898 - DNA, 22 bp, Homo sapiens
ttttgatatcatgatgaacaga

SEQ ID NO: 7317899 - DNA, 22 bp, Homo sapiens
ttttgaaagggtgatttggctt

SEQ ID NO: 7317900 - DNA, 22 bp, Homo sapiens
ttttgaaagccaggtttgtatg

SEQ ID NO: 7317901 - DNA, 22 bp, Homo sapiens
ttttgaaagagtcctgctacag

SEQ ID NO: 7317902 - DNA, 22 bp, Homo sapiens
ttttggaatttatacagtaatg

SEQ ID NO: 7317903 - DNA, 22 bp, Homo sapiens
ttttgcaaagtacattatcagg

SEQ ID NO: 7317904 - DNA, 22 bp, Homo sapiens
ttttatctacctatgctcattt

SEQ ID NO: 7317905 - DNA, 22 bp, Homo sapiens
ttttatctacctatgctcattt

SEQ ID NO: 7317906 - DNA, 22 bp, Homo sapiens
ttttatctgtgacatctggcag

SEQ ID NO: 7317907 - DNA, 22 bp, Homo sapiens
ttttctttaatctggtggggtg

SEQ ID NO: 7317908 - DNA, 22 bp, Homo sapiens
ttttctttaatctggtggggtg

SEQ ID NO: 7317909 - DNA, 22 bp, Homo sapiens
ttttctaacatctagtaatttg

SEQ ID NO: 7317910 - DNA, 22 bp, Homo sapiens
ttttctaactttacactcgaaa

SEQ ID NO: 7317911 - DNA, 22 bp, Homo sapiens
ttttctaaaatatccaggacag

SEQ ID NO: 7317912 - DNA, 22 bp, Homo sapiens
tttggaacaagacaaaacatta

SEQ ID NO: 7317913 - DNA, 20 bp, Homo sapiens
tttggagagaaagaagtagt

SEQ ID NO: 7317914 - DNA, 17 bp, Homo sapiens
tttgtacaacattttaa

SEQ ID NO: 7317915 - DNA, 22 bp, Homo sapiens
tttgtaatgataatgttaaatt

SEQ ID NO: 7317916 - DNA, 22 bp, Homo sapiens
tttgtaatgataatgttaaatt

SEQ ID NO: 7317917 - DNA, 22 bp, Homo sapiens
tttgtacatgtaagattgcatc

SEQ ID NO: 7317918 - DNA, 22 bp, Homo sapiens
tttgtacattcaaatgtcccat

SEQ ID NO: 7317919 - DNA, 22 bp, Homo sapiens
tttgtacatgtaagattgcatc

SEQ ID NO: 7317920 - DNA, 22 bp, Homo sapiens
tttgtacatgaatgtgcaccca

SEQ ID NO: 7317921 - DNA, 22 bp, Homo sapiens
tttgtacacaacctgtggtagt

SEQ ID NO: 7317922 - DNA, 22 bp, Homo sapiens
tttgtacacaggatgttataat

SEQ ID NO: 7317923 - DNA, 22 bp, Homo sapiens
tttggcaagcgagtactttctg

SEQ ID NO: 7317924 - DNA, 22 bp, Homo sapiens
tttgcaaataccatgaaacttg

SEQ ID NO: 7317925 - DNA, 22 bp, Homo sapiens
tttgcaaatacagaggtcttgc

SEQ ID NO: 7317926 - DNA, 22 bp, Homo sapiens
tttgcaaataccatgaaacttg

SEQ ID NO: 7317927 - DNA, 22 bp, Homo sapiens
tttgcaaatatgtgtttctatt

SEQ ID NO: 7317928 - DNA, 22 bp, Homo sapiens
tttgattttcagcaatagtggc

SEQ ID NO: 7317929 - DNA, 22 bp, Homo sapiens
tttgcaaaatgaggtgaagagt

SEQ ID NO: 7317930 - DNA, 22 bp, Homo sapiens
tttgcacagcctttctggctgc

SEQ ID NO: 7317931 - DNA, 22 bp, Homo sapiens
tttgcagaagaaaacatgaaca

SEQ ID NO: 7317932 - DNA, 22 bp, Homo sapiens
tttgcacacacaataacaaatg

SEQ ID NO: 7317933 - DNA, 22 bp, Homo sapiens
tttgcaacagactcatcattga

SEQ ID NO: 7317934 - DNA, 22 bp, Homo sapiens
tttgcaaatttcgtctcctcag

SEQ ID NO: 7317935 - DNA, 22 bp, Homo sapiens
tttgcaaatgctctgcagagct

SEQ ID NO: 7317936 - DNA, 22 bp, Homo sapiens
tttgttgacatccctgtacttt

SEQ ID NO: 7317937 - DNA, 22 bp, Homo sapiens
tttgttcttagtatctgtgtgc

SEQ ID NO: 7317938 - DNA, 22 bp, Homo sapiens
tttgtcaatcccttgaaaacct

SEQ ID NO: 7317939 - DNA, 22 bp, Homo sapiens
tttgtcaccagtggctttggta

SEQ ID NO: 7317940 - DNA, 22 bp, Homo sapiens
tttgtcagtcatgtctgctttt

SEQ ID NO: 7317941 - DNA, 22 bp, Homo sapiens
tttgtcaagtttgcaaatacgt

SEQ ID NO: 7317942 - DNA, 22 bp, Homo sapiens
tttgtcaataactaccaacagg

SEQ ID NO: 7317943 - DNA, 22 bp, Homo sapiens
tttgtcaaatcaaaccacattc

SEQ ID NO: 7317944 - DNA, 22 bp, Homo sapiens
tttgtattccatatcatgccat

SEQ ID NO: 7317945 - DNA, 22 bp, Homo sapiens
tttgtagattcattgaactttt

SEQ ID NO: 7317946 - DNA, 22 bp, Homo sapiens
tttgtagactaccagtaattgt

SEQ ID NO: 7317947 - DNA, 22 bp, Homo sapiens
tttgtagacgtcagaagttact

SEQ ID NO: 7317948 - DNA, 22 bp, Homo sapiens
tttgtagaactatacttacatt

SEQ ID NO: 7317949 - DNA, 22 bp, Homo sapiens
tttgttttgaactagctcagaa

SEQ ID NO: 7317950 - DNA, 22 bp, Homo sapiens
ttttaaactcccctagttggtg

SEQ ID NO: 7317951 - DNA, 22 bp, Homo sapiens
ttttaaactgcagaatttagaa

SEQ ID NO: 7317952 - DNA, 22 bp, Homo sapiens
tttgttttctgtaggcctttcc

SEQ ID NO: 7317953 - DNA, 22 bp, Homo sapiens
tttgttttctgtaggcctttcc

SEQ ID NO: 7317954 - DNA, 22 bp, Homo sapiens
tttgttttgaactagctcagaa

SEQ ID NO: 7317955 - DNA, 22 bp, Homo sapiens
tttgtttctgcaatacctatag

SEQ ID NO: 7317956 - DNA, 22 bp, Homo sapiens
tttgttttcaatgtgtcattca

SEQ ID NO: 7317957 - DNA, 22 bp, Homo sapiens
ttttataaagagagtcagttgg

SEQ ID NO: 7317958 - DNA, 22 bp, Homo sapiens
ttttatagctgaatagtattcc

SEQ ID NO: 7317959 - DNA, 22 bp, Homo sapiens
ttttatacacatgaacatgcag

SEQ ID NO: 7317960 - DNA, 22 bp, Homo sapiens
cagcctgtctgggcagagtgga

SEQ ID NO: 7317961 - DNA, 22 bp, Homo sapiens
cagccccatggtgtgctccagc

SEQ ID NO: 7317962 - DNA, 22 bp, Homo sapiens
cagagggctcggcggccgctcc

SEQ ID NO: 7317963 - DNA, 22 bp, Homo sapiens
gacgagagactccatccaccac

SEQ ID NO: 7317964 - DNA, 22 bp, Homo sapiens
gagagagctctgtgcctgggat

SEQ ID NO: 7317965 - DNA, 22 bp, Homo sapiens
gagagagaaggcctgtgggtgt

SEQ ID NO: 7317966 - DNA, 22 bp, Homo sapiens
gagagagagctaatattaagct

SEQ ID NO: 7317967 - DNA, 22 bp, Homo sapiens
gagagagaggtgctgccaggca

SEQ ID NO: 7317968 - DNA, 22 bp, Homo sapiens
gcccccagagaatgaggtacga

SEQ ID NO: 7317969 - DNA, 22 bp, Homo sapiens
ctgggctcaagaagtcttccct

SEQ ID NO: 7317970 - DNA, 22 bp, Homo sapiens
cgggcaaggcgagactaggccc

SEQ ID NO: 7317971 - DNA, 22 bp, Homo sapiens
agtcccagctactcaagaggct

SEQ ID NO: 7317972 - DNA, 22 bp, Homo sapiens
agggagccctgaaccagagggt

SEQ ID NO: 7317973 - DNA, 22 bp, Homo sapiens
cccagagttggtcaggggaccc

SEQ ID NO: 7317974 - DNA, 22 bp, Homo sapiens
cccacgtcgaacttgctccaga

SEQ ID NO: 7317975 - DNA, 20 bp, Homo sapiens
aggaggcctgcagatagttc

SEQ ID NO: 7317976 - DNA, 22 bp, Homo sapiens
aggaggcctggctggggagatc

SEQ ID NO: 7317977 - DNA, 22 bp, Homo sapiens
aggaggcctctatccagagaga

SEQ ID NO: 7317978 - DNA, 22 bp, Homo sapiens
ccacagagactctgcaggactg

SEQ ID NO: 7317979 - DNA, 19 bp, Homo sapiens
ccacagagactagaagaca

SEQ ID NO: 7317980 - DNA, 22 bp, Homo sapiens
caggcagggagctggaaaggat

SEQ ID NO: 7317981 - DNA, 22 bp, Homo sapiens
agggaggagtcctcaaagtcat

SEQ ID NO: 7317982 - DNA, 22 bp, Homo sapiens
accagagaatttagccaagaaa

SEQ ID NO: 7317983 - DNA, 20 bp, Homo sapiens
accagagacctgaatcagtt

SEQ ID NO: 7317984 - DNA, 20 bp, Homo sapiens
accagagactggggacaagt

SEQ ID NO: 7317985 - DNA, 22 bp, Homo sapiens
accagagaaaacacagcaggct

SEQ ID NO: 7317986 - DNA, 20 bp, Homo sapiens
accagagatagcaatagtgc

SEQ ID NO: 7317987 - DNA, 22 bp, Homo sapiens
accagagaggctgcagtgtgtg

SEQ ID NO: 7317988 - DNA, 22 bp, Homo sapiens
accagagatgtctaataggggc

SEQ ID NO: 7317989 - DNA, 22 bp, Homo sapiens
accagagagcctaggctgggca

SEQ ID NO: 7317990 - DNA, 22 bp, Homo sapiens
accagagagagacagggttgtg

SEQ ID NO: 7317991 - DNA, 22 bp, Homo sapiens
agttgcagacgcagagatgttg

SEQ ID NO: 7317992 - DNA, 22 bp, Homo sapiens
cagcccaaagccccaggctaga

SEQ ID NO: 7317993 - DNA, 22 bp, Homo sapiens
agccagggatgcagcacagtga

SEQ ID NO: 7317994 - DNA, 22 bp, Homo sapiens
agaggccggccgagcccatggg

SEQ ID NO: 7317995 - DNA, 17 bp, Homo sapiens
agagagaaaagggccat

SEQ ID NO: 7317996 - DNA, 22 bp, Homo sapiens
agagccaggatctgttttgggg

SEQ ID NO: 7317997 - DNA, 22 bp, Homo sapiens
agagccaggactgtgtctcact

SEQ ID NO: 7317998 - DNA, 22 bp, Homo sapiens
agagccaggaagtggcgtgggg

SEQ ID NO: 7317999 - DNA, 22 bp, Homo sapiens
agagccagcatttgacactggc

SEQ ID NO: 7318000 - DNA, 22 bp, Homo sapiens
agagccagcatttgggccctgc

SEQ ID NO: 7318001 - DNA, 22 bp, Homo sapiens
agagccagcaagtgaatagtga

SEQ ID NO: 7318002 - DNA, 22 bp, Homo sapiens
atgccaggaacaaacagtggtg

SEQ ID NO: 7318003 - DNA, 22 bp, Homo sapiens
aaggcccttccaccagtcctcg

SEQ ID NO: 7318004 - DNA, 22 bp, Homo sapiens
aaggccctggccccagcttctt

SEQ ID NO: 7318005 - DNA, 22 bp, Homo sapiens
aatgcacatgccacatgtggta

SEQ ID NO: 7318006 - DNA, 22 bp, Homo sapiens
aaaggctcatgaaccaggctcg

SEQ ID NO: 7318007 - DNA, 22 bp, Homo sapiens
aagagagaactcccttcgccag

SEQ ID NO: 7318008 - DNA, 22 bp, Homo sapiens
aatttcggttcaaggcccagtt

SEQ ID NO: 7318009 - DNA, 22 bp, Homo sapiens
agccaaggcagctagagctctg

SEQ ID NO: 7318010 - DNA, 22 bp, Homo sapiens
acacccagcttttgaatgccct

SEQ ID NO: 7318011 - DNA, 22 bp, Homo sapiens
agcgggtctgcaagccttccct

SEQ ID NO: 7318012 - DNA, 22 bp, Homo sapiens
acccagggcagccagcggggag

SEQ ID NO: 7318013 - DNA, 22 bp, Homo sapiens
tcacccaggatattgaagtcag

SEQ ID NO: 7318014 - DNA, 22 bp, Homo sapiens
tcacccaggctggtatgcagtg

SEQ ID NO: 7318015 - DNA, 23 bp, Homo sapiens
tcagagaggccccctgcagagat

SEQ ID NO: 7318016 - DNA, 22 bp, Homo sapiens
tccagagaggtttctccatgct

SEQ ID NO: 7318017 - DNA, 18 bp, Homo sapiens
tccagagagggagaagtg

SEQ ID NO: 7318018 - DNA, 20 bp, Homo sapiens
tccagagagtggcaaagctc

SEQ ID NO: 7318019 - DNA, 22 bp, Homo sapiens
tccagagatcacactgggcagg

SEQ ID NO: 7318020 - DNA, 22 bp, Homo sapiens
tccagagatctctcttccctgt

SEQ ID NO: 7318021 - DNA, 17 bp, Homo sapiens
tccagctcctcattgtt

SEQ ID NO: 7318022 - DNA, 18 bp, Homo sapiens
tccagctcacagatgggc

SEQ ID NO: 7318023 - DNA, 22 bp, Homo sapiens
ggagacagtatggcttgtagct

SEQ ID NO: 7318024 - DNA, 22 bp, Homo sapiens
gctcccagaaccaaggctgggg

SEQ ID NO: 7318025 - DNA, 23 bp, Homo sapiens
gccagccttgctctcctgcagcc

SEQ ID NO: 7318026 - DNA, 22 bp, Homo sapiens
gccagctcagatgcaggaagga

SEQ ID NO: 7318027 - DNA, 22 bp, Homo sapiens
gccagctcagtgccaggcccct

SEQ ID NO: 7318028 - DNA, 22 bp, Homo sapiens
gccagctcccaagtgagcccct

SEQ ID NO: 7318029 - DNA, 22 bp, Homo sapiens
gccccagcctgggaactggagg

SEQ ID NO: 7318030 - DNA, 22 bp, Homo sapiens
gccccagccaaggtgacacgaa

SEQ ID NO: 7318031 - DNA, 22 bp, Homo sapiens
gccccagcctcccgagtagctg

SEQ ID NO: 7318032 - DNA, 22 bp, Homo sapiens
gcccagctttttgaggcaggca

SEQ ID NO: 7318033 - DNA, 22 bp, Homo sapiens
gcccagctcctctgcagaccct

SEQ ID NO: 7318034 - DNA, 22 bp, Homo sapiens
gcagccccaggagacgcccagg

SEQ ID NO: 7318035 - DNA, 18 bp, Homo sapiens
gcagcccctcttccttcc

SEQ ID NO: 7318036 - DNA, 22 bp, Homo sapiens
gcaggcagatcacctgtcagga

SEQ ID NO: 7318037 - DNA, 22 bp, Homo sapiens
gcaggcagaggtggaggagaca

SEQ ID NO: 7318038 - DNA, 22 bp, Homo sapiens
gtccccagctgtgacgagagcc

SEQ ID NO: 7318039 - DNA, 22 bp, Homo sapiens
gtccccagaaaggtgaggcagg

SEQ ID NO: 7318040 - DNA, 22 bp, Homo sapiens
ggagccagagcactggggagcc

SEQ ID NO: 7318041 - DNA, 22 bp, Homo sapiens
ggcagaggtagctggaaccagg

SEQ ID NO: 7318042 - DNA, 22 bp, Homo sapiens
ggcagaggagctggaaacatgg

SEQ ID NO: 7318043 - DNA, 22 bp, Homo sapiens
ggcagaggaagctggaagtggg

SEQ ID NO: 7318044 - DNA, 22 bp, Homo sapiens
ggcaggtggaagttggcagagc

SEQ ID NO: 7318045 - DNA, 22 bp, Homo sapiens
ggccagtcccctaatccagggc

SEQ ID NO: 7318046 - DNA, 22 bp, Homo sapiens
ggccagggcctggggactgtcc

SEQ ID NO: 7318047 - DNA, 22 bp, Homo sapiens
ggccatggcgggagccggcgtc

SEQ ID NO: 7318048 - DNA, 22 bp, Homo sapiens
ggctctttggcgggccttgaac

SEQ ID NO: 7318049 - DNA, 23 bp, Homo sapiens
gggcatggagtgtaggtggaagg

SEQ ID NO: 7318050 - DNA, 22 bp, Homo sapiens
ctgtggccagtcccacacctcc

SEQ ID NO: 7318051 - DNA, 22 bp, Homo sapiens
ccttccagtgactaaggaggaa

SEQ ID NO: 7318052 - DNA, 22 bp, Homo sapiens
ctctttggatagaattacaaag

SEQ ID NO: 7318053 - DNA, 22 bp, Homo sapiens
ctctttggatgtttatgataag

SEQ ID NO: 7318054 - DNA, 22 bp, Homo sapiens
tctttggtgatatctctttggt

SEQ ID NO: 7318055 - DNA, 22 bp, Homo sapiens
ccaggctctgttccccgaggag

SEQ ID NO: 7318056 - DNA, 22 bp, Homo sapiens
ccagctctctgtcctccccaca

SEQ ID NO: 7318057 - DNA, 22 bp, Homo sapiens
ccagctctgattttgacctcca

SEQ ID NO: 7318058 - DNA, 22 bp, Homo sapiens
ccagagagaaaatggagggcca

SEQ ID NO: 7318059 - DNA, 22 bp, Homo sapiens
ccatgcgcacccaggggaagct

SEQ ID NO: 7318060 - DNA, 22 bp, Homo sapiens
ccatgctccttaccactcactt

SEQ ID NO: 7318061 - DNA, 22 bp, Homo sapiens
ccaggctggagtgcagtggcac

SEQ ID NO: 7318062 - DNA, 22 bp, Homo sapiens
tgagacagttctgcagctgggt

SEQ ID NO: 7318063 - DNA, 22 bp, Homo sapiens
cccaggagacatatagaaggac

SEQ ID NO: 7318064 - DNA, 22 bp, Homo sapiens
cccaggctggcctccgcagtgc

SEQ ID NO: 7318065 - DNA, 22 bp, Homo sapiens
cccaggctggggctcctccagc

SEQ ID NO: 7318066 - DNA, 22 bp, Homo sapiens
cccaggctggagtgcagtggcg

SEQ ID NO: 7318067 - DNA, 22 bp, Homo sapiens
cccaggctggagtgcaatggtg

SEQ ID NO: 7318068 - DNA, 22 bp, Homo sapiens
cccaggctggagtgcaatggca

SEQ ID NO: 7318069 - DNA, 22 bp, Homo sapiens
cccagggattataaaggtgaaa

SEQ ID NO: 7318070 - DNA, 22 bp, Homo sapiens
cccagggacagatgggcagcta

SEQ ID NO: 7318071 - DNA, 22 bp, Homo sapiens
tgggaaggacgtgtcagtggca

SEQ ID NO: 7318072 - DNA, 22 bp, Homo sapiens
cctcagagttatttgaagtgaa

SEQ ID NO: 7318073 - DNA, 22 bp, Homo sapiens
tccttccatggtggggctgctt

SEQ ID NO: 7318074 - DNA, 22 bp, Homo sapiens
tccttccaggtccagggatgtg

SEQ ID NO: 7318075 - DNA, 22 bp, Homo sapiens
tcagagagttagtgtcttagct

SEQ ID NO: 7318076 - DNA, 22 bp, Homo sapiens
tcagagagttttcactagggtg

SEQ ID NO: 7318077 - DNA, 22 bp, Homo sapiens
catggcagagaaggggaactgg

SEQ ID NO: 7318078 - DNA, 23 bp, Homo sapiens
catggcagcaagagctcatggcc

SEQ ID NO: 7318079 - DNA, 22 bp, Homo sapiens
catggcaggatctgggcccaca

SEQ ID NO: 7318080 - DNA, 22 bp, Homo sapiens
catggcaggaaggacatgcact

SEQ ID NO: 7318081 - DNA, 22 bp, Homo sapiens
catggcagggctgtgggcaggt

SEQ ID NO: 7318082 - DNA, 22 bp, Homo sapiens
caggcccaagactgatgagtct

SEQ ID NO: 7318083 - DNA, 22 bp, Homo sapiens
caggcccagcccttagccaggt

SEQ ID NO: 7318084 - DNA, 22 bp, Homo sapiens
caggcctgagacatctgagata

SEQ ID NO: 7318085 - DNA, 22 bp, Homo sapiens
caggcctgagtgtggaagtctt

SEQ ID NO: 7318086 - DNA, 22 bp, Homo sapiens
caggctggagttcagtggtgtg

SEQ ID NO: 7318087 - DNA, 22 bp, Homo sapiens
ttccagagcccatgctctaggc

SEQ ID NO: 7318088 - DNA, 22 bp, Homo sapiens
ttccagagagttattcccctgg

SEQ ID NO: 7318089 - DNA, 22 bp, Homo sapiens
ggggccttggatctgtgccccg

SEQ ID NO: 7318090 - DNA, 22 bp, Homo sapiens
ggggccttttctgaatgtggaa

SEQ ID NO: 7318091 - DNA, 23 bp, Homo sapiens
cagatgaggttggcagcatggtc

SEQ ID NO: 7318092 - DNA, 22 bp, Homo sapiens
ggagaaggcacacccacctctg

SEQ ID NO: 7318093 - DNA, 22 bp, Homo sapiens
ggagaagggtatgtgtggcgga

SEQ ID NO: 7318094 - DNA, 22 bp, Homo sapiens
ggccaggctggtctcagacttc

SEQ ID NO: 7318095 - DNA, 22 bp, Homo sapiens
gcatggcaagatcaggagacca

SEQ ID NO: 7318096 - DNA, 22 bp, Homo sapiens
gcatggcagaacacctcgcccg

SEQ ID NO: 7318097 - DNA, 22 bp, Homo sapiens
gcagagaggatattattgtcca

SEQ ID NO: 7318098 - DNA, 22 bp, Homo sapiens
gcagagagttgggctgcgccag

SEQ ID NO: 7318099 - DNA, 22 bp, Homo sapiens
gcagagaggaatgaagccatcc

SEQ ID NO: 7318100 - DNA, 23 bp, Homo sapiens
gagtggggagaaattggttaaac

SEQ ID NO: 7318101 - DNA, 22 bp, Homo sapiens
atgttatgtctgggaaggggta

SEQ ID NO: 7318102 - DNA, 22 bp, Homo sapiens
agtgggcatatgaagtctcaag

SEQ ID NO: 7318103 - DNA, 22 bp, Homo sapiens
agtgggcagcccaggaggtctt

SEQ ID NO: 7318104 - DNA, 22 bp, Homo sapiens
agtgggcaaaacagctcagagc

SEQ ID NO: 7318105 - DNA, 22 bp, Homo sapiens
ccagagtgacgtgaagtgtgaa

SEQ ID NO: 7318106 - DNA, 22 bp, Homo sapiens
ccagagagtatcatggagagta

SEQ ID NO: 7318107 - DNA, 22 bp, Homo sapiens
ccagagagtcgatgggggacac

SEQ ID NO: 7318108 - DNA, 22 bp, Homo sapiens
ccagagaggggaagggcttgcc

SEQ ID NO: 7318109 - DNA, 22 bp, Homo sapiens
ccagagaggtagcttaccctct

SEQ ID NO: 7318110 - DNA, 20 bp, Homo sapiens
ccagagagtaggttagtgat

SEQ ID NO: 7318111 - DNA, 22 bp, Homo sapiens
ccagagagggcgccacctggag

SEQ ID NO: 7318112 - DNA, 22 bp, Homo sapiens
aggcccagagcaggaaagggtt

SEQ ID NO: 7318113 - DNA, 23 bp, Homo sapiens
ccagcctctgggtcttcatccag

SEQ ID NO: 7318114 - DNA, 22 bp, Homo sapiens
ccaggagagcattgcacagagg

SEQ ID NO: 7318115 - DNA, 22 bp, Homo sapiens
cccagagatgtcctgagtgata

SEQ ID NO: 7318116 - DNA, 19 bp, Homo sapiens
agctgggcttactcactcg

SEQ ID NO: 7318117 - DNA, 19 bp, Homo sapiens
agctgggctgtcacagtga

SEQ ID NO: 7318118 - DNA, 22 bp, Homo sapiens
caggctggagtgcagtgtcgcc

SEQ ID NO: 7318119 - DNA, 22 bp, Homo sapiens
caggctggagtgcagtggtgcc

SEQ ID NO: 7318120 - DNA, 18 bp, Homo sapiens
aggcaggctggagtgact

SEQ ID NO: 7318121 - DNA, 22 bp, Homo sapiens
cagtggcgtgatctctgctcac

SEQ ID NO: 7318122 - DNA, 22 bp, Homo sapiens
acccagagccagggtcaggagc

SEQ ID NO: 7318123 - DNA, 22 bp, Homo sapiens
acccagagtgtctgtctcagtc

SEQ ID NO: 7318124 - DNA, 22 bp, Homo sapiens
actaggggctcaggcccaggga

SEQ ID NO: 7318125 - DNA, 19 bp, Homo sapiens
agagccagacagcatagga

SEQ ID NO: 7318126 - DNA, 22 bp, Homo sapiens
agagccagaccattgccgtgca

SEQ ID NO: 7318127 - DNA, 22 bp, Homo sapiens
agagatgaatcttgagactctg

SEQ ID NO: 7318128 - DNA, 22 bp, Homo sapiens
agagccagatggagccgtgtgt

SEQ ID NO: 7318129 - DNA, 22 bp, Homo sapiens
atggccagcaaggtagggcaat

SEQ ID NO: 7318130 - DNA, 22 bp, Homo sapiens
atggccagctcagagcactcag

SEQ ID NO: 7318131 - DNA, 22 bp, Homo sapiens
agagaagacttacagccacagt

SEQ ID NO: 7318132 - DNA, 22 bp, Homo sapiens
agcctcttattctccaggactt

SEQ ID NO: 7318133 - DNA, 22 bp, Homo sapiens
agcctgagagccaagctgtgca

SEQ ID NO: 7318134 - DNA, 22 bp, Homo sapiens
cagagggccccctggccacagt

SEQ ID NO: 7318135 - DNA, 22 bp, Homo sapiens
agcccagggaaccaggaagtgg

SEQ ID NO: 7318136 - DNA, 22 bp, Homo sapiens
cagagggagccctccaggagca

SEQ ID NO: 7318137 - DNA, 20 bp, Homo sapiens
agcccaggcctgtgtgagtc

SEQ ID NO: 7318138 - DNA, 22 bp, Homo sapiens
cacccagggctgtgcctgccca

SEQ ID NO: 7318139 - DNA, 22 bp, Homo sapiens
aaagggtcagattctgctagtg

SEQ ID NO: 7318140 - DNA, 22 bp, Homo sapiens
aaagggtccagatacttggaaa

SEQ ID NO: 7318141 - DNA, 22 bp, Homo sapiens
aaggcaggatgcggacccatct

SEQ ID NO: 7318142 - DNA, 22 bp, Homo sapiens
aagccaggtgtttaggccagcg

SEQ ID NO: 7318143 - DNA, 22 bp, Homo sapiens
aagccagggattcctgagggag

SEQ ID NO: 7318144 - DNA, 22 bp, Homo sapiens
aagggctcggtagcagtcctga

SEQ ID NO: 7318145 - DNA, 19 bp, Homo sapiens
agcccccagacagcaggcc

SEQ ID NO: 7318146 - DNA, 22 bp, Homo sapiens
agccatggcgccactagaggga

SEQ ID NO: 7318147 - DNA, 22 bp, Homo sapiens
tcctagagcctccagagggaga

SEQ ID NO: 7318148 - DNA, 22 bp, Homo sapiens
ggggaggctgatgtgggcaaag

SEQ ID NO: 7318149 - DNA, 22 bp, Homo sapiens
ggggaggaagctggaacacggg

SEQ ID NO: 7318150 - DNA, 18 bp, Homo sapiens
ggcagtgcagtctcaggg

SEQ ID NO: 7318151 - DNA, 22 bp, Homo sapiens
ggacaggccctctggtcagctt

SEQ ID NO: 7318152 - DNA, 22 bp, Homo sapiens
ggacaggcccggggagcctgga

SEQ ID NO: 7318153 - DNA, 22 bp, Homo sapiens
gctgtcccgaacccctggtaat

SEQ ID NO: 7318154 - DNA, 22 bp, Homo sapiens
ctgggctcagtgtctcactcct

SEQ ID NO: 7318155 - DNA, 22 bp, Homo sapiens
ctgtccattttcgtgcctcctt

SEQ ID NO: 7318156 - DNA, 22 bp, Homo sapiens
cttggaaactttccctgggcac

SEQ ID NO: 7318157 - DNA, 22 bp, Homo sapiens
ctttggaataatcaagctctga

SEQ ID NO: 7318158 - DNA, 22 bp, Homo sapiens
gagagccatggtggagatgggg

SEQ ID NO: 7318159 - DNA, 20 bp, Homo sapiens
gaggatgcagacagagggca

SEQ ID NO: 7318160 - DNA, 22 bp, Homo sapiens
gagctcagcccaaagagcagtg

SEQ ID NO: 7318161 - DNA, 22 bp, Homo sapiens
gagcaggcattctagtggctga

SEQ ID NO: 7318162 - DNA, 22 bp, Homo sapiens
gagcaggcctggggtgaggcct

SEQ ID NO: 7318163 - DNA, 22 bp, Homo sapiens
ctcacctgcaatcccttccagg

SEQ ID NO: 7318164 - DNA, 19 bp, Homo sapiens
ctcagagaggggcagtgcc

SEQ ID NO: 7318165 - DNA, 22 bp, Homo sapiens
ctcagagaacctaagcggagga

SEQ ID NO: 7318166 - DNA, 22 bp, Homo sapiens
ctccagagtcatcgagcattcc

SEQ ID NO: 7318167 - DNA, 22 bp, Homo sapiens
ctccagaggatgcaggtgaggg

SEQ ID NO: 7318168 - DNA, 22 bp, Homo sapiens
ctccagaggaaagcacatagtg

SEQ ID NO: 7318169 - DNA, 22 bp, Homo sapiens
ctctgtggttagactatggctg

SEQ ID NO: 7318170 - DNA, 22 bp, Homo sapiens
caggctggagtgcagtggcgcc

SEQ ID NO: 7318171 - DNA, 22 bp, Homo sapiens
caggctggagtgcagtggcgct

SEQ ID NO: 7318172 - DNA, 22 bp, Homo sapiens
cagtcccaaggaggaagcagtc

SEQ ID NO: 7318173 - DNA, 22 bp, Homo sapiens
tccagagagatagtggctaata

SEQ ID NO: 7318174 - DNA, 22 bp, Homo sapiens
tccagagagaaaaacaagcttt

SEQ ID NO: 7318175 - DNA, 22 bp, Homo sapiens
tccagagagccacggacagggg

SEQ ID NO: 7318176 - DNA, 22 bp, Homo sapiens
tccagagaacgatgaaagctgg

SEQ ID NO: 7318177 - DNA, 22 bp, Homo sapiens
tccagagacttgcatgtgcttg

SEQ ID NO: 7318178 - DNA, 22 bp, Homo sapiens
tccagagaattctacgcagtgc

SEQ ID NO: 7318179 - DNA, 22 bp, Homo sapiens
tcccagagctctgacaccagct

SEQ ID NO: 7318180 - DNA, 18 bp, Homo sapiens
ccagcatgccagaggctg

SEQ ID NO: 7318181 - DNA, 22 bp, Homo sapiens
ccagagaggcaaaactccttcc

SEQ ID NO: 7318182 - DNA, 22 bp, Homo sapiens
ccagagaggccaaggtcgtggt

SEQ ID NO: 7318183 - DNA, 22 bp, Homo sapiens
ccagagagagaggtcaatggca

SEQ ID NO: 7318184 - DNA, 22 bp, Homo sapiens
ccagagagctacaaggcataaa

SEQ ID NO: 7318185 - DNA, 19 bp, Homo sapiens
ccagagagctaggtacaga

SEQ ID NO: 7318186 - DNA, 21 bp, Homo sapiens
ccagagagagggaagtgggtt

SEQ ID NO: 7318187 - DNA, 22 bp, Homo sapiens
ccagagagagtactgggctctg

SEQ ID NO: 7318188 - DNA, 23 bp, Homo sapiens
tggacagtagggtagacagtgcc

SEQ ID NO: 7318189 - DNA, 22 bp, Homo sapiens
tggacagttgtcttgtagctaa

SEQ ID NO: 7318190 - DNA, 22 bp, Homo sapiens
cctcagccttggccccaggcag

SEQ ID NO: 7318191 - DNA, 22 bp, Homo sapiens
ccaggctcagcgcgcacgtctg

SEQ ID NO: 7318192 - DNA, 22 bp, Homo sapiens
ccaggctcaggcctgctcgttg

SEQ ID NO: 7318193 - DNA, 22 bp, Homo sapiens
ccaggctcacagcatcccagga

SEQ ID NO: 7318194 - DNA, 22 bp, Homo sapiens
ccagcctcactggcatcaccta

SEQ ID NO: 7318195 - DNA, 22 bp, Homo sapiens
tgacagagacttcagagccaaa

SEQ ID NO: 7318196 - DNA, 22 bp, Homo sapiens
cccagcatttctgggctgcact

SEQ ID NO: 7318197 - DNA, 22 bp, Homo sapiens
cccaggagacagaaacagaggt

SEQ ID NO: 7318198 - DNA, 22 bp, Homo sapiens
cccaaaggttgaggctgcagtg

SEQ ID NO: 7318199 - DNA, 22 bp, Homo sapiens
cccaagggtgcccagcagagga

SEQ ID NO: 7318200 - DNA, 22 bp, Homo sapiens
cccagagactttgtccgacgac

SEQ ID NO: 7318201 - DNA, 22 bp, Homo sapiens
cccagagaattccacatagagg

SEQ ID NO: 7318202 - DNA, 22 bp, Homo sapiens
cccagagagcacaggtggtggg

SEQ ID NO: 7318203 - DNA, 22 bp, Homo sapiens
cccagagagcatttggacaaag

SEQ ID NO: 7318204 - DNA, 22 bp, Homo sapiens
cccagagaggtaaaacagcctt

SEQ ID NO: 7318205 - DNA, 22 bp, Homo sapiens
cccagagatctactgagcccag

SEQ ID NO: 7318206 - DNA, 22 bp, Homo sapiens
cccagagaagtgaagtgacttg

SEQ ID NO: 7318207 - DNA, 22 bp, Homo sapiens
ttgcaattgctatggagagcgt

SEQ ID NO: 7318208 - DNA, 22 bp, Homo sapiens
ttggaaaggagattctattgtg

SEQ ID NO: 7318209 - DNA, 22 bp, Homo sapiens
ttggaaagcccattatttggac

SEQ ID NO: 7318210 - DNA, 22 bp, Homo sapiens
ttggagagatttaggtctcagt

SEQ ID NO: 7318211 - DNA, 22 bp, Homo sapiens
ttggagagaggctgctcaggct

SEQ ID NO: 7318212 - DNA, 22 bp, Homo sapiens
cagagagagtctgtccctgaag

SEQ ID NO: 7318213 - DNA, 22 bp, Homo sapiens
cagagagagtggggtgtggatt

SEQ ID NO: 7318214 - DNA, 22 bp, Homo sapiens
cagagagaatatgtagtatgga

SEQ ID NO: 7318215 - DNA, 22 bp, Homo sapiens
cagagagaggccactgctatta

SEQ ID NO: 7318216 - DNA, 22 bp, Homo sapiens
cagagagaggggctgcctggcc

SEQ ID NO: 7318217 - DNA, 22 bp, Homo sapiens
cagagagagtcaaatctttgct

SEQ ID NO: 7318218 - DNA, 22 bp, Homo sapiens
cagagagaggtgccgataatgg

SEQ ID NO: 7318219 - DNA, 19 bp, Homo sapiens
cagagagaccaaggcgcca

SEQ ID NO: 7318220 - DNA, 22 bp, Homo sapiens
cagagagaatcttggcagctga

SEQ ID NO: 7318221 - DNA, 22 bp, Homo sapiens
cagagagagcaggaaacctccg

SEQ ID NO: 7318222 - DNA, 22 bp, Homo sapiens
ggccccagcagaccctcctctg

SEQ ID NO: 7318223 - DNA, 21 bp, Homo sapiens
ggccccagcccatgggttctc

SEQ ID NO: 7318224 - DNA, 22 bp, Homo sapiens
ggccccagcctcagtcccctga

SEQ ID NO: 7318225 - DNA, 22 bp, Homo sapiens
cacccaggcaggtggctgagaa

SEQ ID NO: 7318226 - DNA, 22 bp, Homo sapiens
cacagagaactgtgggagtgtg

SEQ ID NO: 7318227 - DNA, 22 bp, Homo sapiens
gacagtggttccaaggcagctt

SEQ ID NO: 7318228 - DNA, 22 bp, Homo sapiens
gagtccagttagtgaggctggg

SEQ ID NO: 7318229 - DNA, 18 bp, Homo sapiens
gccagaggtactactgat

SEQ ID NO: 7318230 - DNA, 22 bp, Homo sapiens
gccagagggattcctggtgtgt

SEQ ID NO: 7318231 - DNA, 22 bp, Homo sapiens
gcaggcggaggttgcagtgagc

SEQ ID NO: 7318232 - DNA, 22 bp, Homo sapiens
aggtggcagactaacagaagga

SEQ ID NO: 7318233 - DNA, 22 bp, Homo sapiens
aggtcaccatggcatgctccac

SEQ ID NO: 7318234 - DNA, 22 bp, Homo sapiens
ccttccaggttttggctccatt

SEQ ID NO: 7318235 - DNA, 18 bp, Homo sapiens
aggcaggcggatcacaag

SEQ ID NO: 7318236 - DNA, 22 bp, Homo sapiens
aggcaggccctgggccatcccg

SEQ ID NO: 7318237 - DNA, 22 bp, Homo sapiens
aggcaggcccctgagaatagac

SEQ ID NO: 7318238 - DNA, 22 bp, Homo sapiens
agctgggctgatgactcatgtt

SEQ ID NO: 7318239 - DNA, 23 bp, Homo sapiens
agctgggccaggtggtcagacct

SEQ ID NO: 7318240 - DNA, 22 bp, Homo sapiens
ccccagagaaagtcagcagcat

SEQ ID NO: 7318241 - DNA, 22 bp, Homo sapiens
ccccagagtgagggattgagtg

SEQ ID NO: 7318242 - DNA, 22 bp, Homo sapiens
ccccagagagcaccatgaagcc

SEQ ID NO: 7318243 - DNA, 22 bp, Homo sapiens
ccagctggcaggagagtcaggg

SEQ ID NO: 7318244 - DNA, 22 bp, Homo sapiens
ccagctctgcttgcccagtcag

SEQ ID NO: 7318245 - DNA, 21 bp, Homo sapiens
ccagctctgcctccagttggt

SEQ ID NO: 7318246 - DNA, 22 bp, Homo sapiens
aggaggccgatttcagaggtcg

SEQ ID NO: 7318247 - DNA, 22 bp, Homo sapiens
agctccagtttcctgactgagc

SEQ ID NO: 7318248 - DNA, 22 bp, Homo sapiens
agctccaggtgcaagtcatggt

SEQ ID NO: 7318249 - DNA, 22 bp, Homo sapiens
acagccccccgctcagtttcca

SEQ ID NO: 7318250 - DNA, 23 bp, Homo sapiens
acagccccatgcaggtgtgtttg

SEQ ID NO: 7318251 - DNA, 22 bp, Homo sapiens
acagcccaggactccagtgggc

SEQ ID NO: 7318252 - DNA, 22 bp, Homo sapiens
acccagagaactgaggcatgaa

SEQ ID NO: 7318253 - DNA, 22 bp, Homo sapiens
acccagagcactgggtgtgggc

SEQ ID NO: 7318254 - DNA, 17 bp, Homo sapiens
acccagagaaggaggtc

SEQ ID NO: 7318255 - DNA, 22 bp, Homo sapiens
acccagagactagcacggtaca

SEQ ID NO: 7318256 - DNA, 22 bp, Homo sapiens
aggcccagcttgaagtgggaag

SEQ ID NO: 7318257 - DNA, 18 bp, Homo sapiens
agaggctggacaggggat

SEQ ID NO: 7318258 - DNA, 22 bp, Homo sapiens
agaggtgacataggagaggctc

SEQ ID NO: 7318259 - DNA, 22 bp, Homo sapiens
agaggctgggtacgggccacct

SEQ ID NO: 7318260 - DNA, 22 bp, Homo sapiens
agagccaggccaggccggggca

SEQ ID NO: 7318261 - DNA, 22 bp, Homo sapiens
agagcagatggccagggggcct

SEQ ID NO: 7318262 - DNA, 22 bp, Homo sapiens
agagaggctgggcgtagggctt

SEQ ID NO: 7318263 - DNA, 22 bp, Homo sapiens
agagagcccgggccagggcaca

SEQ ID NO: 7318264 - DNA, 22 bp, Homo sapiens
cacagagatggtctggcaggtg

SEQ ID NO: 7318265 - DNA, 22 bp, Homo sapiens
cacagagatggccagggcacat

SEQ ID NO: 7318266 - DNA, 21 bp, Homo sapiens
cacagagatattggtgagcct

SEQ ID NO: 7318267 - DNA, 22 bp, Homo sapiens
cacagagatcggaacagaagta

SEQ ID NO: 7318268 - DNA, 22 bp, Homo sapiens
agccccagttccctggaagtct

SEQ ID NO: 7318269 - DNA, 22 bp, Homo sapiens
agccaggccttagggagaggca

SEQ ID NO: 7318270 - DNA, 22 bp, Homo sapiens
agccagagttgaatgtgagtct

SEQ ID NO: 7318271 - DNA, 23 bp, Homo sapiens
agctccagaacatagcacaggaa

SEQ ID NO: 7318272 - DNA, 22 bp, Homo sapiens
agctccagaagcctgcaaggta

SEQ ID NO: 7318273 - DNA, 22 bp, Homo sapiens
aaaggccttttccccacttctt

SEQ ID NO: 7318274 - DNA, 20 bp, Homo sapiens
acagtgggtggggagcactg

SEQ ID NO: 7318275 - DNA, 17 bp, Homo sapiens
agagagagcatgccacc

SEQ ID NO: 7318276 - DNA, 22 bp, Homo sapiens
agcccaggtgaggggttcgaaa

SEQ ID NO: 7318277 - DNA, 22 bp, Homo sapiens
agcctgtgtgctttggacaggg

SEQ ID NO: 7318278 - DNA, 23 bp, Homo sapiens
tcagagagctgttgagagctgcc

SEQ ID NO: 7318279 - DNA, 22 bp, Homo sapiens
tcagagagcctcaggcactgcc

SEQ ID NO: 7318280 - DNA, 22 bp, Homo sapiens
tcagagagctggtgggcagagg

SEQ ID NO: 7318281 - DNA, 22 bp, Homo sapiens
tcccagagtgtgggcatcaagg

SEQ ID NO: 7318282 - DNA, 22 bp, Homo sapiens
tacacccacattgagcatggga

SEQ ID NO: 7318283 - DNA, 22 bp, Homo sapiens
tatgccactgctctccatccta

SEQ ID NO: 7318284 - DNA, 22 bp, Homo sapiens
gggctggctgattttcctctct

SEQ ID NO: 7318285 - DNA, 22 bp, Homo sapiens
ggtgccagcctagtgcagtggt

SEQ ID NO: 7318286 - DNA, 22 bp, Homo sapiens
ggcgtgggcgaggtgctctatc

SEQ ID NO: 7318287 - DNA, 22 bp, Homo sapiens
gccttccacctaggcctctgct

SEQ ID NO: 7318288 - DNA, 22 bp, Homo sapiens
gcggccttgtggcggagcaggc

SEQ ID NO: 7318289 - DNA, 22 bp, Homo sapiens
gcagaggagcaagctggacacc

SEQ ID NO: 7318290 - DNA, 22 bp, Homo sapiens
gcagggcggcccagagcaggcc

SEQ ID NO: 7318291 - DNA, 22 bp, Homo sapiens
gccagagagactgatacatgct

SEQ ID NO: 7318292 - DNA, 22 bp, Homo sapiens
gccagagagatggaaaagctta

SEQ ID NO: 7318293 - DNA, 22 bp, Homo sapiens
gccagagagagtccctgggcct

SEQ ID NO: 7318294 - DNA, 22 bp, Homo sapiens
gccagagaggcctaaggccata

SEQ ID NO: 7318295 - DNA, 22 bp, Homo sapiens
gccagagaggccgaggtaccca

SEQ ID NO: 7318296 - DNA, 22 bp, Homo sapiens
gccagagaggcaaatcctagca

SEQ ID NO: 7318297 - DNA, 22 bp, Homo sapiens
gcccagagtggccacttggctc

SEQ ID NO: 7318298 - DNA, 22 bp, Homo sapiens
gcccagagttcaaggctgcagt

SEQ ID NO: 7318299 - DNA, 22 bp, Homo sapiens
gcccagagtgagtcctgggccc

SEQ ID NO: 7318300 - DNA, 18 bp, Homo sapiens
gcccagaggtctgggccc

SEQ ID NO: 7318301 - DNA, 22 bp, Homo sapiens
gcccagagagatgctgtagacc

SEQ ID NO: 7318302 - DNA, 22 bp, Homo sapiens
gcccagagggaagaggtgtcat

SEQ ID NO: 7318303 - DNA, 22 bp, Homo sapiens
gagccagtgatcagacagggag

SEQ ID NO: 7318304 - DNA, 22 bp, Homo sapiens
gagcccagtaggcaaagctgca

SEQ ID NO: 7318305 - DNA, 22 bp, Homo sapiens
gagcccaggctggggttcagag

SEQ ID NO: 7318306 - DNA, 22 bp, Homo sapiens
gagcccaggcagaggttgcagt

SEQ ID NO: 7318307 - DNA, 22 bp, Homo sapiens
gaagggctgcaggtctgggccc

SEQ ID NO: 7318308 - DNA, 22 bp, Homo sapiens
gagagaacacaaagggccagct

SEQ ID NO: 7318309 - DNA, 22 bp, Homo sapiens
cccagagatgggaggtgatcgg

SEQ ID NO: 7318310 - DNA, 17 bp, Homo sapiens
cccagagatgctgcctt

SEQ ID NO: 7318311 - DNA, 22 bp, Homo sapiens
tgaggccaggcaaaggcgatct

SEQ ID NO: 7318312 - DNA, 17 bp, Homo sapiens
tgaggccatggcaccat

SEQ ID NO: 7318313 - DNA, 22 bp, Homo sapiens
tgaggccatgcccgtgccggcc

SEQ ID NO: 7318314 - DNA, 22 bp, Homo sapiens
tgagccagttcttcagatccat

SEQ ID NO: 7318315 - DNA, 22 bp, Homo sapiens
ccagggctgcctggccgtgtgt

SEQ ID NO: 7318316 - DNA, 22 bp, Homo sapiens
ccagggctgctgggggagttga

SEQ ID NO: 7318317 - DNA, 22 bp, Homo sapiens
ccagggctgccgcatccctggt

SEQ ID NO: 7318318 - DNA, 22 bp, Homo sapiens
cagggagaggcatcatagggaa

SEQ ID NO: 7318319 - DNA, 22 bp, Homo sapiens
cagtcccagctgctcagaaggc

SEQ ID NO: 7318320 - DNA, 22 bp, Homo sapiens
ccagagggcctttggagttatc

SEQ ID NO: 7318321 - DNA, 22 bp, Homo sapiens
ccagaggggcacaaaagtagaa

SEQ ID NO: 7318322 - DNA, 22 bp, Homo sapiens
ccagagggaagaggaagcgctg

SEQ ID NO: 7318323 - DNA, 22 bp, Homo sapiens
ccagagcagggcagcagggctc

SEQ ID NO: 7318324 - DNA, 20 bp, Homo sapiens
ccagagcagccactgaagtt

SEQ ID NO: 7318325 - DNA, 22 bp, Homo sapiens
ccagagaggccttggcaagaca

SEQ ID NO: 7318326 - DNA, 17 bp, Homo sapiens
tccagagaggcttccct

SEQ ID NO: 7318327 - DNA, 22 bp, Homo sapiens
ttctttgggctcagagagggag

SEQ ID NO: 7318328 - DNA, 22 bp, Homo sapiens
gagccaggaggcagagactgca

SEQ ID NO: 7318329 - DNA, 22 bp, Homo sapiens
atggccagtctgttggacagca

SEQ ID NO: 7318330 - DNA, 22 bp, Homo sapiens
atggcaggatacccagtccggc

SEQ ID NO: 7318331 - DNA, 22 bp, Homo sapiens
atgcagagacagatgtggcatg

SEQ ID NO: 7318332 - DNA, 22 bp, Homo sapiens
ggcctcgcggcttctggtggct

SEQ ID NO: 7318333 - DNA, 22 bp, Homo sapiens
cacccagacatgtggtcccaga

SEQ ID NO: 7318334 - DNA, 22 bp, Homo sapiens
gggacttaatgcagagagggac

SEQ ID NO: 7318335 - DNA, 22 bp, Homo sapiens
agtggtgaggggcatgtgtgat

SEQ ID NO: 7318336 - DNA, 22 bp, Homo sapiens
ctcgcatgccctgcctcatcca

SEQ ID NO: 7318337 - DNA, 22 bp, Homo sapiens
ctccagaaatttggatgcagca

SEQ ID NO: 7318338 - DNA, 22 bp, Homo sapiens
ctcagccccagcccagatagca

SEQ ID NO: 7318339 - DNA, 22 bp, Homo sapiens
agggtctttcctgggagccagc

SEQ ID NO: 7318340 - DNA, 22 bp, Homo sapiens
cctgcccctcaaggcctggtgc

SEQ ID NO: 7318341 - DNA, 22 bp, Homo sapiens
cccagctctgccatctacccac

SEQ ID NO: 7318342 - DNA, 22 bp, Homo sapiens
cccagcctgatctcggccagct

SEQ ID NO: 7318343 - DNA, 22 bp, Homo sapiens
cccagcctctgtttgctcctct

SEQ ID NO: 7318344 - DNA, 22 bp, Homo sapiens
ccagtctgtgtgccagcctgcg

SEQ ID NO: 7318345 - DNA, 20 bp, Homo sapiens
aggccaggaaatgtagttct

SEQ ID NO: 7318346 - DNA, 22 bp, Homo sapiens
aggcagcctggtttgaatggaa

SEQ ID NO: 7318347 - DNA, 22 bp, Homo sapiens
aggcagtggagctggaataggc

SEQ ID NO: 7318348 - DNA, 22 bp, Homo sapiens
cagtctctttatccaccaagcc

SEQ ID NO: 7318349 - DNA, 22 bp, Homo sapiens
caggcctggctgcagctcgcct

SEQ ID NO: 7318350 - DNA, 21 bp, Homo sapiens
atgcaggctgctcagaagcaa

SEQ ID NO: 7318351 - DNA, 22 bp, Homo sapiens
agagtgggcctctgagtcccag

SEQ ID NO: 7318352 - DNA, 22 bp, Homo sapiens
cagaagcctgcctcagatgcac

SEQ ID NO: 7318353 - DNA, 22 bp, Homo sapiens
cagaagcctaaatagtgcacca

SEQ ID NO: 7318354 - DNA, 22 bp, Homo sapiens
agccaggatggtctcgatcggc

SEQ ID NO: 7318355 - DNA, 22 bp, Homo sapiens
cagagagggcggccctggcttc

SEQ ID NO: 7318356 - DNA, 22 bp, Homo sapiens
agctccagggaaagagtggatc

SEQ ID NO: 7318357 - DNA, 22 bp, Homo sapiens
acctggacacctgctgtcatct

SEQ ID NO: 7318358 - DNA, 22 bp, Homo sapiens
aggcccttcttggtggctcagg

SEQ ID NO: 7318359 - DNA, 22 bp, Homo sapiens
aggcccttggactcatgctcga

SEQ ID NO: 7318360 - DNA, 17 bp, Homo sapiens
aggcaggcagagcggga

SEQ ID NO: 7318361 - DNA, 22 bp, Homo sapiens
aggcaggcagctgtcaccactc

SEQ ID NO: 7318362 - DNA, 22 bp, Homo sapiens
aggcaggctggtctgaagagtg

SEQ ID NO: 7318363 - DNA, 20 bp, Homo sapiens
accaggcccggtgtctcctc

SEQ ID NO: 7318364 - DNA, 22 bp, Homo sapiens
aggcaggcacacttcctccagg

SEQ ID NO: 7318365 - DNA, 22 bp, Homo sapiens
aggcaggcaagttcatatgagg

SEQ ID NO: 7318366 - DNA, 22 bp, Homo sapiens
aggcaggcaaccacctgggaag

SEQ ID NO: 7318367 - DNA, 22 bp, Homo sapiens
acagagagctgtgattgagtta

SEQ ID NO: 7318368 - DNA, 22 bp, Homo sapiens
acagagccaaaaggacatagta

SEQ ID NO: 7318369 - DNA, 22 bp, Homo sapiens
acagagagaaacaatcagcagc

SEQ ID NO: 7318370 - DNA, 22 bp, Homo sapiens
acagagagaattgggtttacag

SEQ ID NO: 7318371 - DNA, 22 bp, Homo sapiens
acagagagaggcccgaggctgc

SEQ ID NO: 7318372 - DNA, 22 bp, Homo sapiens
acaaagggggactgcagagggt

SEQ ID NO: 7318373 - DNA, 22 bp, Homo sapiens
agagccagttacaactgtggag

SEQ ID NO: 7318374 - DNA, 22 bp, Homo sapiens
agagccaggtgctgctgtttga

SEQ ID NO: 7318375 - DNA, 22 bp, Homo sapiens
agagccaggctcccatggggca

SEQ ID NO: 7318376 - DNA, 22 bp, Homo sapiens
agagccaggctctacctgggtt

SEQ ID NO: 7318377 - DNA, 22 bp, Homo sapiens
agagccaggcggctgggcacct

SEQ ID NO: 7318378 - DNA, 22 bp, Homo sapiens
acccagagcccttagcacagac

SEQ ID NO: 7318379 - DNA, 22 bp, Homo sapiens
acccagagtcatggcacttagc

SEQ ID NO: 7318380 - DNA, 22 bp, Homo sapiens
acccagaggtgtctagcaagct

SEQ ID NO: 7318381 - DNA, 22 bp, Homo sapiens
acccagaggcggaggttgcagt

SEQ ID NO: 7318382 - DNA, 22 bp, Homo sapiens
aagcctctggggcctcatctgt

SEQ ID NO: 7318383 - DNA, 22 bp, Homo sapiens
gtggccagccagggtgctgatg

SEQ ID NO: 7318384 - DNA, 22 bp, Homo sapiens
gtggccagccccatggacagtt

SEQ ID NO: 7318385 - DNA, 22 bp, Homo sapiens
gtggccagaatcttgaggcctt

SEQ ID NO: 7318386 - DNA, 22 bp, Homo sapiens
gtggccaggacattgccaggca

SEQ ID NO: 7318387 - DNA, 22 bp, Homo sapiens
gtggccaggagagggtgggaca

SEQ ID NO: 7318388 - DNA, 22 bp, Homo sapiens
gtggccaggagaccttgggcat

SEQ ID NO: 7318389 - DNA, 22 bp, Homo sapiens
gtgggccaggcgtctaggccct

SEQ ID NO: 7318390 - DNA, 22 bp, Homo sapiens
gtgggtgatgtactggaggcca

SEQ ID NO: 7318391 - DNA, 22 bp, Homo sapiens
gtggggtagatctttctcagga

SEQ ID NO: 7318392 - DNA, 22 bp, Homo sapiens
ggcaggcgtggtggcctcagaa

SEQ ID NO: 7318393 - DNA, 22 bp, Homo sapiens
ggcaaggcctgcagctcagtgt

SEQ ID NO: 7318394 - DNA, 22 bp, Homo sapiens
ggagcctggttactagagcctg

SEQ ID NO: 7318395 - DNA, 22 bp, Homo sapiens
ggagaggcttggcccagcctgg

SEQ ID NO: 7318396 - DNA, 22 bp, Homo sapiens
gctgggctctttacccctgtac

SEQ ID NO: 7318397 - DNA, 22 bp, Homo sapiens
gctgggctgcccaacctctgac

SEQ ID NO: 7318398 - DNA, 22 bp, Homo sapiens
ggccatgggaagaggtggagag

SEQ ID NO: 7318399 - DNA, 22 bp, Homo sapiens
ggccccagattctgggctgggt

SEQ ID NO: 7318400 - DNA, 22 bp, Homo sapiens
ggccccagttcactcctggccg

SEQ ID NO: 7318401 - DNA, 22 bp, Homo sapiens
ggccatggtcatgggtgagctt

SEQ ID NO: 7318402 - DNA, 20 bp, Homo sapiens
ggccatgggttgcctgaggt

SEQ ID NO: 7318403 - DNA, 22 bp, Homo sapiens
ggccatggtggtttgagcacct

SEQ ID NO: 7318404 - DNA, 22 bp, Homo sapiens
ggccatggtgaggtcttctcag

SEQ ID NO: 7318405 - DNA, 22 bp, Homo sapiens
gggcctgttctgattggcagat

SEQ ID NO: 7318406 - DNA, 22 bp, Homo sapiens
gggccatgagaggttcatcaac

SEQ ID NO: 7318407 - DNA, 23 bp, Homo sapiens
ggggacagagggcagcccgcatc

SEQ ID NO: 7318408 - DNA, 22 bp, Homo sapiens
gctccagagcagagactaggtt

SEQ ID NO: 7318409 - DNA, 22 bp, Homo sapiens
gctccagagtgtggcatctggg

SEQ ID NO: 7318410 - DNA, 22 bp, Homo sapiens
gctccagatgaaaggccagagg

SEQ ID NO: 7318411 - DNA, 22 bp, Homo sapiens
gctccagatgaatgcacttgtt

SEQ ID NO: 7318412 - DNA, 22 bp, Homo sapiens
gcagtgggcaacaagagctgga

SEQ ID NO: 7318413 - DNA, 22 bp, Homo sapiens
gcagagcctgtgtctgagcaaa

SEQ ID NO: 7318414 - DNA, 22 bp, Homo sapiens
gcagagcggtgatcaggcgcag

SEQ ID NO: 7318415 - DNA, 22 bp, Homo sapiens
gcacccagtttgtctcagggtt

SEQ ID NO: 7318416 - DNA, 22 bp, Homo sapiens
gacacagagataggcctgtgtt

SEQ ID NO: 7318417 - DNA, 22 bp, Homo sapiens
gacccagaggcctgacagtgtg

SEQ ID NO: 7318418 - DNA, 22 bp, Homo sapiens
gacccagggtatccagagctgc

SEQ ID NO: 7318419 - DNA, 22 bp, Homo sapiens
cctggcaggctggggacagtgc

SEQ ID NO: 7318420 - DNA, 22 bp, Homo sapiens
tggcaaggctgtgggggcagag

SEQ ID NO: 7318421 - DNA, 22 bp, Homo sapiens
tggcaaggccacaggtgcagtt

SEQ ID NO: 7318422 - DNA, 22 bp, Homo sapiens
tggcacaggatctcagcggcca

SEQ ID NO: 7318423 - DNA, 21 bp, Homo sapiens
cccaggaggctgagaagagca

SEQ ID NO: 7318424 - DNA, 22 bp, Homo sapiens
cccagcctgtgacagccgtcct

SEQ ID NO: 7318425 - DNA, 22 bp, Homo sapiens
cccagctcttcaagtcaccccc

SEQ ID NO: 7318426 - DNA, 22 bp, Homo sapiens
cccaggctcctgactcattcta

SEQ ID NO: 7318427 - DNA, 22 bp, Homo sapiens
cccaggctcctagaggcccaga

SEQ ID NO: 7318428 - DNA, 22 bp, Homo sapiens
cccagggagcttggagaacggg

SEQ ID NO: 7318429 - DNA, 22 bp, Homo sapiens
ctggcaagaaatatatatctta

SEQ ID NO: 7318430 - DNA, 22 bp, Homo sapiens
ttggaaaagcgttctctgtagc

SEQ ID NO: 7318431 - DNA, 20 bp, Homo sapiens
gttggaaagttcactctgct

SEQ ID NO: 7318432 - DNA, 22 bp, Homo sapiens
gttggaaatggtttctatccct

SEQ ID NO: 7318433 - DNA, 22 bp, Homo sapiens
gttggaaatgcagagtctcaga

SEQ ID NO: 7318434 - DNA, 22 bp, Homo sapiens
gtggccaggcgtccgcgcggct

SEQ ID NO: 7318435 - DNA, 19 bp, Homo sapiens
gtggccagggcaggggctg

SEQ ID NO: 7318436 - DNA, 21 bp, Homo sapiens
cagcccagcccattgacagtg

SEQ ID NO: 7318437 - DNA, 20 bp, Homo sapiens
ccacagaggacagggctgtg

SEQ ID NO: 7318438 - DNA, 22 bp, Homo sapiens
ccagctctaaacggctctgtgg

SEQ ID NO: 7318439 - DNA, 22 bp, Homo sapiens
ccagctctcaaggctccctggg

SEQ ID NO: 7318440 - DNA, 22 bp, Homo sapiens
ccagccccgggaacctggccgt

SEQ ID NO: 7318441 - DNA, 22 bp, Homo sapiens
ccagcccctatcctcgctccac

SEQ ID NO: 7318442 - DNA, 22 bp, Homo sapiens
tctcttgggaggaaagagagaa

SEQ ID NO: 7318443 - DNA, 22 bp, Homo sapiens
ccagctgctttttgtcacatgg

SEQ ID NO: 7318444 - DNA, 18 bp, Homo sapiens
cagtgctgttaacagtga

SEQ ID NO: 7318445 - DNA, 22 bp, Homo sapiens
tcacccaagaccatcggaagtg

SEQ ID NO: 7318446 - DNA, 20 bp, Homo sapiens
tcagcccagggtgagcatct

SEQ ID NO: 7318447 - DNA, 22 bp, Homo sapiens
tcagcccagggacagaggcccc

SEQ ID NO: 7318448 - DNA, 23 bp, Homo sapiens
ttccagagtccacatctgccacc

SEQ ID NO: 7318449 - DNA, 22 bp, Homo sapiens
ttccagaggttctcagccctgt

SEQ ID NO: 7318450 - DNA, 22 bp, Homo sapiens
ttccagagtgactgtgccactt

SEQ ID NO: 7318451 - DNA, 22 bp, Homo sapiens
ttccagagtctggttccatggt

SEQ ID NO: 7318452 - DNA, 22 bp, Homo sapiens
ttccagaggagtgattcagagg

SEQ ID NO: 7318453 - DNA, 23 bp, Homo sapiens
ttccagaggaagaagtcatgact

SEQ ID NO: 7318454 - DNA, 22 bp, Homo sapiens
tggttcctcaagcgctggcggc

SEQ ID NO: 7318455 - DNA, 22 bp, Homo sapiens
tgggccaggatttcaagaccct

SEQ ID NO: 7318456 - DNA, 22 bp, Homo sapiens
tgggcagggagctggaaccaca

SEQ ID NO: 7318457 - DNA, 22 bp, Homo sapiens
tgggccagggcacccagtccag

SEQ ID NO: 7318458 - DNA, 22 bp, Homo sapiens
tgggccaggcatgtgatcagca

SEQ ID NO: 7318459 - DNA, 22 bp, Homo sapiens
tgggtgaggatgatgaggcagc

SEQ ID NO: 7318460 - DNA, 22 bp, Homo sapiens
tgggaagggtcaacagctggaa

SEQ ID NO: 7318461 - DNA, 22 bp, Homo sapiens
tgggaaggggagctggaaagga

SEQ ID NO: 7318462 - DNA, 22 bp, Homo sapiens
tggccaggctggtctggaacgc

SEQ ID NO: 7318463 - DNA, 22 bp, Homo sapiens
tggccaggccggggacagaact

SEQ ID NO: 7318464 - DNA, 22 bp, Homo sapiens
tggcagagtcatcacatctgga

SEQ ID NO: 7318465 - DNA, 21 bp, Homo sapiens
tggcaggcagctggaagcttg

SEQ ID NO: 7318466 - DNA, 20 bp, Homo sapiens
tggcacagaacccttgccta

SEQ ID NO: 7318467 - DNA, 22 bp, Homo sapiens
tggcacagaaaaatgctccatt

SEQ ID NO: 7318468 - DNA, 22 bp, Homo sapiens
tgctgagcgcatccggcggccg

SEQ ID NO: 7318469 - DNA, 22 bp, Homo sapiens
tggagaggagcaccatggccat

SEQ ID NO: 7318470 - DNA, 22 bp, Homo sapiens
tggaagggggaagacagctctg

SEQ ID NO: 7318471 - DNA, 22 bp, Homo sapiens
tggacaggtgagtgactcaggg

SEQ ID NO: 7318472 - DNA, 22 bp, Homo sapiens
tggacagggcagagaccgagtc

SEQ ID NO: 7318473 - DNA, 22 bp, Homo sapiens
tgaggccaatgaccctgggcag

SEQ ID NO: 7318474 - DNA, 19 bp, Homo sapiens
tgaggccagctggcatttt

SEQ ID NO: 7318475 - DNA, 18 bp, Homo sapiens
tgaggccagagtgggcat

SEQ ID NO: 7318476 - DNA, 22 bp, Homo sapiens
tgaggccaactagggagatgga

SEQ ID NO: 7318477 - DNA, 22 bp, Homo sapiens
tgaggccaagaaaagctgggtg

SEQ ID NO: 7318478 - DNA, 22 bp, Homo sapiens
tgagccagtctctcagaaccct

SEQ ID NO: 7318479 - DNA, 22 bp, Homo sapiens
tgagccaggttaagacaggagc

SEQ ID NO: 7318480 - DNA, 22 bp, Homo sapiens
tgagccagcctcagaagtcacg

SEQ ID NO: 7318481 - DNA, 22 bp, Homo sapiens
tgagccagagaggttgaggcta

SEQ ID NO: 7318482 - DNA, 22 bp, Homo sapiens
tctttggagtgttatcagtaat

SEQ ID NO: 7318483 - DNA, 22 bp, Homo sapiens
tgccccagacctactgaatggg

SEQ ID NO: 7318484 - DNA, 20 bp, Homo sapiens
tgccccaggcctgcacctgc

SEQ ID NO: 7318485 - DNA, 22 bp, Homo sapiens
tgccagagatttcacactgcta

SEQ ID NO: 7318486 - DNA, 22 bp, Homo sapiens
tgcagaggagctggaaggctgg

SEQ ID NO: 7318487 - DNA, 22 bp, Homo sapiens
tctggctctctcatcacccaat

SEQ ID NO: 7318488 - DNA, 22 bp, Homo sapiens
tctgcaacattcctctccccac

SEQ ID NO: 7318489 - DNA, 22 bp, Homo sapiens
aaatgcatgtagaataatagag

SEQ ID NO: 7318490 - DNA, 22 bp, Homo sapiens
aagcaggagatgcaggaatgta

SEQ ID NO: 7318491 - DNA, 22 bp, Homo sapiens
aagcaggagatgcaggaatgta

SEQ ID NO: 7318492 - DNA, 22 bp, Homo sapiens
aagattcccagagaagttccac

SEQ ID NO: 7318493 - DNA, 22 bp, Homo sapiens
aaagttttagaactaggaagca

SEQ ID NO: 7318494 - DNA, 22 bp, Homo sapiens
aagactctatctttagagatca

SEQ ID NO: 7318495 - DNA, 22 bp, Homo sapiens
aaagtgattatgctgtcaaaga

SEQ ID NO: 7318496 - DNA, 22 bp, Homo sapiens
aaagatgttttataagttatgg

SEQ ID NO: 7318497 - DNA, 22 bp, Homo sapiens
aaagatttgagttctgcttata

SEQ ID NO: 7318498 - DNA, 22 bp, Homo sapiens
aaagatttcagaagcctgtgcc

SEQ ID NO: 7318499 - DNA, 22 bp, Homo sapiens
aacatacatatttcagtgtcca

SEQ ID NO: 7318500 - DNA, 22 bp, Homo sapiens
aaagcccatgtggaagtacagg

SEQ ID NO: 7318501 - DNA, 22 bp, Homo sapiens
aaagccattgcagagcaggatt

SEQ ID NO: 7318502 - DNA, 22 bp, Homo sapiens
aaaggtttttatttatcctgga

SEQ ID NO: 7318503 - DNA, 22 bp, Homo sapiens
aaaggttttgccctgggtattc

SEQ ID NO: 7318504 - DNA, 22 bp, Homo sapiens
aaaggcagagttgttggaggca

SEQ ID NO: 7318505 - DNA, 18 bp, Homo sapiens
aaaggcagattactggga

SEQ ID NO: 7318506 - DNA, 22 bp, Homo sapiens
aaaggcagtgtgatactgtggt

SEQ ID NO: 7318507 - DNA, 22 bp, Homo sapiens
aaaggcagtgggtatgtggatc

SEQ ID NO: 7318508 - DNA, 23 bp, Homo sapiens
aaaggcaggcctaggacatattg

SEQ ID NO: 7318509 - DNA, 22 bp, Homo sapiens
aaaggcaggctttcacatctca

SEQ ID NO: 7318510 - DNA, 22 bp, Homo sapiens
aacatttgtttggcttcaatta

SEQ ID NO: 7318511 - DNA, 22 bp, Homo sapiens
aaagagaaaatgatctgtacat

SEQ ID NO: 7318512 - DNA, 22 bp, Homo sapiens
aaagagaacttttacccaagaa

SEQ ID NO: 7318513 - DNA, 22 bp, Homo sapiens
aaagagatgtgccaaatagcct

SEQ ID NO: 7318514 - DNA, 22 bp, Homo sapiens
aaatagtcctgggaatagtact

SEQ ID NO: 7318515 - DNA, 22 bp, Homo sapiens
aaagaaatagatggcatttaaa

SEQ ID NO: 7318516 - DNA, 22 bp, Homo sapiens
aaactttttattctaatgtcta

SEQ ID NO: 7318517 - DNA, 22 bp, Homo sapiens
aaacattgagcacttgctattt

SEQ ID NO: 7318518 - DNA, 22 bp, Homo sapiens
aaacattccctaatgtgtccgt

SEQ ID NO: 7318519 - DNA, 22 bp, Homo sapiens
aaacattgtaattttagcatgg

SEQ ID NO: 7318520 - DNA, 22 bp, Homo sapiens
aaactgcaatgacaggtaggag

SEQ ID NO: 7318521 - DNA, 22 bp, Homo sapiens
aaacatgttttctgaatatttt

SEQ ID NO: 7318522 - DNA, 22 bp, Homo sapiens
aaacattccatttctatgtaag

SEQ ID NO: 7318523 - DNA, 22 bp, Homo sapiens
aaacatgctggatttagaatat

SEQ ID NO: 7318524 - DNA, 22 bp, Homo sapiens
aaacatgcattcaagaaaatct

SEQ ID NO: 7318525 - DNA, 22 bp, Homo sapiens
aaacatgtaattctgcttaaga

SEQ ID NO: 7318526 - DNA, 22 bp, Homo sapiens
aaaaggtagattctccttctat

SEQ ID NO: 7318527 - DNA, 22 bp, Homo sapiens
aaaattaagtgtctgggaagcc

SEQ ID NO: 7318528 - DNA, 22 bp, Homo sapiens
aaaattatggagtatcccaaag

SEQ ID NO: 7318529 - DNA, 22 bp, Homo sapiens
aaaatgtgatctacaaatgcaa

SEQ ID NO: 7318530 - DNA, 22 bp, Homo sapiens
aaaattgagagttatagatggt

SEQ ID NO: 7318531 - DNA, 22 bp, Homo sapiens
aaaatatgaagttgtcagtatg

SEQ ID NO: 7318532 - DNA, 22 bp, Homo sapiens
aaaatatgtataactcttctgc

SEQ ID NO: 7318533 - DNA, 22 bp, Homo sapiens
aaactgcatgaagctgatttta

SEQ ID NO: 7318534 - DNA, 21 bp, Homo sapiens
aaaatgtgagcgtgatgctta

SEQ ID NO: 7318535 - DNA, 22 bp, Homo sapiens
aacagacaactcctgtggctca

SEQ ID NO: 7318536 - DNA, 22 bp, Homo sapiens
aaattttaaggctggaacttaa

SEQ ID NO: 7318537 - DNA, 22 bp, Homo sapiens
aaatgtcaaggtgatagatgca

SEQ ID NO: 7318538 - DNA, 22 bp, Homo sapiens
aatgacagtgttgggccagatg

SEQ ID NO: 7318539 - DNA, 23 bp, Homo sapiens
aatgacagtgtgtgattgaagaa

SEQ ID NO: 7318540 - DNA, 22 bp, Homo sapiens
aatgacagagatagaagggatg

SEQ ID NO: 7318541 - DNA, 22 bp, Homo sapiens
aatgacagccctctagtctggg

SEQ ID NO: 7318542 - DNA, 23 bp, Homo sapiens
aatgacaggcaatgtaattgtgt

SEQ ID NO: 7318543 - DNA, 23 bp, Homo sapiens
aatgacaggcaatgtaattgtgt

SEQ ID NO: 7318544 - DNA, 22 bp, Homo sapiens
aatgacagagcactgaacttgg

SEQ ID NO: 7318545 - DNA, 21 bp, Homo sapiens
aatgacagccagatcctttta

SEQ ID NO: 7318546 - DNA, 22 bp, Homo sapiens
aatagacaagcaccctggtaaa

SEQ ID NO: 7318547 - DNA, 22 bp, Homo sapiens
aatagacaattctagccaacat

SEQ ID NO: 7318548 - DNA, 22 bp, Homo sapiens
aagtgcttggattgcaggtatg

SEQ ID NO: 7318549 - DNA, 19 bp, Homo sapiens
aacatcatggctctttcca

SEQ ID NO: 7318550 - DNA, 22 bp, Homo sapiens
aacatcagaagtagaagactca

SEQ ID NO: 7318551 - DNA, 22 bp, Homo sapiens
aacatatttggctgatattccc

SEQ ID NO: 7318552 - DNA, 19 bp, Homo sapiens
aactggataatggccacat

SEQ ID NO: 7318553 - DNA, 22 bp, Homo sapiens
aagaaacaaccactgctctcct

SEQ ID NO: 7318554 - DNA, 22 bp, Homo sapiens
aagaaaacaatgacttgccagc

SEQ ID NO: 7318555 - DNA, 17 bp, Homo sapiens
aagaacactcaatagca

SEQ ID NO: 7318556 - DNA, 22 bp, Homo sapiens
aagaacaactgctttaaaagca

SEQ ID NO: 7318557 - DNA, 22 bp, Homo sapiens
aagaaatgtgaatattgaatag

SEQ ID NO: 7318558 - DNA, 22 bp, Homo sapiens
aattctctccagggtaacatca

SEQ ID NO: 7318559 - DNA, 22 bp, Homo sapiens
acacaaacagtctatagcacca

SEQ ID NO: 7318560 - DNA, 22 bp, Homo sapiens
aagagaatatcgatagcactct

SEQ ID NO: 7318561 - DNA, 21 bp, Homo sapiens
aatttcagacccattttgcct

SEQ ID NO: 7318562 - DNA, 22 bp, Homo sapiens
aatttcagaactatctgggagt

SEQ ID NO: 7318563 - DNA, 22 bp, Homo sapiens
aatttcagttgctaataagttc

SEQ ID NO: 7318564 - DNA, 22 bp, Homo sapiens
aatttcagtatgaagtttcaca

SEQ ID NO: 7318565 - DNA, 22 bp, Homo sapiens
aatttcagcaacgggagcctag

SEQ ID NO: 7318566 - DNA, 22 bp, Homo sapiens
aatttcagcttaagttgtttgg

SEQ ID NO: 7318567 - DNA, 22 bp, Homo sapiens
aattttaagcatatgactggtt

SEQ ID NO: 7318568 - DNA, 22 bp, Homo sapiens
aattttaatcagtggtgctgag

SEQ ID NO: 7318569 - DNA, 22 bp, Homo sapiens
aagactttctgtaaagctacag

SEQ ID NO: 7318570 - DNA, 22 bp, Homo sapiens
aagcaatatactgatatgatta

SEQ ID NO: 7318571 - DNA, 20 bp, Homo sapiens
aagcaatatagtgcaaatgt

SEQ ID NO: 7318572 - DNA, 19 bp, Homo sapiens
aagcaatgttgtgaatcta

SEQ ID NO: 7318573 - DNA, 22 bp, Homo sapiens
aagcaggaagctcaggtccttg

SEQ ID NO: 7318574 - DNA, 22 bp, Homo sapiens
acacatttctaaatttttaccg

SEQ ID NO: 7318575 - DNA, 22 bp, Homo sapiens
aagcaataatcccaaagtgctg

SEQ ID NO: 7318576 - DNA, 22 bp, Homo sapiens
aagatggtcttgagatattata

SEQ ID NO: 7318577 - DNA, 22 bp, Homo sapiens
aagatggtggccagagtggaaa

SEQ ID NO: 7318578 - DNA, 22 bp, Homo sapiens
aagatggtttctgtaggtttat

SEQ ID NO: 7318579 - DNA, 22 bp, Homo sapiens
aagatggttatttcatcaccta

SEQ ID NO: 7318580 - DNA, 22 bp, Homo sapiens
aagatggtgtggtcaaggacca

SEQ ID NO: 7318581 - DNA, 21 bp, Homo sapiens
aagatggttatgtgctaaaga

SEQ ID NO: 7318582 - DNA, 22 bp, Homo sapiens
aagatggtaaggcagctggcag

SEQ ID NO: 7318583 - DNA, 22 bp, Homo sapiens
aagatgcggttgaccatggtgt

SEQ ID NO: 7318584 - DNA, 22 bp, Homo sapiens
aaggccttgccgaaggatgcca

SEQ ID NO: 7318585 - DNA, 22 bp, Homo sapiens
aaggccttgcctgacagcacca

SEQ ID NO: 7318586 - DNA, 22 bp, Homo sapiens
aaggcctttcttatcagtagat

SEQ ID NO: 7318587 - DNA, 22 bp, Homo sapiens
acatttctcttgatgtctctat

SEQ ID NO: 7318588 - DNA, 22 bp, Homo sapiens
acatttaaatatgccttatatt

SEQ ID NO: 7318589 - DNA, 22 bp, Homo sapiens
acatttaaatacctatgtttct

SEQ ID NO: 7318590 - DNA, 22 bp, Homo sapiens
aaggaggaatttcagggtgaat

SEQ ID NO: 7318591 - DNA, 22 bp, Homo sapiens
aaggaggaatgtagccagctcc

SEQ ID NO: 7318592 - DNA, 22 bp, Homo sapiens
acagtgtttatgtacagattgt

SEQ ID NO: 7318593 - DNA, 22 bp, Homo sapiens
acatatgcgatcataggatgca

SEQ ID NO: 7318594 - DNA, 22 bp, Homo sapiens
acagtcttatgcatacactatt

SEQ ID NO: 7318595 - DNA, 22 bp, Homo sapiens
acagtcttgcacttctatcagc

SEQ ID NO: 7318596 - DNA, 22 bp, Homo sapiens
acagtgtttaaaaatcagatct

SEQ ID NO: 7318597 - DNA, 22 bp, Homo sapiens
aaggagagtacaggagttggta

SEQ ID NO: 7318598 - DNA, 22 bp, Homo sapiens
aagcatttttcacagcaacagc

SEQ ID NO: 7318599 - DNA, 22 bp, Homo sapiens
aagctcattaattagaagctaa

SEQ ID NO: 7318600 - DNA, 23 bp, Homo sapiens
actttattgaccccaggtcagtt

SEQ ID NO: 7318601 - DNA, 22 bp, Homo sapiens
aatatagtgttagctcatttga

SEQ ID NO: 7318602 - DNA, 22 bp, Homo sapiens
aatatagttctagaaatatttt

SEQ ID NO: 7318603 - DNA, 22 bp, Homo sapiens
aatatagttctggtattgttaa

SEQ ID NO: 7318604 - DNA, 22 bp, Homo sapiens
actgggcttcacttggcacatc

SEQ ID NO: 7318605 - DNA, 22 bp, Homo sapiens
actgggctgcctggttcttcta

SEQ ID NO: 7318606 - DNA, 22 bp, Homo sapiens
actgggctggttagttttacta

SEQ ID NO: 7318607 - DNA, 22 bp, Homo sapiens
actgggctggggctcattctcc

SEQ ID NO: 7318608 - DNA, 22 bp, Homo sapiens
actgggctgcttgagtgccttc

SEQ ID NO: 7318609 - DNA, 22 bp, Homo sapiens
actgggctgtggacacccagcg

SEQ ID NO: 7318610 - DNA, 22 bp, Homo sapiens
actgggctgtaaagagaggcaa

SEQ ID NO: 7318611 - DNA, 23 bp, Homo sapiens
actgggcttatgaggaggcttgt

SEQ ID NO: 7318612 - DNA, 22 bp, Homo sapiens
actgggctgttccttatttcta

SEQ ID NO: 7318613 - DNA, 22 bp, Homo sapiens
actgggctgttttttgagtgga

SEQ ID NO: 7318614 - DNA, 22 bp, Homo sapiens
actgggcttatttcttgtgaac

SEQ ID NO: 7318615 - DNA, 22 bp, Homo sapiens
actgggcttatgctgtggagta

SEQ ID NO: 7318616 - DNA, 22 bp, Homo sapiens
aatcagaacttctcagggtggg

SEQ ID NO: 7318617 - DNA, 22 bp, Homo sapiens
actgcactccagcctgggtaac

SEQ ID NO: 7318618 - DNA, 22 bp, Homo sapiens
actggacagaggaaatatggag

SEQ ID NO: 7318619 - DNA, 22 bp, Homo sapiens
actggaggattcctggaaggcg

SEQ ID NO: 7318620 - DNA, 22 bp, Homo sapiens
actctcccacgttcgactctaa

SEQ ID NO: 7318621 - DNA, 22 bp, Homo sapiens
actctccctgctatccacttcc

SEQ ID NO: 7318622 - DNA, 22 bp, Homo sapiens
aattaaattggtttagagagga

SEQ ID NO: 7318623 - DNA, 22 bp, Homo sapiens
aatgtgtaaaaggttttcttca

SEQ ID NO: 7318624 - DNA, 22 bp, Homo sapiens
agaccccctttaatggaagtgc

SEQ ID NO: 7318625 - DNA, 22 bp, Homo sapiens
aatgtgaactttgtcatgtaac

SEQ ID NO: 7318626 - DNA, 22 bp, Homo sapiens
aatgggaagtcactactgttac

SEQ ID NO: 7318627 - DNA, 22 bp, Homo sapiens
aatggcactttataaatgttaa

SEQ ID NO: 7318628 - DNA, 22 bp, Homo sapiens
agacaatgtcaaggtgatcatc

SEQ ID NO: 7318629 - DNA, 22 bp, Homo sapiens
acaaagtagtcaaagtagatga

SEQ ID NO: 7318630 - DNA, 22 bp, Homo sapiens
aattgatgggcactgaaatatt

SEQ ID NO: 7318631 - DNA, 22 bp, Homo sapiens
aattgcatgttaatgactaagt

SEQ ID NO: 7318632 - DNA, 22 bp, Homo sapiens
acaacaaagacacttgaaatga

SEQ ID NO: 7318633 - DNA, 22 bp, Homo sapiens
acaagattttatgactcttttt

SEQ ID NO: 7318634 - DNA, 22 bp, Homo sapiens
acaagcatgtggtaaaaagacc

SEQ ID NO: 7318635 - DNA, 21 bp, Homo sapiens
acagagaaagagcagcctcct

SEQ ID NO: 7318636 - DNA, 22 bp, Homo sapiens
acagacagaggctccatgagga

SEQ ID NO: 7318637 - DNA, 22 bp, Homo sapiens
acagatgcaaggaaatgattgc

SEQ ID NO: 7318638 - DNA, 17 bp, Homo sapiens
acagatgctgataagaa

SEQ ID NO: 7318639 - DNA, 21 bp, Homo sapiens
acagatgtgatatgcagtctt

SEQ ID NO: 7318640 - DNA, 22 bp, Homo sapiens
acagatgttgcttgtcattctc

SEQ ID NO: 7318641 - DNA, 22 bp, Homo sapiens
agcagcaaagaataggccctct

SEQ ID NO: 7318642 - DNA, 22 bp, Homo sapiens
acactctgtgaggcatgtaatg

SEQ ID NO: 7318643 - DNA, 22 bp, Homo sapiens
acacattatagagagtataata

SEQ ID NO: 7318644 - DNA, 22 bp, Homo sapiens
acacattataggcaatcaaaag

SEQ ID NO: 7318645 - DNA, 22 bp, Homo sapiens
acactttagaaaaaagaatggt

SEQ ID NO: 7318646 - DNA, 22 bp, Homo sapiens
acacatgtgattctaagacagc

SEQ ID NO: 7318647 - DNA, 21 bp, Homo sapiens
acagttttaaggagcacatgg

SEQ ID NO: 7318648 - DNA, 22 bp, Homo sapiens
acagttcaagcaagtttctgtt

SEQ ID NO: 7318649 - DNA, 22 bp, Homo sapiens
acagttcaagacatcagtatga

SEQ ID NO: 7318650 - DNA, 22 bp, Homo sapiens
acagggcaacctctgggagact

SEQ ID NO: 7318651 - DNA, 21 bp, Homo sapiens
accaaaacctatactttctgt

SEQ ID NO: 7318652 - DNA, 22 bp, Homo sapiens
accaaaacctgctactaaagga

SEQ ID NO: 7318653 - DNA, 22 bp, Homo sapiens
acccgggaggcaggagtcatag

SEQ ID NO: 7318654 - DNA, 22 bp, Homo sapiens
agggagctctaagtagagggac

SEQ ID NO: 7318655 - DNA, 22 bp, Homo sapiens
agggagctcagttggaagcggt

SEQ ID NO: 7318656 - DNA, 22 bp, Homo sapiens
accattctgtctctttacaaat

SEQ ID NO: 7318657 - DNA, 22 bp, Homo sapiens
aggccttcctcggagacaggga

SEQ ID NO: 7318658 - DNA, 16 bp, Homo sapiens
aggcgaaggttcattt

SEQ ID NO: 7318659 - DNA, 22 bp, Homo sapiens
acattgtatacagacttagtca

SEQ ID NO: 7318660 - DNA, 22 bp, Homo sapiens
acatttaaccaaactgtttaat

SEQ ID NO: 7318661 - DNA, 19 bp, Homo sapiens
acatttaaattcagatctc

SEQ ID NO: 7318662 - DNA, 22 bp, Homo sapiens
acatttacagtgctagacaatc

SEQ ID NO: 7318663 - DNA, 22 bp, Homo sapiens
acatttaatgatcctactgtga

SEQ ID NO: 7318664 - DNA, 22 bp, Homo sapiens
acatttatataactcactagga

SEQ ID NO: 7318665 - DNA, 22 bp, Homo sapiens
agggtgcctgctgcaggttcag

SEQ ID NO: 7318666 - DNA, 19 bp, Homo sapiens
actcaggcttcctctgagg

SEQ ID NO: 7318667 - DNA, 22 bp, Homo sapiens
actatataagattggcattttt

SEQ ID NO: 7318668 - DNA, 22 bp, Homo sapiens
actgctttagacctagagctct

SEQ ID NO: 7318669 - DNA, 22 bp, Homo sapiens
actgctattgatgtcacacttt

SEQ ID NO: 7318670 - DNA, 22 bp, Homo sapiens
actggacagaggaaatatggag

SEQ ID NO: 7318671 - DNA, 22 bp, Homo sapiens
actgagggttagtggaccgtgt

SEQ ID NO: 7318672 - DNA, 22 bp, Homo sapiens
actgagggtgcacaggcaggca

SEQ ID NO: 7318673 - DNA, 22 bp, Homo sapiens
agtttagtataccagtacatct

SEQ ID NO: 7318674 - DNA, 17 bp, Homo sapiens
actggttttggcagcat

SEQ ID NO: 7318675 - DNA, 22 bp, Homo sapiens
actggtttttccatatgagatg

SEQ ID NO: 7318676 - DNA, 22 bp, Homo sapiens
actggtttttctcatgaaaatg

SEQ ID NO: 7318677 - DNA, 22 bp, Homo sapiens
actggtttgggacaatttgtgc

SEQ ID NO: 7318678 - DNA, 22 bp, Homo sapiens
actggtttgtctattgtcattc

SEQ ID NO: 7318679 - DNA, 22 bp, Homo sapiens
actggttttccaggttacttct

SEQ ID NO: 7318680 - DNA, 22 bp, Homo sapiens
actggttttggaaatcagtaca

SEQ ID NO: 7318681 - DNA, 22 bp, Homo sapiens
actgtgtattcctatatagtaa

SEQ ID NO: 7318682 - DNA, 22 bp, Homo sapiens
actgtgaaagctaacatcttag

SEQ ID NO: 7318683 - DNA, 22 bp, Homo sapiens
acttatttcatggatcataatg

SEQ ID NO: 7318684 - DNA, 22 bp, Homo sapiens
atataattctcaggtttgacta

SEQ ID NO: 7318685 - DNA, 22 bp, Homo sapiens
atatatttgagaatattcatga

SEQ ID NO: 7318686 - DNA, 22 bp, Homo sapiens
atatatttactctcctgttgca

SEQ ID NO: 7318687 - DNA, 22 bp, Homo sapiens
atatatttgagaatattcatga

SEQ ID NO: 7318688 - DNA, 22 bp, Homo sapiens
agaaacatattcagtgagtaat

SEQ ID NO: 7318689 - DNA, 22 bp, Homo sapiens
atcatttatgccccaattagat

SEQ ID NO: 7318690 - DNA, 22 bp, Homo sapiens
atcatttaaaacaagtctctat

SEQ ID NO: 7318691 - DNA, 22 bp, Homo sapiens
atcattgaatataagtgctatt

SEQ ID NO: 7318692 - DNA, 22 bp, Homo sapiens
atcattctgatggtcaatgcta

SEQ ID NO: 7318693 - DNA, 23 bp, Homo sapiens
atcattctccaatctggagcagg

SEQ ID NO: 7318694 - DNA, 22 bp, Homo sapiens
cagcaggaggcatggcttccct

SEQ ID NO: 7318695 - DNA, 22 bp, Homo sapiens
cagcaggataggtttctttgga

SEQ ID NO: 7318696 - DNA, 23 bp, Homo sapiens
cagcaggagggtgcctgggctgc

SEQ ID NO: 7318697 - DNA, 19 bp, Homo sapiens
agcccccagacagcaggcc

SEQ ID NO: 7318698 - DNA, 23 bp, Homo sapiens
cagaagacagtctcaagacaagg

SEQ ID NO: 7318699 - DNA, 22 bp, Homo sapiens
agccacagcaacaagtgcaatt

SEQ ID NO: 7318700 - DNA, 22 bp, Homo sapiens
cacagggcctggggcagctgct

SEQ ID NO: 7318701 - DNA, 22 bp, Homo sapiens
cacagggcagtgattgtccaca

SEQ ID NO: 7318702 - DNA, 22 bp, Homo sapiens
cactctgggctcttgtttcaga

SEQ ID NO: 7318703 - DNA, 22 bp, Homo sapiens
cacagtatttgtttttctgagt

SEQ ID NO: 7318704 - DNA, 22 bp, Homo sapiens
caaggcaggccagtttcaaggc

SEQ ID NO: 7318705 - DNA, 21 bp, Homo sapiens
agcaatttttcctcctctgca

SEQ ID NO: 7318706 - DNA, 22 bp, Homo sapiens
attttctatgttgtaattgtta

SEQ ID NO: 7318707 - DNA, 22 bp, Homo sapiens
agcacagagaagatttcaatta

SEQ ID NO: 7318708 - DNA, 22 bp, Homo sapiens
caaatgtttcttatctattgtt

SEQ ID NO: 7318709 - DNA, 22 bp, Homo sapiens
caaatgttaagacaggatcaag

SEQ ID NO: 7318710 - DNA, 22 bp, Homo sapiens
caaatgttttttagtataagta

SEQ ID NO: 7318711 - DNA, 22 bp, Homo sapiens
caaatgttaaatgtgttaagac

SEQ ID NO: 7318712 - DNA, 22 bp, Homo sapiens
agagtggggaaggtgttgagaa

SEQ ID NO: 7318713 - DNA, 22 bp, Homo sapiens
atttagcaagagtacaaaataa

SEQ ID NO: 7318714 - DNA, 22 bp, Homo sapiens
atttagtagagaaattaagaaa

SEQ ID NO: 7318715 - DNA, 22 bp, Homo sapiens
atttagtagagaaattaagaaa

SEQ ID NO: 7318716 - DNA, 22 bp, Homo sapiens
agagggttgaacctataaacta

SEQ ID NO: 7318717 - DNA, 22 bp, Homo sapiens
atttaagaggctgctagagtat

SEQ ID NO: 7318718 - DNA, 22 bp, Homo sapiens
atttaagattgcgtattcatgt

SEQ ID NO: 7318719 - DNA, 22 bp, Homo sapiens
agatggttatctaagtgaaaaa

SEQ ID NO: 7318720 - DNA, 22 bp, Homo sapiens
agatggttggtccataggccta

SEQ ID NO: 7318721 - DNA, 22 bp, Homo sapiens
agatggttctcagaaactcaac

SEQ ID NO: 7318722 - DNA, 22 bp, Homo sapiens
agatggttcagaattataaaga

SEQ ID NO: 7318723 - DNA, 22 bp, Homo sapiens
agatggttatcttttctttgta

SEQ ID NO: 7318724 - DNA, 22 bp, Homo sapiens
agatggttgtcgcaaatgaatg

SEQ ID NO: 7318725 - DNA, 22 bp, Homo sapiens
agatggttttgtctttatgatt

SEQ ID NO: 7318726 - DNA, 21 bp, Homo sapiens
atttccaagggtacctaagat

SEQ ID NO: 7318727 - DNA, 22 bp, Homo sapiens
agatgaagactcaggagcaggt

SEQ ID NO: 7318728 - DNA, 22 bp, Homo sapiens
agatgaagatatctgcaggggc

SEQ ID NO: 7318729 - DNA, 22 bp, Homo sapiens
agatgaagatgccactaagacc

SEQ ID NO: 7318730 - DNA, 22 bp, Homo sapiens
agatgaagcctgtacttagtct

SEQ ID NO: 7318731 - DNA, 22 bp, Homo sapiens
agcaaaataaggtaatttattg

SEQ ID NO: 7318732 - DNA, 22 bp, Homo sapiens
agcaaacagtgtgctaagaaat

SEQ ID NO: 7318733 - DNA, 22 bp, Homo sapiens
attataaagaacatgtgtgtgg

SEQ ID NO: 7318734 - DNA, 22 bp, Homo sapiens
attcaaagatcatgatctctac

SEQ ID NO: 7318735 - DNA, 22 bp, Homo sapiens
attcaaagagctgccagaactg

SEQ ID NO: 7318736 - DNA, 22 bp, Homo sapiens
attcaaagcccagtaaacattg

SEQ ID NO: 7318737 - DNA, 22 bp, Homo sapiens
attcacacacatttagagcaga

SEQ ID NO: 7318738 - DNA, 22 bp, Homo sapiens
attcacagaatagttttaccag

SEQ ID NO: 7318739 - DNA, 20 bp, Homo sapiens
atgttaaatagcatttagag

SEQ ID NO: 7318740 - DNA, 22 bp, Homo sapiens
atgtttatgttgggctatattt

SEQ ID NO: 7318741 - DNA, 22 bp, Homo sapiens
atgttaaataatcccttaaagc

SEQ ID NO: 7318742 - DNA, 22 bp, Homo sapiens
attacagtagcaaaagaccgga

SEQ ID NO: 7318743 - DNA, 22 bp, Homo sapiens
attacagtaggattggaaagga

SEQ ID NO: 7318744 - DNA, 22 bp, Homo sapiens
attacagtgccacctcgtggtc

SEQ ID NO: 7318745 - DNA, 22 bp, Homo sapiens
attaaacaatgtaaagttcttg

SEQ ID NO: 7318746 - DNA, 22 bp, Homo sapiens
agaatacatcaatctattttct

SEQ ID NO: 7318747 - DNA, 22 bp, Homo sapiens
agaagaatttctctcatgattt

SEQ ID NO: 7318748 - DNA, 22 bp, Homo sapiens
agaagaatacttgatgttcatg

SEQ ID NO: 7318749 - DNA, 23 bp, Homo sapiens
atgcagggttacagggctgactt

SEQ ID NO: 7318750 - DNA, 18 bp, Homo sapiens
atggctcaggaatggctt

SEQ ID NO: 7318751 - DNA, 22 bp, Homo sapiens
atgtacatactgcattttcaaa

SEQ ID NO: 7318752 - DNA, 22 bp, Homo sapiens
atgtccagccaaccactggatt

SEQ ID NO: 7318753 - DNA, 22 bp, Homo sapiens
atgtacagtttctagactcaaa

SEQ ID NO: 7318754 - DNA, 22 bp, Homo sapiens
atgtacaggatggtgctcatct

SEQ ID NO: 7318755 - DNA, 22 bp, Homo sapiens
atgtacagtgataagagggcag

SEQ ID NO: 7318756 - DNA, 22 bp, Homo sapiens
atgtacaggtcttggcaaaggg

SEQ ID NO: 7318757 - DNA, 22 bp, Homo sapiens
atgtacagccacttcacagtta

SEQ ID NO: 7318758 - DNA, 22 bp, Homo sapiens
cagctttgattctttctgccat

SEQ ID NO: 7318759 - DNA, 22 bp, Homo sapiens
cagtctcttttcagctccatcc

SEQ ID NO: 7318760 - DNA, 22 bp, Homo sapiens
aggagagaatgttccaggcttg

SEQ ID NO: 7318761 - DNA, 22 bp, Homo sapiens
aggagaggaatcattattacaa

SEQ ID NO: 7318762 - DNA, 22 bp, Homo sapiens
aggagaggcatcaagaaaatcg

SEQ ID NO: 7318763 - DNA, 22 bp, Homo sapiens
aggagaggctctaactctgtgt

SEQ ID NO: 7318764 - DNA, 22 bp, Homo sapiens
aggagaggggtaggattaattt

SEQ ID NO: 7318765 - DNA, 22 bp, Homo sapiens
aggagaggtctcccttccccag

SEQ ID NO: 7318766 - DNA, 22 bp, Homo sapiens
aggagagggtggcattaagttt

SEQ ID NO: 7318767 - DNA, 22 bp, Homo sapiens
aggaggaggtaagaaaagcata

SEQ ID NO: 7318768 - DNA, 22 bp, Homo sapiens
aggaggaggtgggacacagtga

SEQ ID NO: 7318769 - DNA, 22 bp, Homo sapiens
cattccaagtatatacatgata

SEQ ID NO: 7318770 - DNA, 22 bp, Homo sapiens
cattcaaacattaatttattca

SEQ ID NO: 7318771 - DNA, 22 bp, Homo sapiens
cattcaaagcaggaaaggcctt

SEQ ID NO: 7318772 - DNA, 22 bp, Homo sapiens
cattcaaaagctccatgtttgt

SEQ ID NO: 7318773 - DNA, 22 bp, Homo sapiens
cattcaaaatgggctgacctgt

SEQ ID NO: 7318774 - DNA, 18 bp, Homo sapiens
cattccccatctctgagc

SEQ ID NO: 7318775 - DNA, 22 bp, Homo sapiens
catggccctcttctggagcaat

SEQ ID NO: 7318776 - DNA, 22 bp, Homo sapiens
catttacagcagactgatgaaa

SEQ ID NO: 7318777 - DNA, 22 bp, Homo sapiens
aggcagcagccacaaggcctga

SEQ ID NO: 7318778 - DNA, 22 bp, Homo sapiens
aggcagtggatgtcaggaatgg

SEQ ID NO: 7318779 - DNA, 22 bp, Homo sapiens
aggcagtgctgtgccctgaacc

SEQ ID NO: 7318780 - DNA, 22 bp, Homo sapiens
aggcagtggaaggagaaagcaa

SEQ ID NO: 7318781 - DNA, 22 bp, Homo sapiens
aggcagtgagaaatagcaagat

SEQ ID NO: 7318782 - DNA, 22 bp, Homo sapiens
aggcagtgcctggaccccagct

SEQ ID NO: 7318783 - DNA, 22 bp, Homo sapiens
aggcagtgctcaagacagcagc

SEQ ID NO: 7318784 - DNA, 22 bp, Homo sapiens
aggcaggttggtgagaagactg

SEQ ID NO: 7318785 - DNA, 23 bp, Homo sapiens
aggcaggtttgggctcttcttgt

SEQ ID NO: 7318786 - DNA, 22 bp, Homo sapiens
aggcagtcagccctgctagggt

SEQ ID NO: 7318787 - DNA, 22 bp, Homo sapiens
aggcagtctatctctggagcct

SEQ ID NO: 7318788 - DNA, 19 bp, Homo sapiens
aggcagtcattggaatata

SEQ ID NO: 7318789 - DNA, 22 bp, Homo sapiens
aggcagtccccaggggtgttgc

SEQ ID NO: 7318790 - DNA, 22 bp, Homo sapiens
aggcagtctagtccccaggcaa

SEQ ID NO: 7318791 - DNA, 22 bp, Homo sapiens
aggcatctgagtttgcaagctt

SEQ ID NO: 7318792 - DNA, 20 bp, Homo sapiens
aggccccaggaaactctcag

SEQ ID NO: 7318793 - DNA, 22 bp, Homo sapiens
aggccccaaagcagtgcaagta

SEQ ID NO: 7318794 - DNA, 22 bp, Homo sapiens
aggcccccacaggcttgaggca

SEQ ID NO: 7318795 - DNA, 22 bp, Homo sapiens
aggcccgaggttcgtgtgcacc

SEQ ID NO: 7318796 - DNA, 22 bp, Homo sapiens
aggccccatcaggaaggaggcc

SEQ ID NO: 7318797 - DNA, 20 bp, Homo sapiens
aggccccaggtggacactag

SEQ ID NO: 7318798 - DNA, 19 bp, Homo sapiens
agggaatccggctgaggga

SEQ ID NO: 7318799 - DNA, 22 bp, Homo sapiens
agggagaggttgaaacctcagt

SEQ ID NO: 7318800 - DNA, 22 bp, Homo sapiens
agggagaggctgaactatccta

SEQ ID NO: 7318801 - DNA, 22 bp, Homo sapiens
agggagagtagatatcaggtgt

SEQ ID NO: 7318802 - DNA, 22 bp, Homo sapiens
agggagagtttgatgtttcctc

SEQ ID NO: 7318803 - DNA, 22 bp, Homo sapiens
ccccattctggccagcccagct

SEQ ID NO: 7318804 - DNA, 22 bp, Homo sapiens
agggtcctgagcctggggcgca

SEQ ID NO: 7318805 - DNA, 22 bp, Homo sapiens
agggtccttctgttcctgagca

SEQ ID NO: 7318806 - DNA, 22 bp, Homo sapiens
cggagaggtgggggcagcatct

SEQ ID NO: 7318807 - DNA, 22 bp, Homo sapiens
aggtgcctatctggtctctgca

SEQ ID NO: 7318808 - DNA, 22 bp, Homo sapiens
ccttgctcaagctagtgacggg

SEQ ID NO: 7318809 - DNA, 21 bp, Homo sapiens
ctcaaatgccagttttattta

SEQ ID NO: 7318810 - DNA, 22 bp, Homo sapiens
ctcaccatggatcttccatttc

SEQ ID NO: 7318811 - DNA, 22 bp, Homo sapiens
ctcctgaggaaaagcttggtca

SEQ ID NO: 7318812 - DNA, 22 bp, Homo sapiens
ctctccattccctacagttttc

SEQ ID NO: 7318813 - DNA, 22 bp, Homo sapiens
ctctccccacaccctctgcatg

SEQ ID NO: 7318814 - DNA, 22 bp, Homo sapiens
ctcttcttgtctctggttagaa

SEQ ID NO: 7318815 - DNA, 22 bp, Homo sapiens
ctctggacctcagctacagact

SEQ ID NO: 7318816 - DNA, 22 bp, Homo sapiens
ctctggacctcagtctactaat

SEQ ID NO: 7318817 - DNA, 22 bp, Homo sapiens
ctgaggctttgtgtgcatgcct

SEQ ID NO: 7318818 - DNA, 22 bp, Homo sapiens
ctgagggtcaacttgattgtat

SEQ ID NO: 7318819 - DNA, 21 bp, Homo sapiens
ctgaggcagcacagctagtca

SEQ ID NO: 7318820 - DNA, 22 bp, Homo sapiens
ctctttggtcgcatcatccatt

SEQ ID NO: 7318821 - DNA, 22 bp, Homo sapiens
ataatacatggttgatcttttc

SEQ ID NO: 7318822 - DNA, 19 bp, Homo sapiens
atacaagactagcatttac

SEQ ID NO: 7318823 - DNA, 22 bp, Homo sapiens
atactcaatttgttggaaagca

SEQ ID NO: 7318824 - DNA, 22 bp, Homo sapiens
atcattctattgttgagctgcc

SEQ ID NO: 7318825 - DNA, 22 bp, Homo sapiens
atcattttgtgacaatgcctgt

SEQ ID NO: 7318826 - DNA, 18 bp, Homo sapiens
atccaaaaagatggaagt

SEQ ID NO: 7318827 - DNA, 22 bp, Homo sapiens
atccaaaatttactgtagcatt

SEQ ID NO: 7318828 - DNA, 22 bp, Homo sapiens
atcattctagtccttatggtct

SEQ ID NO: 7318829 - DNA, 22 bp, Homo sapiens
atcattctagctgttgtgttga

SEQ ID NO: 7318830 - DNA, 22 bp, Homo sapiens
atcacatggaatgattttagac

SEQ ID NO: 7318831 - DNA, 22 bp, Homo sapiens
ctgtcttctaccttcaacctcc

SEQ ID NO: 7318832 - DNA, 22 bp, Homo sapiens
ctgtcttctcctttgtttcagg

SEQ ID NO: 7318833 - DNA, 19 bp, Homo sapiens
atcacatgtcaagagcagg

SEQ ID NO: 7318834 - DNA, 22 bp, Homo sapiens
ctgtcttttcttctcattgatg

SEQ ID NO: 7318835 - DNA, 22 bp, Homo sapiens
ctgtgagtgaccctggtcagca

SEQ ID NO: 7318836 - DNA, 22 bp, Homo sapiens
ctgggagacaagagagggctga

SEQ ID NO: 7318837 - DNA, 22 bp, Homo sapiens
atatatacaactagattaaaag

SEQ ID NO: 7318838 - DNA, 22 bp, Homo sapiens
ctgggcaggatacttcatggga

SEQ ID NO: 7318839 - DNA, 22 bp, Homo sapiens
atatgcttacactacaagatga

SEQ ID NO: 7318840 - DNA, 22 bp, Homo sapiens
atatgtatgtacgcacatattc

SEQ ID NO: 7318841 - DNA, 22 bp, Homo sapiens
atatttctctcagacatggaag

SEQ ID NO: 7318842 - DNA, 22 bp, Homo sapiens
atatttactgctgtggtgaagg

SEQ ID NO: 7318843 - DNA, 22 bp, Homo sapiens
gggaaactgtccagttctcccc

SEQ ID NO: 7318844 - DNA, 22 bp, Homo sapiens
gggccttctagttagccccaat

SEQ ID NO: 7318845 - DNA, 22 bp, Homo sapiens
gggccttcagccttggactgag

SEQ ID NO: 7318846 - DNA, 22 bp, Homo sapiens
gggccttccgactcccaaggcc

SEQ ID NO: 7318847 - DNA, 22 bp, Homo sapiens
cagagcctgctgccttctgaag

SEQ ID NO: 7318848 - DNA, 22 bp, Homo sapiens
cagaggtggggagtatttcaag

SEQ ID NO: 7318849 - DNA, 19 bp, Homo sapiens
gtatatttatatggctgta

SEQ ID NO: 7318850 - DNA, 22 bp, Homo sapiens
ggttccttctgaggtccctgta

SEQ ID NO: 7318851 - DNA, 19 bp, Homo sapiens
ggttcctcacgctaagggc

SEQ ID NO: 7318852 - DNA, 22 bp, Homo sapiens
cactgagagatgtgtcacagca

SEQ ID NO: 7318853 - DNA, 21 bp, Homo sapiens
cactgaggaggaaaaggagct

SEQ ID NO: 7318854 - DNA, 22 bp, Homo sapiens
cactggacagagtggggttccc

SEQ ID NO: 7318855 - DNA, 18 bp, Homo sapiens
cactggacctcatgagag

SEQ ID NO: 7318856 - DNA, 22 bp, Homo sapiens
cactgcttttcagacagttatt

SEQ ID NO: 7318857 - DNA, 22 bp, Homo sapiens
cactggaagttcattctcagaa

SEQ ID NO: 7318858 - DNA, 22 bp, Homo sapiens
cacagggcaccagttggccatc

SEQ ID NO: 7318859 - DNA, 22 bp, Homo sapiens
ggcactgggcaccggctgaggg

SEQ ID NO: 7318860 - DNA, 22 bp, Homo sapiens
ggcactgggagaggtgagacgg

SEQ ID NO: 7318861 - DNA, 22 bp, Homo sapiens
ggcactgggaatgcagtgatga

SEQ ID NO: 7318862 - DNA, 20 bp, Homo sapiens
ggcactggaagcacacagga

SEQ ID NO: 7318863 - DNA, 22 bp, Homo sapiens
ggcactggcctggggccaagag

SEQ ID NO: 7318864 - DNA, 16 bp, Homo sapiens
ggcactggcaggtcct

SEQ ID NO: 7318865 - DNA, 22 bp, Homo sapiens
ggcactggcaaagcaaagtctg

SEQ ID NO: 7318866 - DNA, 22 bp, Homo sapiens
ggcactggagactgttatgaga

SEQ ID NO: 7318867 - DNA, 22 bp, Homo sapiens
ggcactggaagtcccattgtct

SEQ ID NO: 7318868 - DNA, 22 bp, Homo sapiens
ggcactggaaggatcatgtgag

SEQ ID NO: 7318869 - DNA, 22 bp, Homo sapiens
ggcacaggagtcacagcatttc

SEQ ID NO: 7318870 - DNA, 22 bp, Homo sapiens
caagacaagatctaagcatgct

SEQ ID NO: 7318871 - DNA, 22 bp, Homo sapiens
caaggagaaaacggcttctgaa

SEQ ID NO: 7318872 - DNA, 22 bp, Homo sapiens
caacatttcaaggtctttagga

SEQ ID NO: 7318873 - DNA, 22 bp, Homo sapiens
caaagtatgaaccagtttctct

SEQ ID NO: 7318874 - DNA, 22 bp, Homo sapiens
cacacattaatatcaaaggctc

SEQ ID NO: 7318875 - DNA, 22 bp, Homo sapiens
cacaatgcagcatgtaaatgca

SEQ ID NO: 7318876 - DNA, 22 bp, Homo sapiens
ggaaaactgaggctctcagcag

SEQ ID NO: 7318877 - DNA, 21 bp, Homo sapiens
ggaaaactttccttgtctgaa

SEQ ID NO: 7318878 - DNA, 22 bp, Homo sapiens
cacaaaatatcaagcactttta

SEQ ID NO: 7318879 - DNA, 22 bp, Homo sapiens
gcttctctggctggtctgccac

SEQ ID NO: 7318880 - DNA, 22 bp, Homo sapiens
gcttctcttaatgcctggcttt

SEQ ID NO: 7318881 - DNA, 22 bp, Homo sapiens
gcttggcattggtttctctaag

SEQ ID NO: 7318882 - DNA, 22 bp, Homo sapiens
caaggcagaattcagactcagg

SEQ ID NO: 7318883 - DNA, 22 bp, Homo sapiens
caaggcagcccgctgaaccaca

SEQ ID NO: 7318884 - DNA, 22 bp, Homo sapiens
caaggcagctattgtctccata

SEQ ID NO: 7318885 - DNA, 22 bp, Homo sapiens
caaggcagctattgtctccata

SEQ ID NO: 7318886 - DNA, 18 bp, Homo sapiens
gctgtggaagtctttata

SEQ ID NO: 7318887 - DNA, 22 bp, Homo sapiens
atgcaaataaagcaactataca

SEQ ID NO: 7318888 - DNA, 22 bp, Homo sapiens
atgcattgaggatgacatgagt

SEQ ID NO: 7318889 - DNA, 22 bp, Homo sapiens
atgcatgtattatctagatgag

SEQ ID NO: 7318890 - DNA, 22 bp, Homo sapiens
atgcatgtgtgagagcaagagg

SEQ ID NO: 7318891 - DNA, 22 bp, Homo sapiens
atgcattcagcggaatgcttag

SEQ ID NO: 7318892 - DNA, 22 bp, Homo sapiens
atgcattatcaattgatgtagg

SEQ ID NO: 7318893 - DNA, 22 bp, Homo sapiens
atgcatgcttcttatagtactt

SEQ ID NO: 7318894 - DNA, 22 bp, Homo sapiens
atgcatgcattgtttatcatgg

SEQ ID NO: 7318895 - DNA, 22 bp, Homo sapiens
atgaggcagtacacacaaagcc

SEQ ID NO: 7318896 - DNA, 22 bp, Homo sapiens
atgaggcaggtggaggctgcca

SEQ ID NO: 7318897 - DNA, 22 bp, Homo sapiens
atgaggcaggagtgcagtggca

SEQ ID NO: 7318898 - DNA, 22 bp, Homo sapiens
atgaggcagctgacagctgttc

SEQ ID NO: 7318899 - DNA, 22 bp, Homo sapiens
atgaggcagctgctggagaacg

SEQ ID NO: 7318900 - DNA, 22 bp, Homo sapiens
atgaggcagatgttgcatgagg

SEQ ID NO: 7318901 - DNA, 22 bp, Homo sapiens
atgaggcagcacatgggattgt

SEQ ID NO: 7318902 - DNA, 19 bp, Homo sapiens
atgaggtagcagctggtgc

SEQ ID NO: 7318903 - DNA, 22 bp, Homo sapiens
atctagaacaattattgtcaca

SEQ ID NO: 7318904 - DNA, 22 bp, Homo sapiens
atctacagctgtctgcacagta

SEQ ID NO: 7318905 - DNA, 22 bp, Homo sapiens
atctacagccagtctggtttgt

SEQ ID NO: 7318906 - DNA, 22 bp, Homo sapiens
atctacatgttgatttaaagaa

SEQ ID NO: 7318907 - DNA, 22 bp, Homo sapiens
cttggctccaatcccagctctg

SEQ ID NO: 7318908 - DNA, 22 bp, Homo sapiens
cttggctccttcacagggagat

SEQ ID NO: 7318909 - DNA, 22 bp, Homo sapiens
gagaggaaagatatatacttct

SEQ ID NO: 7318910 - DNA, 22 bp, Homo sapiens
gagaggaactcccagtgcctgg

SEQ ID NO: 7318911 - DNA, 22 bp, Homo sapiens
atggccagtcaagcctctggct

SEQ ID NO: 7318912 - DNA, 22 bp, Homo sapiens
atggccagtgtttccctcagtt

SEQ ID NO: 7318913 - DNA, 19 bp, Homo sapiens
atggccagtttagaggttt

SEQ ID NO: 7318914 - DNA, 22 bp, Homo sapiens
gagaaagggataatttgaagag

SEQ ID NO: 7318915 - DNA, 22 bp, Homo sapiens
atgtctttgccatagttcatat

SEQ ID NO: 7318916 - DNA, 22 bp, Homo sapiens
atgtctttcttgtgtcccaaga

SEQ ID NO: 7318917 - DNA, 22 bp, Homo sapiens
atgtctttcttgtgtcccaaga

SEQ ID NO: 7318918 - DNA, 20 bp, Homo sapiens
gaggctgcggactgctggac

SEQ ID NO: 7318919 - DNA, 21 bp, Homo sapiens
gcctctccaaatcctgccttc

SEQ ID NO: 7318920 - DNA, 22 bp, Homo sapiens
gcctctcctcttaataccatta

SEQ ID NO: 7318921 - DNA, 22 bp, Homo sapiens
gcctctccgagccactgcctct

SEQ ID NO: 7318922 - DNA, 22 bp, Homo sapiens
caaaaaacacagatgtctgtgt

SEQ ID NO: 7318923 - DNA, 22 bp, Homo sapiens
atttacagaagcatgtaatagc

SEQ ID NO: 7318924 - DNA, 22 bp, Homo sapiens
atttacagaaacttaatcatag

SEQ ID NO: 7318925 - DNA, 22 bp, Homo sapiens
attgcttttcagacaatgaggc

SEQ ID NO: 7318926 - DNA, 22 bp, Homo sapiens
atttaatttggagagagaaacc

SEQ ID NO: 7318927 - DNA, 22 bp, Homo sapiens
atttaatgtcgagctattgtag

SEQ ID NO: 7318928 - DNA, 22 bp, Homo sapiens
atttaatttacatttgacagag

SEQ ID NO: 7318929 - DNA, 21 bp, Homo sapiens
attggcacaccttttattgga

SEQ ID NO: 7318930 - DNA, 22 bp, Homo sapiens
atttcagtgttttaagagttca

SEQ ID NO: 7318931 - DNA, 20 bp, Homo sapiens
atttcagtgtttgcaatttc

SEQ ID NO: 7318932 - DNA, 22 bp, Homo sapiens
atttcagtgttggttagcaagc

SEQ ID NO: 7318933 - DNA, 22 bp, Homo sapiens
atgttttctagagtttaaaatc

SEQ ID NO: 7318934 - DNA, 22 bp, Homo sapiens
atgttttccccaaatgatcttc

SEQ ID NO: 7318935 - DNA, 22 bp, Homo sapiens
atgttttcaaagtaaacttgta

SEQ ID NO: 7318936 - DNA, 22 bp, Homo sapiens
attaaatgttccttaaattata

SEQ ID NO: 7318937 - DNA, 22 bp, Homo sapiens
attaaattagcaaactgtgaaa

SEQ ID NO: 7318938 - DNA, 22 bp, Homo sapiens
attaaattaagtggctaattta

SEQ ID NO: 7318939 - DNA, 22 bp, Homo sapiens
attaaatgttggcatattttgt

SEQ ID NO: 7318940 - DNA, 22 bp, Homo sapiens
gatgagtgaggacagggtggca

SEQ ID NO: 7318941 - DNA, 22 bp, Homo sapiens
gatgaggctagagacatgtgta

SEQ ID NO: 7318942 - DNA, 22 bp, Homo sapiens
gatgaggcataaacacagtcac

SEQ ID NO: 7318943 - DNA, 22 bp, Homo sapiens
gatgaggctgtgtctgcacaag

SEQ ID NO: 7318944 - DNA, 22 bp, Homo sapiens
attacaagtagactaactttca

SEQ ID NO: 7318945 - DNA, 22 bp, Homo sapiens
attaatatacactgttagcatg

SEQ ID NO: 7318946 - DNA, 22 bp, Homo sapiens
attagaatgaagtataggattt

SEQ ID NO: 7318947 - DNA, 22 bp, Homo sapiens
attgaatgtcctttagtaaaaa

SEQ ID NO: 7318948 - DNA, 22 bp, Homo sapiens
attgaatctgcactagtatttt

SEQ ID NO: 7318949 - DNA, 22 bp, Homo sapiens
attgacagtggtgttctgggga

SEQ ID NO: 7318950 - DNA, 20 bp, Homo sapiens
attgacagaaagtgttcacc

SEQ ID NO: 7318951 - DNA, 22 bp, Homo sapiens
attcttattaaatagccagaag

SEQ ID NO: 7318952 - DNA, 22 bp, Homo sapiens
attcttacaaagcagagtctgt

SEQ ID NO: 7318953 - DNA, 22 bp, Homo sapiens
attcttacaaatgaaactgcaa

SEQ ID NO: 7318954 - DNA, 22 bp, Homo sapiens
attcttactccatagaatgaat

SEQ ID NO: 7318955 - DNA, 22 bp, Homo sapiens
attattgtactttcaataaggt

SEQ ID NO: 7318956 - DNA, 22 bp, Homo sapiens
cagtttgtatttattactcata

SEQ ID NO: 7318957 - DNA, 22 bp, Homo sapiens
catacattgctcattcagtatc

SEQ ID NO: 7318958 - DNA, 22 bp, Homo sapiens
catataatgtttgaagatgtgg

SEQ ID NO: 7318959 - DNA, 22 bp, Homo sapiens
catagacaaagatcagaagagt

SEQ ID NO: 7318960 - DNA, 22 bp, Homo sapiens
tcagtttaagatgactaacaat

SEQ ID NO: 7318961 - DNA, 22 bp, Homo sapiens
tcagtttaatacccagatgcct

SEQ ID NO: 7318962 - DNA, 22 bp, Homo sapiens
tcagtttagatgcatttgtcgt

SEQ ID NO: 7318963 - DNA, 19 bp, Homo sapiens
tcatgtctctcatctgtga

SEQ ID NO: 7318964 - DNA, 22 bp, Homo sapiens
tcatgtctctatgtgcctatta

SEQ ID NO: 7318965 - DNA, 22 bp, Homo sapiens
catgatttactaaaatttgttt

SEQ ID NO: 7318966 - DNA, 22 bp, Homo sapiens
catctttagttattgaatatag

SEQ ID NO: 7318967 - DNA, 22 bp, Homo sapiens
catctttatttatatagacagg

SEQ ID NO: 7318968 - DNA, 22 bp, Homo sapiens
tcagttcttagtaatgcagtct

SEQ ID NO: 7318969 - DNA, 22 bp, Homo sapiens
catgtctttcaaaccacacagt

SEQ ID NO: 7318970 - DNA, 22 bp, Homo sapiens
catgtgcagactctgacaggct

SEQ ID NO: 7318971 - DNA, 22 bp, Homo sapiens
catgattttgtcttgtgttaat

SEQ ID NO: 7318972 - DNA, 22 bp, Homo sapiens
catgcaaaggtcaagatcagga

SEQ ID NO: 7318973 - DNA, 22 bp, Homo sapiens
cagtgagtaagtagacagctta

SEQ ID NO: 7318974 - DNA, 22 bp, Homo sapiens
tatttactgtatttgaagttga

SEQ ID NO: 7318975 - DNA, 22 bp, Homo sapiens
tatttagttatctttcataaaa

SEQ ID NO: 7318976 - DNA, 22 bp, Homo sapiens
tatttagatgcatttggattgc

SEQ ID NO: 7318977 - DNA, 22 bp, Homo sapiens
tatacagtcttttgctatattc

SEQ ID NO: 7318978 - DNA, 22 bp, Homo sapiens
tatacagttaagtttcttcagt

SEQ ID NO: 7318979 - DNA, 22 bp, Homo sapiens
caggggccaggctgtctgctgt

SEQ ID NO: 7318980 - DNA, 22 bp, Homo sapiens
tatgtactaactttcattctag

SEQ ID NO: 7318981 - DNA, 22 bp, Homo sapiens
tattaaagagagaatcatcatc

SEQ ID NO: 7318982 - DNA, 19 bp, Homo sapiens
tctgcctctggtcaggctc

SEQ ID NO: 7318983 - DNA, 22 bp, Homo sapiens
tctgtcttctgtagctaataat

SEQ ID NO: 7318984 - DNA, 22 bp, Homo sapiens
tctctcttgaagtattagctag

SEQ ID NO: 7318985 - DNA, 23 bp, Homo sapiens
tctctcttagctatgcttatggc

SEQ ID NO: 7318986 - DNA, 22 bp, Homo sapiens
tctgcctcgctaacagcagcca

SEQ ID NO: 7318987 - DNA, 20 bp, Homo sapiens
ccacagaggacagggctgtg

SEQ ID NO: 7318988 - DNA, 22 bp, Homo sapiens
ccacagaggacaactgcctggc

SEQ ID NO: 7318989 - DNA, 22 bp, Homo sapiens
ccaaatgtgcctgtttcaacaa

SEQ ID NO: 7318990 - DNA, 22 bp, Homo sapiens
catttgaacctggatgttctta

SEQ ID NO: 7318991 - DNA, 22 bp, Homo sapiens
catttctcataatattagcact

SEQ ID NO: 7318992 - DNA, 22 bp, Homo sapiens
catttgaaattcttagaacaaa

SEQ ID NO: 7318993 - DNA, 22 bp, Homo sapiens
catttgcaagagataaatgttt

SEQ ID NO: 7318994 - DNA, 22 bp, Homo sapiens
catttgcaaaccaacaagatga

SEQ ID NO: 7318995 - DNA, 22 bp, Homo sapiens
tctctaaagtagaaaagacccc

SEQ ID NO: 7318996 - DNA, 22 bp, Homo sapiens
tctctaaataacacttattgaa

SEQ ID NO: 7318997 - DNA, 22 bp, Homo sapiens
tctctaaatacagatgtcatgg

SEQ ID NO: 7318998 - DNA, 22 bp, Homo sapiens
tctctaaagcctggaagaggag

SEQ ID NO: 7318999 - DNA, 22 bp, Homo sapiens
tctctaaagcactttaaccaca

SEQ ID NO: 7319000 - DNA, 20 bp, Homo sapiens
tctctaaagcacctggacta

SEQ ID NO: 7319001 - DNA, 22 bp, Homo sapiens
tctctaaatgttgggggaaatg

SEQ ID NO: 7319002 - DNA, 19 bp, Homo sapiens
tctctaaatggtctttcac

SEQ ID NO: 7319003 - DNA, 22 bp, Homo sapiens
tctctaaatgctctcccatccc

SEQ ID NO: 7319004 - DNA, 22 bp, Homo sapiens
tctctaaatctggttcacttgc

SEQ ID NO: 7319005 - DNA, 22 bp, Homo sapiens
tctctaaatgattgtgtactcc

SEQ ID NO: 7319006 - DNA, 22 bp, Homo sapiens
tctcccaaggcacagaaagagt

SEQ ID NO: 7319007 - DNA, 22 bp, Homo sapiens
tctctagtataatatagcaaaa

SEQ ID NO: 7319008 - DNA, 22 bp, Homo sapiens
ccactctgctgtgctccatgat

SEQ ID NO: 7319009 - DNA, 22 bp, Homo sapiens
ccactctgatttcaagggagat

SEQ ID NO: 7319010 - DNA, 22 bp, Homo sapiens
gtggctcacgtctgtcatctca

SEQ ID NO: 7319011 - DNA, 22 bp, Homo sapiens
gtggcttctgcggtgtgcgcag

SEQ ID NO: 7319012 - DNA, 22 bp, Homo sapiens
gtggctcacgcctgtaatccca

SEQ ID NO: 7319013 - DNA, 22 bp, Homo sapiens
gtggctcacagcaatgtttcct

SEQ ID NO: 7319014 - DNA, 22 bp, Homo sapiens
gtggctcacacctgtaatccca

SEQ ID NO: 7319015 - DNA, 22 bp, Homo sapiens
gtgggcagtggggtcttctgcc

SEQ ID NO: 7319016 - DNA, 22 bp, Homo sapiens
cagctgcccctccagggctggg

SEQ ID NO: 7319017 - DNA, 22 bp, Homo sapiens
gttggctcattttatagacagc

SEQ ID NO: 7319018 - DNA, 22 bp, Homo sapiens
caggaaaggtagtcacaatgta

SEQ ID NO: 7319019 - DNA, 22 bp, Homo sapiens
caggaaaggtgtgtcatgatgg

SEQ ID NO: 7319020 - DNA, 22 bp, Homo sapiens
caggaaagggatgggctgccac

SEQ ID NO: 7319021 - DNA, 22 bp, Homo sapiens
caggaaagccgagtgccatagg

SEQ ID NO: 7319022 - DNA, 22 bp, Homo sapiens
gtttattattcaacttcatgtt

SEQ ID NO: 7319023 - DNA, 22 bp, Homo sapiens
gtttacagtactcacttgcatt

SEQ ID NO: 7319024 - DNA, 22 bp, Homo sapiens
gtttacagtggcttcattggat

SEQ ID NO: 7319025 - DNA, 22 bp, Homo sapiens
gtttacaacatgccaactgggc

SEQ ID NO: 7319026 - DNA, 22 bp, Homo sapiens
cagcttcaactgcacagtcaac

SEQ ID NO: 7319027 - DNA, 22 bp, Homo sapiens
gttacagtgcttggcaataagt

SEQ ID NO: 7319028 - DNA, 22 bp, Homo sapiens
gttacagtgcatgtggcttctg

SEQ ID NO: 7319029 - DNA, 22 bp, Homo sapiens
gttacagtgagaagatagccta

SEQ ID NO: 7319030 - DNA, 22 bp, Homo sapiens
gttacagtcaggagatattttg

SEQ ID NO: 7319031 - DNA, 22 bp, Homo sapiens
gtgtgtggggccttcgggtcct

SEQ ID NO: 7319032 - DNA, 21 bp, Homo sapiens
caggaaagaaaacgtacatat

SEQ ID NO: 7319033 - DNA, 22 bp, Homo sapiens
gttacatttattagaggtctct

SEQ ID NO: 7319034 - DNA, 22 bp, Homo sapiens
gttacatttggtgatttggtgc

SEQ ID NO: 7319035 - DNA, 22 bp, Homo sapiens
gttacattaggataatttgctg

SEQ ID NO: 7319036 - DNA, 22 bp, Homo sapiens
gttacattacttgtgcagttgt

SEQ ID NO: 7319037 - DNA, 22 bp, Homo sapiens
gttacattaaaaacattcactg

SEQ ID NO: 7319038 - DNA, 22 bp, Homo sapiens
gttacagtttgggcttgattca

SEQ ID NO: 7319039 - DNA, 22 bp, Homo sapiens
gttacagtgggtttggggccca

SEQ ID NO: 7319040 - DNA, 22 bp, Homo sapiens
gttttcttcctgcaattggcat

SEQ ID NO: 7319041 - DNA, 19 bp, Homo sapiens
taaaaactgaaggaagcag

SEQ ID NO: 7319042 - DNA, 22 bp, Homo sapiens
taaacatttgttattcttgttt

SEQ ID NO: 7319043 - DNA, 22 bp, Homo sapiens
taaacatttgttattcttgttt

SEQ ID NO: 7319044 - DNA, 22 bp, Homo sapiens
caggacccaacctccctgctct

SEQ ID NO: 7319045 - DNA, 22 bp, Homo sapiens
caggacccatcagccaggcact

SEQ ID NO: 7319046 - DNA, 22 bp, Homo sapiens
taaatatcagtccagctcttcc

SEQ ID NO: 7319047 - DNA, 22 bp, Homo sapiens
taaagtcatctttaaacatgcc

SEQ ID NO: 7319048 - DNA, 22 bp, Homo sapiens
taaagccacgctggaaatcagg

SEQ ID NO: 7319049 - DNA, 22 bp, Homo sapiens
taaagcagtgcaaaagcgtttt

SEQ ID NO: 7319050 - DNA, 22 bp, Homo sapiens
taagatttttaaaatgtcctca

SEQ ID NO: 7319051 - DNA, 22 bp, Homo sapiens
taagacaattcttcagtcacaa

SEQ ID NO: 7319052 - DNA, 22 bp, Homo sapiens
taacattaggtagacataagcc

SEQ ID NO: 7319053 - DNA, 22 bp, Homo sapiens
taagaaacatgatacttttcct

SEQ ID NO: 7319054 - DNA, 22 bp, Homo sapiens
tacagggtataggtacagatga

SEQ ID NO: 7319055 - DNA, 20 bp, Homo sapiens
tacaaattttccatgtttcc

SEQ ID NO: 7319056 - DNA, 22 bp, Homo sapiens
tacaaattaatgggcatgttta

SEQ ID NO: 7319057 - DNA, 22 bp, Homo sapiens
tacagtaacatgttgtacaagc

SEQ ID NO: 7319058 - DNA, 22 bp, Homo sapiens
caggccctttcctgggcatagg

SEQ ID NO: 7319059 - DNA, 22 bp, Homo sapiens
tacatcatggcttcatgctgca

SEQ ID NO: 7319060 - DNA, 22 bp, Homo sapiens
tacatcataataatacttagaa

SEQ ID NO: 7319061 - DNA, 22 bp, Homo sapiens
taattgtacgatgttaaatcag

SEQ ID NO: 7319062 - DNA, 22 bp, Homo sapiens
taattgtaaagtagtagtacag

SEQ ID NO: 7319063 - DNA, 22 bp, Homo sapiens
taatttacagagatacagtcag

SEQ ID NO: 7319064 - DNA, 22 bp, Homo sapiens
ttggaaaagcgttctctgtagc

SEQ ID NO: 7319065 - DNA, 22 bp, Homo sapiens
ctcagtttttgtgggcatcagc

SEQ ID NO: 7319066 - DNA, 22 bp, Homo sapiens
ctcagttttgaaaaggtaagct

SEQ ID NO: 7319067 - DNA, 22 bp, Homo sapiens
ctcagttttaagactactcttt

SEQ ID NO: 7319068 - DNA, 22 bp, Homo sapiens
ctcagtttgaatgctgacactg

SEQ ID NO: 7319069 - DNA, 22 bp, Homo sapiens
ctcagtttctgacattaaaatc

SEQ ID NO: 7319070 - DNA, 22 bp, Homo sapiens
ctcagtttctgaagtggacagg

SEQ ID NO: 7319071 - DNA, 22 bp, Homo sapiens
ctcagtttttttaagagccatg

SEQ ID NO: 7319072 - DNA, 22 bp, Homo sapiens
ctcataatgtgactgtatttga

SEQ ID NO: 7319073 - DNA, 22 bp, Homo sapiens
ttggtcaagctgtcttctttgc

SEQ ID NO: 7319074 - DNA, 22 bp, Homo sapiens
ctctccctaggttagcggtcag

SEQ ID NO: 7319075 - DNA, 22 bp, Homo sapiens
ctctccctcattgggttccatt

SEQ ID NO: 7319076 - DNA, 22 bp, Homo sapiens
ctctcccttgggtgggctttgg

SEQ ID NO: 7319077 - DNA, 22 bp, Homo sapiens
ctctccctggccagctgtgcag

SEQ ID NO: 7319078 - DNA, 22 bp, Homo sapiens
ctcctgggatgactctttcttt

SEQ ID NO: 7319079 - DNA, 22 bp, Homo sapiens
ctcctgggagtcttcctggatg

SEQ ID NO: 7319080 - DNA, 22 bp, Homo sapiens
tttaaatttagaagaaacactg

SEQ ID NO: 7319081 - DNA, 22 bp, Homo sapiens
tttaaatttgtgtttagagggt

SEQ ID NO: 7319082 - DNA, 22 bp, Homo sapiens
tttaaatttagaagaaacactg

SEQ ID NO: 7319083 - DNA, 22 bp, Homo sapiens
tttaaattatagttaatgtctg

SEQ ID NO: 7319084 - DNA, 22 bp, Homo sapiens
tttaaattctgtctgccgctta

SEQ ID NO: 7319085 - DNA, 22 bp, Homo sapiens
tttacagtgtcttgttgactgt

SEQ ID NO: 7319086 - DNA, 22 bp, Homo sapiens
tttacagttccatgtgataggc

SEQ ID NO: 7319087 - DNA, 22 bp, Homo sapiens
tttacagttaagaaatgttacc

SEQ ID NO: 7319088 - DNA, 22 bp, Homo sapiens
tttacatctcaccagattcata

SEQ ID NO: 7319089 - DNA, 17 bp, Homo sapiens
tttagaatacaatgttt

SEQ ID NO: 7319090 - DNA, 22 bp, Homo sapiens
ctaatcacctcatccctcagcg

SEQ ID NO: 7319091 - DNA, 22 bp, Homo sapiens
ctaatttaatgaatgagtctta

SEQ ID NO: 7319092 - DNA, 22 bp, Homo sapiens
ttccaaagtgctggaattacat

SEQ ID NO: 7319093 - DNA, 22 bp, Homo sapiens
ttcccaagtctccaatgtggga

SEQ ID NO: 7319094 - DNA, 22 bp, Homo sapiens
ttcacagttgggcaggttgtgt

SEQ ID NO: 7319095 - DNA, 22 bp, Homo sapiens
ttcacagtggtagtgcatttag

SEQ ID NO: 7319096 - DNA, 22 bp, Homo sapiens
ttcacagtgtttctcacggtta

SEQ ID NO: 7319097 - DNA, 19 bp, Homo sapiens
ttcattctcttattgttgt

SEQ ID NO: 7319098 - DNA, 22 bp, Homo sapiens
ttcattctcttagcatagtcct

SEQ ID NO: 7319099 - DNA, 22 bp, Homo sapiens
ttcattctgggctctaaggaac

SEQ ID NO: 7319100 - DNA, 22 bp, Homo sapiens
ttcattctgtttggaaaggtgg

SEQ ID NO: 7319101 - DNA, 22 bp, Homo sapiens
ttcattctgcagttctcagctc

SEQ ID NO: 7319102 - DNA, 22 bp, Homo sapiens
ttcattcttgggatcagagagt

SEQ ID NO: 7319103 - DNA, 22 bp, Homo sapiens
ttcattcttatttgtgatctgg

SEQ ID NO: 7319104 - DNA, 22 bp, Homo sapiens
ttcattcttcagagctgcgctt

SEQ ID NO: 7319105 - DNA, 22 bp, Homo sapiens
ttcagaaaaagaccattgcaat

SEQ ID NO: 7319106 - DNA, 22 bp, Homo sapiens
ttcctttccctcacagcctcgg

SEQ ID NO: 7319107 - DNA, 22 bp, Homo sapiens
ttcctttcacgttttaatgcac

SEQ ID NO: 7319108 - DNA, 22 bp, Homo sapiens
ttgataaaatgatgaaatcact

SEQ ID NO: 7319109 - DNA, 22 bp, Homo sapiens
ctggacttggggaggctagatt

SEQ ID NO: 7319110 - DNA, 22 bp, Homo sapiens
ctggaagtggagagtggccctc

SEQ ID NO: 7319111 - DNA, 22 bp, Homo sapiens
ctgaggcagaaaaagcaagggt

SEQ ID NO: 7319112 - DNA, 22 bp, Homo sapiens
ctgcacttgacatgctctcaga

SEQ ID NO: 7319113 - DNA, 22 bp, Homo sapiens
ctgaggcactggtaatgggcat

SEQ ID NO: 7319114 - DNA, 22 bp, Homo sapiens
ctgaggcacctacagtctcggg

SEQ ID NO: 7319115 - DNA, 22 bp, Homo sapiens
ctgaggcactaacaaggacaag

SEQ ID NO: 7319116 - DNA, 22 bp, Homo sapiens
ctgagagagtaaagtagaatta

SEQ ID NO: 7319117 - DNA, 22 bp, Homo sapiens
ctgccatgctcaagaagtcttt

SEQ ID NO: 7319118 - DNA, 17 bp, Homo sapiens
ctcttttgtcttcttcc

SEQ ID NO: 7319119 - DNA, 22 bp, Homo sapiens
ctcttttcaaacctgtttatgg

SEQ ID NO: 7319120 - DNA, 22 bp, Homo sapiens
ctgaaagcaaatacatgaatct

SEQ ID NO: 7319121 - DNA, 19 bp, Homo sapiens
ctctggcttccaaagcatc

SEQ ID NO: 7319122 - DNA, 22 bp, Homo sapiens
ctctggctggcacctgatctga

SEQ ID NO: 7319123 - DNA, 22 bp, Homo sapiens
tttgtcttgtaagttaaattca

SEQ ID NO: 7319124 - DNA, 22 bp, Homo sapiens
ccctaggaattctatggccaag

SEQ ID NO: 7319125 - DNA, 22 bp, Homo sapiens
tgcagggaccccgaggctctct

SEQ ID NO: 7319126 - DNA, 22 bp, Homo sapiens
tgcagggagctctggggtgcag

SEQ ID NO: 7319127 - DNA, 22 bp, Homo sapiens
ccctggatttacatcattctga

SEQ ID NO: 7319128 - DNA, 22 bp, Homo sapiens
cctctgggttagtttagggagc

SEQ ID NO: 7319129 - DNA, 22 bp, Homo sapiens
cctctcccgggtgccgctgggc

SEQ ID NO: 7319130 - DNA, 22 bp, Homo sapiens
cctccctgtctacctgttgtgg

SEQ ID NO: 7319131 - DNA, 22 bp, Homo sapiens
tggccccatcaagggatgagtt

SEQ ID NO: 7319132 - DNA, 22 bp, Homo sapiens
tggctcatattgagtgatttct

SEQ ID NO: 7319133 - DNA, 22 bp, Homo sapiens
tggctcatgcctgtaatcttag

SEQ ID NO: 7319134 - DNA, 22 bp, Homo sapiens
tggctcatgcatcttttctaca

SEQ ID NO: 7319135 - DNA, 22 bp, Homo sapiens
tggctcatctttttagacttat

SEQ ID NO: 7319136 - DNA, 22 bp, Homo sapiens
tgtctcttggctctatcactta

SEQ ID NO: 7319137 - DNA, 22 bp, Homo sapiens
tgtctcttgagctgcctgatgc

SEQ ID NO: 7319138 - DNA, 22 bp, Homo sapiens
tgtctatttgaattatcctaat

SEQ ID NO: 7319139 - DNA, 22 bp, Homo sapiens
tgtaggcacatgtatatatccc

SEQ ID NO: 7319140 - DNA, 23 bp, Homo sapiens
tgtaggcagtacagttgtaaatg

SEQ ID NO: 7319141 - DNA, 22 bp, Homo sapiens
tgtaggcatattcatagagttg

SEQ ID NO: 7319142 - DNA, 22 bp, Homo sapiens
tgtaggcatcactttctcttgg

SEQ ID NO: 7319143 - DNA, 22 bp, Homo sapiens
tgtcatgtctgtaaatacacca

SEQ ID NO: 7319144 - DNA, 22 bp, Homo sapiens
tgtctttacttagaagttcagg

SEQ ID NO: 7319145 - DNA, 22 bp, Homo sapiens
tgtgcttctcacatcactgttg

SEQ ID NO: 7319146 - DNA, 22 bp, Homo sapiens
tgtgcttctcacatcactgttg

SEQ ID NO: 7319147 - DNA, 22 bp, Homo sapiens
cctgggagagccatctgtggcc

SEQ ID NO: 7319148 - DNA, 22 bp, Homo sapiens
cctgggagagtctgtggtctcc

SEQ ID NO: 7319149 - DNA, 22 bp, Homo sapiens
cctgggctttgctggcaaggcc

SEQ ID NO: 7319150 - DNA, 22 bp, Homo sapiens
cctgggctttggaacagtactt

SEQ ID NO: 7319151 - DNA, 22 bp, Homo sapiens
cctgggctcaagcgatcttgtc

SEQ ID NO: 7319152 - DNA, 22 bp, Homo sapiens
cctgggcttccacgagcagagg

SEQ ID NO: 7319153 - DNA, 20 bp, Homo sapiens
cctgggctcaaagcatcctc

SEQ ID NO: 7319154 - DNA, 22 bp, Homo sapiens
tgtgcttcttgcagctcctgta

SEQ ID NO: 7319155 - DNA, 20 bp, Homo sapiens
tgtggaaaaacagaagcaga

SEQ ID NO: 7319156 - DNA, 19 bp, Homo sapiens
cctgggaggcggaggttgc

SEQ ID NO: 7319157 - DNA, 18 bp, Homo sapiens
gactttaaaacactgctc

SEQ ID NO: 7319158 - DNA, 19 bp, Homo sapiens
gacaggaaggctaccagta

SEQ ID NO: 7319159 - DNA, 22 bp, Homo sapiens
gaatttaagaggatgaatctgt

SEQ ID NO: 7319160 - DNA, 20 bp, Homo sapiens
gaaggcttggacagtgacag

SEQ ID NO: 7319161 - DNA, 22 bp, Homo sapiens
gaaggcttgccgggaagcggca

SEQ ID NO: 7319162 - DNA, 22 bp, Homo sapiens
gaaggcttgcaagtggttcata

SEQ ID NO: 7319163 - DNA, 22 bp, Homo sapiens
gaaggcttgcagctctgtggca

SEQ ID NO: 7319164 - DNA, 22 bp, Homo sapiens
gaaggctttttgggtaattgta

SEQ ID NO: 7319165 - DNA, 19 bp, Homo sapiens
gaaggcttttggtatgttt

SEQ ID NO: 7319166 - DNA, 22 bp, Homo sapiens
gaaggcttggttttttcaacac

SEQ ID NO: 7319167 - DNA, 22 bp, Homo sapiens
gaaggctttagagagatataaa

SEQ ID NO: 7319168 - DNA, 22 bp, Homo sapiens
gaaggcttttctaccagatctt

SEQ ID NO: 7319169 - DNA, 22 bp, Homo sapiens
gaaggcttattttctttgtaaa

SEQ ID NO: 7319170 - DNA, 22 bp, Homo sapiens
gaaggcttcaaaaggtgtaatt

SEQ ID NO: 7319171 - DNA, 22 bp, Homo sapiens
gaaggcttcccacctgatattt

SEQ ID NO: 7319172 - DNA, 22 bp, Homo sapiens
gaaggcttcctgatgccaacca

SEQ ID NO: 7319173 - DNA, 22 bp, Homo sapiens
gaaggcttcctggaggaggtgg

SEQ ID NO: 7319174 - DNA, 22 bp, Homo sapiens
gaaggcttctccagggcttact

SEQ ID NO: 7319175 - DNA, 21 bp, Homo sapiens
gaaggcttctgcctggaggag

SEQ ID NO: 7319176 - DNA, 22 bp, Homo sapiens
gaaggcttgattgaggaatgcc

SEQ ID NO: 7319177 - DNA, 22 bp, Homo sapiens
gaaaacatccagagatagacct

SEQ ID NO: 7319178 - DNA, 22 bp, Homo sapiens
gaactcattagcctgctttcag

SEQ ID NO: 7319179 - DNA, 22 bp, Homo sapiens
gaaatttacaactttctcatgg

SEQ ID NO: 7319180 - DNA, 22 bp, Homo sapiens
cttctttactttctagaaataa

SEQ ID NO: 7319181 - DNA, 22 bp, Homo sapiens
cttctttcccaggcatgtttta

SEQ ID NO: 7319182 - DNA, 22 bp, Homo sapiens
cttctctggcatagcaagcagg

SEQ ID NO: 7319183 - DNA, 22 bp, Homo sapiens
cttgggctctaaatgccagtga

SEQ ID NO: 7319184 - DNA, 22 bp, Homo sapiens
cttgggaggcagaggttgcagt

SEQ ID NO: 7319185 - DNA, 22 bp, Homo sapiens
cttgggaggggagcattggcct

SEQ ID NO: 7319186 - DNA, 22 bp, Homo sapiens
ctttagaatttgatataatcaa

SEQ ID NO: 7319187 - DNA, 22 bp, Homo sapiens
gagatatttattcatactgtca

SEQ ID NO: 7319188 - DNA, 22 bp, Homo sapiens
gagagtgatgaatggttaaaca

SEQ ID NO: 7319189 - DNA, 22 bp, Homo sapiens
gatcagtttattaattttctag

SEQ ID NO: 7319190 - DNA, 22 bp, Homo sapiens
gatataaattaatcaagtgcaa

SEQ ID NO: 7319191 - DNA, 22 bp, Homo sapiens
gatagctgctgggatattttta

SEQ ID NO: 7319192 - DNA, 22 bp, Homo sapiens
gatgaaaaattgctgtgtcata

SEQ ID NO: 7319193 - DNA, 22 bp, Homo sapiens
gatgaagctatttggttggcac

SEQ ID NO: 7319194 - DNA, 18 bp, Homo sapiens
gatgaagctgctggggat

SEQ ID NO: 7319195 - DNA, 22 bp, Homo sapiens
gatgaagctttgaagtctaatc

SEQ ID NO: 7319196 - DNA, 22 bp, Homo sapiens
gatgaagccccagtgtaagtaa

SEQ ID NO: 7319197 - DNA, 21 bp, Homo sapiens
gatgaagcaatctttctgttg

SEQ ID NO: 7319198 - DNA, 22 bp, Homo sapiens
gatgaagcctgacttctcggtg

SEQ ID NO: 7319199 - DNA, 22 bp, Homo sapiens
gatgaagctaaatctaaggttt

SEQ ID NO: 7319200 - DNA, 22 bp, Homo sapiens
gatgcatgtatggagtgagggt

SEQ ID NO: 7319201 - DNA, 20 bp, Homo sapiens
gataaattgtctcttaagtg

SEQ ID NO: 7319202 - DNA, 22 bp, Homo sapiens
gataaaataactatggaatact

SEQ ID NO: 7319203 - DNA, 22 bp, Homo sapiens
gagtgtgggcacgggggccttg

SEQ ID NO: 7319204 - DNA, 22 bp, Homo sapiens
gagtggcaggcactgtgacgga

SEQ ID NO: 7319205 - DNA, 22 bp, Homo sapiens
gcaatgcaatcagatgattatt

SEQ ID NO: 7319206 - DNA, 22 bp, Homo sapiens
gatttctgtggcttgtacatat

SEQ ID NO: 7319207 - DNA, 22 bp, Homo sapiens
gatttctgttgagaaacatggg

SEQ ID NO: 7319208 - DNA, 22 bp, Homo sapiens
gatttgtctatattcaaatatg

SEQ ID NO: 7319209 - DNA, 22 bp, Homo sapiens
gatggtgtcccaggctcaggct

SEQ ID NO: 7319210 - DNA, 22 bp, Homo sapiens
gatggtttatgatagatgggaa

SEQ ID NO: 7319211 - DNA, 22 bp, Homo sapiens
gatggggttttgccaggctggt

SEQ ID NO: 7319212 - DNA, 21 bp, Homo sapiens
gattaaatttaagctacatgc

SEQ ID NO: 7319213 - DNA, 22 bp, Homo sapiens
gatttacagctatacccaatgg

SEQ ID NO: 7319214 - DNA, 22 bp, Homo sapiens
gcagggcagaaggtgctgagga

SEQ ID NO: 7319215 - DNA, 22 bp, Homo sapiens
gcaggtgtcttcagcaggatga

SEQ ID NO: 7319216 - DNA, 22 bp, Homo sapiens
gcatgtggaatctctccatggt

SEQ ID NO: 7319217 - DNA, 22 bp, Homo sapiens
gcctgcttcctagccttccaag

SEQ ID NO: 7319218 - DNA, 22 bp, Homo sapiens
gccctctcttctgcagcctcca

SEQ ID NO: 7319219 - DNA, 22 bp, Homo sapiens
gggtctctcagaaggctgcaat

SEQ ID NO: 7319220 - DNA, 22 bp, Homo sapiens
gggtctctcatgcagttgctgt

SEQ ID NO: 7319221 - DNA, 22 bp, Homo sapiens
gggagaagaatgtgtcaattgt

SEQ ID NO: 7319222 - DNA, 22 bp, Homo sapiens
gggaccctcaacatctgcttct

SEQ ID NO: 7319223 - DNA, 22 bp, Homo sapiens
ggcccccagggtgggtgtagac

SEQ ID NO: 7319224 - DNA, 22 bp, Homo sapiens
ggccccaaatgtcaatagtact

SEQ ID NO: 7319225 - DNA, 22 bp, Homo sapiens
ggccttccatctgcctctgttt

SEQ ID NO: 7319226 - DNA, 21 bp, Homo sapiens
ggccttcccctgcagtctccg

SEQ ID NO: 7319227 - DNA, 22 bp, Homo sapiens
ggccttcctgttgtgtccaccg

SEQ ID NO: 7319228 - DNA, 22 bp, Homo sapiens
ggccttccttcccagcctactg

SEQ ID NO: 7319229 - DNA, 22 bp, Homo sapiens
ggctgcagaagtacttccggat

SEQ ID NO: 7319230 - DNA, 22 bp, Homo sapiens
ggctgctcggcagctcctgagc

SEQ ID NO: 7319231 - DNA, 20 bp, Homo sapiens
ggctgcaggactcattggct

SEQ ID NO: 7319232 - DNA, 22 bp, Homo sapiens
ggcttcaggggcccagtcagca

SEQ ID NO: 7319233 - DNA, 19 bp, Homo sapiens
ggcttcagtttagcaggct

SEQ ID NO: 7319234 - DNA, 22 bp, Homo sapiens
ggcttcagtgagctgagctcac

SEQ ID NO: 7319235 - DNA, 22 bp, Homo sapiens
ggcttccccacaaagcacacaa

SEQ ID NO: 7319236 - DNA, 18 bp, Homo sapiens
ggcttctcactgacctca

SEQ ID NO: 7319237 - DNA, 22 bp, Homo sapiens
ggcttctcagcacactgtccac

SEQ ID NO: 7319238 - DNA, 22 bp, Homo sapiens
gctgggctgcccaacctctgac

SEQ ID NO: 7319239 - DNA, 22 bp, Homo sapiens
gctgggctgagctagacttggc

SEQ ID NO: 7319240 - DNA, 22 bp, Homo sapiens
gcttaatgagcagagaatctac

SEQ ID NO: 7319241 - DNA, 22 bp, Homo sapiens
gctgggctgcgtcggggaagcc

SEQ ID NO: 7319242 - DNA, 22 bp, Homo sapiens
gcttattttcaccttctctcag

SEQ ID NO: 7319243 - DNA, 21 bp, Homo sapiens
gcttatagaaacatcaccaga

SEQ ID NO: 7319244 - DNA, 22 bp, Homo sapiens
gcttagagcagctcacaacatg

SEQ ID NO: 7319245 - DNA, 22 bp, Homo sapiens
gctgggctgagaagttaagcaa

SEQ ID NO: 7319246 - DNA, 22 bp, Homo sapiens
gctgggctctttacccctgtac

SEQ ID NO: 7319247 - DNA, 22 bp, Homo sapiens
gctgggctcttatcacctgtac

SEQ ID NO: 7319248 - DNA, 21 bp, Homo sapiens
gctgggctccagtctgccgct

SEQ ID NO: 7319249 - DNA, 22 bp, Homo sapiens
gctgggctcgttcccacacgcg

SEQ ID NO: 7319250 - DNA, 22 bp, Homo sapiens
gctgggctctgtcatgccttcc

SEQ ID NO: 7319251 - DNA, 22 bp, Homo sapiens
gctgggctccaccctcaactgt

SEQ ID NO: 7319252 - DNA, 22 bp, Homo sapiens
gctgggctccaggccagggtga

SEQ ID NO: 7319253 - DNA, 22 bp, Homo sapiens
gctgggctcatttgtgtgtctg

SEQ ID NO: 7319254 - DNA, 22 bp, Homo sapiens
gctgggctcagacctagtgaac

SEQ ID NO: 7319255 - DNA, 20 bp, Homo sapiens
gcttcagtttcctcactggt

SEQ ID NO: 7319256 - DNA, 22 bp, Homo sapiens
gcttctggcagtgcagccacca

SEQ ID NO: 7319257 - DNA, 22 bp, Homo sapiens
ggaaactgtagtttgctgacat

SEQ ID NO: 7319258 - DNA, 20 bp, Homo sapiens
ggaaacatttttatttccat

SEQ ID NO: 7319259 - DNA, 22 bp, Homo sapiens
ggagcctgtgggatgagatgtg

SEQ ID NO: 7319260 - DNA, 22 bp, Homo sapiens
ggagaaggaagaaagctactat

SEQ ID NO: 7319261 - DNA, 22 bp, Homo sapiens
ggagaaggaagaaagctactat

SEQ ID NO: 7319262 - DNA, 22 bp, Homo sapiens
ggaaggtttttctcctggtggg

SEQ ID NO: 7319263 - DNA, 22 bp, Homo sapiens
ggaggaaatccttagtaaggca

SEQ ID NO: 7319264 - DNA, 22 bp, Homo sapiens
ggcacacatagatctgcactgg

SEQ ID NO: 7319265 - DNA, 22 bp, Homo sapiens
ggagttgattttggatatatta

SEQ ID NO: 7319266 - DNA, 22 bp, Homo sapiens
ggcaggtgctaagagaggtaaa

SEQ ID NO: 7319267 - DNA, 22 bp, Homo sapiens
ggcagaggaagctggaagtggg

SEQ ID NO: 7319268 - DNA, 22 bp, Homo sapiens
gtgggctttgctggatccttcc

SEQ ID NO: 7319269 - DNA, 22 bp, Homo sapiens
gtgggctttggcctctttctcc

SEQ ID NO: 7319270 - DNA, 22 bp, Homo sapiens
gtgggcttctgttagggaggct

SEQ ID NO: 7319271 - DNA, 22 bp, Homo sapiens
gtgggcttgttttgatgagatc

SEQ ID NO: 7319272 - DNA, 22 bp, Homo sapiens
gtgggcttcccttaagccagag

SEQ ID NO: 7319273 - DNA, 22 bp, Homo sapiens
gtgggcttttgacagtgcctgg

SEQ ID NO: 7319274 - DNA, 22 bp, Homo sapiens
gtgggcagttggtgattctcgt

SEQ ID NO: 7319275 - DNA, 22 bp, Homo sapiens
gtgtcaggagaattagggcttt

SEQ ID NO: 7319276 - DNA, 22 bp, Homo sapiens
gtgtcaggagccttccatgggc

SEQ ID NO: 7319277 - DNA, 19 bp, Homo sapiens
gtgtcaggatgtgcagggg

SEQ ID NO: 7319278 - DNA, 22 bp, Homo sapiens
gtgtcaggcagtcagcatggag

SEQ ID NO: 7319279 - DNA, 21 bp, Homo sapiens
gttcaaatgggtagattcaca

SEQ ID NO: 7319280 - DNA, 21 bp, Homo sapiens
gttcaaatcctgacactacac

SEQ ID NO: 7319281 - DNA, 22 bp, Homo sapiens
gttcaaatctcaggacttcaga

SEQ ID NO: 7319282 - DNA, 22 bp, Homo sapiens
gttgtctgtgtcagttagcgtc

SEQ ID NO: 7319283 - DNA, 22 bp, Homo sapiens
gtggcattgccttctgcaggaa

SEQ ID NO: 7319284 - DNA, 22 bp, Homo sapiens
gtggcatttactctgactgaaa

SEQ ID NO: 7319285 - DNA, 22 bp, Homo sapiens
gtgggagaatggccttgcaaac

SEQ ID NO: 7319286 - DNA, 22 bp, Homo sapiens
gtggcttcatcaactgtgctta

SEQ ID NO: 7319287 - DNA, 22 bp, Homo sapiens
gtggcctctgttggctcctagg

SEQ ID NO: 7319288 - DNA, 22 bp, Homo sapiens
gtggctcagcggagctctgcac

SEQ ID NO: 7319289 - DNA, 22 bp, Homo sapiens
gtggctcagttaacttccatgt

SEQ ID NO: 7319290 - DNA, 22 bp, Homo sapiens
gtggctcatctttgggaagtaa

SEQ ID NO: 7319291 - DNA, 19 bp, Homo sapiens
gtggctcatgtagtgggcc

SEQ ID NO: 7319292 - DNA, 22 bp, Homo sapiens
gtgacagagtgagaccttgtct

SEQ ID NO: 7319293 - DNA, 23 bp, Homo sapiens
gtggagagattagtaattcaccc

SEQ ID NO: 7319294 - DNA, 22 bp, Homo sapiens
gtcaggacaggctctggactga

SEQ ID NO: 7319295 - DNA, 22 bp, Homo sapiens
gtcaggccctggcagccgtgac

SEQ ID NO: 7319296 - DNA, 22 bp, Homo sapiens
gtcaggctgctggagcttgggt

SEQ ID NO: 7319297 - DNA, 22 bp, Homo sapiens
gtcaggccaatactctccagca

SEQ ID NO: 7319298 - DNA, 21 bp, Homo sapiens
gtcaggcccatagcagtgcct

SEQ ID NO: 7319299 - DNA, 22 bp, Homo sapiens
gtccttccccagccagctctgg

SEQ ID NO: 7319300 - DNA, 22 bp, Homo sapiens
gtccttggcctgggtagagtgg

SEQ ID NO: 7319301 - DNA, 22 bp, Homo sapiens
ggtgagtttcatggttgtttac

SEQ ID NO: 7319302 - DNA, 22 bp, Homo sapiens
gtacatattataaaatacagct

SEQ ID NO: 7319303 - DNA, 22 bp, Homo sapiens
gtacatttactgatgaaaagta

SEQ ID NO: 7319304 - DNA, 22 bp, Homo sapiens
gtatacatgtggtaaaatgcac

SEQ ID NO: 7319305 - DNA, 22 bp, Homo sapiens
gtatatatcggcactattttaa

SEQ ID NO: 7319306 - DNA, 22 bp, Homo sapiens
gtatatatgtgtgaacatgtat

SEQ ID NO: 7319307 - DNA, 19 bp, Homo sapiens
tctgagggagcacgaaggc

SEQ ID NO: 7319308 - DNA, 22 bp, Homo sapiens
tctgaggaaagagagtgggatg

SEQ ID NO: 7319309 - DNA, 22 bp, Homo sapiens
tctgagcttttattatcaacct

SEQ ID NO: 7319310 - DNA, 23 bp, Homo sapiens
tctgagctgtcttttcagcagaa

SEQ ID NO: 7319311 - DNA, 22 bp, Homo sapiens
tctgagctgggtcttgacagct

SEQ ID NO: 7319312 - DNA, 22 bp, Homo sapiens
tctgagctgtaagtagacaagg

SEQ ID NO: 7319313 - DNA, 22 bp, Homo sapiens
tctgagctgggcacagaaggcg

SEQ ID NO: 7319314 - DNA, 22 bp, Homo sapiens
tctgagctgggggcctggcatg

SEQ ID NO: 7319315 - DNA, 19 bp, Homo sapiens
tctgagctgatatgacatt

SEQ ID NO: 7319316 - DNA, 18 bp, Homo sapiens
tctgcaggacctcagggc

SEQ ID NO: 7319317 - DNA, 22 bp, Homo sapiens
tctgcaggaggctggctgcagg

SEQ ID NO: 7319318 - DNA, 22 bp, Homo sapiens
tctggctctcaacaaatattta

SEQ ID NO: 7319319 - DNA, 22 bp, Homo sapiens
tctggctccctggagctccaca

SEQ ID NO: 7319320 - DNA, 23 bp, Homo sapiens
tctgggctgagctcgagtgtaga

SEQ ID NO: 7319321 - DNA, 23 bp, Homo sapiens
tctgggctgagacttggaaggtc

SEQ ID NO: 7319322 - DNA, 22 bp, Homo sapiens
tctgggctgaaatgaaggcctt

SEQ ID NO: 7319323 - DNA, 22 bp, Homo sapiens
tctgggctgctatgaggcagag

SEQ ID NO: 7319324 - DNA, 22 bp, Homo sapiens
tctgggctgctgtgcagtgacc

SEQ ID NO: 7319325 - DNA, 21 bp, Homo sapiens
tctgggctgctgctgcccatc

SEQ ID NO: 7319326 - DNA, 22 bp, Homo sapiens
tctgggctcttagtgtaccctc

SEQ ID NO: 7319327 - DNA, 22 bp, Homo sapiens
tctggatgaagacccagaggct

SEQ ID NO: 7319328 - DNA, 22 bp, Homo sapiens
tctggatgacagaatggtcata

SEQ ID NO: 7319329 - DNA, 22 bp, Homo sapiens
tctggatgctctgagcccaagg

SEQ ID NO: 7319330 - DNA, 22 bp, Homo sapiens
tctgttagagaggtagttcttg

SEQ ID NO: 7319331 - DNA, 22 bp, Homo sapiens
tctgttagctgtcaaagtgttt

SEQ ID NO: 7319332 - DNA, 22 bp, Homo sapiens
tctgtgctcattcagtcattca

SEQ ID NO: 7319333 - DNA, 22 bp, Homo sapiens
tctggggtgtgacctgagcatg

SEQ ID NO: 7319334 - DNA, 22 bp, Homo sapiens
tctggggtgcagcctaggcatc

SEQ ID NO: 7319335 - DNA, 22 bp, Homo sapiens
tctgggctttgtaatgggaggt

SEQ ID NO: 7319336 - DNA, 22 bp, Homo sapiens
tctgggcttgggtagaaatcac

SEQ ID NO: 7319337 - DNA, 22 bp, Homo sapiens
tctgggcttggattggctctgc

SEQ ID NO: 7319338 - DNA, 22 bp, Homo sapiens
tctgggcttggttagggctgtt

SEQ ID NO: 7319339 - DNA, 22 bp, Homo sapiens
tctgggctttaagaactctgtt

SEQ ID NO: 7319340 - DNA, 22 bp, Homo sapiens
tctgggctttagtttgttatct

SEQ ID NO: 7319341 - DNA, 21 bp, Homo sapiens
tctgggctttcttataaggca

SEQ ID NO: 7319342 - DNA, 22 bp, Homo sapiens
tctgggctttacactgtgctta

SEQ ID NO: 7319343 - DNA, 22 bp, Homo sapiens
tctgggctggttgtgcttgctt

SEQ ID NO: 7319344 - DNA, 22 bp, Homo sapiens
tctgggctgggcttaggaaccc

SEQ ID NO: 7319345 - DNA, 22 bp, Homo sapiens
tctgggctggtgctcatgaatt

SEQ ID NO: 7319346 - DNA, 22 bp, Homo sapiens
tctgggctgtctacaggttggc

SEQ ID NO: 7319347 - DNA, 15 bp, Homo sapiens
tctgggctgtgagca

SEQ ID NO: 7319348 - DNA, 22 bp, Homo sapiens
tctgggctggctttatgctgac

SEQ ID NO: 7319349 - DNA, 22 bp, Homo sapiens
tctgggctgggagcgtgtggac

SEQ ID NO: 7319350 - DNA, 22 bp, Homo sapiens
tctgggctgcttcagccttcgc

SEQ ID NO: 7319351 - DNA, 23 bp, Homo sapiens
tctgggctgcttaaggatcaagg

SEQ ID NO: 7319352 - DNA, 22 bp, Homo sapiens
tctgggcttgcctggttgtgca

SEQ ID NO: 7319353 - DNA, 20 bp, Homo sapiens
tctgggcttcccccagctcc

SEQ ID NO: 7319354 - DNA, 18 bp, Homo sapiens
tctgggcttcccgaggct

SEQ ID NO: 7319355 - DNA, 17 bp, Homo sapiens
tctgggcttcagtggtc

SEQ ID NO: 7319356 - DNA, 22 bp, Homo sapiens
tctgggctgtggttccactccg

SEQ ID NO: 7319357 - DNA, 22 bp, Homo sapiens
tctgggctgtgggaattcaaca

SEQ ID NO: 7319358 - DNA, 22 bp, Homo sapiens
tctgggctgtgccaaagctctt

SEQ ID NO: 7319359 - DNA, 20 bp, Homo sapiens
tcttgagaacaatttctggc

SEQ ID NO: 7319360 - DNA, 23 bp, Homo sapiens
tctttacatactgatgagttctc

SEQ ID NO: 7319361 - DNA, 22 bp, Homo sapiens
tctttacatagtgtggactact

SEQ ID NO: 7319362 - DNA, 22 bp, Homo sapiens
tctttataaaagtcattatgtc

SEQ ID NO: 7319363 - DNA, 22 bp, Homo sapiens
tctttagctagaaatactctaa

SEQ ID NO: 7319364 - DNA, 22 bp, Homo sapiens
tctttagtgaccatctcattct

SEQ ID NO: 7319365 - DNA, 20 bp, Homo sapiens
tctttagttcctggcccttt

SEQ ID NO: 7319366 - DNA, 22 bp, Homo sapiens
tcttcagtgcacctgatgtctt

SEQ ID NO: 7319367 - DNA, 22 bp, Homo sapiens
tcttattttgttagatgctgta

SEQ ID NO: 7319368 - DNA, 22 bp, Homo sapiens
tcttcaaatacagtcatattga

SEQ ID NO: 7319369 - DNA, 22 bp, Homo sapiens
tcttcaaatgctagtaatatca

SEQ ID NO: 7319370 - DNA, 22 bp, Homo sapiens
tcttcgggaatcggtgcatttc

SEQ ID NO: 7319371 - DNA, 21 bp, Homo sapiens
tcttgaaaagttagattctct

SEQ ID NO: 7319372 - DNA, 22 bp, Homo sapiens
tcttcttcccatccctcaaatg

SEQ ID NO: 7319373 - DNA, 20 bp, Homo sapiens
tcttctgttgccttgttctg

SEQ ID NO: 7319374 - DNA, 22 bp, Homo sapiens
tcctggctctctacaaaccaga

SEQ ID NO: 7319375 - DNA, 22 bp, Homo sapiens
tcctggattctgccctgaaggc

SEQ ID NO: 7319376 - DNA, 22 bp, Homo sapiens
tcctggatttaaccctggctct

SEQ ID NO: 7319377 - DNA, 17 bp, Homo sapiens
tcctggatccatggtgg

SEQ ID NO: 7319378 - DNA, 22 bp, Homo sapiens
tcctggatcagcgggggcaggc

SEQ ID NO: 7319379 - DNA, 22 bp, Homo sapiens
tcctggatggagctgccctcgc

SEQ ID NO: 7319380 - DNA, 22 bp, Homo sapiens
tcctggatggcctgcaggcggt

SEQ ID NO: 7319381 - DNA, 22 bp, Homo sapiens
tcctggattaatagggagctgt

SEQ ID NO: 7319382 - DNA, 22 bp, Homo sapiens
tcctggactcaggaccacagga

SEQ ID NO: 7319383 - DNA, 21 bp, Homo sapiens
tcctgggaagcactggggtgg

SEQ ID NO: 7319384 - DNA, 22 bp, Homo sapiens
tcctgggaagagacctgagcat

SEQ ID NO: 7319385 - DNA, 22 bp, Homo sapiens
tcctgggactctgcctcaggct

SEQ ID NO: 7319386 - DNA, 22 bp, Homo sapiens
tcctttcttcttctgcccatgg

SEQ ID NO: 7319387 - DNA, 22 bp, Homo sapiens
tctaaagatgtttattgacata

SEQ ID NO: 7319388 - DNA, 22 bp, Homo sapiens
tctaaagatgtttattgacata

SEQ ID NO: 7319389 - DNA, 22 bp, Homo sapiens
tctaaagatttggattcatttg

SEQ ID NO: 7319390 - DNA, 22 bp, Homo sapiens
tctaaagagaaccttttctcat

SEQ ID NO: 7319391 - DNA, 22 bp, Homo sapiens
tctaaagagagtgggtacatgt

SEQ ID NO: 7319392 - DNA, 22 bp, Homo sapiens
tctaaagaaacattgagacctg

SEQ ID NO: 7319393 - DNA, 22 bp, Homo sapiens
tctaaagaagagggttctgcgg

SEQ ID NO: 7319394 - DNA, 22 bp, Homo sapiens
tctaaagacactttttacaggg

SEQ ID NO: 7319395 - DNA, 22 bp, Homo sapiens
tcgtggaatatggatgcttgtc

SEQ ID NO: 7319396 - DNA, 22 bp, Homo sapiens
tccttgagagccactgtcttgg

SEQ ID NO: 7319397 - DNA, 21 bp, Homo sapiens
tccttgctattttcctcagct

SEQ ID NO: 7319398 - DNA, 22 bp, Homo sapiens
tccttaggcaatttgggagagt

SEQ ID NO: 7319399 - DNA, 22 bp, Homo sapiens
tctattagattattctcaagga

SEQ ID NO: 7319400 - DNA, 22 bp, Homo sapiens
tctatgtctccaccttcgcaga

SEQ ID NO: 7319401 - DNA, 22 bp, Homo sapiens
tctatgtcctttctcccattcc

SEQ ID NO: 7319402 - DNA, 22 bp, Homo sapiens
tctatgtcagcatctttctacc

SEQ ID NO: 7319403 - DNA, 22 bp, Homo sapiens
tctattttatactcaaatcttc

SEQ ID NO: 7319404 - DNA, 22 bp, Homo sapiens
tctactgccacttaagacattt

SEQ ID NO: 7319405 - DNA, 22 bp, Homo sapiens
tctacatgcagcgaggggactt

SEQ ID NO: 7319406 - DNA, 22 bp, Homo sapiens
tctacagtgtttggtttgagga

SEQ ID NO: 7319407 - DNA, 22 bp, Homo sapiens
tctcaggtctcatgccaggcct

SEQ ID NO: 7319408 - DNA, 22 bp, Homo sapiens
tctcaggtttcaagacaggaaa

SEQ ID NO: 7319409 - DNA, 22 bp, Homo sapiens
tctcataatagcatttctcacc

SEQ ID NO: 7319410 - DNA, 22 bp, Homo sapiens
tctcatttgtgtgcaattcaga

SEQ ID NO: 7319411 - DNA, 22 bp, Homo sapiens
tctcatttggctttgttttaaa

SEQ ID NO: 7319412 - DNA, 22 bp, Homo sapiens
tctcatttgcctcatctataaa

SEQ ID NO: 7319413 - DNA, 22 bp, Homo sapiens
tctcatttgcctcatctataaa

SEQ ID NO: 7319414 - DNA, 22 bp, Homo sapiens
tctcattcataccctacatgct

SEQ ID NO: 7319415 - DNA, 22 bp, Homo sapiens
tctcatgttttacctgtcctca

SEQ ID NO: 7319416 - DNA, 18 bp, Homo sapiens
tctcattacaatctttgt

SEQ ID NO: 7319417 - DNA, 22 bp, Homo sapiens
tctcctggtatgtatgcacctg

SEQ ID NO: 7319418 - DNA, 21 bp, Homo sapiens
tctctaaaaagattctatttg

SEQ ID NO: 7319419 - DNA, 22 bp, Homo sapiens
tctctaaaattcccggccaact

SEQ ID NO: 7319420 - DNA, 22 bp, Homo sapiens
tctctaaacttatatgaactat

SEQ ID NO: 7319421 - DNA, 22 bp, Homo sapiens
tctctaaagatagctgcctcga

SEQ ID NO: 7319422 - DNA, 22 bp, Homo sapiens
tctctaaagatatttatggcaa

SEQ ID NO: 7319423 - DNA, 22 bp, Homo sapiens
tctctaaagaagcctccctaaa

SEQ ID NO: 7319424 - DNA, 22 bp, Homo sapiens
tctcccaggtgggtgcctggag

SEQ ID NO: 7319425 - DNA, 22 bp, Homo sapiens
tctcttaggagaaattcataaa

SEQ ID NO: 7319426 - DNA, 22 bp, Homo sapiens
tctctgtgagatttgtattaag

SEQ ID NO: 7319427 - DNA, 22 bp, Homo sapiens
tctctgtgaagctcccgttagg

SEQ ID NO: 7319428 - DNA, 22 bp, Homo sapiens
tctctttaaaaatagtgaaata

SEQ ID NO: 7319429 - DNA, 22 bp, Homo sapiens
tctctttaagtataatcttata

SEQ ID NO: 7319430 - DNA, 22 bp, Homo sapiens
tctctttaaagactcagagatt

SEQ ID NO: 7319431 - DNA, 22 bp, Homo sapiens
tctgaaagaaagattttgtttc

SEQ ID NO: 7319432 - DNA, 22 bp, Homo sapiens
tctctctttttaatcatgtaat

SEQ ID NO: 7319433 - DNA, 22 bp, Homo sapiens
tctctgaaggggagctgtttaa

SEQ ID NO: 7319434 - DNA, 22 bp, Homo sapiens
tctctgacatgcctaagacttt

SEQ ID NO: 7319435 - DNA, 22 bp, Homo sapiens
tctctcagaaagcccatgtctg

SEQ ID NO: 7319436 - DNA, 20 bp, Homo sapiens
tctctggccagaaacaacag

SEQ ID NO: 7319437 - DNA, 22 bp, Homo sapiens
tctctgagttcctgtggatttt

SEQ ID NO: 7319438 - DNA, 22 bp, Homo sapiens
tgcaccctcatcagtcaaatgg

SEQ ID NO: 7319439 - DNA, 22 bp, Homo sapiens
tgcaaatgggcatctccaagtg

SEQ ID NO: 7319440 - DNA, 22 bp, Homo sapiens
tgcaaatgcccatttattttct

SEQ ID NO: 7319441 - DNA, 22 bp, Homo sapiens
tgcaaatgagttgcagatcagg

SEQ ID NO: 7319442 - DNA, 22 bp, Homo sapiens
tgcaatttgacgtcagcacagt

SEQ ID NO: 7319443 - DNA, 22 bp, Homo sapiens
tgcaatttcaaatatcagaaag

SEQ ID NO: 7319444 - DNA, 22 bp, Homo sapiens
tgcaagcaatccaggaaggcta

SEQ ID NO: 7319445 - DNA, 19 bp, Homo sapiens
tgatgccctgacctgagcc

SEQ ID NO: 7319446 - DNA, 22 bp, Homo sapiens
tgatgctgctgggagtggtgct

SEQ ID NO: 7319447 - DNA, 22 bp, Homo sapiens
tgagtgtatatgaaggttgtaa

SEQ ID NO: 7319448 - DNA, 22 bp, Homo sapiens
tgccactggctcaatggtgcag

SEQ ID NO: 7319449 - DNA, 22 bp, Homo sapiens
tgcatttagttttaataaagga

SEQ ID NO: 7319450 - DNA, 22 bp, Homo sapiens
tgcattgggttgacatactaaa

SEQ ID NO: 7319451 - DNA, 22 bp, Homo sapiens
tgcattggaaactcagcagcac

SEQ ID NO: 7319452 - DNA, 22 bp, Homo sapiens
tgcatttaagaaaacatgagtc

SEQ ID NO: 7319453 - DNA, 22 bp, Homo sapiens
tgcatgtgtgacaaggacagtt

SEQ ID NO: 7319454 - DNA, 22 bp, Homo sapiens
tgcatggaggaagatgaatgca

SEQ ID NO: 7319455 - DNA, 22 bp, Homo sapiens
tgcatctttttccaagtttatt

SEQ ID NO: 7319456 - DNA, 23 bp, Homo sapiens
tgcatgctaacacagtgcacagg

SEQ ID NO: 7319457 - DNA, 22 bp, Homo sapiens
tgcatgctctgtagaaagcagg

SEQ ID NO: 7319458 - DNA, 22 bp, Homo sapiens
tgcatctgattctcaggcagaa

SEQ ID NO: 7319459 - DNA, 22 bp, Homo sapiens
tgcatcagtgactgaatatgag

SEQ ID NO: 7319460 - DNA, 22 bp, Homo sapiens
tgcatcagtgactgggagataa

SEQ ID NO: 7319461 - DNA, 22 bp, Homo sapiens
tgcagggattatgtaggggttg

SEQ ID NO: 7319462 - DNA, 22 bp, Homo sapiens
tgcaggtacttgacaacttggg

SEQ ID NO: 7319463 - DNA, 22 bp, Homo sapiens
tgcaggtggatatctcatcaga

SEQ ID NO: 7319464 - DNA, 22 bp, Homo sapiens
tgcaggtggctccagggactgc

SEQ ID NO: 7319465 - DNA, 22 bp, Homo sapiens
tgcaggtgtggttcctcagcca

SEQ ID NO: 7319466 - DNA, 22 bp, Homo sapiens
tgcccaggctggagtgcagagg

SEQ ID NO: 7319467 - DNA, 22 bp, Homo sapiens
tgaaaaaacaagttggcccatt

SEQ ID NO: 7319468 - DNA, 22 bp, Homo sapiens
tgaaaatgccctctatgtctca

SEQ ID NO: 7319469 - DNA, 22 bp, Homo sapiens
tgaaaatttccatcagttatat

SEQ ID NO: 7319470 - DNA, 22 bp, Homo sapiens
tgaaacataaagttatcttcag

SEQ ID NO: 7319471 - DNA, 22 bp, Homo sapiens
tgaaacattatagaatatttat

SEQ ID NO: 7319472 - DNA, 22 bp, Homo sapiens
tgaaacattgcactgtatgaat

SEQ ID NO: 7319473 - DNA, 22 bp, Homo sapiens
tgaaacatttgatgatctttgg

SEQ ID NO: 7319474 - DNA, 22 bp, Homo sapiens
tgaagaaacgcagagaggtagg

SEQ ID NO: 7319475 - DNA, 22 bp, Homo sapiens
tgaaatcagtatgtctttctca

SEQ ID NO: 7319476 - DNA, 22 bp, Homo sapiens
tgacacttgggctttgagaggt

SEQ ID NO: 7319477 - DNA, 22 bp, Homo sapiens
tgacacttccggtaaaaaatgc

SEQ ID NO: 7319478 - DNA, 22 bp, Homo sapiens
tgacacttccagttaaaaatat

SEQ ID NO: 7319479 - DNA, 22 bp, Homo sapiens
tgacacttctgaaacggaagtt

SEQ ID NO: 7319480 - DNA, 20 bp, Homo sapiens
tgacacttgatattgtcagt

SEQ ID NO: 7319481 - DNA, 22 bp, Homo sapiens
tgacttcctgcactcaggtgat

SEQ ID NO: 7319482 - DNA, 22 bp, Homo sapiens
tgacttctagcatttagcaacc

SEQ ID NO: 7319483 - DNA, 22 bp, Homo sapiens
tgacctttgtgctagaaacata

SEQ ID NO: 7319484 - DNA, 22 bp, Homo sapiens
tgacctctgtcctgcagtctgg

SEQ ID NO: 7319485 - DNA, 21 bp, Homo sapiens
tgaatttccctctatcattct

SEQ ID NO: 7319486 - DNA, 22 bp, Homo sapiens
tgaagccctgtgtcagcttcca

SEQ ID NO: 7319487 - DNA, 22 bp, Homo sapiens
tgaagcccttcatgcacagtca

SEQ ID NO: 7319488 - DNA, 22 bp, Homo sapiens
tgaagccctgtgataggtccag

SEQ ID NO: 7319489 - DNA, 22 bp, Homo sapiens
tgaagcccaaggcactgtctga

SEQ ID NO: 7319490 - DNA, 22 bp, Homo sapiens
tgaagcccaatcctgtgttcct

SEQ ID NO: 7319491 - DNA, 23 bp, Homo sapiens
tgaagcccagtgattttgtttca

SEQ ID NO: 7319492 - DNA, 22 bp, Homo sapiens
tgaagcccaggaatctacattt

SEQ ID NO: 7319493 - DNA, 22 bp, Homo sapiens
tgaagcccaggtgttagtgggg

SEQ ID NO: 7319494 - DNA, 22 bp, Homo sapiens
tgaagcccctaagtcccaggca

SEQ ID NO: 7319495 - DNA, 22 bp, Homo sapiens
tgaagccctgtcttatggaaga

SEQ ID NO: 7319496 - DNA, 22 bp, Homo sapiens
tgaaggccacttcctgtgagct

SEQ ID NO: 7319497 - DNA, 22 bp, Homo sapiens
tgaaggccagcagagtgaaggc

SEQ ID NO: 7319498 - DNA, 23 bp, Homo sapiens
tgaaggccctggagccacgaggc

SEQ ID NO: 7319499 - DNA, 22 bp, Homo sapiens
tgaaggctttttaaagcatttg

SEQ ID NO: 7319500 - DNA, 22 bp, Homo sapiens
tgaaggctgggctcagccagct

SEQ ID NO: 7319501 - DNA, 22 bp, Homo sapiens
tgaagtttaattttggacatga

SEQ ID NO: 7319502 - DNA, 22 bp, Homo sapiens
tgaaggtggcataggagagatg

SEQ ID NO: 7319503 - DNA, 22 bp, Homo sapiens
tgagctcatagctcttattatg

SEQ ID NO: 7319504 - DNA, 22 bp, Homo sapiens
tgagatggagttttggggatat

SEQ ID NO: 7319505 - DNA, 22 bp, Homo sapiens
tgagaaatggcagcattactgg

SEQ ID NO: 7319506 - DNA, 22 bp, Homo sapiens
tgagaatttgcatttctaacaa

SEQ ID NO: 7319507 - DNA, 22 bp, Homo sapiens
tgagaattttttgtcatgcatt

SEQ ID NO: 7319508 - DNA, 22 bp, Homo sapiens
tgaggcaggagttaatgtgctc

SEQ ID NO: 7319509 - DNA, 22 bp, Homo sapiens
tgaggccctagggcatgggaga

SEQ ID NO: 7319510 - DNA, 18 bp, Homo sapiens
tgaggcccgcagaggtgg

SEQ ID NO: 7319511 - DNA, 22 bp, Homo sapiens
tgaggcccgggtggaggaatgc

SEQ ID NO: 7319512 - DNA, 22 bp, Homo sapiens
tgaggaagccaaacagctacac

SEQ ID NO: 7319513 - DNA, 22 bp, Homo sapiens
tgaggaagttgatctcatcagt

SEQ ID NO: 7319514 - DNA, 22 bp, Homo sapiens
tgaggatggtgttggagagggc

SEQ ID NO: 7319515 - DNA, 22 bp, Homo sapiens
tgaggcaacagaaagggccaat

SEQ ID NO: 7319516 - DNA, 22 bp, Homo sapiens
tgaggcaaagttcaagctgaaa

SEQ ID NO: 7319517 - DNA, 22 bp, Homo sapiens
tgaggcaaagacaaagcagcat

SEQ ID NO: 7319518 - DNA, 22 bp, Homo sapiens
tgaggcaaaagttatgtggtag

SEQ ID NO: 7319519 - DNA, 22 bp, Homo sapiens
tgaggcacatccaggccagctc

SEQ ID NO: 7319520 - DNA, 20 bp, Homo sapiens
tgaggcaggagaatggcatg

SEQ ID NO: 7319521 - DNA, 22 bp, Homo sapiens
tgaggcttggaggctccagtgg

SEQ ID NO: 7319522 - DNA, 22 bp, Homo sapiens
tgagggtggcacaggcacaaag

SEQ ID NO: 7319523 - DNA, 22 bp, Homo sapiens
tgagtattttaagttctcaatc

SEQ ID NO: 7319524 - DNA, 22 bp, Homo sapiens
tggaccctgaagcaacagggag

SEQ ID NO: 7319525 - DNA, 23 bp, Homo sapiens
tggaccctgcacaccagctctac

SEQ ID NO: 7319526 - DNA, 22 bp, Homo sapiens
tggaccctggactgccctggcc

SEQ ID NO: 7319527 - DNA, 22 bp, Homo sapiens
tggaccctacccggccctcggc

SEQ ID NO: 7319528 - DNA, 22 bp, Homo sapiens
tggaaggcaacggagtgagctg

SEQ ID NO: 7319529 - DNA, 22 bp, Homo sapiens
tggaagatcaaccaggattgac

SEQ ID NO: 7319530 - DNA, 22 bp, Homo sapiens
tggaagagcaggcagacaatgc

SEQ ID NO: 7319531 - DNA, 21 bp, Homo sapiens
tgctttatgggaaaaatgtca

SEQ ID NO: 7319532 - DNA, 22 bp, Homo sapiens
tgcttctttactataggcaatt

SEQ ID NO: 7319533 - DNA, 22 bp, Homo sapiens
tggagaggagcaccatggccat

SEQ ID NO: 7319534 - DNA, 19 bp, Homo sapiens
tggagaggaaatgctgctc

SEQ ID NO: 7319535 - DNA, 22 bp, Homo sapiens
tggagaggttgaataacttgtc

SEQ ID NO: 7319536 - DNA, 22 bp, Homo sapiens
tggagaggtttaaacaaaagtt

SEQ ID NO: 7319537 - DNA, 22 bp, Homo sapiens
tggagaggaaagtgcagttttg

SEQ ID NO: 7319538 - DNA, 22 bp, Homo sapiens
tggaggcagtaactgagcaaca

SEQ ID NO: 7319539 - DNA, 22 bp, Homo sapiens
tggaggcaggagacagggcaaa

SEQ ID NO: 7319540 - DNA, 20 bp, Homo sapiens
tggaggcacctgtggagatc

SEQ ID NO: 7319541 - DNA, 20 bp, Homo sapiens
tggaggcagagccagaggga

SEQ ID NO: 7319542 - DNA, 22 bp, Homo sapiens
tgctctgtaggggaaagagagc

SEQ ID NO: 7319543 - DNA, 22 bp, Homo sapiens
tgctctgtcaagaaaagatgcc

SEQ ID NO: 7319544 - DNA, 18 bp, Homo sapiens
tgctctgtttaatgattt

SEQ ID NO: 7319545 - DNA, 22 bp, Homo sapiens
tgcctgtcttcaggagtgtcac

SEQ ID NO: 7319546 - DNA, 22 bp, Homo sapiens
tgcctgtcttggagtcctggcc

SEQ ID NO: 7319547 - DNA, 22 bp, Homo sapiens
tgcctgtgtatgtgcatgcaca

SEQ ID NO: 7319548 - DNA, 22 bp, Homo sapiens
tgctatttctatctcatttaaa

SEQ ID NO: 7319549 - DNA, 22 bp, Homo sapiens
tgctggcaccagaatgactgca

SEQ ID NO: 7319550 - DNA, 22 bp, Homo sapiens
tgctggcacatagagactggct

SEQ ID NO: 7319551 - DNA, 22 bp, Homo sapiens
tgctggcatgcatgctgtagga

SEQ ID NO: 7319552 - DNA, 22 bp, Homo sapiens
tgctgtcagacagcagtggtaa

SEQ ID NO: 7319553 - DNA, 22 bp, Homo sapiens
tgcttaaacacatacatacata

SEQ ID NO: 7319554 - DNA, 22 bp, Homo sapiens
tgcttaaacatactatttatat

SEQ ID NO: 7319555 - DNA, 22 bp, Homo sapiens
tgcttaaaccctgatcatgtgt

SEQ ID NO: 7319556 - DNA, 22 bp, Homo sapiens
tgcttaaacatccagacagtat

SEQ ID NO: 7319557 - DNA, 22 bp, Homo sapiens
tgcttaaagtagtggattgtta

SEQ ID NO: 7319558 - DNA, 22 bp, Homo sapiens
tgcttaataggagttgaacatt

SEQ ID NO: 7319559 - DNA, 22 bp, Homo sapiens
tgcttaatcaagaagcctattt

SEQ ID NO: 7319560 - DNA, 22 bp, Homo sapiens
tgcttataatgttactgacaac

SEQ ID NO: 7319561 - DNA, 22 bp, Homo sapiens
tgcttaaaatagttcatttttg

SEQ ID NO: 7319562 - DNA, 22 bp, Homo sapiens
tgcttaaaatgatgattatttt

SEQ ID NO: 7319563 - DNA, 22 bp, Homo sapiens
tgcttaaaaacagtatggtagt

SEQ ID NO: 7319564 - DNA, 22 bp, Homo sapiens
tgcttatttaggtagatattaa

SEQ ID NO: 7319565 - DNA, 22 bp, Homo sapiens
tgcttattctttccacaattca

SEQ ID NO: 7319566 - DNA, 22 bp, Homo sapiens
tggcactgtggatttcacaagt

SEQ ID NO: 7319567 - DNA, 22 bp, Homo sapiens
tggcacatggttaatcataatt

SEQ ID NO: 7319568 - DNA, 21 bp, Homo sapiens
tggcagagtgcagtctataca

SEQ ID NO: 7319569 - DNA, 22 bp, Homo sapiens
tggcccagggagttcatggtgt

SEQ ID NO: 7319570 - DNA, 22 bp, Homo sapiens
tggcccagctgcagatggtgga

SEQ ID NO: 7319571 - DNA, 22 bp, Homo sapiens
tgggagagcttcatgccttcag

SEQ ID NO: 7319572 - DNA, 22 bp, Homo sapiens
tgggacttgcctcgagggctgc

SEQ ID NO: 7319573 - DNA, 22 bp, Homo sapiens
tgggagagtttgtttagagtga

SEQ ID NO: 7319574 - DNA, 22 bp, Homo sapiens
tgggagagtctaaaaccgaggt

SEQ ID NO: 7319575 - DNA, 22 bp, Homo sapiens
tgggagagtgctcaatgtgcaa

SEQ ID NO: 7319576 - DNA, 21 bp, Homo sapiens
tgggagagggctcagctaccc

SEQ ID NO: 7319577 - DNA, 22 bp, Homo sapiens
tgggagagtaaccaattccttc

SEQ ID NO: 7319578 - DNA, 19 bp, Homo sapiens
tgggagaggcaacagagta

SEQ ID NO: 7319579 - DNA, 22 bp, Homo sapiens
tgggagaggctgccatcttgca

SEQ ID NO: 7319580 - DNA, 22 bp, Homo sapiens
tgggagcagcattgccatgtgc

SEQ ID NO: 7319581 - DNA, 22 bp, Homo sapiens
tggcttcacacaggcacttccg

SEQ ID NO: 7319582 - DNA, 22 bp, Homo sapiens
tggcttcactgctcaagtgatt

SEQ ID NO: 7319583 - DNA, 22 bp, Homo sapiens
tggctgcagtgcttgagatgtc

SEQ ID NO: 7319584 - DNA, 21 bp, Homo sapiens
tggctcgatttatagcatttc

SEQ ID NO: 7319585 - DNA, 22 bp, Homo sapiens
tggctcattctactctccctgg

SEQ ID NO: 7319586 - DNA, 22 bp, Homo sapiens
tggctcatggaattagctatta

SEQ ID NO: 7319587 - DNA, 22 bp, Homo sapiens
tggctcattctttagaatatac

SEQ ID NO: 7319588 - DNA, 22 bp, Homo sapiens
tggctcagtcatggatgagtaa

SEQ ID NO: 7319589 - DNA, 22 bp, Homo sapiens
tggctcagtagcagtgtggtca

SEQ ID NO: 7319590 - DNA, 23 bp, Homo sapiens
tggctcagggtctcttatgaagt

SEQ ID NO: 7319591 - DNA, 22 bp, Homo sapiens
tggctcaggcttgaaaatagat

SEQ ID NO: 7319592 - DNA, 22 bp, Homo sapiens
tggctcagcaagacattgacct

SEQ ID NO: 7319593 - DNA, 22 bp, Homo sapiens
tggctattgagtgatctctaga

SEQ ID NO: 7319594 - DNA, 22 bp, Homo sapiens
tggctcagaactacttctagtt

SEQ ID NO: 7319595 - DNA, 22 bp, Homo sapiens
tggctcagaagaaaaggtaaac

SEQ ID NO: 7319596 - DNA, 22 bp, Homo sapiens
tggctcagatttttgtaggctt

SEQ ID NO: 7319597 - DNA, 22 bp, Homo sapiens
tggccttcctggtgactcatga

SEQ ID NO: 7319598 - DNA, 22 bp, Homo sapiens
tggtatggctaacgaggtcaag

SEQ ID NO: 7319599 - DNA, 22 bp, Homo sapiens
tggggtgccgacagggagggca

SEQ ID NO: 7319600 - DNA, 20 bp, Homo sapiens
tgggtcctgcttcttcctga

SEQ ID NO: 7319601 - DNA, 20 bp, Homo sapiens
tgggtcctgcacattctcca

SEQ ID NO: 7319602 - DNA, 22 bp, Homo sapiens
tgggtccttgctaacttctatg

SEQ ID NO: 7319603 - DNA, 22 bp, Homo sapiens
tggggaaactatttccttgtcc

SEQ ID NO: 7319604 - DNA, 22 bp, Homo sapiens
tgggcttggaaagctgctgtgc

SEQ ID NO: 7319605 - DNA, 22 bp, Homo sapiens
tgggcttctgatgttgagtgct

SEQ ID NO: 7319606 - DNA, 22 bp, Homo sapiens
tgggcttctggagtggggcaga

SEQ ID NO: 7319607 - DNA, 22 bp, Homo sapiens
tgggctgtggagaggagctgga

SEQ ID NO: 7319608 - DNA, 22 bp, Homo sapiens
tgggcttaggtacctccctggt

SEQ ID NO: 7319609 - DNA, 22 bp, Homo sapiens
tgggcttcataattggtcctag

SEQ ID NO: 7319610 - DNA, 22 bp, Homo sapiens
tgggcttcctggagcctgtgct

SEQ ID NO: 7319611 - DNA, 23 bp, Homo sapiens
tgggcttctgagaaagcacctaa

SEQ ID NO: 7319612 - DNA, 19 bp, Homo sapiens
tgggcttccccagggcaga

SEQ ID NO: 7319613 - DNA, 22 bp, Homo sapiens
tgggccttgtcccctcagctgt

SEQ ID NO: 7319614 - DNA, 22 bp, Homo sapiens
tgggccttctaatctggtccct

SEQ ID NO: 7319615 - DNA, 22 bp, Homo sapiens
tgggctcagccttcatgtggcc

SEQ ID NO: 7319616 - DNA, 22 bp, Homo sapiens
tgggctctgaagtcagtctgct

SEQ ID NO: 7319617 - DNA, 22 bp, Homo sapiens
tgggctctcaaagtgcggcttg

SEQ ID NO: 7319618 - DNA, 19 bp, Homo sapiens
tgggcaggttcagtaatgg

SEQ ID NO: 7319619 - DNA, 22 bp, Homo sapiens
tgggcactcctggggacagctg

SEQ ID NO: 7319620 - DNA, 22 bp, Homo sapiens
tgggcagagagtagaggcaacg

SEQ ID NO: 7319621 - DNA, 22 bp, Homo sapiens
tgggcagagtcgtggggaatag

SEQ ID NO: 7319622 - DNA, 22 bp, Homo sapiens
tggttacacaagtgtgtgcagt

SEQ ID NO: 7319623 - DNA, 22 bp, Homo sapiens
tggttacacagcatgtggactt

SEQ ID NO: 7319624 - DNA, 22 bp, Homo sapiens
tggttaagtccagaaaggaagc

SEQ ID NO: 7319625 - DNA, 18 bp, Homo sapiens
tggttccttgaaggggca

SEQ ID NO: 7319626 - DNA, 22 bp, Homo sapiens
tggttcctggttcacttggcag

SEQ ID NO: 7319627 - DNA, 22 bp, Homo sapiens
tggtttctcccttcgcagtgag

SEQ ID NO: 7319628 - DNA, 22 bp, Homo sapiens
tggtttataacatgtctcatga

SEQ ID NO: 7319629 - DNA, 21 bp, Homo sapiens
tggtttatttcactcagcata

SEQ ID NO: 7319630 - DNA, 22 bp, Homo sapiens
tggtttatttctctgaaaggtt

SEQ ID NO: 7319631 - DNA, 23 bp, Homo sapiens
tggtttatgatatgtatgggaat

SEQ ID NO: 7319632 - DNA, 22 bp, Homo sapiens
tggtttatgctgttgcagctct

SEQ ID NO: 7319633 - DNA, 21 bp, Homo sapiens
tggtttatgtgcttagggtct

SEQ ID NO: 7319634 - DNA, 22 bp, Homo sapiens
tggtttatatcttgattctagt

SEQ ID NO: 7319635 - DNA, 22 bp, Homo sapiens
tggtttctttccactctccacc

SEQ ID NO: 7319636 - DNA, 22 bp, Homo sapiens
tgtacagggtgcagcgagcgga

SEQ ID NO: 7319637 - DNA, 22 bp, Homo sapiens
tgtacagtacatgtgtagtgat

SEQ ID NO: 7319638 - DNA, 22 bp, Homo sapiens
tgtaaattgaaggaaatttgtg

SEQ ID NO: 7319639 - DNA, 23 bp, Homo sapiens
tgtaaattttgtagtcacatttt

SEQ ID NO: 7319640 - DNA, 22 bp, Homo sapiens
tgtaattttctcaagtttctac

SEQ ID NO: 7319641 - DNA, 22 bp, Homo sapiens
tggtccttcgtggtgcagttct

SEQ ID NO: 7319642 - DNA, 22 bp, Homo sapiens
tggtcctttaagtctttctctg

SEQ ID NO: 7319643 - DNA, 23 bp, Homo sapiens
tggtctcacttggtaagatgaag

SEQ ID NO: 7319644 - DNA, 22 bp, Homo sapiens
tggtccttgtaggcatttgagc

SEQ ID NO: 7319645 - DNA, 22 bp, Homo sapiens
tggtccttgtggcttttcagta

SEQ ID NO: 7319646 - DNA, 22 bp, Homo sapiens
tggtccttctgtcttccgcacc

SEQ ID NO: 7319647 - DNA, 19 bp, Homo sapiens
tggtctctgtctctttgca

SEQ ID NO: 7319648 - DNA, 22 bp, Homo sapiens
tgtccaggcactgggactctag

SEQ ID NO: 7319649 - DNA, 22 bp, Homo sapiens
tgtcactttttataggtgttga

SEQ ID NO: 7319650 - DNA, 22 bp, Homo sapiens
tgtcaggtttcagttaatggtt

SEQ ID NO: 7319651 - DNA, 22 bp, Homo sapiens
tgtcaggtttctccaacttata

SEQ ID NO: 7319652 - DNA, 22 bp, Homo sapiens
tgtcaggttcagtgattttact

SEQ ID NO: 7319653 - DNA, 22 bp, Homo sapiens
tgtcaggttctttaattctgca

SEQ ID NO: 7319654 - DNA, 22 bp, Homo sapiens
tgtcaggttggttttcagagaa

SEQ ID NO: 7319655 - DNA, 22 bp, Homo sapiens
tgtcaggtctacaaaaatgctg

SEQ ID NO: 7319656 - DNA, 22 bp, Homo sapiens
tgtcaggtctctgtgatggtaa

SEQ ID NO: 7319657 - DNA, 15 bp, Homo sapiens
tgtcaggtgaatggt

SEQ ID NO: 7319658 - DNA, 22 bp, Homo sapiens
tgtcaggtgacacactaggagc

SEQ ID NO: 7319659 - DNA, 22 bp, Homo sapiens
tgtcaggtgacagtttttacca

SEQ ID NO: 7319660 - DNA, 22 bp, Homo sapiens
tgtcaggtgcagcttggatgca

SEQ ID NO: 7319661 - DNA, 22 bp, Homo sapiens
tgtcaggttcaaatcttggtcc

SEQ ID NO: 7319662 - DNA, 22 bp, Homo sapiens
tgtcaggtagtaggtagaaact

SEQ ID NO: 7319663 - DNA, 22 bp, Homo sapiens
tgtcaggtatgcaacagaatgc

SEQ ID NO: 7319664 - DNA, 22 bp, Homo sapiens
tgtcaggtcagacttggttttt

SEQ ID NO: 7319665 - DNA, 22 bp, Homo sapiens
tgtcaggtcagtatttgatgcc

SEQ ID NO: 7319666 - DNA, 22 bp, Homo sapiens
tgtcaggtcattgccatggaaa

SEQ ID NO: 7319667 - DNA, 22 bp, Homo sapiens
tgtcaggtctaaaatgggtctc

SEQ ID NO: 7319668 - DNA, 22 bp, Homo sapiens
tgtcaggtagagataatggggg

SEQ ID NO: 7319669 - DNA, 23 bp, Homo sapiens
tgtcaggtaaggaaggattcact

SEQ ID NO: 7319670 - DNA, 19 bp, Homo sapiens
tgtcagtagttgtctaggg

SEQ ID NO: 7319671 - DNA, 22 bp, Homo sapiens
tgtcatatgttgatgaaagaga

SEQ ID NO: 7319672 - DNA, 22 bp, Homo sapiens
tgtattttctgaagataatcaa

SEQ ID NO: 7319673 - DNA, 22 bp, Homo sapiens
tgtattttgagtccaatctcct

SEQ ID NO: 7319674 - DNA, 22 bp, Homo sapiens
tgtattttgtgaggatcactct

SEQ ID NO: 7319675 - DNA, 22 bp, Homo sapiens
tgtatgcataaaattatttaca

SEQ ID NO: 7319676 - DNA, 17 bp, Homo sapiens
tgtatgcatatgctttt

SEQ ID NO: 7319677 - DNA, 22 bp, Homo sapiens
tgtatgcaccattgtattacct

SEQ ID NO: 7319678 - DNA, 22 bp, Homo sapiens
ttcattctttgaatctgaggta

SEQ ID NO: 7319679 - DNA, 19 bp, Homo sapiens
ttcattctttctacttacc

SEQ ID NO: 7319680 - DNA, 19 bp, Homo sapiens
ttcattctttctacttacc

SEQ ID NO: 7319681 - DNA, 22 bp, Homo sapiens
ttcattcttttacatgtgaata

SEQ ID NO: 7319682 - DNA, 22 bp, Homo sapiens
ttcattcttgtctttgtatagt

SEQ ID NO: 7319683 - DNA, 22 bp, Homo sapiens
ttcattcatctctaaaatgcct

SEQ ID NO: 7319684 - DNA, 22 bp, Homo sapiens
ttcattcaggtgtatttatggg

SEQ ID NO: 7319685 - DNA, 22 bp, Homo sapiens
ttatttcttgtctatgtagcca

SEQ ID NO: 7319686 - DNA, 22 bp, Homo sapiens
ttatttctactattttgcctga

SEQ ID NO: 7319687 - DNA, 22 bp, Homo sapiens
ttacatttggctatgtcctcta

SEQ ID NO: 7319688 - DNA, 22 bp, Homo sapiens
ttacattttagttaacctgtga

SEQ ID NO: 7319689 - DNA, 22 bp, Homo sapiens
ttacatttcccccttggaggct

SEQ ID NO: 7319690 - DNA, 22 bp, Homo sapiens
ttacattcaaggaactcattct

SEQ ID NO: 7319691 - DNA, 22 bp, Homo sapiens
ttacattcaatttctagaggta

SEQ ID NO: 7319692 - DNA, 21 bp, Homo sapiens
ttacattcagaggagtggaag

SEQ ID NO: 7319693 - DNA, 22 bp, Homo sapiens
ttacattcagaaagatttgagt

SEQ ID NO: 7319694 - DNA, 22 bp, Homo sapiens
ttacattcttggaatcttgttt

SEQ ID NO: 7319695 - DNA, 22 bp, Homo sapiens
ttacattcttatctcagttatt

SEQ ID NO: 7319696 - DNA, 22 bp, Homo sapiens
ttacattcccagtgtgcagcat

SEQ ID NO: 7319697 - DNA, 22 bp, Homo sapiens
ttacattcattgaagtgattca

SEQ ID NO: 7319698 - DNA, 22 bp, Homo sapiens
ttacatgtttatgtggtacatg

SEQ ID NO: 7319699 - DNA, 22 bp, Homo sapiens
ttacaattgagtctattgtatg

SEQ ID NO: 7319700 - DNA, 22 bp, Homo sapiens
ttacagaggtatgtatgtctct

SEQ ID NO: 7319701 - DNA, 22 bp, Homo sapiens
ttacagagcctcattttagaga

SEQ ID NO: 7319702 - DNA, 17 bp, Homo sapiens
ttacagaggtaattaag

SEQ ID NO: 7319703 - DNA, 22 bp, Homo sapiens
ttacacaaaaataagatatggc

SEQ ID NO: 7319704 - DNA, 22 bp, Homo sapiens
ttaattaactagccaaccacta

SEQ ID NO: 7319705 - DNA, 21 bp, Homo sapiens
ttacaaagctacagatgttgc

SEQ ID NO: 7319706 - DNA, 22 bp, Homo sapiens
ttacaacagacacatattctaa

SEQ ID NO: 7319707 - DNA, 22 bp, Homo sapiens
ttacaacttgcagaggatgttg

SEQ ID NO: 7319708 - DNA, 22 bp, Homo sapiens
ttaataaagtatgaattggaaa

SEQ ID NO: 7319709 - DNA, 22 bp, Homo sapiens
ttatatgtttctgtttggaggc

SEQ ID NO: 7319710 - DNA, 22 bp, Homo sapiens
ttatatgtttctgtttggaggc

SEQ ID NO: 7319711 - DNA, 22 bp, Homo sapiens
ttagcatagccattgaaatatg

SEQ ID NO: 7319712 - DNA, 22 bp, Homo sapiens
ttagatttacaagcactgttta

SEQ ID NO: 7319713 - DNA, 22 bp, Homo sapiens
ttacattttgcacagatgtccc

SEQ ID NO: 7319714 - DNA, 22 bp, Homo sapiens
ttagaacatagcaacagaatta

SEQ ID NO: 7319715 - DNA, 18 bp, Homo sapiens
tgttaaatgaagatttgc

SEQ ID NO: 7319716 - DNA, 22 bp, Homo sapiens
ttaaaatttccccaccatgtat

SEQ ID NO: 7319717 - DNA, 22 bp, Homo sapiens
ttaaaatttccccaccatgtat

SEQ ID NO: 7319718 - DNA, 22 bp, Homo sapiens
tgtgtattaccattttacagct

SEQ ID NO: 7319719 - DNA, 22 bp, Homo sapiens
tgtggcgagaacattggaccat

SEQ ID NO: 7319720 - DNA, 22 bp, Homo sapiens
tgtggctccactccacattaat

SEQ ID NO: 7319721 - DNA, 22 bp, Homo sapiens
tgtctgagctggggcagacaga

SEQ ID NO: 7319722 - DNA, 22 bp, Homo sapiens
tgtctgagactgttttactttc

SEQ ID NO: 7319723 - DNA, 19 bp, Homo sapiens
tgtctgagtatgctgacaa

SEQ ID NO: 7319724 - DNA, 22 bp, Homo sapiens
tgtctgagtgtgcctgggcatt

SEQ ID NO: 7319725 - DNA, 22 bp, Homo sapiens
tgtctctttgggttcctcttgg

SEQ ID NO: 7319726 - DNA, 23 bp, Homo sapiens
tgtctaggatcagtcaggatgag

SEQ ID NO: 7319727 - DNA, 19 bp, Homo sapiens
tgtctggaagagctgcagg

SEQ ID NO: 7319728 - DNA, 22 bp, Homo sapiens
tgtcttcaggagtaaatatcat

SEQ ID NO: 7319729 - DNA, 22 bp, Homo sapiens
tgtctttaaaattaaacacatc

SEQ ID NO: 7319730 - DNA, 22 bp, Homo sapiens
tgtcttttacctaatgagctgg

SEQ ID NO: 7319731 - DNA, 22 bp, Homo sapiens
tgtcttttataactgacatata

SEQ ID NO: 7319732 - DNA, 22 bp, Homo sapiens
tgtcttttggagcatctttctt

SEQ ID NO: 7319733 - DNA, 22 bp, Homo sapiens
tgtgagttcttagaaagtcagt

SEQ ID NO: 7319734 - DNA, 22 bp, Homo sapiens
tgtgagttattttcaggagttt

SEQ ID NO: 7319735 - DNA, 22 bp, Homo sapiens
tgtgctcactctaaattaagat

SEQ ID NO: 7319736 - DNA, 22 bp, Homo sapiens
tgtggaaaaaccacaagtttgg

SEQ ID NO: 7319737 - DNA, 22 bp, Homo sapiens
tgtggaaaagaataagggagat

SEQ ID NO: 7319738 - DNA, 22 bp, Homo sapiens
tgtggaaagtggtctaagcaca

SEQ ID NO: 7319739 - DNA, 22 bp, Homo sapiens
tgtggaaagtcaagttccagga

SEQ ID NO: 7319740 - DNA, 22 bp, Homo sapiens
tgtggaaaagccccacaggact

SEQ ID NO: 7319741 - DNA, 20 bp, Homo sapiens
tgtgcaggagagtgaggctg

SEQ ID NO: 7319742 - DNA, 18 bp, Homo sapiens
tgtgcaatattaaccacc

SEQ ID NO: 7319743 - DNA, 22 bp, Homo sapiens
acagacagtatggtggggctga

SEQ ID NO: 7319744 - DNA, 22 bp, Homo sapiens
agagatcaaagcttgccaagta

SEQ ID NO: 7319745 - DNA, 19 bp, Homo sapiens
aatggacaggcaatagtct

SEQ ID NO: 7319746 - DNA, 22 bp, Homo sapiens
aatgtataaagtgttaataact

SEQ ID NO: 7319747 - DNA, 23 bp, Homo sapiens
agaatttcaaagtccagcacatt

SEQ ID NO: 7319748 - DNA, 22 bp, Homo sapiens
agaatttcaaaaggaagccagc

SEQ ID NO: 7319749 - DNA, 22 bp, Homo sapiens
aattttgtgtgggatcaaagga

SEQ ID NO: 7319750 - DNA, 21 bp, Homo sapiens
aattttgaaggaagattaagg

SEQ ID NO: 7319751 - DNA, 22 bp, Homo sapiens
agagggcataaaatagagcacg

SEQ ID NO: 7319752 - DNA, 22 bp, Homo sapiens
agattacagaagaataagtaga

SEQ ID NO: 7319753 - DNA, 22 bp, Homo sapiens
acaaaaaccgtggattcagcat

SEQ ID NO: 7319754 - DNA, 22 bp, Homo sapiens
acagtttacagggatttgagct

SEQ ID NO: 7319755 - DNA, 22 bp, Homo sapiens
acaggtaggttaaaatgtgtca

SEQ ID NO: 7319756 - DNA, 22 bp, Homo sapiens
acaggtagatacatacttctaa

SEQ ID NO: 7319757 - DNA, 22 bp, Homo sapiens
acagattttggtatttgcaatg

SEQ ID NO: 7319758 - DNA, 22 bp, Homo sapiens
acattcaaaaagcatctgtcac

SEQ ID NO: 7319759 - DNA, 22 bp, Homo sapiens
acattcaaccaatgtttgctat

SEQ ID NO: 7319760 - DNA, 22 bp, Homo sapiens
acattcaacatggctggtctag

SEQ ID NO: 7319761 - DNA, 22 bp, Homo sapiens
acattcaaaattaggttagttg

SEQ ID NO: 7319762 - DNA, 22 bp, Homo sapiens
acattcaaaattgtggtttaga

SEQ ID NO: 7319763 - DNA, 22 bp, Homo sapiens
acattcaaaatatttctgatgt

SEQ ID NO: 7319764 - DNA, 17 bp, Homo sapiens
acatgggctgagactcc

SEQ ID NO: 7319765 - DNA, 22 bp, Homo sapiens
aaggtttccagtgatattgtgg

SEQ ID NO: 7319766 - DNA, 22 bp, Homo sapiens
aaggttccctctctggaagcct

SEQ ID NO: 7319767 - DNA, 22 bp, Homo sapiens
aaggttcctctctccacccagc

SEQ ID NO: 7319768 - DNA, 19 bp, Homo sapiens
accttctgggaaacattcc

SEQ ID NO: 7319769 - DNA, 22 bp, Homo sapiens
actgagaagctcgcagtgatgc

SEQ ID NO: 7319770 - DNA, 21 bp, Homo sapiens
aagttttatgttgccatttgt

SEQ ID NO: 7319771 - DNA, 22 bp, Homo sapiens
aagttttaacaagtacttacta

SEQ ID NO: 7319772 - DNA, 22 bp, Homo sapiens
actcagttatcatgtgtccaca

SEQ ID NO: 7319773 - DNA, 21 bp, Homo sapiens
agaaaatggcgttttagattt

SEQ ID NO: 7319774 - DNA, 22 bp, Homo sapiens
aatatgcagcatgatgaagtaa

SEQ ID NO: 7319775 - DNA, 22 bp, Homo sapiens
aaagcaatgcccgttcattatc

SEQ ID NO: 7319776 - DNA, 22 bp, Homo sapiens
aaacatcaccattttacctaat

SEQ ID NO: 7319777 - DNA, 22 bp, Homo sapiens
aaacatcataggcatgcatgat

SEQ ID NO: 7319778 - DNA, 22 bp, Homo sapiens
aaatatgtaaccaaggtgaagt

SEQ ID NO: 7319779 - DNA, 22 bp, Homo sapiens
aaatatgtgatcagtgaataaa

SEQ ID NO: 7319780 - DNA, 22 bp, Homo sapiens
aaaaatgtcattatggaactga

SEQ ID NO: 7319781 - DNA, 22 bp, Homo sapiens
aaaagtattttgagcactttat

SEQ ID NO: 7319782 - DNA, 22 bp, Homo sapiens
aaaagtattttggatctcagat

SEQ ID NO: 7319783 - DNA, 22 bp, Homo sapiens
aaacaagagcttacatggctgc

SEQ ID NO: 7319784 - DNA, 22 bp, Homo sapiens
aaacaactcggcaactgctttt

SEQ ID NO: 7319785 - DNA, 22 bp, Homo sapiens
aaacagtcctctttatttagtc

SEQ ID NO: 7319786 - DNA, 22 bp, Homo sapiens
aaacagtctgatgccatctgcc

SEQ ID NO: 7319787 - DNA, 22 bp, Homo sapiens
aaagaagatggagacctgacta

SEQ ID NO: 7319788 - DNA, 22 bp, Homo sapiens
aagcaaattggatgtctgtgag

SEQ ID NO: 7319789 - DNA, 22 bp, Homo sapiens
aagaatgagctcaaagatctta

SEQ ID NO: 7319790 - DNA, 22 bp, Homo sapiens
aagaatgattacaaagcaacga

SEQ ID NO: 7319791 - DNA, 22 bp, Homo sapiens
aagacactaagctttcaggata

SEQ ID NO: 7319792 - DNA, 22 bp, Homo sapiens
aagaatgttcttgtagtcatga

SEQ ID NO: 7319793 - DNA, 22 bp, Homo sapiens
aacaaattagttgcaagactgg

SEQ ID NO: 7319794 - DNA, 22 bp, Homo sapiens
aacaaatgtgttttgtaattaa

SEQ ID NO: 7319795 - DNA, 22 bp, Homo sapiens
aacaattgacacttcattgtga

SEQ ID NO: 7319796 - DNA, 22 bp, Homo sapiens
aacacaaagaagctgcaggatc

SEQ ID NO: 7319797 - DNA, 22 bp, Homo sapiens
aacacatgggtgtttattgtac

SEQ ID NO: 7319798 - DNA, 22 bp, Homo sapiens
aacacatatttatatatgcaca

SEQ ID NO: 7319799 - DNA, 23 bp, Homo sapiens
aactgagataatgtatgtaaagc

SEQ ID NO: 7319800 - DNA, 22 bp, Homo sapiens
aactgaggtctccagtgcagaa

SEQ ID NO: 7319801 - DNA, 22 bp, Homo sapiens
aactcagatatgatagcaggag

SEQ ID NO: 7319802 - DNA, 22 bp, Homo sapiens
aactatgttaataagtttcatt

SEQ ID NO: 7319803 - DNA, 22 bp, Homo sapiens
aacatttcttctgaaactgagt

SEQ ID NO: 7319804 - DNA, 22 bp, Homo sapiens
aacatttctgagaatatcagtt

SEQ ID NO: 7319805 - DNA, 22 bp, Homo sapiens
aacatttcataacttgactttt

SEQ ID NO: 7319806 - DNA, 22 bp, Homo sapiens
aacatttcattggaagctatgt

SEQ ID NO: 7319807 - DNA, 22 bp, Homo sapiens
aacattctatgtgcattcagaa

SEQ ID NO: 7319808 - DNA, 22 bp, Homo sapiens
aacattctactgtactgcattg

SEQ ID NO: 7319809 - DNA, 19 bp, Homo sapiens
aagatttggtcattgataa

SEQ ID NO: 7319810 - DNA, 22 bp, Homo sapiens
aagcacatttggaaaacatgga

SEQ ID NO: 7319811 - DNA, 22 bp, Homo sapiens
acactagagagcaggcattccc

SEQ ID NO: 7319812 - DNA, 22 bp, Homo sapiens
aagagtttaattttgtctagac

SEQ ID NO: 7319813 - DNA, 22 bp, Homo sapiens
aagacatttatttgaatcaatt

SEQ ID NO: 7319814 - DNA, 22 bp, Homo sapiens
aatgtctttaaagtgcaataga

SEQ ID NO: 7319815 - DNA, 22 bp, Homo sapiens
aatgtcaacacaagagaaatgc

SEQ ID NO: 7319816 - DNA, 22 bp, Homo sapiens
aatgtattctgggaaaatgtta

SEQ ID NO: 7319817 - DNA, 22 bp, Homo sapiens
aatgttattacacttgtgaaat

SEQ ID NO: 7319818 - DNA, 22 bp, Homo sapiens
aactttacttgaaagaacatgt

SEQ ID NO: 7319819 - DNA, 22 bp, Homo sapiens
aatgttatgtggttcaacttaa

SEQ ID NO: 7319820 - DNA, 22 bp, Homo sapiens
aattcaaattacaatagttgtt

SEQ ID NO: 7319821 - DNA, 22 bp, Homo sapiens
aattcaaagactagaattttgc

SEQ ID NO: 7319822 - DNA, 17 bp, Homo sapiens
aagacaagacaaatgca

SEQ ID NO: 7319823 - DNA, 22 bp, Homo sapiens
aagacaagccttgtttttctgc

SEQ ID NO: 7319824 - DNA, 22 bp, Homo sapiens
aagacaatcctggacagtcagc

SEQ ID NO: 7319825 - DNA, 22 bp, Homo sapiens
aagacaatgcattactaagaag

SEQ ID NO: 7319826 - DNA, 22 bp, Homo sapiens
acaacaaaatcactagtcttcc

SEQ ID NO: 7319827 - DNA, 22 bp, Homo sapiens
acaagaaaggtaggattcaggt

SEQ ID NO: 7319828 - DNA, 22 bp, Homo sapiens
aagtcaatcaagggtgtaggca

SEQ ID NO: 7319829 - DNA, 21 bp, Homo sapiens
aagtcaatacagataagtctt

SEQ ID NO: 7319830 - DNA, 22 bp, Homo sapiens
aatcactttgcactcttatttg

SEQ ID NO: 7319831 - DNA, 22 bp, Homo sapiens
aactcatttgcatttttcctgt

SEQ ID NO: 7319832 - DNA, 22 bp, Homo sapiens
aacatttcagcacctgattcct

SEQ ID NO: 7319833 - DNA, 22 bp, Homo sapiens
aatatttgcatcattagctatt

SEQ ID NO: 7319834 - DNA, 22 bp, Homo sapiens
aacattgccatggttaatttta

SEQ ID NO: 7319835 - DNA, 22 bp, Homo sapiens
aacattctttagctcttcctgc

SEQ ID NO: 7319836 - DNA, 22 bp, Homo sapiens
aacattcttcaaatatcactct

SEQ ID NO: 7319837 - DNA, 22 bp, Homo sapiens
aaatttcaagcaaagtagctat

SEQ ID NO: 7319838 - DNA, 22 bp, Homo sapiens
aacaagcagatgcaatgcactt

SEQ ID NO: 7319839 - DNA, 22 bp, Homo sapiens
aacaatcaagtttctaaatgac

SEQ ID NO: 7319840 - DNA, 22 bp, Homo sapiens
aacaatcaagtttctaaatgac

SEQ ID NO: 7319841 - DNA, 22 bp, Homo sapiens
aaggggagatgtcatgggccct

SEQ ID NO: 7319842 - DNA, 22 bp, Homo sapiens
aagctgtagaggcagtacattt

SEQ ID NO: 7319843 - DNA, 22 bp, Homo sapiens
aaattataggtgccaccttgga

SEQ ID NO: 7319844 - DNA, 22 bp, Homo sapiens
aaggagaaggcatcattcaagt

SEQ ID NO: 7319845 - DNA, 22 bp, Homo sapiens
aaggactgaataattctctttc

SEQ ID NO: 7319846 - DNA, 22 bp, Homo sapiens
agctaggaaattgaggctgaga

SEQ ID NO: 7319847 - DNA, 22 bp, Homo sapiens
cagcaaatactactagttttta

SEQ ID NO: 7319848 - DNA, 18 bp, Homo sapiens
cagagctcctggatgcag

SEQ ID NO: 7319849 - DNA, 22 bp, Homo sapiens
cagagaaagggtgaattccttc

SEQ ID NO: 7319850 - DNA, 17 bp, Homo sapiens
agcccccactcccaagt

SEQ ID NO: 7319851 - DNA, 22 bp, Homo sapiens
agcccccaaaagtgcttatgat

SEQ ID NO: 7319852 - DNA, 22 bp, Homo sapiens
agcccccacgtttcctgggtcc

SEQ ID NO: 7319853 - DNA, 22 bp, Homo sapiens
agcaggttgttttgtggccagg

SEQ ID NO: 7319854 - DNA, 22 bp, Homo sapiens
cactttactatctataaaataa

SEQ ID NO: 7319855 - DNA, 22 bp, Homo sapiens
agcagggaggcggtgtgctggc

SEQ ID NO: 7319856 - DNA, 22 bp, Homo sapiens
agcaggacaatatgggatcagg

SEQ ID NO: 7319857 - DNA, 18 bp, Homo sapiens
agcaggactgtggggtgg

SEQ ID NO: 7319858 - DNA, 22 bp, Homo sapiens
agcagggctctgtggagggtgg

SEQ ID NO: 7319859 - DNA, 23 bp, Homo sapiens
caccactttctccttctccttgg

SEQ ID NO: 7319860 - DNA, 22 bp, Homo sapiens
cacatttaatcctttataagta

SEQ ID NO: 7319861 - DNA, 22 bp, Homo sapiens
agcagggcaggtaaggatcaga

SEQ ID NO: 7319862 - DNA, 22 bp, Homo sapiens
agcagggcaaagtcaggctaac

SEQ ID NO: 7319863 - DNA, 22 bp, Homo sapiens
agagaaggtcactaaggaccca

SEQ ID NO: 7319864 - DNA, 22 bp, Homo sapiens
agacttcaaagcctttgttcat

SEQ ID NO: 7319865 - DNA, 22 bp, Homo sapiens
agagcccctggtggagtgagaa

SEQ ID NO: 7319866 - DNA, 22 bp, Homo sapiens
agagcccctcggtggaggggtc

SEQ ID NO: 7319867 - DNA, 22 bp, Homo sapiens
agagattgctagctggctttaa

SEQ ID NO: 7319868 - DNA, 19 bp, Homo sapiens
atgaaggcactgagtggga

SEQ ID NO: 7319869 - DNA, 22 bp, Homo sapiens
atgaaggcaagactgaggtgtg

SEQ ID NO: 7319870 - DNA, 19 bp, Homo sapiens
atgaagccccagggcccgt

SEQ ID NO: 7319871 - DNA, 22 bp, Homo sapiens
atgaagccagaagaagactggc

SEQ ID NO: 7319872 - DNA, 22 bp, Homo sapiens
atgaagccatctcctccccttc

SEQ ID NO: 7319873 - DNA, 21 bp, Homo sapiens
agaccttttctcagataactt

SEQ ID NO: 7319874 - DNA, 22 bp, Homo sapiens
agacctttatttcatgatagga

SEQ ID NO: 7319875 - DNA, 22 bp, Homo sapiens
agactgtaattgacatgtcagc

SEQ ID NO: 7319876 - DNA, 22 bp, Homo sapiens
agagtgatgggttgtgctgacc

SEQ ID NO: 7319877 - DNA, 22 bp, Homo sapiens
agagctggctgtgggtgacttt

SEQ ID NO: 7319878 - DNA, 22 bp, Homo sapiens
attacagtaaatgctacaggca

SEQ ID NO: 7319879 - DNA, 22 bp, Homo sapiens
attacagtaacagctacaatgc

SEQ ID NO: 7319880 - DNA, 22 bp, Homo sapiens
attacagtaacagctacaatgc

SEQ ID NO: 7319881 - DNA, 22 bp, Homo sapiens
attttagcaaatgcaagatgga

SEQ ID NO: 7319882 - DNA, 22 bp, Homo sapiens
agcaaatgggtttatatttgac

SEQ ID NO: 7319883 - DNA, 22 bp, Homo sapiens
agcaacagccctgtttcattag

SEQ ID NO: 7319884 - DNA, 22 bp, Homo sapiens
caaacattttgagtggtttctg

SEQ ID NO: 7319885 - DNA, 22 bp, Homo sapiens
caaagcaccacaaaccaggtga

SEQ ID NO: 7319886 - DNA, 22 bp, Homo sapiens
caaagcaagggctgaagactcc

SEQ ID NO: 7319887 - DNA, 22 bp, Homo sapiens
caaagcaaggctcagtttgaac

SEQ ID NO: 7319888 - DNA, 22 bp, Homo sapiens
agcaacaggcataatgtgttga

SEQ ID NO: 7319889 - DNA, 22 bp, Homo sapiens
attggtagttttgtatttctct

SEQ ID NO: 7319890 - DNA, 21 bp, Homo sapiens
agatcattcttctgagcactt

SEQ ID NO: 7319891 - DNA, 22 bp, Homo sapiens
agatgattatgatagcactgtt

SEQ ID NO: 7319892 - DNA, 20 bp, Homo sapiens
acatgaaaggaaacaggaaa

SEQ ID NO: 7319893 - DNA, 22 bp, Homo sapiens
aggcatggggctgcagtcaggt

SEQ ID NO: 7319894 - DNA, 22 bp, Homo sapiens
acattcaagtttctgctcatgg

SEQ ID NO: 7319895 - DNA, 22 bp, Homo sapiens
acattcaaggcagcactgagtg

SEQ ID NO: 7319896 - DNA, 22 bp, Homo sapiens
acattcaaggccttctgacaca

SEQ ID NO: 7319897 - DNA, 22 bp, Homo sapiens
acattcattccaggtcagtcag

SEQ ID NO: 7319898 - DNA, 22 bp, Homo sapiens
acattcaagatgcattcactta

SEQ ID NO: 7319899 - DNA, 22 bp, Homo sapiens
acattctagatatgttatattt

SEQ ID NO: 7319900 - DNA, 22 bp, Homo sapiens
acattctaacattgtacagata

SEQ ID NO: 7319901 - DNA, 18 bp, Homo sapiens
aggcttcccaggcaggcc

SEQ ID NO: 7319902 - DNA, 22 bp, Homo sapiens
acccagagcactgggtgtgggc

SEQ ID NO: 7319903 - DNA, 22 bp, Homo sapiens
accctggaggtggaggtgcagt

SEQ ID NO: 7319904 - DNA, 22 bp, Homo sapiens
accctggaggtctacagtgcag

SEQ ID NO: 7319905 - DNA, 22 bp, Homo sapiens
accctggagcttttctggccct

SEQ ID NO: 7319906 - DNA, 22 bp, Homo sapiens
accctggactggggctgaggct

SEQ ID NO: 7319907 - DNA, 22 bp, Homo sapiens
accctggacatcttgtcatagc

SEQ ID NO: 7319908 - DNA, 23 bp, Homo sapiens
aggcttcctatcttagagctggg

SEQ ID NO: 7319909 - DNA, 22 bp, Homo sapiens
aggaaactgggtatggttatac

SEQ ID NO: 7319910 - DNA, 22 bp, Homo sapiens
aggaaactgatgttttttacaa

SEQ ID NO: 7319911 - DNA, 22 bp, Homo sapiens
aggaaactaacttatctttata

SEQ ID NO: 7319912 - DNA, 21 bp, Homo sapiens
agaaaaacacgatataagccc

SEQ ID NO: 7319913 - DNA, 22 bp, Homo sapiens
atattttggggtgatgtgcatc

SEQ ID NO: 7319914 - DNA, 22 bp, Homo sapiens
atattttgtaacttggaatagg

SEQ ID NO: 7319915 - DNA, 22 bp, Homo sapiens
agaaatcaggaacagtaaggag

SEQ ID NO: 7319916 - DNA, 22 bp, Homo sapiens
agaagccaagaacagacagtgc

SEQ ID NO: 7319917 - DNA, 22 bp, Homo sapiens
atctctttgatggctcctgtga

SEQ ID NO: 7319918 - DNA, 22 bp, Homo sapiens
agaagccacaggaaagcagctt

SEQ ID NO: 7319919 - DNA, 22 bp, Homo sapiens
agaaatctgactgctgtgcaca

SEQ ID NO: 7319920 - DNA, 22 bp, Homo sapiens
actgggctccagatgtgatacg

SEQ ID NO: 7319921 - DNA, 22 bp, Homo sapiens
actgggctcccaggcttgtcat

SEQ ID NO: 7319922 - DNA, 22 bp, Homo sapiens
actgggctccaaggacctggag

SEQ ID NO: 7319923 - DNA, 22 bp, Homo sapiens
actgggctcataatgtcataga

SEQ ID NO: 7319924 - DNA, 22 bp, Homo sapiens
actgggctcaagtgattgtcct

SEQ ID NO: 7319925 - DNA, 22 bp, Homo sapiens
actgggctagagtggaagctgg

SEQ ID NO: 7319926 - DNA, 21 bp, Homo sapiens
actgggctagcctgacttctg

SEQ ID NO: 7319927 - DNA, 22 bp, Homo sapiens
actgggctaccccaccattacc

SEQ ID NO: 7319928 - DNA, 22 bp, Homo sapiens
acttaaagtagttttactgtgg

SEQ ID NO: 7319929 - DNA, 22 bp, Homo sapiens
atacatcacctatatattcaca

SEQ ID NO: 7319930 - DNA, 22 bp, Homo sapiens
actttacacatcttttctcatt

SEQ ID NO: 7319931 - DNA, 21 bp, Homo sapiens
actttacaatttacatagtga

SEQ ID NO: 7319932 - DNA, 22 bp, Homo sapiens
actttacaatatcctgtgactt

SEQ ID NO: 7319933 - DNA, 22 bp, Homo sapiens
actttacaaactcctcactgtt

SEQ ID NO: 7319934 - DNA, 22 bp, Homo sapiens
ataatttttgtttgatgtccaa

SEQ ID NO: 7319935 - DNA, 22 bp, Homo sapiens
acttctctcattcagacatagc

SEQ ID NO: 7319936 - DNA, 22 bp, Homo sapiens
actgggcatcccatggcagagc

SEQ ID NO: 7319937 - DNA, 22 bp, Homo sapiens
actctgaaatagaggctggtgg

SEQ ID NO: 7319938 - DNA, 22 bp, Homo sapiens
actctgaactccaggaggctca

SEQ ID NO: 7319939 - DNA, 22 bp, Homo sapiens
actgagaggtgatagtgacatt

SEQ ID NO: 7319940 - DNA, 22 bp, Homo sapiens
actgcactcctgcctgggtaac

SEQ ID NO: 7319941 - DNA, 19 bp, Homo sapiens
aggtagctcagactcaaag

SEQ ID NO: 7319942 - DNA, 22 bp, Homo sapiens
actccctgtacttgcctctctt

SEQ ID NO: 7319943 - DNA, 22 bp, Homo sapiens
ccagaacacagtggaagaatat

SEQ ID NO: 7319944 - DNA, 22 bp, Homo sapiens
ccatttaacacagagttttcca

SEQ ID NO: 7319945 - DNA, 22 bp, Homo sapiens
agggccttgctgtctgaagctg

SEQ ID NO: 7319946 - DNA, 22 bp, Homo sapiens
aggggagagttaatgtgaatgt

SEQ ID NO: 7319947 - DNA, 23 bp, Homo sapiens
aggggcagcaagttttggtgtta

SEQ ID NO: 7319948 - DNA, 22 bp, Homo sapiens
agctgggactcaactgtctggg

SEQ ID NO: 7319949 - DNA, 22 bp, Homo sapiens
agctgggctgatgactcatgtt

SEQ ID NO: 7319950 - DNA, 21 bp, Homo sapiens
agctgaaaagttgtttacaag

SEQ ID NO: 7319951 - DNA, 22 bp, Homo sapiens
caggtcccgccccgggctgacc

SEQ ID NO: 7319952 - DNA, 22 bp, Homo sapiens
cagggtgtgaacagtgtaaaac

SEQ ID NO: 7319953 - DNA, 22 bp, Homo sapiens
cagggtttcaccatgttagcag

SEQ ID NO: 7319954 - DNA, 22 bp, Homo sapiens
aggaagaggtgtgcaatggtgt

SEQ ID NO: 7319955 - DNA, 21 bp, Homo sapiens
ccaaagaactgccatttgtca

SEQ ID NO: 7319956 - DNA, 22 bp, Homo sapiens
ccaaacaaatccccattcttag

SEQ ID NO: 7319957 - DNA, 22 bp, Homo sapiens
ccaaaatattagtgcttaagta

SEQ ID NO: 7319958 - DNA, 22 bp, Homo sapiens
ccaaaataacagcccaattcac

SEQ ID NO: 7319959 - DNA, 22 bp, Homo sapiens
aggcagctggcagcacccaggg

SEQ ID NO: 7319960 - DNA, 22 bp, Homo sapiens
aggcagctttctggtgcaccat

SEQ ID NO: 7319961 - DNA, 22 bp, Homo sapiens
aggcactgaaaggtggccagag

SEQ ID NO: 7319962 - DNA, 22 bp, Homo sapiens
aggcactgaatatccagtaaaa

SEQ ID NO: 7319963 - DNA, 22 bp, Homo sapiens
aggcactgaagtggtaaatgta

SEQ ID NO: 7319964 - DNA, 22 bp, Homo sapiens
aggcactgaaggaagcttgcgc

SEQ ID NO: 7319965 - DNA, 22 bp, Homo sapiens
aggcactgaagaactctttttg

SEQ ID NO: 7319966 - DNA, 22 bp, Homo sapiens
aggcactgattctgttttccat

SEQ ID NO: 7319967 - DNA, 22 bp, Homo sapiens
aggcactgagaggctgtgttgc

SEQ ID NO: 7319968 - DNA, 22 bp, Homo sapiens
aggcactgattctcagagttac

SEQ ID NO: 7319969 - DNA, 22 bp, Homo sapiens
aggcactttctgtatgctagtt

SEQ ID NO: 7319970 - DNA, 22 bp, Homo sapiens
aggcactgacctgcttccttga

SEQ ID NO: 7319971 - DNA, 22 bp, Homo sapiens
aggcactgactcaagggagcca

SEQ ID NO: 7319972 - DNA, 22 bp, Homo sapiens
aggcactgacaattctggactg

SEQ ID NO: 7319973 - DNA, 22 bp, Homo sapiens
aggcactgacagattctgtgtc

SEQ ID NO: 7319974 - DNA, 23 bp, Homo sapiens
aggcactgaatgtgtcagtgagt

SEQ ID NO: 7319975 - DNA, 23 bp, Homo sapiens
aggatcctggtacaggagcagag

SEQ ID NO: 7319976 - DNA, 22 bp, Homo sapiens
aggacaaaggaccagatctgga

SEQ ID NO: 7319977 - DNA, 22 bp, Homo sapiens
cagttcaaagttaagcagcagt

SEQ ID NO: 7319978 - DNA, 22 bp, Homo sapiens
catcacttttaaaggtgatcga

SEQ ID NO: 7319979 - DNA, 19 bp, Homo sapiens
agtagacattttcatgttt

SEQ ID NO: 7319980 - DNA, 22 bp, Homo sapiens
agtaggcatttaataaacatga

SEQ ID NO: 7319981 - DNA, 22 bp, Homo sapiens
agtaggcagaagtggcattcgg

SEQ ID NO: 7319982 - DNA, 22 bp, Homo sapiens
agtaggcagggaataatacaaa

SEQ ID NO: 7319983 - DNA, 22 bp, Homo sapiens
agtaggcatagaaagaagcacc

SEQ ID NO: 7319984 - DNA, 22 bp, Homo sapiens
agtaggcatcccacagtctcct

SEQ ID NO: 7319985 - DNA, 22 bp, Homo sapiens
ctatgaccccagcatgaataag

SEQ ID NO: 7319986 - DNA, 22 bp, Homo sapiens
ctatattctggaatgtccattt

SEQ ID NO: 7319987 - DNA, 22 bp, Homo sapiens
aggtcaggtatcagcaggtatt

SEQ ID NO: 7319988 - DNA, 21 bp, Homo sapiens
cctgggagaattgggtgtggc

SEQ ID NO: 7319989 - DNA, 22 bp, Homo sapiens
cctgggaggctgtgggtctgct

SEQ ID NO: 7319990 - DNA, 22 bp, Homo sapiens
aggtaagcctggaggcttctat

SEQ ID NO: 7319991 - DNA, 22 bp, Homo sapiens
aggtaagcatggtggctgctgt

SEQ ID NO: 7319992 - DNA, 22 bp, Homo sapiens
cctgggctttgagggcaggatg

SEQ ID NO: 7319993 - DNA, 22 bp, Homo sapiens
aggtcctggtgaccatggagtt

SEQ ID NO: 7319994 - DNA, 22 bp, Homo sapiens
agtggcatcaactttatctgta

SEQ ID NO: 7319995 - DNA, 18 bp, Homo sapiens
agtggaaaacaaatacac

SEQ ID NO: 7319996 - DNA, 22 bp, Homo sapiens
agtggaaagaaccctggactca

SEQ ID NO: 7319997 - DNA, 22 bp, Homo sapiens
agtctttatttagagttaggac

SEQ ID NO: 7319998 - DNA, 22 bp, Homo sapiens
agtgaggctaataggcaatggt

SEQ ID NO: 7319999 - DNA, 22 bp, Homo sapiens
agtgtggattggctggagctat

SEQ ID NO: 7320000 - DNA, 22 bp, Homo sapiens
agtgtggatttagttgtgcttt

SEQ ID NO: 7320001 - DNA, 22 bp, Homo sapiens
agttaacacaagtaagattcca

SEQ ID NO: 7320002 - DNA, 22 bp, Homo sapiens
atacacatatcaggtgtataca

SEQ ID NO: 7320003 - DNA, 21 bp, Homo sapiens
atacacatacacataaatgtg

SEQ ID NO: 7320004 - DNA, 22 bp, Homo sapiens
atacacatgcacacatgtgtgt

SEQ ID NO: 7320005 - DNA, 22 bp, Homo sapiens
atacacatatgtgtgtatatgt

SEQ ID NO: 7320006 - DNA, 17 bp, Homo sapiens
agttttgatataatggc

SEQ ID NO: 7320007 - DNA, 22 bp, Homo sapiens
agttctctttagctcatatggt

SEQ ID NO: 7320008 - DNA, 22 bp, Homo sapiens
agttctctggctcctttccaga

SEQ ID NO: 7320009 - DNA, 22 bp, Homo sapiens
ataaagagtctgggaggcccac

SEQ ID NO: 7320010 - DNA, 22 bp, Homo sapiens
ctggcctcacctcagacttact

SEQ ID NO: 7320011 - DNA, 22 bp, Homo sapiens
atacatgtgtccctgatttatt

SEQ ID NO: 7320012 - DNA, 22 bp, Homo sapiens
atacatgtcatcatatgtttgt

SEQ ID NO: 7320013 - DNA, 22 bp, Homo sapiens
atacatgtcatcatatgtttgt

SEQ ID NO: 7320014 - DNA, 22 bp, Homo sapiens
atatacaggtggtatgtgtaaa

SEQ ID NO: 7320015 - DNA, 22 bp, Homo sapiens
atatacagttttacagggtttc

SEQ ID NO: 7320016 - DNA, 22 bp, Homo sapiens
atagttttatagatattgtgta

SEQ ID NO: 7320017 - DNA, 22 bp, Homo sapiens
ctggcctttttagaaaacagct

SEQ ID NO: 7320018 - DNA, 22 bp, Homo sapiens
ctggcctttcgtgagagctggg

SEQ ID NO: 7320019 - DNA, 22 bp, Homo sapiens
atagtttgggcaaagaggacct

SEQ ID NO: 7320020 - DNA, 22 bp, Homo sapiens
ctggctcacaggtgagatgcat

SEQ ID NO: 7320021 - DNA, 22 bp, Homo sapiens
ctggctcaataaatattagctg

SEQ ID NO: 7320022 - DNA, 22 bp, Homo sapiens
ctggctcaatttgtactgctgt

SEQ ID NO: 7320023 - DNA, 22 bp, Homo sapiens
atctgtggctggtgagaggcag

SEQ ID NO: 7320024 - DNA, 22 bp, Homo sapiens
atctgtggaaattggcaagtgc

SEQ ID NO: 7320025 - DNA, 22 bp, Homo sapiens
atctgtcttttattcatgagct

SEQ ID NO: 7320026 - DNA, 22 bp, Homo sapiens
atctgtcttccaccacacatcc

SEQ ID NO: 7320027 - DNA, 22 bp, Homo sapiens
atctgtcttgccttgcatattt

SEQ ID NO: 7320028 - DNA, 23 bp, Homo sapiens
atccatgtgagaatagactagca

SEQ ID NO: 7320029 - DNA, 22 bp, Homo sapiens
atcatacatgtaactaagtaaa

SEQ ID NO: 7320030 - DNA, 18 bp, Homo sapiens
ctgggtctccaggctgcc

SEQ ID NO: 7320031 - DNA, 19 bp, Homo sapiens
ctggggctttggtactgcc

SEQ ID NO: 7320032 - DNA, 22 bp, Homo sapiens
atcacacagagcattaggggcc

SEQ ID NO: 7320033 - DNA, 22 bp, Homo sapiens
atcagtttgtatatgaaacact

SEQ ID NO: 7320034 - DNA, 22 bp, Homo sapiens
atcagttttgggggacatactg

SEQ ID NO: 7320035 - DNA, 22 bp, Homo sapiens
atcagtttggaacattcaggcc

SEQ ID NO: 7320036 - DNA, 22 bp, Homo sapiens
atcagtttctaccatgtggaat

SEQ ID NO: 7320037 - DNA, 22 bp, Homo sapiens
atcataaaccactttgtaatct

SEQ ID NO: 7320038 - DNA, 22 bp, Homo sapiens
atcataaaccactttgtaatct

SEQ ID NO: 7320039 - DNA, 22 bp, Homo sapiens
gcagggattgtcaatgctgctc

SEQ ID NO: 7320040 - DNA, 22 bp, Homo sapiens
attggttactcaatttgactga

SEQ ID NO: 7320041 - DNA, 22 bp, Homo sapiens
attggttagaagtagtatgact

SEQ ID NO: 7320042 - DNA, 22 bp, Homo sapiens
attggttagagtaacacctatt

SEQ ID NO: 7320043 - DNA, 22 bp, Homo sapiens
attggttaagacgcatcatgct

SEQ ID NO: 7320044 - DNA, 22 bp, Homo sapiens
attggttaccactttaaatctt

SEQ ID NO: 7320045 - DNA, 22 bp, Homo sapiens
attggttacggcttttcaaatt

SEQ ID NO: 7320046 - DNA, 22 bp, Homo sapiens
attggttaactctgtgtgtcaa

SEQ ID NO: 7320047 - DNA, 22 bp, Homo sapiens
atttaaatgcttaagagggttt

SEQ ID NO: 7320048 - DNA, 22 bp, Homo sapiens
attgtaattttagagaaagtgg

SEQ ID NO: 7320049 - DNA, 22 bp, Homo sapiens
gcaacagcattctcattgacat

SEQ ID NO: 7320050 - DNA, 22 bp, Homo sapiens
gcaacagcccaggttctgtgtg

SEQ ID NO: 7320051 - DNA, 22 bp, Homo sapiens
gcaaacaagctgcctgaagatt

SEQ ID NO: 7320052 - DNA, 22 bp, Homo sapiens
gcaaacaaggacatacatcctg

SEQ ID NO: 7320053 - DNA, 22 bp, Homo sapiens
gatttctgggctttatttcaga

SEQ ID NO: 7320054 - DNA, 22 bp, Homo sapiens
atgtttctacagcgtccactga

SEQ ID NO: 7320055 - DNA, 20 bp, Homo sapiens
gcaaaataggctctgttggt

SEQ ID NO: 7320056 - DNA, 22 bp, Homo sapiens
gcactggtgtgaaacagtagat

SEQ ID NO: 7320057 - DNA, 22 bp, Homo sapiens
atttaccagctgtgcactgata

SEQ ID NO: 7320058 - DNA, 22 bp, Homo sapiens
atttacagtttagcatttcaag

SEQ ID NO: 7320059 - DNA, 22 bp, Homo sapiens
atttacataatagactttaggt

SEQ ID NO: 7320060 - DNA, 22 bp, Homo sapiens
attttgaaaccaagttatttcc

SEQ ID NO: 7320061 - DNA, 22 bp, Homo sapiens
attttgaaaagcatttgagtaa

SEQ ID NO: 7320062 - DNA, 22 bp, Homo sapiens
atttgcagattctgtcaggttt

SEQ ID NO: 7320063 - DNA, 22 bp, Homo sapiens
atttgcagttattgttcatgaa

SEQ ID NO: 7320064 - DNA, 22 bp, Homo sapiens
atttgcaggtgtcgattagtct

SEQ ID NO: 7320065 - DNA, 21 bp, Homo sapiens
atttgcattaaaatattacgc

SEQ ID NO: 7320066 - DNA, 22 bp, Homo sapiens
atttgcatttacatagcataga

SEQ ID NO: 7320067 - DNA, 20 bp, Homo sapiens
caaatccctgctctgtgctg

SEQ ID NO: 7320068 - DNA, 22 bp, Homo sapiens
caaattcacatgattgcttctg

SEQ ID NO: 7320069 - DNA, 22 bp, Homo sapiens
caaattcaaatttcatcagtgt

SEQ ID NO: 7320070 - DNA, 22 bp, Homo sapiens
caaattcaatgaacatgtttaa

SEQ ID NO: 7320071 - DNA, 22 bp, Homo sapiens
gctcaaagaatattcagaatga

SEQ ID NO: 7320072 - DNA, 23 bp, Homo sapiens
gctcaggtggctcagggactgat

SEQ ID NO: 7320073 - DNA, 18 bp, Homo sapiens
gctcaggtatagacaggg

SEQ ID NO: 7320074 - DNA, 22 bp, Homo sapiens
atgtttcatgactgagcaaaat

SEQ ID NO: 7320075 - DNA, 22 bp, Homo sapiens
atgtttcaccagcaaattacct

SEQ ID NO: 7320076 - DNA, 22 bp, Homo sapiens
gaggcattaaagggaatcttct

SEQ ID NO: 7320077 - DNA, 22 bp, Homo sapiens
atgtcacatggtcacctctagc

SEQ ID NO: 7320078 - DNA, 22 bp, Homo sapiens
gaggtagccacagatagagact

SEQ ID NO: 7320079 - DNA, 22 bp, Homo sapiens
gaggtagcgagtggacagtgca

SEQ ID NO: 7320080 - DNA, 22 bp, Homo sapiens
gagaggaagccttctgtacttg

SEQ ID NO: 7320081 - DNA, 22 bp, Homo sapiens
gagaggtggtgaggacttgtct

SEQ ID NO: 7320082 - DNA, 22 bp, Homo sapiens
gagaggtgaaatagttgtccgg

SEQ ID NO: 7320083 - DNA, 22 bp, Homo sapiens
gagcagggagacaactctggtg

SEQ ID NO: 7320084 - DNA, 22 bp, Homo sapiens
gagcagggccacttctgtacct

SEQ ID NO: 7320085 - DNA, 22 bp, Homo sapiens
atgtaatttgccctcaagttaa

SEQ ID NO: 7320086 - DNA, 22 bp, Homo sapiens
atgtaattgtagcaaaatgatg

SEQ ID NO: 7320087 - DNA, 22 bp, Homo sapiens
atgtacaaaatgttttgaaatg

SEQ ID NO: 7320088 - DNA, 22 bp, Homo sapiens
atgctttcttctttcctgtaag

SEQ ID NO: 7320089 - DNA, 22 bp, Homo sapiens
gaccctccactcactgctgtgt

SEQ ID NO: 7320090 - DNA, 22 bp, Homo sapiens
gacaggaaatatgggggttgtt

SEQ ID NO: 7320091 - DNA, 20 bp, Homo sapiens
atgcctctaattttgcaaac

SEQ ID NO: 7320092 - DNA, 22 bp, Homo sapiens
atgcatataaggcacatgtatt

SEQ ID NO: 7320093 - DNA, 22 bp, Homo sapiens
atgcatatatacatacacagtc

SEQ ID NO: 7320094 - DNA, 22 bp, Homo sapiens
gaaaactaacggaaaagttagg

SEQ ID NO: 7320095 - DNA, 22 bp, Homo sapiens
atgcaatgttacagaatgtact

SEQ ID NO: 7320096 - DNA, 23 bp, Homo sapiens
gaacattcattggttgctttaga

SEQ ID NO: 7320097 - DNA, 22 bp, Homo sapiens
gaacattcacagactcaccatt

SEQ ID NO: 7320098 - DNA, 22 bp, Homo sapiens
gaactttaaaacaaagtacagt

SEQ ID NO: 7320099 - DNA, 22 bp, Homo sapiens
atgaggcatctgcagtcactag

SEQ ID NO: 7320100 - DNA, 22 bp, Homo sapiens
atgaggcatgtgaggagaaggg

SEQ ID NO: 7320101 - DNA, 22 bp, Homo sapiens
ggagagtggattccagctgtat

SEQ ID NO: 7320102 - DNA, 18 bp, Homo sapiens
ggagagtgagatcaaaca

SEQ ID NO: 7320103 - DNA, 22 bp, Homo sapiens
ggagagctgaagcatggacagg

SEQ ID NO: 7320104 - DNA, 22 bp, Homo sapiens
ggacaaatctcattatttctga

SEQ ID NO: 7320105 - DNA, 22 bp, Homo sapiens
ggacaaattccctatttgcatg

SEQ ID NO: 7320106 - DNA, 20 bp, Homo sapiens
gctgggctaccactggccct

SEQ ID NO: 7320107 - DNA, 22 bp, Homo sapiens
caatgcttttagcttcagcttg

SEQ ID NO: 7320108 - DNA, 22 bp, Homo sapiens
caagttatcagggcagttagag

SEQ ID NO: 7320109 - DNA, 19 bp, Homo sapiens
ggcagtcacggtcaggagc

SEQ ID NO: 7320110 - DNA, 22 bp, Homo sapiens
ggcagtcacaggggagactggg

SEQ ID NO: 7320111 - DNA, 22 bp, Homo sapiens
ggcagtcacttttgcttgtgcc

SEQ ID NO: 7320112 - DNA, 22 bp, Homo sapiens
cacatttctctacctcacacaa

SEQ ID NO: 7320113 - DNA, 22 bp, Homo sapiens
ggcagtcaagagggagtctgaa

SEQ ID NO: 7320114 - DNA, 22 bp, Homo sapiens
ggcaggttggatgctgtagtga

SEQ ID NO: 7320115 - DNA, 22 bp, Homo sapiens
ggcttcttcctggctcctatta

SEQ ID NO: 7320116 - DNA, 22 bp, Homo sapiens
ggctgcagatagccagccacca

SEQ ID NO: 7320117 - DNA, 20 bp, Homo sapiens
cactgaggtgcagctcatgc

SEQ ID NO: 7320118 - DNA, 22 bp, Homo sapiens
cagaggcagccgggggagaacg

SEQ ID NO: 7320119 - DNA, 22 bp, Homo sapiens
gtaagcagaggttaatgttaac

SEQ ID NO: 7320120 - DNA, 22 bp, Homo sapiens
tccaagaagcttacaatctaat

SEQ ID NO: 7320121 - DNA, 22 bp, Homo sapiens
catgctctctggcaacttgtgt

SEQ ID NO: 7320122 - DNA, 22 bp, Homo sapiens
catgctatttatacataagtct

SEQ ID NO: 7320123 - DNA, 22 bp, Homo sapiens
catgcattttctattcactcag

SEQ ID NO: 7320124 - DNA, 22 bp, Homo sapiens
catgggctcttctggactgcac

SEQ ID NO: 7320125 - DNA, 22 bp, Homo sapiens
catgtggatatgaattgtagaa

SEQ ID NO: 7320126 - DNA, 22 bp, Homo sapiens
cattaattgtatttttcaaagt

SEQ ID NO: 7320127 - DNA, 22 bp, Homo sapiens
catcaatgtgcagagatgaacg

SEQ ID NO: 7320128 - DNA, 22 bp, Homo sapiens
catcctggttaccccatagtca

SEQ ID NO: 7320129 - DNA, 19 bp, Homo sapiens
tcagtgtgtgggaggtggt

SEQ ID NO: 7320130 - DNA, 22 bp, Homo sapiens
tcataatgtagttcatggctgg

SEQ ID NO: 7320131 - DNA, 22 bp, Homo sapiens
tcataatgaccccagagtccgc

SEQ ID NO: 7320132 - DNA, 22 bp, Homo sapiens
catcataataacccagacacag

SEQ ID NO: 7320133 - DNA, 22 bp, Homo sapiens
catcataaaattgagataactg

SEQ ID NO: 7320134 - DNA, 22 bp, Homo sapiens
catcagtttggtcaatgatggg

SEQ ID NO: 7320135 - DNA, 22 bp, Homo sapiens
tcagtgtcttctctttcctacc

SEQ ID NO: 7320136 - DNA, 22 bp, Homo sapiens
tcagtgtctgtgggcaggatgg

SEQ ID NO: 7320137 - DNA, 22 bp, Homo sapiens
tctatacatgtgcacacacatc

SEQ ID NO: 7320138 - DNA, 22 bp, Homo sapiens
catttcactattcactaaaagg

SEQ ID NO: 7320139 - DNA, 22 bp, Homo sapiens
catttcatagttgtcacaataa

SEQ ID NO: 7320140 - DNA, 21 bp, Homo sapiens
catttcatgattatagaaatg

SEQ ID NO: 7320141 - DNA, 22 bp, Homo sapiens
catttcattcctttgaaagtgg

SEQ ID NO: 7320142 - DNA, 20 bp, Homo sapiens
catttcattgtgtcttcact

SEQ ID NO: 7320143 - DNA, 22 bp, Homo sapiens
tcctgaggtgctcagccaggaa

SEQ ID NO: 7320144 - DNA, 22 bp, Homo sapiens
cagtcttagccttccctcaccc

SEQ ID NO: 7320145 - DNA, 22 bp, Homo sapiens
cagtgaaatcacaactttagtt

SEQ ID NO: 7320146 - DNA, 22 bp, Homo sapiens
tcaaattttaacatgcattaga

SEQ ID NO: 7320147 - DNA, 22 bp, Homo sapiens
cagtagcaggcaggtgcttttg

SEQ ID NO: 7320148 - DNA, 22 bp, Homo sapiens
tcacatgtcagtcttaaacaga

SEQ ID NO: 7320149 - DNA, 22 bp, Homo sapiens
cagtggatgatttggctgctag

SEQ ID NO: 7320150 - DNA, 22 bp, Homo sapiens
cagtggatggtttgtcttgcct

SEQ ID NO: 7320151 - DNA, 22 bp, Homo sapiens
tagtacagttccatcaaagcag

SEQ ID NO: 7320152 - DNA, 22 bp, Homo sapiens
tagtacagtggcattcaaactt

SEQ ID NO: 7320153 - DNA, 22 bp, Homo sapiens
tatataatttgtaaaagcacct

SEQ ID NO: 7320154 - DNA, 22 bp, Homo sapiens
tagttttagcagcaatgggatg

SEQ ID NO: 7320155 - DNA, 22 bp, Homo sapiens
tatatacaaggtaggtttaggt

SEQ ID NO: 7320156 - DNA, 22 bp, Homo sapiens
tatgtacatgatttcatttgct

SEQ ID NO: 7320157 - DNA, 22 bp, Homo sapiens
tatattccagttcatctcttga

SEQ ID NO: 7320158 - DNA, 22 bp, Homo sapiens
tatattgtaggtgctatttgaa

SEQ ID NO: 7320159 - DNA, 22 bp, Homo sapiens
tatattgtagctgatgacaaat

SEQ ID NO: 7320160 - DNA, 22 bp, Homo sapiens
tagacagtgagctatgagtggt

SEQ ID NO: 7320161 - DNA, 22 bp, Homo sapiens
tacctcattacatctgcaatga

SEQ ID NO: 7320162 - DNA, 22 bp, Homo sapiens
tacctcatgctgtacagcacgt

SEQ ID NO: 7320163 - DNA, 22 bp, Homo sapiens
caggctgcagcagcagtggccc

SEQ ID NO: 7320164 - DNA, 22 bp, Homo sapiens
cagggagtgtacaccatgtgta

SEQ ID NO: 7320165 - DNA, 22 bp, Homo sapiens
tagcagtgtctaggtaggccat

SEQ ID NO: 7320166 - DNA, 22 bp, Homo sapiens
tacagacattcaattttgaccc

SEQ ID NO: 7320167 - DNA, 22 bp, Homo sapiens
tacaatagggcttttgtttatg

SEQ ID NO: 7320168 - DNA, 22 bp, Homo sapiens
tacagtttcccagcagatgcaa

SEQ ID NO: 7320169 - DNA, 22 bp, Homo sapiens
caggccttaaggactcggagaa

SEQ ID NO: 7320170 - DNA, 22 bp, Homo sapiens
caggccttagtaggtgctccct

SEQ ID NO: 7320171 - DNA, 22 bp, Homo sapiens
caggccttatctccaccctgca

SEQ ID NO: 7320172 - DNA, 17 bp, Homo sapiens
caggccttgagccttta

SEQ ID NO: 7320173 - DNA, 22 bp, Homo sapiens
caggccttctccctccctcaac

SEQ ID NO: 7320174 - DNA, 22 bp, Homo sapiens
caggccttgaaggcctgcggga

SEQ ID NO: 7320175 - DNA, 22 bp, Homo sapiens
caggccttgggacccagactgg

SEQ ID NO: 7320176 - DNA, 22 bp, Homo sapiens
caggccttgagttttgggcttt

SEQ ID NO: 7320177 - DNA, 22 bp, Homo sapiens
caggccttgcgtcccatggcct

SEQ ID NO: 7320178 - DNA, 22 bp, Homo sapiens
tacagccatggttaatttacct

SEQ ID NO: 7320179 - DNA, 22 bp, Homo sapiens
ccagggcacgttgggacagtac

SEQ ID NO: 7320180 - DNA, 17 bp, Homo sapiens
tcttctcttccagtctt

SEQ ID NO: 7320181 - DNA, 22 bp, Homo sapiens
tcttaattctgtgtcttcacta

SEQ ID NO: 7320182 - DNA, 22 bp, Homo sapiens
tcttaattgagaacagtgtagg

SEQ ID NO: 7320183 - DNA, 22 bp, Homo sapiens
tctgggcttttgcactggccat

SEQ ID NO: 7320184 - DNA, 22 bp, Homo sapiens
tctgggctctgtcagcacctct

SEQ ID NO: 7320185 - DNA, 22 bp, Homo sapiens
tctgggcttttccatgcctgtg

SEQ ID NO: 7320186 - DNA, 22 bp, Homo sapiens
tctgggctctgggaattaggga

SEQ ID NO: 7320187 - DNA, 22 bp, Homo sapiens
tctgggctctgcgaagcccttc

SEQ ID NO: 7320188 - DNA, 22 bp, Homo sapiens
tctgggctcacgagtctggaca

SEQ ID NO: 7320189 - DNA, 22 bp, Homo sapiens
tctgggctatatggtctctgct

SEQ ID NO: 7320190 - DNA, 22 bp, Homo sapiens
tgaggccccgaagctgaggttt

SEQ ID NO: 7320191 - DNA, 22 bp, Homo sapiens
tgaggcccagccgccctgagag

SEQ ID NO: 7320192 - DNA, 22 bp, Homo sapiens
tggggagaggtatcattgagat

SEQ ID NO: 7320193 - DNA, 22 bp, Homo sapiens
tggggagagattgaggagtttt

SEQ ID NO: 7320194 - DNA, 22 bp, Homo sapiens
tggggagactggccgagatcct

SEQ ID NO: 7320195 - DNA, 22 bp, Homo sapiens
tgggcaggcaagtgaatacctt

SEQ ID NO: 7320196 - DNA, 22 bp, Homo sapiens
tgggctcatgtttctttgagga

SEQ ID NO: 7320197 - DNA, 23 bp, Homo sapiens
tggttacatagggcagatggcgc

SEQ ID NO: 7320198 - DNA, 22 bp, Homo sapiens
tggttacatcatcccattctga

SEQ ID NO: 7320199 - DNA, 22 bp, Homo sapiens
tggttacatatcctttggagcc

SEQ ID NO: 7320200 - DNA, 22 bp, Homo sapiens
tggttacagaacatgaatgttg

SEQ ID NO: 7320201 - DNA, 22 bp, Homo sapiens
tggttacagagatttttaagat

SEQ ID NO: 7320202 - DNA, 23 bp, Homo sapiens
tggttacaggaacagggtttcgg

SEQ ID NO: 7320203 - DNA, 22 bp, Homo sapiens
tggttacataagaatagcactg

SEQ ID NO: 7320204 - DNA, 22 bp, Homo sapiens
tggtagcaacatctcagtggct

SEQ ID NO: 7320205 - DNA, 22 bp, Homo sapiens
cctcctgggccttgctctgtga

SEQ ID NO: 7320206 - DNA, 23 bp, Homo sapiens
cctcctgggcacaggcctgatgg

SEQ ID NO: 7320207 - DNA, 22 bp, Homo sapiens
cctcctgggagagcacggaggg

SEQ ID NO: 7320208 - DNA, 22 bp, Homo sapiens
cctcctgggacaggctggcaca

SEQ ID NO: 7320209 - DNA, 22 bp, Homo sapiens
cctcctggcctgtgcagagccc

SEQ ID NO: 7320210 - DNA, 22 bp, Homo sapiens
cctcctggggtgaaggatggga

SEQ ID NO: 7320211 - DNA, 20 bp, Homo sapiens
cctcctggtcaggtgtgcag

SEQ ID NO: 7320212 - DNA, 22 bp, Homo sapiens
cctctcccacgtggcagaggct

SEQ ID NO: 7320213 - DNA, 22 bp, Homo sapiens
cctctcccagggagagcctgag

SEQ ID NO: 7320214 - DNA, 19 bp, Homo sapiens
cctctcccatgcttacctc

SEQ ID NO: 7320215 - DNA, 22 bp, Homo sapiens
tgggagagcactgcagccccgg

SEQ ID NO: 7320216 - DNA, 22 bp, Homo sapiens
tgggagagcagagaaccctctt

SEQ ID NO: 7320217 - DNA, 22 bp, Homo sapiens
tgggcagaattgtggtagttaa

SEQ ID NO: 7320218 - DNA, 22 bp, Homo sapiens
tgggagagaataatcaataggt

SEQ ID NO: 7320219 - DNA, 22 bp, Homo sapiens
tgggagagataggcttctggac

SEQ ID NO: 7320220 - DNA, 22 bp, Homo sapiens
tgggagagaattctggtgactg

SEQ ID NO: 7320221 - DNA, 22 bp, Homo sapiens
tgggagagagaattcccagtgg

SEQ ID NO: 7320222 - DNA, 22 bp, Homo sapiens
ccctgggaggcttccaggcaga

SEQ ID NO: 7320223 - DNA, 22 bp, Homo sapiens
ccctttaaggtctgattttcag

SEQ ID NO: 7320224 - DNA, 22 bp, Homo sapiens
ccctttagcccctgcagagact

SEQ ID NO: 7320225 - DNA, 22 bp, Homo sapiens
gagaaactgaaacatagggcca

SEQ ID NO: 7320226 - DNA, 22 bp, Homo sapiens
gacatttagaagttagattcaa

SEQ ID NO: 7320227 - DNA, 22 bp, Homo sapiens
gactgagggacagggcagtgga

SEQ ID NO: 7320228 - DNA, 22 bp, Homo sapiens
gactctcaagcacaagtccacc

SEQ ID NO: 7320229 - DNA, 22 bp, Homo sapiens
gacatttactgaatactgatta

SEQ ID NO: 7320230 - DNA, 22 bp, Homo sapiens
gacatttaaattgcaggcagcc

SEQ ID NO: 7320231 - DNA, 22 bp, Homo sapiens
gacactttctcaggtaaagcat

SEQ ID NO: 7320232 - DNA, 22 bp, Homo sapiens
gacagacactgtgtcctcactt

SEQ ID NO: 7320233 - DNA, 22 bp, Homo sapiens
gaaagctgtgaaatagtgctct

SEQ ID NO: 7320234 - DNA, 22 bp, Homo sapiens
gagaggggacctgtgtgtctag

SEQ ID NO: 7320235 - DNA, 22 bp, Homo sapiens
gaggcagtatagtcattaagta

SEQ ID NO: 7320236 - DNA, 19 bp, Homo sapiens
gaggcagtagtcaaagctt

SEQ ID NO: 7320237 - DNA, 22 bp, Homo sapiens
gaggagagatggtagattgggt

SEQ ID NO: 7320238 - DNA, 22 bp, Homo sapiens
gaggagaggctggacgcggtga

SEQ ID NO: 7320239 - DNA, 18 bp, Homo sapiens
ctgtgccctgctcctact

SEQ ID NO: 7320240 - DNA, 22 bp, Homo sapiens
ctgtcaggggcgggtggagcgg

SEQ ID NO: 7320241 - DNA, 19 bp, Homo sapiens
ctgtcaggggctggatgtt

SEQ ID NO: 7320242 - DNA, 22 bp, Homo sapiens
ctgtcagggggcctggccatca

SEQ ID NO: 7320243 - DNA, 22 bp, Homo sapiens
ctgtcaggaagctgggcatcca

SEQ ID NO: 7320244 - DNA, 22 bp, Homo sapiens
ctgtcaggtttcccatctgcaa

SEQ ID NO: 7320245 - DNA, 22 bp, Homo sapiens
ctgtatatggcttactttatat

SEQ ID NO: 7320246 - DNA, 22 bp, Homo sapiens
ctgtattttttaagaatatctc

SEQ ID NO: 7320247 - DNA, 21 bp, Homo sapiens
ctgggctttctctcaaagaca

SEQ ID NO: 7320248 - DNA, 22 bp, Homo sapiens
ctgggctttggtactgtgatta

SEQ ID NO: 7320249 - DNA, 22 bp, Homo sapiens
ctgggctttgaagccaggctgc

SEQ ID NO: 7320250 - DNA, 22 bp, Homo sapiens
ctgggcttttgagtcacaaggg

SEQ ID NO: 7320251 - DNA, 19 bp, Homo sapiens
ctgggcttgatgttgagtt

SEQ ID NO: 7320252 - DNA, 22 bp, Homo sapiens
ctgggcttgcactgcagcgaga

SEQ ID NO: 7320253 - DNA, 22 bp, Homo sapiens
ctgggcttgtgttagctgacaa

SEQ ID NO: 7320254 - DNA, 22 bp, Homo sapiens
ctgggctttcaggccctaaggc

SEQ ID NO: 7320255 - DNA, 22 bp, Homo sapiens
ctgggcttgagttcctgctcgt

SEQ ID NO: 7320256 - DNA, 22 bp, Homo sapiens
ctgggcttctccccctggcaga

SEQ ID NO: 7320257 - DNA, 22 bp, Homo sapiens
ctgggcttaggacctggtgcgg

SEQ ID NO: 7320258 - DNA, 16 bp, Homo sapiens
ctggtcttgctgccga

SEQ ID NO: 7320259 - DNA, 22 bp, Homo sapiens
ctgggcttagcagctcctggtc

SEQ ID NO: 7320260 - DNA, 22 bp, Homo sapiens
ctgggccttggattgacactgt

SEQ ID NO: 7320261 - DNA, 22 bp, Homo sapiens
ctgggcgtgtcttccagctggc

SEQ ID NO: 7320262 - DNA, 22 bp, Homo sapiens
ctgggcctggtgtggcacctgc

SEQ ID NO: 7320263 - DNA, 22 bp, Homo sapiens
ctgggactcagaccagttctgt

SEQ ID NO: 7320264 - DNA, 22 bp, Homo sapiens
ctgggagattgaggccatggtg

SEQ ID NO: 7320265 - DNA, 22 bp, Homo sapiens
ctgggagatctcctgagggcag

SEQ ID NO: 7320266 - DNA, 22 bp, Homo sapiens
ctgggagatctgttgggactgg

SEQ ID NO: 7320267 - DNA, 22 bp, Homo sapiens
ctgggactggacctctgcctgg

SEQ ID NO: 7320268 - DNA, 22 bp, Homo sapiens
ctgcttatggagatgagtaaga

SEQ ID NO: 7320269 - DNA, 22 bp, Homo sapiens
cttagcttctctgcatctgtgt

SEQ ID NO: 7320270 - DNA, 22 bp, Homo sapiens
cttagctttaaaagtgagatct

SEQ ID NO: 7320271 - DNA, 22 bp, Homo sapiens
cttacagtgttgagggaattaa

SEQ ID NO: 7320272 - DNA, 22 bp, Homo sapiens
cttacagtgatcaacacaaaga

SEQ ID NO: 7320273 - DNA, 22 bp, Homo sapiens
cttacagtgaccctgcagattt

SEQ ID NO: 7320274 - DNA, 22 bp, Homo sapiens
cttacagtacttctaatatgat

SEQ ID NO: 7320275 - DNA, 22 bp, Homo sapiens
cttaaattttcatctacaagaa

SEQ ID NO: 7320276 - DNA, 22 bp, Homo sapiens
cttaaattggatgagttaagtt

SEQ ID NO: 7320277 - DNA, 22 bp, Homo sapiens
cttaaattcttaatgccctcat

SEQ ID NO: 7320278 - DNA, 22 bp, Homo sapiens
ctgtggaaataaacaatgctaa

SEQ ID NO: 7320279 - DNA, 22 bp, Homo sapiens
ctgtggaaaatgctttacatat

SEQ ID NO: 7320280 - DNA, 22 bp, Homo sapiens
ctgtggaaaatttgtatgtaat

SEQ ID NO: 7320281 - DNA, 22 bp, Homo sapiens
ctgtggaagctgacacggtggt

SEQ ID NO: 7320282 - DNA, 22 bp, Homo sapiens
ctgtggaagagggtcaccagta

SEQ ID NO: 7320283 - DNA, 21 bp, Homo sapiens
ctgtggaagggaactagaggg

SEQ ID NO: 7320284 - DNA, 22 bp, Homo sapiens
ctttaaataatacaaggtccag

SEQ ID NO: 7320285 - DNA, 22 bp, Homo sapiens
ctttacaaactataaagtgcgg

SEQ ID NO: 7320286 - DNA, 22 bp, Homo sapiens
gaaaattattgaaaatggctct

SEQ ID NO: 7320287 - DNA, 22 bp, Homo sapiens
gaaaatgtttcctgttatttgc

SEQ ID NO: 7320288 - DNA, 22 bp, Homo sapiens
gaaaatgttagcttcatagtca

SEQ ID NO: 7320289 - DNA, 22 bp, Homo sapiens
gaaaatacttcagtgttctggc

SEQ ID NO: 7320290 - DNA, 22 bp, Homo sapiens
ctctatttatggcatctttatg

SEQ ID NO: 7320291 - DNA, 22 bp, Homo sapiens
ctctagcttttgataccagtgt

SEQ ID NO: 7320292 - DNA, 22 bp, Homo sapiens
tttcttctgtttgtagttacac

SEQ ID NO: 7320293 - DNA, 22 bp, Homo sapiens
tttcttctttcccagtgatggg

SEQ ID NO: 7320294 - DNA, 22 bp, Homo sapiens
tttcttcttaatactggctgct

SEQ ID NO: 7320295 - DNA, 22 bp, Homo sapiens
tttcttctgtttgtagttacac

SEQ ID NO: 7320296 - DNA, 22 bp, Homo sapiens
tttcttcttgatttaaacaggg

SEQ ID NO: 7320297 - DNA, 22 bp, Homo sapiens
tttcttcttgagtaaccagatt

SEQ ID NO: 7320298 - DNA, 22 bp, Homo sapiens
ctcctgagctctgaggaagctt

SEQ ID NO: 7320299 - DNA, 21 bp, Homo sapiens
ctctacattcccagcaactct

SEQ ID NO: 7320300 - DNA, 22 bp, Homo sapiens
ctctaaaggcttgttattgcat

SEQ ID NO: 7320301 - DNA, 22 bp, Homo sapiens
tttcaaataccataaacctaat

SEQ ID NO: 7320302 - DNA, 22 bp, Homo sapiens
ctccctgggcagatgtggctct

SEQ ID NO: 7320303 - DNA, 22 bp, Homo sapiens
ctccctggaggtgagctggcac

SEQ ID NO: 7320304 - DNA, 22 bp, Homo sapiens
ctccccaccttcgcggtccctg

SEQ ID NO: 7320305 - DNA, 22 bp, Homo sapiens
ctccccacatttctccctgtct

SEQ ID NO: 7320306 - DNA, 22 bp, Homo sapiens
ttttcagttgtgctctctagtt

SEQ ID NO: 7320307 - DNA, 22 bp, Homo sapiens
ttttcagttccatctctgctct

SEQ ID NO: 7320308 - DNA, 18 bp, Homo sapiens
ctgaggctggcaggagcc

SEQ ID NO: 7320309 - DNA, 20 bp, Homo sapiens
ttctccaaaggagacactag

SEQ ID NO: 7320310 - DNA, 22 bp, Homo sapiens
ttctcatgaaactcgcttcctc

SEQ ID NO: 7320311 - DNA, 22 bp, Homo sapiens
ttctcatgatgcaattcatccc

SEQ ID NO: 7320312 - DNA, 22 bp, Homo sapiens
ttctcatgtaaatgccatcatc

SEQ ID NO: 7320313 - DNA, 22 bp, Homo sapiens
ctacatttacacagttaggctt

SEQ ID NO: 7320314 - DNA, 22 bp, Homo sapiens
ttctatttttgtggaactgtag

SEQ ID NO: 7320315 - DNA, 22 bp, Homo sapiens
ttctacatgagaaaatgtattt

SEQ ID NO: 7320316 - DNA, 22 bp, Homo sapiens
cgtcagtttactgttgccatgg

SEQ ID NO: 7320317 - DNA, 22 bp, Homo sapiens
cgtccttgcaagatctgtacaa

SEQ ID NO: 7320318 - DNA, 22 bp, Homo sapiens
ttcagtttccacttacatttaa

SEQ ID NO: 7320319 - DNA, 22 bp, Homo sapiens
ctcaggccattcctaccaaggg

SEQ ID NO: 7320320 - DNA, 22 bp, Homo sapiens
ctcaggccaggtttctcccaca

SEQ ID NO: 7320321 - DNA, 22 bp, Homo sapiens
ctcaggccaataagctccagcc

SEQ ID NO: 7320322 - DNA, 22 bp, Homo sapiens
ctcaggcccacagcagacccac

SEQ ID NO: 7320323 - DNA, 22 bp, Homo sapiens
ctcaggcctgagtggcagtccc

SEQ ID NO: 7320324 - DNA, 22 bp, Homo sapiens
ctcaggccattcttccagctgc

SEQ ID NO: 7320325 - DNA, 22 bp, Homo sapiens
ctcaggccttgaagtcttttct

SEQ ID NO: 7320326 - DNA, 18 bp, Homo sapiens
ctcaggcctttccctgtg

SEQ ID NO: 7320327 - DNA, 21 bp, Homo sapiens
ttcttcatgatgattaatggc

SEQ ID NO: 7320328 - DNA, 22 bp, Homo sapiens
ttctgaaatttcaactttacta

SEQ ID NO: 7320329 - DNA, 22 bp, Homo sapiens
ttctgtctctgtgtttacatta

SEQ ID NO: 7320330 - DNA, 22 bp, Homo sapiens
cctttaaatggatgttcaactg

SEQ ID NO: 7320331 - DNA, 22 bp, Homo sapiens
ttacaagtttctggcttcatcc

SEQ ID NO: 7320332 - DNA, 22 bp, Homo sapiens
ttaatgacctggaagaagtgat

SEQ ID NO: 7320333 - DNA, 22 bp, Homo sapiens
ttaaggaaacatttttccatag

SEQ ID NO: 7320334 - DNA, 22 bp, Homo sapiens
tgttttcctcctggtttctgcc

SEQ ID NO: 7320335 - DNA, 22 bp, Homo sapiens
tggttcatgctcatggtgatag

SEQ ID NO: 7320336 - DNA, 22 bp, Homo sapiens
gcagtcatgggtagaactcaag

SEQ ID NO: 7320337 - DNA, 22 bp, Homo sapiens
gcagtcatttaacctctctgtg

SEQ ID NO: 7320338 - DNA, 22 bp, Homo sapiens
gcagtcatggaaaaatgtatac

SEQ ID NO: 7320339 - DNA, 22 bp, Homo sapiens
gcagtcatctgagctaactact

SEQ ID NO: 7320340 - DNA, 22 bp, Homo sapiens
gcagtcatcagtcctttaatta

SEQ ID NO: 7320341 - DNA, 21 bp, Homo sapiens
gcagtcatcatcaagctttgg

SEQ ID NO: 7320342 - DNA, 22 bp, Homo sapiens
gcagtcatccagcctttccact

SEQ ID NO: 7320343 - DNA, 22 bp, Homo sapiens
gcagtcatcacggcttttaggc

SEQ ID NO: 7320344 - DNA, 22 bp, Homo sapiens
gcagtcatatcattccaacagg

SEQ ID NO: 7320345 - DNA, 22 bp, Homo sapiens
gcagtcataactaatattggtt

SEQ ID NO: 7320346 - DNA, 22 bp, Homo sapiens
gcatctgttagagtgtgcatgc

SEQ ID NO: 7320347 - DNA, 22 bp, Homo sapiens
gcaggagttaaaatatgtaatg

SEQ ID NO: 7320348 - DNA, 22 bp, Homo sapiens
gcactgtgctagaagccagggg

SEQ ID NO: 7320349 - DNA, 22 bp, Homo sapiens
gcactggattttgatctgcaag

SEQ ID NO: 7320350 - DNA, 22 bp, Homo sapiens
gcactggagggtgtagttgctg

SEQ ID NO: 7320351 - DNA, 22 bp, Homo sapiens
gcactggatcttgggagacgtg

SEQ ID NO: 7320352 - DNA, 22 bp, Homo sapiens
gcactggattttgatctgcaag

SEQ ID NO: 7320353 - DNA, 23 bp, Homo sapiens
gcactggaaaaatgaagattact

SEQ ID NO: 7320354 - DNA, 22 bp, Homo sapiens
gcactggaaatacctagatgaa

SEQ ID NO: 7320355 - DNA, 22 bp, Homo sapiens
gcactggaaggagggaatctta

SEQ ID NO: 7320356 - DNA, 22 bp, Homo sapiens
gcactggacaggagtgaaatta

SEQ ID NO: 7320357 - DNA, 22 bp, Homo sapiens
gcactggagaatggctgtattc

SEQ ID NO: 7320358 - DNA, 22 bp, Homo sapiens
gcactggaccccaggatatgga

SEQ ID NO: 7320359 - DNA, 22 bp, Homo sapiens
gcactggagatacagagatgaa

SEQ ID NO: 7320360 - DNA, 22 bp, Homo sapiens
gcactggagatggggttgtcgg

SEQ ID NO: 7320361 - DNA, 22 bp, Homo sapiens
gcaagcagttacccaggattcg

SEQ ID NO: 7320362 - DNA, 22 bp, Homo sapiens
gcaagcaaattatttataggca

SEQ ID NO: 7320363 - DNA, 22 bp, Homo sapiens
gcaagcaaaatgggagattccc

SEQ ID NO: 7320364 - DNA, 22 bp, Homo sapiens
gcaagcaagcaggtagagctga

SEQ ID NO: 7320365 - DNA, 22 bp, Homo sapiens
gcgacctcctgcctgagagtct

SEQ ID NO: 7320366 - DNA, 22 bp, Homo sapiens
gctcacatcatagtaagctcat

SEQ ID NO: 7320367 - DNA, 22 bp, Homo sapiens
gctcaatgctcaatgctgcaaa

SEQ ID NO: 7320368 - DNA, 22 bp, Homo sapiens
gctggctcttcagtggagatag

SEQ ID NO: 7320369 - DNA, 21 bp, Homo sapiens
ggaacattgttaatagtctct

SEQ ID NO: 7320370 - DNA, 22 bp, Homo sapiens
ggagagctggtatatgaagaca

SEQ ID NO: 7320371 - DNA, 22 bp, Homo sapiens
ggagaggagattgtggcatttt

SEQ ID NO: 7320372 - DNA, 22 bp, Homo sapiens
ggagaggaaatgccagcacttc

SEQ ID NO: 7320373 - DNA, 22 bp, Homo sapiens
ggagaggcgatgagtcacagcc

SEQ ID NO: 7320374 - DNA, 22 bp, Homo sapiens
ggagaggcttccagagtcgtgc

SEQ ID NO: 7320375 - DNA, 22 bp, Homo sapiens
ggacacgtggctgaaggcggcc

SEQ ID NO: 7320376 - DNA, 22 bp, Homo sapiens
ggctttctcacagcatggcagc

SEQ ID NO: 7320377 - DNA, 22 bp, Homo sapiens
gggcactgaatgccaagctagg

SEQ ID NO: 7320378 - DNA, 22 bp, Homo sapiens
gggcaggttattggagtaggga

SEQ ID NO: 7320379 - DNA, 22 bp, Homo sapiens
gggcaggttggcatcccgggca

SEQ ID NO: 7320380 - DNA, 23 bp, Homo sapiens
gggcaggtttttataggcttcag

SEQ ID NO: 7320381 - DNA, 22 bp, Homo sapiens
ggcactgggttgtaggaattaa

SEQ ID NO: 7320382 - DNA, 22 bp, Homo sapiens
ggcactgggtgagggtcactgg

SEQ ID NO: 7320383 - DNA, 18 bp, Homo sapiens
ggcactggtgatgcagag

SEQ ID NO: 7320384 - DNA, 19 bp, Homo sapiens
ggcactggggccaggacca

SEQ ID NO: 7320385 - DNA, 22 bp, Homo sapiens
ggcatcgtcctgggcataggga

SEQ ID NO: 7320386 - DNA, 22 bp, Homo sapiens
ggtgccagtgggtctcaggata

SEQ ID NO: 7320387 - DNA, 22 bp, Homo sapiens
ggtgccagcctagtgcagtggt

SEQ ID NO: 7320388 - DNA, 22 bp, Homo sapiens
ggtaggcagatcactgtctatg

SEQ ID NO: 7320389 - DNA, 20 bp, Homo sapiens
ggtagctgctgcagttggta

SEQ ID NO: 7320390 - DNA, 22 bp, Homo sapiens
gggtcacttttgctatgttggc

SEQ ID NO: 7320391 - DNA, 22 bp, Homo sapiens
ggggcttccagcgcccgccggt

SEQ ID NO: 7320392 - DNA, 22 bp, Homo sapiens
ggggcttctttctgccaccgac

SEQ ID NO: 7320393 - DNA, 22 bp, Homo sapiens
ggggcaggagcccttcttcagc

SEQ ID NO: 7320394 - DNA, 22 bp, Homo sapiens
gggcctgcaggttctgagaggc

SEQ ID NO: 7320395 - DNA, 22 bp, Homo sapiens
gtcttcttttcagtctgcttgt

SEQ ID NO: 7320396 - DNA, 22 bp, Homo sapiens
gtgaggcattgaagaccggaat

SEQ ID NO: 7320397 - DNA, 22 bp, Homo sapiens
gtgaggcagggaaagaggataa

SEQ ID NO: 7320398 - DNA, 22 bp, Homo sapiens
gtgagtgtcagtcaaaggtttt

SEQ ID NO: 7320399 - DNA, 19 bp, Homo sapiens
gtcctcatgttgttctcca

SEQ ID NO: 7320400 - DNA, 23 bp, Homo sapiens
gtcaggtcattagaggtgacttc

SEQ ID NO: 7320401 - DNA, 19 bp, Homo sapiens
gtcaggtcgttcctgccgg

SEQ ID NO: 7320402 - DNA, 22 bp, Homo sapiens
gtcaggtcttggaagataggct

SEQ ID NO: 7320403 - DNA, 22 bp, Homo sapiens
gtcattcttaacaactcagtag

SEQ ID NO: 7320404 - DNA, 22 bp, Homo sapiens
gtcattctctggtgtggttgtt

SEQ ID NO: 7320405 - DNA, 22 bp, Homo sapiens
gtcagttcattagcacttccaa

SEQ ID NO: 7320406 - DNA, 22 bp, Homo sapiens
gtcagtttgactcagtgttata

SEQ ID NO: 7320407 - DNA, 22 bp, Homo sapiens
gtaacaggcaatacaactctct

SEQ ID NO: 7320408 - DNA, 22 bp, Homo sapiens
gtagctgatattagcaatgagt

SEQ ID NO: 7320409 - DNA, 22 bp, Homo sapiens
gtagctgatcctgaggacaggg

SEQ ID NO: 7320410 - DNA, 22 bp, Homo sapiens
tatgttctgactctacatggga

SEQ ID NO: 7320411 - DNA, 22 bp, Homo sapiens
tatgttctctgctctaggatgt

SEQ ID NO: 7320412 - DNA, 22 bp, Homo sapiens
tatttcagctctttggattatc

SEQ ID NO: 7320413 - DNA, 19 bp, Homo sapiens
tatttcaggctcagagtct

SEQ ID NO: 7320414 - DNA, 22 bp, Homo sapiens
tatttcagcacatgggataggt

SEQ ID NO: 7320415 - DNA, 22 bp, Homo sapiens
tatttcagagttgttttctgtc

SEQ ID NO: 7320416 - DNA, 22 bp, Homo sapiens
tatttcagacactgatcttgca

SEQ ID NO: 7320417 - DNA, 21 bp, Homo sapiens
tatttcagaagagtctcagag

SEQ ID NO: 7320418 - DNA, 22 bp, Homo sapiens
tatacatgttttacataagtga

SEQ ID NO: 7320419 - DNA, 22 bp, Homo sapiens
tatactctgagaaacgtgtcac

SEQ ID NO: 7320420 - DNA, 18 bp, Homo sapiens
tatagacacatatgccag

SEQ ID NO: 7320421 - DNA, 22 bp, Homo sapiens
tatattacatagtgtttgagat

SEQ ID NO: 7320422 - DNA, 22 bp, Homo sapiens
tatctataatgttttacttcct

SEQ ID NO: 7320423 - DNA, 22 bp, Homo sapiens
tatctagatggattttagtgaa

SEQ ID NO: 7320424 - DNA, 22 bp, Homo sapiens
tatgcactggtactattcgtgt

SEQ ID NO: 7320425 - DNA, 22 bp, Homo sapiens
taggctcacatagcactaagtg

SEQ ID NO: 7320426 - DNA, 22 bp, Homo sapiens
tagtacagtttactttcagcgc

SEQ ID NO: 7320427 - DNA, 19 bp, Homo sapiens
tagtagtagaaaacaatac

SEQ ID NO: 7320428 - DNA, 22 bp, Homo sapiens
taggttccatgagggaggcaaa

SEQ ID NO: 7320429 - DNA, 22 bp, Homo sapiens
taggttccatttaaacaaagaa

SEQ ID NO: 7320430 - DNA, 22 bp, Homo sapiens
tagtggatgttcagagatttga

SEQ ID NO: 7320431 - DNA, 21 bp, Homo sapiens
tagcacttcgctgtaattggg

SEQ ID NO: 7320432 - DNA, 22 bp, Homo sapiens
tagcagggttttgaagagggtt

SEQ ID NO: 7320433 - DNA, 20 bp, Homo sapiens
tagatgtttcctgtcataaa

SEQ ID NO: 7320434 - DNA, 22 bp, Homo sapiens
tagattttgcatttctaacaag

SEQ ID NO: 7320435 - DNA, 22 bp, Homo sapiens
tagaatcatacctctaggaaca

SEQ ID NO: 7320436 - DNA, 22 bp, Homo sapiens
tacacattacataatactatct

SEQ ID NO: 7320437 - DNA, 23 bp, Homo sapiens
taattttagccttacaggaccct

SEQ ID NO: 7320438 - DNA, 22 bp, Homo sapiens
taattttatgacagtgtatttt

SEQ ID NO: 7320439 - DNA, 22 bp, Homo sapiens
taattttaactgtgctgtttgg

SEQ ID NO: 7320440 - DNA, 22 bp, Homo sapiens
taattttaatagtatgtggcat

SEQ ID NO: 7320441 - DNA, 22 bp, Homo sapiens
taattttacttcctgagcacct

SEQ ID NO: 7320442 - DNA, 22 bp, Homo sapiens
taatttcaatagcttgcataat

SEQ ID NO: 7320443 - DNA, 22 bp, Homo sapiens
taatttcactgatatgaagtca

SEQ ID NO: 7320444 - DNA, 22 bp, Homo sapiens
taatgagatcatatcttctgag

SEQ ID NO: 7320445 - DNA, 22 bp, Homo sapiens
taagcagatgctgtctgcacaa

SEQ ID NO: 7320446 - DNA, 22 bp, Homo sapiens
taagcaatgagataatcatggg

SEQ ID NO: 7320447 - DNA, 22 bp, Homo sapiens
tacccagagggagagcaactat

SEQ ID NO: 7320448 - DNA, 22 bp, Homo sapiens
tactgaggctgaattcttagca

SEQ ID NO: 7320449 - DNA, 22 bp, Homo sapiens
tactgaggccatgagtctcata

SEQ ID NO: 7320450 - DNA, 22 bp, Homo sapiens
tactgaggcaatagataacggc

SEQ ID NO: 7320451 - DNA, 22 bp, Homo sapiens
tactgaggttgagaagctgctc

SEQ ID NO: 7320452 - DNA, 22 bp, Homo sapiens
tactgaggtactttacttataa

SEQ ID NO: 7320453 - DNA, 20 bp, Homo sapiens
tactgaggttaggggatgga

SEQ ID NO: 7320454 - DNA, 22 bp, Homo sapiens
tactgagggtgaaaaataaagt

SEQ ID NO: 7320455 - DNA, 22 bp, Homo sapiens
tactgagggtatgaagccaagg

SEQ ID NO: 7320456 - DNA, 17 bp, Homo sapiens
tactgaggggtctggag

SEQ ID NO: 7320457 - DNA, 22 bp, Homo sapiens
tactgagggctgtgtatgtatt

SEQ ID NO: 7320458 - DNA, 22 bp, Homo sapiens
tactgagggcaaagagtgaagc

SEQ ID NO: 7320459 - DNA, 22 bp, Homo sapiens
tactgaggctggcagccccttg

SEQ ID NO: 7320460 - DNA, 22 bp, Homo sapiens
tactgaggctgggttaagcatc

SEQ ID NO: 7320461 - DNA, 22 bp, Homo sapiens
tacatacagtggatgctttagg

SEQ ID NO: 7320462 - DNA, 22 bp, Homo sapiens
tacattcaacatgtcactatgt

SEQ ID NO: 7320463 - DNA, 22 bp, Homo sapiens
tacattcaacatgtcactatgt

SEQ ID NO: 7320464 - DNA, 22 bp, Homo sapiens
tacattcaaacgatttattgat

SEQ ID NO: 7320465 - DNA, 20 bp, Homo sapiens
tacattcaaaacaaactctg

SEQ ID NO: 7320466 - DNA, 22 bp, Homo sapiens
tacattcatggtgacttgtatg

SEQ ID NO: 7320467 - DNA, 23 bp, Homo sapiens
tacattcatttgcacagccagta

SEQ ID NO: 7320468 - DNA, 15 bp, Homo sapiens
tacattcatttccac

SEQ ID NO: 7320469 - DNA, 22 bp, Homo sapiens
tacattcatatgtgtgcataca

SEQ ID NO: 7320470 - DNA, 22 bp, Homo sapiens
tacattcagcaaaagaatggtt

SEQ ID NO: 7320471 - DNA, 22 bp, Homo sapiens
tacattcagaagaatggacacg

SEQ ID NO: 7320472 - DNA, 22 bp, Homo sapiens
tacattcagaattgggaggcaa

SEQ ID NO: 7320473 - DNA, 22 bp, Homo sapiens
tacattcagagaaagtttccat

SEQ ID NO: 7320474 - DNA, 22 bp, Homo sapiens
tacattcacagttgttcatctc

SEQ ID NO: 7320475 - DNA, 22 bp, Homo sapiens
tacattcacttgttgaaggtgg

SEQ ID NO: 7320476 - DNA, 22 bp, Homo sapiens
tacaggagagatttagtaatca

SEQ ID NO: 7320477 - DNA, 22 bp, Homo sapiens
tacatacaagatgtgtttaaaa

SEQ ID NO: 7320478 - DNA, 22 bp, Homo sapiens
tacataatgagctagttaagtt

SEQ ID NO: 7320479 - DNA, 22 bp, Homo sapiens
tacataattaatctttaagttc

SEQ ID NO: 7320480 - DNA, 22 bp, Homo sapiens
gttcctggtggtcatggcagct

SEQ ID NO: 7320481 - DNA, 22 bp, Homo sapiens
gttataaaatgcacagttgttt

SEQ ID NO: 7320482 - DNA, 22 bp, Homo sapiens
gttataaaggtgataatggtca

SEQ ID NO: 7320483 - DNA, 20 bp, Homo sapiens
gttaggaggttggacatgga

SEQ ID NO: 7320484 - DNA, 22 bp, Homo sapiens
taacacatggttctgtcaggaa

SEQ ID NO: 7320485 - DNA, 22 bp, Homo sapiens
taagatgaggtaggtaagactt

SEQ ID NO: 7320486 - DNA, 22 bp, Homo sapiens
taagatgggggaaagaaatagt

SEQ ID NO: 7320487 - DNA, 22 bp, Homo sapiens
taagaaactgtcacagtactat

SEQ ID NO: 7320488 - DNA, 22 bp, Homo sapiens
taaacatctgtagccttcagtc

SEQ ID NO: 7320489 - DNA, 22 bp, Homo sapiens
taaacatctgaatcctgcttcc

SEQ ID NO: 7320490 - DNA, 22 bp, Homo sapiens
tcccagagtcttctcctgtaat

SEQ ID NO: 7320491 - DNA, 22 bp, Homo sapiens
tcccagctgtgtggaggagatg

SEQ ID NO: 7320492 - DNA, 18 bp, Homo sapiens
tcatggctttagtccctc

SEQ ID NO: 7320493 - DNA, 22 bp, Homo sapiens
tcccttgtcacctcacactatg

SEQ ID NO: 7320494 - DNA, 22 bp, Homo sapiens
tcccttgtcctcttcgtcactg

SEQ ID NO: 7320495 - DNA, 22 bp, Homo sapiens
tcactggatcctagctgagcct

SEQ ID NO: 7320496 - DNA, 22 bp, Homo sapiens
tcactggaaatgcacagctgta

SEQ ID NO: 7320497 - DNA, 22 bp, Homo sapiens
tcacagacactgggttattgca

SEQ ID NO: 7320498 - DNA, 22 bp, Homo sapiens
tcaattctgcctctaaatattt

SEQ ID NO: 7320499 - DNA, 22 bp, Homo sapiens
tcaattctgcatacatttcact

SEQ ID NO: 7320500 - DNA, 22 bp, Homo sapiens
tcacacacatggatagtatttt

SEQ ID NO: 7320501 - DNA, 18 bp, Homo sapiens
tcaaaatatttctgtgga

SEQ ID NO: 7320502 - DNA, 20 bp, Homo sapiens
tcaaaataggtgtgggcgga

SEQ ID NO: 7320503 - DNA, 22 bp, Homo sapiens
tcaggagctgtgaatacaaagg

SEQ ID NO: 7320504 - DNA, 22 bp, Homo sapiens
tcaggtacttaagactctttag

SEQ ID NO: 7320505 - DNA, 22 bp, Homo sapiens
tcaggctctgagctgatgctaa

SEQ ID NO: 7320506 - DNA, 22 bp, Homo sapiens
tcaggcctttgaacttggagtg

SEQ ID NO: 7320507 - DNA, 22 bp, Homo sapiens
tcaggcctttcttcagagcttc

SEQ ID NO: 7320508 - DNA, 22 bp, Homo sapiens
tcatctaagagtcttacattta

SEQ ID NO: 7320509 - DNA, 22 bp, Homo sapiens
tcataaaagtactcatgttcat

SEQ ID NO: 7320510 - DNA, 22 bp, Homo sapiens
tcagttcaaacaggtgtctgga

SEQ ID NO: 7320511 - DNA, 22 bp, Homo sapiens
tcagtttttctatactttgtag

SEQ ID NO: 7320512 - DNA, 22 bp, Homo sapiens
ttcttcttctggctgcacctgg

SEQ ID NO: 7320513 - DNA, 22 bp, Homo sapiens
ttcttcttgaaactttaggttg

SEQ ID NO: 7320514 - DNA, 21 bp, Homo sapiens
ttcttcttggactgttttggc

SEQ ID NO: 7320515 - DNA, 22 bp, Homo sapiens
ttcttcttgaaactttaggttg

SEQ ID NO: 7320516 - DNA, 22 bp, Homo sapiens
ttcttcttaatgtcctgggaac

SEQ ID NO: 7320517 - DNA, 22 bp, Homo sapiens
ttcttcttcaagtgctgcattc

SEQ ID NO: 7320518 - DNA, 22 bp, Homo sapiens
ttcttcttcaagtgctgcattc

SEQ ID NO: 7320519 - DNA, 22 bp, Homo sapiens
ttcttcttcatttctgacgatg

SEQ ID NO: 7320520 - DNA, 22 bp, Homo sapiens
ttctttctcaacatgaatgttt

SEQ ID NO: 7320521 - DNA, 22 bp, Homo sapiens
ttctggctttgaccaagttcaa

SEQ ID NO: 7320522 - DNA, 22 bp, Homo sapiens
ttgaggtaataaacagccattc

SEQ ID NO: 7320523 - DNA, 22 bp, Homo sapiens
ttgaggtatattcacatatatc

SEQ ID NO: 7320524 - DNA, 22 bp, Homo sapiens
ttgaggtagttctattgtgagt

SEQ ID NO: 7320525 - DNA, 22 bp, Homo sapiens
ttgaaaatatcacaggagcagc

SEQ ID NO: 7320526 - DNA, 22 bp, Homo sapiens
ttgacagttgagggttgtctaa

SEQ ID NO: 7320527 - DNA, 19 bp, Homo sapiens
ttgaaagattagctttcta

SEQ ID NO: 7320528 - DNA, 22 bp, Homo sapiens
ttccctgcaacctttccctggg

SEQ ID NO: 7320529 - DNA, 22 bp, Homo sapiens
ttctaaagagaatgcgtttctg

SEQ ID NO: 7320530 - DNA, 22 bp, Homo sapiens
ttctctgttttcccctcgatgt

SEQ ID NO: 7320531 - DNA, 22 bp, Homo sapiens
ttctcttattctggatatgcag

SEQ ID NO: 7320532 - DNA, 19 bp, Homo sapiens
ttctctgtgctagactctg

SEQ ID NO: 7320533 - DNA, 22 bp, Homo sapiens
ttctctgtagttgcctggtgga

SEQ ID NO: 7320534 - DNA, 22 bp, Homo sapiens
ttccatgactgaagcaggggcg

SEQ ID NO: 7320535 - DNA, 22 bp, Homo sapiens
ttcatagtgtttccttccagtg

SEQ ID NO: 7320536 - DNA, 22 bp, Homo sapiens
ttcatattatgatttgaaatgc

SEQ ID NO: 7320537 - DNA, 22 bp, Homo sapiens
ttcagaatgtgaccttatttgg

SEQ ID NO: 7320538 - DNA, 22 bp, Homo sapiens
ttcagaatgctatttctgaaat

SEQ ID NO: 7320539 - DNA, 22 bp, Homo sapiens
ttcatacaatgggatattatga

SEQ ID NO: 7320540 - DNA, 22 bp, Homo sapiens
ttcaatatctctaagaatgagg

SEQ ID NO: 7320541 - DNA, 22 bp, Homo sapiens
ttcagaaatccctcttctaccc

SEQ ID NO: 7320542 - DNA, 20 bp, Homo sapiens
tcctccttgcagagcccaga

SEQ ID NO: 7320543 - DNA, 19 bp, Homo sapiens
tcctccttacttcctcttg

SEQ ID NO: 7320544 - DNA, 23 bp, Homo sapiens
ttgcttctgtgcaattcagtact

SEQ ID NO: 7320545 - DNA, 22 bp, Homo sapiens
ttgaggtattgatattttatga

SEQ ID NO: 7320546 - DNA, 22 bp, Homo sapiens
ttgcattttggttgtaaatatg

SEQ ID NO: 7320547 - DNA, 22 bp, Homo sapiens
ttgctaaaaatggaattatagg

SEQ ID NO: 7320548 - DNA, 22 bp, Homo sapiens
ttggctcagtgtgagggagatg

SEQ ID NO: 7320549 - DNA, 22 bp, Homo sapiens
ttggctcattaaagatgataat

SEQ ID NO: 7320550 - DNA, 22 bp, Homo sapiens
ttggctcatgctgttttgtgca

SEQ ID NO: 7320551 - DNA, 20 bp, Homo sapiens
ttggctcatgcaacacctac

SEQ ID NO: 7320552 - DNA, 22 bp, Homo sapiens
ttggctcacatgattatggagg

SEQ ID NO: 7320553 - DNA, 22 bp, Homo sapiens
ttggctcacctggagcctgttg

SEQ ID NO: 7320554 - DNA, 20 bp, Homo sapiens
ttggctcagatttttatggg

SEQ ID NO: 7320555 - DNA, 22 bp, Homo sapiens
ttggctcacctgtctacccaga

SEQ ID NO: 7320556 - DNA, 22 bp, Homo sapiens
ttggctcagctgggactgttga

SEQ ID NO: 7320557 - DNA, 22 bp, Homo sapiens
ttggctcagcatcttggtgcca

SEQ ID NO: 7320558 - DNA, 22 bp, Homo sapiens
ttggctcaggctttcattgtaa

SEQ ID NO: 7320559 - DNA, 22 bp, Homo sapiens
ttggctcaggacccctgtgact

SEQ ID NO: 7320560 - DNA, 22 bp, Homo sapiens
ttggctcacaaggacggttgct

SEQ ID NO: 7320561 - DNA, 22 bp, Homo sapiens
ttggctcaaaacttagattcca

SEQ ID NO: 7320562 - DNA, 22 bp, Homo sapiens
ttgggctttaattccagagagg

SEQ ID NO: 7320563 - DNA, 22 bp, Homo sapiens
ttgggcttggtcggtttgaggc

SEQ ID NO: 7320564 - DNA, 22 bp, Homo sapiens
ttgggcttgacaagctgtcaag

SEQ ID NO: 7320565 - DNA, 22 bp, Homo sapiens
ttgggcttgtctgggaaactgc

SEQ ID NO: 7320566 - DNA, 22 bp, Homo sapiens
ttggcttcattgatctcacttt

SEQ ID NO: 7320567 - DNA, 22 bp, Homo sapiens
ttgtatcagtgcctataaaatg

SEQ ID NO: 7320568 - DNA, 22 bp, Homo sapiens
ttgtacttacattttaaagcta

SEQ ID NO: 7320569 - DNA, 22 bp, Homo sapiens
ttgtggaagccctatgagagac

SEQ ID NO: 7320570 - DNA, 22 bp, Homo sapiens
ttgtggaactcatctgcctggt

SEQ ID NO: 7320571 - DNA, 22 bp, Homo sapiens
ttgtggaaatacagactccaag

SEQ ID NO: 7320572 - DNA, 22 bp, Homo sapiens
ttgtggaatgtggctgtcaatt

SEQ ID NO: 7320573 - DNA, 22 bp, Homo sapiens
tttcccaagaaaaataattgga

SEQ ID NO: 7320574 - DNA, 22 bp, Homo sapiens
tttcccaagaccatagatggaa

SEQ ID NO: 7320575 - DNA, 22 bp, Homo sapiens
tttcccaaagcctggggtgagt

SEQ ID NO: 7320576 - DNA, 22 bp, Homo sapiens
tttcccaacagtctctctcaaa

SEQ ID NO: 7320577 - DNA, 22 bp, Homo sapiens
tttcccaagtgaagtgaagcca

SEQ ID NO: 7320578 - DNA, 22 bp, Homo sapiens
tttcccaagtgtaaacatggca

SEQ ID NO: 7320579 - DNA, 22 bp, Homo sapiens
tttcccaatgagtccttgagca

SEQ ID NO: 7320580 - DNA, 22 bp, Homo sapiens
tttcccaattgagaggttctgt

SEQ ID NO: 7320581 - DNA, 22 bp, Homo sapiens
tttccaaataaggtcacactca

SEQ ID NO: 7320582 - DNA, 22 bp, Homo sapiens
tttcatcttatttgtctacatc

SEQ ID NO: 7320583 - DNA, 22 bp, Homo sapiens
tttccaaataaggtcacattct

SEQ ID NO: 7320584 - DNA, 22 bp, Homo sapiens
tttccagtgaattagtctgttt

SEQ ID NO: 7320585 - DNA, 22 bp, Homo sapiens
tttcatagtcaagtgtgtatga

SEQ ID NO: 7320586 - DNA, 22 bp, Homo sapiens
tttcacaactgcttatttgaga

SEQ ID NO: 7320587 - DNA, 23 bp, Homo sapiens
tttaacatttgaacatgtggcca

SEQ ID NO: 7320588 - DNA, 22 bp, Homo sapiens
tttaagaagttatgttataaat

SEQ ID NO: 7320589 - DNA, 22 bp, Homo sapiens
ttgttgcatttcaagtatgaga

SEQ ID NO: 7320590 - DNA, 22 bp, Homo sapiens
tttacagatgtggaaagtgagc

SEQ ID NO: 7320591 - DNA, 22 bp, Homo sapiens
tttagcatgtgtgccatgtggc

SEQ ID NO: 7320592 - DNA, 22 bp, Homo sapiens
tttatctgtatatctcaagtgt

SEQ ID NO: 7320593 - DNA, 22 bp, Homo sapiens
tttatctgttgtacctgcattg

SEQ ID NO: 7320594 - DNA, 22 bp, Homo sapiens
tttatctgttgtacatttatgc

SEQ ID NO: 7320595 - DNA, 22 bp, Homo sapiens
tttggcatagctctttgttcct

SEQ ID NO: 7320596 - DNA, 22 bp, Homo sapiens
tttgcagtgttcatcagtattt

SEQ ID NO: 7320597 - DNA, 22 bp, Homo sapiens
tttgcagtttgttcagctcttt

SEQ ID NO: 7320598 - DNA, 22 bp, Homo sapiens
tttgcatgggaggtagtaatca

SEQ ID NO: 7320599 - DNA, 22 bp, Homo sapiens
tttgcattatctcacttatata

SEQ ID NO: 7320600 - DNA, 22 bp, Homo sapiens
tttgcattctagaaaaatttct

SEQ ID NO: 7320601 - DNA, 22 bp, Homo sapiens
tttgaacaggagtatctatagt

SEQ ID NO: 7320602 - DNA, 22 bp, Homo sapiens
tttgaaattggctcattggttt

SEQ ID NO: 7320603 - DNA, 22 bp, Homo sapiens
tttgaacatgctgcatgataat

SEQ ID NO: 7320604 - DNA, 22 bp, Homo sapiens
tttgacatctaagaattcttac

SEQ ID NO: 7320605 - DNA, 22 bp, Homo sapiens
tttctagagttcatcatggtaa

SEQ ID NO: 7320606 - DNA, 22 bp, Homo sapiens
tttctagacatttctatgtaca

SEQ ID NO: 7320607 - DNA, 22 bp, Homo sapiens
tttgaaatatgtgatgagagag

SEQ ID NO: 7320608 - DNA, 22 bp, Homo sapiens
tttgaaatatgaggcattatga

SEQ ID NO: 7320609 - DNA, 22 bp, Homo sapiens
tttgaaattaagatattgtcca

SEQ ID NO: 7320610 - DNA, 22 bp, Homo sapiens
tttctattggcgtcactgttgt

SEQ ID NO: 7320611 - DNA, 19 bp, Homo sapiens
ttttcccaccctttagaat

SEQ ID NO: 7320612 - DNA, 22 bp, Homo sapiens
tttgtccttgaatcaattcaca

SEQ ID NO: 7320613 - DNA, 22 bp, Homo sapiens
agccacagtcaacctgtccata

SEQ ID NO: 7320614 - DNA, 22 bp, Homo sapiens
agcccccaggagtctccacgcc

SEQ ID NO: 7320615 - DNA, 22 bp, Homo sapiens
agcccccagtctaaactgttgg

SEQ ID NO: 7320616 - DNA, 22 bp, Homo sapiens
agcccccaggatgcaaaatgac

SEQ ID NO: 7320617 - DNA, 22 bp, Homo sapiens
acagagttaaagtggagtttaa

SEQ ID NO: 7320618 - DNA, 22 bp, Homo sapiens
acagagttagcagaaagttgga

SEQ ID NO: 7320619 - DNA, 22 bp, Homo sapiens
agctctatcacctgtcagttgc

SEQ ID NO: 7320620 - DNA, 22 bp, Homo sapiens
acagcaaaagacaagaacttaa

SEQ ID NO: 7320621 - DNA, 22 bp, Homo sapiens
agctaggataagcagagactgg

SEQ ID NO: 7320622 - DNA, 22 bp, Homo sapiens
agctagttcagagagatatgta

SEQ ID NO: 7320623 - DNA, 22 bp, Homo sapiens
acacatatgtatgcatcatgtg

SEQ ID NO: 7320624 - DNA, 22 bp, Homo sapiens
acacatatctaagatagatgac

SEQ ID NO: 7320625 - DNA, 22 bp, Homo sapiens
agcagggcccactaggggagat

SEQ ID NO: 7320626 - DNA, 22 bp, Homo sapiens
acaaaatagagttctcccctgg

SEQ ID NO: 7320627 - DNA, 20 bp, Homo sapiens
acaaaataggtactgggtag

SEQ ID NO: 7320628 - DNA, 22 bp, Homo sapiens
acaaaattacctagttattttc

SEQ ID NO: 7320629 - DNA, 22 bp, Homo sapiens
acaaaattgtgttaaactttat

SEQ ID NO: 7320630 - DNA, 22 bp, Homo sapiens
acaaatgtggacatggataatg

SEQ ID NO: 7320631 - DNA, 22 bp, Homo sapiens
acaaatgtctacattgagaata

SEQ ID NO: 7320632 - DNA, 22 bp, Homo sapiens
acaagtttatttgattagaaca

SEQ ID NO: 7320633 - DNA, 22 bp, Homo sapiens
acaatgttttgaaacatctagg

SEQ ID NO: 7320634 - DNA, 22 bp, Homo sapiens
agatggggtttcatcatgttgg

SEQ ID NO: 7320635 - DNA, 22 bp, Homo sapiens
aatgtgtttagttaatgagttg

SEQ ID NO: 7320636 - DNA, 22 bp, Homo sapiens
aatgtcatagcatttcttcaat

SEQ ID NO: 7320637 - DNA, 22 bp, Homo sapiens
aatttacagttgctgatggtac

SEQ ID NO: 7320638 - DNA, 22 bp, Homo sapiens
aatttacacttcatttggaggg

SEQ ID NO: 7320639 - DNA, 19 bp, Homo sapiens
aatttagttcttgtttaga

SEQ ID NO: 7320640 - DNA, 22 bp, Homo sapiens
aattatatgttaatcttcaatt

SEQ ID NO: 7320641 - DNA, 22 bp, Homo sapiens
aatgttgtgtttcagttcaaga

SEQ ID NO: 7320642 - DNA, 22 bp, Homo sapiens
aatgttatttctgcatagtagt

SEQ ID NO: 7320643 - DNA, 22 bp, Homo sapiens
aatgttattgtcctttccaaaa

SEQ ID NO: 7320644 - DNA, 22 bp, Homo sapiens
aagtcaatttatgttctcagac

SEQ ID NO: 7320645 - DNA, 22 bp, Homo sapiens
aagtcaattagtaaacttggaa

SEQ ID NO: 7320646 - DNA, 22 bp, Homo sapiens
aaggtgagagggaaattttcca

SEQ ID NO: 7320647 - DNA, 17 bp, Homo sapiens
aaggtgagagctgttct

SEQ ID NO: 7320648 - DNA, 22 bp, Homo sapiens
aaggtgaggattttgttctgct

SEQ ID NO: 7320649 - DNA, 22 bp, Homo sapiens
aaggtgccacagttcttttagc

SEQ ID NO: 7320650 - DNA, 22 bp, Homo sapiens
aaggtgccacttccctcagact

SEQ ID NO: 7320651 - DNA, 22 bp, Homo sapiens
aaggtgccagcccctccactga

SEQ ID NO: 7320652 - DNA, 22 bp, Homo sapiens
aaggtgccatattttggaatag

SEQ ID NO: 7320653 - DNA, 22 bp, Homo sapiens
aaggtgccccctcctgaacctt

SEQ ID NO: 7320654 - DNA, 22 bp, Homo sapiens
aaggtgcctggctttgccttct

SEQ ID NO: 7320655 - DNA, 22 bp, Homo sapiens
aaggtgcctgtctgcaaacctg

SEQ ID NO: 7320656 - DNA, 22 bp, Homo sapiens
aaggaaagattctctctctaga

SEQ ID NO: 7320657 - DNA, 22 bp, Homo sapiens
aaggcagtttgggccaccatct

SEQ ID NO: 7320658 - DNA, 22 bp, Homo sapiens
aaggcagttcactcacgcagcc

SEQ ID NO: 7320659 - DNA, 22 bp, Homo sapiens
aaggcagttaccgcaatggagg

SEQ ID NO: 7320660 - DNA, 22 bp, Homo sapiens
aaggcagtggttgtgatactgt

SEQ ID NO: 7320661 - DNA, 22 bp, Homo sapiens
aaggcagttaatttggctagaa

SEQ ID NO: 7320662 - DNA, 22 bp, Homo sapiens
aaggcagtggttgggtggagga

SEQ ID NO: 7320663 - DNA, 22 bp, Homo sapiens
aaggcagtggctggaaaacctg

SEQ ID NO: 7320664 - DNA, 22 bp, Homo sapiens
aaggcagtctggtttcaaagca

SEQ ID NO: 7320665 - DNA, 22 bp, Homo sapiens
aaggcagtcagttgttttgaaa

SEQ ID NO: 7320666 - DNA, 22 bp, Homo sapiens
aaggcagtaaaatctaccttgc

SEQ ID NO: 7320667 - DNA, 22 bp, Homo sapiens
aaggcagtaggatcttccacag

SEQ ID NO: 7320668 - DNA, 22 bp, Homo sapiens
aaggcagtactttatgtccata

SEQ ID NO: 7320669 - DNA, 22 bp, Homo sapiens
aaggcagtcaaagcagacttct

SEQ ID NO: 7320670 - DNA, 18 bp, Homo sapiens
aaggcagtatgattgcac

SEQ ID NO: 7320671 - DNA, 22 bp, Homo sapiens
aaggcagtaggtgtttcaaact

SEQ ID NO: 7320672 - DNA, 22 bp, Homo sapiens
aaggcagtatctgtagagtgct

SEQ ID NO: 7320673 - DNA, 19 bp, Homo sapiens
acagttctaatttctgtgg

SEQ ID NO: 7320674 - DNA, 21 bp, Homo sapiens
acagttctgccggcatctttc

SEQ ID NO: 7320675 - DNA, 22 bp, Homo sapiens
acagtagtacacatctatgtcc

SEQ ID NO: 7320676 - DNA, 22 bp, Homo sapiens
acagtagtgctcaatcagtgtt

SEQ ID NO: 7320677 - DNA, 22 bp, Homo sapiens
aaggcacttttctaaagacctt

SEQ ID NO: 7320678 - DNA, 22 bp, Homo sapiens
aatcaaaacctacagaggtaat

SEQ ID NO: 7320679 - DNA, 22 bp, Homo sapiens
aatccatgcatgcaaggaaagg

SEQ ID NO: 7320680 - DNA, 22 bp, Homo sapiens
aatgactctgctgcagagacac

SEQ ID NO: 7320681 - DNA, 22 bp, Homo sapiens
aataatgttgacgatagtctta

SEQ ID NO: 7320682 - DNA, 22 bp, Homo sapiens
aataacttcagttcttacatta

SEQ ID NO: 7320683 - DNA, 22 bp, Homo sapiens
aagtttcatgacttggttatta

SEQ ID NO: 7320684 - DNA, 22 bp, Homo sapiens
aagtttcaaatgttgattatgc

SEQ ID NO: 7320685 - DNA, 22 bp, Homo sapiens
aagtgcttggctaatggttatg

SEQ ID NO: 7320686 - DNA, 22 bp, Homo sapiens
aagtcaggacttatgctacctg

SEQ ID NO: 7320687 - DNA, 22 bp, Homo sapiens
aaacaatgtacatttataatgc

SEQ ID NO: 7320688 - DNA, 22 bp, Homo sapiens
aaacaatgtacacatgaatgtt

SEQ ID NO: 7320689 - DNA, 21 bp, Homo sapiens
aaagagcttttgtgctagtta

SEQ ID NO: 7320690 - DNA, 22 bp, Homo sapiens
aaagacatggaactagagatgg

SEQ ID NO: 7320691 - DNA, 22 bp, Homo sapiens
aaaagtattggccaccatttct

SEQ ID NO: 7320692 - DNA, 22 bp, Homo sapiens
aaaagtatggtggtccttttta

SEQ ID NO: 7320693 - DNA, 22 bp, Homo sapiens
aaagacattagcttagatgtca

SEQ ID NO: 7320694 - DNA, 22 bp, Homo sapiens
aaaattttgccctatccttcat

SEQ ID NO: 7320695 - DNA, 22 bp, Homo sapiens
aaacaagagtcttgctccacct

SEQ ID NO: 7320696 - DNA, 23 bp, Homo sapiens
aaaatcttctgcctatgaagaaa

SEQ ID NO: 7320697 - DNA, 22 bp, Homo sapiens
aaaatgacattccagtgatatt

SEQ ID NO: 7320698 - DNA, 22 bp, Homo sapiens
aacaaacaaacattttgtcatc

SEQ ID NO: 7320699 - DNA, 22 bp, Homo sapiens
aaattgtggcgtctgtaagagt

SEQ ID NO: 7320700 - DNA, 22 bp, Homo sapiens
aaattttagactcctgggtcta

SEQ ID NO: 7320701 - DNA, 22 bp, Homo sapiens
aaattttagtaaggaagttgag

SEQ ID NO: 7320702 - DNA, 22 bp, Homo sapiens
aaaggtttattgattctgctct

SEQ ID NO: 7320703 - DNA, 22 bp, Homo sapiens
aaaggtttatttaatcagggag

SEQ ID NO: 7320704 - DNA, 22 bp, Homo sapiens
aaagtatcaagggaagcatttt

SEQ ID NO: 7320705 - DNA, 22 bp, Homo sapiens
aaagtcaaaatgctctcctgtc

SEQ ID NO: 7320706 - DNA, 22 bp, Homo sapiens
aaagtcaatgatttctcctgga

SEQ ID NO: 7320707 - DNA, 22 bp, Homo sapiens
aaagtgtggcacaagtcacatc

SEQ ID NO: 7320708 - DNA, 22 bp, Homo sapiens
aaataattatagcgagtctatc

SEQ ID NO: 7320709 - DNA, 22 bp, Homo sapiens
aagcatcaacactatattgatg

SEQ ID NO: 7320710 - DNA, 22 bp, Homo sapiens
aaatgtattgcataggatattt

SEQ ID NO: 7320711 - DNA, 22 bp, Homo sapiens
aaatgtacaacatccatatata

SEQ ID NO: 7320712 - DNA, 22 bp, Homo sapiens
aagaaatgcagaaatgtgctgg

SEQ ID NO: 7320713 - DNA, 22 bp, Homo sapiens
aattgtaactacattgagaaca

SEQ ID NO: 7320714 - DNA, 22 bp, Homo sapiens
aagacatcagtgatgacatttg

SEQ ID NO: 7320715 - DNA, 22 bp, Homo sapiens
acaaagagggaccagtgacttg

SEQ ID NO: 7320716 - DNA, 22 bp, Homo sapiens
aagagatgtggaatcatttaca

SEQ ID NO: 7320717 - DNA, 22 bp, Homo sapiens
aagagatgctttacatcggatg

SEQ ID NO: 7320718 - DNA, 22 bp, Homo sapiens
aagagatgaaggtcctgactgt

SEQ ID NO: 7320719 - DNA, 22 bp, Homo sapiens
aagagatgatggcagccagagg

SEQ ID NO: 7320720 - DNA, 22 bp, Homo sapiens
aagagatgtgggctgctgtgca

SEQ ID NO: 7320721 - DNA, 22 bp, Homo sapiens
aagagatgttgaagtttattag

SEQ ID NO: 7320722 - DNA, 22 bp, Homo sapiens
aacatgctcttcctggctagtc

SEQ ID NO: 7320723 - DNA, 22 bp, Homo sapiens
aacatgctctgtttcttggatg

SEQ ID NO: 7320724 - DNA, 18 bp, Homo sapiens
aacatgcattagaactgc

SEQ ID NO: 7320725 - DNA, 22 bp, Homo sapiens
aaccaacataggaatgcagaga

SEQ ID NO: 7320726 - DNA, 22 bp, Homo sapiens
aataagaactccatttactcgt

SEQ ID NO: 7320727 - DNA, 21 bp, Homo sapiens
aacatttcaggatccaaattg

SEQ ID NO: 7320728 - DNA, 22 bp, Homo sapiens
aactgcttagtgatggatgacc

SEQ ID NO: 7320729 - DNA, 22 bp, Homo sapiens
aactggttatgttacctatgtc

SEQ ID NO: 7320730 - DNA, 21 bp, Homo sapiens
aactggttcaattcaactaga

SEQ ID NO: 7320731 - DNA, 22 bp, Homo sapiens
aacttaaacccactcatgtaga

SEQ ID NO: 7320732 - DNA, 23 bp, Homo sapiens
aactggttgaaggctgttaattg

SEQ ID NO: 7320733 - DNA, 22 bp, Homo sapiens
aactggttctcttttgcttgtg

SEQ ID NO: 7320734 - DNA, 22 bp, Homo sapiens
aactggttctggaggctgcagg

SEQ ID NO: 7320735 - DNA, 22 bp, Homo sapiens
aaattgaatttgggaaacattg

SEQ ID NO: 7320736 - DNA, 22 bp, Homo sapiens
aaattttagaccaggcaaaact

SEQ ID NO: 7320737 - DNA, 22 bp, Homo sapiens
aaatgtgtcagtttcattctct

SEQ ID NO: 7320738 - DNA, 22 bp, Homo sapiens
aaatgtgtatatgaaacatgat

SEQ ID NO: 7320739 - DNA, 22 bp, Homo sapiens
aaatgtgtcatattcaaagtca

SEQ ID NO: 7320740 - DNA, 21 bp, Homo sapiens
aaatgtgttccataatgcttt

SEQ ID NO: 7320741 - DNA, 22 bp, Homo sapiens
aaatgtgtgtatgtacatatat

SEQ ID NO: 7320742 - DNA, 22 bp, Homo sapiens
aaatgtctatctggcatattcc

SEQ ID NO: 7320743 - DNA, 22 bp, Homo sapiens
aaatgtttctacttgtgagcat

SEQ ID NO: 7320744 - DNA, 22 bp, Homo sapiens
aaatgttttgctcccatgtggt

SEQ ID NO: 7320745 - DNA, 22 bp, Homo sapiens
aaatgtgtttcgaaaactggtg

SEQ ID NO: 7320746 - DNA, 22 bp, Homo sapiens
aaatgtgttcctttgctacaga

SEQ ID NO: 7320747 - DNA, 22 bp, Homo sapiens
aaatgtgtttgataggaatatt

SEQ ID NO: 7320748 - DNA, 22 bp, Homo sapiens
aacaaatgtaaaatgcagatgc

SEQ ID NO: 7320749 - DNA, 22 bp, Homo sapiens
aacaggaatgaggagaaaaggt

SEQ ID NO: 7320750 - DNA, 22 bp, Homo sapiens
cacctctgctgtccacaggatg

SEQ ID NO: 7320751 - DNA, 22 bp, Homo sapiens
cacctctttgatttgaggcaag

SEQ ID NO: 7320752 - DNA, 22 bp, Homo sapiens
agcatacaccctaaactgctta

SEQ ID NO: 7320753 - DNA, 22 bp, Homo sapiens
agcaggggcagggttttgtgct

SEQ ID NO: 7320754 - DNA, 22 bp, Homo sapiens
agcagggggcatccttgccctt

SEQ ID NO: 7320755 - DNA, 22 bp, Homo sapiens
agcaggggtggaaggtagcttt

SEQ ID NO: 7320756 - DNA, 22 bp, Homo sapiens
agcaggagtttgatgcttttat

SEQ ID NO: 7320757 - DNA, 22 bp, Homo sapiens
cacacactggagcaaggagatg

SEQ ID NO: 7320758 - DNA, 22 bp, Homo sapiens
cacacactgttaatgtaggagt

SEQ ID NO: 7320759 - DNA, 22 bp, Homo sapiens
caagcaacgactttcaagctgt

SEQ ID NO: 7320760 - DNA, 22 bp, Homo sapiens
cacaaggctttcatctggcata

SEQ ID NO: 7320761 - DNA, 22 bp, Homo sapiens
caagacaatgggtaagtgtaac

SEQ ID NO: 7320762 - DNA, 22 bp, Homo sapiens
cagaatgtatatgatctaaggt

SEQ ID NO: 7320763 - DNA, 22 bp, Homo sapiens
cagaatgtagatcatcatcaag

SEQ ID NO: 7320764 - DNA, 22 bp, Homo sapiens
cagaataccctatagacagaat

SEQ ID NO: 7320765 - DNA, 22 bp, Homo sapiens
agcatataaatggacatatttg

SEQ ID NO: 7320766 - DNA, 22 bp, Homo sapiens
agcatatacaaactcatataca

SEQ ID NO: 7320767 - DNA, 22 bp, Homo sapiens
cagaaggagcgctaaggtccca

SEQ ID NO: 7320768 - DNA, 22 bp, Homo sapiens
cagaggtgcatacaggtcatta

SEQ ID NO: 7320769 - DNA, 22 bp, Homo sapiens
agcctctgtcaagcttttcaaa

SEQ ID NO: 7320770 - DNA, 22 bp, Homo sapiens
cagcagggcccccgggtgcgcc

SEQ ID NO: 7320771 - DNA, 22 bp, Homo sapiens
cagcagtttcctatggttcagc

SEQ ID NO: 7320772 - DNA, 22 bp, Homo sapiens
atggccaggcacctctggctga

SEQ ID NO: 7320773 - DNA, 22 bp, Homo sapiens
atggccagcttataggggctca

SEQ ID NO: 7320774 - DNA, 22 bp, Homo sapiens
atggccagcccttcccgcagct

SEQ ID NO: 7320775 - DNA, 22 bp, Homo sapiens
atggccagccactcctgatggc

SEQ ID NO: 7320776 - DNA, 22 bp, Homo sapiens
agacattttggaaagtattact

SEQ ID NO: 7320777 - DNA, 22 bp, Homo sapiens
agagatgaagggcattccccag

SEQ ID NO: 7320778 - DNA, 22 bp, Homo sapiens
agagatgaacataaaacaagga

SEQ ID NO: 7320779 - DNA, 22 bp, Homo sapiens
atggctcagcgcctttctgtgg

SEQ ID NO: 7320780 - DNA, 22 bp, Homo sapiens
atggctcagcccatggaagaaa

SEQ ID NO: 7320781 - DNA, 17 bp, Homo sapiens
atggctcacctgtgggc

SEQ ID NO: 7320782 - DNA, 22 bp, Homo sapiens
agagatgacatgagggacttaa

SEQ ID NO: 7320783 - DNA, 22 bp, Homo sapiens
agagatgaatcttgagactctg

SEQ ID NO: 7320784 - DNA, 22 bp, Homo sapiens
agagatgactgatggctgatta

SEQ ID NO: 7320785 - DNA, 22 bp, Homo sapiens
agagatgagaacatgcttggat

SEQ ID NO: 7320786 - DNA, 22 bp, Homo sapiens
atgacaaaatgaatgcagctag

SEQ ID NO: 7320787 - DNA, 22 bp, Homo sapiens
atgcactgggtgaggaaggaga

SEQ ID NO: 7320788 - DNA, 22 bp, Homo sapiens
atgcacttaaataacataactt

SEQ ID NO: 7320789 - DNA, 17 bp, Homo sapiens
agacagacctctgcatc

SEQ ID NO: 7320790 - DNA, 21 bp, Homo sapiens
agaagtcaattgaactgaaat

SEQ ID NO: 7320791 - DNA, 23 bp, Homo sapiens
agaagtggaatggccgtggggtc

SEQ ID NO: 7320792 - DNA, 22 bp, Homo sapiens
atgaaactctaacttaacaagt

SEQ ID NO: 7320793 - DNA, 22 bp, Homo sapiens
atgaaagatgatttaaagtact

SEQ ID NO: 7320794 - DNA, 22 bp, Homo sapiens
attcagtagaagttagctatta

SEQ ID NO: 7320795 - DNA, 20 bp, Homo sapiens
attcatgtctttataaaagc

SEQ ID NO: 7320796 - DNA, 22 bp, Homo sapiens
attgcagtgtgtgttccatgag

SEQ ID NO: 7320797 - DNA, 22 bp, Homo sapiens
attgcagtgatggttgcataat

SEQ ID NO: 7320798 - DNA, 22 bp, Homo sapiens
atgtttatgcaaacatgtgagt

SEQ ID NO: 7320799 - DNA, 22 bp, Homo sapiens
attattagtgatgttgttactg

SEQ ID NO: 7320800 - DNA, 22 bp, Homo sapiens
agaggaggaagagctttaaaat

SEQ ID NO: 7320801 - DNA, 22 bp, Homo sapiens
atttctcttagcaagacattac

SEQ ID NO: 7320802 - DNA, 22 bp, Homo sapiens
atttgcttttactatgttaaaa

SEQ ID NO: 7320803 - DNA, 22 bp, Homo sapiens
atttctctcattgttagctagg

SEQ ID NO: 7320804 - DNA, 22 bp, Homo sapiens
agagtgggtgatctctgttgtc

SEQ ID NO: 7320805 - DNA, 22 bp, Homo sapiens
acctcctgatgagagtaaagga

SEQ ID NO: 7320806 - DNA, 22 bp, Homo sapiens
agtcttctgggtgtttccagag

SEQ ID NO: 7320807 - DNA, 20 bp, Homo sapiens
agtctgtcaatttacagtgg

SEQ ID NO: 7320808 - DNA, 22 bp, Homo sapiens
agtcttcttgatcttttcagtg

SEQ ID NO: 7320809 - DNA, 22 bp, Homo sapiens
agtcttctttcatttactcagt

SEQ ID NO: 7320810 - DNA, 22 bp, Homo sapiens
agtcttctttgtgttctctcat

SEQ ID NO: 7320811 - DNA, 22 bp, Homo sapiens
agtctttaagtaatgataggca

SEQ ID NO: 7320812 - DNA, 22 bp, Homo sapiens
actgagggccaaaggcactgag

SEQ ID NO: 7320813 - DNA, 22 bp, Homo sapiens
agtgcaattttgctttcccaat

SEQ ID NO: 7320814 - DNA, 22 bp, Homo sapiens
actcttcagtacaataatatct

SEQ ID NO: 7320815 - DNA, 21 bp, Homo sapiens
actgagggccagagaggacct

SEQ ID NO: 7320816 - DNA, 23 bp, Homo sapiens
actgctttattcatgaggctctc

SEQ ID NO: 7320817 - DNA, 21 bp, Homo sapiens
actggaagtgggtcaggaagt

SEQ ID NO: 7320818 - DNA, 22 bp, Homo sapiens
acttaaagttataatttgctaa

SEQ ID NO: 7320819 - DNA, 22 bp, Homo sapiens
acttctctttagtactaaatgt

SEQ ID NO: 7320820 - DNA, 22 bp, Homo sapiens
acttctcttccccggaactcta

SEQ ID NO: 7320821 - DNA, 22 bp, Homo sapiens
actgtagtctaaatatagtctt

SEQ ID NO: 7320822 - DNA, 22 bp, Homo sapiens
ataaaaactgacccatcctttg

SEQ ID NO: 7320823 - DNA, 22 bp, Homo sapiens
ataaacaagactggccaacttt

SEQ ID NO: 7320824 - DNA, 22 bp, Homo sapiens
atatgcttgggactgatacagt

SEQ ID NO: 7320825 - DNA, 22 bp, Homo sapiens
atatgcttacagcttaaaatcc

SEQ ID NO: 7320826 - DNA, 22 bp, Homo sapiens
atatgcttatgatgtctcaagt

SEQ ID NO: 7320827 - DNA, 22 bp, Homo sapiens
actttcagaattgtacagagtc

SEQ ID NO: 7320828 - DNA, 22 bp, Homo sapiens
actttcatgttcatttggaacc

SEQ ID NO: 7320829 - DNA, 22 bp, Homo sapiens
atattcttccaaaacatcattt

SEQ ID NO: 7320830 - DNA, 22 bp, Homo sapiens
agaaaggtcacttagcctcagc

SEQ ID NO: 7320831 - DNA, 16 bp, Homo sapiens
agggagagaggaacat

SEQ ID NO: 7320832 - DNA, 22 bp, Homo sapiens
agggagaggagcgtttcacatc

SEQ ID NO: 7320833 - DNA, 22 bp, Homo sapiens
agggagaggagggtcttgttga

SEQ ID NO: 7320834 - DNA, 22 bp, Homo sapiens
agggagagacatttccttcttg

SEQ ID NO: 7320835 - DNA, 18 bp, Homo sapiens
agggagagaccgcgggtc

SEQ ID NO: 7320836 - DNA, 22 bp, Homo sapiens
agggagagaagttatacaagat

SEQ ID NO: 7320837 - DNA, 22 bp, Homo sapiens
acatttctatagtgcatctgtt

SEQ ID NO: 7320838 - DNA, 22 bp, Homo sapiens
acattgtagacttttcatatgt

SEQ ID NO: 7320839 - DNA, 22 bp, Homo sapiens
acattgtataatgattatcaca

SEQ ID NO: 7320840 - DNA, 22 bp, Homo sapiens
acatttcactgttcacagcagg

SEQ ID NO: 7320841 - DNA, 22 bp, Homo sapiens
acattgcaataataattctctt

SEQ ID NO: 7320842 - DNA, 22 bp, Homo sapiens
acatttcttgatgcctctgtga

SEQ ID NO: 7320843 - DNA, 18 bp, Homo sapiens
acatttctatgcttctgg

SEQ ID NO: 7320844 - DNA, 22 bp, Homo sapiens
acatgtttaagtttaatgaaaa

SEQ ID NO: 7320845 - DNA, 22 bp, Homo sapiens
acatccatcttatgagataggt

SEQ ID NO: 7320846 - DNA, 22 bp, Homo sapiens
acatgcttctgtttcaagaact

SEQ ID NO: 7320847 - DNA, 22 bp, Homo sapiens
acagtacaccactgtgtacagt

SEQ ID NO: 7320848 - DNA, 21 bp, Homo sapiens
aggacacagagacacctattg

SEQ ID NO: 7320849 - DNA, 22 bp, Homo sapiens
acagtctctgttgctgctgttt

SEQ ID NO: 7320850 - DNA, 22 bp, Homo sapiens
acatattggcaaactggaggca

SEQ ID NO: 7320851 - DNA, 21 bp, Homo sapiens
aggcagctcaggcccagagag

SEQ ID NO: 7320852 - DNA, 21 bp, Homo sapiens
acatacattatctttttaaaa

SEQ ID NO: 7320853 - DNA, 22 bp, Homo sapiens
acagtttagagcatgatgacca

SEQ ID NO: 7320854 - DNA, 22 bp, Homo sapiens
aggatgccttcattgcatggcc

SEQ ID NO: 7320855 - DNA, 20 bp, Homo sapiens
acagtttattttacttggtt

SEQ ID NO: 7320856 - DNA, 22 bp, Homo sapiens
aggcactgggtaattagtagct

SEQ ID NO: 7320857 - DNA, 22 bp, Homo sapiens
aggcactgggggatgagcaagg

SEQ ID NO: 7320858 - DNA, 20 bp, Homo sapiens
aggcactggggataggtaag

SEQ ID NO: 7320859 - DNA, 22 bp, Homo sapiens
aggcactgggaatatgctgagg

SEQ ID NO: 7320860 - DNA, 20 bp, Homo sapiens
aggcactggatttcttatat

SEQ ID NO: 7320861 - DNA, 18 bp, Homo sapiens
aggcactggaattaaggg

SEQ ID NO: 7320862 - DNA, 22 bp, Homo sapiens
aggcactgcttctaagtaggaa

SEQ ID NO: 7320863 - DNA, 22 bp, Homo sapiens
aggacacactgttctcacgtaa

SEQ ID NO: 7320864 - DNA, 22 bp, Homo sapiens
cagtttatttccaagatgacaa

SEQ ID NO: 7320865 - DNA, 22 bp, Homo sapiens
cagtttcagctcaagcactcag

SEQ ID NO: 7320866 - DNA, 22 bp, Homo sapiens
caggtgccatagacgggcctgg

SEQ ID NO: 7320867 - DNA, 22 bp, Homo sapiens
aggaccctgaggtctcctgtga

SEQ ID NO: 7320868 - DNA, 22 bp, Homo sapiens
aggaccctgctcaagcatctcc

SEQ ID NO: 7320869 - DNA, 22 bp, Homo sapiens
aggaccctgagcgggcatgccg

SEQ ID NO: 7320870 - DNA, 22 bp, Homo sapiens
aggacgctctcgctgaacttct

SEQ ID NO: 7320871 - DNA, 22 bp, Homo sapiens
ccaaggtggctacagccctgca

SEQ ID NO: 7320872 - DNA, 22 bp, Homo sapiens
ccaaggtgggaggattgcttga

SEQ ID NO: 7320873 - DNA, 22 bp, Homo sapiens
ccaaggtgggcagatcacgagg

SEQ ID NO: 7320874 - DNA, 23 bp, Homo sapiens
aggcagcaggttgtccagggtga

SEQ ID NO: 7320875 - DNA, 22 bp, Homo sapiens
ccaagcagagcagcctctctgg

SEQ ID NO: 7320876 - DNA, 22 bp, Homo sapiens
ccaagcagaaccattcaggcac

SEQ ID NO: 7320877 - DNA, 22 bp, Homo sapiens
ccaagcaggatattctgtgtca

SEQ ID NO: 7320878 - DNA, 22 bp, Homo sapiens
ccaagcaaggctaattcacttg

SEQ ID NO: 7320879 - DNA, 22 bp, Homo sapiens
cattaaattccttgttctcaaa

SEQ ID NO: 7320880 - DNA, 22 bp, Homo sapiens
cattaaatatcaacctagacta

SEQ ID NO: 7320881 - DNA, 15 bp, Homo sapiens
aggcactgtgggacc

SEQ ID NO: 7320882 - DNA, 22 bp, Homo sapiens
aggcactgtggaagacatggtt

SEQ ID NO: 7320883 - DNA, 22 bp, Homo sapiens
aggcactgtgcttcttatatgt

SEQ ID NO: 7320884 - DNA, 22 bp, Homo sapiens
aggcactgtgctgatgtcttat

SEQ ID NO: 7320885 - DNA, 22 bp, Homo sapiens
aggcactgtgcagtcccaagca

SEQ ID NO: 7320886 - DNA, 22 bp, Homo sapiens
aggcactgtactaggtacaggg

SEQ ID NO: 7320887 - DNA, 22 bp, Homo sapiens
aggcactggtctaccccttagt

SEQ ID NO: 7320888 - DNA, 22 bp, Homo sapiens
aggatttctgtgcctggaaaat

SEQ ID NO: 7320889 - DNA, 22 bp, Homo sapiens
aggattgtgcctccagtcagaa

SEQ ID NO: 7320890 - DNA, 22 bp, Homo sapiens
aggcactgcagattacaggcgc

SEQ ID NO: 7320891 - DNA, 22 bp, Homo sapiens
catgtcagggcttcctcctctc

SEQ ID NO: 7320892 - DNA, 22 bp, Homo sapiens
catgtcagggaagagagtcagt

SEQ ID NO: 7320893 - DNA, 22 bp, Homo sapiens
aggattcagaatgtatgcagtg

SEQ ID NO: 7320894 - DNA, 22 bp, Homo sapiens
caggctgcgtttgtgaaaggta

SEQ ID NO: 7320895 - DNA, 23 bp, Homo sapiens
cagggtgaccaatgtggccatca

SEQ ID NO: 7320896 - DNA, 22 bp, Homo sapiens
caggtgagctctatctagggag

SEQ ID NO: 7320897 - DNA, 22 bp, Homo sapiens
agctgggctgggctgagctgag

SEQ ID NO: 7320898 - DNA, 22 bp, Homo sapiens
caggcactggccagtcagcaca

SEQ ID NO: 7320899 - DNA, 22 bp, Homo sapiens
ccacaggacggaggtctggccg

SEQ ID NO: 7320900 - DNA, 17 bp, Homo sapiens
aggcaggtaagagttat

SEQ ID NO: 7320901 - DNA, 22 bp, Homo sapiens
aggcatggatgtagcagtgacc

SEQ ID NO: 7320902 - DNA, 21 bp, Homo sapiens
aggcatggaaatggcacactg

SEQ ID NO: 7320903 - DNA, 22 bp, Homo sapiens
aggcttcctggaggaagaggta

SEQ ID NO: 7320904 - DNA, 18 bp, Homo sapiens
ccctcttgcacaaagcaa

SEQ ID NO: 7320905 - DNA, 22 bp, Homo sapiens
cctcctggaggctctagggaaa

SEQ ID NO: 7320906 - DNA, 21 bp, Homo sapiens
aggggacagagtagctccagg

SEQ ID NO: 7320907 - DNA, 22 bp, Homo sapiens
ccgaggacattgggcttctgtt

SEQ ID NO: 7320908 - DNA, 22 bp, Homo sapiens
agtgggcttttttccgttccat

SEQ ID NO: 7320909 - DNA, 22 bp, Homo sapiens
ctctgagaagccttgatgggga

SEQ ID NO: 7320910 - DNA, 22 bp, Homo sapiens
ctctgagagcggtctgtggctt

SEQ ID NO: 7320911 - DNA, 22 bp, Homo sapiens
ctgaagctaggtcaaaaaaggg

SEQ ID NO: 7320912 - DNA, 22 bp, Homo sapiens
aggtatgtgggtgagaggagga

SEQ ID NO: 7320913 - DNA, 19 bp, Homo sapiens
aggtgaggggcaccatgtc

SEQ ID NO: 7320914 - DNA, 22 bp, Homo sapiens
aggtgagggtgccagtgcatgg

SEQ ID NO: 7320915 - DNA, 22 bp, Homo sapiens
aggtgaggtttgggaggtgtca

SEQ ID NO: 7320916 - DNA, 23 bp, Homo sapiens
aggtgcactgtggtggcagtggc

SEQ ID NO: 7320917 - DNA, 22 bp, Homo sapiens
agtcagttgtggagatttaact

SEQ ID NO: 7320918 - DNA, 18 bp, Homo sapiens
agtcagttgatggggacc

SEQ ID NO: 7320919 - DNA, 22 bp, Homo sapiens
ctacactagagttgcaatggaa

SEQ ID NO: 7320920 - DNA, 22 bp, Homo sapiens
ctaaacaagggattataattga

SEQ ID NO: 7320921 - DNA, 22 bp, Homo sapiens
ctaaacaagggattataattga

SEQ ID NO: 7320922 - DNA, 22 bp, Homo sapiens
ctaaacaatgaacaaagcactg

SEQ ID NO: 7320923 - DNA, 22 bp, Homo sapiens
agtaatagagattttaatgtcc

SEQ ID NO: 7320924 - DNA, 22 bp, Homo sapiens
aggtttccagcatggggaaggc

SEQ ID NO: 7320925 - DNA, 22 bp, Homo sapiens
aggtttataggaaatttgttcc

SEQ ID NO: 7320926 - DNA, 22 bp, Homo sapiens
ataataaaccaggatgggtctg

SEQ ID NO: 7320927 - DNA, 18 bp, Homo sapiens
ctgcccagagcatttcat

SEQ ID NO: 7320928 - DNA, 22 bp, Homo sapiens
agtgttactggttcatgaatct

SEQ ID NO: 7320929 - DNA, 17 bp, Homo sapiens
agtttatttagccttct

SEQ ID NO: 7320930 - DNA, 22 bp, Homo sapiens
agtttcaaattactgcccatgg

SEQ ID NO: 7320931 - DNA, 22 bp, Homo sapiens
agtttattctctggtcttagta

SEQ ID NO: 7320932 - DNA, 20 bp, Homo sapiens
agtttattccaggagaactg

SEQ ID NO: 7320933 - DNA, 22 bp, Homo sapiens
agttttattccaatgtgcagca

SEQ ID NO: 7320934 - DNA, 22 bp, Homo sapiens
atagacacatgttattatactt

SEQ ID NO: 7320935 - DNA, 22 bp, Homo sapiens
atagacacagatctatatatgt

SEQ ID NO: 7320936 - DNA, 22 bp, Homo sapiens
atagacagctacatagaatata

SEQ ID NO: 7320937 - DNA, 19 bp, Homo sapiens
atagaaagggttaaagaca

SEQ ID NO: 7320938 - DNA, 22 bp, Homo sapiens
ctggagctgtcttcacaggcct

SEQ ID NO: 7320939 - DNA, 22 bp, Homo sapiens
ctggagcttattgggagcagaa

SEQ ID NO: 7320940 - DNA, 22 bp, Homo sapiens
ataatttacaactgcttttaat

SEQ ID NO: 7320941 - DNA, 22 bp, Homo sapiens
atacatgaggaggctggaaaca

SEQ ID NO: 7320942 - DNA, 22 bp, Homo sapiens
ctggagctggcccaggctggcc

SEQ ID NO: 7320943 - DNA, 22 bp, Homo sapiens
ctggagctgccagggctgccgc

SEQ ID NO: 7320944 - DNA, 22 bp, Homo sapiens
ctggagctggtatagggacaaa

SEQ ID NO: 7320945 - DNA, 22 bp, Homo sapiens
ctggaaatcactactagtcaat

SEQ ID NO: 7320946 - DNA, 22 bp, Homo sapiens
atcaggccagcaatccctgggc

SEQ ID NO: 7320947 - DNA, 22 bp, Homo sapiens
atcattcagcctaagcaagtac

SEQ ID NO: 7320948 - DNA, 22 bp, Homo sapiens
atcattagaccaaactagagct

SEQ ID NO: 7320949 - DNA, 22 bp, Homo sapiens
cttcagttctaaagtagaatgt

SEQ ID NO: 7320950 - DNA, 22 bp, Homo sapiens
ctgggctgtaatgtggcactga

SEQ ID NO: 7320951 - DNA, 22 bp, Homo sapiens
atagtctttactgctgaattga

SEQ ID NO: 7320952 - DNA, 22 bp, Homo sapiens
atatattttgaatagcctctgt

SEQ ID NO: 7320953 - DNA, 22 bp, Homo sapiens
atatattttgcggtcacgtggc

SEQ ID NO: 7320954 - DNA, 20 bp, Homo sapiens
atagtattcaggccacttgt

SEQ ID NO: 7320955 - DNA, 22 bp, Homo sapiens
atagtcttcagcactttgatca

SEQ ID NO: 7320956 - DNA, 22 bp, Homo sapiens
atatattttttgagacagagtc

SEQ ID NO: 7320957 - DNA, 22 bp, Homo sapiens
atattttcactgaaccaaagta

SEQ ID NO: 7320958 - DNA, 22 bp, Homo sapiens
atattttcacagaacttgcaaa

SEQ ID NO: 7320959 - DNA, 22 bp, Homo sapiens
atattttgaagttaataatgtg

SEQ ID NO: 7320960 - DNA, 22 bp, Homo sapiens
atgttattcaatttgaatccaa

SEQ ID NO: 7320961 - DNA, 22 bp, Homo sapiens
atgttatttctgaaagatcatt

SEQ ID NO: 7320962 - DNA, 22 bp, Homo sapiens
attaaattttcactaggctccc

SEQ ID NO: 7320963 - DNA, 22 bp, Homo sapiens
attaaattggatctgcatagtt

SEQ ID NO: 7320964 - DNA, 22 bp, Homo sapiens
attaaattggacgctgggggaa

SEQ ID NO: 7320965 - DNA, 22 bp, Homo sapiens
gattcttaagacattatgtatt

SEQ ID NO: 7320966 - DNA, 22 bp, Homo sapiens
attcaagtggctgctatgttaa

SEQ ID NO: 7320967 - DNA, 22 bp, Homo sapiens
gcatcagtagctatagttacaa

SEQ ID NO: 7320968 - DNA, 22 bp, Homo sapiens
attctgcacatccaagaacagg

SEQ ID NO: 7320969 - DNA, 22 bp, Homo sapiens
gcagggcagtgtgtctgtgggg

SEQ ID NO: 7320970 - DNA, 22 bp, Homo sapiens
atttcttatgaatattgactgt

SEQ ID NO: 7320971 - DNA, 22 bp, Homo sapiens
atttcccaggactagaaatata

SEQ ID NO: 7320972 - DNA, 22 bp, Homo sapiens
atttcccactctactacatgct

SEQ ID NO: 7320973 - DNA, 22 bp, Homo sapiens
atttcccaatacgctaagtgga

SEQ ID NO: 7320974 - DNA, 22 bp, Homo sapiens
attgtactggtaaagaagtggg

SEQ ID NO: 7320975 - DNA, 22 bp, Homo sapiens
attgtactacaccatagtactg

SEQ ID NO: 7320976 - DNA, 22 bp, Homo sapiens
atttcttcctctgtcagtaact

SEQ ID NO: 7320977 - DNA, 22 bp, Homo sapiens
atttgtagtgaagtgaaaataa

SEQ ID NO: 7320978 - DNA, 22 bp, Homo sapiens
attttcctctggtttccccaga

SEQ ID NO: 7320979 - DNA, 22 bp, Homo sapiens
gccttccctctcatcctgctgg

SEQ ID NO: 7320980 - DNA, 22 bp, Homo sapiens
gccttccctggctaggcaagca

SEQ ID NO: 7320981 - DNA, 22 bp, Homo sapiens
gccttcccaagacgcctgagtt

SEQ ID NO: 7320982 - DNA, 19 bp, Homo sapiens
gccttcccaccacccgtcc

SEQ ID NO: 7320983 - DNA, 22 bp, Homo sapiens
gccttcccaccctgcgaggctg

SEQ ID NO: 7320984 - DNA, 21 bp, Homo sapiens
attttcattaattcagtgtgg

SEQ ID NO: 7320985 - DNA, 22 bp, Homo sapiens
caaagaatgagtgagtacataa

SEQ ID NO: 7320986 - DNA, 22 bp, Homo sapiens
attttgaatcaccttggaagaa

SEQ ID NO: 7320987 - DNA, 22 bp, Homo sapiens
attttgaagggaattgaagttc

SEQ ID NO: 7320988 - DNA, 22 bp, Homo sapiens
gaattttagaatatgtgggctt

SEQ ID NO: 7320989 - DNA, 22 bp, Homo sapiens
gaattttaataaaggtttatca

SEQ ID NO: 7320990 - DNA, 22 bp, Homo sapiens
gaattttaagtgttcgcctctt

SEQ ID NO: 7320991 - DNA, 22 bp, Homo sapiens
gacaggaaaggggtctgttttc

SEQ ID NO: 7320992 - DNA, 22 bp, Homo sapiens
cttctccagccacgcccactcc

SEQ ID NO: 7320993 - DNA, 22 bp, Homo sapiens
ctttacagcttagtggtatgga

SEQ ID NO: 7320994 - DNA, 22 bp, Homo sapiens
ctttacagcctccagaaggaac

SEQ ID NO: 7320995 - DNA, 22 bp, Homo sapiens
ctttacagaataagaatactgg

SEQ ID NO: 7320996 - DNA, 22 bp, Homo sapiens
ctttggcttttagatatccatt

SEQ ID NO: 7320997 - DNA, 19 bp, Homo sapiens
ctttttcaccttctagaag

SEQ ID NO: 7320998 - DNA, 22 bp, Homo sapiens
atgacagaggagtgcaggtgat

SEQ ID NO: 7320999 - DNA, 22 bp, Homo sapiens
atgagaaagagttgtatctaga

SEQ ID NO: 7321000 - DNA, 22 bp, Homo sapiens
atgagaaatttattacaagcta

SEQ ID NO: 7321001 - DNA, 22 bp, Homo sapiens
gaggagctgggtcagggagaca

SEQ ID NO: 7321002 - DNA, 22 bp, Homo sapiens
gaggcacatatatacagagccc

SEQ ID NO: 7321003 - DNA, 22 bp, Homo sapiens
atgtggaatgaacaaaggaggc

SEQ ID NO: 7321004 - DNA, 20 bp, Homo sapiens
atgtcaggaagggagtcagg

SEQ ID NO: 7321005 - DNA, 22 bp, Homo sapiens
atgtcagttataaaagacagat

SEQ ID NO: 7321006 - DNA, 22 bp, Homo sapiens
atgttactgtgatcatgatact

SEQ ID NO: 7321007 - DNA, 22 bp, Homo sapiens
atgttacttagaataattctgg

SEQ ID NO: 7321008 - DNA, 22 bp, Homo sapiens
gaggttccccattgtactggct

SEQ ID NO: 7321009 - DNA, 22 bp, Homo sapiens
gaggttccagacagcttaggga

SEQ ID NO: 7321010 - DNA, 22 bp, Homo sapiens
atgctgtggggagtgagggtag

SEQ ID NO: 7321011 - DNA, 22 bp, Homo sapiens
atgcttaacttcctagtctata

SEQ ID NO: 7321012 - DNA, 22 bp, Homo sapiens
atgcttaactctgtacatagtt

SEQ ID NO: 7321013 - DNA, 22 bp, Homo sapiens
atggatgtgaagagggagaagc

SEQ ID NO: 7321014 - DNA, 21 bp, Homo sapiens
atggctcaggccatcaatgga

SEQ ID NO: 7321015 - DNA, 22 bp, Homo sapiens
atggctcatttatcttgcagcc

SEQ ID NO: 7321016 - DNA, 22 bp, Homo sapiens
atgggagttttctctgatgctc

SEQ ID NO: 7321017 - DNA, 22 bp, Homo sapiens
cacctgcctggtccttagggct

SEQ ID NO: 7321018 - DNA, 22 bp, Homo sapiens
cacctggcccagctccagtgct

SEQ ID NO: 7321019 - DNA, 22 bp, Homo sapiens
cacctgccccagtcttggagct

SEQ ID NO: 7321020 - DNA, 22 bp, Homo sapiens
cactcaatacaatggttggcac

SEQ ID NO: 7321021 - DNA, 21 bp, Homo sapiens
cactcaataaatgtcatatgc

SEQ ID NO: 7321022 - DNA, 22 bp, Homo sapiens
cactgcaacctccacctcctgg

SEQ ID NO: 7321023 - DNA, 22 bp, Homo sapiens
cactttaactcacatttcagct

SEQ ID NO: 7321024 - DNA, 22 bp, Homo sapiens
cacttcagctacaatcacatga

SEQ ID NO: 7321025 - DNA, 22 bp, Homo sapiens
cacttaagcagttaatttatct

SEQ ID NO: 7321026 - DNA, 22 bp, Homo sapiens
cacttagtctcaccagttcagt

SEQ ID NO: 7321027 - DNA, 22 bp, Homo sapiens
ggagaagggacagactcagctt

SEQ ID NO: 7321028 - DNA, 22 bp, Homo sapiens
caatttcatggataaaagatgt

SEQ ID NO: 7321029 - DNA, 22 bp, Homo sapiens
caatttccttcatagatgactg

SEQ ID NO: 7321030 - DNA, 22 bp, Homo sapiens
caatttcattaatagatataga

SEQ ID NO: 7321031 - DNA, 22 bp, Homo sapiens
caatttcaatacaaaatacatt

SEQ ID NO: 7321032 - DNA, 22 bp, Homo sapiens
caatttcactaataatatttac

SEQ ID NO: 7321033 - DNA, 22 bp, Homo sapiens
caatttcaatgaggccacaggg

SEQ ID NO: 7321034 - DNA, 20 bp, Homo sapiens
gctgggctttgactgacaca

SEQ ID NO: 7321035 - DNA, 22 bp, Homo sapiens
gctgggcttgtggccagctggg

SEQ ID NO: 7321036 - DNA, 22 bp, Homo sapiens
gctgggctcaccaggccactag

SEQ ID NO: 7321037 - DNA, 22 bp, Homo sapiens
caagccatactgggtgaaatca

SEQ ID NO: 7321038 - DNA, 22 bp, Homo sapiens
caagccatattttgaagaatga

SEQ ID NO: 7321039 - DNA, 22 bp, Homo sapiens
caagcccccggcaagtgtgtat

SEQ ID NO: 7321040 - DNA, 22 bp, Homo sapiens
gctgccctgactccagcagcct

SEQ ID NO: 7321041 - DNA, 22 bp, Homo sapiens
caacaatatgctgagtttttca

SEQ ID NO: 7321042 - DNA, 22 bp, Homo sapiens
caaattttgtgtgttctctagt

SEQ ID NO: 7321043 - DNA, 22 bp, Homo sapiens
caacaatatgccagactcaatt

SEQ ID NO: 7321044 - DNA, 22 bp, Homo sapiens
caaattttgtgtgttctctagt

SEQ ID NO: 7321045 - DNA, 22 bp, Homo sapiens
cagatgcatgtacagtgttgct

SEQ ID NO: 7321046 - DNA, 22 bp, Homo sapiens
gggttcctggctcctgtgtggt

SEQ ID NO: 7321047 - DNA, 22 bp, Homo sapiens
gggtccctggaattacttgaca

SEQ ID NO: 7321048 - DNA, 22 bp, Homo sapiens
ggggccttggatctgtgccccg

SEQ ID NO: 7321049 - DNA, 22 bp, Homo sapiens
gggctgtcacgcccctgcacct

SEQ ID NO: 7321050 - DNA, 22 bp, Homo sapiens
gggctgtcatgtgtcagtgacc

SEQ ID NO: 7321051 - DNA, 22 bp, Homo sapiens
gggcaggtacaagatgcttctt

SEQ ID NO: 7321052 - DNA, 22 bp, Homo sapiens
cagagacacttaacaggaatgg

SEQ ID NO: 7321053 - DNA, 22 bp, Homo sapiens
cagacaaagcggaaactgttta

SEQ ID NO: 7321054 - DNA, 22 bp, Homo sapiens
gtcagcagggtccccttgagtg

SEQ ID NO: 7321055 - DNA, 22 bp, Homo sapiens
gtcagcagtgtcagctctgggg

SEQ ID NO: 7321056 - DNA, 22 bp, Homo sapiens
gtcagcagtggcagctcccggg

SEQ ID NO: 7321057 - DNA, 22 bp, Homo sapiens
gtcagatctttggggatgctgt

SEQ ID NO: 7321058 - DNA, 22 bp, Homo sapiens
cagatttattttacatccttca

SEQ ID NO: 7321059 - DNA, 23 bp, Homo sapiens
cccagcagagatgaggaggggtc

SEQ ID NO: 7321060 - DNA, 20 bp, Homo sapiens
cccaaggtcacagctagcag

SEQ ID NO: 7321061 - DNA, 22 bp, Homo sapiens
tgacttttggacctcactgtcc

SEQ ID NO: 7321062 - DNA, 22 bp, Homo sapiens
tgaaagcttgttggaaatgtag

SEQ ID NO: 7321063 - DNA, 22 bp, Homo sapiens
cctcacatgaatgtaagctcca

SEQ ID NO: 7321064 - DNA, 20 bp, Homo sapiens
ccctgtgattggcaagtgtc

SEQ ID NO: 7321065 - DNA, 22 bp, Homo sapiens
tgctttcagctggtaaagaaac

SEQ ID NO: 7321066 - DNA, 22 bp, Homo sapiens
tgctttcaatgaattgtatact

SEQ ID NO: 7321067 - DNA, 22 bp, Homo sapiens
tggaaggcgtctcgaaggccta

SEQ ID NO: 7321068 - DNA, 22 bp, Homo sapiens
tggaaggctaggtgctaggccc

SEQ ID NO: 7321069 - DNA, 19 bp, Homo sapiens
tggaaggctaagacacttg

SEQ ID NO: 7321070 - DNA, 22 bp, Homo sapiens
cctgacagttaattgtcctgta

SEQ ID NO: 7321071 - DNA, 22 bp, Homo sapiens
cctgaatactggtgctgaaagt

SEQ ID NO: 7321072 - DNA, 22 bp, Homo sapiens
cctcttgattggttggaagcgg

SEQ ID NO: 7321073 - DNA, 21 bp, Homo sapiens
tgggagagcgttgctgtcctc

SEQ ID NO: 7321074 - DNA, 22 bp, Homo sapiens
tgtacagtgccatgcagtttgc

SEQ ID NO: 7321075 - DNA, 22 bp, Homo sapiens
tgtaatttcctgatgttagaac

SEQ ID NO: 7321076 - DNA, 23 bp, Homo sapiens
tctccctgaggttgttagcatta

SEQ ID NO: 7321077 - DNA, 20 bp, Homo sapiens
tctccctgcccatctcagat

SEQ ID NO: 7321078 - DNA, 21 bp, Homo sapiens
tcgggcttggctgcggtgctg

SEQ ID NO: 7321079 - DNA, 22 bp, Homo sapiens
tctctgttcatggcactatgtc

SEQ ID NO: 7321080 - DNA, 22 bp, Homo sapiens
tctctgtgtgttggctgtatat

SEQ ID NO: 7321081 - DNA, 22 bp, Homo sapiens
tctgagaggttaagcaatttga

SEQ ID NO: 7321082 - DNA, 22 bp, Homo sapiens
tctgagaggcatctgcacttct

SEQ ID NO: 7321083 - DNA, 21 bp, Homo sapiens
tctgagagcaactgcccttta

SEQ ID NO: 7321084 - DNA, 22 bp, Homo sapiens
tctcctggcctttaggttaagg

SEQ ID NO: 7321085 - DNA, 22 bp, Homo sapiens
tctctcttgtcaccccatctgc

SEQ ID NO: 7321086 - DNA, 22 bp, Homo sapiens
cattcaaaggcatgtcctattt

SEQ ID NO: 7321087 - DNA, 22 bp, Homo sapiens
cattcaaattaagattttgtta

SEQ ID NO: 7321088 - DNA, 22 bp, Homo sapiens
cattcaaatgtgccactgtcct

SEQ ID NO: 7321089 - DNA, 22 bp, Homo sapiens
cattcacatcttgttccatcac

SEQ ID NO: 7321090 - DNA, 22 bp, Homo sapiens
tccccactgggcctcctctttc

SEQ ID NO: 7321091 - DNA, 22 bp, Homo sapiens
cattgcacgggcgtctgtctgt

SEQ ID NO: 7321092 - DNA, 22 bp, Homo sapiens
cattgcaccacattgcatccct

SEQ ID NO: 7321093 - DNA, 22 bp, Homo sapiens
catttgtatagtgcttagacca

SEQ ID NO: 7321094 - DNA, 22 bp, Homo sapiens
tcattctctgggatgcagtttg

SEQ ID NO: 7321095 - DNA, 22 bp, Homo sapiens
tcattctcagactcttggcctc

SEQ ID NO: 7321096 - DNA, 22 bp, Homo sapiens
tcattcttgatcactagttagt

SEQ ID NO: 7321097 - DNA, 22 bp, Homo sapiens
tccacagggcctttctggtgtg

SEQ ID NO: 7321098 - DNA, 22 bp, Homo sapiens
catgaaaaatttactgttaaca

SEQ ID NO: 7321099 - DNA, 22 bp, Homo sapiens
caggttcccttgcagctaagtg

SEQ ID NO: 7321100 - DNA, 22 bp, Homo sapiens
caggttcagcaggaggcatccc

SEQ ID NO: 7321101 - DNA, 22 bp, Homo sapiens
caggttcccaggtccagggctt

SEQ ID NO: 7321102 - DNA, 22 bp, Homo sapiens
caggttccagttgcagggactt

SEQ ID NO: 7321103 - DNA, 22 bp, Homo sapiens
caggttccctagcagcaaagcc

SEQ ID NO: 7321104 - DNA, 22 bp, Homo sapiens
cagtgacgtaaactgcatgtgc

SEQ ID NO: 7321105 - DNA, 22 bp, Homo sapiens
tcacagactcttgattgtctaa

SEQ ID NO: 7321106 - DNA, 22 bp, Homo sapiens
cagtgtgcctgaatcaagtgtt

SEQ ID NO: 7321107 - DNA, 22 bp, Homo sapiens
tactcaaactcactaagacaga

SEQ ID NO: 7321108 - DNA, 22 bp, Homo sapiens
tactatttttgcaacgtataca

SEQ ID NO: 7321109 - DNA, 22 bp, Homo sapiens
tactcacattctgtttcttgct

SEQ ID NO: 7321110 - DNA, 20 bp, Homo sapiens
tactcacaaatggtttagca

SEQ ID NO: 7321111 - DNA, 22 bp, Homo sapiens
tactcaatctaggtggcttacc

SEQ ID NO: 7321112 - DNA, 22 bp, Homo sapiens
tactcaatgaagtagcctggtt

SEQ ID NO: 7321113 - DNA, 22 bp, Homo sapiens
tactcaatttcttatgggtttc

SEQ ID NO: 7321114 - DNA, 22 bp, Homo sapiens
tactcatttcaaacagcacaaa

SEQ ID NO: 7321115 - DNA, 22 bp, Homo sapiens
tactatgtgaaaatactatagt

SEQ ID NO: 7321116 - DNA, 22 bp, Homo sapiens
tactatgttcttcctaaatagt

SEQ ID NO: 7321117 - DNA, 22 bp, Homo sapiens
cagggcagaacatatagatagt

SEQ ID NO: 7321118 - DNA, 21 bp, Homo sapiens
cagggcacacagaggatggta

SEQ ID NO: 7321119 - DNA, 22 bp, Homo sapiens
tagcaagtgttggtgaagatgt

SEQ ID NO: 7321120 - DNA, 21 bp, Homo sapiens
tagaatcactaataagatgta

SEQ ID NO: 7321121 - DNA, 22 bp, Homo sapiens
tagagtgtcataacagtgccca

SEQ ID NO: 7321122 - DNA, 22 bp, Homo sapiens
cagggcctgcctggttcctgga

SEQ ID NO: 7321123 - DNA, 22 bp, Homo sapiens
taggacccctgtggtagatggg

SEQ ID NO: 7321124 - DNA, 22 bp, Homo sapiens
taggagagctgaactattgtct

SEQ ID NO: 7321125 - DNA, 22 bp, Homo sapiens
tagctattcacttgttgatgga

SEQ ID NO: 7321126 - DNA, 22 bp, Homo sapiens
cagggctttttattagctgcct

SEQ ID NO: 7321127 - DNA, 22 bp, Homo sapiens
taggtaggtgcaattaaaagta

SEQ ID NO: 7321128 - DNA, 22 bp, Homo sapiens
taggtagctttggcgtttcttg

SEQ ID NO: 7321129 - DNA, 22 bp, Homo sapiens
caggggagtgagtccctctctg

SEQ ID NO: 7321130 - DNA, 22 bp, Homo sapiens
tatcataagttaattaaacagt

SEQ ID NO: 7321131 - DNA, 22 bp, Homo sapiens
tatcagtttaaaatctgtgaat

SEQ ID NO: 7321132 - DNA, 22 bp, Homo sapiens
ctctggctatctgtttctatgt

SEQ ID NO: 7321133 - DNA, 22 bp, Homo sapiens
tttgcaaagaaattattgctgt

SEQ ID NO: 7321134 - DNA, 22 bp, Homo sapiens
tttgcaaacacttaagaagaga

SEQ ID NO: 7321135 - DNA, 18 bp, Homo sapiens
ctctctttccactctttg

SEQ ID NO: 7321136 - DNA, 22 bp, Homo sapiens
tttctcaacagagtatgccctt

SEQ ID NO: 7321137 - DNA, 22 bp, Homo sapiens
tttctcaacctcaacactattt

SEQ ID NO: 7321138 - DNA, 22 bp, Homo sapiens
tttcatgttacatttaaaatgt

SEQ ID NO: 7321139 - DNA, 22 bp, Homo sapiens
tttcatgtttatggaaaatgag

SEQ ID NO: 7321140 - DNA, 22 bp, Homo sapiens
tttcattagtatgacagcacgc

SEQ ID NO: 7321141 - DNA, 22 bp, Homo sapiens
tttcatgttacagtgtaaaagt

SEQ ID NO: 7321142 - DNA, 22 bp, Homo sapiens
ctgaggctgcccagggccaggt

SEQ ID NO: 7321143 - DNA, 22 bp, Homo sapiens
ctgaggctgaagagggcctacg

SEQ ID NO: 7321144 - DNA, 22 bp, Homo sapiens
ctgaggctcaagggcaggtggg

SEQ ID NO: 7321145 - DNA, 22 bp, Homo sapiens
ctgaggtggcctctgccgggga

SEQ ID NO: 7321146 - DNA, 22 bp, Homo sapiens
ctgaggtgtgctttcaatgggt

SEQ ID NO: 7321147 - DNA, 22 bp, Homo sapiens
ctgcctgtgggtacaagtggaa

SEQ ID NO: 7321148 - DNA, 22 bp, Homo sapiens
ttgccctgcagcggtgagtggt

SEQ ID NO: 7321149 - DNA, 22 bp, Homo sapiens
ttgccctgcctccctgaggtga

SEQ ID NO: 7321150 - DNA, 22 bp, Homo sapiens
ttgcactttgaaataacagtgg

SEQ ID NO: 7321151 - DNA, 22 bp, Homo sapiens
ctcaggaaaggccatgcaaggg

SEQ ID NO: 7321152 - DNA, 22 bp, Homo sapiens
ctcaggaaaatattgaagaagt

SEQ ID NO: 7321153 - DNA, 22 bp, Homo sapiens
ttctggctctcccctgctgggt

SEQ ID NO: 7321154 - DNA, 22 bp, Homo sapiens
ttctggctcgattctctgaccg

SEQ ID NO: 7321155 - DNA, 22 bp, Homo sapiens
ttctggctccactcagccccac

SEQ ID NO: 7321156 - DNA, 22 bp, Homo sapiens
ttctggcttgacccctacttcc

SEQ ID NO: 7321157 - DNA, 22 bp, Homo sapiens
ttctggcttacttcactcattt

SEQ ID NO: 7321158 - DNA, 22 bp, Homo sapiens
ttctatgtcagtgtgctctgtg

SEQ ID NO: 7321159 - DNA, 22 bp, Homo sapiens
ttctatgtggatatagaactgc

SEQ ID NO: 7321160 - DNA, 22 bp, Homo sapiens
ctagagaaaatgttaatacagt

SEQ ID NO: 7321161 - DNA, 22 bp, Homo sapiens
cgttcctctactccagctaccc

SEQ ID NO: 7321162 - DNA, 22 bp, Homo sapiens
ttcaaatgatggcagtcctggc

SEQ ID NO: 7321163 - DNA, 22 bp, Homo sapiens
ttcaaatacattctttgccact

SEQ ID NO: 7321164 - DNA, 22 bp, Homo sapiens
cggagaggacctgcaactcgct

SEQ ID NO: 7321165 - DNA, 22 bp, Homo sapiens
cgggcttcctccagggaagtgc

SEQ ID NO: 7321166 - DNA, 22 bp, Homo sapiens
cggggctgctcgtcctcctgtg

SEQ ID NO: 7321167 - DNA, 22 bp, Homo sapiens
cctttttctgagttgtagcttc

SEQ ID NO: 7321168 - DNA, 22 bp, Homo sapiens
ttatttcatataatgttatcaa

SEQ ID NO: 7321169 - DNA, 20 bp, Homo sapiens
ttatttcagttgctagattg

SEQ ID NO: 7321170 - DNA, 22 bp, Homo sapiens
ttatttattgtgtacctactgt

SEQ ID NO: 7321171 - DNA, 22 bp, Homo sapiens
ttagcaagataacagtaatttt

SEQ ID NO: 7321172 - DNA, 22 bp, Homo sapiens
ttagcaagaaagattgcagcac

SEQ ID NO: 7321173 - DNA, 22 bp, Homo sapiens
ccttgagaggaacgtggtcatg

SEQ ID NO: 7321174 - DNA, 22 bp, Homo sapiens
ttatatttctggtagccttcag

SEQ ID NO: 7321175 - DNA, 22 bp, Homo sapiens
ttatcatagtgcagttttctga

SEQ ID NO: 7321176 - DNA, 22 bp, Homo sapiens
ttatcataagtaattgaaataa

SEQ ID NO: 7321177 - DNA, 22 bp, Homo sapiens
ttatcagttgtgtgtatacacg

SEQ ID NO: 7321178 - DNA, 22 bp, Homo sapiens
ttacagttactggtactgttaa

SEQ ID NO: 7321179 - DNA, 22 bp, Homo sapiens
ttaaatttctacgtgatccagg

SEQ ID NO: 7321180 - DNA, 22 bp, Homo sapiens
ttaaattttagaaacagactct

SEQ ID NO: 7321181 - DNA, 22 bp, Homo sapiens
gagctcattgtggatggatggg

SEQ ID NO: 7321182 - DNA, 22 bp, Homo sapiens
gaggagagaagctaacggtgct

SEQ ID NO: 7321183 - DNA, 22 bp, Homo sapiens
gaggtgagaagggggtcagatg

SEQ ID NO: 7321184 - DNA, 22 bp, Homo sapiens
gaggtgcctttttgtaattagt

SEQ ID NO: 7321185 - DNA, 22 bp, Homo sapiens
gaggtgcctggcgatgtctctg

SEQ ID NO: 7321186 - DNA, 22 bp, Homo sapiens
gaggtgcccttgtgtattgctg

SEQ ID NO: 7321187 - DNA, 22 bp, Homo sapiens
gagtaaggctgctgatggagtg

SEQ ID NO: 7321188 - DNA, 18 bp, Homo sapiens
gagagcccagcaggtggt

SEQ ID NO: 7321189 - DNA, 22 bp, Homo sapiens
gagcaaatggagcttgtctact

SEQ ID NO: 7321190 - DNA, 22 bp, Homo sapiens
gacatgttatctctggcttcaa

SEQ ID NO: 7321191 - DNA, 22 bp, Homo sapiens
gacctggaagaactgaggcctt

SEQ ID NO: 7321192 - DNA, 22 bp, Homo sapiens
gaatgcttggaacctgaagttc

SEQ ID NO: 7321193 - DNA, 22 bp, Homo sapiens
gaatgctttgggaattcagaat

SEQ ID NO: 7321194 - DNA, 19 bp, Homo sapiens
gaatgtttgtattcagcgc

SEQ ID NO: 7321195 - DNA, 22 bp, Homo sapiens
gaattttattactagtcaactg

SEQ ID NO: 7321196 - DNA, 22 bp, Homo sapiens
gaatttacagggtgagcttcag

SEQ ID NO: 7321197 - DNA, 20 bp, Homo sapiens
gaattttatgaacactacca

SEQ ID NO: 7321198 - DNA, 21 bp, Homo sapiens
gacaaacatttcatagcttta

SEQ ID NO: 7321199 - DNA, 22 bp, Homo sapiens
gaaaaatgagctgatgtcaggg

SEQ ID NO: 7321200 - DNA, 22 bp, Homo sapiens
gaagaagacatggaacaatagt

SEQ ID NO: 7321201 - DNA, 23 bp, Homo sapiens
gaaatgtttcttgattaatccta

SEQ ID NO: 7321202 - DNA, 22 bp, Homo sapiens
cttggacccactcccagaattg

SEQ ID NO: 7321203 - DNA, 22 bp, Homo sapiens
cttggacaacttttctctggtt

SEQ ID NO: 7321204 - DNA, 22 bp, Homo sapiens
cttcttccaagcttatgctcaa

SEQ ID NO: 7321205 - DNA, 21 bp, Homo sapiens
cttccccaggctggtctgtat

SEQ ID NO: 7321206 - DNA, 22 bp, Homo sapiens
cttcttcagaggccagcctctg

SEQ ID NO: 7321207 - DNA, 22 bp, Homo sapiens
cttcttcataggcagtcctgtt

SEQ ID NO: 7321208 - DNA, 19 bp, Homo sapiens
ctggtttaggtagtgagtc

SEQ ID NO: 7321209 - DNA, 22 bp, Homo sapiens
ctggtttagtcataatggagaa

SEQ ID NO: 7321210 - DNA, 22 bp, Homo sapiens
ctggtttagtaggggactgaag

SEQ ID NO: 7321211 - DNA, 17 bp, Homo sapiens
ctggtttatgggcagtg

SEQ ID NO: 7321212 - DNA, 22 bp, Homo sapiens
ctggtttatgtatcatctagaa

SEQ ID NO: 7321213 - DNA, 22 bp, Homo sapiens
ctggtttattcgtcacaccgga

SEQ ID NO: 7321214 - DNA, 22 bp, Homo sapiens
ctggtttagtgaaataggccag

SEQ ID NO: 7321215 - DNA, 22 bp, Homo sapiens
ctggtttataaatctgtggcca

SEQ ID NO: 7321216 - DNA, 22 bp, Homo sapiens
ctggtttatgagggaagggatg

SEQ ID NO: 7321217 - DNA, 22 bp, Homo sapiens
ctggtttactctgcactgctca

SEQ ID NO: 7321218 - DNA, 22 bp, Homo sapiens
ctggtttagctgtaaggttccc

SEQ ID NO: 7321219 - DNA, 22 bp, Homo sapiens
ctggtttaagcttatatagttg

SEQ ID NO: 7321220 - DNA, 22 bp, Homo sapiens
ctggtttacccaagatttgctg

SEQ ID NO: 7321221 - DNA, 22 bp, Homo sapiens
ctggtttaaaattactggttaa

SEQ ID NO: 7321222 - DNA, 22 bp, Homo sapiens
ctggtttaaccatgtatcctgg

SEQ ID NO: 7321223 - DNA, 22 bp, Homo sapiens
ctgtggaatcatcaggtcttac

SEQ ID NO: 7321224 - DNA, 20 bp, Homo sapiens
ctgtggaattttaccatgcg

SEQ ID NO: 7321225 - DNA, 22 bp, Homo sapiens
ctgggagttgacgaggcttgta

SEQ ID NO: 7321226 - DNA, 22 bp, Homo sapiens
ctgggatgtctatagaacactt

SEQ ID NO: 7321227 - DNA, 22 bp, Homo sapiens
ctgggagtactgggggatgtca

SEQ ID NO: 7321228 - DNA, 22 bp, Homo sapiens
ctgggagtctggcctctggtcc

SEQ ID NO: 7321229 - DNA, 22 bp, Homo sapiens
ctgggagtgaaaggagggctgc

SEQ ID NO: 7321230 - DNA, 22 bp, Homo sapiens
ctggggctggtgaggcaggctc

SEQ ID NO: 7321231 - DNA, 22 bp, Homo sapiens
ctgggctctaagggagcaccgt

SEQ ID NO: 7321232 - DNA, 22 bp, Homo sapiens
ctgggctcctaaccatccaggt

SEQ ID NO: 7321233 - DNA, 20 bp, Homo sapiens
ctgggctcggtggccctggc

SEQ ID NO: 7321234 - DNA, 22 bp, Homo sapiens
gctttacaacaaattgaatatg

SEQ ID NO: 7321235 - DNA, 22 bp, Homo sapiens
gctttacatgagatgaggacaa

SEQ ID NO: 7321236 - DNA, 22 bp, Homo sapiens
gctttacacagatgaatatttc

SEQ ID NO: 7321237 - DNA, 22 bp, Homo sapiens
gcttaaagttgtaaattagaga

SEQ ID NO: 7321238 - DNA, 22 bp, Homo sapiens
ggaaggctttctgttctgtgac

SEQ ID NO: 7321239 - DNA, 22 bp, Homo sapiens
ggaggaggcggcagaagttcct

SEQ ID NO: 7321240 - DNA, 22 bp, Homo sapiens
gctaggttggggaagttctcct

SEQ ID NO: 7321241 - DNA, 22 bp, Homo sapiens
gctcagtttttagtttgtgaga

SEQ ID NO: 7321242 - DNA, 22 bp, Homo sapiens
gctcagttatccgtgtgtgact

SEQ ID NO: 7321243 - DNA, 19 bp, Homo sapiens
gctctccctctcagttgag

SEQ ID NO: 7321244 - DNA, 22 bp, Homo sapiens
gccctggaatctctccatggga

SEQ ID NO: 7321245 - DNA, 22 bp, Homo sapiens
gccctggacagtgacggtgacc

SEQ ID NO: 7321246 - DNA, 22 bp, Homo sapiens
gccctggagagggatatggcat

SEQ ID NO: 7321247 - DNA, 22 bp, Homo sapiens
gcatttaaatttgaacttcaga

SEQ ID NO: 7321248 - DNA, 22 bp, Homo sapiens
gcatttaaatttgaacttcaga

SEQ ID NO: 7321249 - DNA, 22 bp, Homo sapiens
gccacctcccaggacgaggctg

SEQ ID NO: 7321250 - DNA, 22 bp, Homo sapiens
gcattcttcacagtattcctcc

SEQ ID NO: 7321251 - DNA, 22 bp, Homo sapiens
gcattcttggtggagtgctaaa

SEQ ID NO: 7321252 - DNA, 22 bp, Homo sapiens
gcagggcatgggccctgtctgc

SEQ ID NO: 7321253 - DNA, 22 bp, Homo sapiens
gcaggcattagcccccatggct

SEQ ID NO: 7321254 - DNA, 22 bp, Homo sapiens
gcaggcatggtcgctgccaggt

SEQ ID NO: 7321255 - DNA, 22 bp, Homo sapiens
gcagggcagcttagtccctgtc

SEQ ID NO: 7321256 - DNA, 22 bp, Homo sapiens
gcagggcagctcactgtggttc

SEQ ID NO: 7321257 - DNA, 17 bp, Homo sapiens
ggcagtggaggaagaga

SEQ ID NO: 7321258 - DNA, 22 bp, Homo sapiens
ggcagtgactgttcagacgtcc

SEQ ID NO: 7321259 - DNA, 23 bp, Homo sapiens
ggaggcacttaggcagagcagag

SEQ ID NO: 7321260 - DNA, 22 bp, Homo sapiens
ggaggcaccctatttgaggcct

SEQ ID NO: 7321261 - DNA, 17 bp, Homo sapiens
ggctgcagtccaggagg

SEQ ID NO: 7321262 - DNA, 22 bp, Homo sapiens
ggctgcaggcttccctccagca

SEQ ID NO: 7321263 - DNA, 21 bp, Homo sapiens
ggctgcagggagccctggggt

SEQ ID NO: 7321264 - DNA, 22 bp, Homo sapiens
gggaaggcaggattctctggtg

SEQ ID NO: 7321265 - DNA, 22 bp, Homo sapiens
gggctatctgctcaccttcctc

SEQ ID NO: 7321266 - DNA, 22 bp, Homo sapiens
gggcaggtgttgtcaatctaat

SEQ ID NO: 7321267 - DNA, 22 bp, Homo sapiens
gggcaggtgtttccaaggtgag

SEQ ID NO: 7321268 - DNA, 22 bp, Homo sapiens
gggcaggtggcagggtctctgg

SEQ ID NO: 7321269 - DNA, 22 bp, Homo sapiens
gggcaggtggcaaagccagagg

SEQ ID NO: 7321270 - DNA, 21 bp, Homo sapiens
gggcaggtctctgatgtcaac

SEQ ID NO: 7321271 - DNA, 22 bp, Homo sapiens
gggcaggtctgggtcagcctga

SEQ ID NO: 7321272 - DNA, 22 bp, Homo sapiens
gggcttctgggcaccactccct

SEQ ID NO: 7321273 - DNA, 22 bp, Homo sapiens
gggcttctggtcattcctcatc

SEQ ID NO: 7321274 - DNA, 22 bp, Homo sapiens
gggcttctctttagtgagctga

SEQ ID NO: 7321275 - DNA, 22 bp, Homo sapiens
gggcttctctgggagtcctggt

SEQ ID NO: 7321276 - DNA, 22 bp, Homo sapiens
gggcttctctcaggggcatgag

SEQ ID NO: 7321277 - DNA, 22 bp, Homo sapiens
gggcttcagggtacttcctcct

SEQ ID NO: 7321278 - DNA, 22 bp, Homo sapiens
gggcttctagaatttctgatat

SEQ ID NO: 7321279 - DNA, 22 bp, Homo sapiens
gggcttctagaccagcagtgag

SEQ ID NO: 7321280 - DNA, 20 bp, Homo sapiens
ggttacattgtctacatgtg

SEQ ID NO: 7321281 - DNA, 22 bp, Homo sapiens
ggttacatggaagaaatataat

SEQ ID NO: 7321282 - DNA, 22 bp, Homo sapiens
ggttacatgtatgtttggtata

SEQ ID NO: 7321283 - DNA, 22 bp, Homo sapiens
ggttacatagtaaggtcctatt

SEQ ID NO: 7321284 - DNA, 22 bp, Homo sapiens
ggttacatctcaagtggagtct

SEQ ID NO: 7321285 - DNA, 22 bp, Homo sapiens
ggtgaggcagagggagtaacct

SEQ ID NO: 7321286 - DNA, 22 bp, Homo sapiens
ggtgaggcccagtgatctgtgt

SEQ ID NO: 7321287 - DNA, 22 bp, Homo sapiens
ggtgaggcaggtggctgctgag

SEQ ID NO: 7321288 - DNA, 18 bp, Homo sapiens
ggtgaggcggcggccagc

SEQ ID NO: 7321289 - DNA, 22 bp, Homo sapiens
ggtgaggcctgtacaaagctgc

SEQ ID NO: 7321290 - DNA, 22 bp, Homo sapiens
ggtgaggcgtccccaccatggg

SEQ ID NO: 7321291 - DNA, 22 bp, Homo sapiens
ggtgaggctaagtgacacaggg

SEQ ID NO: 7321292 - DNA, 22 bp, Homo sapiens
ggtgaggctggcttgccttctt

SEQ ID NO: 7321293 - DNA, 22 bp, Homo sapiens
gtgaggcaagggcatactaggc

SEQ ID NO: 7321294 - DNA, 22 bp, Homo sapiens
gtgaggcagaagttccctttta

SEQ ID NO: 7321295 - DNA, 22 bp, Homo sapiens
gtgaggcaggcattctcctttc

SEQ ID NO: 7321296 - DNA, 22 bp, Homo sapiens
gtgaggcagagatgccaaaact

SEQ ID NO: 7321297 - DNA, 22 bp, Homo sapiens
gtgaggcagcaggagcctctgt

SEQ ID NO: 7321298 - DNA, 22 bp, Homo sapiens
gtcttttttacaccttacatca

SEQ ID NO: 7321299 - DNA, 22 bp, Homo sapiens
gtctttagagctcctggcatct

SEQ ID NO: 7321300 - DNA, 22 bp, Homo sapiens
gtctttagttgaaacatgtggt

SEQ ID NO: 7321301 - DNA, 22 bp, Homo sapiens
gtcgtggagctcacagtgtgcc

SEQ ID NO: 7321302 - DNA, 22 bp, Homo sapiens
gtcctggcccaggagtacacat

SEQ ID NO: 7321303 - DNA, 22 bp, Homo sapiens
gtcctctgggctttgagcagtc

SEQ ID NO: 7321304 - DNA, 22 bp, Homo sapiens
gtagttatgtttacatgccatc

SEQ ID NO: 7321305 - DNA, 22 bp, Homo sapiens
gtatttttaggtaaggaaagta

SEQ ID NO: 7321306 - DNA, 22 bp, Homo sapiens
gtagtctgaacagtaattttgt

SEQ ID NO: 7321307 - DNA, 22 bp, Homo sapiens
tccctggacaacagacttcact

SEQ ID NO: 7321308 - DNA, 22 bp, Homo sapiens
tccctggagataacttctggga

SEQ ID NO: 7321309 - DNA, 22 bp, Homo sapiens
tccctggaacagagagacaacg

SEQ ID NO: 7321310 - DNA, 22 bp, Homo sapiens
tccctggaggtgtttgctcagg

SEQ ID NO: 7321311 - DNA, 23 bp, Homo sapiens
tccctggaggcaggtccagggcc

SEQ ID NO: 7321312 - DNA, 22 bp, Homo sapiens
tccctggccattcctctaggcc

SEQ ID NO: 7321313 - DNA, 22 bp, Homo sapiens
tcctcaggggtttcaggtgtac

SEQ ID NO: 7321314 - DNA, 22 bp, Homo sapiens
tccaggtgagtgcaggtgcaga

SEQ ID NO: 7321315 - DNA, 22 bp, Homo sapiens
tcccagaggtctctgctggttc

SEQ ID NO: 7321316 - DNA, 22 bp, Homo sapiens
tcccagagaagagctggatgga

SEQ ID NO: 7321317 - DNA, 22 bp, Homo sapiens
tcctgaggcctctgtgatgtga

SEQ ID NO: 7321318 - DNA, 22 bp, Homo sapiens
tcctgagattctgcatttctaa

SEQ ID NO: 7321319 - DNA, 22 bp, Homo sapiens
tcctgagaaggcacagcttgca

SEQ ID NO: 7321320 - DNA, 22 bp, Homo sapiens
tcctcttctgcctatatctgcc

SEQ ID NO: 7321321 - DNA, 22 bp, Homo sapiens
tcctcaggtgactaggtatctt

SEQ ID NO: 7321322 - DNA, 22 bp, Homo sapiens
tcatacattcagcagatatttg

SEQ ID NO: 7321323 - DNA, 22 bp, Homo sapiens
tcatgaaaatagatcagaaatt

SEQ ID NO: 7321324 - DNA, 22 bp, Homo sapiens
tcagtacaaaggtgctctcaag

SEQ ID NO: 7321325 - DNA, 22 bp, Homo sapiens
tcagtatccacaaatgctcaaa

SEQ ID NO: 7321326 - DNA, 22 bp, Homo sapiens
tcagggctgactgctactctcc

SEQ ID NO: 7321327 - DNA, 22 bp, Homo sapiens
tccaaggccgcaggctgggcct

SEQ ID NO: 7321328 - DNA, 22 bp, Homo sapiens
tcatttaattggttttgctcgt

SEQ ID NO: 7321329 - DNA, 22 bp, Homo sapiens
tcatttacagactgtgtgggtg

SEQ ID NO: 7321330 - DNA, 22 bp, Homo sapiens
tcatttctgttgtgcatcactg

SEQ ID NO: 7321331 - DNA, 23 bp, Homo sapiens
tcatttcacagtgagcttcctag

SEQ ID NO: 7321332 - DNA, 22 bp, Homo sapiens
tcatttcagccatttttaaatg

SEQ ID NO: 7321333 - DNA, 22 bp, Homo sapiens
tcaactttagtgtagctattta

SEQ ID NO: 7321334 - DNA, 22 bp, Homo sapiens
tcaacactaaagaataatcttt

SEQ ID NO: 7321335 - DNA, 21 bp, Homo sapiens
tcagaattacccctggatctg

SEQ ID NO: 7321336 - DNA, 22 bp, Homo sapiens
tcagaattttctggaatggagc

SEQ ID NO: 7321337 - DNA, 22 bp, Homo sapiens
tcagcagggccatgctctctct

SEQ ID NO: 7321338 - DNA, 22 bp, Homo sapiens
tcagcagggaggctctgtgccc

SEQ ID NO: 7321339 - DNA, 22 bp, Homo sapiens
tcagcaggcccatcctccaggc

SEQ ID NO: 7321340 - DNA, 22 bp, Homo sapiens
tagtttaccaaattgatcttcc

SEQ ID NO: 7321341 - DNA, 22 bp, Homo sapiens
tagttacataaagtggactgtt

SEQ ID NO: 7321342 - DNA, 22 bp, Homo sapiens
tagtttatagttagcgagcacg

SEQ ID NO: 7321343 - DNA, 22 bp, Homo sapiens
tagtttatgattttttggaagg

SEQ ID NO: 7321344 - DNA, 22 bp, Homo sapiens
tagttacagagaaatgatttga

SEQ ID NO: 7321345 - DNA, 22 bp, Homo sapiens
tagtgcttaacacaaagtgatt

SEQ ID NO: 7321346 - DNA, 18 bp, Homo sapiens
tagtggaactgctctggg

SEQ ID NO: 7321347 - DNA, 22 bp, Homo sapiens
tagtgcttattactgtgctgtc

SEQ ID NO: 7321348 - DNA, 22 bp, Homo sapiens
tagcaaatgtgttatgctatgc

SEQ ID NO: 7321349 - DNA, 22 bp, Homo sapiens
tagcaaaggatgactatgtacc

SEQ ID NO: 7321350 - DNA, 22 bp, Homo sapiens
tagcaaataaaacagtattgaa

SEQ ID NO: 7321351 - DNA, 22 bp, Homo sapiens
tagctgacgctaaataaatgtt

SEQ ID NO: 7321352 - DNA, 22 bp, Homo sapiens
tagcagggtctcaggagtcagg

SEQ ID NO: 7321353 - DNA, 22 bp, Homo sapiens
tagcaggggtagatagagtgtg

SEQ ID NO: 7321354 - DNA, 22 bp, Homo sapiens
tagcagggtaaatgtagatgga

SEQ ID NO: 7321355 - DNA, 20 bp, Homo sapiens
tcaaagaagattcagctcaa

SEQ ID NO: 7321356 - DNA, 22 bp, Homo sapiens
tcaaagaacatcatctgaaatg

SEQ ID NO: 7321357 - DNA, 22 bp, Homo sapiens
tcaaagaagtgcaaacctcatc

SEQ ID NO: 7321358 - DNA, 17 bp, Homo sapiens
tcaaagaatgcatgcag

SEQ ID NO: 7321359 - DNA, 22 bp, Homo sapiens
tcaaagatagatgttgagaaat

SEQ ID NO: 7321360 - DNA, 22 bp, Homo sapiens
tcaaagagctattcagttgtgg

SEQ ID NO: 7321361 - DNA, 22 bp, Homo sapiens
tcaaaggttaactctgttgttc

SEQ ID NO: 7321362 - DNA, 23 bp, Homo sapiens
tattttccaaatgatgactacat

SEQ ID NO: 7321363 - DNA, 22 bp, Homo sapiens
tatttgcaggcttttgtcatgg

SEQ ID NO: 7321364 - DNA, 23 bp, Homo sapiens
tatttgctactggtaattctgga

SEQ ID NO: 7321365 - DNA, 22 bp, Homo sapiens
tatttgcaacataaaactctga

SEQ ID NO: 7321366 - DNA, 22 bp, Homo sapiens
tatcattttactgtgacatttt

SEQ ID NO: 7321367 - DNA, 22 bp, Homo sapiens
tataaagtgtgaactgtgagta

SEQ ID NO: 7321368 - DNA, 22 bp, Homo sapiens
tatcatttaacagaatcattgc

SEQ ID NO: 7321369 - DNA, 22 bp, Homo sapiens
tatgtatccgtgtgtgtacaga

SEQ ID NO: 7321370 - DNA, 22 bp, Homo sapiens
tatgtatagagtcttttaaatt

SEQ ID NO: 7321371 - DNA, 22 bp, Homo sapiens
tatgtagcaatagcatcatact

SEQ ID NO: 7321372 - DNA, 22 bp, Homo sapiens
tattaaattatggatttaggag

SEQ ID NO: 7321373 - DNA, 22 bp, Homo sapiens
tatgtactcatcaactattgaa

SEQ ID NO: 7321374 - DNA, 22 bp, Homo sapiens
tatgtactctaatttgtctcat

SEQ ID NO: 7321375 - DNA, 22 bp, Homo sapiens
gtttattatacaacaaaagcta

SEQ ID NO: 7321376 - DNA, 22 bp, Homo sapiens
gtttattatacaacaaaagcta

SEQ ID NO: 7321377 - DNA, 22 bp, Homo sapiens
gtttattaactgtcaagtgatt

SEQ ID NO: 7321378 - DNA, 22 bp, Homo sapiens
gtttattagagttttctgtctg

SEQ ID NO: 7321379 - DNA, 22 bp, Homo sapiens
gttaaattcgatgatggataaa

SEQ ID NO: 7321380 - DNA, 22 bp, Homo sapiens
gttcttcagtcacatcacagaa

SEQ ID NO: 7321381 - DNA, 22 bp, Homo sapiens
taacatcaaactgcattttcta

SEQ ID NO: 7321382 - DNA, 22 bp, Homo sapiens
taacatcaaacatgttttaaag

SEQ ID NO: 7321383 - DNA, 22 bp, Homo sapiens
taacagtatccccatttgcaag

SEQ ID NO: 7321384 - DNA, 22 bp, Homo sapiens
taacagtacatccttttctctt

SEQ ID NO: 7321385 - DNA, 22 bp, Homo sapiens
taagacagggagggctctcagc

SEQ ID NO: 7321386 - DNA, 22 bp, Homo sapiens
taagacaaatactatttcaaga

SEQ ID NO: 7321387 - DNA, 19 bp, Homo sapiens
taaagagaataccggtggc

SEQ ID NO: 7321388 - DNA, 22 bp, Homo sapiens
tacaagaaactacatgaatgca

SEQ ID NO: 7321389 - DNA, 22 bp, Homo sapiens
tacacacagaggccatgggatt

SEQ ID NO: 7321390 - DNA, 22 bp, Homo sapiens
taatatacttcccatagtttga

SEQ ID NO: 7321391 - DNA, 22 bp, Homo sapiens
taagccatacatttcagactct

SEQ ID NO: 7321392 - DNA, 22 bp, Homo sapiens
taattgaaatcatttcaattca

SEQ ID NO: 7321393 - DNA, 22 bp, Homo sapiens
taatttacttgcaaataacaat

SEQ ID NO: 7321394 - DNA, 22 bp, Homo sapiens
tacatgcttctatatgtgaagt

SEQ ID NO: 7321395 - DNA, 20 bp, Homo sapiens
taccaacagcaggaagcata

SEQ ID NO: 7321396 - DNA, 22 bp, Homo sapiens
tacagttaaaaagttcaatggt

SEQ ID NO: 7321397 - DNA, 22 bp, Homo sapiens
tacagtgtgacatttctacaaa

SEQ ID NO: 7321398 - DNA, 22 bp, Homo sapiens
tacagtggaaaactcagtgtgt

SEQ ID NO: 7321399 - DNA, 20 bp, Homo sapiens
tacagtgtatgtatttaggc

SEQ ID NO: 7321400 - DNA, 22 bp, Homo sapiens
tacagtgtccctttttcagaca

SEQ ID NO: 7321401 - DNA, 22 bp, Homo sapiens
tacagtgcatagaggcatgata

SEQ ID NO: 7321402 - DNA, 22 bp, Homo sapiens
tacagtaggattttcagggtct

SEQ ID NO: 7321403 - DNA, 22 bp, Homo sapiens
tacagtagtatcttcatttgtt

SEQ ID NO: 7321404 - DNA, 22 bp, Homo sapiens
taccatttgagagagaacataa

SEQ ID NO: 7321405 - DNA, 22 bp, Homo sapiens
tactacatacagaatttagaga

SEQ ID NO: 7321406 - DNA, 22 bp, Homo sapiens
taccatttcagtaaaaacttag

SEQ ID NO: 7321407 - DNA, 18 bp, Homo sapiens
ttggacctgtgtcagggc

SEQ ID NO: 7321408 - DNA, 22 bp, Homo sapiens
ttggaaaatgtatttctagaag

SEQ ID NO: 7321409 - DNA, 22 bp, Homo sapiens
ttgcttatttgattaaatgtct

SEQ ID NO: 7321410 - DNA, 22 bp, Homo sapiens
tttcaacagctctcaaatgatc

SEQ ID NO: 7321411 - DNA, 22 bp, Homo sapiens
tttcaacatataccataatgcc

SEQ ID NO: 7321412 - DNA, 22 bp, Homo sapiens
tttcacacaacgtgaatatact

SEQ ID NO: 7321413 - DNA, 22 bp, Homo sapiens
tttcatgtctgaattctttagt

SEQ ID NO: 7321414 - DNA, 22 bp, Homo sapiens
tttcatgtggcgatgtctctgg

SEQ ID NO: 7321415 - DNA, 22 bp, Homo sapiens
tttcatgtgcaattagcaatat

SEQ ID NO: 7321416 - DNA, 22 bp, Homo sapiens
tttcatgtgttgaatgtgtaca

SEQ ID NO: 7321417 - DNA, 22 bp, Homo sapiens
tttcagagctgagatgccacag

SEQ ID NO: 7321418 - DNA, 22 bp, Homo sapiens
tttcactgttaggagtatgcta

SEQ ID NO: 7321419 - DNA, 22 bp, Homo sapiens
tttcagaaatggcactgaaatc

SEQ ID NO: 7321420 - DNA, 22 bp, Homo sapiens
tttcagagcctttatctctcta

SEQ ID NO: 7321421 - DNA, 22 bp, Homo sapiens
tttcagagatgtctagcctatt

SEQ ID NO: 7321422 - DNA, 22 bp, Homo sapiens
tttcagagaactgagtccttgc

SEQ ID NO: 7321423 - DNA, 22 bp, Homo sapiens
tttaccaaagtactctgaggca

SEQ ID NO: 7321424 - DNA, 22 bp, Homo sapiens
tttacagtctgtctagcaatgt

SEQ ID NO: 7321425 - DNA, 22 bp, Homo sapiens
tttacagtgagagcttagtgag

SEQ ID NO: 7321426 - DNA, 22 bp, Homo sapiens
tttagagaccctctgctatttt

SEQ ID NO: 7321427 - DNA, 22 bp, Homo sapiens
tttagagagaaataaatgagat

SEQ ID NO: 7321428 - DNA, 23 bp, Homo sapiens
tttatattcctaatgtcttgagc

SEQ ID NO: 7321429 - DNA, 22 bp, Homo sapiens
tttatcatcttgtttttaaagc

SEQ ID NO: 7321430 - DNA, 22 bp, Homo sapiens
tttatctgagctgatagatagt

SEQ ID NO: 7321431 - DNA, 22 bp, Homo sapiens
tttacagtaaggtggatggtac

SEQ ID NO: 7321432 - DNA, 22 bp, Homo sapiens
tttacagtatagtaggactcat

SEQ ID NO: 7321433 - DNA, 22 bp, Homo sapiens
tttacagtcaccaaactttgct

SEQ ID NO: 7321434 - DNA, 22 bp, Homo sapiens
tttacagtctctatagtcaaaa

SEQ ID NO: 7321435 - DNA, 22 bp, Homo sapiens
tttacagtccccaggtgaggat

SEQ ID NO: 7321436 - DNA, 22 bp, Homo sapiens
tttacagtctatgttgaattaa

SEQ ID NO: 7321437 - DNA, 22 bp, Homo sapiens
tttaagcacagggataaagtta

SEQ ID NO: 7321438 - DNA, 22 bp, Homo sapiens
tttaagatggtattttataaag

SEQ ID NO: 7321439 - DNA, 22 bp, Homo sapiens
tttaagattcagtaaggcaaac

SEQ ID NO: 7321440 - DNA, 22 bp, Homo sapiens
ttctctaatggtgatgattaga

SEQ ID NO: 7321441 - DNA, 22 bp, Homo sapiens
ttctctaaggcttggcttccct

SEQ ID NO: 7321442 - DNA, 22 bp, Homo sapiens
ttctctaagctggctgaggtct

SEQ ID NO: 7321443 - DNA, 22 bp, Homo sapiens
ttctctaatacattttgacaaa

SEQ ID NO: 7321444 - DNA, 22 bp, Homo sapiens
ttctctaaggtcccgttctgga

SEQ ID NO: 7321445 - DNA, 22 bp, Homo sapiens
ttctctaagccttagtttcttc

SEQ ID NO: 7321446 - DNA, 22 bp, Homo sapiens
ttctctaggttttagatgaaga

SEQ ID NO: 7321447 - DNA, 22 bp, Homo sapiens
ttctctcttactgccatgctgt

SEQ ID NO: 7321448 - DNA, 22 bp, Homo sapiens
ttctccaagtagaagctaagtt

SEQ ID NO: 7321449 - DNA, 22 bp, Homo sapiens
ttctctaagagttatatgaatt

SEQ ID NO: 7321450 - DNA, 22 bp, Homo sapiens
ttcctgcgcccttctcgcccgc

SEQ ID NO: 7321451 - DNA, 22 bp, Homo sapiens
ttgaacaatttggtatacaaac

SEQ ID NO: 7321452 - DNA, 19 bp, Homo sapiens
ttgaaattgtttgatatgg

SEQ ID NO: 7321453 - DNA, 22 bp, Homo sapiens
ttgaaattgggtgtggctgtca

SEQ ID NO: 7321454 - DNA, 20 bp, Homo sapiens
ttgaaattggatggtagcta

SEQ ID NO: 7321455 - DNA, 22 bp, Homo sapiens
ttgaaatggcagcagctgacct

SEQ ID NO: 7321456 - DNA, 22 bp, Homo sapiens
ttcttattcttgaaatgtggga

SEQ ID NO: 7321457 - DNA, 23 bp, Homo sapiens
ttcttatttactttggaatctcc

SEQ ID NO: 7321458 - DNA, 22 bp, Homo sapiens
ttctgtaagctaccaagtttgt

SEQ ID NO: 7321459 - DNA, 22 bp, Homo sapiens
ttcttatattgggtcatggata

SEQ ID NO: 7321460 - DNA, 22 bp, Homo sapiens
ttctgtctggaaaaggacatag

SEQ ID NO: 7321461 - DNA, 22 bp, Homo sapiens
ttattgacttgtttgtcctggt

SEQ ID NO: 7321462 - DNA, 22 bp, Homo sapiens
ttcaaacagttgcacaacttat

SEQ ID NO: 7321463 - DNA, 22 bp, Homo sapiens
ttcaaacagatgactctgctct

SEQ ID NO: 7321464 - DNA, 22 bp, Homo sapiens
ttattctttaaacatatatgtt

SEQ ID NO: 7321465 - DNA, 22 bp, Homo sapiens
ttattagagatatttggttagg

SEQ ID NO: 7321466 - DNA, 22 bp, Homo sapiens
ttattagtgttgatattaggat

SEQ ID NO: 7321467 - DNA, 22 bp, Homo sapiens
ttagctgagattaagtgaactt

SEQ ID NO: 7321468 - DNA, 22 bp, Homo sapiens
ttagctgaaaaaattcatgcaa

SEQ ID NO: 7321469 - DNA, 23 bp, Homo sapiens
ttcaaagatcttctgaaatctgt

SEQ ID NO: 7321470 - DNA, 22 bp, Homo sapiens
ttcaaagattagcatacgcaat

SEQ ID NO: 7321471 - DNA, 22 bp, Homo sapiens
ttcatttaatcagaatctctaa

SEQ ID NO: 7321472 - DNA, 22 bp, Homo sapiens
ttcagttttgcttttaatcatg

SEQ ID NO: 7321473 - DNA, 22 bp, Homo sapiens
tttgtaaaaggaggaagcatgg

SEQ ID NO: 7321474 - DNA, 22 bp, Homo sapiens
ttttaagaaatgtatgactgtc

SEQ ID NO: 7321475 - DNA, 22 bp, Homo sapiens
ttttaatactgctattgtagga

SEQ ID NO: 7321476 - DNA, 22 bp, Homo sapiens
ttttctgacctatctacattta

SEQ ID NO: 7321477 - DNA, 22 bp, Homo sapiens
ttttccaaagtaccatgtccct

SEQ ID NO: 7321478 - DNA, 22 bp, Homo sapiens
ttttccaaattagaagtagaga

SEQ ID NO: 7321479 - DNA, 22 bp, Homo sapiens
ttttcattgttcctcgagcatt

SEQ ID NO: 7321480 - DNA, 22 bp, Homo sapiens
ttttctcttgttaatgtactga

SEQ ID NO: 7321481 - DNA, 22 bp, Homo sapiens
ttttcagtttgcactgcagtgc

SEQ ID NO: 7321482 - DNA, 22 bp, Homo sapiens
tttgataatacacaagagaaag

SEQ ID NO: 7321483 - DNA, 22 bp, Homo sapiens
tttgacaaaggaaaaatgcaca

SEQ ID NO: 7321484 - DNA, 22 bp, Homo sapiens
tttgacaaataggggaataagg

SEQ ID NO: 7321485 - DNA, 22 bp, Homo sapiens
tttgaagactactgggagtgaa

SEQ ID NO: 7321486 - DNA, 22 bp, Homo sapiens
acctcctggcctcaagcaatcc

SEQ ID NO: 7321487 - DNA, 22 bp, Homo sapiens
acctcctggtgcccaagtgttt

SEQ ID NO: 7321488 - DNA, 22 bp, Homo sapiens
acatttcagtgagctattgaag

SEQ ID NO: 7321489 - DNA, 22 bp, Homo sapiens
acatttcagcgtgcatgacatg

SEQ ID NO: 7321490 - DNA, 22 bp, Homo sapiens
acatttcagatgtaatgtgatg

SEQ ID NO: 7321491 - DNA, 22 bp, Homo sapiens
aaggaatcacttctttaaatga

SEQ ID NO: 7321492 - DNA, 22 bp, Homo sapiens
acatctcatgaatgataaatca

SEQ ID NO: 7321493 - DNA, 22 bp, Homo sapiens
aatagtaaaagatacagctaat

SEQ ID NO: 7321494 - DNA, 22 bp, Homo sapiens
agaaagctggagtcaagcagag

SEQ ID NO: 7321495 - DNA, 22 bp, Homo sapiens
aatctacatgcaatatttttag

SEQ ID NO: 7321496 - DNA, 22 bp, Homo sapiens
aagtgtttacttaaagtcatgg

SEQ ID NO: 7321497 - DNA, 22 bp, Homo sapiens
aagtgggtcagggacagatctt

SEQ ID NO: 7321498 - DNA, 19 bp, Homo sapiens
actgggcttgtcctcgtgg

SEQ ID NO: 7321499 - DNA, 22 bp, Homo sapiens
actgggcaaggatatgatgggt

SEQ ID NO: 7321500 - DNA, 21 bp, Homo sapiens
agctgaggtaaggcaagagag

SEQ ID NO: 7321501 - DNA, 22 bp, Homo sapiens
agccaatgcgtaaaaagatcta

SEQ ID NO: 7321502 - DNA, 22 bp, Homo sapiens
acacttaagcatgaagtataaa

SEQ ID NO: 7321503 - DNA, 22 bp, Homo sapiens
acacatcatgccaagtttcacc

SEQ ID NO: 7321504 - DNA, 19 bp, Homo sapiens
agcagggacatggaacttt

SEQ ID NO: 7321505 - DNA, 22 bp, Homo sapiens
acacacaactcattgtgtaata

SEQ ID NO: 7321506 - DNA, 22 bp, Homo sapiens
agagctgggtggtggtgactca

SEQ ID NO: 7321507 - DNA, 23 bp, Homo sapiens
aattacaaccaagaactggaagg

SEQ ID NO: 7321508 - DNA, 22 bp, Homo sapiens
aatgtataaccataggaaattt

SEQ ID NO: 7321509 - DNA, 22 bp, Homo sapiens
agagatgaaaagggtactgagg

SEQ ID NO: 7321510 - DNA, 22 bp, Homo sapiens
agagatgaaaagtggagactgg

SEQ ID NO: 7321511 - DNA, 22 bp, Homo sapiens
acaacagtaggaaaacatgtct

SEQ ID NO: 7321512 - DNA, 22 bp, Homo sapiens
aatttgtatacatgttacattt

SEQ ID NO: 7321513 - DNA, 22 bp, Homo sapiens
aatttgacagcaatagaagatt

SEQ ID NO: 7321514 - DNA, 22 bp, Homo sapiens
acaacattcttaaatacactga

SEQ ID NO: 7321515 - DNA, 22 bp, Homo sapiens
acaacattcttaaatacactga

SEQ ID NO: 7321516 - DNA, 22 bp, Homo sapiens
acaagtttcattgtttagaacc

SEQ ID NO: 7321517 - DNA, 22 bp, Homo sapiens
acaagttttggaagtcttaagg

SEQ ID NO: 7321518 - DNA, 22 bp, Homo sapiens
aagagtttccatgctctgtgct

SEQ ID NO: 7321519 - DNA, 22 bp, Homo sapiens
aaatatagtaaatgcatagttc

SEQ ID NO: 7321520 - DNA, 22 bp, Homo sapiens
aagagtttttggagtgtgagtt

SEQ ID NO: 7321521 - DNA, 22 bp, Homo sapiens
aagagtttttaatgggtactgg

SEQ ID NO: 7321522 - DNA, 22 bp, Homo sapiens
aagagagacaataggtagcatt

SEQ ID NO: 7321523 - DNA, 22 bp, Homo sapiens
aaatcagacacagtgaaagtta

SEQ ID NO: 7321524 - DNA, 22 bp, Homo sapiens
aaatattggtaggatgcttgtt

SEQ ID NO: 7321525 - DNA, 22 bp, Homo sapiens
aaatcagaaaatatggagagga

SEQ ID NO: 7321526 - DNA, 22 bp, Homo sapiens
aaaggcttctttgctccatgtc

SEQ ID NO: 7321527 - DNA, 22 bp, Homo sapiens
aaattgtaatgacttcacttga

SEQ ID NO: 7321528 - DNA, 22 bp, Homo sapiens
aacatgaaacccaaacagaata

SEQ ID NO: 7321529 - DNA, 22 bp, Homo sapiens
aaatgtctttgagtatttctgc

SEQ ID NO: 7321530 - DNA, 22 bp, Homo sapiens
aaatgtctttatctcatgtaac

SEQ ID NO: 7321531 - DNA, 22 bp, Homo sapiens
aaatgtctttcaatagagaaat

SEQ ID NO: 7321532 - DNA, 22 bp, Homo sapiens
aaatgtctgagacttctgaact

SEQ ID NO: 7321533 - DNA, 22 bp, Homo sapiens
aaatgtctgtatgagaaagaga

SEQ ID NO: 7321534 - DNA, 22 bp, Homo sapiens
aaaattgtcgaacagtagtaac

SEQ ID NO: 7321535 - DNA, 22 bp, Homo sapiens
aaaattttactggtgtttcctt

SEQ ID NO: 7321536 - DNA, 22 bp, Homo sapiens
aaaattttcagcttgacttgat

SEQ ID NO: 7321537 - DNA, 22 bp, Homo sapiens
aaagtacagccacatccaagta

SEQ ID NO: 7321538 - DNA, 22 bp, Homo sapiens
aaagcaatggatgagaatctgt

SEQ ID NO: 7321539 - DNA, 18 bp, Homo sapiens
aaaatgcaggcgacatgg

SEQ ID NO: 7321540 - DNA, 22 bp, Homo sapiens
aaaagtgtccagattatgaaga

SEQ ID NO: 7321541 - DNA, 22 bp, Homo sapiens
aaaagtttaagactcattctag

SEQ ID NO: 7321542 - DNA, 22 bp, Homo sapiens
aaaacattttactgccatctca

SEQ ID NO: 7321543 - DNA, 22 bp, Homo sapiens
aaaacattttactgccatctca

SEQ ID NO: 7321544 - DNA, 22 bp, Homo sapiens
aaaacattgaattgcacactat

SEQ ID NO: 7321545 - DNA, 22 bp, Homo sapiens
aaaaatgtgaccacagggtgtt

SEQ ID NO: 7321546 - DNA, 22 bp, Homo sapiens
aaaaatgttatctactgtccga

SEQ ID NO: 7321547 - DNA, 22 bp, Homo sapiens
aaaaatttatggttcttctctg

SEQ ID NO: 7321548 - DNA, 22 bp, Homo sapiens
aaaagccaaggtcctcttcaga

SEQ ID NO: 7321549 - DNA, 23 bp, Homo sapiens
aactttactattttgaataatgc

SEQ ID NO: 7321550 - DNA, 22 bp, Homo sapiens
aactttaaggctataaattatg

SEQ ID NO: 7321551 - DNA, 19 bp, Homo sapiens
aatgcttaggacagtgcct

SEQ ID NO: 7321552 - DNA, 22 bp, Homo sapiens
aatgcttattattaatagaatg

SEQ ID NO: 7321553 - DNA, 22 bp, Homo sapiens
aataatgtacatacatatttcg

SEQ ID NO: 7321554 - DNA, 22 bp, Homo sapiens
aataatgtctgctattttaaaa

SEQ ID NO: 7321555 - DNA, 22 bp, Homo sapiens
aatattgtttcaagatcacaga

SEQ ID NO: 7321556 - DNA, 22 bp, Homo sapiens
aatatttctgtagctatgttct

SEQ ID NO: 7321557 - DNA, 18 bp, Homo sapiens
aaatggcagaatggatag

SEQ ID NO: 7321558 - DNA, 22 bp, Homo sapiens
aaggagtctgggccattcagag

SEQ ID NO: 7321559 - DNA, 22 bp, Homo sapiens
aaggcactgactgtgcagggga

SEQ ID NO: 7321560 - DNA, 22 bp, Homo sapiens
aagtctggtgctgtcctcaccc

SEQ ID NO: 7321561 - DNA, 22 bp, Homo sapiens
aagtctgggcctccttcccaga

SEQ ID NO: 7321562 - DNA, 23 bp, Homo sapiens
aagcagggagattcttagctgag

SEQ ID NO: 7321563 - DNA, 22 bp, Homo sapiens
aagcagggtcttcctcagttgg

SEQ ID NO: 7321564 - DNA, 21 bp, Homo sapiens
acaaattgtttatataggaag

SEQ ID NO: 7321565 - DNA, 22 bp, Homo sapiens
acaatgtaggctgaaaaagctt

SEQ ID NO: 7321566 - DNA, 20 bp, Homo sapiens
acaatatgtagatgaatagc

SEQ ID NO: 7321567 - DNA, 22 bp, Homo sapiens
acacagagccagggaatacagt

SEQ ID NO: 7321568 - DNA, 22 bp, Homo sapiens
aagagtttccagttgtggctca

SEQ ID NO: 7321569 - DNA, 22 bp, Homo sapiens
aattttatctctaagcaggctt

SEQ ID NO: 7321570 - DNA, 22 bp, Homo sapiens
aagaacattttgtagaatgaca

SEQ ID NO: 7321571 - DNA, 22 bp, Homo sapiens
atctgggagacccttgcgggaa

SEQ ID NO: 7321572 - DNA, 22 bp, Homo sapiens
atctgggagcggaggttgcagt

SEQ ID NO: 7321573 - DNA, 22 bp, Homo sapiens
atgaggcaaaggtggaggtggg

SEQ ID NO: 7321574 - DNA, 22 bp, Homo sapiens
atgaggcaaggctggccgtgtt

SEQ ID NO: 7321575 - DNA, 22 bp, Homo sapiens
atgtgcaaagggacttgcacat

SEQ ID NO: 7321576 - DNA, 22 bp, Homo sapiens
attaaggaagcctattctctcc

SEQ ID NO: 7321577 - DNA, 22 bp, Homo sapiens
atgttccttccagagagcagaa

SEQ ID NO: 7321578 - DNA, 22 bp, Homo sapiens
atgttcctggtatatcatgacc

SEQ ID NO: 7321579 - DNA, 22 bp, Homo sapiens
atgttcctgatcctcgttctat

SEQ ID NO: 7321580 - DNA, 22 bp, Homo sapiens
agagactggcttctaaaatggc

SEQ ID NO: 7321581 - DNA, 17 bp, Homo sapiens
atgtatattaactctga

SEQ ID NO: 7321582 - DNA, 17 bp, Homo sapiens
atgtatattaactctga

SEQ ID NO: 7321583 - DNA, 22 bp, Homo sapiens
atgtatatgaagctagtatttt

SEQ ID NO: 7321584 - DNA, 22 bp, Homo sapiens
attcttctgcctactttcatcc

SEQ ID NO: 7321585 - DNA, 22 bp, Homo sapiens
attctctgggttccagtaaatg

SEQ ID NO: 7321586 - DNA, 21 bp, Homo sapiens
attcaaagaagaggaaggccc

SEQ ID NO: 7321587 - DNA, 22 bp, Homo sapiens
attcaaagaacctttagcattg

SEQ ID NO: 7321588 - DNA, 22 bp, Homo sapiens
attgtatgcagcattaagcaat

SEQ ID NO: 7321589 - DNA, 22 bp, Homo sapiens
agataattatttacttcaaagt

SEQ ID NO: 7321590 - DNA, 22 bp, Homo sapiens
agataatttgagtaaattaatt

SEQ ID NO: 7321591 - DNA, 22 bp, Homo sapiens
atttacagacgtggattagtgc

SEQ ID NO: 7321592 - DNA, 22 bp, Homo sapiens
atttacaggtagaattttaagt

SEQ ID NO: 7321593 - DNA, 22 bp, Homo sapiens
atttacagccttgaaaacagca

SEQ ID NO: 7321594 - DNA, 22 bp, Homo sapiens
atttacagatgatgctatttga

SEQ ID NO: 7321595 - DNA, 23 bp, Homo sapiens
atttacagctgtgtgagcaagtt

SEQ ID NO: 7321596 - DNA, 22 bp, Homo sapiens
agattcattgctttaggcattg

SEQ ID NO: 7321597 - DNA, 22 bp, Homo sapiens
agattgcaattccttacatgca

SEQ ID NO: 7321598 - DNA, 22 bp, Homo sapiens
agatttcaatggatattgcaag

SEQ ID NO: 7321599 - DNA, 21 bp, Homo sapiens
attttgtacatagaatttgtc

SEQ ID NO: 7321600 - DNA, 22 bp, Homo sapiens
attttgttgaggtaattgtcaa

SEQ ID NO: 7321601 - DNA, 22 bp, Homo sapiens
caaacattttgagtggtttctg

SEQ ID NO: 7321602 - DNA, 22 bp, Homo sapiens
caaacattttctacttccagga

SEQ ID NO: 7321603 - DNA, 22 bp, Homo sapiens
caaacatttgttggaacccctg

SEQ ID NO: 7321604 - DNA, 22 bp, Homo sapiens
caaacatttgttggaacccctg

SEQ ID NO: 7321605 - DNA, 22 bp, Homo sapiens
caaacatttgacttctctcagg

SEQ ID NO: 7321606 - DNA, 22 bp, Homo sapiens
caaacattgggggcttcaacac

SEQ ID NO: 7321607 - DNA, 22 bp, Homo sapiens
caaacattgggggcttcaacac

SEQ ID NO: 7321608 - DNA, 22 bp, Homo sapiens
caaacattgctaccagaggttt

SEQ ID NO: 7321609 - DNA, 22 bp, Homo sapiens
caaacattgcactttctgctat

SEQ ID NO: 7321610 - DNA, 22 bp, Homo sapiens
agcaatgactttgaaatcatga

SEQ ID NO: 7321611 - DNA, 22 bp, Homo sapiens
agcaatgaccagtgatcttgta

SEQ ID NO: 7321612 - DNA, 22 bp, Homo sapiens
caaagttttagtaaacatatat

SEQ ID NO: 7321613 - DNA, 22 bp, Homo sapiens
agcctattccaggatgagctca

SEQ ID NO: 7321614 - DNA, 22 bp, Homo sapiens
cagaggtgctggagtgagtcct

SEQ ID NO: 7321615 - DNA, 18 bp, Homo sapiens
cagctgccagctcatgga

SEQ ID NO: 7321616 - DNA, 22 bp, Homo sapiens
cactgggctttgtagttagcat

SEQ ID NO: 7321617 - DNA, 22 bp, Homo sapiens
cactgggcgtgtcctgggtgag

SEQ ID NO: 7321618 - DNA, 22 bp, Homo sapiens
cactgggcaattctgagcctaa

SEQ ID NO: 7321619 - DNA, 22 bp, Homo sapiens
caattttattggtccaaataca

SEQ ID NO: 7321620 - DNA, 18 bp, Homo sapiens
caattttacccagtccct

SEQ ID NO: 7321621 - DNA, 22 bp, Homo sapiens
caattttactcttcctcttcca

SEQ ID NO: 7321622 - DNA, 22 bp, Homo sapiens
agcagagaagacacaggcttca

SEQ ID NO: 7321623 - DNA, 22 bp, Homo sapiens
agttgcactttctagatactgt

SEQ ID NO: 7321624 - DNA, 22 bp, Homo sapiens
atacacatttgctagagatggg

SEQ ID NO: 7321625 - DNA, 22 bp, Homo sapiens
ataaggacacccttctctttac

SEQ ID NO: 7321626 - DNA, 22 bp, Homo sapiens
atacaagttgtgataatgtaaa

SEQ ID NO: 7321627 - DNA, 22 bp, Homo sapiens
actttactccccaacataaatg

SEQ ID NO: 7321628 - DNA, 22 bp, Homo sapiens
ataggacagcagacaattagta

SEQ ID NO: 7321629 - DNA, 22 bp, Homo sapiens
agaaaactgggaggagagcttc

SEQ ID NO: 7321630 - DNA, 22 bp, Homo sapiens
agaaaacttgtcacagctctca

SEQ ID NO: 7321631 - DNA, 20 bp, Homo sapiens
agaaacatttcttgagaact

SEQ ID NO: 7321632 - DNA, 22 bp, Homo sapiens
agaaatcttggagtctgtggta

SEQ ID NO: 7321633 - DNA, 22 bp, Homo sapiens
atcaagcagtgaaaaatgctag

SEQ ID NO: 7321634 - DNA, 22 bp, Homo sapiens
agaaatgtcaggaaagaagtcc

SEQ ID NO: 7321635 - DNA, 22 bp, Homo sapiens
agaaatgtattctgtatgtttt

SEQ ID NO: 7321636 - DNA, 22 bp, Homo sapiens
agaaatgtggatcgttttaaaa

SEQ ID NO: 7321637 - DNA, 22 bp, Homo sapiens
agaaatgttcttcatttgccat

SEQ ID NO: 7321638 - DNA, 22 bp, Homo sapiens
actggtttcccggaactacagt

SEQ ID NO: 7321639 - DNA, 22 bp, Homo sapiens
actggtttcctagaataagact

SEQ ID NO: 7321640 - DNA, 22 bp, Homo sapiens
agttacagcactcaaagttttc

SEQ ID NO: 7321641 - DNA, 23 bp, Homo sapiens
actgggctgaaatttttcatggc

SEQ ID NO: 7321642 - DNA, 23 bp, Homo sapiens
actgggctgaaattaaaggtgtc

SEQ ID NO: 7321643 - DNA, 22 bp, Homo sapiens
agtgaggcaaagtgagaggcag

SEQ ID NO: 7321644 - DNA, 22 bp, Homo sapiens
agtcaggttgcattttaagtaa

SEQ ID NO: 7321645 - DNA, 22 bp, Homo sapiens
agtcaggtaccacattacattg

SEQ ID NO: 7321646 - DNA, 22 bp, Homo sapiens
agtcaggtactccgagggcatg

SEQ ID NO: 7321647 - DNA, 22 bp, Homo sapiens
agtcaggtgaatgttatacaca

SEQ ID NO: 7321648 - DNA, 19 bp, Homo sapiens
agtcaggtggctggtgcca

SEQ ID NO: 7321649 - DNA, 22 bp, Homo sapiens
agtcaggtgggggctgcagtgg

SEQ ID NO: 7321650 - DNA, 22 bp, Homo sapiens
agtcaggtggttctgctccact

SEQ ID NO: 7321651 - DNA, 22 bp, Homo sapiens
agtcaggttctcacagctcttc

SEQ ID NO: 7321652 - DNA, 22 bp, Homo sapiens
agtaagcaccgggatggtcaag

SEQ ID NO: 7321653 - DNA, 22 bp, Homo sapiens
aggtgccaaagcctgcgggtgt

SEQ ID NO: 7321654 - DNA, 22 bp, Homo sapiens
aggtgaggataggtggccaagg

SEQ ID NO: 7321655 - DNA, 22 bp, Homo sapiens
aggttccttatggggatggcta

SEQ ID NO: 7321656 - DNA, 20 bp, Homo sapiens
aggttcctttgtggagaatt

SEQ ID NO: 7321657 - DNA, 20 bp, Homo sapiens
aggtgtccacgtggcagggt

SEQ ID NO: 7321658 - DNA, 22 bp, Homo sapiens
aggtgtccaatcctggttggat

SEQ ID NO: 7321659 - DNA, 20 bp, Homo sapiens
aggtgtccacgtggcagggt

SEQ ID NO: 7321660 - DNA, 22 bp, Homo sapiens
aggttcccaggatctgtctggg

SEQ ID NO: 7321661 - DNA, 22 bp, Homo sapiens
aggttcccagagatagagctgt

SEQ ID NO: 7321662 - DNA, 22 bp, Homo sapiens
aggtggagacccagagaaggcg

SEQ ID NO: 7321663 - DNA, 22 bp, Homo sapiens
agggcactggcttgcaaactca

SEQ ID NO: 7321664 - DNA, 22 bp, Homo sapiens
agggcactctgcagggaccacc

SEQ ID NO: 7321665 - DNA, 22 bp, Homo sapiens
agggcactccttggcagctctg

SEQ ID NO: 7321666 - DNA, 22 bp, Homo sapiens
accagacactgtgaagacaggc

SEQ ID NO: 7321667 - DNA, 22 bp, Homo sapiens
acatgtcttttaaagtctaata

SEQ ID NO: 7321668 - DNA, 22 bp, Homo sapiens
acatgtctacacattctgcaat

SEQ ID NO: 7321669 - DNA, 22 bp, Homo sapiens
acatatatgtaaagtactttgt

SEQ ID NO: 7321670 - DNA, 22 bp, Homo sapiens
aggcagatgggagctggaagtt

SEQ ID NO: 7321671 - DNA, 22 bp, Homo sapiens
aggcagatcacaggagggcctg

SEQ ID NO: 7321672 - DNA, 18 bp, Homo sapiens
aggcaggtgctggaagtc

SEQ ID NO: 7321673 - DNA, 22 bp, Homo sapiens
aggcaggtgttgggagacacca

SEQ ID NO: 7321674 - DNA, 22 bp, Homo sapiens
aggcaggtgggtcacttgagtc

SEQ ID NO: 7321675 - DNA, 22 bp, Homo sapiens
acagtgaatccaaattcctacc

SEQ ID NO: 7321676 - DNA, 22 bp, Homo sapiens
acagtgttctgaaagttgaggg

SEQ ID NO: 7321677 - DNA, 22 bp, Homo sapiens
aggcactggtccattttctgca

SEQ ID NO: 7321678 - DNA, 19 bp, Homo sapiens
aggaaaggtggccttagca

SEQ ID NO: 7321679 - DNA, 22 bp, Homo sapiens
aggaaaggtagcgtgccagcag

SEQ ID NO: 7321680 - DNA, 22 bp, Homo sapiens
acaggatggccagctgatattg

SEQ ID NO: 7321681 - DNA, 22 bp, Homo sapiens
agcttcttttacagctcatgct

SEQ ID NO: 7321682 - DNA, 22 bp, Homo sapiens
agcttagaagtgtgctgagagg

SEQ ID NO: 7321683 - DNA, 22 bp, Homo sapiens
caggaccccatattcactgaac

SEQ ID NO: 7321684 - DNA, 22 bp, Homo sapiens
aggaagagcattcacatggtag

SEQ ID NO: 7321685 - DNA, 22 bp, Homo sapiens
aggaagagctggaccagaggac

SEQ ID NO: 7321686 - DNA, 21 bp, Homo sapiens
aggaaaggaagtccccagggt

SEQ ID NO: 7321687 - DNA, 21 bp, Homo sapiens
aggaaaggccagcacgtaggg

SEQ ID NO: 7321688 - DNA, 22 bp, Homo sapiens
aggaaaggattggcttctctgt

SEQ ID NO: 7321689 - DNA, 22 bp, Homo sapiens
aggaaaggcctttgcatttggt

SEQ ID NO: 7321690 - DNA, 22 bp, Homo sapiens
cagggcttcgctcctggtgcac

SEQ ID NO: 7321691 - DNA, 22 bp, Homo sapiens
catttctgttctcttcctgtac

SEQ ID NO: 7321692 - DNA, 22 bp, Homo sapiens
ccaatgaaaggtcaattctata

SEQ ID NO: 7321693 - DNA, 22 bp, Homo sapiens
catttctgtcacgttcttttat

SEQ ID NO: 7321694 - DNA, 19 bp, Homo sapiens
ccacagagcatgctgaggc

SEQ ID NO: 7321695 - DNA, 22 bp, Homo sapiens
cattggcacaagtagcttcatc

SEQ ID NO: 7321696 - DNA, 22 bp, Homo sapiens
aggcactgttcccagttatcct

SEQ ID NO: 7321697 - DNA, 20 bp, Homo sapiens
aggcactgttgtctgtatcc

SEQ ID NO: 7321698 - DNA, 21 bp, Homo sapiens
aggcactgtttgtggtttggg

SEQ ID NO: 7321699 - DNA, 22 bp, Homo sapiens
aggcactgtgggtgtggccgga

SEQ ID NO: 7321700 - DNA, 22 bp, Homo sapiens
aggcacttctcaaattcatgcc

SEQ ID NO: 7321701 - DNA, 22 bp, Homo sapiens
catttctccgccgagatcactg

SEQ ID NO: 7321702 - DNA, 22 bp, Homo sapiens
catttctcctgggtgataaatt

SEQ ID NO: 7321703 - DNA, 22 bp, Homo sapiens
catttcaatgccttcaacatag

SEQ ID NO: 7321704 - DNA, 22 bp, Homo sapiens
cataacattaagcctctatttc

SEQ ID NO: 7321705 - DNA, 22 bp, Homo sapiens
cagtgttgctaagttctgaact

SEQ ID NO: 7321706 - DNA, 22 bp, Homo sapiens
catacagttttccctagatgtg

SEQ ID NO: 7321707 - DNA, 22 bp, Homo sapiens
catacaaatgtgtccaggctct

SEQ ID NO: 7321708 - DNA, 22 bp, Homo sapiens
cccacacatttttcacttaccg

SEQ ID NO: 7321709 - DNA, 20 bp, Homo sapiens
ccaggcctgggcctgctcta

SEQ ID NO: 7321710 - DNA, 22 bp, Homo sapiens
ccaggttcaaatagctgtgtga

SEQ ID NO: 7321711 - DNA, 19 bp, Homo sapiens
aggcaggtgcagaggtccc

SEQ ID NO: 7321712 - DNA, 22 bp, Homo sapiens
aggcaggtcccctggaaggcac

SEQ ID NO: 7321713 - DNA, 22 bp, Homo sapiens
aggcaggtgagtcaaaacagac

SEQ ID NO: 7321714 - DNA, 22 bp, Homo sapiens
aggctttcctgtcactcatgct

SEQ ID NO: 7321715 - DNA, 21 bp, Homo sapiens
agggagctttaggtagaagtt

SEQ ID NO: 7321716 - DNA, 22 bp, Homo sapiens
cctagaatgtacttaatagatg

SEQ ID NO: 7321717 - DNA, 22 bp, Homo sapiens
cctcctggtgggcgcttctggc

SEQ ID NO: 7321718 - DNA, 22 bp, Homo sapiens
cctcttaattgtactccttcag

SEQ ID NO: 7321719 - DNA, 22 bp, Homo sapiens
agtatttagagacacaagatgg

SEQ ID NO: 7321720 - DNA, 22 bp, Homo sapiens
ctacatttggagagtataggaa

SEQ ID NO: 7321721 - DNA, 22 bp, Homo sapiens
ctacatttgttcaaataagctg

SEQ ID NO: 7321722 - DNA, 22 bp, Homo sapiens
ctacatttcccagctgccttcc

SEQ ID NO: 7321723 - DNA, 22 bp, Homo sapiens
ctacatttgttctatagctttt

SEQ ID NO: 7321724 - DNA, 22 bp, Homo sapiens
ctacattttgtgattatgaaat

SEQ ID NO: 7321725 - DNA, 22 bp, Homo sapiens
ctacattttaataagctgctta

SEQ ID NO: 7321726 - DNA, 22 bp, Homo sapiens
ctacatttttcaccgagcctct

SEQ ID NO: 7321727 - DNA, 22 bp, Homo sapiens
ctaagcaagaatgagtgcaaca

SEQ ID NO: 7321728 - DNA, 22 bp, Homo sapiens
aggttttcacaggaagtatgtt

SEQ ID NO: 7321729 - DNA, 19 bp, Homo sapiens
aggtccctgtcacctctca

SEQ ID NO: 7321730 - DNA, 22 bp, Homo sapiens
cctggatagctactggccaggc

SEQ ID NO: 7321731 - DNA, 22 bp, Homo sapiens
aggtaggatagataggaagacc

SEQ ID NO: 7321732 - DNA, 22 bp, Homo sapiens
cctgtcagttgctgtcagggat

SEQ ID NO: 7321733 - DNA, 22 bp, Homo sapiens
cctgggctttcaaaaccagcct

SEQ ID NO: 7321734 - DNA, 22 bp, Homo sapiens
cctgggctttcggcggcttcct

SEQ ID NO: 7321735 - DNA, 20 bp, Homo sapiens
cctgggctccaggagccccg

SEQ ID NO: 7321736 - DNA, 22 bp, Homo sapiens
cctgggcttctgtctagatgtt

SEQ ID NO: 7321737 - DNA, 22 bp, Homo sapiens
cctgggcttggttgttgagaac

SEQ ID NO: 7321738 - DNA, 22 bp, Homo sapiens
cctgggcttgcatctgtgctgg

SEQ ID NO: 7321739 - DNA, 22 bp, Homo sapiens
cctgggctcacagccaaggctc

SEQ ID NO: 7321740 - DNA, 22 bp, Homo sapiens
cctgggctcaagtgatggtccc

SEQ ID NO: 7321741 - DNA, 22 bp, Homo sapiens
cctgggctcaccatgccttgga

SEQ ID NO: 7321742 - DNA, 22 bp, Homo sapiens
cctgggctcaggcttgggcagc

SEQ ID NO: 7321743 - DNA, 22 bp, Homo sapiens
cctgggctccactccaagagca

SEQ ID NO: 7321744 - DNA, 22 bp, Homo sapiens
cctgggctcaagtgatcctcct

SEQ ID NO: 7321745 - DNA, 22 bp, Homo sapiens
ctcctgggtcattgccagcaaa

SEQ ID NO: 7321746 - DNA, 22 bp, Homo sapiens
ctcctggctttcccagaccagg

SEQ ID NO: 7321747 - DNA, 22 bp, Homo sapiens
ctcctgggaatttagttgtgag

SEQ ID NO: 7321748 - DNA, 18 bp, Homo sapiens
agtcttctgatccatttt

SEQ ID NO: 7321749 - DNA, 22 bp, Homo sapiens
agtcttctcatttcacatgctt

SEQ ID NO: 7321750 - DNA, 22 bp, Homo sapiens
ctcattctttcacagtctgtgg

SEQ ID NO: 7321751 - DNA, 22 bp, Homo sapiens
ctcattgcaacctccgcctccc

SEQ ID NO: 7321752 - DNA, 22 bp, Homo sapiens
ctcattagacaggtatacttta

SEQ ID NO: 7321753 - DNA, 22 bp, Homo sapiens
ctcatgtcttcacccattctaa

SEQ ID NO: 7321754 - DNA, 22 bp, Homo sapiens
ctcatgtcaggggtgtcaatgt

SEQ ID NO: 7321755 - DNA, 22 bp, Homo sapiens
ctctggcttgttaatgcatatt

SEQ ID NO: 7321756 - DNA, 22 bp, Homo sapiens
ctctggctttgctcatgcatcc

SEQ ID NO: 7321757 - DNA, 22 bp, Homo sapiens
agttagttttgtaattccaccc

SEQ ID NO: 7321758 - DNA, 20 bp, Homo sapiens
ctgggctcaagtgagcctcc

SEQ ID NO: 7321759 - DNA, 22 bp, Homo sapiens
atatgcacatacatacataggt

SEQ ID NO: 7321760 - DNA, 22 bp, Homo sapiens
ctggcttccaccatggcccctg

SEQ ID NO: 7321761 - DNA, 19 bp, Homo sapiens
ctgggctgaggtctgcctt

SEQ ID NO: 7321762 - DNA, 22 bp, Homo sapiens
ctgggctctgcggtgtcgctct

SEQ ID NO: 7321763 - DNA, 22 bp, Homo sapiens
atattgtactagggttacatgt

SEQ ID NO: 7321764 - DNA, 22 bp, Homo sapiens
atcaaaatgctccagtgatggt

SEQ ID NO: 7321765 - DNA, 22 bp, Homo sapiens
atcagaatagtgggggacagtc

SEQ ID NO: 7321766 - DNA, 20 bp, Homo sapiens
atcagacttttaggaacata

SEQ ID NO: 7321767 - DNA, 22 bp, Homo sapiens
ctgtgggagaagctagcacagg

SEQ ID NO: 7321768 - DNA, 22 bp, Homo sapiens
cttcccaagactgtattgcaag

SEQ ID NO: 7321769 - DNA, 22 bp, Homo sapiens
cttcccaagctttagttatttt

SEQ ID NO: 7321770 - DNA, 22 bp, Homo sapiens
atacagtagggaccatgtctga

SEQ ID NO: 7321771 - DNA, 17 bp, Homo sapiens
atacattgttaaagtat

SEQ ID NO: 7321772 - DNA, 22 bp, Homo sapiens
atacattgagttttgatgttct

SEQ ID NO: 7321773 - DNA, 22 bp, Homo sapiens
atactcaaggttaatgattgaa

SEQ ID NO: 7321774 - DNA, 22 bp, Homo sapiens
atagcacaatattacctttatg

SEQ ID NO: 7321775 - DNA, 22 bp, Homo sapiens
atagcacaatgacttgggtatc

SEQ ID NO: 7321776 - DNA, 22 bp, Homo sapiens
agttatattccatagattcaga

SEQ ID NO: 7321777 - DNA, 22 bp, Homo sapiens
ctgcagagaattgtggggcttc

SEQ ID NO: 7321778 - DNA, 22 bp, Homo sapiens
gcccccagagaatgaggtacga

SEQ ID NO: 7321779 - DNA, 22 bp, Homo sapiens
gcctcaaatgtggagcactatt

SEQ ID NO: 7321780 - DNA, 22 bp, Homo sapiens
gcctggattacaaacagccaac

SEQ ID NO: 7321781 - DNA, 22 bp, Homo sapiens
atttcatgttgatctttcgagg

SEQ ID NO: 7321782 - DNA, 22 bp, Homo sapiens
atttcatgtttcatctacctaa

SEQ ID NO: 7321783 - DNA, 22 bp, Homo sapiens
atttccagtgactctcacaggt

SEQ ID NO: 7321784 - DNA, 22 bp, Homo sapiens
atttctgttgcttataaattac

SEQ ID NO: 7321785 - DNA, 22 bp, Homo sapiens
caaaatgttctggcacctttaa

SEQ ID NO: 7321786 - DNA, 22 bp, Homo sapiens
caaacaatttgcatttccttag

SEQ ID NO: 7321787 - DNA, 22 bp, Homo sapiens
caaaattgatgaatgtatgatt

SEQ ID NO: 7321788 - DNA, 22 bp, Homo sapiens
caaacattcagatgcaatggta

SEQ ID NO: 7321789 - DNA, 22 bp, Homo sapiens
attttgctttatgtaaatatgt

SEQ ID NO: 7321790 - DNA, 22 bp, Homo sapiens
caaatgctactaataggcaagt

SEQ ID NO: 7321791 - DNA, 22 bp, Homo sapiens
gctgacctgctctcagcagaga

SEQ ID NO: 7321792 - DNA, 22 bp, Homo sapiens
gcaggcctgcccagcaggatgg

SEQ ID NO: 7321793 - DNA, 20 bp, Homo sapiens
attgtcagccttcagaggag

SEQ ID NO: 7321794 - DNA, 18 bp, Homo sapiens
attgtcagaagtcatgtg

SEQ ID NO: 7321795 - DNA, 22 bp, Homo sapiens
attgtcacttaaaagtgcatgt

SEQ ID NO: 7321796 - DNA, 22 bp, Homo sapiens
attgtacttttattacatgtag

SEQ ID NO: 7321797 - DNA, 22 bp, Homo sapiens
attcaaggtttattcagtttag

SEQ ID NO: 7321798 - DNA, 22 bp, Homo sapiens
attcacagtttcctcatattct

SEQ ID NO: 7321799 - DNA, 22 bp, Homo sapiens
gcacggctaatttttgtatttt

SEQ ID NO: 7321800 - DNA, 22 bp, Homo sapiens
attcaaagtaataaccagaact

SEQ ID NO: 7321801 - DNA, 22 bp, Homo sapiens
attcaaagtagatgaagtttca

SEQ ID NO: 7321802 - DNA, 22 bp, Homo sapiens
attcaaagtactagctattttt

SEQ ID NO: 7321803 - DNA, 22 bp, Homo sapiens
attcaaagtctagatgtagtgt

SEQ ID NO: 7321804 - DNA, 22 bp, Homo sapiens
attacagttctgcaggtagttt

SEQ ID NO: 7321805 - DNA, 22 bp, Homo sapiens
attacagttctacacatccttt

SEQ ID NO: 7321806 - DNA, 23 bp, Homo sapiens
attacagttaattacaacatctt

SEQ ID NO: 7321807 - DNA, 22 bp, Homo sapiens
attacagttaatttaccttctt

SEQ ID NO: 7321808 - DNA, 22 bp, Homo sapiens
gatatgtattgaatgatcattt

SEQ ID NO: 7321809 - DNA, 22 bp, Homo sapiens
attacagtggacagctatgcac

SEQ ID NO: 7321810 - DNA, 22 bp, Homo sapiens
attacagtgggtaaacagaatt

SEQ ID NO: 7321811 - DNA, 23 bp, Homo sapiens
gagagcaatgagatgtaaacact

SEQ ID NO: 7321812 - DNA, 18 bp, Homo sapiens
atggaggcagagagctga

SEQ ID NO: 7321813 - DNA, 17 bp, Homo sapiens
atggaggcagacaggtc

SEQ ID NO: 7321814 - DNA, 22 bp, Homo sapiens
atggccagagaggccagcctgg

SEQ ID NO: 7321815 - DNA, 22 bp, Homo sapiens
atgggaagctgacctgcatgga

SEQ ID NO: 7321816 - DNA, 22 bp, Homo sapiens
atgggagaaacatcatgaggca

SEQ ID NO: 7321817 - DNA, 23 bp, Homo sapiens
atgggcttagaaagcaagtggga

SEQ ID NO: 7321818 - DNA, 22 bp, Homo sapiens
atgggcttgaccctacagaaag

SEQ ID NO: 7321819 - DNA, 22 bp, Homo sapiens
atgggcttggcgacaatttgaa

SEQ ID NO: 7321820 - DNA, 20 bp, Homo sapiens
atgtgtcttagagcatcagg

SEQ ID NO: 7321821 - DNA, 22 bp, Homo sapiens
atgttctttcagccagtgcatc

SEQ ID NO: 7321822 - DNA, 22 bp, Homo sapiens
gatatgtatgaggagtatgtat

SEQ ID NO: 7321823 - DNA, 22 bp, Homo sapiens
gatatgtaccacctcttaaaag

SEQ ID NO: 7321824 - DNA, 22 bp, Homo sapiens
atgtagctgcagatgataatgc

SEQ ID NO: 7321825 - DNA, 19 bp, Homo sapiens
atgtctctgtagcacatac

SEQ ID NO: 7321826 - DNA, 22 bp, Homo sapiens
atgtctctctctgagtgccaga

SEQ ID NO: 7321827 - DNA, 22 bp, Homo sapiens
atgtctctcaggtttaacttta

SEQ ID NO: 7321828 - DNA, 22 bp, Homo sapiens
gacctttaatgtttctaccact

SEQ ID NO: 7321829 - DNA, 22 bp, Homo sapiens
atgctattccagaatgtaaatt

SEQ ID NO: 7321830 - DNA, 22 bp, Homo sapiens
atgctatgtaactggcagatag

SEQ ID NO: 7321831 - DNA, 22 bp, Homo sapiens
gacatttattagaaaactatca

SEQ ID NO: 7321832 - DNA, 22 bp, Homo sapiens
gacatttatgaaggagatatgc

SEQ ID NO: 7321833 - DNA, 22 bp, Homo sapiens
gacaatttctcaatatagaaac

SEQ ID NO: 7321834 - DNA, 22 bp, Homo sapiens
gaatcagaatctctaaggtggg

SEQ ID NO: 7321835 - DNA, 22 bp, Homo sapiens
gaattttatcttattacttgca

SEQ ID NO: 7321836 - DNA, 19 bp, Homo sapiens
gaattttaggacttcagca

SEQ ID NO: 7321837 - DNA, 22 bp, Homo sapiens
gaatacaaacttaaggctttac

SEQ ID NO: 7321838 - DNA, 22 bp, Homo sapiens
gaaggcttagaaacaagggagc

SEQ ID NO: 7321839 - DNA, 16 bp, Homo sapiens
gaaggcttactgcagg

SEQ ID NO: 7321840 - DNA, 22 bp, Homo sapiens
gaaggcttatgtgtgactttcg

SEQ ID NO: 7321841 - DNA, 22 bp, Homo sapiens
gaaacatttgttgagtacttgc

SEQ ID NO: 7321842 - DNA, 22 bp, Homo sapiens
gaaacattggtctgccccttat

SEQ ID NO: 7321843 - DNA, 22 bp, Homo sapiens
gaaacattcatatgagaaacct

SEQ ID NO: 7321844 - DNA, 22 bp, Homo sapiens
gaaatttattatctacatcatt

SEQ ID NO: 7321845 - DNA, 22 bp, Homo sapiens
cttctttaatgtatacaaaaga

SEQ ID NO: 7321846 - DNA, 22 bp, Homo sapiens
atctggctcacttagtctagga

SEQ ID NO: 7321847 - DNA, 22 bp, Homo sapiens
atctggctattgacatgttata

SEQ ID NO: 7321848 - DNA, 22 bp, Homo sapiens
atgaaattaatcaacacataca

SEQ ID NO: 7321849 - DNA, 22 bp, Homo sapiens
ggggagagtattttattcaagt

SEQ ID NO: 7321850 - DNA, 22 bp, Homo sapiens
ggggagagtcctttccagttcc

SEQ ID NO: 7321851 - DNA, 19 bp, Homo sapiens
cagaggcaccaggtataga

SEQ ID NO: 7321852 - DNA, 22 bp, Homo sapiens
ggtcctgggaagatgctcatga

SEQ ID NO: 7321853 - DNA, 22 bp, Homo sapiens
ggtcaggtttttaggagtgacc

SEQ ID NO: 7321854 - DNA, 22 bp, Homo sapiens
ggtcaggtggcttctgtcctct

SEQ ID NO: 7321855 - DNA, 22 bp, Homo sapiens
ggtcaggtaggaagttaactat

SEQ ID NO: 7321856 - DNA, 22 bp, Homo sapiens
ggtcaggtagctctgacaggcc

SEQ ID NO: 7321857 - DNA, 22 bp, Homo sapiens
cagcaagatggtgaatgagacg

SEQ ID NO: 7321858 - DNA, 22 bp, Homo sapiens
cagaggacttcccactcatctg

SEQ ID NO: 7321859 - DNA, 22 bp, Homo sapiens
cagaggcaaaagaggtggaggt

SEQ ID NO: 7321860 - DNA, 22 bp, Homo sapiens
cagagcctcatcatccactcca

SEQ ID NO: 7321861 - DNA, 22 bp, Homo sapiens
gggcaggtatttatcttctatt

SEQ ID NO: 7321862 - DNA, 22 bp, Homo sapiens
gggcagagaaatggacagttgg

SEQ ID NO: 7321863 - DNA, 22 bp, Homo sapiens
cagcaggaaggtttcccctgca

SEQ ID NO: 7321864 - DNA, 20 bp, Homo sapiens
cagcaggaaaagtgcctcag

SEQ ID NO: 7321865 - DNA, 22 bp, Homo sapiens
cacaggaatcagcattaatggc

SEQ ID NO: 7321866 - DNA, 22 bp, Homo sapiens
cacaggaaggccttctcacaat

SEQ ID NO: 7321867 - DNA, 22 bp, Homo sapiens
caagcaggaggagaagtttctg

SEQ ID NO: 7321868 - DNA, 22 bp, Homo sapiens
caaatgtgtaaggaagtgttag

SEQ ID NO: 7321869 - DNA, 22 bp, Homo sapiens
caagcatactgtgagagtttta

SEQ ID NO: 7321870 - DNA, 22 bp, Homo sapiens
caaggtgaacttgctgtacagc

SEQ ID NO: 7321871 - DNA, 22 bp, Homo sapiens
caaggtgatacttacattagtg

SEQ ID NO: 7321872 - DNA, 22 bp, Homo sapiens
caaggtgattgggatagctggt

SEQ ID NO: 7321873 - DNA, 22 bp, Homo sapiens
caagtcaactcaaattgttatc

SEQ ID NO: 7321874 - DNA, 22 bp, Homo sapiens
caagtttacaatgtgtatgtgt

SEQ ID NO: 7321875 - DNA, 21 bp, Homo sapiens
caatgtctgctctctgcctag

SEQ ID NO: 7321876 - DNA, 22 bp, Homo sapiens
caatgtcaaggagaccaaaacg

SEQ ID NO: 7321877 - DNA, 22 bp, Homo sapiens
caagttttgcatagttctgtat

SEQ ID NO: 7321878 - DNA, 22 bp, Homo sapiens
cacatacttgtgtgtacatatg

SEQ ID NO: 7321879 - DNA, 20 bp, Homo sapiens
ggcagggagggatactgagg

SEQ ID NO: 7321880 - DNA, 21 bp, Homo sapiens
cactttaatggatatttgttt

SEQ ID NO: 7321881 - DNA, 22 bp, Homo sapiens
cactttgtgtgggatcaggggt

SEQ ID NO: 7321882 - DNA, 22 bp, Homo sapiens
ggctgccccagtgctcatggct

SEQ ID NO: 7321883 - DNA, 20 bp, Homo sapiens
ggctgcccactccagagtac

SEQ ID NO: 7321884 - DNA, 22 bp, Homo sapiens
ggcttaaaaggaaaatgagagt

SEQ ID NO: 7321885 - DNA, 22 bp, Homo sapiens
ggcttaaaactttgaaagtgtt

SEQ ID NO: 7321886 - DNA, 22 bp, Homo sapiens
ggcttaaagaattaacagagat

SEQ ID NO: 7321887 - DNA, 22 bp, Homo sapiens
ggcttaaagttttctagaataa

SEQ ID NO: 7321888 - DNA, 22 bp, Homo sapiens
caggctgcagtgcagtggctat

SEQ ID NO: 7321889 - DNA, 22 bp, Homo sapiens
caggctgccgaggctgcagaat

SEQ ID NO: 7321890 - DNA, 22 bp, Homo sapiens
caggctttactttctctctgaa

SEQ ID NO: 7321891 - DNA, 22 bp, Homo sapiens
tacattgtgatgtttcaataca

SEQ ID NO: 7321892 - DNA, 22 bp, Homo sapiens
caggccttttttcctgcagtgt

SEQ ID NO: 7321893 - DNA, 22 bp, Homo sapiens
caggcctttcttggggcttaga

SEQ ID NO: 7321894 - DNA, 22 bp, Homo sapiens
caggcctttctggggaagtgag

SEQ ID NO: 7321895 - DNA, 22 bp, Homo sapiens
tacatttcctgtcagagatata

SEQ ID NO: 7321896 - DNA, 22 bp, Homo sapiens
caggcatttcgcaaaggctgag

SEQ ID NO: 7321897 - DNA, 22 bp, Homo sapiens
tacaaaaaattgatactgacga

SEQ ID NO: 7321898 - DNA, 21 bp, Homo sapiens
taataattccactacagagta

SEQ ID NO: 7321899 - DNA, 22 bp, Homo sapiens
cagtcaggctgcgcttctctga

SEQ ID NO: 7321900 - DNA, 22 bp, Homo sapiens
cagtcaggctgcgcttctctga

SEQ ID NO: 7321901 - DNA, 22 bp, Homo sapiens
cagtcaggaatgcctccttcct

SEQ ID NO: 7321902 - DNA, 22 bp, Homo sapiens
cagtcagttatccacacaccag

SEQ ID NO: 7321903 - DNA, 19 bp, Homo sapiens
tcaaaacacaaatggttga

SEQ ID NO: 7321904 - DNA, 23 bp, Homo sapiens
tcaagcaataattggtaatagtg

SEQ ID NO: 7321905 - DNA, 22 bp, Homo sapiens
tcaacaaatacttaaagcagag

SEQ ID NO: 7321906 - DNA, 22 bp, Homo sapiens
caggtgcctcaggatgagacaa

SEQ ID NO: 7321907 - DNA, 16 bp, Homo sapiens
caggtgcctctcccga

SEQ ID NO: 7321908 - DNA, 22 bp, Homo sapiens
caggtgccgggaatgcagcaat

SEQ ID NO: 7321909 - DNA, 22 bp, Homo sapiens
caggtgcccagctcctgctgtg

SEQ ID NO: 7321910 - DNA, 22 bp, Homo sapiens
caggtgcccaggggacagtggc

SEQ ID NO: 7321911 - DNA, 22 bp, Homo sapiens
tagcttgactattctatgatgt

SEQ ID NO: 7321912 - DNA, 22 bp, Homo sapiens
taggcagtagcttgagatataa

SEQ ID NO: 7321913 - DNA, 22 bp, Homo sapiens
taggcagtagcaggatctgcca

SEQ ID NO: 7321914 - DNA, 22 bp, Homo sapiens
cagggtccccgggtctcctgtg

SEQ ID NO: 7321915 - DNA, 22 bp, Homo sapiens
catgcatgccgggctgacagag

SEQ ID NO: 7321916 - DNA, 22 bp, Homo sapiens
catgcattcagaatctctcaca

SEQ ID NO: 7321917 - DNA, 22 bp, Homo sapiens
catgaagtcactggagctttca

SEQ ID NO: 7321918 - DNA, 22 bp, Homo sapiens
catctgggttctcagatggata

SEQ ID NO: 7321919 - DNA, 19 bp, Homo sapiens
catctggatgattctcctg

SEQ ID NO: 7321920 - DNA, 22 bp, Homo sapiens
tcaatgaaagagcatgcatttt

SEQ ID NO: 7321921 - DNA, 22 bp, Homo sapiens
cataacatccttgctactttga

SEQ ID NO: 7321922 - DNA, 22 bp, Homo sapiens
cataattaggcagttgatcatt

SEQ ID NO: 7321923 - DNA, 22 bp, Homo sapiens
catagaaactgagacaaggatt

SEQ ID NO: 7321924 - DNA, 22 bp, Homo sapiens
catagaaaagagtaggtaatgt

SEQ ID NO: 7321925 - DNA, 22 bp, Homo sapiens
tcaggcctccaggttaccattt

SEQ ID NO: 7321926 - DNA, 19 bp, Homo sapiens
tccttccccccagcacaga

SEQ ID NO: 7321927 - DNA, 22 bp, Homo sapiens
tcctgggagagtgggactgtat

SEQ ID NO: 7321928 - DNA, 22 bp, Homo sapiens
catgggctacagaagcatgctg

SEQ ID NO: 7321929 - DNA, 22 bp, Homo sapiens
cattctctgatcttcacatacc

SEQ ID NO: 7321930 - DNA, 22 bp, Homo sapiens
cattcttatatttactcattca

SEQ ID NO: 7321931 - DNA, 22 bp, Homo sapiens
cattagcattacttcaaagagt

SEQ ID NO: 7321932 - DNA, 22 bp, Homo sapiens
cattaggtatttaagcacacag

SEQ ID NO: 7321933 - DNA, 22 bp, Homo sapiens
cattgtcacccaaagctcatag

SEQ ID NO: 7321934 - DNA, 22 bp, Homo sapiens
cccttcccttctgggagatcca

SEQ ID NO: 7321935 - DNA, 22 bp, Homo sapiens
tggcttcatggctgtgcaatct

SEQ ID NO: 7321936 - DNA, 22 bp, Homo sapiens
tggcttcattctgtagttaaaa

SEQ ID NO: 7321937 - DNA, 22 bp, Homo sapiens
tggcttcatggcaagtcttagt

SEQ ID NO: 7321938 - DNA, 22 bp, Homo sapiens
tggcttcatctgcagcactgcc

SEQ ID NO: 7321939 - DNA, 22 bp, Homo sapiens
tggcttcagggttgtcttcagc

SEQ ID NO: 7321940 - DNA, 22 bp, Homo sapiens
cctcttctaggtttcagcctgc

SEQ ID NO: 7321941 - DNA, 22 bp, Homo sapiens
tgccttcctaatggtggggttt

SEQ ID NO: 7321942 - DNA, 22 bp, Homo sapiens
ccccaaggtgctcactgtctgg

SEQ ID NO: 7321943 - DNA, 22 bp, Homo sapiens
ccccacaggtgtctgaggcagg

SEQ ID NO: 7321944 - DNA, 23 bp, Homo sapiens
tgctgtggatggcaggtccttgc

SEQ ID NO: 7321945 - DNA, 22 bp, Homo sapiens
tgctgtggttcccagagtggat

SEQ ID NO: 7321946 - DNA, 22 bp, Homo sapiens
ccctcctggaggcggatgccca

SEQ ID NO: 7321947 - DNA, 19 bp, Homo sapiens
ccctcttgcacaaagcaaa

SEQ ID NO: 7321948 - DNA, 22 bp, Homo sapiens
tgacaagctttacagaattgaa

SEQ ID NO: 7321949 - DNA, 18 bp, Homo sapiens
tctggaacaacttcatgt

SEQ ID NO: 7321950 - DNA, 22 bp, Homo sapiens
tctggcctatttctgtcagatc

SEQ ID NO: 7321951 - DNA, 22 bp, Homo sapiens
tctttcttattatgctcaatgt

SEQ ID NO: 7321952 - DNA, 22 bp, Homo sapiens
tctttcttcagccctgtaagat

SEQ ID NO: 7321953 - DNA, 22 bp, Homo sapiens
tcttcccattagtaatgaagtg

SEQ ID NO: 7321954 - DNA, 22 bp, Homo sapiens
ctctttggatagaattacaaag

SEQ ID NO: 7321955 - DNA, 22 bp, Homo sapiens
ctctttagtttgaaatccacat

SEQ ID NO: 7321956 - DNA, 22 bp, Homo sapiens
ctctttagtggtgatgatgcta

SEQ ID NO: 7321957 - DNA, 22 bp, Homo sapiens
ctgaggcagagggcagaccaga

SEQ ID NO: 7321958 - DNA, 18 bp, Homo sapiens
ctgcacttcagcttgggc

SEQ ID NO: 7321959 - DNA, 22 bp, Homo sapiens
ctgcacagtgttggaagctgcc

SEQ ID NO: 7321960 - DNA, 22 bp, Homo sapiens
ctgcacagtggacagtgaagat

SEQ ID NO: 7321961 - DNA, 22 bp, Homo sapiens
ctgcacagctggccagggagag

SEQ ID NO: 7321962 - DNA, 21 bp, Homo sapiens
ctgaggcatgcaggcctgggc

SEQ ID NO: 7321963 - DNA, 22 bp, Homo sapiens
ctgaggcatgttacaggacata

SEQ ID NO: 7321964 - DNA, 22 bp, Homo sapiens
ctctttagtctgtgtggagaag

SEQ ID NO: 7321965 - DNA, 22 bp, Homo sapiens
ctctttagtcacagggcttcat

SEQ ID NO: 7321966 - DNA, 22 bp, Homo sapiens
tttgtacatataaatcttgtat

SEQ ID NO: 7321967 - DNA, 22 bp, Homo sapiens
tttgtacacaggatgttataat

SEQ ID NO: 7321968 - DNA, 22 bp, Homo sapiens
ctcatttatttctcccaaaaca

SEQ ID NO: 7321969 - DNA, 22 bp, Homo sapiens
ctcatttaacagattaaaaagt

SEQ ID NO: 7321970 - DNA, 22 bp, Homo sapiens
ctcatttacctttgcaatcaag

SEQ ID NO: 7321971 - DNA, 22 bp, Homo sapiens
ctcatttactcatctgcaaaac

SEQ ID NO: 7321972 - DNA, 22 bp, Homo sapiens
ctcctggatgcaggctgtctgc

SEQ ID NO: 7321973 - DNA, 17 bp, Homo sapiens
ctcctggcagcctcagg

SEQ ID NO: 7321974 - DNA, 22 bp, Homo sapiens
tttagtagaatgatacagggca

SEQ ID NO: 7321975 - DNA, 22 bp, Homo sapiens
tttagtagaatagtatatcaaa

SEQ ID NO: 7321976 - DNA, 22 bp, Homo sapiens
tttcacagtagaaatcattatg

SEQ ID NO: 7321977 - DNA, 22 bp, Homo sapiens
ccttccccaggtgctcactgtc

SEQ ID NO: 7321978 - DNA, 20 bp, Homo sapiens
ccttccccacccgctgaggt

SEQ ID NO: 7321979 - DNA, 19 bp, Homo sapiens
ccttccccttcagcctctg

SEQ ID NO: 7321980 - DNA, 22 bp, Homo sapiens
ttagaatttctgctcactttga

SEQ ID NO: 7321981 - DNA, 23 bp, Homo sapiens
ttacttttgcaccaacctaatat

SEQ ID NO: 7321982 - DNA, 21 bp, Homo sapiens
ttacttttgcagcaacctaat

SEQ ID NO: 7321983 - DNA, 22 bp, Homo sapiens
ttacttttgcaccaaactaata

SEQ ID NO: 7321984 - DNA, 21 bp, Homo sapiens
ttacttttgcaccaacctaat

SEQ ID NO: 7321985 - DNA, 22 bp, Homo sapiens
cctgtcagatgaagtaattgtg

SEQ ID NO: 7321986 - DNA, 22 bp, Homo sapiens
tggggcttctcctgtaggctca

SEQ ID NO: 7321987 - DNA, 22 bp, Homo sapiens
cctgggagtgtcagacttgctt

SEQ ID NO: 7321988 - DNA, 22 bp, Homo sapiens
tgtgtattaatgtttgtatatg

SEQ ID NO: 7321989 - DNA, 22 bp, Homo sapiens
tgttacaaggaagaatgtaggt

SEQ ID NO: 7321990 - DNA, 22 bp, Homo sapiens
cctgggctgggcgtctcatggg

SEQ ID NO: 7321991 - DNA, 22 bp, Homo sapiens
cctgggctgtacctgtgcgcgg

SEQ ID NO: 7321992 - DNA, 21 bp, Homo sapiens
cctgggctgtggtttggagac

SEQ ID NO: 7321993 - DNA, 22 bp, Homo sapiens
cctgggctgttgcatcatcctt

SEQ ID NO: 7321994 - DNA, 22 bp, Homo sapiens
cctgggcttacgacctctgact

SEQ ID NO: 7321995 - DNA, 22 bp, Homo sapiens
cctgggctgctcatggggatga

SEQ ID NO: 7321996 - DNA, 22 bp, Homo sapiens
cctgggctggagtacagcagtg

SEQ ID NO: 7321997 - DNA, 16 bp, Homo sapiens
cctgggctctgttgga

SEQ ID NO: 7321998 - DNA, 22 bp, Homo sapiens
cctgggctctgtcagaattggg

SEQ ID NO: 7321999 - DNA, 22 bp, Homo sapiens
cctgggctctgaggagggagtc

SEQ ID NO: 7322000 - DNA, 22 bp, Homo sapiens
cctgggctgaagtcaagtgtgg

SEQ ID NO: 7322001 - DNA, 22 bp, Homo sapiens
cctgggctgcatgatggcattt

SEQ ID NO: 7322002 - DNA, 22 bp, Homo sapiens
cctgggctcgcgcacttcaccc

SEQ ID NO: 7322003 - DNA, 22 bp, Homo sapiens
cctgggctctatcctgacccag

SEQ ID NO: 7322004 - DNA, 22 bp, Homo sapiens
ctagcagggtcgacgtctggcg

SEQ ID NO: 7322005 - DNA, 22 bp, Homo sapiens
ctacatttcatccagggagagc

SEQ ID NO: 7322006 - DNA, 22 bp, Homo sapiens
ttctctaaatgtgaaccggctt

SEQ ID NO: 7322007 - DNA, 22 bp, Homo sapiens
ttctctaagagatgcagaagtt

SEQ ID NO: 7322008 - DNA, 22 bp, Homo sapiens
ttctctaaagagttaggccaag

SEQ ID NO: 7322009 - DNA, 22 bp, Homo sapiens
ttctctaaacatattggatctg

SEQ ID NO: 7322010 - DNA, 22 bp, Homo sapiens
ttctctaaaattaagtgaggta

SEQ ID NO: 7322011 - DNA, 22 bp, Homo sapiens
cgtcaggtccccagtgaagttg

SEQ ID NO: 7322012 - DNA, 22 bp, Homo sapiens
cgtcaggtgtgattatttttca

SEQ ID NO: 7322013 - DNA, 22 bp, Homo sapiens
cgtcaggtttgtggcacctggg

SEQ ID NO: 7322014 - DNA, 22 bp, Homo sapiens
ctaaagagaagatgtttgctga

SEQ ID NO: 7322015 - DNA, 22 bp, Homo sapiens
ctaaagagagttcaagactcct

SEQ ID NO: 7322016 - DNA, 20 bp, Homo sapiens
ttcagagtcagcaaatgcag

SEQ ID NO: 7322017 - DNA, 22 bp, Homo sapiens
ttcaggcccaacgcacagcttc

SEQ ID NO: 7322018 - DNA, 22 bp, Homo sapiens
ttcaggcccagcacagcgcgtg

SEQ ID NO: 7322019 - DNA, 22 bp, Homo sapiens
ttcaggcctaatttctagcccc

SEQ ID NO: 7322020 - DNA, 22 bp, Homo sapiens
ttcaggcctctaaagggaaagc

SEQ ID NO: 7322021 - DNA, 22 bp, Homo sapiens
ttcagggcagacagaagagatg

SEQ ID NO: 7322022 - DNA, 22 bp, Homo sapiens
ttcaaattaccacatttgctta

SEQ ID NO: 7322023 - DNA, 22 bp, Homo sapiens
ttcacacacagcttcctattgt

SEQ ID NO: 7322024 - DNA, 22 bp, Homo sapiens
ttaggatttgaaaaggggcaga

SEQ ID NO: 7322025 - DNA, 16 bp, Homo sapiens
cctttctctgccttcc

SEQ ID NO: 7322026 - DNA, 22 bp, Homo sapiens
cctttctacagatgcctcttgc

SEQ ID NO: 7322027 - DNA, 19 bp, Homo sapiens
ctgtgccctatgacttgta

SEQ ID NO: 7322028 - DNA, 22 bp, Homo sapiens
ctgggtctgtgcccagggacct

SEQ ID NO: 7322029 - DNA, 22 bp, Homo sapiens
ctgtggctctcagaggctgctg

SEQ ID NO: 7322030 - DNA, 22 bp, Homo sapiens
ctgtggctctctgcagggtccc

SEQ ID NO: 7322031 - DNA, 22 bp, Homo sapiens
ctgtgtagtcaggtggtcccac

SEQ ID NO: 7322032 - DNA, 22 bp, Homo sapiens
cttatatttgtcaactttacaa

SEQ ID NO: 7322033 - DNA, 22 bp, Homo sapiens
ctggctcagttcttggttttca

SEQ ID NO: 7322034 - DNA, 22 bp, Homo sapiens
ctggctcagtgccttcagaagt

SEQ ID NO: 7322035 - DNA, 22 bp, Homo sapiens
ctggctcatccaggtgttgctc

SEQ ID NO: 7322036 - DNA, 22 bp, Homo sapiens
ctggctcatagagcagctccaa

SEQ ID NO: 7322037 - DNA, 23 bp, Homo sapiens
ctggctcatcctggttgcagtgg

SEQ ID NO: 7322038 - DNA, 23 bp, Homo sapiens
ctggctcatcctggttgcagtgg

SEQ ID NO: 7322039 - DNA, 22 bp, Homo sapiens
ctggctcattttagcatcaggt

SEQ ID NO: 7322040 - DNA, 22 bp, Homo sapiens
ctggctcatgtgatgagggcaa

SEQ ID NO: 7322041 - DNA, 22 bp, Homo sapiens
ctggctcacctccgctccagca

SEQ ID NO: 7322042 - DNA, 22 bp, Homo sapiens
ctggctcagggtggtctgggtc

SEQ ID NO: 7322043 - DNA, 22 bp, Homo sapiens
ctggctcaggaaagttgctgct

SEQ ID NO: 7322044 - DNA, 22 bp, Homo sapiens
ctggctcagacagctgtgcagt

SEQ ID NO: 7322045 - DNA, 22 bp, Homo sapiens
ctggctcactagccctgccctg

SEQ ID NO: 7322046 - DNA, 22 bp, Homo sapiens
ctggggctgcggacgggagccc

SEQ ID NO: 7322047 - DNA, 22 bp, Homo sapiens
ctggggtgtgctcagagcaggg

SEQ ID NO: 7322048 - DNA, 22 bp, Homo sapiens
ctgggtctccggcagcctcggg

SEQ ID NO: 7322049 - DNA, 23 bp, Homo sapiens
ctgggctgcttgagtccctggct

SEQ ID NO: 7322050 - DNA, 22 bp, Homo sapiens
ctgggcatggacagctgcacag

SEQ ID NO: 7322051 - DNA, 22 bp, Homo sapiens
gagcttaaaacatagccagact

SEQ ID NO: 7322052 - DNA, 22 bp, Homo sapiens
gagaagggatatgccactctcg

SEQ ID NO: 7322053 - DNA, 22 bp, Homo sapiens
gagaagggcttgggagtcaaca

SEQ ID NO: 7322054 - DNA, 22 bp, Homo sapiens
gagatgaagaggcccttggagt

SEQ ID NO: 7322055 - DNA, 22 bp, Homo sapiens
gagatgaatcattccatggtca

SEQ ID NO: 7322056 - DNA, 22 bp, Homo sapiens
gagatgaatgtaaacaaaggca

SEQ ID NO: 7322057 - DNA, 22 bp, Homo sapiens
gagaggctcagggacttgctga

SEQ ID NO: 7322058 - DNA, 22 bp, Homo sapiens
gaagagctatgtccagggagca

SEQ ID NO: 7322059 - DNA, 22 bp, Homo sapiens
gaagagctgctcagaacatgat

SEQ ID NO: 7322060 - DNA, 22 bp, Homo sapiens
gaagagctgtcagaaaagctaa

SEQ ID NO: 7322061 - DNA, 22 bp, Homo sapiens
gaagagctgtgattcaggctta

SEQ ID NO: 7322062 - DNA, 22 bp, Homo sapiens
gaagagcttagacagaatcaaa

SEQ ID NO: 7322063 - DNA, 22 bp, Homo sapiens
gaagatgttatggagagctcag

SEQ ID NO: 7322064 - DNA, 22 bp, Homo sapiens
gaagatttttcttaatgctccg

SEQ ID NO: 7322065 - DNA, 22 bp, Homo sapiens
gaagccaggggcctgacaggca

SEQ ID NO: 7322066 - DNA, 22 bp, Homo sapiens
gaagccccatggatatatgtga

SEQ ID NO: 7322067 - DNA, 22 bp, Homo sapiens
gaagccccaaaccctcgccatc

SEQ ID NO: 7322068 - DNA, 22 bp, Homo sapiens
ctttcagttacagttacacaca

SEQ ID NO: 7322069 - DNA, 18 bp, Homo sapiens
ctttcagtaatttcagcc

SEQ ID NO: 7322070 - DNA, 22 bp, Homo sapiens
ctttcatttgataagaatgcca

SEQ ID NO: 7322071 - DNA, 22 bp, Homo sapiens
gacaaggcagaaagcttaaagg

SEQ ID NO: 7322072 - DNA, 22 bp, Homo sapiens
gacaagcaggctcctgaagaaa

SEQ ID NO: 7322073 - DNA, 22 bp, Homo sapiens
gaatacattggaaatcagaata

SEQ ID NO: 7322074 - DNA, 22 bp, Homo sapiens
gaaggaaaacagatctgcctga

SEQ ID NO: 7322075 - DNA, 22 bp, Homo sapiens
gggcagctgcccctctctgggc

SEQ ID NO: 7322076 - DNA, 19 bp, Homo sapiens
gggcaaatcccttctttct

SEQ ID NO: 7322077 - DNA, 21 bp, Homo sapiens
ggcttgtcaccatagctactg

SEQ ID NO: 7322078 - DNA, 22 bp, Homo sapiens
ggcttgtccttgggctgtgcat

SEQ ID NO: 7322079 - DNA, 19 bp, Homo sapiens
ggcttgtctcggcagccgc

SEQ ID NO: 7322080 - DNA, 22 bp, Homo sapiens
gggagaggttacccgagcaact

SEQ ID NO: 7322081 - DNA, 19 bp, Homo sapiens
gggagagccaggctcaccc

SEQ ID NO: 7322082 - DNA, 22 bp, Homo sapiens
gggagagcgcgctagggccgag

SEQ ID NO: 7322083 - DNA, 22 bp, Homo sapiens
gggagagagagctcatgttgaa

SEQ ID NO: 7322084 - DNA, 22 bp, Homo sapiens
ggcttctgctcagcctgcacgc

SEQ ID NO: 7322085 - DNA, 22 bp, Homo sapiens
ggcttctctcttcacatggctt

SEQ ID NO: 7322086 - DNA, 22 bp, Homo sapiens
ggcttctctccagtatgcattc

SEQ ID NO: 7322087 - DNA, 22 bp, Homo sapiens
ggcttctctaaagatcatgcgt

SEQ ID NO: 7322088 - DNA, 22 bp, Homo sapiens
ggcttctcctggaagtacagag

SEQ ID NO: 7322089 - DNA, 22 bp, Homo sapiens
ggcttctcccattcttcagggg

SEQ ID NO: 7322090 - DNA, 22 bp, Homo sapiens
ggcttctccaggtactgagcat

SEQ ID NO: 7322091 - DNA, 22 bp, Homo sapiens
ggcctcatcacagtgcattagt

SEQ ID NO: 7322092 - DNA, 22 bp, Homo sapiens
ggccaggtggctgtcctggcgt

SEQ ID NO: 7322093 - DNA, 22 bp, Homo sapiens
ggcaggtggaagttggcagagc

SEQ ID NO: 7322094 - DNA, 22 bp, Homo sapiens
ggcagtcatttaatccctgcat

SEQ ID NO: 7322095 - DNA, 22 bp, Homo sapiens
ggcagtcagtgtggttcataaa

SEQ ID NO: 7322096 - DNA, 22 bp, Homo sapiens
ggcagtcagtttggagatggat

SEQ ID NO: 7322097 - DNA, 22 bp, Homo sapiens
ggcagtcatcccacttggaacc

SEQ ID NO: 7322098 - DNA, 22 bp, Homo sapiens
ggagtaggccccgggagagagt

SEQ ID NO: 7322099 - DNA, 19 bp, Homo sapiens
ggcaagcacaaaagctttg

SEQ ID NO: 7322100 - DNA, 22 bp, Homo sapiens
ggcaaattgctgcaattactta

SEQ ID NO: 7322101 - DNA, 22 bp, Homo sapiens
ggcaaatttgtcttaagacacc

SEQ ID NO: 7322102 - DNA, 22 bp, Homo sapiens
gtccctctgctctagagagcca

SEQ ID NO: 7322103 - DNA, 20 bp, Homo sapiens
gtacattttcaggaggggat

SEQ ID NO: 7322104 - DNA, 22 bp, Homo sapiens
gtacattttgaggttaaaacaa

SEQ ID NO: 7322105 - DNA, 22 bp, Homo sapiens
gtacatttctcttgttcttatt

SEQ ID NO: 7322106 - DNA, 22 bp, Homo sapiens
gtacattttactttgtttgaat

SEQ ID NO: 7322107 - DNA, 22 bp, Homo sapiens
gtacatttctcccaacactaaa

SEQ ID NO: 7322108 - DNA, 22 bp, Homo sapiens
gtacatttaggattcattgaaa

SEQ ID NO: 7322109 - DNA, 22 bp, Homo sapiens
gtacatttcatttaaatgatgt

SEQ ID NO: 7322110 - DNA, 22 bp, Homo sapiens
gtacatttatttttgcagcata

SEQ ID NO: 7322111 - DNA, 22 bp, Homo sapiens
gtacatttcagtttccttaaga

SEQ ID NO: 7322112 - DNA, 22 bp, Homo sapiens
gtagacaagcacaggactcaga

SEQ ID NO: 7322113 - DNA, 22 bp, Homo sapiens
gtgagactcgcctttgtgtagc

SEQ ID NO: 7322114 - DNA, 22 bp, Homo sapiens
gggcttcttgagctgccggccc

SEQ ID NO: 7322115 - DNA, 22 bp, Homo sapiens
gggcatgtaggaatccatggag

SEQ ID NO: 7322116 - DNA, 22 bp, Homo sapiens
ggtttattaatgtgaactgtat

SEQ ID NO: 7322117 - DNA, 22 bp, Homo sapiens
ggtttattgaaggccaccccac

SEQ ID NO: 7322118 - DNA, 22 bp, Homo sapiens
ggtttattgttaataagtttga

SEQ ID NO: 7322119 - DNA, 22 bp, Homo sapiens
ggtccttcagtaggttccagac

SEQ ID NO: 7322120 - DNA, 22 bp, Homo sapiens
gcagggaagatcttggagctgc

SEQ ID NO: 7322121 - DNA, 22 bp, Homo sapiens
gcagggaaggggcatgctggag

SEQ ID NO: 7322122 - DNA, 22 bp, Homo sapiens
gccccaagggagcccagcacac

SEQ ID NO: 7322123 - DNA, 22 bp, Homo sapiens
gccccaagtccctatgtttcca

SEQ ID NO: 7322124 - DNA, 22 bp, Homo sapiens
gccctggagctagactaggaca

SEQ ID NO: 7322125 - DNA, 22 bp, Homo sapiens
gcctcctccttcccgagggtct

SEQ ID NO: 7322126 - DNA, 22 bp, Homo sapiens
gcatgcatgtgtgcagacagtc

SEQ ID NO: 7322127 - DNA, 22 bp, Homo sapiens
gcaggggagtccactctatgca

SEQ ID NO: 7322128 - DNA, 17 bp, Homo sapiens
gctccctgaggacagct

SEQ ID NO: 7322129 - DNA, 22 bp, Homo sapiens
gctgccctacccgaggcactct

SEQ ID NO: 7322130 - DNA, 22 bp, Homo sapiens
ggacaaaatccaaacttcttag

SEQ ID NO: 7322131 - DNA, 22 bp, Homo sapiens
ggaagattcagttatctcatga

SEQ ID NO: 7322132 - DNA, 19 bp, Homo sapiens
gctgggcttgggtttgtag

SEQ ID NO: 7322133 - DNA, 22 bp, Homo sapiens
gctgggcttctcaatgctgcct

SEQ ID NO: 7322134 - DNA, 22 bp, Homo sapiens
gctgggcttggtttccctgctt

SEQ ID NO: 7322135 - DNA, 22 bp, Homo sapiens
gctgggctggaaggccaaggca

SEQ ID NO: 7322136 - DNA, 22 bp, Homo sapiens
gctgggctggccgccgagatcg

SEQ ID NO: 7322137 - DNA, 22 bp, Homo sapiens
gctgggctgtagtttgctgacc

SEQ ID NO: 7322138 - DNA, 23 bp, Homo sapiens
gctgggcttactctttcagtgag

SEQ ID NO: 7322139 - DNA, 22 bp, Homo sapiens
gctgggcttcacagagccttta

SEQ ID NO: 7322140 - DNA, 22 bp, Homo sapiens
gctgggcttcacctccagagtt

SEQ ID NO: 7322141 - DNA, 22 bp, Homo sapiens
tcccaaggtgctcggcaacagg

SEQ ID NO: 7322142 - DNA, 22 bp, Homo sapiens
tccccactcaccactggccaaa

SEQ ID NO: 7322143 - DNA, 22 bp, Homo sapiens
tcagagccctgctcctccccaa

SEQ ID NO: 7322144 - DNA, 22 bp, Homo sapiens
tcagcaagtggaccatcctggg

SEQ ID NO: 7322145 - DNA, 22 bp, Homo sapiens
tcactttagaggaaacattgag

SEQ ID NO: 7322146 - DNA, 22 bp, Homo sapiens
tatttctgtcagccagatatgg

SEQ ID NO: 7322147 - DNA, 20 bp, Homo sapiens
tatttctgggcaaccattta

SEQ ID NO: 7322148 - DNA, 22 bp, Homo sapiens
tatttctgggagttcagaaatt

SEQ ID NO: 7322149 - DNA, 22 bp, Homo sapiens
tcaatttcaacagctgataaga

SEQ ID NO: 7322150 - DNA, 22 bp, Homo sapiens
tcacaaaggatgatgaattctg

SEQ ID NO: 7322151 - DNA, 22 bp, Homo sapiens
tcagtctttcgaattcagccag

SEQ ID NO: 7322152 - DNA, 22 bp, Homo sapiens
tcagtgaaatgcatattcttcg

SEQ ID NO: 7322153 - DNA, 22 bp, Homo sapiens
tcaggttctggtgagggccctt

SEQ ID NO: 7322154 - DNA, 22 bp, Homo sapiens
tcatgcttattgcatatttgga

SEQ ID NO: 7322155 - DNA, 23 bp, Homo sapiens
tcatggaactgggcaatcttgaa

SEQ ID NO: 7322156 - DNA, 18 bp, Homo sapiens
tcattagggattgcaaag

SEQ ID NO: 7322157 - DNA, 22 bp, Homo sapiens
tcattattctctttaatgttct

SEQ ID NO: 7322158 - DNA, 21 bp, Homo sapiens
tcatatttctcttgctattgt

SEQ ID NO: 7322159 - DNA, 21 bp, Homo sapiens
tcatatttctcttgctattgt

SEQ ID NO: 7322160 - DNA, 22 bp, Homo sapiens
tcatatttaggcctttaattca

SEQ ID NO: 7322161 - DNA, 22 bp, Homo sapiens
tcagctctaagttttatgcaaa

SEQ ID NO: 7322162 - DNA, 22 bp, Homo sapiens
tcaggcctgcaaatgaatggta

SEQ ID NO: 7322163 - DNA, 22 bp, Homo sapiens
tcaggcctgcaggcttcctgga

SEQ ID NO: 7322164 - DNA, 22 bp, Homo sapiens
tcaggccttcagacctggcccg

SEQ ID NO: 7322165 - DNA, 22 bp, Homo sapiens
tcaggcctggagaaaggaatga

SEQ ID NO: 7322166 - DNA, 18 bp, Homo sapiens
tcaggctgggcctccttc

SEQ ID NO: 7322167 - DNA, 22 bp, Homo sapiens
tagaaacatatgtttgagacat

SEQ ID NO: 7322168 - DNA, 22 bp, Homo sapiens
tagaaacattcagttgcagtcc

SEQ ID NO: 7322169 - DNA, 22 bp, Homo sapiens
tagaaacaagtttctctttggg

SEQ ID NO: 7322170 - DNA, 22 bp, Homo sapiens
tagaaacaatgacatgcttgta

SEQ ID NO: 7322171 - DNA, 22 bp, Homo sapiens
tagacactagggatttagtact

SEQ ID NO: 7322172 - DNA, 22 bp, Homo sapiens
tagaaagtactaaatttaactg

SEQ ID NO: 7322173 - DNA, 22 bp, Homo sapiens
tagaaaggagcattttagacta

SEQ ID NO: 7322174 - DNA, 22 bp, Homo sapiens
tagcagaggaaaagagaacatt

SEQ ID NO: 7322175 - DNA, 22 bp, Homo sapiens
tagcagagcagggatcagagcc

SEQ ID NO: 7322176 - DNA, 22 bp, Homo sapiens
taggcactagacatggttacca

SEQ ID NO: 7322177 - DNA, 22 bp, Homo sapiens
taggcactggatgaccgaagag

SEQ ID NO: 7322178 - DNA, 22 bp, Homo sapiens
taggcactgagtacatattggt

SEQ ID NO: 7322179 - DNA, 22 bp, Homo sapiens
taggcactgggctaggacaggt

SEQ ID NO: 7322180 - DNA, 22 bp, Homo sapiens
taggcactgaggggagcaaggt

SEQ ID NO: 7322181 - DNA, 22 bp, Homo sapiens
taggcactgaccttctcagatt

SEQ ID NO: 7322182 - DNA, 22 bp, Homo sapiens
taggcacttaataaatggtata

SEQ ID NO: 7322183 - DNA, 22 bp, Homo sapiens
taggcacttggcgtgttggaga

SEQ ID NO: 7322184 - DNA, 22 bp, Homo sapiens
taggcactgtgtttgtaggagt

SEQ ID NO: 7322185 - DNA, 22 bp, Homo sapiens
taggcactggttgtggatagtt

SEQ ID NO: 7322186 - DNA, 22 bp, Homo sapiens
taggcactggggaggcagcatg

SEQ ID NO: 7322187 - DNA, 22 bp, Homo sapiens
tatgtctttagtatcttttgga

SEQ ID NO: 7322188 - DNA, 22 bp, Homo sapiens
tatgtcttgtgtttgctaatct

SEQ ID NO: 7322189 - DNA, 22 bp, Homo sapiens
tatgtcttcgtcacctatctca

SEQ ID NO: 7322190 - DNA, 22 bp, Homo sapiens
tatgtcttaatccttccttagg

SEQ ID NO: 7322191 - DNA, 22 bp, Homo sapiens
tattacagaatcaggcataact

SEQ ID NO: 7322192 - DNA, 22 bp, Homo sapiens
tattacagggctagttatgagt

SEQ ID NO: 7322193 - DNA, 22 bp, Homo sapiens
tattagaaaggctattgcatag

SEQ ID NO: 7322194 - DNA, 22 bp, Homo sapiens
tattagcagttgtatgtgtctg

SEQ ID NO: 7322195 - DNA, 22 bp, Homo sapiens
tattcttactctcgactgcatt

SEQ ID NO: 7322196 - DNA, 22 bp, Homo sapiens
tattctctccccaatcttgctt

SEQ ID NO: 7322197 - DNA, 22 bp, Homo sapiens
tatacagaaagaattcaagtct

SEQ ID NO: 7322198 - DNA, 22 bp, Homo sapiens
tataatttatcatgtcacagtt

SEQ ID NO: 7322199 - DNA, 22 bp, Homo sapiens
taggtgcctcggagaaaggacc

SEQ ID NO: 7322200 - DNA, 22 bp, Homo sapiens
taggtgcctgcacgacccaaac

SEQ ID NO: 7322201 - DNA, 22 bp, Homo sapiens
tatatcatggagattaacattc

SEQ ID NO: 7322202 - DNA, 22 bp, Homo sapiens
tatccaaagtggcatattatag

SEQ ID NO: 7322203 - DNA, 22 bp, Homo sapiens
tatgacagtttcgtaggggttg

SEQ ID NO: 7322204 - DNA, 19 bp, Homo sapiens
tatgacagctggagggctc

SEQ ID NO: 7322205 - DNA, 22 bp, Homo sapiens
tatgacattgctttttagaact

SEQ ID NO: 7322206 - DNA, 22 bp, Homo sapiens
tacaacagtaatcaaggttttt

SEQ ID NO: 7322207 - DNA, 22 bp, Homo sapiens
tacaacagacctagatgaatga

SEQ ID NO: 7322208 - DNA, 22 bp, Homo sapiens
tacaacaggaatttcaactttg

SEQ ID NO: 7322209 - DNA, 22 bp, Homo sapiens
tacagcaatgcctgaaatagta

SEQ ID NO: 7322210 - DNA, 22 bp, Homo sapiens
tacagagtatttttaatatggt

SEQ ID NO: 7322211 - DNA, 22 bp, Homo sapiens
tacatcattttggagatgagca

SEQ ID NO: 7322212 - DNA, 22 bp, Homo sapiens
tacagtagctgaggttctcagg

SEQ ID NO: 7322213 - DNA, 22 bp, Homo sapiens
taaggcaggctttcatccagag

SEQ ID NO: 7322214 - DNA, 22 bp, Homo sapiens
taagggttcagaatgcagtggt

SEQ ID NO: 7322215 - DNA, 22 bp, Homo sapiens
tacaaagatagtgttagagtaa

SEQ ID NO: 7322216 - DNA, 22 bp, Homo sapiens
taattacagaggtttgccagtt

SEQ ID NO: 7322217 - DNA, 22 bp, Homo sapiens
taattacaaagcaagcacaggg

SEQ ID NO: 7322218 - DNA, 22 bp, Homo sapiens
taattatagccgctattttgct

SEQ ID NO: 7322219 - DNA, 18 bp, Homo sapiens
gttttgaattgtcttaca

SEQ ID NO: 7322220 - DNA, 22 bp, Homo sapiens
taaaatggtaactttcatttgc

SEQ ID NO: 7322221 - DNA, 19 bp, Homo sapiens
taaaatgtctgtggtcagt

SEQ ID NO: 7322222 - DNA, 22 bp, Homo sapiens
taaaattgcggtgaatatttcc

SEQ ID NO: 7322223 - DNA, 22 bp, Homo sapiens
taaaatgtgtttctgtatggtt

SEQ ID NO: 7322224 - DNA, 22 bp, Homo sapiens
taaacaattcctctctaggcat

SEQ ID NO: 7322225 - DNA, 22 bp, Homo sapiens
taaattatgttccatgtccttt

SEQ ID NO: 7322226 - DNA, 18 bp, Homo sapiens
gtttcatgcatgtgaaac

SEQ ID NO: 7322227 - DNA, 22 bp, Homo sapiens
gtttcatggagagctgaatatt

SEQ ID NO: 7322228 - DNA, 22 bp, Homo sapiens
gttgaggtgatgccagccctgc

SEQ ID NO: 7322229 - DNA, 22 bp, Homo sapiens
gttcagtcacgtgcccaagttc

SEQ ID NO: 7322230 - DNA, 21 bp, Homo sapiens
gttcaagtgatcctcctgtct

SEQ ID NO: 7322231 - DNA, 22 bp, Homo sapiens
gttaagaagctagagatgaaca

SEQ ID NO: 7322232 - DNA, 22 bp, Homo sapiens
gttaagaacttgttgaaggtct

SEQ ID NO: 7322233 - DNA, 22 bp, Homo sapiens
gtgctcaggttcccatgagtgc

SEQ ID NO: 7322234 - DNA, 22 bp, Homo sapiens
ttcctcagctgtgtcctggcga

SEQ ID NO: 7322235 - DNA, 22 bp, Homo sapiens
ttcaatttagtgatgttgttgg

SEQ ID NO: 7322236 - DNA, 22 bp, Homo sapiens
ttcaatttcataatatctagct

SEQ ID NO: 7322237 - DNA, 22 bp, Homo sapiens
ttcacagtaagtaggatagttg

SEQ ID NO: 7322238 - DNA, 22 bp, Homo sapiens
ttcacagtcacccttctccatg

SEQ ID NO: 7322239 - DNA, 22 bp, Homo sapiens
ttcacagtataggtttccagcg

SEQ ID NO: 7322240 - DNA, 22 bp, Homo sapiens
ttcacagtgctcacagttcagt

SEQ ID NO: 7322241 - DNA, 22 bp, Homo sapiens
ttcacagtctatcttggttttt

SEQ ID NO: 7322242 - DNA, 22 bp, Homo sapiens
ttcacagtgagctatgtcttgt

SEQ ID NO: 7322243 - DNA, 22 bp, Homo sapiens
ttcaaaggtgactttgggccag

SEQ ID NO: 7322244 - DNA, 22 bp, Homo sapiens
ttcaaagtaaaaatgtgttcac

SEQ ID NO: 7322245 - DNA, 22 bp, Homo sapiens
ttcaggtagacgcagcagaaca

SEQ ID NO: 7322246 - DNA, 22 bp, Homo sapiens
ttcaggtagtttaactgttcca

SEQ ID NO: 7322247 - DNA, 22 bp, Homo sapiens
ttcagtatgtagaacaagtgtt

SEQ ID NO: 7322248 - DNA, 22 bp, Homo sapiens
ttcacagtggctaagttctgca

SEQ ID NO: 7322249 - DNA, 22 bp, Homo sapiens
ttctttatgttaatgaatctat

SEQ ID NO: 7322250 - DNA, 22 bp, Homo sapiens
ttctttcaatagctggcatatg

SEQ ID NO: 7322251 - DNA, 22 bp, Homo sapiens
ttgaagcccttcttgatagtca

SEQ ID NO: 7322252 - DNA, 22 bp, Homo sapiens
ttgcaaagagtcatgtaagtca

SEQ ID NO: 7322253 - DNA, 20 bp, Homo sapiens
ttgaggcatgtctagaagta

SEQ ID NO: 7322254 - DNA, 22 bp, Homo sapiens
ttcttctttcctataattaatt

SEQ ID NO: 7322255 - DNA, 22 bp, Homo sapiens
ttcttctttcctataattaatt

SEQ ID NO: 7322256 - DNA, 22 bp, Homo sapiens
ttcttctttccaattacatggt

SEQ ID NO: 7322257 - DNA, 22 bp, Homo sapiens
ttcttctttccccctgtggtac

SEQ ID NO: 7322258 - DNA, 22 bp, Homo sapiens
ttcttctttatctcagtatcct

SEQ ID NO: 7322259 - DNA, 22 bp, Homo sapiens
ttcttcttgtctgccctcacat

SEQ ID NO: 7322260 - DNA, 20 bp, Homo sapiens
ttctgcttgcaaatatcaag

SEQ ID NO: 7322261 - DNA, 22 bp, Homo sapiens
ttctgcttttagctaaactata

SEQ ID NO: 7322262 - DNA, 22 bp, Homo sapiens
ttctcttttagaggctccatga

SEQ ID NO: 7322263 - DNA, 22 bp, Homo sapiens
ttctagttttcagtccaccagg

SEQ ID NO: 7322264 - DNA, 22 bp, Homo sapiens
ttctagttaatgtagcatcttg

SEQ ID NO: 7322265 - DNA, 22 bp, Homo sapiens
ttacagtagattttgaatgtgg

SEQ ID NO: 7322266 - DNA, 22 bp, Homo sapiens
ttacagtacctgtatggccact

SEQ ID NO: 7322267 - DNA, 22 bp, Homo sapiens
ttacagtaatcgagtgttgtgg

SEQ ID NO: 7322268 - DNA, 22 bp, Homo sapiens
ttacaggttgtgtattcagtga

SEQ ID NO: 7322269 - DNA, 22 bp, Homo sapiens
ttacagtaacattttcagtctg

SEQ ID NO: 7322270 - DNA, 22 bp, Homo sapiens
ttacagggaaccaatccagtgt

SEQ ID NO: 7322271 - DNA, 22 bp, Homo sapiens
ttacagtgaagattcaggttcc

SEQ ID NO: 7322272 - DNA, 22 bp, Homo sapiens
ttacagtattggtcacgtttgt

SEQ ID NO: 7322273 - DNA, 22 bp, Homo sapiens
ttacagtatgatcaacttttca

SEQ ID NO: 7322274 - DNA, 22 bp, Homo sapiens
ttacatagttaaatagtacagc

SEQ ID NO: 7322275 - DNA, 22 bp, Homo sapiens
ttacacattaacaggcagctaa

SEQ ID NO: 7322276 - DNA, 22 bp, Homo sapiens
ttaattttctcatctgtgaaat

SEQ ID NO: 7322277 - DNA, 21 bp, Homo sapiens
ttaatttattcatgatagcta

SEQ ID NO: 7322278 - DNA, 22 bp, Homo sapiens
ttacttcttacaaaagaaatat

SEQ ID NO: 7322279 - DNA, 19 bp, Homo sapiens
ttactagtctcagttatgg

SEQ ID NO: 7322280 - DNA, 22 bp, Homo sapiens
ttacattttggggtaaggataa

SEQ ID NO: 7322281 - DNA, 22 bp, Homo sapiens
ttagaaagaactttagatatca

SEQ ID NO: 7322282 - DNA, 22 bp, Homo sapiens
ttaaatgagatgttcagatatt

SEQ ID NO: 7322283 - DNA, 22 bp, Homo sapiens
ttaatttatacataatcacagg

SEQ ID NO: 7322284 - DNA, 20 bp, Homo sapiens
ttaagaaaagcacatcctgc

SEQ ID NO: 7322285 - DNA, 22 bp, Homo sapiens
ttaacattgtccttagcagatt

SEQ ID NO: 7322286 - DNA, 22 bp, Homo sapiens
tgttctcactggatgcttcaca

SEQ ID NO: 7322287 - DNA, 21 bp, Homo sapiens
tgttcctgttctctaggatcc

SEQ ID NO: 7322288 - DNA, 22 bp, Homo sapiens
tgtttacatgcataagcttaag

SEQ ID NO: 7322289 - DNA, 22 bp, Homo sapiens
tgtttacatatttggtctcaga

SEQ ID NO: 7322290 - DNA, 22 bp, Homo sapiens
tgttcctgaatgcctggctggc

SEQ ID NO: 7322291 - DNA, 22 bp, Homo sapiens
tgttcctgacggccaaagaggt

SEQ ID NO: 7322292 - DNA, 22 bp, Homo sapiens
tgttcctggaaagccaggtggg

SEQ ID NO: 7322293 - DNA, 22 bp, Homo sapiens
tgttcctggttcctgcatgatg

SEQ ID NO: 7322294 - DNA, 22 bp, Homo sapiens
tgttcctgtactgctgtggctt

SEQ ID NO: 7322295 - DNA, 22 bp, Homo sapiens
tgttatttatctgagcatttat

SEQ ID NO: 7322296 - DNA, 22 bp, Homo sapiens
tgtgttctggaaagctcactga

SEQ ID NO: 7322297 - DNA, 22 bp, Homo sapiens
tgtgtttctgagaatcccacct

SEQ ID NO: 7322298 - DNA, 22 bp, Homo sapiens
tgtggcctgattttgcatctct

SEQ ID NO: 7322299 - DNA, 22 bp, Homo sapiens
tgtggacattttttgtcagtag

SEQ ID NO: 7322300 - DNA, 22 bp, Homo sapiens
tgtggacagagccctggtttgg

SEQ ID NO: 7322301 - DNA, 22 bp, Homo sapiens
tgtggcagaactgggactcaaa

SEQ ID NO: 7322302 - DNA, 22 bp, Homo sapiens
tgtggcagagtaaggacccagt

SEQ ID NO: 7322303 - DNA, 22 bp, Homo sapiens
tttgtagagaatgttaagcact

SEQ ID NO: 7322304 - DNA, 22 bp, Homo sapiens
tttgcacacacaataacaaatg

SEQ ID NO: 7322305 - DNA, 22 bp, Homo sapiens
tttgcactagcatttgtccatg

SEQ ID NO: 7322306 - DNA, 22 bp, Homo sapiens
tttgcacttaaatttacaacac

SEQ ID NO: 7322307 - DNA, 22 bp, Homo sapiens
tttgatttactggatattctca

SEQ ID NO: 7322308 - DNA, 22 bp, Homo sapiens
tttgcagtgattcttgcagtga

SEQ ID NO: 7322309 - DNA, 22 bp, Homo sapiens
tttgcagtcaaatttgctaaat

SEQ ID NO: 7322310 - DNA, 22 bp, Homo sapiens
ttttgatatcatgatgaacaga

SEQ ID NO: 7322311 - DNA, 22 bp, Homo sapiens
ttttgcaaagtacattatcagg

SEQ ID NO: 7322312 - DNA, 22 bp, Homo sapiens
tttccaaaggtggcaggaacaa

SEQ ID NO: 7322313 - DNA, 22 bp, Homo sapiens
tttccaaagttgccataagctt

SEQ ID NO: 7322314 - DNA, 22 bp, Homo sapiens
tttccaaaatgaatctaatgca

SEQ ID NO: 7322315 - DNA, 22 bp, Homo sapiens
tttcattgtcatctatcttaga

SEQ ID NO: 7322316 - DNA, 22 bp, Homo sapiens
tttcagtggaccacagtttgat

SEQ ID NO: 7322317 - DNA, 22 bp, Homo sapiens
tttcagagttggggaaaagcag

SEQ ID NO: 7322318 - DNA, 22 bp, Homo sapiens
tttcagagttgtcttcttgacc

SEQ ID NO: 7322319 - DNA, 22 bp, Homo sapiens
tttcagaggaaatctcattgag

SEQ ID NO: 7322320 - DNA, 20 bp, Homo sapiens
tttcagagtgtctttccatt

SEQ ID NO: 7322321 - DNA, 22 bp, Homo sapiens
tttcagagtcagctcctctcta

SEQ ID NO: 7322322 - DNA, 22 bp, Homo sapiens
tttcagaggtatgctgcttatc

SEQ ID NO: 7322323 - DNA, 22 bp, Homo sapiens
tttcagaggtgcttggaatgct

SEQ ID NO: 7322324 - DNA, 22 bp, Homo sapiens
tttctattgtaagtctcctata

SEQ ID NO: 7322325 - DNA, 22 bp, Homo sapiens
tttctcatggacccttcatgat

SEQ ID NO: 7322326 - DNA, 22 bp, Homo sapiens
tttctcatagtcatgcctctta

SEQ ID NO: 7322327 - DNA, 22 bp, Homo sapiens
tttctcatggaacatagctcct

SEQ ID NO: 7322328 - DNA, 22 bp, Homo sapiens
tttctaatctgattctcctacc

SEQ ID NO: 7322329 - DNA, 21 bp, Homo sapiens
tttctgaaggcaacatctatc

SEQ ID NO: 7322330 - DNA, 22 bp, Homo sapiens
tttctgaacttggtactggagc

SEQ ID NO: 7322331 - DNA, 22 bp, Homo sapiens
tttctgaagatacagctttgct

SEQ ID NO: 7322332 - DNA, 22 bp, Homo sapiens
tttctgaaaactgaagtagtgc

SEQ ID NO: 7322333 - DNA, 22 bp, Homo sapiens
tttctgaaacatggtctttgta

SEQ ID NO: 7322334 - DNA, 22 bp, Homo sapiens
tttctgaacaaagccattatca

SEQ ID NO: 7322335 - DNA, 20 bp, Homo sapiens
tttctgtagctcagtattca

SEQ ID NO: 7322336 - DNA, 22 bp, Homo sapiens
tttctgcatgcatttaattaaa

SEQ ID NO: 7322337 - DNA, 22 bp, Homo sapiens
tttctgaataactctatgatat

SEQ ID NO: 7322338 - DNA, 18 bp, Homo sapiens
tttctgaatgtctatttc

SEQ ID NO: 7322339 - DNA, 22 bp, Homo sapiens
tttctgaagtcttctaacagat

SEQ ID NO: 7322340 - DNA, 23 bp, Homo sapiens
tttctgaagttgagatggacttt

SEQ ID NO: 7322341 - DNA, 22 bp, Homo sapiens
tttctgaaggttaaggaattag

SEQ ID NO: 7322342 - DNA, 22 bp, Homo sapiens
tttctgaagggcagcagactct

SEQ ID NO: 7322343 - DNA, 22 bp, Homo sapiens
tttcttatggggtagtccttta

SEQ ID NO: 7322344 - DNA, 22 bp, Homo sapiens
tttcttctcacccaggacagag

SEQ ID NO: 7322345 - DNA, 22 bp, Homo sapiens
tttcttctcatccctgaaatca

SEQ ID NO: 7322346 - DNA, 22 bp, Homo sapiens
tttcttctatgtgtgatatttt

SEQ ID NO: 7322347 - DNA, 22 bp, Homo sapiens
tttcttctccatggcaggtcct

SEQ ID NO: 7322348 - DNA, 22 bp, Homo sapiens
tttcttctcgacaccttatccc

SEQ ID NO: 7322349 - DNA, 23 bp, Homo sapiens
tttcttctcgaagagggagctta

SEQ ID NO: 7322350 - DNA, 22 bp, Homo sapiens
tttcttctaagatttcaaacta

SEQ ID NO: 7322351 - DNA, 22 bp, Homo sapiens
tttcttctaggactaataagag

SEQ ID NO: 7322352 - DNA, 22 bp, Homo sapiens
tttcttctctaatctcaatgat

SEQ ID NO: 7322353 - DNA, 22 bp, Homo sapiens
tttcttctgagatcagggagaa

SEQ ID NO: 7322354 - DNA, 22 bp, Homo sapiens
tttcttctctgattaaggctca

SEQ ID NO: 7322355 - DNA, 22 bp, Homo sapiens
tttattagattatcaaagaggt

SEQ ID NO: 7322356 - DNA, 22 bp, Homo sapiens
tttattagtgcttgtatcactg

SEQ ID NO: 7322357 - DNA, 22 bp, Homo sapiens
tttacaacctcatattctgatg

SEQ ID NO: 7322358 - DNA, 22 bp, Homo sapiens
tttacaacctcatattctgatg

SEQ ID NO: 7322359 - DNA, 22 bp, Homo sapiens
tttactaagcccagttatatgc

SEQ ID NO: 7322360 - DNA, 22 bp, Homo sapiens
tttaattttcctcttcctggag

SEQ ID NO: 7322361 - DNA, 22 bp, Homo sapiens
ttggtttactaggattcaaatt

SEQ ID NO: 7322362 - DNA, 22 bp, Homo sapiens
ttggtttagagagtgtggttac

SEQ ID NO: 7322363 - DNA, 22 bp, Homo sapiens
ttggttacttttaaacttgtct

SEQ ID NO: 7322364 - DNA, 22 bp, Homo sapiens
ttggttactaaaaactgtttgg

SEQ ID NO: 7322365 - DNA, 22 bp, Homo sapiens
ttggttacttcagtggagaaag

SEQ ID NO: 7322366 - DNA, 22 bp, Homo sapiens
ttggttacttaagttggtgcga

SEQ ID NO: 7322367 - DNA, 23 bp, Homo sapiens
ttggttactggatttgaggggcc

SEQ ID NO: 7322368 - DNA, 22 bp, Homo sapiens
ttggttacacttaatttttcca

SEQ ID NO: 7322369 - DNA, 22 bp, Homo sapiens
ttggttaccttcagaaatgagt

SEQ ID NO: 7322370 - DNA, 22 bp, Homo sapiens
ttgtctaatgagctccacttca

SEQ ID NO: 7322371 - DNA, 22 bp, Homo sapiens
ttggttacagactcttctctaa

SEQ ID NO: 7322372 - DNA, 22 bp, Homo sapiens
ttggttacaagtttgctctgcc

SEQ ID NO: 7322373 - DNA, 22 bp, Homo sapiens
ttggttacacagactggtgctt

SEQ ID NO: 7322374 - DNA, 19 bp, Homo sapiens
ttggttacaactgagcttc

SEQ ID NO: 7322375 - DNA, 22 bp, Homo sapiens
ttgcaactaaaagaacttgaca

SEQ ID NO: 7322376 - DNA, 22 bp, Homo sapiens
ggcttaaagttttctagaataa

SEQ ID NO: 7322377 - DNA, 22 bp, Homo sapiens
ggcttaaagaattaacagagat

SEQ ID NO: 7322378 - DNA, 22 bp, Homo sapiens
ggcttaaaactttgaaagtgtt

SEQ ID NO: 7322379 - DNA, 22 bp, Homo sapiens
ggcttaaaaggaaaatgagagt

SEQ ID NO: 7322380 - DNA, 22 bp, Homo sapiens
cagaaatacccagcatttggag

SEQ ID NO: 7322381 - DNA, 22 bp, Homo sapiens
cactttggatgccactggtcta

SEQ ID NO: 7322382 - DNA, 22 bp, Homo sapiens
ggctcaggttgggtcacatgac

SEQ ID NO: 7322383 - DNA, 22 bp, Homo sapiens
ggcaggtgatctagagtcaata

SEQ ID NO: 7322384 - DNA, 23 bp, Homo sapiens
ggccactgaattttctgcatctt

SEQ ID NO: 7322385 - DNA, 22 bp, Homo sapiens
caccttgcattcttttaattta

SEQ ID NO: 7322386 - DNA, 22 bp, Homo sapiens
ggccactgtttcctgggcagtt

SEQ ID NO: 7322387 - DNA, 22 bp, Homo sapiens
ggccactgctctccagcctggg

SEQ ID NO: 7322388 - DNA, 22 bp, Homo sapiens
ggccactgcctccgccatggct

SEQ ID NO: 7322389 - DNA, 22 bp, Homo sapiens
cacagttttgcccagggcttct

SEQ ID NO: 7322390 - DNA, 22 bp, Homo sapiens
ggaggtggaggttgcagtgagc

SEQ ID NO: 7322391 - DNA, 22 bp, Homo sapiens
ggaggtggaggttgcaatgagc

SEQ ID NO: 7322392 - DNA, 22 bp, Homo sapiens
ggaggtggagctggaagttcca

SEQ ID NO: 7322393 - DNA, 22 bp, Homo sapiens
ggaggtgcagagtagggttggt

SEQ ID NO: 7322394 - DNA, 22 bp, Homo sapiens
ggaggtgactggatcatgggca

SEQ ID NO: 7322395 - DNA, 22 bp, Homo sapiens
ggaggtgaggccgtagggtgtg

SEQ ID NO: 7322396 - DNA, 22 bp, Homo sapiens
ggcaggcaggagctctgtctcc

SEQ ID NO: 7322397 - DNA, 20 bp, Homo sapiens
ggcaggcaggaggtttccag

SEQ ID NO: 7322398 - DNA, 22 bp, Homo sapiens
cacatttacatataaaactttc

SEQ ID NO: 7322399 - DNA, 22 bp, Homo sapiens
cacatttagaggttagcatggt

SEQ ID NO: 7322400 - DNA, 22 bp, Homo sapiens
gctttctggttctcaaagcact

SEQ ID NO: 7322401 - DNA, 22 bp, Homo sapiens
caatgtcaaggagaccaaaacg

SEQ ID NO: 7322402 - DNA, 22 bp, Homo sapiens
gctttgcattcttgtgtgatca

SEQ ID NO: 7322403 - DNA, 19 bp, Homo sapiens
gctgttctgaccatcaccc

SEQ ID NO: 7322404 - DNA, 22 bp, Homo sapiens
caagtcaactcaaattgttatc

SEQ ID NO: 7322405 - DNA, 22 bp, Homo sapiens
gctgttcatagaaatggtctca

SEQ ID NO: 7322406 - DNA, 22 bp, Homo sapiens
caagcatactgtgagagtttta

SEQ ID NO: 7322407 - DNA, 22 bp, Homo sapiens
caaatgtgtaaggaagtgttag

SEQ ID NO: 7322408 - DNA, 22 bp, Homo sapiens
gctggctggctgtgcaaaggca

SEQ ID NO: 7322409 - DNA, 22 bp, Homo sapiens
caaggggttcagaaagaggtga

SEQ ID NO: 7322410 - DNA, 22 bp, Homo sapiens
caagggttctgtgcctcctgct

SEQ ID NO: 7322411 - DNA, 22 bp, Homo sapiens
gctggctgtatcacctggccag

SEQ ID NO: 7322412 - DNA, 22 bp, Homo sapiens
cacaggaaggccttctcacaat

SEQ ID NO: 7322413 - DNA, 22 bp, Homo sapiens
cacaggaagtggtcagtgccag

SEQ ID NO: 7322414 - DNA, 22 bp, Homo sapiens
cacagctttgctttccttaata

SEQ ID NO: 7322415 - DNA, 22 bp, Homo sapiens
cacaggaatcagcattaatggc

SEQ ID NO: 7322416 - DNA, 22 bp, Homo sapiens
ggaggcaggaaagacaggttca

SEQ ID NO: 7322417 - DNA, 22 bp, Homo sapiens
ggaggcattatggggaagactt

SEQ ID NO: 7322418 - DNA, 22 bp, Homo sapiens
cacaggcttgtcagcatgaggc

SEQ ID NO: 7322419 - DNA, 22 bp, Homo sapiens
ggagcctgaaaagtctgcattt

SEQ ID NO: 7322420 - DNA, 22 bp, Homo sapiens
ggagcctgacagtgcccagcat

SEQ ID NO: 7322421 - DNA, 22 bp, Homo sapiens
ggagcctgagggccctcttgga

SEQ ID NO: 7322422 - DNA, 22 bp, Homo sapiens
ggagcctgagcggcccagggcc

SEQ ID NO: 7322423 - DNA, 23 bp, Homo sapiens
ggagctgctgttgggggagctgc

SEQ ID NO: 7322424 - DNA, 19 bp, Homo sapiens
ggagcctggagcacgtgcc

SEQ ID NO: 7322425 - DNA, 22 bp, Homo sapiens
ggagcctgcgggagctcccatt

SEQ ID NO: 7322426 - DNA, 22 bp, Homo sapiens
ggagctgcttcttgctgtgggt

SEQ ID NO: 7322427 - DNA, 22 bp, Homo sapiens
ggagccctccatcccttgcggc

SEQ ID NO: 7322428 - DNA, 21 bp, Homo sapiens
ggaagggctctgaggacggct

SEQ ID NO: 7322429 - DNA, 20 bp, Homo sapiens
ggaaggggcaaagtgtgtga

SEQ ID NO: 7322430 - DNA, 21 bp, Homo sapiens
cacacagctgcccttaggtag

SEQ ID NO: 7322431 - DNA, 20 bp, Homo sapiens
cagcaggaaaagtgcctcag

SEQ ID NO: 7322432 - DNA, 22 bp, Homo sapiens
gtcataaagacagaaacattcc

SEQ ID NO: 7322433 - DNA, 22 bp, Homo sapiens
cagcagctgcgtgcccaggccg

SEQ ID NO: 7322434 - DNA, 22 bp, Homo sapiens
cagcagctagaggaagggcaga

SEQ ID NO: 7322435 - DNA, 22 bp, Homo sapiens
gtcattataccattataattgt

SEQ ID NO: 7322436 - DNA, 22 bp, Homo sapiens
gtcattatctacagaagtgtgt

SEQ ID NO: 7322437 - DNA, 22 bp, Homo sapiens
gtcatcttgctgttttagatct

SEQ ID NO: 7322438 - DNA, 22 bp, Homo sapiens
gtcatcttcgcagagtgatttt

SEQ ID NO: 7322439 - DNA, 22 bp, Homo sapiens
gtcatcttctctcagcccaggc

SEQ ID NO: 7322440 - DNA, 22 bp, Homo sapiens
gtcccaggagttgctgggcctt

SEQ ID NO: 7322441 - DNA, 22 bp, Homo sapiens
gtcccaggcaggccactggcag

SEQ ID NO: 7322442 - DNA, 22 bp, Homo sapiens
gtcccaggaacattctggctag

SEQ ID NO: 7322443 - DNA, 22 bp, Homo sapiens
cagcaggctgtggaaatcctgg

SEQ ID NO: 7322444 - DNA, 22 bp, Homo sapiens
cagccccttcctggcatctgga

SEQ ID NO: 7322445 - DNA, 22 bp, Homo sapiens
cagccaggtatgggcgtgcggg

SEQ ID NO: 7322446 - DNA, 22 bp, Homo sapiens
cagccaggggctggcgtgttga

SEQ ID NO: 7322447 - DNA, 22 bp, Homo sapiens
gtctgtgtgcacagcgagtgcc

SEQ ID NO: 7322448 - DNA, 22 bp, Homo sapiens
gtcccaggctccatggcagcca

SEQ ID NO: 7322449 - DNA, 22 bp, Homo sapiens
gtcccaggctccatggcagcca

SEQ ID NO: 7322450 - DNA, 22 bp, Homo sapiens
cagccagggagcaaagagttga

SEQ ID NO: 7322451 - DNA, 22 bp, Homo sapiens
cagcctggagccacagcccagg

SEQ ID NO: 7322452 - DNA, 22 bp, Homo sapiens
gtgcccagtcctgccttgacag

SEQ ID NO: 7322453 - DNA, 22 bp, Homo sapiens
gtgcccagtaaatgaaagcttt

SEQ ID NO: 7322454 - DNA, 22 bp, Homo sapiens
gtgcccaggtgtccctgagaag

SEQ ID NO: 7322455 - DNA, 22 bp, Homo sapiens
cagctacaaatacttttgtatg

SEQ ID NO: 7322456 - DNA, 22 bp, Homo sapiens
cagctacacaccagaactatta

SEQ ID NO: 7322457 - DNA, 22 bp, Homo sapiens
cagctacaggacctgatgcacc

SEQ ID NO: 7322458 - DNA, 22 bp, Homo sapiens
cagctacaggacgggcatctgc

SEQ ID NO: 7322459 - DNA, 22 bp, Homo sapiens
cagctacagtctgattggttca

SEQ ID NO: 7322460 - DNA, 22 bp, Homo sapiens
cagctacacgtgcccctggggt

SEQ ID NO: 7322461 - DNA, 22 bp, Homo sapiens
cagctacagaggccacatggct

SEQ ID NO: 7322462 - DNA, 22 bp, Homo sapiens
cagctacacttctgggtgtgtc

SEQ ID NO: 7322463 - DNA, 22 bp, Homo sapiens
cagctacagttccactgagcat

SEQ ID NO: 7322464 - DNA, 23 bp, Homo sapiens
cagccctggagatgtgggaggca

SEQ ID NO: 7322465 - DNA, 22 bp, Homo sapiens
gtgcccagttgaggccaggact

SEQ ID NO: 7322466 - DNA, 22 bp, Homo sapiens
cagacagggtcctgtccgtcac

SEQ ID NO: 7322467 - DNA, 22 bp, Homo sapiens
cagagacagggcagggagtgtg

SEQ ID NO: 7322468 - DNA, 22 bp, Homo sapiens
cagagacaggagtgctcccagt

SEQ ID NO: 7322469 - DNA, 22 bp, Homo sapiens
cagagacagcctgggagggaca

SEQ ID NO: 7322470 - DNA, 20 bp, Homo sapiens
gggctctgcttggcagaagt

SEQ ID NO: 7322471 - DNA, 22 bp, Homo sapiens
cagcaagatggtgaatgagacg

SEQ ID NO: 7322472 - DNA, 22 bp, Homo sapiens
cagcaaagtaagctgacatgta

SEQ ID NO: 7322473 - DNA, 22 bp, Homo sapiens
cagcaaatactactagttttta

SEQ ID NO: 7322474 - DNA, 17 bp, Homo sapiens
cagagtctgtctgcatc

SEQ ID NO: 7322475 - DNA, 22 bp, Homo sapiens
cagagtcattgacttccaggag

SEQ ID NO: 7322476 - DNA, 22 bp, Homo sapiens
cagagtcatgggccgtcaggca

SEQ ID NO: 7322477 - DNA, 22 bp, Homo sapiens
cagagggaaaaggggagtaata

SEQ ID NO: 7322478 - DNA, 22 bp, Homo sapiens
atgaaattaatcaacacataca

SEQ ID NO: 7322479 - DNA, 22 bp, Homo sapiens
atgaaattaatcaacacataca

SEQ ID NO: 7322480 - DNA, 22 bp, Homo sapiens
ctttctcttgagcaagagctgt

SEQ ID NO: 7322481 - DNA, 22 bp, Homo sapiens
atctggctattgacatgttata

SEQ ID NO: 7322482 - DNA, 22 bp, Homo sapiens
ctttcccttagccccattctat

SEQ ID NO: 7322483 - DNA, 22 bp, Homo sapiens
cttctttaatgtatacaaaaga

SEQ ID NO: 7322484 - DNA, 22 bp, Homo sapiens
cttctttactttctagaaataa

SEQ ID NO: 7322485 - DNA, 22 bp, Homo sapiens
gaaatttattatctacatcatt

SEQ ID NO: 7322486 - DNA, 22 bp, Homo sapiens
gaaagtatttacattaacatct

SEQ ID NO: 7322487 - DNA, 22 bp, Homo sapiens
gaaagtattcacaaagttcttg

SEQ ID NO: 7322488 - DNA, 22 bp, Homo sapiens
gaaacattcatatgagaaacct

SEQ ID NO: 7322489 - DNA, 22 bp, Homo sapiens
gaaacattggtctgccccttat

SEQ ID NO: 7322490 - DNA, 22 bp, Homo sapiens
atgacagtaggtaaatgatagc

SEQ ID NO: 7322491 - DNA, 22 bp, Homo sapiens
atgacatcactacattattcct

SEQ ID NO: 7322492 - DNA, 22 bp, Homo sapiens
gaaggcttatgtgtgactttcg

SEQ ID NO: 7322493 - DNA, 16 bp, Homo sapiens
gaaggcttactgcagg

SEQ ID NO: 7322494 - DNA, 22 bp, Homo sapiens
gaaggcttagaaacaagggagc

SEQ ID NO: 7322495 - DNA, 22 bp, Homo sapiens
gaatacaaacttaaggctttac

SEQ ID NO: 7322496 - DNA, 19 bp, Homo sapiens
gaattttaggacttcagca

SEQ ID NO: 7322497 - DNA, 22 bp, Homo sapiens
gaattttatcttattacttgca

SEQ ID NO: 7322498 - DNA, 22 bp, Homo sapiens
gacaatctggacccagtcttca

SEQ ID NO: 7322499 - DNA, 22 bp, Homo sapiens
gaatcagaatctctaaggtggg

SEQ ID NO: 7322500 - DNA, 22 bp, Homo sapiens
gacacattgatgtgagtacata

SEQ ID NO: 7322501 - DNA, 22 bp, Homo sapiens
gacatttatgaaggagatatgc

SEQ ID NO: 7322502 - DNA, 22 bp, Homo sapiens
gacatttattagaaaactatca

SEQ ID NO: 7322503 - DNA, 22 bp, Homo sapiens
atgctatgtaactggcagatag

SEQ ID NO: 7322504 - DNA, 22 bp, Homo sapiens
atgctattccagaatgtaaatt

SEQ ID NO: 7322505 - DNA, 22 bp, Homo sapiens
atgctcagggcacactctggac

SEQ ID NO: 7322506 - DNA, 22 bp, Homo sapiens
atgctcaggttttgcccaagac

SEQ ID NO: 7322507 - DNA, 22 bp, Homo sapiens
gaccttgtgatctgcccacctt

SEQ ID NO: 7322508 - DNA, 22 bp, Homo sapiens
gactggaaagcctgtcctcaga

SEQ ID NO: 7322509 - DNA, 22 bp, Homo sapiens
atgtccttcggacaaaattctt

SEQ ID NO: 7322510 - DNA, 22 bp, Homo sapiens
gaggtagggcagaggctgaatg

SEQ ID NO: 7322511 - DNA, 20 bp, Homo sapiens
gaggtagggcttaaggcaag

SEQ ID NO: 7322512 - DNA, 22 bp, Homo sapiens
gatacaaaatataaatggagag

SEQ ID NO: 7322513 - DNA, 22 bp, Homo sapiens
gagttcaatttccagctgttct

SEQ ID NO: 7322514 - DNA, 16 bp, Homo sapiens
gagttcaatggcagag

SEQ ID NO: 7322515 - DNA, 22 bp, Homo sapiens
gaggtggccaagcgaggaaggg

SEQ ID NO: 7322516 - DNA, 22 bp, Homo sapiens
gaggtggcactgtgaggagcac

SEQ ID NO: 7322517 - DNA, 22 bp, Homo sapiens
atgggaagctgacctgcatgga

SEQ ID NO: 7322518 - DNA, 22 bp, Homo sapiens
gaggagaagggcacggagaaaa

SEQ ID NO: 7322519 - DNA, 22 bp, Homo sapiens
gaggagaaattatccttggtgt

SEQ ID NO: 7322520 - DNA, 22 bp, Homo sapiens
gaggagaaatttggggacctga

SEQ ID NO: 7322521 - DNA, 22 bp, Homo sapiens
gaggagaagctaagaaacacag

SEQ ID NO: 7322522 - DNA, 22 bp, Homo sapiens
gaggaagggactttattatctg

SEQ ID NO: 7322523 - DNA, 22 bp, Homo sapiens
gaggagaagctattggaaggac

SEQ ID NO: 7322524 - DNA, 22 bp, Homo sapiens
atggttattactgctgttccag

SEQ ID NO: 7322525 - DNA, 22 bp, Homo sapiens
atggccaagaaattgccgactg

SEQ ID NO: 7322526 - DNA, 23 bp, Homo sapiens
gagagcaatgagatgtaaacact

SEQ ID NO: 7322527 - DNA, 22 bp, Homo sapiens
gagacatggcaaaagcactggt

SEQ ID NO: 7322528 - DNA, 22 bp, Homo sapiens
attacatatgttggcaacattt

SEQ ID NO: 7322529 - DNA, 22 bp, Homo sapiens
attaggaaattatatgtcctcc

SEQ ID NO: 7322530 - DNA, 22 bp, Homo sapiens
attaggaagtaagtatcacaag

SEQ ID NO: 7322531 - DNA, 22 bp, Homo sapiens
gcagcagagaccccaggaagga

SEQ ID NO: 7322532 - DNA, 22 bp, Homo sapiens
attcagaatggcaaacttctag

SEQ ID NO: 7322533 - DNA, 22 bp, Homo sapiens
attgtagcaatttctcttaatt

SEQ ID NO: 7322534 - DNA, 22 bp, Homo sapiens
attgtatttgtacaagacatgt

SEQ ID NO: 7322535 - DNA, 22 bp, Homo sapiens
gccaaatcttgcacactcttgt

SEQ ID NO: 7322536 - DNA, 22 bp, Homo sapiens
attgtgaatagtgccgcagtaa

SEQ ID NO: 7322537 - DNA, 22 bp, Homo sapiens
gcagggctgatggcttccctca

SEQ ID NO: 7322538 - DNA, 19 bp, Homo sapiens
attcttggtgcaccttgta

SEQ ID NO: 7322539 - DNA, 22 bp, Homo sapiens
attctttcatataaaggctcag

SEQ ID NO: 7322540 - DNA, 22 bp, Homo sapiens
attctttcaaggaatagttatt

SEQ ID NO: 7322541 - DNA, 22 bp, Homo sapiens
gctgactcagatgcagctggat

SEQ ID NO: 7322542 - DNA, 22 bp, Homo sapiens
caaatgatacctattactaggc

SEQ ID NO: 7322543 - DNA, 22 bp, Homo sapiens
gctctttagacatagtctgaag

SEQ ID NO: 7322544 - DNA, 22 bp, Homo sapiens
attttgtttcctttggagtaga

SEQ ID NO: 7322545 - DNA, 22 bp, Homo sapiens
attttacttcatttgaaatgcc

SEQ ID NO: 7322546 - DNA, 22 bp, Homo sapiens
attttagagaaacaaacgtagg

SEQ ID NO: 7322547 - DNA, 22 bp, Homo sapiens
caaacattcagatgcaatggta

SEQ ID NO: 7322548 - DNA, 20 bp, Homo sapiens
caaagcagtaggataaaaat

SEQ ID NO: 7322549 - DNA, 22 bp, Homo sapiens
caaagcagttttaatcaagtag

SEQ ID NO: 7322550 - DNA, 22 bp, Homo sapiens
caaacaatttgcatttccttag

SEQ ID NO: 7322551 - DNA, 22 bp, Homo sapiens
caaaatgttctggcacctttaa

SEQ ID NO: 7322552 - DNA, 22 bp, Homo sapiens
atttctgttgcttataaattac

SEQ ID NO: 7322553 - DNA, 17 bp, Homo sapiens
gcccccagaaatctcag

SEQ ID NO: 7322554 - DNA, 22 bp, Homo sapiens
atttctgttatacctttctcag

SEQ ID NO: 7322555 - DNA, 22 bp, Homo sapiens
atttctgtggcttcattctcct

SEQ ID NO: 7322556 - DNA, 22 bp, Homo sapiens
gcccacctaacctgctcacctt

SEQ ID NO: 7322557 - DNA, 22 bp, Homo sapiens
gcccacatccactagacatgca

SEQ ID NO: 7322558 - DNA, 22 bp, Homo sapiens
atttcatgtttcatctacctaa

SEQ ID NO: 7322559 - DNA, 22 bp, Homo sapiens
atttcatgttgatctttcgagg

SEQ ID NO: 7322560 - DNA, 22 bp, Homo sapiens
gcccccagacctcagtgggctg

SEQ ID NO: 7322561 - DNA, 22 bp, Homo sapiens
gcccccagacctcagtgggctg

SEQ ID NO: 7322562 - DNA, 22 bp, Homo sapiens
gcccccagagaatgaggtacga

SEQ ID NO: 7322563 - DNA, 18 bp, Homo sapiens
gcccccagatgctactga

SEQ ID NO: 7322564 - DNA, 22 bp, Homo sapiens
gcccccagaagggccacagatt

SEQ ID NO: 7322565 - DNA, 22 bp, Homo sapiens
gcccccaggctctggagaacct

SEQ ID NO: 7322566 - DNA, 22 bp, Homo sapiens
gcccccaggcactacatgtgaa

SEQ ID NO: 7322567 - DNA, 22 bp, Homo sapiens
gcccccagctctcaagctcaaa

SEQ ID NO: 7322568 - DNA, 22 bp, Homo sapiens
gcccccaggtgacttatccaca

SEQ ID NO: 7322569 - DNA, 21 bp, Homo sapiens
ctgcatctcatagaacatgtc

SEQ ID NO: 7322570 - DNA, 22 bp, Homo sapiens
ctgaggagcgttggtcacgtgt

SEQ ID NO: 7322571 - DNA, 22 bp, Homo sapiens
ctgaggagccccctctcagcat

SEQ ID NO: 7322572 - DNA, 22 bp, Homo sapiens
agttattgttcagtacaatgtc

SEQ ID NO: 7322573 - DNA, 22 bp, Homo sapiens
agttattgagtatctataatgt

SEQ ID NO: 7322574 - DNA, 19 bp, Homo sapiens
agttattgatctattcagg

SEQ ID NO: 7322575 - DNA, 22 bp, Homo sapiens
agttatttactcctttgtctct

SEQ ID NO: 7322576 - DNA, 22 bp, Homo sapiens
ctgctgatgtaagccatgctct

SEQ ID NO: 7322577 - DNA, 22 bp, Homo sapiens
atagcaaggtatgactggagcc

SEQ ID NO: 7322578 - DNA, 22 bp, Homo sapiens
ctggctccatctttgcttcctg

SEQ ID NO: 7322579 - DNA, 22 bp, Homo sapiens
ctggctccatccttgagctctg

SEQ ID NO: 7322580 - DNA, 22 bp, Homo sapiens
ctggcccctgtggctaaaatca

SEQ ID NO: 7322581 - DNA, 22 bp, Homo sapiens
atagcaaatattttaatgagca

SEQ ID NO: 7322582 - DNA, 22 bp, Homo sapiens
ctggctcccgaagccctcagtg

SEQ ID NO: 7322583 - DNA, 22 bp, Homo sapiens
ctggctccattactcagcatct

SEQ ID NO: 7322584 - DNA, 22 bp, Homo sapiens
atactcaaggttaatgattgaa

SEQ ID NO: 7322585 - DNA, 22 bp, Homo sapiens
ctggccccatctggagtctgag

SEQ ID NO: 7322586 - DNA, 22 bp, Homo sapiens
ctggccccaggcagcctgctgg

SEQ ID NO: 7322587 - DNA, 22 bp, Homo sapiens
ctggccccggttcctaaaaacc

SEQ ID NO: 7322588 - DNA, 22 bp, Homo sapiens
ctggcccccacacctgtcaggg

SEQ ID NO: 7322589 - DNA, 22 bp, Homo sapiens
ctggccccagagtttcacttgg

SEQ ID NO: 7322590 - DNA, 22 bp, Homo sapiens
atagcaaaaggcaccagagtga

SEQ ID NO: 7322591 - DNA, 22 bp, Homo sapiens
atagcaaagcctggcacaatga

SEQ ID NO: 7322592 - DNA, 22 bp, Homo sapiens
atacataggatatgtacgtgca

SEQ ID NO: 7322593 - DNA, 22 bp, Homo sapiens
atacatagtaccacatttgaca

SEQ ID NO: 7322594 - DNA, 22 bp, Homo sapiens
atacatagttctgtgaaaagta

SEQ ID NO: 7322595 - DNA, 22 bp, Homo sapiens
atacatagctgaaaacttgtag

SEQ ID NO: 7322596 - DNA, 22 bp, Homo sapiens
atacataggagaataacttcag

SEQ ID NO: 7322597 - DNA, 22 bp, Homo sapiens
atacagtagggaccatgtctga

SEQ ID NO: 7322598 - DNA, 22 bp, Homo sapiens
atacagtagggaccatgtctga

SEQ ID NO: 7322599 - DNA, 21 bp, Homo sapiens
atacagtggtatgaatgtagg

SEQ ID NO: 7322600 - DNA, 22 bp, Homo sapiens
atacatagcagagtcaattaat

SEQ ID NO: 7322601 - DNA, 22 bp, Homo sapiens
atacatagcagggtagtagatc

SEQ ID NO: 7322602 - DNA, 22 bp, Homo sapiens
atacatagatagataatctggc

SEQ ID NO: 7322603 - DNA, 19 bp, Homo sapiens
atacagatgtatccatgat

SEQ ID NO: 7322604 - DNA, 22 bp, Homo sapiens
cttcccaagctttagttatttt

SEQ ID NO: 7322605 - DNA, 22 bp, Homo sapiens
cttcccaagactgtattgcaag

SEQ ID NO: 7322606 - DNA, 22 bp, Homo sapiens
atctgagaagattttggcataa

SEQ ID NO: 7322607 - DNA, 22 bp, Homo sapiens
atctgagactgagtttggattt

SEQ ID NO: 7322608 - DNA, 20 bp, Homo sapiens
atcagacttttaggaacata

SEQ ID NO: 7322609 - DNA, 22 bp, Homo sapiens
ctgtggccctgtgatctggcac

SEQ ID NO: 7322610 - DNA, 23 bp, Homo sapiens
ctgtggccctgcttcatgcagcc

SEQ ID NO: 7322611 - DNA, 21 bp, Homo sapiens
ctgtggcctggctagcaccgt

SEQ ID NO: 7322612 - DNA, 22 bp, Homo sapiens
ctgtgtgtcatttgtcaatcct

SEQ ID NO: 7322613 - DNA, 22 bp, Homo sapiens
ctgtgtgtcctcggacgagttt

SEQ ID NO: 7322614 - DNA, 22 bp, Homo sapiens
atcagaatagtgggggacagtc

SEQ ID NO: 7322615 - DNA, 22 bp, Homo sapiens
atcagaaactcttagagcaggg

SEQ ID NO: 7322616 - DNA, 22 bp, Homo sapiens
atcagaaaggtgggcaagcaga

SEQ ID NO: 7322617 - DNA, 22 bp, Homo sapiens
atcaaaatgctccagtgatggt

SEQ ID NO: 7322618 - DNA, 22 bp, Homo sapiens
atatttactgctgtggtgaagg

SEQ ID NO: 7322619 - DNA, 22 bp, Homo sapiens
atatgcatctgtgtgcgtgtct

SEQ ID NO: 7322620 - DNA, 22 bp, Homo sapiens
atatgcatgcatgcttgtgaga

SEQ ID NO: 7322621 - DNA, 22 bp, Homo sapiens
atatgcattcatacttagtgga

SEQ ID NO: 7322622 - DNA, 22 bp, Homo sapiens
atatgtttttggaaagaacaca

SEQ ID NO: 7322623 - DNA, 22 bp, Homo sapiens
atattaaaactatggttttcag

SEQ ID NO: 7322624 - DNA, 18 bp, Homo sapiens
agttagaaatgaaggcca

SEQ ID NO: 7322625 - DNA, 22 bp, Homo sapiens
ctgaggagaggtggcctgtgtt

SEQ ID NO: 7322626 - DNA, 22 bp, Homo sapiens
ctgaggagagatcacgtggtgt

SEQ ID NO: 7322627 - DNA, 22 bp, Homo sapiens
ctgaggagaccatcaactaatt

SEQ ID NO: 7322628 - DNA, 22 bp, Homo sapiens
ctgaggagacagaagccaaata

SEQ ID NO: 7322629 - DNA, 22 bp, Homo sapiens
ctgaatccattcatgcaagata

SEQ ID NO: 7322630 - DNA, 22 bp, Homo sapiens
ctgacacactgagcatttgata

SEQ ID NO: 7322631 - DNA, 22 bp, Homo sapiens
ctctggctttgctcatgcatcc

SEQ ID NO: 7322632 - DNA, 22 bp, Homo sapiens
ctctggcttgttaatgcatatt

SEQ ID NO: 7322633 - DNA, 22 bp, Homo sapiens
ctctgctgagccagagtcccca

SEQ ID NO: 7322634 - DNA, 22 bp, Homo sapiens
ctctgcaggcacccagggtggg

SEQ ID NO: 7322635 - DNA, 22 bp, Homo sapiens
ctcattctttcacagtctgtgg

SEQ ID NO: 7322636 - DNA, 22 bp, Homo sapiens
ctcattcattcccgcagccacc

SEQ ID NO: 7322637 - DNA, 22 bp, Homo sapiens
ctcatgcccagagccactgttg

SEQ ID NO: 7322638 - DNA, 22 bp, Homo sapiens
agtccccaggggatgcccacgc

SEQ ID NO: 7322639 - DNA, 22 bp, Homo sapiens
ctccagctcgcgagctctgctc

SEQ ID NO: 7322640 - DNA, 22 bp, Homo sapiens
ctccaggaaagcctgaggcccg

SEQ ID NO: 7322641 - DNA, 22 bp, Homo sapiens
ctccaggaaagcctgaggcccg

SEQ ID NO: 7322642 - DNA, 22 bp, Homo sapiens
ctccaggaaagcctgaggcccg

SEQ ID NO: 7322643 - DNA, 22 bp, Homo sapiens
ctcctggctttcccagaccagg

SEQ ID NO: 7322644 - DNA, 22 bp, Homo sapiens
ctcctggctttcccagaccagg

SEQ ID NO: 7322645 - DNA, 22 bp, Homo sapiens
ctcctggcttctgaaatcgtgg

SEQ ID NO: 7322646 - DNA, 18 bp, Homo sapiens
ctcctggctgatggtgag

SEQ ID NO: 7322647 - DNA, 22 bp, Homo sapiens
ctcctggctctgccacttacta

SEQ ID NO: 7322648 - DNA, 22 bp, Homo sapiens
ctcctaggtgctcactggggtc

SEQ ID NO: 7322649 - DNA, 22 bp, Homo sapiens
cctggctctggttccctcagct

SEQ ID NO: 7322650 - DNA, 20 bp, Homo sapiens
cctgtctcacgttccgcccc

SEQ ID NO: 7322651 - DNA, 22 bp, Homo sapiens
cctgtctccctggcatggctca

SEQ ID NO: 7322652 - DNA, 20 bp, Homo sapiens
cctgtctcctcttacctggc

SEQ ID NO: 7322653 - DNA, 22 bp, Homo sapiens
aggtggggaggagtgtctcttt

SEQ ID NO: 7322654 - DNA, 22 bp, Homo sapiens
aggtgggcacagatggagaagt

SEQ ID NO: 7322655 - DNA, 21 bp, Homo sapiens
cctgtgccaaagtgtgttagg

SEQ ID NO: 7322656 - DNA, 22 bp, Homo sapiens
aggtgggcaatgaggcctgagt

SEQ ID NO: 7322657 - DNA, 22 bp, Homo sapiens
cctgtgccagccccttctgctg

SEQ ID NO: 7322658 - DNA, 21 bp, Homo sapiens
aggtggggctgcacctctgct

SEQ ID NO: 7322659 - DNA, 21 bp, Homo sapiens
aggtggggctgcacctctgct

SEQ ID NO: 7322660 - DNA, 22 bp, Homo sapiens
aggtggggcccaccaatttgca

SEQ ID NO: 7322661 - DNA, 22 bp, Homo sapiens
aggtggggccaaatgctacagt

SEQ ID NO: 7322662 - DNA, 22 bp, Homo sapiens
aggtggggccaaatgctacagt

SEQ ID NO: 7322663 - DNA, 22 bp, Homo sapiens
aggtggggagtatatgtaattg

SEQ ID NO: 7322664 - DNA, 22 bp, Homo sapiens
aggtaggatagataggaagacc

SEQ ID NO: 7322665 - DNA, 20 bp, Homo sapiens
aggtaggatcggtgtcataa

SEQ ID NO: 7322666 - DNA, 22 bp, Homo sapiens
aggtaggatgggtggagatgat

SEQ ID NO: 7322667 - DNA, 22 bp, Homo sapiens
aggtaggatagataggaagacc

SEQ ID NO: 7322668 - DNA, 22 bp, Homo sapiens
cctgccagcgcttatctctcgg

SEQ ID NO: 7322669 - DNA, 22 bp, Homo sapiens
cctgccagcccgcgttcatgcc

SEQ ID NO: 7322670 - DNA, 22 bp, Homo sapiens
cctgccagctgggtaccttcat

SEQ ID NO: 7322671 - DNA, 22 bp, Homo sapiens
cctgccagctgtgggccagcct

SEQ ID NO: 7322672 - DNA, 22 bp, Homo sapiens
aggtagggttaatggagatata

SEQ ID NO: 7322673 - DNA, 22 bp, Homo sapiens
aggtagggaagaaggcatgaaa

SEQ ID NO: 7322674 - DNA, 19 bp, Homo sapiens
aggtaggcagtggcatgga

SEQ ID NO: 7322675 - DNA, 22 bp, Homo sapiens
aggtaggcctgaaagtgacagc

SEQ ID NO: 7322676 - DNA, 22 bp, Homo sapiens
aggtaggcctgacgctggggtg

SEQ ID NO: 7322677 - DNA, 22 bp, Homo sapiens
cctgccagccagatcactcgcc

SEQ ID NO: 7322678 - DNA, 22 bp, Homo sapiens
cctgccagcccccatagagaca

SEQ ID NO: 7322679 - DNA, 22 bp, Homo sapiens
cctgccagattttactatcgta

SEQ ID NO: 7322680 - DNA, 22 bp, Homo sapiens
cctgccagatcccctgagctga

SEQ ID NO: 7322681 - DNA, 22 bp, Homo sapiens
cctgccagcatggcttatctcc

SEQ ID NO: 7322682 - DNA, 22 bp, Homo sapiens
cctgccagcatcttcagcccct

SEQ ID NO: 7322683 - DNA, 22 bp, Homo sapiens
cctgccagagcagcttgtcctc

SEQ ID NO: 7322684 - DNA, 22 bp, Homo sapiens
cctgccagaggcaaagttttag

SEQ ID NO: 7322685 - DNA, 22 bp, Homo sapiens
aggtagtggtcatgctggggag

SEQ ID NO: 7322686 - DNA, 19 bp, Homo sapiens
cctgttcttggctgaggct

SEQ ID NO: 7322687 - DNA, 22 bp, Homo sapiens
cctgtgttagttatgggtctct

SEQ ID NO: 7322688 - DNA, 22 bp, Homo sapiens
ctaagcaagaatgagtgcaaca

SEQ ID NO: 7322689 - DNA, 22 bp, Homo sapiens
ctacatttttcaccgagcctct

SEQ ID NO: 7322690 - DNA, 22 bp, Homo sapiens
ctacattttaataagctgctta

SEQ ID NO: 7322691 - DNA, 22 bp, Homo sapiens
ctacattttgtgattatgaaat

SEQ ID NO: 7322692 - DNA, 22 bp, Homo sapiens
ctacatttgttctatagctttt

SEQ ID NO: 7322693 - DNA, 22 bp, Homo sapiens
ctacatttcccagctgccttcc

SEQ ID NO: 7322694 - DNA, 22 bp, Homo sapiens
ctacatttgttcaaataagctg

SEQ ID NO: 7322695 - DNA, 22 bp, Homo sapiens
ctacatttggagagtataggaa

SEQ ID NO: 7322696 - DNA, 22 bp, Homo sapiens
ctagtattaagtgtgagtaaaa

SEQ ID NO: 7322697 - DNA, 22 bp, Homo sapiens
ctagtaggatgcatagttattt

SEQ ID NO: 7322698 - DNA, 22 bp, Homo sapiens
ctagggtcaggggcctgcgtcg

SEQ ID NO: 7322699 - DNA, 18 bp, Homo sapiens
agtccatgcatggctata

SEQ ID NO: 7322700 - DNA, 22 bp, Homo sapiens
agtcccaacagcttacaaggaa

SEQ ID NO: 7322701 - DNA, 22 bp, Homo sapiens
cctcttaattgtactccttcag

SEQ ID NO: 7322702 - DNA, 22 bp, Homo sapiens
cctagaatgtacttaatagatg

SEQ ID NO: 7322703 - DNA, 22 bp, Homo sapiens
cctacagttatattcttgattg

SEQ ID NO: 7322704 - DNA, 21 bp, Homo sapiens
agggagctttaggtagaagtt

SEQ ID NO: 7322705 - DNA, 22 bp, Homo sapiens
agggatggtggaggttgcaagt

SEQ ID NO: 7322706 - DNA, 22 bp, Homo sapiens
agggcagactaggatggaagtg

SEQ ID NO: 7322707 - DNA, 22 bp, Homo sapiens
agggcagagaaatgtagttgag

SEQ ID NO: 7322708 - DNA, 21 bp, Homo sapiens
cccctgggagccctgtcagta

SEQ ID NO: 7322709 - DNA, 22 bp, Homo sapiens
agggaaaggtagtgaggtcaca

SEQ ID NO: 7322710 - DNA, 22 bp, Homo sapiens
cccaggaacagcacagaacagc

SEQ ID NO: 7322711 - DNA, 22 bp, Homo sapiens
cccaggaacctaccagctcgag

SEQ ID NO: 7322712 - DNA, 22 bp, Homo sapiens
cccaggaacagggctcagaccc

SEQ ID NO: 7322713 - DNA, 22 bp, Homo sapiens
cccaggaacctaccagctcgag

SEQ ID NO: 7322714 - DNA, 22 bp, Homo sapiens
cccaggaactccagagctcctc

SEQ ID NO: 7322715 - DNA, 22 bp, Homo sapiens
cccaggaagggatgccaaggaa

SEQ ID NO: 7322716 - DNA, 22 bp, Homo sapiens
cccaggaagttgagactgcagt

SEQ ID NO: 7322717 - DNA, 22 bp, Homo sapiens
cccaggaagaggggtcaggtgt

SEQ ID NO: 7322718 - DNA, 22 bp, Homo sapiens
cccaggaagagtgagtggcatt

SEQ ID NO: 7322719 - DNA, 22 bp, Homo sapiens
cccaggaagggatgccaaggaa

SEQ ID NO: 7322720 - DNA, 22 bp, Homo sapiens
cccaggaatgagcaggcagggg

SEQ ID NO: 7322721 - DNA, 22 bp, Homo sapiens
agggactatttacccatctcac

SEQ ID NO: 7322722 - DNA, 22 bp, Homo sapiens
agggacccatagagagaccagt

SEQ ID NO: 7322723 - DNA, 22 bp, Homo sapiens
aggcaggtcccctggaaggcac

SEQ ID NO: 7322724 - DNA, 19 bp, Homo sapiens
aggcaggtgcagaggtccc

SEQ ID NO: 7322725 - DNA, 21 bp, Homo sapiens
ccagaggttctgggcctccct

SEQ ID NO: 7322726 - DNA, 22 bp, Homo sapiens
ccagccaggctggctgtggagg

SEQ ID NO: 7322727 - DNA, 22 bp, Homo sapiens
ccagccagatgataagctctat

SEQ ID NO: 7322728 - DNA, 18 bp, Homo sapiens
ccaggcacctttaaatat

SEQ ID NO: 7322729 - DNA, 22 bp, Homo sapiens
ccaggcactggctgggttcttt

SEQ ID NO: 7322730 - DNA, 22 bp, Homo sapiens
ccaggaggtctgagtgtggaca

SEQ ID NO: 7322731 - DNA, 18 bp, Homo sapiens
ccaggtggtgacagagat

SEQ ID NO: 7322732 - DNA, 22 bp, Homo sapiens
ccagggcacttaggcccagccc

SEQ ID NO: 7322733 - DNA, 22 bp, Homo sapiens
ccagggcagccaacccagatgc

SEQ ID NO: 7322734 - DNA, 22 bp, Homo sapiens
ccagggcagcagaattggggca

SEQ ID NO: 7322735 - DNA, 22 bp, Homo sapiens
ccagggcagaaaaagagggaat

SEQ ID NO: 7322736 - DNA, 22 bp, Homo sapiens
cccaagtctggcagaattaaac

SEQ ID NO: 7322737 - DNA, 22 bp, Homo sapiens
cccactccctgcacgcctgccg

SEQ ID NO: 7322738 - DNA, 22 bp, Homo sapiens
cccacgtcgaacttgctccaga

SEQ ID NO: 7322739 - DNA, 22 bp, Homo sapiens
aggctgtgcacagggcacctgc

SEQ ID NO: 7322740 - DNA, 22 bp, Homo sapiens
catacaaatgtgtccaggctct

SEQ ID NO: 7322741 - DNA, 22 bp, Homo sapiens
catacagttttccctagatgtg

SEQ ID NO: 7322742 - DNA, 22 bp, Homo sapiens
catcttattttcttctagtgct

SEQ ID NO: 7322743 - DNA, 23 bp, Homo sapiens
aggatgggtggcaatagaaagac

SEQ ID NO: 7322744 - DNA, 22 bp, Homo sapiens
aggatgggcctgggatatgctt

SEQ ID NO: 7322745 - DNA, 22 bp, Homo sapiens
aggatgagagatacatggagca

SEQ ID NO: 7322746 - DNA, 22 bp, Homo sapiens
catcttctgggacttctcagtt

SEQ ID NO: 7322747 - DNA, 23 bp, Homo sapiens
aggatgtcgaatgttagagtgag

SEQ ID NO: 7322748 - DNA, 22 bp, Homo sapiens
catgaggatgggcagctgggga

SEQ ID NO: 7322749 - DNA, 19 bp, Homo sapiens
catgaggcagctgcacccc

SEQ ID NO: 7322750 - DNA, 22 bp, Homo sapiens
aggagccagattctctcacttt

SEQ ID NO: 7322751 - DNA, 22 bp, Homo sapiens
aggagccagcgttcctcaggat

SEQ ID NO: 7322752 - DNA, 22 bp, Homo sapiens
cagtgtgggtttgggaggagta

SEQ ID NO: 7322753 - DNA, 22 bp, Homo sapiens
aggagccatccccatgagaggt

SEQ ID NO: 7322754 - DNA, 22 bp, Homo sapiens
cataacattgagcagcattcct

SEQ ID NO: 7322755 - DNA, 22 bp, Homo sapiens
aggaggcctctatccagagaga

SEQ ID NO: 7322756 - DNA, 22 bp, Homo sapiens
aggaggcaggaagtctatggga

SEQ ID NO: 7322757 - DNA, 22 bp, Homo sapiens
catttcaatgccttcaacatag

SEQ ID NO: 7322758 - DNA, 22 bp, Homo sapiens
catttacctttaattaaaacac

SEQ ID NO: 7322759 - DNA, 22 bp, Homo sapiens
aggcaaggtgctacagacagtg

SEQ ID NO: 7322760 - DNA, 22 bp, Homo sapiens
aggcaagaaactttctgggaga

SEQ ID NO: 7322761 - DNA, 22 bp, Homo sapiens
aggcaagaacagacatgggagt

SEQ ID NO: 7322762 - DNA, 22 bp, Homo sapiens
aggcaggaaccctgtgtgcgcc

SEQ ID NO: 7322763 - DNA, 17 bp, Homo sapiens
aggcaggagattggaga

SEQ ID NO: 7322764 - DNA, 22 bp, Homo sapiens
aggcaggagcaagccctacaag

SEQ ID NO: 7322765 - DNA, 22 bp, Homo sapiens
aggcaggagtgaccctgacagg

SEQ ID NO: 7322766 - DNA, 22 bp, Homo sapiens
aggcaggaggatcatggatgca

SEQ ID NO: 7322767 - DNA, 22 bp, Homo sapiens
catttctgtcacgttcttttat

SEQ ID NO: 7322768 - DNA, 22 bp, Homo sapiens
ccaatgaaaggtcaattctata

SEQ ID NO: 7322769 - DNA, 22 bp, Homo sapiens
catttctgttctcttcctgtac

SEQ ID NO: 7322770 - DNA, 22 bp, Homo sapiens
ccacccagaccagggatctggg

SEQ ID NO: 7322771 - DNA, 22 bp, Homo sapiens
ccacagttgctgaaatcgctta

SEQ ID NO: 7322772 - DNA, 22 bp, Homo sapiens
ccacagttattcatttgtgaca

SEQ ID NO: 7322773 - DNA, 22 bp, Homo sapiens
caggtggttatgaggaaggtga

SEQ ID NO: 7322774 - DNA, 21 bp, Homo sapiens
aggaagtggccagattgggaa

SEQ ID NO: 7322775 - DNA, 22 bp, Homo sapiens
aggaagtgcagggggaagtact

SEQ ID NO: 7322776 - DNA, 18 bp, Homo sapiens
aggaatattcaaggtgct

SEQ ID NO: 7322777 - DNA, 22 bp, Homo sapiens
aggacagacctaggactggagc

SEQ ID NO: 7322778 - DNA, 20 bp, Homo sapiens
cagtattgatccattgtctg

SEQ ID NO: 7322779 - DNA, 22 bp, Homo sapiens
cagtaagtgtctccacttttct

SEQ ID NO: 7322780 - DNA, 22 bp, Homo sapiens
cagtatctgtcagtaatcaggt

SEQ ID NO: 7322781 - DNA, 22 bp, Homo sapiens
aggaagaaaactaattagatgg

SEQ ID NO: 7322782 - DNA, 22 bp, Homo sapiens
aggaagaaacctactagagttt

SEQ ID NO: 7322783 - DNA, 21 bp, Homo sapiens
aggaaaggccagcacgtaggg

SEQ ID NO: 7322784 - DNA, 22 bp, Homo sapiens
aggaagagctggaccagaggac

SEQ ID NO: 7322785 - DNA, 22 bp, Homo sapiens
aggaagagctggaccagaggac

SEQ ID NO: 7322786 - DNA, 22 bp, Homo sapiens
aggaagagcattcacatggtag

SEQ ID NO: 7322787 - DNA, 22 bp, Homo sapiens
aggaagagctggaccagaggac

SEQ ID NO: 7322788 - DNA, 22 bp, Homo sapiens
agctttctgtcacctgtgcttg

SEQ ID NO: 7322789 - DNA, 22 bp, Homo sapiens
agctttgaagtatttggtctcc

SEQ ID NO: 7322790 - DNA, 22 bp, Homo sapiens
agctttcttgattttgcctgta

SEQ ID NO: 7322791 - DNA, 22 bp, Homo sapiens
cagggcagtaacgggaacatct

SEQ ID NO: 7322792 - DNA, 22 bp, Homo sapiens
caggactggctcgcagtgggtg

SEQ ID NO: 7322793 - DNA, 22 bp, Homo sapiens
caggagaaacataattttctgg

SEQ ID NO: 7322794 - DNA, 22 bp, Homo sapiens
caggactgtatccttggagaaa

SEQ ID NO: 7322795 - DNA, 22 bp, Homo sapiens
caggatgggtgtcggccagcac

SEQ ID NO: 7322796 - DNA, 22 bp, Homo sapiens
caggatggcagagaaaagggtg

SEQ ID NO: 7322797 - DNA, 22 bp, Homo sapiens
caggagccagctgtcccaacca

SEQ ID NO: 7322798 - DNA, 22 bp, Homo sapiens
caggagccagaggcggatggag

SEQ ID NO: 7322799 - DNA, 22 bp, Homo sapiens
caggagccagctgtcccaacca

SEQ ID NO: 7322800 - DNA, 22 bp, Homo sapiens
caggagccagctgtcccaacca

SEQ ID NO: 7322801 - DNA, 22 bp, Homo sapiens
caggagcccagagtcctcagct

SEQ ID NO: 7322802 - DNA, 22 bp, Homo sapiens
caggagcccagagtcctcagct

SEQ ID NO: 7322803 - DNA, 22 bp, Homo sapiens
caggagcccagagtcctcagct

SEQ ID NO: 7322804 - DNA, 22 bp, Homo sapiens
caggagcaggcccaaggacaca

SEQ ID NO: 7322805 - DNA, 22 bp, Homo sapiens
caggagccacattccaccttga

SEQ ID NO: 7322806 - DNA, 22 bp, Homo sapiens
caggagccacattccaccttga

SEQ ID NO: 7322807 - DNA, 22 bp, Homo sapiens
caggagccacattccaccttga

SEQ ID NO: 7322808 - DNA, 22 bp, Homo sapiens
caggagccacattccaccttga

SEQ ID NO: 7322809 - DNA, 22 bp, Homo sapiens
caggagccagaggcggatggag

SEQ ID NO: 7322810 - DNA, 22 bp, Homo sapiens
caggagccagaggcggatggag

SEQ ID NO: 7322811 - DNA, 22 bp, Homo sapiens
agcttagaagtgtgctgagagg

SEQ ID NO: 7322812 - DNA, 22 bp, Homo sapiens
agctgtctttcattacctcatt

SEQ ID NO: 7322813 - DNA, 22 bp, Homo sapiens
agctgtctttctgcctcctgat

SEQ ID NO: 7322814 - DNA, 22 bp, Homo sapiens
agctgtctggaagttcctcatg

SEQ ID NO: 7322815 - DNA, 21 bp, Homo sapiens
caggctctgctagaggagcct

SEQ ID NO: 7322816 - DNA, 22 bp, Homo sapiens
caggcaggtcagtgaagaagga

SEQ ID NO: 7322817 - DNA, 22 bp, Homo sapiens
agctgtctctctggtgtccata

SEQ ID NO: 7322818 - DNA, 22 bp, Homo sapiens
agctgtctctggtattatgtga

SEQ ID NO: 7322819 - DNA, 22 bp, Homo sapiens
agctgtctacctgcagagtcct

SEQ ID NO: 7322820 - DNA, 22 bp, Homo sapiens
agctgtctccagatacaggatt

SEQ ID NO: 7322821 - DNA, 22 bp, Homo sapiens
agctggtttaggatggtctcca

SEQ ID NO: 7322822 - DNA, 22 bp, Homo sapiens
agctggtttatttctcacaaca

SEQ ID NO: 7322823 - DNA, 22 bp, Homo sapiens
agctggttcccactgggcctgt

SEQ ID NO: 7322824 - DNA, 22 bp, Homo sapiens
agctggtttggggtagaggaca

SEQ ID NO: 7322825 - DNA, 22 bp, Homo sapiens
caggcagtgtcccaggaagcca

SEQ ID NO: 7322826 - DNA, 22 bp, Homo sapiens
agctggttcatggactgcctgg

SEQ ID NO: 7322827 - DNA, 22 bp, Homo sapiens
caggcagtggctcacagcaacc

SEQ ID NO: 7322828 - DNA, 22 bp, Homo sapiens
acaggatgataaaggatggcca

SEQ ID NO: 7322829 - DNA, 22 bp, Homo sapiens
acaggattagcaagtaatcagg

SEQ ID NO: 7322830 - DNA, 22 bp, Homo sapiens
agcttcttggctcagcacttgg

SEQ ID NO: 7322831 - DNA, 19 bp, Homo sapiens
aggaaaggtggccttagca

SEQ ID NO: 7322832 - DNA, 22 bp, Homo sapiens
acagggcaggtggctactggtc

SEQ ID NO: 7322833 - DNA, 22 bp, Homo sapiens
acagggcacctgaggtaggaag

SEQ ID NO: 7322834 - DNA, 19 bp, Homo sapiens
acagggcagcaataggata

SEQ ID NO: 7322835 - DNA, 22 bp, Homo sapiens
aggactggccctgaggggaggc

SEQ ID NO: 7322836 - DNA, 22 bp, Homo sapiens
aggactggcagtgtgaggggtc

SEQ ID NO: 7322837 - DNA, 22 bp, Homo sapiens
aggactggcggtcggtggggat

SEQ ID NO: 7322838 - DNA, 22 bp, Homo sapiens
aggactgggtgcagagggcatc

SEQ ID NO: 7322839 - DNA, 22 bp, Homo sapiens
acagtgttcacttaacaatgga

SEQ ID NO: 7322840 - DNA, 22 bp, Homo sapiens
aggcacagcacacctggccccc

SEQ ID NO: 7322841 - DNA, 20 bp, Homo sapiens
acagtggaaattgatgtctg

SEQ ID NO: 7322842 - DNA, 22 bp, Homo sapiens
acagtggaaatgtgggagggga

SEQ ID NO: 7322843 - DNA, 22 bp, Homo sapiens
acagtgaatccaaattcctacc

SEQ ID NO: 7322844 - DNA, 22 bp, Homo sapiens
acagtgagatccaagggcaggc

SEQ ID NO: 7322845 - DNA, 22 bp, Homo sapiens
aggaggcagtctgtcccttagc

SEQ ID NO: 7322846 - DNA, 22 bp, Homo sapiens
acagtgagcccactccaggaga

SEQ ID NO: 7322847 - DNA, 22 bp, Homo sapiens
acagtgcagggtgggaagaagg

SEQ ID NO: 7322848 - DNA, 22 bp, Homo sapiens
acagtgcagggcgggaagaagg

SEQ ID NO: 7322849 - DNA, 22 bp, Homo sapiens
acagtggaaagaacatggattt

SEQ ID NO: 7322850 - DNA, 20 bp, Homo sapiens
aggaggccaaagtaatgggg

SEQ ID NO: 7322851 - DNA, 20 bp, Homo sapiens
aggaggcatagtctggaaag

SEQ ID NO: 7322852 - DNA, 20 bp, Homo sapiens
aggaggcatgaggggattta

SEQ ID NO: 7322853 - DNA, 22 bp, Homo sapiens
aggcaggtgggagtgattcctt

SEQ ID NO: 7322854 - DNA, 22 bp, Homo sapiens
aggcaggtgttgggagacacca

SEQ ID NO: 7322855 - DNA, 18 bp, Homo sapiens
aggcaggtgctggaagtc

SEQ ID NO: 7322856 - DNA, 22 bp, Homo sapiens
aggcagagaaaaaccagatatg

SEQ ID NO: 7322857 - DNA, 22 bp, Homo sapiens
aggcagacaagtccagaactgg

SEQ ID NO: 7322858 - DNA, 22 bp, Homo sapiens
aggcagaatgttggaaaggaag

SEQ ID NO: 7322859 - DNA, 22 bp, Homo sapiens
acatatatgtaaagtactttgt

SEQ ID NO: 7322860 - DNA, 22 bp, Homo sapiens
acatatatgtgcacatgtgcag

SEQ ID NO: 7322861 - DNA, 22 bp, Homo sapiens
aggcagtgtgtagctggaagag

SEQ ID NO: 7322862 - DNA, 22 bp, Homo sapiens
aggcagtgtggagggctgttgc

SEQ ID NO: 7322863 - DNA, 22 bp, Homo sapiens
aggcagtgtgggccaagcttcc

SEQ ID NO: 7322864 - DNA, 20 bp, Homo sapiens
aggcagtgtagagatgagta

SEQ ID NO: 7322865 - DNA, 22 bp, Homo sapiens
aggcagtgtattgctagcggct

SEQ ID NO: 7322866 - DNA, 22 bp, Homo sapiens
acatctttatactagtccttga

SEQ ID NO: 7322867 - DNA, 22 bp, Homo sapiens
acatctttatactagtccttga

SEQ ID NO: 7322868 - DNA, 22 bp, Homo sapiens
aggcagtggtgtttgctggtgg

SEQ ID NO: 7322869 - DNA, 22 bp, Homo sapiens
acatgtctacacattctgcaat

SEQ ID NO: 7322870 - DNA, 22 bp, Homo sapiens
acatgtcttttaaagtctaata

SEQ ID NO: 7322871 - DNA, 22 bp, Homo sapiens
accagacactgtgaagacaggc

SEQ ID NO: 7322872 - DNA, 22 bp, Homo sapiens
accactgtctacacattgactc

SEQ ID NO: 7322873 - DNA, 22 bp, Homo sapiens
aggctgtgattccaccactctc

SEQ ID NO: 7322874 - DNA, 22 bp, Homo sapiens
accagacactgtgaagacaggc

SEQ ID NO: 7322875 - DNA, 22 bp, Homo sapiens
agggaggatagtagtcagttta

SEQ ID NO: 7322876 - DNA, 20 bp, Homo sapiens
accagagctctcagtatgtg

SEQ ID NO: 7322877 - DNA, 19 bp, Homo sapiens
agggaggtagcattggaaa

SEQ ID NO: 7322878 - DNA, 22 bp, Homo sapiens
agggaggtggttccccagtgga

SEQ ID NO: 7322879 - DNA, 22 bp, Homo sapiens
acctcccagaaagttttgcagg

SEQ ID NO: 7322880 - DNA, 22 bp, Homo sapiens
acctcccagaaagttttgcagg

SEQ ID NO: 7322881 - DNA, 22 bp, Homo sapiens
acctcatctgagaagagcatac

SEQ ID NO: 7322882 - DNA, 22 bp, Homo sapiens
acctcagaggaggctcctggct

SEQ ID NO: 7322883 - DNA, 22 bp, Homo sapiens
aggtggagacccagagaaggcg

SEQ ID NO: 7322884 - DNA, 22 bp, Homo sapiens
aggtggagacccagagaaggcg

SEQ ID NO: 7322885 - DNA, 22 bp, Homo sapiens
aggtggaaatggctttcctagg

SEQ ID NO: 7322886 - DNA, 22 bp, Homo sapiens
aggtggtattgacaaggtggag

SEQ ID NO: 7322887 - DNA, 19 bp, Homo sapiens
aggtgaggggcaccatgtc

SEQ ID NO: 7322888 - DNA, 22 bp, Homo sapiens
agtaacatgagtttttctaatg

SEQ ID NO: 7322889 - DNA, 22 bp, Homo sapiens
agtaagtacctccacttgattg

SEQ ID NO: 7322890 - DNA, 22 bp, Homo sapiens
agtcaggttgcattttaagtaa

SEQ ID NO: 7322891 - DNA, 22 bp, Homo sapiens
agtccttagaacactgtatctg

SEQ ID NO: 7322892 - DNA, 22 bp, Homo sapiens
actctgggtcctgccattcact

SEQ ID NO: 7322893 - DNA, 22 bp, Homo sapiens
agtgagccataagggctgccac

SEQ ID NO: 7322894 - DNA, 22 bp, Homo sapiens
agtgcaaagggctgttgagaag

SEQ ID NO: 7322895 - DNA, 22 bp, Homo sapiens
agtgcaaagggctgttgagaag

SEQ ID NO: 7322896 - DNA, 22 bp, Homo sapiens
agtgcaaagaaatcagctttgt

SEQ ID NO: 7322897 - DNA, 22 bp, Homo sapiens
agtgggagccagcagcttgggg

SEQ ID NO: 7322898 - DNA, 22 bp, Homo sapiens
agtgggaggaagtggtgatatt

SEQ ID NO: 7322899 - DNA, 22 bp, Homo sapiens
agtgggagcggcagtcggggac

SEQ ID NO: 7322900 - DNA, 22 bp, Homo sapiens
agtgggaggcggctgacgggcg

SEQ ID NO: 7322901 - DNA, 22 bp, Homo sapiens
agtgctttagcatccaactgtc

SEQ ID NO: 7322902 - DNA, 22 bp, Homo sapiens
agtgtcttacatgaattgattt

SEQ ID NO: 7322903 - DNA, 22 bp, Homo sapiens
agtgtgggtgagggaggccctc

SEQ ID NO: 7322904 - DNA, 22 bp, Homo sapiens
agtgggggccaacgagggcagc

SEQ ID NO: 7322905 - DNA, 22 bp, Homo sapiens
agttacaactgtttgaatgtca

SEQ ID NO: 7322906 - DNA, 22 bp, Homo sapiens
agttcaaaaaggtaaagtttat

SEQ ID NO: 7322907 - DNA, 22 bp, Homo sapiens
agttcaacctaatacagcagaa

SEQ ID NO: 7322908 - DNA, 22 bp, Homo sapiens
agaaatgttcttcatttgccat

SEQ ID NO: 7322909 - DNA, 22 bp, Homo sapiens
agaaatgtggatcgttttaaaa

SEQ ID NO: 7322910 - DNA, 22 bp, Homo sapiens
agaaatgtattctgtatgtttt

SEQ ID NO: 7322911 - DNA, 22 bp, Homo sapiens
agaaatgtcaggaaagaagtcc

SEQ ID NO: 7322912 - DNA, 22 bp, Homo sapiens
atcctgaaaattgaatggaagg

SEQ ID NO: 7322913 - DNA, 22 bp, Homo sapiens
agaagcagggcagggaaaagca

SEQ ID NO: 7322914 - DNA, 22 bp, Homo sapiens
agaagccatagtctgggaggca

SEQ ID NO: 7322915 - DNA, 22 bp, Homo sapiens
agaagccatagtatctcagggt

SEQ ID NO: 7322916 - DNA, 22 bp, Homo sapiens
agaagccatatttagggaggag

SEQ ID NO: 7322917 - DNA, 22 bp, Homo sapiens
agaagccatggtatgcaactac

SEQ ID NO: 7322918 - DNA, 22 bp, Homo sapiens
agaagccatggggtcaccagag

SEQ ID NO: 7322919 - DNA, 22 bp, Homo sapiens
agaagccattgaagcagacctc

SEQ ID NO: 7322920 - DNA, 22 bp, Homo sapiens
agaagccattctcagttcctga

SEQ ID NO: 7322921 - DNA, 22 bp, Homo sapiens
agaagccattccctgtaggctc

SEQ ID NO: 7322922 - DNA, 22 bp, Homo sapiens
agaagccatgtttagtaggatg

SEQ ID NO: 7322923 - DNA, 22 bp, Homo sapiens
atcaagcagtgaaaaatgctag

SEQ ID NO: 7322924 - DNA, 22 bp, Homo sapiens
agaaactgcagctcagagaagt

SEQ ID NO: 7322925 - DNA, 22 bp, Homo sapiens
atattaaatggattttgggagc

SEQ ID NO: 7322926 - DNA, 22 bp, Homo sapiens
agaaaacttgtcacagctctca

SEQ ID NO: 7322927 - DNA, 22 bp, Homo sapiens
agaaaactgggaggagagcttc

SEQ ID NO: 7322928 - DNA, 22 bp, Homo sapiens
agaaaaggcttgaagaggtttt

SEQ ID NO: 7322929 - DNA, 22 bp, Homo sapiens
agaaaagggcaggagggataca

SEQ ID NO: 7322930 - DNA, 22 bp, Homo sapiens
agaaaaggcttgaagaggtttt

SEQ ID NO: 7322931 - DNA, 22 bp, Homo sapiens
agaaaaggattgatggatcaga

SEQ ID NO: 7322932 - DNA, 22 bp, Homo sapiens
atagctaccatgttggacagta

SEQ ID NO: 7322933 - DNA, 22 bp, Homo sapiens
atagatgtcattgtcatccatc

SEQ ID NO: 7322934 - DNA, 22 bp, Homo sapiens
atagaacagaaacagatgcaca

SEQ ID NO: 7322935 - DNA, 21 bp, Homo sapiens
atagaacaccaggcatatata

SEQ ID NO: 7322936 - DNA, 22 bp, Homo sapiens
ataaggacacccttctctttac

SEQ ID NO: 7322937 - DNA, 22 bp, Homo sapiens
atacacagctacattgaacaat

SEQ ID NO: 7322938 - DNA, 22 bp, Homo sapiens
atacacagccattatgaattag

SEQ ID NO: 7322939 - DNA, 22 bp, Homo sapiens
atacacatttgctagagatggg

SEQ ID NO: 7322940 - DNA, 22 bp, Homo sapiens
agcagacatggcttggatgtgg

SEQ ID NO: 7322941 - DNA, 22 bp, Homo sapiens
caaggaaaagaagtatttcaga

SEQ ID NO: 7322942 - DNA, 22 bp, Homo sapiens
caaggaaacatgaaatgcattg

SEQ ID NO: 7322943 - DNA, 22 bp, Homo sapiens
caaggaaaacagatgatcaaca

SEQ ID NO: 7322944 - DNA, 22 bp, Homo sapiens
caaggaaaaagcgagctcgggg

SEQ ID NO: 7322945 - DNA, 22 bp, Homo sapiens
caagtctgtctgctcctgtgtg

SEQ ID NO: 7322946 - DNA, 22 bp, Homo sapiens
caagtctagcttggtcacttgg

SEQ ID NO: 7322947 - DNA, 20 bp, Homo sapiens
caaggggagtagtatgggcc

SEQ ID NO: 7322948 - DNA, 22 bp, Homo sapiens
caagtccaagatcaagaagcca

SEQ ID NO: 7322949 - DNA, 22 bp, Homo sapiens
caagtccatcctactgccttct

SEQ ID NO: 7322950 - DNA, 22 bp, Homo sapiens
caattttactcttcctcttcca

SEQ ID NO: 7322951 - DNA, 18 bp, Homo sapiens
caattttacccagtccct

SEQ ID NO: 7322952 - DNA, 22 bp, Homo sapiens
caattttattggtccaaataca

SEQ ID NO: 7322953 - DNA, 22 bp, Homo sapiens
cacactgttgaggacgagatgt

SEQ ID NO: 7322954 - DNA, 22 bp, Homo sapiens
cacagctgccatgcagtcagtg

SEQ ID NO: 7322955 - DNA, 22 bp, Homo sapiens
cacagctgccatgcagtcagtg

SEQ ID NO: 7322956 - DNA, 22 bp, Homo sapiens
cacagctgcacagaggaggtgc

SEQ ID NO: 7322957 - DNA, 22 bp, Homo sapiens
cacagctgccatggctgcactt

SEQ ID NO: 7322958 - DNA, 22 bp, Homo sapiens
cacagctgcttgttagaatagc

SEQ ID NO: 7322959 - DNA, 20 bp, Homo sapiens
cacaggaaagctactcagtt

SEQ ID NO: 7322960 - DNA, 22 bp, Homo sapiens
cacagctggggaagctgaggcc

SEQ ID NO: 7322961 - DNA, 22 bp, Homo sapiens
agcaggcctcatgcaccagcta

SEQ ID NO: 7322962 - DNA, 22 bp, Homo sapiens
cacaggctccggccttgcagcc

SEQ ID NO: 7322963 - DNA, 22 bp, Homo sapiens
cacatgtagtaagcaggcaatg

SEQ ID NO: 7322964 - DNA, 22 bp, Homo sapiens
cactacttgaaagaattacaga

SEQ ID NO: 7322965 - DNA, 22 bp, Homo sapiens
agcaggtggccacgaggaggag

SEQ ID NO: 7322966 - DNA, 22 bp, Homo sapiens
cacatttaaaggttgaagctga

SEQ ID NO: 7322967 - DNA, 22 bp, Homo sapiens
cacatttaagtgcttgttcaga

SEQ ID NO: 7322968 - DNA, 22 bp, Homo sapiens
cacgttaacagctaacagatga

SEQ ID NO: 7322969 - DNA, 22 bp, Homo sapiens
cagcccacctggcacgtgtgtt

SEQ ID NO: 7322970 - DNA, 22 bp, Homo sapiens
cagcccacttcccagcacctac

SEQ ID NO: 7322971 - DNA, 22 bp, Homo sapiens
cagcccactgcctctgtggtag

SEQ ID NO: 7322972 - DNA, 22 bp, Homo sapiens
cagcccattcctgccatgccgc

SEQ ID NO: 7322973 - DNA, 22 bp, Homo sapiens
cagcccattcctgccatgccgc

SEQ ID NO: 7322974 - DNA, 22 bp, Homo sapiens
cagcatcaccgccatttctgat

SEQ ID NO: 7322975 - DNA, 22 bp, Homo sapiens
cagaggagttcagtacacagcc

SEQ ID NO: 7322976 - DNA, 22 bp, Homo sapiens
cagaggagtgggccgttatggt

SEQ ID NO: 7322977 - DNA, 22 bp, Homo sapiens
cagaggaggcggtatacactgc

SEQ ID NO: 7322978 - DNA, 20 bp, Homo sapiens
cagaggagtacatatgttca

SEQ ID NO: 7322979 - DNA, 22 bp, Homo sapiens
cagaggaggcggtatacactgc

SEQ ID NO: 7322980 - DNA, 17 bp, Homo sapiens
cagaggagctttggggg

SEQ ID NO: 7322981 - DNA, 22 bp, Homo sapiens
cagaggaggccaccgcataggc

SEQ ID NO: 7322982 - DNA, 22 bp, Homo sapiens
cagaggaggccaccgcataggc

SEQ ID NO: 7322983 - DNA, 18 bp, Homo sapiens
cagaggagagacattcag

SEQ ID NO: 7322984 - DNA, 22 bp, Homo sapiens
cagaggagaattgcgggatcat

SEQ ID NO: 7322985 - DNA, 22 bp, Homo sapiens
agccctctgctgttctagtctc

SEQ ID NO: 7322986 - DNA, 22 bp, Homo sapiens
agcctaggaggttggggctgca

SEQ ID NO: 7322987 - DNA, 22 bp, Homo sapiens
agcctagactaagacttgctct

SEQ ID NO: 7322988 - DNA, 22 bp, Homo sapiens
caaagttttagtaaacatatat

SEQ ID NO: 7322989 - DNA, 22 bp, Homo sapiens
agcaatgaccagtgatcttgta

SEQ ID NO: 7322990 - DNA, 22 bp, Homo sapiens
agcaatgactttgaaatcatga

SEQ ID NO: 7322991 - DNA, 22 bp, Homo sapiens
caaacattgcactttctgctat

SEQ ID NO: 7322992 - DNA, 22 bp, Homo sapiens
agcaatatttcagctagcaggt

SEQ ID NO: 7322993 - DNA, 22 bp, Homo sapiens
agcaatagataaaacatttacc

SEQ ID NO: 7322994 - DNA, 22 bp, Homo sapiens
agcaatatgacattgctacatc

SEQ ID NO: 7322995 - DNA, 22 bp, Homo sapiens
agcaatagacacaagatggata

SEQ ID NO: 7322996 - DNA, 22 bp, Homo sapiens
caaacattgggggcttcaacac

SEQ ID NO: 7322997 - DNA, 22 bp, Homo sapiens
caaacatttgacttctctcagg

SEQ ID NO: 7322998 - DNA, 22 bp, Homo sapiens
caaacatttgttggaacccctg

SEQ ID NO: 7322999 - DNA, 22 bp, Homo sapiens
caaacattttctacttccagga

SEQ ID NO: 7323000 - DNA, 22 bp, Homo sapiens
caaagggctctagactcagcag

SEQ ID NO: 7323001 - DNA, 22 bp, Homo sapiens
attttgttgaggtaattgtcaa

SEQ ID NO: 7323002 - DNA, 22 bp, Homo sapiens
attttgttgaggtaattgtcaa

SEQ ID NO: 7323003 - DNA, 21 bp, Homo sapiens
attttgtacatagaatttgtc

SEQ ID NO: 7323004 - DNA, 22 bp, Homo sapiens
attttgttatagaactctgtga

SEQ ID NO: 7323005 - DNA, 22 bp, Homo sapiens
attttttagccaagactctgca

SEQ ID NO: 7323006 - DNA, 22 bp, Homo sapiens
attttgttgatggtggagtagc

SEQ ID NO: 7323007 - DNA, 22 bp, Homo sapiens
agcaagtgtaagaatgcagaat

SEQ ID NO: 7323008 - DNA, 22 bp, Homo sapiens
agatttcaatggatattgcaag

SEQ ID NO: 7323009 - DNA, 21 bp, Homo sapiens
attttctgtgatagctgtctc

SEQ ID NO: 7323010 - DNA, 22 bp, Homo sapiens
attttgctttatgtaaatatgt

SEQ ID NO: 7323011 - DNA, 22 bp, Homo sapiens
agattgtgtcaatttctcttta

SEQ ID NO: 7323012 - DNA, 22 bp, Homo sapiens
agatgtttgtaaacacactgct

SEQ ID NO: 7323013 - DNA, 22 bp, Homo sapiens
atttctcttagcaagacattac

SEQ ID NO: 7323014 - DNA, 21 bp, Homo sapiens
agatgaggatactgaggccta

SEQ ID NO: 7323015 - DNA, 22 bp, Homo sapiens
agatacagaagtttttccctat

SEQ ID NO: 7323016 - DNA, 22 bp, Homo sapiens
attgtattagcacaatacaatt

SEQ ID NO: 7323017 - DNA, 22 bp, Homo sapiens
attgtattcagttacaggtctt

SEQ ID NO: 7323018 - DNA, 22 bp, Homo sapiens
attgagatctgcatcataagct

SEQ ID NO: 7323019 - DNA, 22 bp, Homo sapiens
attgagaatgcaatctactatg

SEQ ID NO: 7323020 - DNA, 23 bp, Homo sapiens
attgagctagtaatatagaccag

SEQ ID NO: 7323021 - DNA, 22 bp, Homo sapiens
attgagaagaaaatctaatata

SEQ ID NO: 7323022 - DNA, 22 bp, Homo sapiens
attgagaaatataatctggaaa

SEQ ID NO: 7323023 - DNA, 22 bp, Homo sapiens
attcaaaagaccatgcagactc

SEQ ID NO: 7323024 - DNA, 22 bp, Homo sapiens
attcttctgcctactttcatcc

SEQ ID NO: 7323025 - DNA, 22 bp, Homo sapiens
agaggaagccattgcttactga

SEQ ID NO: 7323026 - DNA, 17 bp, Homo sapiens
atgtatattaactctga

SEQ ID NO: 7323027 - DNA, 22 bp, Homo sapiens
agagatgggcgggggcttctgc

SEQ ID NO: 7323028 - DNA, 22 bp, Homo sapiens
agagactggagatgggcagtgt

SEQ ID NO: 7323029 - DNA, 22 bp, Homo sapiens
agagactgcaaatcataagaat

SEQ ID NO: 7323030 - DNA, 22 bp, Homo sapiens
agagaacatgacgtaatagtgg

SEQ ID NO: 7323031 - DNA, 22 bp, Homo sapiens
agagaacagcctcctagagaaa

SEQ ID NO: 7323032 - DNA, 22 bp, Homo sapiens
agagctaagaaacagaattgct

SEQ ID NO: 7323033 - DNA, 22 bp, Homo sapiens
attaaggaagcctattctctcc

SEQ ID NO: 7323034 - DNA, 22 bp, Homo sapiens
attaagtgtgacatgctgctct

SEQ ID NO: 7323035 - DNA, 22 bp, Homo sapiens
attaagtgttttacatacatta

SEQ ID NO: 7323036 - DNA, 22 bp, Homo sapiens
agagctctcctagaccgcagag

SEQ ID NO: 7323037 - DNA, 22 bp, Homo sapiens
atgtgcaaagggacttgcacat

SEQ ID NO: 7323038 - DNA, 22 bp, Homo sapiens
agagatgttcattcagcatgtt

SEQ ID NO: 7323039 - DNA, 22 bp, Homo sapiens
atgttattttggaaaatacaaa

SEQ ID NO: 7323040 - DNA, 22 bp, Homo sapiens
atgaggagctccttgaaatgag

SEQ ID NO: 7323041 - DNA, 22 bp, Homo sapiens
atgaggaggccagtaagagcct

SEQ ID NO: 7323042 - DNA, 22 bp, Homo sapiens
atgaggagtcaaggagtcggag

SEQ ID NO: 7323043 - DNA, 22 bp, Homo sapiens
atgaggagccctcatttaggtt

SEQ ID NO: 7323044 - DNA, 21 bp, Homo sapiens
atcttaaaaggtcttaacttt

SEQ ID NO: 7323045 - DNA, 20 bp, Homo sapiens
agacagtggggagctcctag

SEQ ID NO: 7323046 - DNA, 22 bp, Homo sapiens
atgctgaaggccatcctgcatc

SEQ ID NO: 7323047 - DNA, 22 bp, Homo sapiens
atgctgaagagagaactactca

SEQ ID NO: 7323048 - DNA, 22 bp, Homo sapiens
aattttatctctaagcaggctt

SEQ ID NO: 7323049 - DNA, 22 bp, Homo sapiens
acaaaacagtgttcctgcccct

SEQ ID NO: 7323050 - DNA, 22 bp, Homo sapiens
aagaagagaactggcatcctaa

SEQ ID NO: 7323051 - DNA, 22 bp, Homo sapiens
acaaatatttactgaatccact

SEQ ID NO: 7323052 - DNA, 22 bp, Homo sapiens
aagagtttccagttgtggctca

SEQ ID NO: 7323053 - DNA, 22 bp, Homo sapiens
acacagctagtgagtggcagag

SEQ ID NO: 7323054 - DNA, 17 bp, Homo sapiens
acacagccaggttctcc

SEQ ID NO: 7323055 - DNA, 21 bp, Homo sapiens
acacagctgccggagacggat

SEQ ID NO: 7323056 - DNA, 22 bp, Homo sapiens
acacagctatggggtaggaaac

SEQ ID NO: 7323057 - DNA, 22 bp, Homo sapiens
acacagagccagggaatacagt

SEQ ID NO: 7323058 - DNA, 22 bp, Homo sapiens
acaatgtaggctgaaaaagctt

SEQ ID NO: 7323059 - DNA, 22 bp, Homo sapiens
acaaatttcataggcaaatttt

SEQ ID NO: 7323060 - DNA, 22 bp, Homo sapiens
acaaatttattgaagggcatat

SEQ ID NO: 7323061 - DNA, 22 bp, Homo sapiens
aagcagtgatgcatacagctgt

SEQ ID NO: 7323062 - DNA, 22 bp, Homo sapiens
aagccaggttccatggaggagc

SEQ ID NO: 7323063 - DNA, 22 bp, Homo sapiens
acacatataccactgtaaatga

SEQ ID NO: 7323064 - DNA, 22 bp, Homo sapiens
acacttcagctccacaaacatt

SEQ ID NO: 7323065 - DNA, 22 bp, Homo sapiens
acagacattttaagacacttta

SEQ ID NO: 7323066 - DNA, 22 bp, Homo sapiens
acagacattttaattattaaat

SEQ ID NO: 7323067 - DNA, 22 bp, Homo sapiens
acagacattttctgtattgcct

SEQ ID NO: 7323068 - DNA, 22 bp, Homo sapiens
acagacatttaataaatgctga

SEQ ID NO: 7323069 - DNA, 19 bp, Homo sapiens
acagacatttgcaattagc

SEQ ID NO: 7323070 - DNA, 23 bp, Homo sapiens
acagacattccataatgtacacc

SEQ ID NO: 7323071 - DNA, 23 bp, Homo sapiens
acagacattgtacatcttgtttt

SEQ ID NO: 7323072 - DNA, 22 bp, Homo sapiens
aacagttacccttaagatcttt

SEQ ID NO: 7323073 - DNA, 22 bp, Homo sapiens
aacagttatctcacatatggaa

SEQ ID NO: 7323074 - DNA, 17 bp, Homo sapiens
aacagttaatgggggaa

SEQ ID NO: 7323075 - DNA, 22 bp, Homo sapiens
aacagttaacattttgggagct

SEQ ID NO: 7323076 - DNA, 22 bp, Homo sapiens
aacagttaagcagtcctgatat

SEQ ID NO: 7323077 - DNA, 22 bp, Homo sapiens
aacagtggtctggggagtggag

SEQ ID NO: 7323078 - DNA, 22 bp, Homo sapiens
aacagtggggaaaagagttggt

SEQ ID NO: 7323079 - DNA, 22 bp, Homo sapiens
aacagtgtgttttgttattaag

SEQ ID NO: 7323080 - DNA, 22 bp, Homo sapiens
aacagtgtctgtggttaaaggt

SEQ ID NO: 7323081 - DNA, 22 bp, Homo sapiens
aaggagtctgggccattcagag

SEQ ID NO: 7323082 - DNA, 22 bp, Homo sapiens
aaggagaagggtaatcaacaca

SEQ ID NO: 7323083 - DNA, 22 bp, Homo sapiens
aaggagaagtctgttgagattg

SEQ ID NO: 7323084 - DNA, 22 bp, Homo sapiens
aagggaggggatgtaagcctgg

SEQ ID NO: 7323085 - DNA, 22 bp, Homo sapiens
aatatttctgtagctatgttct

SEQ ID NO: 7323086 - DNA, 22 bp, Homo sapiens
aatccagcacatggacacagtc

SEQ ID NO: 7323087 - DNA, 22 bp, Homo sapiens
aatccagatgagcaatcatact

SEQ ID NO: 7323088 - DNA, 22 bp, Homo sapiens
aatacagtaattttgatgagtt

SEQ ID NO: 7323089 - DNA, 22 bp, Homo sapiens
aatatccacttcaatacaggca

SEQ ID NO: 7323090 - DNA, 22 bp, Homo sapiens
aatatccaggtagatgtcttct

SEQ ID NO: 7323091 - DNA, 22 bp, Homo sapiens
aatatccattgggagcaaatgg

SEQ ID NO: 7323092 - DNA, 22 bp, Homo sapiens
aataatgtctgctattttaaaa

SEQ ID NO: 7323093 - DNA, 22 bp, Homo sapiens
aataatgtacatacatatttcg

SEQ ID NO: 7323094 - DNA, 22 bp, Homo sapiens
aagttacagtctgcttgctgac

SEQ ID NO: 7323095 - DNA, 22 bp, Homo sapiens
aagttacaggagaaagagatca

SEQ ID NO: 7323096 - DNA, 22 bp, Homo sapiens
aacagttattatcacattagtg

SEQ ID NO: 7323097 - DNA, 22 bp, Homo sapiens
aatgcttattattaatagaatg

SEQ ID NO: 7323098 - DNA, 22 bp, Homo sapiens
aacttcatttataatgtcatta

SEQ ID NO: 7323099 - DNA, 19 bp, Homo sapiens
aatgcttaggacagtgcct

SEQ ID NO: 7323100 - DNA, 22 bp, Homo sapiens
aatgctgtccaataggaacata

SEQ ID NO: 7323101 - DNA, 22 bp, Homo sapiens
aactttaaggctataaattatg

SEQ ID NO: 7323102 - DNA, 22 bp, Homo sapiens
aatctctttggctcaaggatcc

SEQ ID NO: 7323103 - DNA, 22 bp, Homo sapiens
aatctggctcagaagaagatga

SEQ ID NO: 7323104 - DNA, 22 bp, Homo sapiens
aaaagccaaggtcctcttcaga

SEQ ID NO: 7323105 - DNA, 22 bp, Homo sapiens
aaaacagttataaacagagtca

SEQ ID NO: 7323106 - DNA, 22 bp, Homo sapiens
aaaaatttatggttcttctctg

SEQ ID NO: 7323107 - DNA, 22 bp, Homo sapiens
aaaacacaagaagcagggtaca

SEQ ID NO: 7323108 - DNA, 22 bp, Homo sapiens
aaaaatgttatctactgtccga

SEQ ID NO: 7323109 - DNA, 22 bp, Homo sapiens
aaaaatgtgaccacagggtgtt

SEQ ID NO: 7323110 - DNA, 22 bp, Homo sapiens
aaaacattgaattgcacactat

SEQ ID NO: 7323111 - DNA, 22 bp, Homo sapiens
aaaacattttactgccatctca

SEQ ID NO: 7323112 - DNA, 22 bp, Homo sapiens
aaaagtttaagactcattctag

SEQ ID NO: 7323113 - DNA, 22 bp, Homo sapiens
aaaagttccctggttagaaaag

SEQ ID NO: 7323114 - DNA, 22 bp, Homo sapiens
aaaagttcattagtgagcttct

SEQ ID NO: 7323115 - DNA, 22 bp, Homo sapiens
aaaagtgtccagattatgaaga

SEQ ID NO: 7323116 - DNA, 22 bp, Homo sapiens
aaagcaatggatgagaatctgt

SEQ ID NO: 7323117 - DNA, 22 bp, Homo sapiens
aaagtacagccacatccaagta

SEQ ID NO: 7323118 - DNA, 22 bp, Homo sapiens
aaagtacagatggtgaggttgg

SEQ ID NO: 7323119 - DNA, 22 bp, Homo sapiens
aaagtacatagcatattccaac

SEQ ID NO: 7323120 - DNA, 22 bp, Homo sapiens
aaaattttcagcttgacttgat

SEQ ID NO: 7323121 - DNA, 22 bp, Homo sapiens
aaaattttactggtgtttcctt

SEQ ID NO: 7323122 - DNA, 22 bp, Homo sapiens
aaaattgtcgaacagtagtaac

SEQ ID NO: 7323123 - DNA, 22 bp, Homo sapiens
aaaattttgccctatccttcat

SEQ ID NO: 7323124 - DNA, 22 bp, Homo sapiens
aaaggacatgtcaatatcaggc

SEQ ID NO: 7323125 - DNA, 22 bp, Homo sapiens
aaatgtctgtatgagaaagaga

SEQ ID NO: 7323126 - DNA, 22 bp, Homo sapiens
aaatgtctgagacttctgaact

SEQ ID NO: 7323127 - DNA, 23 bp, Homo sapiens
aaacttcagtagtgtcatcagcc

SEQ ID NO: 7323128 - DNA, 22 bp, Homo sapiens
aaacttcaagattcaagcctgg

SEQ ID NO: 7323129 - DNA, 22 bp, Homo sapiens
aaatgtctttcaatagagaaat

SEQ ID NO: 7323130 - DNA, 22 bp, Homo sapiens
aaatgtctttatctcatgtaac

SEQ ID NO: 7323131 - DNA, 22 bp, Homo sapiens
aaatgtctttgagtatttctgc

SEQ ID NO: 7323132 - DNA, 22 bp, Homo sapiens
aaagacagagctgtaggggaaa

SEQ ID NO: 7323133 - DNA, 22 bp, Homo sapiens
aaagacagtggattcaaaatcc

SEQ ID NO: 7323134 - DNA, 22 bp, Homo sapiens
aaagacagatggcaaggatgat

SEQ ID NO: 7323135 - DNA, 22 bp, Homo sapiens
aaatacaatttcaggctgtaat

SEQ ID NO: 7323136 - DNA, 22 bp, Homo sapiens
aacatgaaacccaaacagaata

SEQ ID NO: 7323137 - DNA, 22 bp, Homo sapiens
aaattggctgagtaatattgga

SEQ ID NO: 7323138 - DNA, 22 bp, Homo sapiens
aaattggcagttcagggaatta

SEQ ID NO: 7323139 - DNA, 19 bp, Homo sapiens
aaattggcatgctgacctc

SEQ ID NO: 7323140 - DNA, 22 bp, Homo sapiens
aaattcatttttcttagtgtgc

SEQ ID NO: 7323141 - DNA, 22 bp, Homo sapiens
aaaggcttctttgctccatgtc

SEQ ID NO: 7323142 - DNA, 22 bp, Homo sapiens
aaaggctggattcagagaggtg

SEQ ID NO: 7323143 - DNA, 22 bp, Homo sapiens
aaaggctctaacaaggagagag

SEQ ID NO: 7323144 - DNA, 22 bp, Homo sapiens
aacttctgcagaaaagtgcatg

SEQ ID NO: 7323145 - DNA, 22 bp, Homo sapiens
aacttctaatctgtacagtttt

SEQ ID NO: 7323146 - DNA, 22 bp, Homo sapiens
aaatcagaaaatatggagagga

SEQ ID NO: 7323147 - DNA, 22 bp, Homo sapiens
aaatcagacacagtgaaagtta

SEQ ID NO: 7323148 - DNA, 22 bp, Homo sapiens
aaatgatgtggagtgaaattgt

SEQ ID NO: 7323149 - DNA, 22 bp, Homo sapiens
aagagagacaataggtagcatt

SEQ ID NO: 7323150 - DNA, 22 bp, Homo sapiens
aagagagacaataggtagcatt

SEQ ID NO: 7323151 - DNA, 22 bp, Homo sapiens
aaatataatttctgcctcaata

SEQ ID NO: 7323152 - DNA, 22 bp, Homo sapiens
aagagtttttaatgggtactgg

SEQ ID NO: 7323153 - DNA, 22 bp, Homo sapiens
aagagtttttggagtgtgagtt

SEQ ID NO: 7323154 - DNA, 22 bp, Homo sapiens
aagagtttccatgctctgtgct

SEQ ID NO: 7323155 - DNA, 22 bp, Homo sapiens
aaatacaaaaattagccaggca

SEQ ID NO: 7323156 - DNA, 22 bp, Homo sapiens
aaatacagattctgactcagag

SEQ ID NO: 7323157 - DNA, 22 bp, Homo sapiens
aaagttggattagttgcaatag

SEQ ID NO: 7323158 - DNA, 22 bp, Homo sapiens
acaacattcttaaatacactga

SEQ ID NO: 7323159 - DNA, 22 bp, Homo sapiens
acacaaattgtaggataattgc

SEQ ID NO: 7323160 - DNA, 22 bp, Homo sapiens
agcacaatatgggttttatagt

SEQ ID NO: 7323161 - DNA, 22 bp, Homo sapiens
agagtggtcatttgtccaggat

SEQ ID NO: 7323162 - DNA, 22 bp, Homo sapiens
agagttaaataagcattaactt

SEQ ID NO: 7323163 - DNA, 22 bp, Homo sapiens
agagttaagtgaaatgtaataa

SEQ ID NO: 7323164 - DNA, 22 bp, Homo sapiens
agagtgtggaacttgaggagct

SEQ ID NO: 7323165 - DNA, 22 bp, Homo sapiens
agagtgtggaaatgttcagagt

SEQ ID NO: 7323166 - DNA, 22 bp, Homo sapiens
agagtgtgtggggctgaggtca

SEQ ID NO: 7323167 - DNA, 22 bp, Homo sapiens
acaacagtaggaaaacatgtct

SEQ ID NO: 7323168 - DNA, 22 bp, Homo sapiens
acaacagtagcctttacaaggc

SEQ ID NO: 7323169 - DNA, 22 bp, Homo sapiens
agagttcatgtcttagcctatc

SEQ ID NO: 7323170 - DNA, 22 bp, Homo sapiens
agagttcagttgtagccatatt

SEQ ID NO: 7323171 - DNA, 22 bp, Homo sapiens
agagttcagctactgcaaatgt

SEQ ID NO: 7323172 - DNA, 22 bp, Homo sapiens
acaaagtcttttacaacagtca

SEQ ID NO: 7323173 - DNA, 22 bp, Homo sapiens
acaaagtttgtggtattccaag

SEQ ID NO: 7323174 - DNA, 23 bp, Homo sapiens
agagcaaggaaatgaggtgtgat

SEQ ID NO: 7323175 - DNA, 22 bp, Homo sapiens
agagcaattctcaaggaggtgt

SEQ ID NO: 7323176 - DNA, 22 bp, Homo sapiens
aatgtataaccataggaaattt

SEQ ID NO: 7323177 - DNA, 23 bp, Homo sapiens
agacatggcaggaatacagcttc

SEQ ID NO: 7323178 - DNA, 22 bp, Homo sapiens
agacattatgctgagtgaaaga

SEQ ID NO: 7323179 - DNA, 22 bp, Homo sapiens
agacatcatgttacagattaag

SEQ ID NO: 7323180 - DNA, 22 bp, Homo sapiens
agacatcatgttacagattaag

SEQ ID NO: 7323181 - DNA, 22 bp, Homo sapiens
agacatcagcttgtgtgcaggg

SEQ ID NO: 7323182 - DNA, 23 bp, Homo sapiens
aattacaaccaagaactggaagg

SEQ ID NO: 7323183 - DNA, 23 bp, Homo sapiens
aattacaaccaagaactggaagg

SEQ ID NO: 7323184 - DNA, 22 bp, Homo sapiens
agagctgaattcaagtgctggc

SEQ ID NO: 7323185 - DNA, 22 bp, Homo sapiens
aattccaaatcaactagtctag

SEQ ID NO: 7323186 - DNA, 21 bp, Homo sapiens
agaggaagtgattggtctggc

SEQ ID NO: 7323187 - DNA, 22 bp, Homo sapiens
agaggaagtaatcaggacctgc

SEQ ID NO: 7323188 - DNA, 22 bp, Homo sapiens
agaggaatttctggaaggaggc

SEQ ID NO: 7323189 - DNA, 22 bp, Homo sapiens
acacacaactcattgtgtaata

SEQ ID NO: 7323190 - DNA, 22 bp, Homo sapiens
acacagtgccaaattgcagtta

SEQ ID NO: 7323191 - DNA, 22 bp, Homo sapiens
acacatctcaggggacactctc

SEQ ID NO: 7323192 - DNA, 22 bp, Homo sapiens
acacatattcatatgtacttac

SEQ ID NO: 7323193 - DNA, 22 bp, Homo sapiens
acacatatgtggcaactgtaga

SEQ ID NO: 7323194 - DNA, 22 bp, Homo sapiens
acacagttctttcactgttggt

SEQ ID NO: 7323195 - DNA, 22 bp, Homo sapiens
agcaggctttccacagaaggag

SEQ ID NO: 7323196 - DNA, 22 bp, Homo sapiens
acacagtttttcagacagagat

SEQ ID NO: 7323197 - DNA, 19 bp, Homo sapiens
agcaggccacagggccagc

SEQ ID NO: 7323198 - DNA, 22 bp, Homo sapiens
acactgttctttgcactgagaa

SEQ ID NO: 7323199 - DNA, 22 bp, Homo sapiens
agccagctgtgggctcaggcgg

SEQ ID NO: 7323200 - DNA, 22 bp, Homo sapiens
agccaggaagagaggcctcacc

SEQ ID NO: 7323201 - DNA, 22 bp, Homo sapiens
agccaatgcgtaaaaagatcta

SEQ ID NO: 7323202 - DNA, 22 bp, Homo sapiens
acaccattcaccatcagtacct

SEQ ID NO: 7323203 - DNA, 21 bp, Homo sapiens
agcaggtgtaaaggaggaaat

SEQ ID NO: 7323204 - DNA, 22 bp, Homo sapiens
agcaggtgtatataaggctgag

SEQ ID NO: 7323205 - DNA, 20 bp, Homo sapiens
acagaatatgctggttgtgg

SEQ ID NO: 7323206 - DNA, 21 bp, Homo sapiens
acagaggcatacagcttaagg

SEQ ID NO: 7323207 - DNA, 22 bp, Homo sapiens
actggctgagttgcttcagcaa

SEQ ID NO: 7323208 - DNA, 22 bp, Homo sapiens
actggctgagtttatgttcaca

SEQ ID NO: 7323209 - DNA, 18 bp, Homo sapiens
actgtctctgagagtggt

SEQ ID NO: 7323210 - DNA, 22 bp, Homo sapiens
actgtctcctcatcatgcctgg

SEQ ID NO: 7323211 - DNA, 22 bp, Homo sapiens
aatagcaaagttatcaaattaa

SEQ ID NO: 7323212 - DNA, 22 bp, Homo sapiens
aagtgggtcagggacagatctt

SEQ ID NO: 7323213 - DNA, 22 bp, Homo sapiens
aagtgtggtttaggcatctttt

SEQ ID NO: 7323214 - DNA, 22 bp, Homo sapiens
aagtgtttacttaaagtcatgg

SEQ ID NO: 7323215 - DNA, 22 bp, Homo sapiens
aagtgtttatggttattgttaa

SEQ ID NO: 7323216 - DNA, 22 bp, Homo sapiens
aagtgtttaatggttttgatga

SEQ ID NO: 7323217 - DNA, 22 bp, Homo sapiens
aagtgtttaacggtgattgagc

SEQ ID NO: 7323218 - DNA, 22 bp, Homo sapiens
aagtgtttaaattatttgcagg

SEQ ID NO: 7323219 - DNA, 22 bp, Homo sapiens
aagtgtttccgggagacttggt

SEQ ID NO: 7323220 - DNA, 22 bp, Homo sapiens
aagttcaaggctctagagttcc

SEQ ID NO: 7323221 - DNA, 22 bp, Homo sapiens
aagttcaaggtgatagtggcag

SEQ ID NO: 7323222 - DNA, 22 bp, Homo sapiens
aagttcaagtagtgttacatgg

SEQ ID NO: 7323223 - DNA, 18 bp, Homo sapiens
actctttctgcccacagg

SEQ ID NO: 7323224 - DNA, 22 bp, Homo sapiens
aagttcaagtgtaatctttatt

SEQ ID NO: 7323225 - DNA, 22 bp, Homo sapiens
aagttcaatcagatgaaaaagc

SEQ ID NO: 7323226 - DNA, 22 bp, Homo sapiens
aagttcaatggaaaagctttag

SEQ ID NO: 7323227 - DNA, 22 bp, Homo sapiens
aagttcaagtctgcatcttttt

SEQ ID NO: 7323228 - DNA, 23 bp, Homo sapiens
aagttcaagtcacagcctgtctt

SEQ ID NO: 7323229 - DNA, 22 bp, Homo sapiens
aagttcaagtctcctgagtata

SEQ ID NO: 7323230 - DNA, 22 bp, Homo sapiens
actgcatctgaactgtgaatgg

SEQ ID NO: 7323231 - DNA, 22 bp, Homo sapiens
aatctacatgcaatatttttag

SEQ ID NO: 7323232 - DNA, 22 bp, Homo sapiens
agaaagggatgaggtagctgct

SEQ ID NO: 7323233 - DNA, 22 bp, Homo sapiens
agaaagctggagtcaagcagag

SEQ ID NO: 7323234 - DNA, 22 bp, Homo sapiens
aatcacagagtccagcagatga

SEQ ID NO: 7323235 - DNA, 22 bp, Homo sapiens
aatcacaaatgcaagttgtcac

SEQ ID NO: 7323236 - DNA, 22 bp, Homo sapiens
aatagtaaaagatacagctaat

SEQ ID NO: 7323237 - DNA, 22 bp, Homo sapiens
agaaggaaggctgagtgctgat

SEQ ID NO: 7323238 - DNA, 22 bp, Homo sapiens
agaaggaagccaggagggtgca

SEQ ID NO: 7323239 - DNA, 22 bp, Homo sapiens
agaaggaaggaagcattctgtt

SEQ ID NO: 7323240 - DNA, 22 bp, Homo sapiens
agaaggaaggataactgcatta

SEQ ID NO: 7323241 - DNA, 22 bp, Homo sapiens
agaagccagcttcagctgcccg

SEQ ID NO: 7323242 - DNA, 22 bp, Homo sapiens
agaagccagccttgcctccttt

SEQ ID NO: 7323243 - DNA, 22 bp, Homo sapiens
agaagccagattgtagtgggac

SEQ ID NO: 7323244 - DNA, 22 bp, Homo sapiens
agaagccagaggcagtgggtac

SEQ ID NO: 7323245 - DNA, 22 bp, Homo sapiens
agaagccaccagctgaggaaga

SEQ ID NO: 7323246 - DNA, 22 bp, Homo sapiens
agaagccactgctcccagtgag

SEQ ID NO: 7323247 - DNA, 22 bp, Homo sapiens
agaagccagaatattcatggat

SEQ ID NO: 7323248 - DNA, 18 bp, Homo sapiens
agaagccacgaggagtcc

SEQ ID NO: 7323249 - DNA, 22 bp, Homo sapiens
acatgaatgcagccataacact

SEQ ID NO: 7323250 - DNA, 22 bp, Homo sapiens
acatccttggttgattaatcaa

SEQ ID NO: 7323251 - DNA, 22 bp, Homo sapiens
acatcgtgtatcactgaacctt

SEQ ID NO: 7323252 - DNA, 22 bp, Homo sapiens
acatgcatacacgtacatacct

SEQ ID NO: 7323253 - DNA, 22 bp, Homo sapiens
aaggaatcacttctttaaatga

SEQ ID NO: 7323254 - DNA, 22 bp, Homo sapiens
aaggaaggtactcagtgattct

SEQ ID NO: 7323255 - DNA, 22 bp, Homo sapiens
aaggaaggttcatagtcaaaga

SEQ ID NO: 7323256 - DNA, 22 bp, Homo sapiens
aaggaagggaaatagtgatgtc

SEQ ID NO: 7323257 - DNA, 22 bp, Homo sapiens
aaggaaggaattgatcatgcgc

SEQ ID NO: 7323258 - DNA, 22 bp, Homo sapiens
aaggaagatgaggtgctgctta

SEQ ID NO: 7323259 - DNA, 22 bp, Homo sapiens
aaggaagaatcatcacgttggg

SEQ ID NO: 7323260 - DNA, 22 bp, Homo sapiens
aaggaagatgctggcctgggga

SEQ ID NO: 7323261 - DNA, 22 bp, Homo sapiens
aaggacacaaaacagcagcagt

SEQ ID NO: 7323262 - DNA, 22 bp, Homo sapiens
aaggaggcctggcagatgaaga

SEQ ID NO: 7323263 - DNA, 22 bp, Homo sapiens
aaggaggcctgcgagaaggggc

SEQ ID NO: 7323264 - DNA, 22 bp, Homo sapiens
aaggaggccctctccttctgga

SEQ ID NO: 7323265 - DNA, 22 bp, Homo sapiens
aaggatctgacagactatagaa

SEQ ID NO: 7323266 - DNA, 22 bp, Homo sapiens
aaggaagaagggaagttactta

SEQ ID NO: 7323267 - DNA, 23 bp, Homo sapiens
aagcttccttcacgtctcctggg

SEQ ID NO: 7323268 - DNA, 21 bp, Homo sapiens
aagcttccaaactgctggact

SEQ ID NO: 7323269 - DNA, 22 bp, Homo sapiens
aagcttcctgcatgggactgct

SEQ ID NO: 7323270 - DNA, 22 bp, Homo sapiens
acagctggacaggggagagttt

SEQ ID NO: 7323271 - DNA, 22 bp, Homo sapiens
acatttcagatgtaatgtgatg

SEQ ID NO: 7323272 - DNA, 22 bp, Homo sapiens
aagggaggtaaagctatttaaa

SEQ ID NO: 7323273 - DNA, 22 bp, Homo sapiens
acatttcagcgtgcatgacatg

SEQ ID NO: 7323274 - DNA, 22 bp, Homo sapiens
acatttcagtgagctattgaag

SEQ ID NO: 7323275 - DNA, 22 bp, Homo sapiens
accagagcttacatgctagaaa

SEQ ID NO: 7323276 - DNA, 19 bp, Homo sapiens
acctctgagaatgccagtc

SEQ ID NO: 7323277 - DNA, 22 bp, Homo sapiens
acctctgaagggccaagcaatg

SEQ ID NO: 7323278 - DNA, 22 bp, Homo sapiens
aaggtggttcgctggtacccag

SEQ ID NO: 7323279 - DNA, 22 bp, Homo sapiens
aaggtggtttgattatcccact

SEQ ID NO: 7323280 - DNA, 22 bp, Homo sapiens
aaggtggtcttactgatggtat

SEQ ID NO: 7323281 - DNA, 22 bp, Homo sapiens
aagtagcatcaaggaggatcca

SEQ ID NO: 7323282 - DNA, 22 bp, Homo sapiens
aagtaggtaccgcgcagcaggg

SEQ ID NO: 7323283 - DNA, 22 bp, Homo sapiens
aagtcatcactcctctgaactt

SEQ ID NO: 7323284 - DNA, 22 bp, Homo sapiens
gtgtgcatgtgcttgcacagat

SEQ ID NO: 7323285 - DNA, 22 bp, Homo sapiens
gtgtgggaatggcggtcgtgca

SEQ ID NO: 7323286 - DNA, 22 bp, Homo sapiens
gttcacaaagtactgtatgcat

SEQ ID NO: 7323287 - DNA, 22 bp, Homo sapiens
gtttcatggagagctgaatatt

SEQ ID NO: 7323288 - DNA, 18 bp, Homo sapiens
gtttcatgcatgtgaaac

SEQ ID NO: 7323289 - DNA, 22 bp, Homo sapiens
taaattatgttccatgtccttt

SEQ ID NO: 7323290 - DNA, 20 bp, Homo sapiens
taaattagccttgaagatta

SEQ ID NO: 7323291 - DNA, 22 bp, Homo sapiens
taactgaacatctcaaatcaag

SEQ ID NO: 7323292 - DNA, 22 bp, Homo sapiens
taactcatggagaggcggagtt

SEQ ID NO: 7323293 - DNA, 22 bp, Homo sapiens
taaattgtgtgttgctagggga

SEQ ID NO: 7323294 - DNA, 22 bp, Homo sapiens
taaacaattcctctctaggcat

SEQ ID NO: 7323295 - DNA, 22 bp, Homo sapiens
taaacagaattcaggcaagata

SEQ ID NO: 7323296 - DNA, 22 bp, Homo sapiens
taaaatgtgtttctgtatggtt

SEQ ID NO: 7323297 - DNA, 19 bp, Homo sapiens
taaaatgtctgtggtcagt

SEQ ID NO: 7323298 - DNA, 22 bp, Homo sapiens
taaaatggtaactttcatttgc

SEQ ID NO: 7323299 - DNA, 18 bp, Homo sapiens
gttttgaattgtcttaca

SEQ ID NO: 7323300 - DNA, 22 bp, Homo sapiens
gttttgttcatgaacattgggt

SEQ ID NO: 7323301 - DNA, 22 bp, Homo sapiens
gttttcttcctgcaattggcat

SEQ ID NO: 7323302 - DNA, 22 bp, Homo sapiens
gtttccacgtctcagttccaaa

SEQ ID NO: 7323303 - DNA, 22 bp, Homo sapiens
taatggctgggataaaggaatg

SEQ ID NO: 7323304 - DNA, 22 bp, Homo sapiens
taaggcagtgagaagaaacagg

SEQ ID NO: 7323305 - DNA, 22 bp, Homo sapiens
tacatagagaagttacagtgga

SEQ ID NO: 7323306 - DNA, 21 bp, Homo sapiens
tacatagaggtgatatctgtt

SEQ ID NO: 7323307 - DNA, 22 bp, Homo sapiens
tacatcattttggagatgagca

SEQ ID NO: 7323308 - DNA, 22 bp, Homo sapiens
tacatgaaataggattctggag

SEQ ID NO: 7323309 - DNA, 22 bp, Homo sapiens
tacatagcaaggaaatgacaga

SEQ ID NO: 7323310 - DNA, 22 bp, Homo sapiens
tacatagctcctagtgatgcat

SEQ ID NO: 7323311 - DNA, 22 bp, Homo sapiens
tacatcatggcttcatgctgca

SEQ ID NO: 7323312 - DNA, 22 bp, Homo sapiens
tacattgaaagtcatttaatcc

SEQ ID NO: 7323313 - DNA, 22 bp, Homo sapiens
tacattgactgtgtgcatcaca

SEQ ID NO: 7323314 - DNA, 22 bp, Homo sapiens
tacagagtatttttaatatggt

SEQ ID NO: 7323315 - DNA, 22 bp, Homo sapiens
tacagcaatgcctgaaatagta

SEQ ID NO: 7323316 - DNA, 18 bp, Homo sapiens
tacagattatagatacat

SEQ ID NO: 7323317 - DNA, 22 bp, Homo sapiens
tacaacaggaatttcaactttg

SEQ ID NO: 7323318 - DNA, 22 bp, Homo sapiens
tacaacagacctagatgaatga

SEQ ID NO: 7323319 - DNA, 22 bp, Homo sapiens
tacaaagtgctttagaaatgaa

SEQ ID NO: 7323320 - DNA, 22 bp, Homo sapiens
tacaacagtaatcaaggttttt

SEQ ID NO: 7323321 - DNA, 22 bp, Homo sapiens
tatccaaagtggcatattatag

SEQ ID NO: 7323322 - DNA, 22 bp, Homo sapiens
tatccacactgggatgttttga

SEQ ID NO: 7323323 - DNA, 22 bp, Homo sapiens
tatccacactcaaggggagggg

SEQ ID NO: 7323324 - DNA, 22 bp, Homo sapiens
tatatccagaaaatcagttcat

SEQ ID NO: 7323325 - DNA, 22 bp, Homo sapiens
tatatccataggctgtgcctag

SEQ ID NO: 7323326 - DNA, 22 bp, Homo sapiens
tataggaccgacttgtttatag

SEQ ID NO: 7323327 - DNA, 22 bp, Homo sapiens
taggtgggtgacttccatgggg

SEQ ID NO: 7323328 - DNA, 22 bp, Homo sapiens
tataaattattaggctgctaaa

SEQ ID NO: 7323329 - DNA, 22 bp, Homo sapiens
tataacaccatgttctacagat

SEQ ID NO: 7323330 - DNA, 20 bp, Homo sapiens
tataaattcagagctttggt

SEQ ID NO: 7323331 - DNA, 22 bp, Homo sapiens
tataatttatcatgtcacagtt

SEQ ID NO: 7323332 - DNA, 22 bp, Homo sapiens
tatacaagtgagaagaagagtt

SEQ ID NO: 7323333 - DNA, 22 bp, Homo sapiens
tatacacatgtgtgtattcata

SEQ ID NO: 7323334 - DNA, 23 bp, Homo sapiens
tatacacatgtggcagtatagtg

SEQ ID NO: 7323335 - DNA, 22 bp, Homo sapiens
tatacacatatcttctaggcct

SEQ ID NO: 7323336 - DNA, 22 bp, Homo sapiens
tattcttactctcgactgcatt

SEQ ID NO: 7323337 - DNA, 22 bp, Homo sapiens
tattgaaatccattacgttctt

SEQ ID NO: 7323338 - DNA, 22 bp, Homo sapiens
tattgaaattcttcatgtcctc

SEQ ID NO: 7323339 - DNA, 22 bp, Homo sapiens
tattattgcaagtatataaagt

SEQ ID NO: 7323340 - DNA, 22 bp, Homo sapiens
tattcaaagtaccttcattgcc

SEQ ID NO: 7323341 - DNA, 20 bp, Homo sapiens
tatttacaacttagagcctc

SEQ ID NO: 7323342 - DNA, 22 bp, Homo sapiens
tattgacatttttatagcttga

SEQ ID NO: 7323343 - DNA, 19 bp, Homo sapiens
tatgtgtgcatttgtgcat

SEQ ID NO: 7323344 - DNA, 20 bp, Homo sapiens
tatgagtattactttcagga

SEQ ID NO: 7323345 - DNA, 22 bp, Homo sapiens
tatgagcagacagtggttttac

SEQ ID NO: 7323346 - DNA, 22 bp, Homo sapiens
taggcaagtggaccagaggttt

SEQ ID NO: 7323347 - DNA, 22 bp, Homo sapiens
tagggaggagggttttcaaatc

SEQ ID NO: 7323348 - DNA, 22 bp, Homo sapiens
tagggaggctacttcttgtagg

SEQ ID NO: 7323349 - DNA, 22 bp, Homo sapiens
taggatggtacaaggcaggggt

SEQ ID NO: 7323350 - DNA, 22 bp, Homo sapiens
taggatggtcacagagatggac

SEQ ID NO: 7323351 - DNA, 22 bp, Homo sapiens
taggaaactaatacagtctgga

SEQ ID NO: 7323352 - DNA, 22 bp, Homo sapiens
tagcagagcagggatcagagcc

SEQ ID NO: 7323353 - DNA, 22 bp, Homo sapiens
tagcagaggaaaagagaacatt

SEQ ID NO: 7323354 - DNA, 22 bp, Homo sapiens
tagaggtgacactgagaccata

SEQ ID NO: 7323355 - DNA, 22 bp, Homo sapiens
tagcccctgcctttgaacctgg

SEQ ID NO: 7323356 - DNA, 22 bp, Homo sapiens
tagcccagcatgagcagagctg

SEQ ID NO: 7323357 - DNA, 22 bp, Homo sapiens
tagcccaggctgtagtgcagtg

SEQ ID NO: 7323358 - DNA, 22 bp, Homo sapiens
tagcccaggctggagtgcaggg

SEQ ID NO: 7323359 - DNA, 22 bp, Homo sapiens
tagcccaggctggagggcagtg

SEQ ID NO: 7323360 - DNA, 22 bp, Homo sapiens
tagcccagcttggcctatttct

SEQ ID NO: 7323361 - DNA, 22 bp, Homo sapiens
tagaaaggagcattttagacta

SEQ ID NO: 7323362 - DNA, 22 bp, Homo sapiens
tagaaagtactaaatttaactg

SEQ ID NO: 7323363 - DNA, 22 bp, Homo sapiens
tagacacatcaaggatcagttt

SEQ ID NO: 7323364 - DNA, 22 bp, Homo sapiens
tagagggaaggaagaatggatt

SEQ ID NO: 7323365 - DNA, 22 bp, Homo sapiens
tagacacaagagaagggtataa

SEQ ID NO: 7323366 - DNA, 22 bp, Homo sapiens
tagacacatacccttgcccaaa

SEQ ID NO: 7323367 - DNA, 22 bp, Homo sapiens
tagaaacaatgacatgcttgta

SEQ ID NO: 7323368 - DNA, 22 bp, Homo sapiens
tagaaacaagtttctctttggg

SEQ ID NO: 7323369 - DNA, 22 bp, Homo sapiens
tagaaacagagagatatgcccc

SEQ ID NO: 7323370 - DNA, 22 bp, Homo sapiens
tagaaacattcagttgcagtcc

SEQ ID NO: 7323371 - DNA, 22 bp, Homo sapiens
tagaaagaaattcagattggct

SEQ ID NO: 7323372 - DNA, 22 bp, Homo sapiens
tagaaacatatgtttgagacat

SEQ ID NO: 7323373 - DNA, 22 bp, Homo sapiens
tacattttctaggggaccaaga

SEQ ID NO: 7323374 - DNA, 22 bp, Homo sapiens
tcaggatgaagtcagaggggtc

SEQ ID NO: 7323375 - DNA, 22 bp, Homo sapiens
tcaggatgacttcaaggaggaa

SEQ ID NO: 7323376 - DNA, 22 bp, Homo sapiens
tcagcactttgaagcagaagga

SEQ ID NO: 7323377 - DNA, 22 bp, Homo sapiens
tcagcactttgaagcagaagga

SEQ ID NO: 7323378 - DNA, 22 bp, Homo sapiens
tcaggaagcatcctgaggtgtc

SEQ ID NO: 7323379 - DNA, 22 bp, Homo sapiens
tcaggaagcatcctgaggtgtc

SEQ ID NO: 7323380 - DNA, 22 bp, Homo sapiens
tcaggaacccccgctgggtgaa

SEQ ID NO: 7323381 - DNA, 22 bp, Homo sapiens
tcaggaacataatgtgagtcag

SEQ ID NO: 7323382 - DNA, 22 bp, Homo sapiens
tcaggaagaaagaagggagtgt

SEQ ID NO: 7323383 - DNA, 22 bp, Homo sapiens
tcaggaaggcaaattgcatgat

SEQ ID NO: 7323384 - DNA, 22 bp, Homo sapiens
tcaggagtaaagacagagttcc

SEQ ID NO: 7323385 - DNA, 22 bp, Homo sapiens
tcaggagtcctgcctgcagcct

SEQ ID NO: 7323386 - DNA, 22 bp, Homo sapiens
tcatatttaggcctttaattca

SEQ ID NO: 7323387 - DNA, 21 bp, Homo sapiens
tcatatttctcttgctattgt

SEQ ID NO: 7323388 - DNA, 22 bp, Homo sapiens
tcatgctcatcattagagtgac

SEQ ID NO: 7323389 - DNA, 22 bp, Homo sapiens
tcatatacctgcatgtgcatgt

SEQ ID NO: 7323390 - DNA, 22 bp, Homo sapiens
tcatataccagagagtttatat

SEQ ID NO: 7323391 - DNA, 22 bp, Homo sapiens
tcagtgttattagatgaggttt

SEQ ID NO: 7323392 - DNA, 22 bp, Homo sapiens
tcagtgttagacaagtttggaa

SEQ ID NO: 7323393 - DNA, 22 bp, Homo sapiens
tcattattctctttaatgttct

SEQ ID NO: 7323394 - DNA, 22 bp, Homo sapiens
tcattatcttggctcatttctg

SEQ ID NO: 7323395 - DNA, 21 bp, Homo sapiens
tcattcacagggtattgtata

SEQ ID NO: 7323396 - DNA, 22 bp, Homo sapiens
tcatgcttattgcatatttgga

SEQ ID NO: 7323397 - DNA, 21 bp, Homo sapiens
tcatggccagcaagtggcaga

SEQ ID NO: 7323398 - DNA, 22 bp, Homo sapiens
tcagtcttcaaatctgagtcgt

SEQ ID NO: 7323399 - DNA, 23 bp, Homo sapiens
tcagtcttccctgtcagtaatag

SEQ ID NO: 7323400 - DNA, 23 bp, Homo sapiens
tcagtcttggcttctgattttcc

SEQ ID NO: 7323401 - DNA, 22 bp, Homo sapiens
tcagtgcaggaatttccttaga

SEQ ID NO: 7323402 - DNA, 22 bp, Homo sapiens
tcagtgcagcggcagcagctct

SEQ ID NO: 7323403 - DNA, 22 bp, Homo sapiens
tcagtgcaatcaaggtatgttt

SEQ ID NO: 7323404 - DNA, 23 bp, Homo sapiens
tcagtgcaaaaataggattttgg

SEQ ID NO: 7323405 - DNA, 22 bp, Homo sapiens
tcagtgcacaatgacggtggct

SEQ ID NO: 7323406 - DNA, 22 bp, Homo sapiens
tcagtgcacagagatttttgtt

SEQ ID NO: 7323407 - DNA, 22 bp, Homo sapiens
tcagtgttaatcagtggtacct

SEQ ID NO: 7323408 - DNA, 22 bp, Homo sapiens
tcagtgttacattatatagaac

SEQ ID NO: 7323409 - DNA, 22 bp, Homo sapiens
tcagtgcagtagaactttagtt

SEQ ID NO: 7323410 - DNA, 22 bp, Homo sapiens
tcacaaaggatgatgaattctg

SEQ ID NO: 7323411 - DNA, 22 bp, Homo sapiens
tcacaaatagctatattaagga

SEQ ID NO: 7323412 - DNA, 22 bp, Homo sapiens
tcacaggataaggtggcatcac

SEQ ID NO: 7323413 - DNA, 22 bp, Homo sapiens
tcacagctgagtttccatttct

SEQ ID NO: 7323414 - DNA, 20 bp, Homo sapiens
tcacagctggctatgacagg

SEQ ID NO: 7323415 - DNA, 22 bp, Homo sapiens
tcacagctcactgtagcctcga

SEQ ID NO: 7323416 - DNA, 22 bp, Homo sapiens
tcaatttcaacagctgataaga

SEQ ID NO: 7323417 - DNA, 22 bp, Homo sapiens
tcaaggttgagtaaattgttgg

SEQ ID NO: 7323418 - DNA, 22 bp, Homo sapiens
tcaagtattatattctcatttt

SEQ ID NO: 7323419 - DNA, 22 bp, Homo sapiens
tcaagtctcaatgtattatggt

SEQ ID NO: 7323420 - DNA, 22 bp, Homo sapiens
tatttctgggagttcagaaatt

SEQ ID NO: 7323421 - DNA, 20 bp, Homo sapiens
tatttctgggcaaccattta

SEQ ID NO: 7323422 - DNA, 22 bp, Homo sapiens
tatttctgtcagccagatatgg

SEQ ID NO: 7323423 - DNA, 22 bp, Homo sapiens
tcactttagaggaaacattgag

SEQ ID NO: 7323424 - DNA, 22 bp, Homo sapiens
tcactttactttgttaatctgg

SEQ ID NO: 7323425 - DNA, 22 bp, Homo sapiens
tcactttaaactactgtggtct

SEQ ID NO: 7323426 - DNA, 22 bp, Homo sapiens
tcactttcctcatcacgactag

SEQ ID NO: 7323427 - DNA, 22 bp, Homo sapiens
tcacttcttcccttgcacatat

SEQ ID NO: 7323428 - DNA, 22 bp, Homo sapiens
tcactctgtggcccaggcagtg

SEQ ID NO: 7323429 - DNA, 22 bp, Homo sapiens
tcactctggtccatccgagagc

SEQ ID NO: 7323430 - DNA, 22 bp, Homo sapiens
tcactctgtcccccattgagat

SEQ ID NO: 7323431 - DNA, 22 bp, Homo sapiens
tcactctgggccctactgggct

SEQ ID NO: 7323432 - DNA, 19 bp, Homo sapiens
tcacccaggctgctggctc

SEQ ID NO: 7323433 - DNA, 22 bp, Homo sapiens
tcactctgagaggtcactggaa

SEQ ID NO: 7323434 - DNA, 22 bp, Homo sapiens
tcactctgagaggtcactggaa

SEQ ID NO: 7323435 - DNA, 22 bp, Homo sapiens
tcactctgcaggaaggagcagc

SEQ ID NO: 7323436 - DNA, 22 bp, Homo sapiens
tcacccagcagctgcttctgct

SEQ ID NO: 7323437 - DNA, 22 bp, Homo sapiens
tcagaggaagccttggtgggag

SEQ ID NO: 7323438 - DNA, 22 bp, Homo sapiens
tcagaggaagcatcaagttctc

SEQ ID NO: 7323439 - DNA, 22 bp, Homo sapiens
tcagaggaactggactaaagcc

SEQ ID NO: 7323440 - DNA, 22 bp, Homo sapiens
tcagaggaaagggaacatagtc

SEQ ID NO: 7323441 - DNA, 22 bp, Homo sapiens
tcagacatcgtaattacacaat

SEQ ID NO: 7323442 - DNA, 22 bp, Homo sapiens
tcagacatctcataatgtatta

SEQ ID NO: 7323443 - DNA, 22 bp, Homo sapiens
tcagacatatcaataggcactt

SEQ ID NO: 7323444 - DNA, 22 bp, Homo sapiens
tcagacatatttttaacaaagt

SEQ ID NO: 7323445 - DNA, 22 bp, Homo sapiens
tcagacatgggatatgaagctc

SEQ ID NO: 7323446 - DNA, 22 bp, Homo sapiens
tcagacatggggagagagacct

SEQ ID NO: 7323447 - DNA, 22 bp, Homo sapiens
tcagacatgttttaagacttat

SEQ ID NO: 7323448 - DNA, 22 bp, Homo sapiens
tcagacattattttcaagataa

SEQ ID NO: 7323449 - DNA, 22 bp, Homo sapiens
tcagacagtgtgatcagtctct

SEQ ID NO: 7323450 - DNA, 20 bp, Homo sapiens
tccccagggcatcaggagca

SEQ ID NO: 7323451 - DNA, 22 bp, Homo sapiens
tcccagtgaggtcctggctgtc

SEQ ID NO: 7323452 - DNA, 22 bp, Homo sapiens
tcccacaggagcctgagtccca

SEQ ID NO: 7323453 - DNA, 22 bp, Homo sapiens
tcccacaggaggagttggaaat

SEQ ID NO: 7323454 - DNA, 20 bp, Homo sapiens
tccatgcaaatacagagttt

SEQ ID NO: 7323455 - DNA, 20 bp, Homo sapiens
tccagggctagggagctcat

SEQ ID NO: 7323456 - DNA, 21 bp, Homo sapiens
tccagggcgggcgcacggaga

SEQ ID NO: 7323457 - DNA, 19 bp, Homo sapiens
tccagcagtgcttgaaatc

SEQ ID NO: 7323458 - DNA, 22 bp, Homo sapiens
tccaggaaagcactgggctggg

SEQ ID NO: 7323459 - DNA, 22 bp, Homo sapiens
tccaggaaacagcatctcagca

SEQ ID NO: 7323460 - DNA, 20 bp, Homo sapiens
tccagacatctagctcagtt

SEQ ID NO: 7323461 - DNA, 22 bp, Homo sapiens
tcattgcaccccagtcccagct

SEQ ID NO: 7323462 - DNA, 22 bp, Homo sapiens
tccagaggtatgtagagagtat

SEQ ID NO: 7323463 - DNA, 22 bp, Homo sapiens
gctggctgtgtttcatctctga

SEQ ID NO: 7323464 - DNA, 22 bp, Homo sapiens
gctggctgtgattttgccaaca

SEQ ID NO: 7323465 - DNA, 23 bp, Homo sapiens
gctggctggcagtaaaggttgtt

SEQ ID NO: 7323466 - DNA, 22 bp, Homo sapiens
gctggctggagtaaggagggag

SEQ ID NO: 7323467 - DNA, 22 bp, Homo sapiens
gctggctggaatgggagaagaa

SEQ ID NO: 7323468 - DNA, 22 bp, Homo sapiens
gctggctgcgtcatcacagggc

SEQ ID NO: 7323469 - DNA, 18 bp, Homo sapiens
gctttatttcttggggaa

SEQ ID NO: 7323470 - DNA, 18 bp, Homo sapiens
gctttatttcttggggaa

SEQ ID NO: 7323471 - DNA, 22 bp, Homo sapiens
gcttgcatcatcttgagagtcc

SEQ ID NO: 7323472 - DNA, 22 bp, Homo sapiens
gctgtgtgaccctagccagtag

SEQ ID NO: 7323473 - DNA, 22 bp, Homo sapiens
ggaagattcagttatctcatga

SEQ ID NO: 7323474 - DNA, 22 bp, Homo sapiens
ggaagaggctggtagtgcccgt

SEQ ID NO: 7323475 - DNA, 22 bp, Homo sapiens
ggaagaggctggtagtgcccgt

SEQ ID NO: 7323476 - DNA, 22 bp, Homo sapiens
ggaagaggctctcattgagggc

SEQ ID NO: 7323477 - DNA, 22 bp, Homo sapiens
ggaagaggctgaggccatgctg

SEQ ID NO: 7323478 - DNA, 22 bp, Homo sapiens
gctttctcttcactgatgttca

SEQ ID NO: 7323479 - DNA, 22 bp, Homo sapiens
gctttattttgtgagggattac

SEQ ID NO: 7323480 - DNA, 22 bp, Homo sapiens
gctttattttgtgagggattac

SEQ ID NO: 7323481 - DNA, 22 bp, Homo sapiens
gctttcaattatgtcagcctgt

SEQ ID NO: 7323482 - DNA, 22 bp, Homo sapiens
ggagacagtatggcttgtagct

SEQ ID NO: 7323483 - DNA, 22 bp, Homo sapiens
ggacagtgaatctggaggtata

SEQ ID NO: 7323484 - DNA, 22 bp, Homo sapiens
ggacagtgaatgtggggatgca

SEQ ID NO: 7323485 - DNA, 22 bp, Homo sapiens
ggacagtggcctggtggtatag

SEQ ID NO: 7323486 - DNA, 22 bp, Homo sapiens
ggagcagtctggtgatactcag

SEQ ID NO: 7323487 - DNA, 22 bp, Homo sapiens
ggagaccaggtcagagatggtg

SEQ ID NO: 7323488 - DNA, 22 bp, Homo sapiens
ggagacccaggttaggaagtaa

SEQ ID NO: 7323489 - DNA, 22 bp, Homo sapiens
ggagacatcatgtaggtttctt

SEQ ID NO: 7323490 - DNA, 22 bp, Homo sapiens
ggagacagtggtagggcctaag

SEQ ID NO: 7323491 - DNA, 22 bp, Homo sapiens
gctgcccagacattgaatcagg

SEQ ID NO: 7323492 - DNA, 19 bp, Homo sapiens
gctgctcctggctgaccac

SEQ ID NO: 7323493 - DNA, 22 bp, Homo sapiens
gctgctgtggcagattggattc

SEQ ID NO: 7323494 - DNA, 22 bp, Homo sapiens
gctgctccagctgtgctgcaga

SEQ ID NO: 7323495 - DNA, 22 bp, Homo sapiens
gctgctgttgatttagtccaat

SEQ ID NO: 7323496 - DNA, 22 bp, Homo sapiens
gctgcttcctagaaggcccagt

SEQ ID NO: 7323497 - DNA, 22 bp, Homo sapiens
gctgctgttatgatgttacttt

SEQ ID NO: 7323498 - DNA, 22 bp, Homo sapiens
gctgctgttcctccagtggatc

SEQ ID NO: 7323499 - DNA, 22 bp, Homo sapiens
gctctggggatgcttctgccgt

SEQ ID NO: 7323500 - DNA, 22 bp, Homo sapiens
gctctgggctgccctctggaca

SEQ ID NO: 7323501 - DNA, 22 bp, Homo sapiens
gctcctccaatatggactcctc

SEQ ID NO: 7323502 - DNA, 20 bp, Homo sapiens
gctccaggtcagagaggacg

SEQ ID NO: 7323503 - DNA, 22 bp, Homo sapiens
gctacagtgataggaaacacat

SEQ ID NO: 7323504 - DNA, 22 bp, Homo sapiens
gctacagtagataaggacggtc

SEQ ID NO: 7323505 - DNA, 23 bp, Homo sapiens
gctcagaggtttttctctggatg

SEQ ID NO: 7323506 - DNA, 22 bp, Homo sapiens
gccttgtttcattacacgtggt

SEQ ID NO: 7323507 - DNA, 22 bp, Homo sapiens
gcgtctcaaggcccccaggcca

SEQ ID NO: 7323508 - DNA, 22 bp, Homo sapiens
gctacaggtatatagatgaaac

SEQ ID NO: 7323509 - DNA, 22 bp, Homo sapiens
gcctctggggtggagcccagca

SEQ ID NO: 7323510 - DNA, 22 bp, Homo sapiens
gcctctgtcatagctcatgtga

SEQ ID NO: 7323511 - DNA, 22 bp, Homo sapiens
gcctctgtggctcagccttgct

SEQ ID NO: 7323512 - DNA, 18 bp, Homo sapiens
gcctctgttgcttgcctg

SEQ ID NO: 7323513 - DNA, 22 bp, Homo sapiens
gcagtgatggggatctcactgg

SEQ ID NO: 7323514 - DNA, 18 bp, Homo sapiens
gcagtgactatggggatc

SEQ ID NO: 7323515 - DNA, 22 bp, Homo sapiens
gcagtggatggccagcaggggc

SEQ ID NO: 7323516 - DNA, 17 bp, Homo sapiens
gcagtggaggggtagtt

SEQ ID NO: 7323517 - DNA, 22 bp, Homo sapiens
gcatgcatgtgtgcagacagtc

SEQ ID NO: 7323518 - DNA, 22 bp, Homo sapiens
gccagctcagtttcaaagtagg

SEQ ID NO: 7323519 - DNA, 22 bp, Homo sapiens
gccagggctgtgcaggtttgtt

SEQ ID NO: 7323520 - DNA, 22 bp, Homo sapiens
gccagggcaggggagcatctgc

SEQ ID NO: 7323521 - DNA, 22 bp, Homo sapiens
gcctcccttggtgtctcccggg

SEQ ID NO: 7323522 - DNA, 22 bp, Homo sapiens
gccctggagggccagcgactgg

SEQ ID NO: 7323523 - DNA, 22 bp, Homo sapiens
gccccaggggaggtgccctgca

SEQ ID NO: 7323524 - DNA, 17 bp, Homo sapiens
gcccaggaaggacggcc

SEQ ID NO: 7323525 - DNA, 22 bp, Homo sapiens
gcaggacagacccaagcagtct

SEQ ID NO: 7323526 - DNA, 19 bp, Homo sapiens
gcaggcagctggggtatcc

SEQ ID NO: 7323527 - DNA, 22 bp, Homo sapiens
gcagggacacctttgtgaagct

SEQ ID NO: 7323528 - DNA, 22 bp, Homo sapiens
gcagggaccaaaagaggcagta

SEQ ID NO: 7323529 - DNA, 22 bp, Homo sapiens
gcagctttgaagacttatttgc

SEQ ID NO: 7323530 - DNA, 23 bp, Homo sapiens
gcaggaactcagggtaggcagca

SEQ ID NO: 7323531 - DNA, 22 bp, Homo sapiens
gcaggacaaaatttccagggtg

SEQ ID NO: 7323532 - DNA, 23 bp, Homo sapiens
gcaggacaacagagtgggaaggc

SEQ ID NO: 7323533 - DNA, 22 bp, Homo sapiens
gcagacatcacctcagtgctat

SEQ ID NO: 7323534 - DNA, 22 bp, Homo sapiens
gcagacatgaccaccaaccagg

SEQ ID NO: 7323535 - DNA, 22 bp, Homo sapiens
gcagacatacttctttttgtac

SEQ ID NO: 7323536 - DNA, 22 bp, Homo sapiens
gcagacatgggatctattcaca

SEQ ID NO: 7323537 - DNA, 22 bp, Homo sapiens
gcagacatgtgttctaacagga

SEQ ID NO: 7323538 - DNA, 22 bp, Homo sapiens
gcagacatgttcctttctgtca

SEQ ID NO: 7323539 - DNA, 22 bp, Homo sapiens
gcagacattttgaatctaggct

SEQ ID NO: 7323540 - DNA, 22 bp, Homo sapiens
gcacagttgatttatgctggtg

SEQ ID NO: 7323541 - DNA, 22 bp, Homo sapiens
gcacagttaaagggtcatgtga

SEQ ID NO: 7323542 - DNA, 22 bp, Homo sapiens
gcagagcaggaaggaagtcagg

SEQ ID NO: 7323543 - DNA, 22 bp, Homo sapiens
gcaaataatatactttgatctc

SEQ ID NO: 7323544 - DNA, 22 bp, Homo sapiens
gcaaagcaaatgcctgaaggcg

SEQ ID NO: 7323545 - DNA, 22 bp, Homo sapiens
ggtcgctgtgtaggttcagcta

SEQ ID NO: 7323546 - DNA, 22 bp, Homo sapiens
ggtctcagctggagtccttggt

SEQ ID NO: 7323547 - DNA, 22 bp, Homo sapiens
gggtggcatctctctgagctgt

SEQ ID NO: 7323548 - DNA, 22 bp, Homo sapiens
gggtggcacaggtgcagagggt

SEQ ID NO: 7323549 - DNA, 22 bp, Homo sapiens
ggtggctctctgtcagtgacag

SEQ ID NO: 7323550 - DNA, 22 bp, Homo sapiens
ggtggctctcttaagggcagcg

SEQ ID NO: 7323551 - DNA, 22 bp, Homo sapiens
ggtggctccgcttccatgggct

SEQ ID NO: 7323552 - DNA, 22 bp, Homo sapiens
ggtggctcggccagtgcaggcc

SEQ ID NO: 7323553 - DNA, 19 bp, Homo sapiens
ggtggctctccctcaggga

SEQ ID NO: 7323554 - DNA, 22 bp, Homo sapiens
ggtggctcagtgtcaggccctg

SEQ ID NO: 7323555 - DNA, 22 bp, Homo sapiens
ggtggctcagggctccaagcat

SEQ ID NO: 7323556 - DNA, 18 bp, Homo sapiens
ggtggctcagtcatgggg

SEQ ID NO: 7323557 - DNA, 22 bp, Homo sapiens
ggtggctcacgcctgtaagccc

SEQ ID NO: 7323558 - DNA, 22 bp, Homo sapiens
gggcatggtgctggtgttcatg

SEQ ID NO: 7323559 - DNA, 22 bp, Homo sapiens
gggctgaggctaccactggtct

SEQ ID NO: 7323560 - DNA, 22 bp, Homo sapiens
ggggtgggcgtgcagggacacc

SEQ ID NO: 7323561 - DNA, 22 bp, Homo sapiens
ggggtggggttactcattgtgc

SEQ ID NO: 7323562 - DNA, 22 bp, Homo sapiens
gggtaggctctgcaggctgggt

SEQ ID NO: 7323563 - DNA, 22 bp, Homo sapiens
gggtaggatggtagaagggacc

SEQ ID NO: 7323564 - DNA, 22 bp, Homo sapiens
gggtaggagaggtgtctgtgtg

SEQ ID NO: 7323565 - DNA, 22 bp, Homo sapiens
ggggaagatggccctccatgtg

SEQ ID NO: 7323566 - DNA, 22 bp, Homo sapiens
gtgagagaaattggagggaatg

SEQ ID NO: 7323567 - DNA, 22 bp, Homo sapiens
gtgcaggtgttttggctgccag

SEQ ID NO: 7323568 - DNA, 18 bp, Homo sapiens
gtgaagctttattgaatg

SEQ ID NO: 7323569 - DNA, 22 bp, Homo sapiens
gtgaaatatttaacgtccaggt

SEQ ID NO: 7323570 - DNA, 22 bp, Homo sapiens
gtattgcaattactcttcttct

SEQ ID NO: 7323571 - DNA, 22 bp, Homo sapiens
gtacatttcagtttccttaaga

SEQ ID NO: 7323572 - DNA, 22 bp, Homo sapiens
gtacatttatttttgcagcata

SEQ ID NO: 7323573 - DNA, 22 bp, Homo sapiens
gtacatttcatttaaatgatgt

SEQ ID NO: 7323574 - DNA, 22 bp, Homo sapiens
gtacatttaggattcattgaaa

SEQ ID NO: 7323575 - DNA, 22 bp, Homo sapiens
gtacatttctcccaacactaaa

SEQ ID NO: 7323576 - DNA, 22 bp, Homo sapiens
gtacattttactttgtttgaat

SEQ ID NO: 7323577 - DNA, 22 bp, Homo sapiens
gtacatttctcttgttcttatt

SEQ ID NO: 7323578 - DNA, 22 bp, Homo sapiens
gtacattttgaggttaaaacaa

SEQ ID NO: 7323579 - DNA, 20 bp, Homo sapiens
gtacattttcaggaggggat

SEQ ID NO: 7323580 - DNA, 22 bp, Homo sapiens
gtaaaacaagctttatggttcc

SEQ ID NO: 7323581 - DNA, 23 bp, Homo sapiens
gtccctcacccctaggcaatgcc

SEQ ID NO: 7323582 - DNA, 22 bp, Homo sapiens
gtcccctcagccacccatgggg

SEQ ID NO: 7323583 - DNA, 22 bp, Homo sapiens
gtccccagagctggtggtggtt

SEQ ID NO: 7323584 - DNA, 22 bp, Homo sapiens
ggcaagagggcagatggagtgc

SEQ ID NO: 7323585 - DNA, 22 bp, Homo sapiens
ggcaagagggcagatggagtgc

SEQ ID NO: 7323586 - DNA, 19 bp, Homo sapiens
ggcaagcacaaaagctttg

SEQ ID NO: 7323587 - DNA, 22 bp, Homo sapiens
ggcaagagttgaagctccagga

SEQ ID NO: 7323588 - DNA, 22 bp, Homo sapiens
ggcaagaggtccaagaggtctc

SEQ ID NO: 7323589 - DNA, 22 bp, Homo sapiens
ggcaagaggtccaagaggtctc

SEQ ID NO: 7323590 - DNA, 22 bp, Homo sapiens
ggcaagagtgaggagtgtctct

SEQ ID NO: 7323591 - DNA, 23 bp, Homo sapiens
ggagtgcaatggcgccatctcgg

SEQ ID NO: 7323592 - DNA, 22 bp, Homo sapiens
ggagtgagtggccttgtcactg

SEQ ID NO: 7323593 - DNA, 22 bp, Homo sapiens
ggagtgcaggtagcacaggaaa

SEQ ID NO: 7323594 - DNA, 22 bp, Homo sapiens
ggagtgctccgcgagagggatg

SEQ ID NO: 7323595 - DNA, 22 bp, Homo sapiens
ggagtaggccccgggagagagt

SEQ ID NO: 7323596 - DNA, 23 bp, Homo sapiens
ggagccagcctgtggggagcggg

SEQ ID NO: 7323597 - DNA, 22 bp, Homo sapiens
ggagccagagcactggggagcc

SEQ ID NO: 7323598 - DNA, 22 bp, Homo sapiens
ggagccagaggctgctgctgtg

SEQ ID NO: 7323599 - DNA, 22 bp, Homo sapiens
ggagccagagtctgcagtgtaa

SEQ ID NO: 7323600 - DNA, 22 bp, Homo sapiens
ggagccagagggatgcagttga

SEQ ID NO: 7323601 - DNA, 18 bp, Homo sapiens
ggagtctcaggagaggaa

SEQ ID NO: 7323602 - DNA, 22 bp, Homo sapiens
ggagtcaccaagtaggagtctt

SEQ ID NO: 7323603 - DNA, 22 bp, Homo sapiens
ggagtcacctgggaggactggg

SEQ ID NO: 7323604 - DNA, 22 bp, Homo sapiens
ggcagaggaggggtgaatttgc

SEQ ID NO: 7323605 - DNA, 20 bp, Homo sapiens
ggcagagggcctgggagaag

SEQ ID NO: 7323606 - DNA, 22 bp, Homo sapiens
ggcaggaggtgagtggcgggtg

SEQ ID NO: 7323607 - DNA, 22 bp, Homo sapiens
ggcaggcaccagctcagcaata

SEQ ID NO: 7323608 - DNA, 22 bp, Homo sapiens
ggcagtcagtgtggttcataaa

SEQ ID NO: 7323609 - DNA, 22 bp, Homo sapiens
ggcagtgaatgaaacagaggct

SEQ ID NO: 7323610 - DNA, 22 bp, Homo sapiens
ggcctcagagaaggctgtgcgg

SEQ ID NO: 7323611 - DNA, 22 bp, Homo sapiens
ggctgggaggccgtgctgacct

SEQ ID NO: 7323612 - DNA, 22 bp, Homo sapiens
ggctgaaggatgaaagctgcag

SEQ ID NO: 7323613 - DNA, 19 bp, Homo sapiens
ggctctggcggctgtagcc

SEQ ID NO: 7323614 - DNA, 22 bp, Homo sapiens
gggagagagagctcatgttgaa

SEQ ID NO: 7323615 - DNA, 19 bp, Homo sapiens
gggagagccaggctcaccc

SEQ ID NO: 7323616 - DNA, 22 bp, Homo sapiens
gggagagagagctcatgttgaa

SEQ ID NO: 7323617 - DNA, 22 bp, Homo sapiens
gggagagagaaaacgtggcgca

SEQ ID NO: 7323618 - DNA, 22 bp, Homo sapiens
gggagagaagggcatgtacact

SEQ ID NO: 7323619 - DNA, 22 bp, Homo sapiens
gggagagaaattatagcaatga

SEQ ID NO: 7323620 - DNA, 22 bp, Homo sapiens
gggaggaaggcttgggtgagta

SEQ ID NO: 7323621 - DNA, 22 bp, Homo sapiens
gggaggaaagagaagtggtcca

SEQ ID NO: 7323622 - DNA, 22 bp, Homo sapiens
gggatggggagctggaaagggg

SEQ ID NO: 7323623 - DNA, 22 bp, Homo sapiens
gggatggggggaagcgtccatg

SEQ ID NO: 7323624 - DNA, 22 bp, Homo sapiens
gggaggacggtccagggcaaag

SEQ ID NO: 7323625 - DNA, 19 bp, Homo sapiens
gggcatggatgagcttacc

SEQ ID NO: 7323626 - DNA, 22 bp, Homo sapiens
gggcaggctgagcatgtcacct

SEQ ID NO: 7323627 - DNA, 22 bp, Homo sapiens
gggcaggagagaacagtcatgg

SEQ ID NO: 7323628 - DNA, 22 bp, Homo sapiens
gggcaggagagggccacctgga

SEQ ID NO: 7323629 - DNA, 22 bp, Homo sapiens
gaaggaaaacagatctgcctga

SEQ ID NO: 7323630 - DNA, 22 bp, Homo sapiens
gaaggaaaaatactctgtaagg

SEQ ID NO: 7323631 - DNA, 22 bp, Homo sapiens
gaaggaaatctgtgatttatgc

SEQ ID NO: 7323632 - DNA, 22 bp, Homo sapiens
gaaggaaaggtctcatgccttt

SEQ ID NO: 7323633 - DNA, 22 bp, Homo sapiens
gacaagcaggctcctgaagaaa

SEQ ID NO: 7323634 - DNA, 22 bp, Homo sapiens
gaatatcccgctatgcaaagta

SEQ ID NO: 7323635 - DNA, 22 bp, Homo sapiens
gaatatcccgctatgcaaagta

SEQ ID NO: 7323636 - DNA, 22 bp, Homo sapiens
gacaaggcagaaagcttaaagg

SEQ ID NO: 7323637 - DNA, 22 bp, Homo sapiens
gacaagtcatctggggcctgtg

SEQ ID NO: 7323638 - DNA, 22 bp, Homo sapiens
ctttcatttgataagaatgcca

SEQ ID NO: 7323639 - DNA, 22 bp, Homo sapiens
ctttcatccgcagatgagcctc

SEQ ID NO: 7323640 - DNA, 22 bp, Homo sapiens
gaacagtgaactgatttgtaaa

SEQ ID NO: 7323641 - DNA, 22 bp, Homo sapiens
gaaatcattagcaaagatatgt

SEQ ID NO: 7323642 - DNA, 22 bp, Homo sapiens
gaagccaggggcctgacaggca

SEQ ID NO: 7323643 - DNA, 22 bp, Homo sapiens
gaagatttttcttaatgctccg

SEQ ID NO: 7323644 - DNA, 22 bp, Homo sapiens
gaagccagccttgtctgcctct

SEQ ID NO: 7323645 - DNA, 22 bp, Homo sapiens
gaagatgttatggagagctcag

SEQ ID NO: 7323646 - DNA, 22 bp, Homo sapiens
gaagattgaaggctgggaatta

SEQ ID NO: 7323647 - DNA, 22 bp, Homo sapiens
gaagagcttagacagaatcaaa

SEQ ID NO: 7323648 - DNA, 22 bp, Homo sapiens
gaagagctgtgattcaggctta

SEQ ID NO: 7323649 - DNA, 22 bp, Homo sapiens
gaagagctgtcagaaaagctaa

SEQ ID NO: 7323650 - DNA, 22 bp, Homo sapiens
gaagagctgctcagaacatgat

SEQ ID NO: 7323651 - DNA, 22 bp, Homo sapiens
gaagaggactgtggcatcctag

SEQ ID NO: 7323652 - DNA, 22 bp, Homo sapiens
gaagaggatgacaggagccggt

SEQ ID NO: 7323653 - DNA, 22 bp, Homo sapiens
gaagagctatgtccagggagca

SEQ ID NO: 7323654 - DNA, 22 bp, Homo sapiens
gagacaatttctaagatgcttc

SEQ ID NO: 7323655 - DNA, 22 bp, Homo sapiens
gagacacaaacacatttagagg

SEQ ID NO: 7323656 - DNA, 22 bp, Homo sapiens
gagagggagccagccaggaacc

SEQ ID NO: 7323657 - DNA, 22 bp, Homo sapiens
gagaagggcttgggagtcaaca

SEQ ID NO: 7323658 - DNA, 22 bp, Homo sapiens
gagaaggcttcttttcctctga

SEQ ID NO: 7323659 - DNA, 22 bp, Homo sapiens
gagaaggagctcaaatatggct

SEQ ID NO: 7323660 - DNA, 22 bp, Homo sapiens
gagaaggagtagctgacctggg

SEQ ID NO: 7323661 - DNA, 17 bp, Homo sapiens
gacctcaggtgatctgc

SEQ ID NO: 7323662 - DNA, 22 bp, Homo sapiens
gacctcaggtttgtaatggaca

SEQ ID NO: 7323663 - DNA, 22 bp, Homo sapiens
gacctcaggcttctgtaattaa

SEQ ID NO: 7323664 - DNA, 22 bp, Homo sapiens
gacctcagctgtggggatgctg

SEQ ID NO: 7323665 - DNA, 22 bp, Homo sapiens
gacctcagtgaatggtcatgta

SEQ ID NO: 7323666 - DNA, 22 bp, Homo sapiens
gacctcatgatccacctgcctt

SEQ ID NO: 7323667 - DNA, 22 bp, Homo sapiens
gacctcgtgatccgccctcctt

SEQ ID NO: 7323668 - DNA, 22 bp, Homo sapiens
gagccagagatccaggatggct

SEQ ID NO: 7323669 - DNA, 22 bp, Homo sapiens
gagccagaaaagctgcctgact

SEQ ID NO: 7323670 - DNA, 22 bp, Homo sapiens
gagccagggctgtgagctgagc

SEQ ID NO: 7323671 - DNA, 22 bp, Homo sapiens
gagccagggtttgaaactagac

SEQ ID NO: 7323672 - DNA, 22 bp, Homo sapiens
gagccaggggtcagctccgagg

SEQ ID NO: 7323673 - DNA, 16 bp, Homo sapiens
gagccaggtgccttga

SEQ ID NO: 7323674 - DNA, 22 bp, Homo sapiens
gagccaggtcgggccgcggcga

SEQ ID NO: 7323675 - DNA, 22 bp, Homo sapiens
gagccaggttggaggctgcagt

SEQ ID NO: 7323676 - DNA, 22 bp, Homo sapiens
gagccaaatgtgcagacattgt

SEQ ID NO: 7323677 - DNA, 22 bp, Homo sapiens
gagccaccatgtctcacgcgct

SEQ ID NO: 7323678 - DNA, 22 bp, Homo sapiens
gagcagcctgaggagcgtgggc

SEQ ID NO: 7323679 - DNA, 22 bp, Homo sapiens
gagattggcctggcttgccaac

SEQ ID NO: 7323680 - DNA, 20 bp, Homo sapiens
gagatggacagatgaagggg

SEQ ID NO: 7323681 - DNA, 22 bp, Homo sapiens
gagatggaatctgtgtggaggg

SEQ ID NO: 7323682 - DNA, 22 bp, Homo sapiens
gagcttaaaacatagccagact

SEQ ID NO: 7323683 - DNA, 23 bp, Homo sapiens
gagctgtttgtgcagagagccct

SEQ ID NO: 7323684 - DNA, 22 bp, Homo sapiens
gagctgttaagagggagtgaca

SEQ ID NO: 7323685 - DNA, 18 bp, Homo sapiens
gagctgagaagaggatgc

SEQ ID NO: 7323686 - DNA, 22 bp, Homo sapiens
gagctacaagggagactttttt

SEQ ID NO: 7323687 - DNA, 20 bp, Homo sapiens
gagctacacaaatgctgctt

SEQ ID NO: 7323688 - DNA, 22 bp, Homo sapiens
gagctacactgattcatttgtt

SEQ ID NO: 7323689 - DNA, 22 bp, Homo sapiens
gagctacagagtttggtgttca

SEQ ID NO: 7323690 - DNA, 22 bp, Homo sapiens
gagctacaggcagctgagccct

SEQ ID NO: 7323691 - DNA, 22 bp, Homo sapiens
gagctctgactgctgggtgaca

SEQ ID NO: 7323692 - DNA, 22 bp, Homo sapiens
gagctctgatgtttagtggaga

SEQ ID NO: 7323693 - DNA, 22 bp, Homo sapiens
gagctctgtgtggcttgggtgg

SEQ ID NO: 7323694 - DNA, 22 bp, Homo sapiens
gaggagcttgaggctaggagcc

SEQ ID NO: 7323695 - DNA, 22 bp, Homo sapiens
gaggagcctggccccacatcca

SEQ ID NO: 7323696 - DNA, 18 bp, Homo sapiens
gaggagccgtccctacta

SEQ ID NO: 7323697 - DNA, 22 bp, Homo sapiens
gaggagccctgttccccaggcc

SEQ ID NO: 7323698 - DNA, 19 bp, Homo sapiens
gaggaggaaaactagtgta

SEQ ID NO: 7323699 - DNA, 22 bp, Homo sapiens
gaggaggaagttctctgtaggc

SEQ ID NO: 7323700 - DNA, 22 bp, Homo sapiens
gaggaggcactagttagtgaca

SEQ ID NO: 7323701 - DNA, 22 bp, Homo sapiens
gaggaggcacttgagcagatgt

SEQ ID NO: 7323702 - DNA, 22 bp, Homo sapiens
gaggaggcacttgagcagatgt

SEQ ID NO: 7323703 - DNA, 22 bp, Homo sapiens
gaggaggcagcctatcccttag

SEQ ID NO: 7323704 - DNA, 22 bp, Homo sapiens
gaggaggccagtggaaggaagc

SEQ ID NO: 7323705 - DNA, 22 bp, Homo sapiens
gaggaggccagtggaaggaagc

SEQ ID NO: 7323706 - DNA, 22 bp, Homo sapiens
gaggaggctaagtgggctctgg

SEQ ID NO: 7323707 - DNA, 19 bp, Homo sapiens
gaggcaaggagtttaagcc

SEQ ID NO: 7323708 - DNA, 22 bp, Homo sapiens
gaggcaagcccagtgggtctaa

SEQ ID NO: 7323709 - DNA, 22 bp, Homo sapiens
gaggaggctatcagcaatcagg

SEQ ID NO: 7323710 - DNA, 22 bp, Homo sapiens
gaggcagaggttgcagtgagct

SEQ ID NO: 7323711 - DNA, 22 bp, Homo sapiens
gaggcagaggaaggtggtctct

SEQ ID NO: 7323712 - DNA, 22 bp, Homo sapiens
gaggcagaagttgcagtgagca

SEQ ID NO: 7323713 - DNA, 22 bp, Homo sapiens
gaggcagagaccttcaggacct

SEQ ID NO: 7323714 - DNA, 22 bp, Homo sapiens
ctgggaggcagtctctctagaa

SEQ ID NO: 7323715 - DNA, 22 bp, Homo sapiens
ctgggaacaggcactgctgtca

SEQ ID NO: 7323716 - DNA, 22 bp, Homo sapiens
ctgggctgctgtccactagggt

SEQ ID NO: 7323717 - DNA, 19 bp, Homo sapiens
ctgggccagagctgtcctc

SEQ ID NO: 7323718 - DNA, 22 bp, Homo sapiens
ctgggtctggctactgcttcct

SEQ ID NO: 7323719 - DNA, 23 bp, Homo sapiens
ctggccctggctctgtgatcatg

SEQ ID NO: 7323720 - DNA, 22 bp, Homo sapiens
ctggccctattccaggccttcc

SEQ ID NO: 7323721 - DNA, 22 bp, Homo sapiens
ctggccctcagactcatgggca

SEQ ID NO: 7323722 - DNA, 22 bp, Homo sapiens
ctgccagaagagaacaccagtt

SEQ ID NO: 7323723 - DNA, 22 bp, Homo sapiens
ctgccagagatctgggcagagt

SEQ ID NO: 7323724 - DNA, 22 bp, Homo sapiens
ctgccagagatttggtgaacaa

SEQ ID NO: 7323725 - DNA, 22 bp, Homo sapiens
cttatatttgtcaactttacaa

SEQ ID NO: 7323726 - DNA, 22 bp, Homo sapiens
ctgttgttcatcatctgtcatt

SEQ ID NO: 7323727 - DNA, 22 bp, Homo sapiens
cttatttaatgagggttagaat

SEQ ID NO: 7323728 - DNA, 22 bp, Homo sapiens
cttatttatgtctgtctctaat

SEQ ID NO: 7323729 - DNA, 22 bp, Homo sapiens
cttatttactgatccacagatg

SEQ ID NO: 7323730 - DNA, 22 bp, Homo sapiens
cttcaaaagccagaagcctgcg

SEQ ID NO: 7323731 - DNA, 22 bp, Homo sapiens
cttcagaaccagccagaagagg

SEQ ID NO: 7323732 - DNA, 22 bp, Homo sapiens
cttcagaagagttaagtgtgag

SEQ ID NO: 7323733 - DNA, 22 bp, Homo sapiens
cttcaggaaaatctctaaggat

SEQ ID NO: 7323734 - DNA, 22 bp, Homo sapiens
cttcaggaaaatctctaaggat

SEQ ID NO: 7323735 - DNA, 22 bp, Homo sapiens
cttcaggattaatttggggcct

SEQ ID NO: 7323736 - DNA, 22 bp, Homo sapiens
cttgtcaggtaggtgtcatttc

SEQ ID NO: 7323737 - DNA, 22 bp, Homo sapiens
ctttatgtccaccagactgcaa

SEQ ID NO: 7323738 - DNA, 22 bp, Homo sapiens
cttgtcttgcacacggttgcca

SEQ ID NO: 7323739 - DNA, 22 bp, Homo sapiens
cttgtagacccctggactcacg

SEQ ID NO: 7323740 - DNA, 22 bp, Homo sapiens
cttgccagtgttgcagaagctc

SEQ ID NO: 7323741 - DNA, 22 bp, Homo sapiens
cttcctgctcccctgccaattc

SEQ ID NO: 7323742 - DNA, 22 bp, Homo sapiens
cttcctgcaacacctgtgttgc

SEQ ID NO: 7323743 - DNA, 22 bp, Homo sapiens
cttcctgcatggagtctgaatg

SEQ ID NO: 7323744 - DNA, 22 bp, Homo sapiens
cttcctgcattgtgccagagtt

SEQ ID NO: 7323745 - DNA, 22 bp, Homo sapiens
ctgtgtcctgcgtcaagccaat

SEQ ID NO: 7323746 - DNA, 22 bp, Homo sapiens
ctgtgtccttttagttgctgtg

SEQ ID NO: 7323747 - DNA, 22 bp, Homo sapiens
ctgtggtggcctccctgccatg

SEQ ID NO: 7323748 - DNA, 22 bp, Homo sapiens
ctgtggctgtatttggccagag

SEQ ID NO: 7323749 - DNA, 22 bp, Homo sapiens
ctgttaattgtgaattttacat

SEQ ID NO: 7323750 - DNA, 22 bp, Homo sapiens
ctgtgtcttcctctgcccaggc

SEQ ID NO: 7323751 - DNA, 22 bp, Homo sapiens
ctgggtgattcctgtccaggca

SEQ ID NO: 7323752 - DNA, 22 bp, Homo sapiens
ctgtcctctgtcctcagcagga

SEQ ID NO: 7323753 - DNA, 22 bp, Homo sapiens
ctgtcctgcccaccctgcaggg

SEQ ID NO: 7323754 - DNA, 22 bp, Homo sapiens
ctgtggccagatggtgccagtt

SEQ ID NO: 7323755 - DNA, 22 bp, Homo sapiens
cctttctacagatgcctcttgc

SEQ ID NO: 7323756 - DNA, 22 bp, Homo sapiens
cctttctctatcgacccatcgc

SEQ ID NO: 7323757 - DNA, 22 bp, Homo sapiens
cctttctcattttaagcattag

SEQ ID NO: 7323758 - DNA, 22 bp, Homo sapiens
cctttctcttggataccgattg

SEQ ID NO: 7323759 - DNA, 16 bp, Homo sapiens
cctttctctgccttcc

SEQ ID NO: 7323760 - DNA, 22 bp, Homo sapiens
cctttctctggcagcaggacag

SEQ ID NO: 7323761 - DNA, 17 bp, Homo sapiens
cctttctctttcatctc

SEQ ID NO: 7323762 - DNA, 22 bp, Homo sapiens
cctttctctttgctgatcatgt

SEQ ID NO: 7323763 - DNA, 22 bp, Homo sapiens
ttaggaggtctatggacatcct

SEQ ID NO: 7323764 - DNA, 22 bp, Homo sapiens
ttaggctgggctacaacaactg

SEQ ID NO: 7323765 - DNA, 22 bp, Homo sapiens
ttcacacacagcttcctattgt

SEQ ID NO: 7323766 - DNA, 22 bp, Homo sapiens
ttcacacagcaactgtatgaat

SEQ ID NO: 7323767 - DNA, 22 bp, Homo sapiens
ttcacacagaatctgaggagct

SEQ ID NO: 7323768 - DNA, 22 bp, Homo sapiens
ttcaaattaccacatttgctta

SEQ ID NO: 7323769 - DNA, 22 bp, Homo sapiens
cgccctccacacagcccctggc

SEQ ID NO: 7323770 - DNA, 22 bp, Homo sapiens
cgccccctcggccacctgcggg

SEQ ID NO: 7323771 - DNA, 22 bp, Homo sapiens
cgcccctcagcgacccaccagc

SEQ ID NO: 7323772 - DNA, 20 bp, Homo sapiens
ttcagagtcagcaaatgcag

SEQ ID NO: 7323773 - DNA, 22 bp, Homo sapiens
ttcagaggttagagcagtggga

SEQ ID NO: 7323774 - DNA, 20 bp, Homo sapiens
ttcagaggtgaagttgtggt

SEQ ID NO: 7323775 - DNA, 22 bp, Homo sapiens
ttcagaggtaagggtctcagaa

SEQ ID NO: 7323776 - DNA, 22 bp, Homo sapiens
ttcagaggctgtatgactagat

SEQ ID NO: 7323777 - DNA, 22 bp, Homo sapiens
ttcagaggacaaccagccatct

SEQ ID NO: 7323778 - DNA, 22 bp, Homo sapiens
ttcacacttgttaggatggctt

SEQ ID NO: 7323779 - DNA, 22 bp, Homo sapiens
ctaaagaagctagcaatctata

SEQ ID NO: 7323780 - DNA, 22 bp, Homo sapiens
ctaaagaattttgcttgaccag

SEQ ID NO: 7323781 - DNA, 22 bp, Homo sapiens
ttctctggactatttgcactcc

SEQ ID NO: 7323782 - DNA, 22 bp, Homo sapiens
ctactttacctccatcagactg

SEQ ID NO: 7323783 - DNA, 21 bp, Homo sapiens
ctacttaagtaggggattagg

SEQ ID NO: 7323784 - DNA, 22 bp, Homo sapiens
ctacatttcatccagggagagc

SEQ ID NO: 7323785 - DNA, 22 bp, Homo sapiens
ctactgaaactcagaaattcaa

SEQ ID NO: 7323786 - DNA, 22 bp, Homo sapiens
ctactgaagataactggctctt

SEQ ID NO: 7323787 - DNA, 22 bp, Homo sapiens
ctactgaattagactgcatttt

SEQ ID NO: 7323788 - DNA, 21 bp, Homo sapiens
ctacagaggagagggaaaggc

SEQ ID NO: 7323789 - DNA, 22 bp, Homo sapiens
ctacagaggacacaaagatctt

SEQ ID NO: 7323790 - DNA, 22 bp, Homo sapiens
ttccaggactcgttctggctca

SEQ ID NO: 7323791 - DNA, 22 bp, Homo sapiens
ctacagagtgaatgcagaaaat

SEQ ID NO: 7323792 - DNA, 22 bp, Homo sapiens
ctacagctgtaaaaggaatgtc

SEQ ID NO: 7323793 - DNA, 22 bp, Homo sapiens
ctagccagactcaagggccacc

SEQ ID NO: 7323794 - DNA, 22 bp, Homo sapiens
ctattaaacactactgtgcact

SEQ ID NO: 7323795 - DNA, 22 bp, Homo sapiens
ctattaaatactcttcaaattg

SEQ ID NO: 7323796 - DNA, 22 bp, Homo sapiens
ctcacagcaaggaggtaaggta

SEQ ID NO: 7323797 - DNA, 22 bp, Homo sapiens
ctcacagcagctctgcgagata

SEQ ID NO: 7323798 - DNA, 22 bp, Homo sapiens
ctcacagcagccagtctgcctt

SEQ ID NO: 7323799 - DNA, 22 bp, Homo sapiens
ctcacagcacttgtgtcattgg

SEQ ID NO: 7323800 - DNA, 22 bp, Homo sapiens
ctcacagcatggaattttctgg

SEQ ID NO: 7323801 - DNA, 22 bp, Homo sapiens
ctcacagctgcttcaggatcca

SEQ ID NO: 7323802 - DNA, 22 bp, Homo sapiens
ctattattatgttaactggact

SEQ ID NO: 7323803 - DNA, 22 bp, Homo sapiens
cctgggctgttgcatcatcctt

SEQ ID NO: 7323804 - DNA, 22 bp, Homo sapiens
cctggtttaatgctcactgttg

SEQ ID NO: 7323805 - DNA, 22 bp, Homo sapiens
cctggtttatgccagatcctgt

SEQ ID NO: 7323806 - DNA, 22 bp, Homo sapiens
cctgggtgtcatgggcagctgg

SEQ ID NO: 7323807 - DNA, 22 bp, Homo sapiens
tgtgtattaatgtttgtatatg

SEQ ID NO: 7323808 - DNA, 22 bp, Homo sapiens
tgtgtatgtctgtatgcacaca

SEQ ID NO: 7323809 - DNA, 20 bp, Homo sapiens
tgtgtatgtgcacatgcgaa

SEQ ID NO: 7323810 - DNA, 22 bp, Homo sapiens
tgtgtatgtgtatacactatat

SEQ ID NO: 7323811 - DNA, 22 bp, Homo sapiens
tgtgtatgcatacacacataga

SEQ ID NO: 7323812 - DNA, 23 bp, Homo sapiens
tgtgtatgtatctatgcataggt

SEQ ID NO: 7323813 - DNA, 22 bp, Homo sapiens
tgtgtatgtaagcatgtgcata

SEQ ID NO: 7323814 - DNA, 21 bp, Homo sapiens
tgggggagaattggttgcttt

SEQ ID NO: 7323815 - DNA, 22 bp, Homo sapiens
cctgtctctgcagggccctgcc

SEQ ID NO: 7323816 - DNA, 22 bp, Homo sapiens
cctgtctctgttaccacatttg

SEQ ID NO: 7323817 - DNA, 22 bp, Homo sapiens
cctgtctctttcaatctgagag

SEQ ID NO: 7323818 - DNA, 19 bp, Homo sapiens
cctgtctgtcttcagctag

SEQ ID NO: 7323819 - DNA, 22 bp, Homo sapiens
cctgtgccatcctgagcatccc

SEQ ID NO: 7323820 - DNA, 17 bp, Homo sapiens
cctgtcttgtttctgcc

SEQ ID NO: 7323821 - DNA, 22 bp, Homo sapiens
cctgtgccttccttaggcacct

SEQ ID NO: 7323822 - DNA, 21 bp, Homo sapiens
ttacttttgcaccaacctaat

SEQ ID NO: 7323823 - DNA, 22 bp, Homo sapiens
ttacttttgcaccaaactaata

SEQ ID NO: 7323824 - DNA, 21 bp, Homo sapiens
ttacttttgcagcaacctaat

SEQ ID NO: 7323825 - DNA, 23 bp, Homo sapiens
ttacttttgcaccaacctaatat

SEQ ID NO: 7323826 - DNA, 22 bp, Homo sapiens
ttagaatttctgctcactttga

SEQ ID NO: 7323827 - DNA, 22 bp, Homo sapiens
ttagaatctaacattcttatct

SEQ ID NO: 7323828 - DNA, 22 bp, Homo sapiens
cctgtgtgtctgtcactgcaca

SEQ ID NO: 7323829 - DNA, 22 bp, Homo sapiens
tttcacagtagaaatcattatg

SEQ ID NO: 7323830 - DNA, 22 bp, Homo sapiens
ctcctccacagagtccttgcca

SEQ ID NO: 7323831 - DNA, 22 bp, Homo sapiens
tttagacatggcttgctcactt

SEQ ID NO: 7323832 - DNA, 17 bp, Homo sapiens
ctcctggcagcctcagg

SEQ ID NO: 7323833 - DNA, 22 bp, Homo sapiens
ctcctggcaggctgagtgaaat

SEQ ID NO: 7323834 - DNA, 22 bp, Homo sapiens
ctcctggcactgtcttgaccca

SEQ ID NO: 7323835 - DNA, 17 bp, Homo sapiens
ctcctggcagcctcagg

SEQ ID NO: 7323836 - DNA, 22 bp, Homo sapiens
ctcctggccacgttcttgctgg

SEQ ID NO: 7323837 - DNA, 22 bp, Homo sapiens
ctcctggccccagatcccaatc

SEQ ID NO: 7323838 - DNA, 22 bp, Homo sapiens
ctcctggccctgagctcccagg

SEQ ID NO: 7323839 - DNA, 22 bp, Homo sapiens
ctcctggcagttccccttgtca

SEQ ID NO: 7323840 - DNA, 17 bp, Homo sapiens
ctcctggccacccctct

SEQ ID NO: 7323841 - DNA, 22 bp, Homo sapiens
ctcctggcactcagtgtggaag

SEQ ID NO: 7323842 - DNA, 16 bp, Homo sapiens
tttatttactagtgtt

SEQ ID NO: 7323843 - DNA, 22 bp, Homo sapiens
tttatttaaagtcgtgtgttaa

SEQ ID NO: 7323844 - DNA, 22 bp, Homo sapiens
tttatttaaagtcgtgtgttaa

SEQ ID NO: 7323845 - DNA, 22 bp, Homo sapiens
tttatttaccttatgtcctcca

SEQ ID NO: 7323846 - DNA, 22 bp, Homo sapiens
ctcctccagtgggtccctcagg

SEQ ID NO: 7323847 - DNA, 22 bp, Homo sapiens
tttattgttgttagtcataagt

SEQ ID NO: 7323848 - DNA, 22 bp, Homo sapiens
tttattgttgggtcttaagctg

SEQ ID NO: 7323849 - DNA, 22 bp, Homo sapiens
ctcatttactcatctgcaaaac

SEQ ID NO: 7323850 - DNA, 22 bp, Homo sapiens
ctcatttacctttgcaatcaag

SEQ ID NO: 7323851 - DNA, 22 bp, Homo sapiens
ctcatttaacagattaaaaagt

SEQ ID NO: 7323852 - DNA, 22 bp, Homo sapiens
ctcatttaacagattaaaaagt

SEQ ID NO: 7323853 - DNA, 22 bp, Homo sapiens
ctcatttatttctcccaaaaca

SEQ ID NO: 7323854 - DNA, 22 bp, Homo sapiens
ctcatttatgtaatgattaagg

SEQ ID NO: 7323855 - DNA, 22 bp, Homo sapiens
ctccaaaggataaaagcagagt

SEQ ID NO: 7323856 - DNA, 22 bp, Homo sapiens
ctcatctgtatatagtgaatga

SEQ ID NO: 7323857 - DNA, 18 bp, Homo sapiens
ttcttttcatgtgatctc

SEQ ID NO: 7323858 - DNA, 22 bp, Homo sapiens
ttcttttcctgtggctcatcca

SEQ ID NO: 7323859 - DNA, 19 bp, Homo sapiens
ctccacagggattgtgatt

SEQ ID NO: 7323860 - DNA, 22 bp, Homo sapiens
ctccacagagatgctgattgta

SEQ ID NO: 7323861 - DNA, 22 bp, Homo sapiens
tttaatattctgcattctcctt

SEQ ID NO: 7323862 - DNA, 22 bp, Homo sapiens
tttaatatttctttcctgaagc

SEQ ID NO: 7323863 - DNA, 22 bp, Homo sapiens
ttgtctgtcccagcttgtgcat

SEQ ID NO: 7323864 - DNA, 22 bp, Homo sapiens
tttgtacacaggatgttataat

SEQ ID NO: 7323865 - DNA, 22 bp, Homo sapiens
tttgtacatataaatcttgtat

SEQ ID NO: 7323866 - DNA, 22 bp, Homo sapiens
ttttagacttgtatgtaaagcc

SEQ ID NO: 7323867 - DNA, 22 bp, Homo sapiens
ttttcagaaagatgagaaatta

SEQ ID NO: 7323868 - DNA, 22 bp, Homo sapiens
ctcttcagcctatttgagtgca

SEQ ID NO: 7323869 - DNA, 22 bp, Homo sapiens
ctctgttacagccccctgcctc

SEQ ID NO: 7323870 - DNA, 22 bp, Homo sapiens
ctcttattttatggcatttgtg

SEQ ID NO: 7323871 - DNA, 19 bp, Homo sapiens
ctctgccatttgctgcctg

SEQ ID NO: 7323872 - DNA, 22 bp, Homo sapiens
ctctgccagtttctggcctcag

SEQ ID NO: 7323873 - DNA, 22 bp, Homo sapiens
ctctgccaccatgcttcctgac

SEQ ID NO: 7323874 - DNA, 22 bp, Homo sapiens
ctgaggccagaacccgaccctg

SEQ ID NO: 7323875 - DNA, 22 bp, Homo sapiens
ctgaggcccctcttgtgagcat

SEQ ID NO: 7323876 - DNA, 22 bp, Homo sapiens
ctgaggcccctctcttgagctt

SEQ ID NO: 7323877 - DNA, 19 bp, Homo sapiens
ctgaggcccatgtaccatg

SEQ ID NO: 7323878 - DNA, 20 bp, Homo sapiens
ctgagcccagatcccaggtc

SEQ ID NO: 7323879 - DNA, 20 bp, Homo sapiens
ctgagcccccagcctgcagg

SEQ ID NO: 7323880 - DNA, 22 bp, Homo sapiens
ctgagcccctctgacctcagag

SEQ ID NO: 7323881 - DNA, 17 bp, Homo sapiens
ctctttataaagagtta

SEQ ID NO: 7323882 - DNA, 21 bp, Homo sapiens
ctctttatatagtaaagatat

SEQ ID NO: 7323883 - DNA, 21 bp, Homo sapiens
ctctttatatagtaaagatat

SEQ ID NO: 7323884 - DNA, 21 bp, Homo sapiens
ctctttatatagtaaagatat

SEQ ID NO: 7323885 - DNA, 22 bp, Homo sapiens
ctgaccagaccccaggaggctg

SEQ ID NO: 7323886 - DNA, 22 bp, Homo sapiens
ctgaatattagtcatgtctgat

SEQ ID NO: 7323887 - DNA, 22 bp, Homo sapiens
tcttcccattagtaatgaagtg

SEQ ID NO: 7323888 - DNA, 22 bp, Homo sapiens
ccaggccagcctggagcatggc

SEQ ID NO: 7323889 - DNA, 22 bp, Homo sapiens
ccaggccagcaggcacacctgc

SEQ ID NO: 7323890 - DNA, 22 bp, Homo sapiens
tcttcagaagatcacatcagtg

SEQ ID NO: 7323891 - DNA, 22 bp, Homo sapiens
tcttcagagcatttctgaggta

SEQ ID NO: 7323892 - DNA, 22 bp, Homo sapiens
tcttcacatggagaagcaactc

SEQ ID NO: 7323893 - DNA, 22 bp, Homo sapiens
tcttcacattcacgtaacatag

SEQ ID NO: 7323894 - DNA, 22 bp, Homo sapiens
tcttcacattttaagaagttct

SEQ ID NO: 7323895 - DNA, 22 bp, Homo sapiens
ccaggagtctggatgaggtgtc

SEQ ID NO: 7323896 - DNA, 22 bp, Homo sapiens
ccaggctgctgttggtgtccgc

SEQ ID NO: 7323897 - DNA, 22 bp, Homo sapiens
ccaggctgagcatgattggagc

SEQ ID NO: 7323898 - DNA, 22 bp, Homo sapiens
ccaggacatgttgcaagtttat

SEQ ID NO: 7323899 - DNA, 22 bp, Homo sapiens
ccaggacagggagacgggagcc

SEQ ID NO: 7323900 - DNA, 22 bp, Homo sapiens
tctggctcacttcaggcttcac

SEQ ID NO: 7323901 - DNA, 22 bp, Homo sapiens
ccaggacacgatttttagtctg

SEQ ID NO: 7323902 - DNA, 22 bp, Homo sapiens
ccaggaaggatcgtttgggagt

SEQ ID NO: 7323903 - DNA, 22 bp, Homo sapiens
ccagctctcagcgggagactca

SEQ ID NO: 7323904 - DNA, 22 bp, Homo sapiens
ccagctctcagcgggagactca

SEQ ID NO: 7323905 - DNA, 22 bp, Homo sapiens
tctggaaagatcattaaatcca

SEQ ID NO: 7323906 - DNA, 22 bp, Homo sapiens
tgacaagctttacagaattgaa

SEQ ID NO: 7323907 - DNA, 22 bp, Homo sapiens
tgacatcagaatggcatagaaa

SEQ ID NO: 7323908 - DNA, 22 bp, Homo sapiens
tgacatcattagtaacatagct

SEQ ID NO: 7323909 - DNA, 22 bp, Homo sapiens
ccaggctggagtgtagtcgcat

SEQ ID NO: 7323910 - DNA, 20 bp, Homo sapiens
ccaggctggcaaatgggggc

SEQ ID NO: 7323911 - DNA, 22 bp, Homo sapiens
ccaggctggagtgcagtagtgt

SEQ ID NO: 7323912 - DNA, 22 bp, Homo sapiens
tgacaacagccatcacttttag

SEQ ID NO: 7323913 - DNA, 22 bp, Homo sapiens
ccaggtggacggcgagtacagg

SEQ ID NO: 7323914 - DNA, 22 bp, Homo sapiens
tgagacatgctgtccaagaagt

SEQ ID NO: 7323915 - DNA, 22 bp, Homo sapiens
tgagacatcacaaaatcctcaa

SEQ ID NO: 7323916 - DNA, 22 bp, Homo sapiens
tgagacatcatggctgaaagta

SEQ ID NO: 7323917 - DNA, 22 bp, Homo sapiens
tgaggcagaaattcctgttttc

SEQ ID NO: 7323918 - DNA, 22 bp, Homo sapiens
tgaggcagagtaagatacatga

SEQ ID NO: 7323919 - DNA, 22 bp, Homo sapiens
tgaggcagcaattgattattca

SEQ ID NO: 7323920 - DNA, 22 bp, Homo sapiens
tgaggcagcaattgtattgtat

SEQ ID NO: 7323921 - DNA, 22 bp, Homo sapiens
tgaggcagatatttattgggtt

SEQ ID NO: 7323922 - DNA, 19 bp, Homo sapiens
ccaggtggaactgaggtag

SEQ ID NO: 7323923 - DNA, 22 bp, Homo sapiens
tgaggtaggttgaaagatagat

SEQ ID NO: 7323924 - DNA, 22 bp, Homo sapiens
tgaggtaggtgtcgagagaggt

SEQ ID NO: 7323925 - DNA, 22 bp, Homo sapiens
tgaggtagggaaggctggtatt

SEQ ID NO: 7323926 - DNA, 22 bp, Homo sapiens
tgaggtaggcttgagatgggag

SEQ ID NO: 7323927 - DNA, 22 bp, Homo sapiens
tgaggtagtgtttagtccagtc

SEQ ID NO: 7323928 - DNA, 22 bp, Homo sapiens
tgaggtagtaaaggtgttagtt

SEQ ID NO: 7323929 - DNA, 22 bp, Homo sapiens
tgaggtagtgattgtagaagtg

SEQ ID NO: 7323930 - DNA, 22 bp, Homo sapiens
tgaggcagcattcttcaagaca

SEQ ID NO: 7323931 - DNA, 22 bp, Homo sapiens
tgaggcagcccactttccttag

SEQ ID NO: 7323932 - DNA, 22 bp, Homo sapiens
tgaggcagcctgcattaaagag

SEQ ID NO: 7323933 - DNA, 22 bp, Homo sapiens
tgcaaagggctttgcatacaga

SEQ ID NO: 7323934 - DNA, 22 bp, Homo sapiens
tgcaaagggctttgcatacaga

SEQ ID NO: 7323935 - DNA, 22 bp, Homo sapiens
tgcaaaggaggccaaaccaagt

SEQ ID NO: 7323936 - DNA, 22 bp, Homo sapiens
tgcaaaggaggccaaaccaagt

SEQ ID NO: 7323937 - DNA, 22 bp, Homo sapiens
cccagacattgcagggactggt

SEQ ID NO: 7323938 - DNA, 22 bp, Homo sapiens
cccagacataacagcagagagg

SEQ ID NO: 7323939 - DNA, 22 bp, Homo sapiens
cccagacagtcaagaggcctgc

SEQ ID NO: 7323940 - DNA, 22 bp, Homo sapiens
cccagacagtgatttacttaat

SEQ ID NO: 7323941 - DNA, 22 bp, Homo sapiens
ccctctctcaggctgacagcct

SEQ ID NO: 7323942 - DNA, 22 bp, Homo sapiens
tgctgtgtaaaaggtgattgaa

SEQ ID NO: 7323943 - DNA, 22 bp, Homo sapiens
tgctgttagtaaggaacatgac

SEQ ID NO: 7323944 - DNA, 22 bp, Homo sapiens
tgctgtgtctttctgtgaaaag

SEQ ID NO: 7323945 - DNA, 22 bp, Homo sapiens
ccccacaggtgtctgaggcagg

SEQ ID NO: 7323946 - DNA, 22 bp, Homo sapiens
ccccacaactcatgttgaaact

SEQ ID NO: 7323947 - DNA, 22 bp, Homo sapiens
cccatttttgtgtgagtaatga

SEQ ID NO: 7323948 - DNA, 22 bp, Homo sapiens
cccagggacagctaggtggggc

SEQ ID NO: 7323949 - DNA, 22 bp, Homo sapiens
cccaggctggagggcagtgtca

SEQ ID NO: 7323950 - DNA, 22 bp, Homo sapiens
cccaggctggagtgcagtggcg

SEQ ID NO: 7323951 - DNA, 22 bp, Homo sapiens
cccagggaaggcagatggagga

SEQ ID NO: 7323952 - DNA, 22 bp, Homo sapiens
cccaggagagaggggataaagc

SEQ ID NO: 7323953 - DNA, 22 bp, Homo sapiens
cccaggctcccaggtgggacaa

SEQ ID NO: 7323954 - DNA, 22 bp, Homo sapiens
tgccctggggagcccagccagg

SEQ ID NO: 7323955 - DNA, 22 bp, Homo sapiens
cccaggcatcccattaaggagc

SEQ ID NO: 7323956 - DNA, 22 bp, Homo sapiens
tgggagtgttcttggcttgctt

SEQ ID NO: 7323957 - DNA, 22 bp, Homo sapiens
tgggagtggggcatagaaggta

SEQ ID NO: 7323958 - DNA, 19 bp, Homo sapiens
tgggagtggggaaggtcct

SEQ ID NO: 7323959 - DNA, 23 bp, Homo sapiens
tgggagtgttgggatctctgctc

SEQ ID NO: 7323960 - DNA, 22 bp, Homo sapiens
cctgagctgactctcctttcag

SEQ ID NO: 7323961 - DNA, 22 bp, Homo sapiens
tggcttcagggttgtcttcagc

SEQ ID NO: 7323962 - DNA, 22 bp, Homo sapiens
cctctggagtcagaccagcttg

SEQ ID NO: 7323963 - DNA, 19 bp, Homo sapiens
tggcagaggacaaggactt

SEQ ID NO: 7323964 - DNA, 19 bp, Homo sapiens
tggcagaggacaaggactt

SEQ ID NO: 7323965 - DNA, 22 bp, Homo sapiens
tggcagaggagaattaagatta

SEQ ID NO: 7323966 - DNA, 19 bp, Homo sapiens
tggcagaggcagtttgtac

SEQ ID NO: 7323967 - DNA, 22 bp, Homo sapiens
tggcagaggaggctcagattga

SEQ ID NO: 7323968 - DNA, 22 bp, Homo sapiens
tggcagaggctctgtgatgttg

SEQ ID NO: 7323969 - DNA, 22 bp, Homo sapiens
tggcctggggacctgtgagacc

SEQ ID NO: 7323970 - DNA, 22 bp, Homo sapiens
tggcctggctgccctgtctgga

SEQ ID NO: 7323971 - DNA, 22 bp, Homo sapiens
tggcctggggaagaccatgggc

SEQ ID NO: 7323972 - DNA, 22 bp, Homo sapiens
tggcctgggcctgccggtgcaa

SEQ ID NO: 7323973 - DNA, 19 bp, Homo sapiens
cctcatcttggtgtgtgca

SEQ ID NO: 7323974 - DNA, 22 bp, Homo sapiens
cctcatctgtcatcctagggaa

SEQ ID NO: 7323975 - DNA, 20 bp, Homo sapiens
cctcatctcaagggcagtcc

SEQ ID NO: 7323976 - DNA, 22 bp, Homo sapiens
cattgtacagttattttaaaat

SEQ ID NO: 7323977 - DNA, 22 bp, Homo sapiens
cattgtcattctatgctattca

SEQ ID NO: 7323978 - DNA, 22 bp, Homo sapiens
cattgtgtatttctgtagtact

SEQ ID NO: 7323979 - DNA, 22 bp, Homo sapiens
cattgttttgagaacaacctga

SEQ ID NO: 7323980 - DNA, 22 bp, Homo sapiens
catttacacttctaaccacaag

SEQ ID NO: 7323981 - DNA, 22 bp, Homo sapiens
catttacacacagaggtgtgct

SEQ ID NO: 7323982 - DNA, 22 bp, Homo sapiens
catttacacttctaaccacaag

SEQ ID NO: 7323983 - DNA, 22 bp, Homo sapiens
catttacaatgtacaggttgtg

SEQ ID NO: 7323984 - DNA, 22 bp, Homo sapiens
catttattctcagatccttgtc

SEQ ID NO: 7323985 - DNA, 22 bp, Homo sapiens
catttattcatgatctgtagct

SEQ ID NO: 7323986 - DNA, 22 bp, Homo sapiens
catttattcagctcagtcggtt

SEQ ID NO: 7323987 - DNA, 22 bp, Homo sapiens
tccctggggtatcgctgaggca

SEQ ID NO: 7323988 - DNA, 22 bp, Homo sapiens
tccctggggttcctccagccac

SEQ ID NO: 7323989 - DNA, 22 bp, Homo sapiens
tccctggggtaacattagaggg

SEQ ID NO: 7323990 - DNA, 18 bp, Homo sapiens
tccctggggctgccaccc

SEQ ID NO: 7323991 - DNA, 22 bp, Homo sapiens
tccctgggttcccgtggaagtg

SEQ ID NO: 7323992 - DNA, 22 bp, Homo sapiens
tccctgggtcattctctggcac

SEQ ID NO: 7323993 - DNA, 22 bp, Homo sapiens
tccctgggttacctttcaaggt

SEQ ID NO: 7323994 - DNA, 22 bp, Homo sapiens
tccctgggtcctgcttgctctc

SEQ ID NO: 7323995 - DNA, 22 bp, Homo sapiens
cattagcattacttcaaagagt

SEQ ID NO: 7323996 - DNA, 22 bp, Homo sapiens
cattcttatatttactcattca

SEQ ID NO: 7323997 - DNA, 22 bp, Homo sapiens
catgggcagaagtggcatcatt

SEQ ID NO: 7323998 - DNA, 22 bp, Homo sapiens
tcctggctccagcagctcttcc

SEQ ID NO: 7323999 - DNA, 22 bp, Homo sapiens
ccaaggctgtcattcagtagct

SEQ ID NO: 7324000 - DNA, 22 bp, Homo sapiens
tcctttatctgctcagaaagta

SEQ ID NO: 7324001 - DNA, 22 bp, Homo sapiens
tcctttatgtgagttgtttccc

SEQ ID NO: 7324002 - DNA, 22 bp, Homo sapiens
tcctttatcaaggagccttaga

SEQ ID NO: 7324003 - DNA, 22 bp, Homo sapiens
tcctgggcttcacagactctgt

SEQ ID NO: 7324004 - DNA, 22 bp, Homo sapiens
catagaaaagagtaggtaatgt

SEQ ID NO: 7324005 - DNA, 22 bp, Homo sapiens
catagaaactgagacaaggatt

SEQ ID NO: 7324006 - DNA, 22 bp, Homo sapiens
cataattactgatatgctgatt

SEQ ID NO: 7324007 - DNA, 22 bp, Homo sapiens
cataacagtggcttcagcaagt

SEQ ID NO: 7324008 - DNA, 22 bp, Homo sapiens
tcagcaggtgctttgtttactc

SEQ ID NO: 7324009 - DNA, 22 bp, Homo sapiens
tcaatcacgtgttccatgttct

SEQ ID NO: 7324010 - DNA, 22 bp, Homo sapiens
tcaatagctcagtgtggaagct

SEQ ID NO: 7324011 - DNA, 22 bp, Homo sapiens
tcagaggagctgcagaacgctg

SEQ ID NO: 7324012 - DNA, 22 bp, Homo sapiens
catctgcctaagtggccctgtt

SEQ ID NO: 7324013 - DNA, 22 bp, Homo sapiens
catctgccactctctcccacca

SEQ ID NO: 7324014 - DNA, 22 bp, Homo sapiens
catctgagggaaaacatgtagt

SEQ ID NO: 7324015 - DNA, 20 bp, Homo sapiens
catctgagcccacagaagtc

SEQ ID NO: 7324016 - DNA, 22 bp, Homo sapiens
catctgtgccgggtgtttgtca

SEQ ID NO: 7324017 - DNA, 22 bp, Homo sapiens
catctgttctatccacgttgct

SEQ ID NO: 7324018 - DNA, 22 bp, Homo sapiens
catctgttgagttctccgtgct

SEQ ID NO: 7324019 - DNA, 22 bp, Homo sapiens
tcagggattgcaaaattcatcc

SEQ ID NO: 7324020 - DNA, 22 bp, Homo sapiens
tcagtcatctctgacagctagc

SEQ ID NO: 7324021 - DNA, 22 bp, Homo sapiens
tcagggagtgttggcaggatca

SEQ ID NO: 7324022 - DNA, 22 bp, Homo sapiens
tcagtgcattgttcattgtagg

SEQ ID NO: 7324023 - DNA, 22 bp, Homo sapiens
catgactgtgttagaagaatga

SEQ ID NO: 7324024 - DNA, 22 bp, Homo sapiens
catgcaggcctatggagcagtg

SEQ ID NO: 7324025 - DNA, 22 bp, Homo sapiens
catgcagggactagagaacagg

SEQ ID NO: 7324026 - DNA, 22 bp, Homo sapiens
catgcatgccgggctgacagag

SEQ ID NO: 7324027 - DNA, 22 bp, Homo sapiens
cagggtggggctggctatcaaa

SEQ ID NO: 7324028 - DNA, 22 bp, Homo sapiens
taggaggcttaaagctgctcag

SEQ ID NO: 7324029 - DNA, 22 bp, Homo sapiens
taggaggccatccagcctgcct

SEQ ID NO: 7324030 - DNA, 22 bp, Homo sapiens
taggaggcatttgctcccaggg

SEQ ID NO: 7324031 - DNA, 22 bp, Homo sapiens
taggaggctcatgttacaggaa

SEQ ID NO: 7324032 - DNA, 22 bp, Homo sapiens
taggaggcagtcgttcttcagt

SEQ ID NO: 7324033 - DNA, 22 bp, Homo sapiens
caggtcagcacttggaggtgca

SEQ ID NO: 7324034 - DNA, 22 bp, Homo sapiens
caggtaggggagagctccaaca

SEQ ID NO: 7324035 - DNA, 22 bp, Homo sapiens
caggtagggatatgatggtgat

SEQ ID NO: 7324036 - DNA, 22 bp, Homo sapiens
caggtaggcagccggtctctgg

SEQ ID NO: 7324037 - DNA, 22 bp, Homo sapiens
caggtaggccaatgttttccaa

SEQ ID NO: 7324038 - DNA, 22 bp, Homo sapiens
caggtaggttttaggctaaaca

SEQ ID NO: 7324039 - DNA, 22 bp, Homo sapiens
caggtaggtatggtgcagtctt

SEQ ID NO: 7324040 - DNA, 22 bp, Homo sapiens
caggtaaggtcacattctgaag

SEQ ID NO: 7324041 - DNA, 22 bp, Homo sapiens
caggtaggaaaagggtgtcagg

SEQ ID NO: 7324042 - DNA, 22 bp, Homo sapiens
caggtaggaggctccctagtcc

SEQ ID NO: 7324043 - DNA, 22 bp, Homo sapiens
caggtaggatggaagggctcaa

SEQ ID NO: 7324044 - DNA, 23 bp, Homo sapiens
caggtggctccacgaggggtggg

SEQ ID NO: 7324045 - DNA, 22 bp, Homo sapiens
caggtgggtacatcacagagac

SEQ ID NO: 7324046 - DNA, 18 bp, Homo sapiens
caggtgggtctcctgccc

SEQ ID NO: 7324047 - DNA, 22 bp, Homo sapiens
tcaacaaatacttaaagcagag

SEQ ID NO: 7324048 - DNA, 23 bp, Homo sapiens
tcaagcaataattggtaatagtg

SEQ ID NO: 7324049 - DNA, 22 bp, Homo sapiens
tcaagcagcagatcaagagcta

SEQ ID NO: 7324050 - DNA, 19 bp, Homo sapiens
tcaaaacacaaatggttga

SEQ ID NO: 7324051 - DNA, 22 bp, Homo sapiens
tcaaaacactattacctttaat

SEQ ID NO: 7324052 - DNA, 22 bp, Homo sapiens
tcaaaacaatcattggatgtgc

SEQ ID NO: 7324053 - DNA, 22 bp, Homo sapiens
cagtcattatgggagttaatcc

SEQ ID NO: 7324054 - DNA, 22 bp, Homo sapiens
cagtcaggggtgggatcaaggc

SEQ ID NO: 7324055 - DNA, 22 bp, Homo sapiens
caggtgggtgtatgaatgcaaa

SEQ ID NO: 7324056 - DNA, 22 bp, Homo sapiens
cagtcacaggtggagaaccgag

SEQ ID NO: 7324057 - DNA, 22 bp, Homo sapiens
caggcaccccaggtgagcactg

SEQ ID NO: 7324058 - DNA, 22 bp, Homo sapiens
caggcagatgctgacaagagtt

SEQ ID NO: 7324059 - DNA, 22 bp, Homo sapiens
caggcagatatgttcgctttaa

SEQ ID NO: 7324060 - DNA, 22 bp, Homo sapiens
caggcagagttagtgatttagg

SEQ ID NO: 7324061 - DNA, 22 bp, Homo sapiens
tacaaaaaattgatactgacga

SEQ ID NO: 7324062 - DNA, 22 bp, Homo sapiens
caggcatgtggcccaggggtga

SEQ ID NO: 7324063 - DNA, 22 bp, Homo sapiens
caggcatggtgagaactcagcc

SEQ ID NO: 7324064 - DNA, 22 bp, Homo sapiens
caggccagggttgagaagagaa

SEQ ID NO: 7324065 - DNA, 19 bp, Homo sapiens
caggccagtgtcagggggc

SEQ ID NO: 7324066 - DNA, 22 bp, Homo sapiens
taatcacaattcagatgtctta

SEQ ID NO: 7324067 - DNA, 22 bp, Homo sapiens
caggcatgatgggaagtgcctg

SEQ ID NO: 7324068 - DNA, 22 bp, Homo sapiens
caggcatgatcataggagttta

SEQ ID NO: 7324069 - DNA, 22 bp, Homo sapiens
caggcagggagctggaaaggat

SEQ ID NO: 7324070 - DNA, 22 bp, Homo sapiens
caggcatggagaggcagagact

SEQ ID NO: 7324071 - DNA, 22 bp, Homo sapiens
caggcatggaaaagcccagagg

SEQ ID NO: 7324072 - DNA, 22 bp, Homo sapiens
caggcatggatctggaatcatt

SEQ ID NO: 7324073 - DNA, 22 bp, Homo sapiens
tacatttcctgtcagagatata

SEQ ID NO: 7324074 - DNA, 22 bp, Homo sapiens
caggcgagggccctgaggagcc

SEQ ID NO: 7324075 - DNA, 22 bp, Homo sapiens
tactttattgtaaatgctgatg

SEQ ID NO: 7324076 - DNA, 22 bp, Homo sapiens
tactttattgtaaatgctgatg

SEQ ID NO: 7324077 - DNA, 22 bp, Homo sapiens
tactttaaagaggtgtaatgag

SEQ ID NO: 7324078 - DNA, 22 bp, Homo sapiens
tacattgattcaggatataggc

SEQ ID NO: 7324079 - DNA, 22 bp, Homo sapiens
cagggaagagccgatgctgcag

SEQ ID NO: 7324080 - DNA, 22 bp, Homo sapiens
cagggacaaagtgagaaaggaa

SEQ ID NO: 7324081 - DNA, 22 bp, Homo sapiens
tagaaacaaaatctgatgactc

SEQ ID NO: 7324082 - DNA, 22 bp, Homo sapiens
ttgcaagacacttggaagcaca

SEQ ID NO: 7324083 - DNA, 22 bp, Homo sapiens
ttggttttagttcttgctcatg

SEQ ID NO: 7324084 - DNA, 22 bp, Homo sapiens
ttgtgaatagtgccacaataaa

SEQ ID NO: 7324085 - DNA, 22 bp, Homo sapiens
ttgtgaatgcttaatatgtttc

SEQ ID NO: 7324086 - DNA, 22 bp, Homo sapiens
ttgttattattactaagtcttc

SEQ ID NO: 7324087 - DNA, 22 bp, Homo sapiens
ttgtttctcctggtgcctgata

SEQ ID NO: 7324088 - DNA, 22 bp, Homo sapiens
ttgtttctcctggtgcctgata

SEQ ID NO: 7324089 - DNA, 22 bp, Homo sapiens
ttgtttctggaaaaggcgagaa

SEQ ID NO: 7324090 - DNA, 22 bp, Homo sapiens
ttgtttttaaacatgtgactga

SEQ ID NO: 7324091 - DNA, 22 bp, Homo sapiens
tttaattttcctcttcctggag

SEQ ID NO: 7324092 - DNA, 22 bp, Homo sapiens
tttaattgcatttaaagatgga

SEQ ID NO: 7324093 - DNA, 22 bp, Homo sapiens
tttaaacatatctgttgaggga

SEQ ID NO: 7324094 - DNA, 22 bp, Homo sapiens
tttactaagcccagttatatgc

SEQ ID NO: 7324095 - DNA, 22 bp, Homo sapiens
tttactaagtacttgtatccct

SEQ ID NO: 7324096 - DNA, 22 bp, Homo sapiens
tttactaacaccatacatgctg

SEQ ID NO: 7324097 - DNA, 22 bp, Homo sapiens
tttacaacctcatattctgatg

SEQ ID NO: 7324098 - DNA, 22 bp, Homo sapiens
tttattaattagtgacccaatg

SEQ ID NO: 7324099 - DNA, 22 bp, Homo sapiens
tttattatccagtgttgtcatg

SEQ ID NO: 7324100 - DNA, 22 bp, Homo sapiens
tttagttcacaccagggtagca

SEQ ID NO: 7324101 - DNA, 22 bp, Homo sapiens
tttattaatgtagcatccatgg

SEQ ID NO: 7324102 - DNA, 22 bp, Homo sapiens
tttattaagatgcgaatgctga

SEQ ID NO: 7324103 - DNA, 21 bp, Homo sapiens
tttattaacaactgtggacgt

SEQ ID NO: 7324104 - DNA, 22 bp, Homo sapiens
tttattaaaactgttggctctg

SEQ ID NO: 7324105 - DNA, 22 bp, Homo sapiens
tttcttctctaatctcaatgat

SEQ ID NO: 7324106 - DNA, 22 bp, Homo sapiens
tttctttaattctcacagcaat

SEQ ID NO: 7324107 - DNA, 22 bp, Homo sapiens
tttcttatggggtagtccttta

SEQ ID NO: 7324108 - DNA, 22 bp, Homo sapiens
tttctgaagggcagcagactct

SEQ ID NO: 7324109 - DNA, 22 bp, Homo sapiens
tttctgaaggttaaggaattag

SEQ ID NO: 7324110 - DNA, 23 bp, Homo sapiens
tttctgaagttgagatggacttt

SEQ ID NO: 7324111 - DNA, 22 bp, Homo sapiens
tttctgaagtcttctaacagat

SEQ ID NO: 7324112 - DNA, 18 bp, Homo sapiens
tttctgaatgtctatttc

SEQ ID NO: 7324113 - DNA, 22 bp, Homo sapiens
tttctgaataactctatgatat

SEQ ID NO: 7324114 - DNA, 22 bp, Homo sapiens
tttctgcatgcatttaattaaa

SEQ ID NO: 7324115 - DNA, 22 bp, Homo sapiens
tttctgcatgcatttaattaaa

SEQ ID NO: 7324116 - DNA, 20 bp, Homo sapiens
tttctgtagctcagtattca

SEQ ID NO: 7324117 - DNA, 22 bp, Homo sapiens
tttctggaaagcaagatacatt

SEQ ID NO: 7324118 - DNA, 22 bp, Homo sapiens
tttctggaaacgggttcaagct

SEQ ID NO: 7324119 - DNA, 22 bp, Homo sapiens
tttctgaacaaagccattatca

SEQ ID NO: 7324120 - DNA, 22 bp, Homo sapiens
tttctgaaacatggtctttgta

SEQ ID NO: 7324121 - DNA, 22 bp, Homo sapiens
tttctgaaaactgaagtagtgc

SEQ ID NO: 7324122 - DNA, 22 bp, Homo sapiens
tttctgaagatacagctttgct

SEQ ID NO: 7324123 - DNA, 22 bp, Homo sapiens
tttctgaacttggtactggagc

SEQ ID NO: 7324124 - DNA, 21 bp, Homo sapiens
tttctgaaggcaacatctatc

SEQ ID NO: 7324125 - DNA, 22 bp, Homo sapiens
tttctctttcaatctgcagtac

SEQ ID NO: 7324126 - DNA, 22 bp, Homo sapiens
tttctcttaatgtctctgtgct

SEQ ID NO: 7324127 - DNA, 22 bp, Homo sapiens
tttctccttgtgtctcctttga

SEQ ID NO: 7324128 - DNA, 22 bp, Homo sapiens
tttctcctgtgtaagccgccca

SEQ ID NO: 7324129 - DNA, 22 bp, Homo sapiens
tttctcctgtgaggtcagaagt

SEQ ID NO: 7324130 - DNA, 22 bp, Homo sapiens
tttctcctgcccagatgcctgg

SEQ ID NO: 7324131 - DNA, 22 bp, Homo sapiens
tttctaatctgattctcctacc

SEQ ID NO: 7324132 - DNA, 22 bp, Homo sapiens
tttcctgcacccgctgatgcca

SEQ ID NO: 7324133 - DNA, 22 bp, Homo sapiens
tttctccaatgtatcagcacac

SEQ ID NO: 7324134 - DNA, 22 bp, Homo sapiens
tttctcctcatgactggttgtg

SEQ ID NO: 7324135 - DNA, 22 bp, Homo sapiens
tttctcctccagagagacacag

SEQ ID NO: 7324136 - DNA, 22 bp, Homo sapiens
tttctattgtaagtctcctata

SEQ ID NO: 7324137 - DNA, 22 bp, Homo sapiens
tttctattggcgtcactgttgt

SEQ ID NO: 7324138 - DNA, 22 bp, Homo sapiens
tttctcagggaggagtcaagcc

SEQ ID NO: 7324139 - DNA, 22 bp, Homo sapiens
tttcagaggtgcttggaatgct

SEQ ID NO: 7324140 - DNA, 22 bp, Homo sapiens
tttcagaggtatgctgcttatc

SEQ ID NO: 7324141 - DNA, 22 bp, Homo sapiens
tttcagagtcagctcctctcta

SEQ ID NO: 7324142 - DNA, 20 bp, Homo sapiens
tttcagagtgtctttccatt

SEQ ID NO: 7324143 - DNA, 22 bp, Homo sapiens
tttcagaggaaatctcattgag

SEQ ID NO: 7324144 - DNA, 22 bp, Homo sapiens
tttcagagttgtcttcttgacc

SEQ ID NO: 7324145 - DNA, 22 bp, Homo sapiens
tttcagagttggggaaaagcag

SEQ ID NO: 7324146 - DNA, 22 bp, Homo sapiens
tttcattgtcatctatcttaga

SEQ ID NO: 7324147 - DNA, 22 bp, Homo sapiens
tttcattgtcatctatcttaga

SEQ ID NO: 7324148 - DNA, 22 bp, Homo sapiens
tttcattgtctacatatgacat

SEQ ID NO: 7324149 - DNA, 22 bp, Homo sapiens
tttccaaaatgaatctaatgca

SEQ ID NO: 7324150 - DNA, 22 bp, Homo sapiens
tttccaaacccagcgagctaca

SEQ ID NO: 7324151 - DNA, 22 bp, Homo sapiens
tttccaaagttgccataagctt

SEQ ID NO: 7324152 - DNA, 22 bp, Homo sapiens
tttccaaataaggtcacactca

SEQ ID NO: 7324153 - DNA, 22 bp, Homo sapiens
tttccaaaggtggcaggaacaa

SEQ ID NO: 7324154 - DNA, 22 bp, Homo sapiens
tttccaaaggctaaactcagtt

SEQ ID NO: 7324155 - DNA, 22 bp, Homo sapiens
ttttgcaaagtacattatcagg

SEQ ID NO: 7324156 - DNA, 22 bp, Homo sapiens
ttttgatatcatgatgaacaga

SEQ ID NO: 7324157 - DNA, 22 bp, Homo sapiens
ttttggcaaaggcattctcttt

SEQ ID NO: 7324158 - DNA, 22 bp, Homo sapiens
ttttggccacatccttttgagt

SEQ ID NO: 7324159 - DNA, 22 bp, Homo sapiens
ttttggcaggatatgcaccagc

SEQ ID NO: 7324160 - DNA, 22 bp, Homo sapiens
ttttctaactttacactcgaaa

SEQ ID NO: 7324161 - DNA, 22 bp, Homo sapiens
tttttctactgcccacattgta

SEQ ID NO: 7324162 - DNA, 19 bp, Homo sapiens
tttggacagagtgtccagg

SEQ ID NO: 7324163 - DNA, 22 bp, Homo sapiens
tttggcagctaaggcagctcgc

SEQ ID NO: 7324164 - DNA, 22 bp, Homo sapiens
tttgatttactggatattctca

SEQ ID NO: 7324165 - DNA, 22 bp, Homo sapiens
tttctttccagagtgattggca

SEQ ID NO: 7324166 - DNA, 22 bp, Homo sapiens
tttctttcaattctcctaatgc

SEQ ID NO: 7324167 - DNA, 22 bp, Homo sapiens
tttctttctcgtaaacttagtt

SEQ ID NO: 7324168 - DNA, 22 bp, Homo sapiens
tttctttccatgagcctatgta

SEQ ID NO: 7324169 - DNA, 22 bp, Homo sapiens
tttctttccatacatattgcta

SEQ ID NO: 7324170 - DNA, 22 bp, Homo sapiens
tttgcacacacaataacaaatg

SEQ ID NO: 7324171 - DNA, 22 bp, Homo sapiens
tttgtagagaatgttaagcact

SEQ ID NO: 7324172 - DNA, 23 bp, Homo sapiens
tttgtacattgaggaggcagaat

SEQ ID NO: 7324173 - DNA, 22 bp, Homo sapiens
tttgtcagagaactccagcaaa

SEQ ID NO: 7324174 - DNA, 22 bp, Homo sapiens
tttgttctgcatcacagaaaaa

SEQ ID NO: 7324175 - DNA, 22 bp, Homo sapiens
tttgtttggcaacttggtaaag

SEQ ID NO: 7324176 - DNA, 22 bp, Homo sapiens
tttgttttctgtaggcctttcc

SEQ ID NO: 7324177 - DNA, 22 bp, Homo sapiens
tttgttttcaatgtgtcattca

SEQ ID NO: 7324178 - DNA, 22 bp, Homo sapiens
tttgttttgaactagctcagaa

SEQ ID NO: 7324179 - DNA, 22 bp, Homo sapiens
tccccaggtcctgtcggctcct

SEQ ID NO: 7324180 - DNA, 22 bp, Homo sapiens
tgtggtctggccattcagggac

SEQ ID NO: 7324181 - DNA, 22 bp, Homo sapiens
tgtgtcatgtgtgaggctccct

SEQ ID NO: 7324182 - DNA, 23 bp, Homo sapiens
tgtgtcatggggaaagactcacc

SEQ ID NO: 7324183 - DNA, 22 bp, Homo sapiens
tgtgtgaagcacatgttcaagg

SEQ ID NO: 7324184 - DNA, 22 bp, Homo sapiens
tgtgtttctgagaatcccacct

SEQ ID NO: 7324185 - DNA, 20 bp, Homo sapiens
tgtgtgcacacatgacattc

SEQ ID NO: 7324186 - DNA, 22 bp, Homo sapiens
tgttatttatctgagcatttat

SEQ ID NO: 7324187 - DNA, 22 bp, Homo sapiens
tgttattatctgttaggtgttc

SEQ ID NO: 7324188 - DNA, 22 bp, Homo sapiens
tgttattgatatctaatgctct

SEQ ID NO: 7324189 - DNA, 22 bp, Homo sapiens
tgttatcctcagctcacctcta

SEQ ID NO: 7324190 - DNA, 22 bp, Homo sapiens
tgttcctggttcctgcatgatg

SEQ ID NO: 7324191 - DNA, 22 bp, Homo sapiens
tgtttcatgaaacatgtttagg

SEQ ID NO: 7324192 - DNA, 22 bp, Homo sapiens
tgttccttgaatatatcagacg

SEQ ID NO: 7324193 - DNA, 22 bp, Homo sapiens
tgttctctctccttttgaagtg

SEQ ID NO: 7324194 - DNA, 22 bp, Homo sapiens
tgttctcttttcctgctgagcc

SEQ ID NO: 7324195 - DNA, 22 bp, Homo sapiens
ttaacattgtccttagcagatt

SEQ ID NO: 7324196 - DNA, 22 bp, Homo sapiens
ttaacattgtccttagcagatt

SEQ ID NO: 7324197 - DNA, 22 bp, Homo sapiens
ttaacagtaaagaattgtgcaa

SEQ ID NO: 7324198 - DNA, 22 bp, Homo sapiens
ttaattgggtgcaacagctgaa

SEQ ID NO: 7324199 - DNA, 22 bp, Homo sapiens
ttaattggtaacctctggacta

SEQ ID NO: 7324200 - DNA, 22 bp, Homo sapiens
ttaattactaagcacaatgcaa

SEQ ID NO: 7324201 - DNA, 22 bp, Homo sapiens
ttaataaacaggtgcagctgaa

SEQ ID NO: 7324202 - DNA, 22 bp, Homo sapiens
ttaaatgtcaatagattgcttg

SEQ ID NO: 7324203 - DNA, 22 bp, Homo sapiens
ttaaattaggactctagttctg

SEQ ID NO: 7324204 - DNA, 22 bp, Homo sapiens
ttaaatgtctgtagatgtgctg

SEQ ID NO: 7324205 - DNA, 22 bp, Homo sapiens
ttaaatgtgatttcatttatgt

SEQ ID NO: 7324206 - DNA, 22 bp, Homo sapiens
tgttttctgtgtagagatcaca

SEQ ID NO: 7324207 - DNA, 22 bp, Homo sapiens
tgttttcttcctaattgctcat

SEQ ID NO: 7324208 - DNA, 22 bp, Homo sapiens
tgttttgcttctctgtttccca

SEQ ID NO: 7324209 - DNA, 22 bp, Homo sapiens
ttagaaagaactttagatatca

SEQ ID NO: 7324210 - DNA, 22 bp, Homo sapiens
ttagaaagagtataccagaaac

SEQ ID NO: 7324211 - DNA, 22 bp, Homo sapiens
ttactttatctcctagattcca

SEQ ID NO: 7324212 - DNA, 22 bp, Homo sapiens
ttagaaagctttccatagtcaa

SEQ ID NO: 7324213 - DNA, 22 bp, Homo sapiens
ttacattttggggtaaggataa

SEQ ID NO: 7324214 - DNA, 22 bp, Homo sapiens
ttactgaaaattcttcaggatt

SEQ ID NO: 7324215 - DNA, 22 bp, Homo sapiens
ttactgaattgcactccagcgt

SEQ ID NO: 7324216 - DNA, 22 bp, Homo sapiens
ttactgaaggtggatagtgagt

SEQ ID NO: 7324217 - DNA, 22 bp, Homo sapiens
ttactgaaccctacttttacag

SEQ ID NO: 7324218 - DNA, 22 bp, Homo sapiens
ttactgaaataatgaaacacat

SEQ ID NO: 7324219 - DNA, 22 bp, Homo sapiens
ttactgaaagtatacatttctg

SEQ ID NO: 7324220 - DNA, 22 bp, Homo sapiens
ttacttgatgatgtataaagtc

SEQ ID NO: 7324221 - DNA, 22 bp, Homo sapiens
ttacttgaaatgtgataagaga

SEQ ID NO: 7324222 - DNA, 22 bp, Homo sapiens
ttaattttctcatctgtgaaat

SEQ ID NO: 7324223 - DNA, 18 bp, Homo sapiens
ttacactagccttggttc

SEQ ID NO: 7324224 - DNA, 22 bp, Homo sapiens
ttacacacaattagcatagtaa

SEQ ID NO: 7324225 - DNA, 22 bp, Homo sapiens
ttacacagatggttagtagagg

SEQ ID NO: 7324226 - DNA, 22 bp, Homo sapiens
ttacatattgtctattgttcaa

SEQ ID NO: 7324227 - DNA, 22 bp, Homo sapiens
ttacatattatccaaaactgct

SEQ ID NO: 7324228 - DNA, 22 bp, Homo sapiens
ttctagtttccattttaagaca

SEQ ID NO: 7324229 - DNA, 22 bp, Homo sapiens
ttctgaatcctcgaaacatagc

SEQ ID NO: 7324230 - DNA, 22 bp, Homo sapiens
ttctgacatatccagtctcagt

SEQ ID NO: 7324231 - DNA, 22 bp, Homo sapiens
ttctgcttttagctaaactata

SEQ ID NO: 7324232 - DNA, 20 bp, Homo sapiens
ttctgcttgcaaatatcaag

SEQ ID NO: 7324233 - DNA, 22 bp, Homo sapiens
ttcttctttcctataattaatt

SEQ ID NO: 7324234 - DNA, 22 bp, Homo sapiens
ttctttatatctgctagtgggt

SEQ ID NO: 7324235 - DNA, 22 bp, Homo sapiens
ttctttatcagttactcatagg

SEQ ID NO: 7324236 - DNA, 22 bp, Homo sapiens
ttctttatatctgctagtgggt

SEQ ID NO: 7324237 - DNA, 22 bp, Homo sapiens
ttctgtttgccatatatagtag

SEQ ID NO: 7324238 - DNA, 22 bp, Homo sapiens
ttcttaaaacttatggacaggt

SEQ ID NO: 7324239 - DNA, 19 bp, Homo sapiens
ttctggtctggaatcaagg

SEQ ID NO: 7324240 - DNA, 22 bp, Homo sapiens
ttgatctctgttgctgtctttg

SEQ ID NO: 7324241 - DNA, 22 bp, Homo sapiens
ttgatgagaccattgccgcgtc

SEQ ID NO: 7324242 - DNA, 22 bp, Homo sapiens
ttgattaaaatgagacatcatt

SEQ ID NO: 7324243 - DNA, 22 bp, Homo sapiens
ttgattaatcccatgtgagtag

SEQ ID NO: 7324244 - DNA, 22 bp, Homo sapiens
ttgcaaagagtcatgtaagtca

SEQ ID NO: 7324245 - DNA, 22 bp, Homo sapiens
ttgaggagtgtttagggtgagg

SEQ ID NO: 7324246 - DNA, 22 bp, Homo sapiens
ttgaggagttgtgacagatact

SEQ ID NO: 7324247 - DNA, 22 bp, Homo sapiens
ttgagatgggctttatgttcag

SEQ ID NO: 7324248 - DNA, 19 bp, Homo sapiens
ttctttccacatcttctct

SEQ ID NO: 7324249 - DNA, 22 bp, Homo sapiens
ttctttatgttaatgaatctat

SEQ ID NO: 7324250 - DNA, 22 bp, Homo sapiens
ttctttatgttaatgaatctat

SEQ ID NO: 7324251 - DNA, 22 bp, Homo sapiens
ttctttattgagacttcattgt

SEQ ID NO: 7324252 - DNA, 22 bp, Homo sapiens
ttctttattagtttagtgagct

SEQ ID NO: 7324253 - DNA, 22 bp, Homo sapiens
ttctttatgcttctgtttaggc

SEQ ID NO: 7324254 - DNA, 22 bp, Homo sapiens
ttctttcccagtagatgtgaaa

SEQ ID NO: 7324255 - DNA, 22 bp, Homo sapiens
ttctttccttgcctcagtgaag

SEQ ID NO: 7324256 - DNA, 22 bp, Homo sapiens
ttctttcccttccagcagctcc

SEQ ID NO: 7324257 - DNA, 22 bp, Homo sapiens
ttctttcctcccagcctttgga

SEQ ID NO: 7324258 - DNA, 22 bp, Homo sapiens
ttcaggagaaagttcagtactt

SEQ ID NO: 7324259 - DNA, 22 bp, Homo sapiens
ttcagtctcaagtgctgctcac

SEQ ID NO: 7324260 - DNA, 22 bp, Homo sapiens
ttcaggtgtcaaggataggctg

SEQ ID NO: 7324261 - DNA, 22 bp, Homo sapiens
ttcaggtttttaagttctgcct

SEQ ID NO: 7324262 - DNA, 22 bp, Homo sapiens
ttcaggagctggctgcgaagga

SEQ ID NO: 7324263 - DNA, 22 bp, Homo sapiens
ttcaggagaattccaagaagta

SEQ ID NO: 7324264 - DNA, 22 bp, Homo sapiens
ttcaggaggtgagcaagaaggg

SEQ ID NO: 7324265 - DNA, 22 bp, Homo sapiens
ttcaacagggcatgatgagacg

SEQ ID NO: 7324266 - DNA, 22 bp, Homo sapiens
ttcaacacaggaacatgatata

SEQ ID NO: 7324267 - DNA, 21 bp, Homo sapiens
ttcaacagcataatgtaggaa

SEQ ID NO: 7324268 - DNA, 22 bp, Homo sapiens
ttcacaaagctggttccttctg

SEQ ID NO: 7324269 - DNA, 22 bp, Homo sapiens
ttcacaaagctggagcatttcc

SEQ ID NO: 7324270 - DNA, 22 bp, Homo sapiens
ttcacaaacttcatgatggcac

SEQ ID NO: 7324271 - DNA, 22 bp, Homo sapiens
ttcaatttcataatatctagct

SEQ ID NO: 7324272 - DNA, 22 bp, Homo sapiens
ttcaatttagtgatgttgttgg

SEQ ID NO: 7324273 - DNA, 22 bp, Homo sapiens
ttcacaaaaatgctgaacagtt

SEQ ID NO: 7324274 - DNA, 22 bp, Homo sapiens
ttcacaaaatggtttgttgatg

SEQ ID NO: 7324275 - DNA, 22 bp, Homo sapiens
ttcacaaacaccagaatggcta

SEQ ID NO: 7324276 - DNA, 22 bp, Homo sapiens
ttcacaaaacactattttctgg

SEQ ID NO: 7324277 - DNA, 22 bp, Homo sapiens
ttcctcttatatagccttggcc

SEQ ID NO: 7324278 - DNA, 22 bp, Homo sapiens
ttccctggaacatcatggtcta

SEQ ID NO: 7324279 - DNA, 22 bp, Homo sapiens
ttccctggaaagccatgcagtc

SEQ ID NO: 7324280 - DNA, 22 bp, Homo sapiens
ttccctggccctggcacgctct

SEQ ID NO: 7324281 - DNA, 22 bp, Homo sapiens
ttccctggctcttctacatcgt

SEQ ID NO: 7324282 - DNA, 22 bp, Homo sapiens
ttcctcttattttcccagtgat

SEQ ID NO: 7324283 - DNA, 21 bp, Homo sapiens
ttcctcttgcttccgccttgc

SEQ ID NO: 7324284 - DNA, 22 bp, Homo sapiens
ttcctctttagggctggccagg

SEQ ID NO: 7324285 - DNA, 22 bp, Homo sapiens
ttcctctttgcatcctcaactc

SEQ ID NO: 7324286 - DNA, 22 bp, Homo sapiens
ttcctctttctctgtgctatgt

SEQ ID NO: 7324287 - DNA, 22 bp, Homo sapiens
ttcctgaagtcaaagatctaaa

SEQ ID NO: 7324288 - DNA, 22 bp, Homo sapiens
ttctacttctgacactgtttgt

SEQ ID NO: 7324289 - DNA, 22 bp, Homo sapiens
ttctaattgtgtttgcatatct

SEQ ID NO: 7324290 - DNA, 22 bp, Homo sapiens
cagcaaaggggatgcgtcctaa

SEQ ID NO: 7324291 - DNA, 22 bp, Homo sapiens
cagcaaagcttgttccttcctg

SEQ ID NO: 7324292 - DNA, 22 bp, Homo sapiens
cagcaaagcttaatttatatct

SEQ ID NO: 7324293 - DNA, 22 bp, Homo sapiens
cagcaaagcaggctcctagaac

SEQ ID NO: 7324294 - DNA, 22 bp, Homo sapiens
cagcaaaggtagaagcacagga

SEQ ID NO: 7324295 - DNA, 22 bp, Homo sapiens
gtaggcagtggttggaagagaa

SEQ ID NO: 7324296 - DNA, 22 bp, Homo sapiens
gtaggcagtctctcaggtgatc

SEQ ID NO: 7324297 - DNA, 22 bp, Homo sapiens
gtactgaataacaaagtctgtc

SEQ ID NO: 7324298 - DNA, 22 bp, Homo sapiens
gtactgaaaagttttctaatct

SEQ ID NO: 7324299 - DNA, 22 bp, Homo sapiens
gtactgaacttaaaaatcccct

SEQ ID NO: 7324300 - DNA, 22 bp, Homo sapiens
gtcacaggaagcagcaggcact

SEQ ID NO: 7324301 - DNA, 18 bp, Homo sapiens
gtcacagcagagaactgc

SEQ ID NO: 7324302 - DNA, 22 bp, Homo sapiens
gtcacagcctcaatcccatctg

SEQ ID NO: 7324303 - DNA, 22 bp, Homo sapiens
gtcagcatagttcacacacagt

SEQ ID NO: 7324304 - DNA, 22 bp, Homo sapiens
cagccaggactcccatttagga

SEQ ID NO: 7324305 - DNA, 22 bp, Homo sapiens
cagccaggatggagaactgttg

SEQ ID NO: 7324306 - DNA, 22 bp, Homo sapiens
cagccctcctaccctgccaggc

SEQ ID NO: 7324307 - DNA, 22 bp, Homo sapiens
cagccctgtccctgagggacct

SEQ ID NO: 7324308 - DNA, 22 bp, Homo sapiens
cagccctgtctatgactgatga

SEQ ID NO: 7324309 - DNA, 22 bp, Homo sapiens
cagccctgtccagcagagggtg

SEQ ID NO: 7324310 - DNA, 22 bp, Homo sapiens
cagacaaagcggaaactgttta

SEQ ID NO: 7324311 - DNA, 22 bp, Homo sapiens
cagacacacaagcaatctaagt

SEQ ID NO: 7324312 - DNA, 22 bp, Homo sapiens
cagaatgttaccagttagtctg

SEQ ID NO: 7324313 - DNA, 22 bp, Homo sapiens
gggaggcacgaggcgcgcagtg

SEQ ID NO: 7324314 - DNA, 22 bp, Homo sapiens
gggaggcagtgctggaggctgg

SEQ ID NO: 7324315 - DNA, 22 bp, Homo sapiens
gggaggcatgtgttatccactt

SEQ ID NO: 7324316 - DNA, 18 bp, Homo sapiens
cagacactctgctctgca

SEQ ID NO: 7324317 - DNA, 22 bp, Homo sapiens
cagagacacttaacaggaatgg

SEQ ID NO: 7324318 - DNA, 20 bp, Homo sapiens
gggaggcattggtccctcac

SEQ ID NO: 7324319 - DNA, 22 bp, Homo sapiens
cagagacaacctggtagagaaa

SEQ ID NO: 7324320 - DNA, 22 bp, Homo sapiens
cagagcactgcttggaggattt

SEQ ID NO: 7324321 - DNA, 22 bp, Homo sapiens
ggggtgagtgctcagccccgga

SEQ ID NO: 7324322 - DNA, 22 bp, Homo sapiens
ggggcagagtagctggggtgtg

SEQ ID NO: 7324323 - DNA, 21 bp, Homo sapiens
ggggcagagctaggccctgca

SEQ ID NO: 7324324 - DNA, 22 bp, Homo sapiens
ggggcagagtctggactgttgt

SEQ ID NO: 7324325 - DNA, 22 bp, Homo sapiens
ggggcagatggaacagagcaca

SEQ ID NO: 7324326 - DNA, 22 bp, Homo sapiens
gggtaggaaatccagaggtggc

SEQ ID NO: 7324327 - DNA, 22 bp, Homo sapiens
cagatgcacattctcatcagca

SEQ ID NO: 7324328 - DNA, 22 bp, Homo sapiens
cagatgcagcaaaatgacaggc

SEQ ID NO: 7324329 - DNA, 22 bp, Homo sapiens
caaattttgtgtgttctctagt

SEQ ID NO: 7324330 - DNA, 22 bp, Homo sapiens
caaattttgtgtgttctctagt

SEQ ID NO: 7324331 - DNA, 22 bp, Homo sapiens
caacaatatgccagactcaatt

SEQ ID NO: 7324332 - DNA, 22 bp, Homo sapiens
caacaatatgctgagtttttca

SEQ ID NO: 7324333 - DNA, 22 bp, Homo sapiens
caacacaggggttatgccatgg

SEQ ID NO: 7324334 - DNA, 22 bp, Homo sapiens
caagccatattttgaagaatga

SEQ ID NO: 7324335 - DNA, 22 bp, Homo sapiens
caagccatactgggtgaaatca

SEQ ID NO: 7324336 - DNA, 20 bp, Homo sapiens
gctggctgaactgaaagcaa

SEQ ID NO: 7324337 - DNA, 22 bp, Homo sapiens
caagcgtggctgctctgatgga

SEQ ID NO: 7324338 - DNA, 22 bp, Homo sapiens
caatttcaatgaggccacaggg

SEQ ID NO: 7324339 - DNA, 22 bp, Homo sapiens
caatttcactaataatatttac

SEQ ID NO: 7324340 - DNA, 22 bp, Homo sapiens
caatttcaatacaaaatacatt

SEQ ID NO: 7324341 - DNA, 22 bp, Homo sapiens
caatttcattaatagatataga

SEQ ID NO: 7324342 - DNA, 22 bp, Homo sapiens
caatttccttcatagatgactg

SEQ ID NO: 7324343 - DNA, 22 bp, Homo sapiens
caatttcatggataaaagatgt

SEQ ID NO: 7324344 - DNA, 22 bp, Homo sapiens
caatagcaggtctacagagaga

SEQ ID NO: 7324345 - DNA, 22 bp, Homo sapiens
ggagaagggacagactcagctt

SEQ ID NO: 7324346 - DNA, 22 bp, Homo sapiens
ggagaagggacagactcagctt

SEQ ID NO: 7324347 - DNA, 22 bp, Homo sapiens
ggaagctgggatctctctcccg

SEQ ID NO: 7324348 - DNA, 22 bp, Homo sapiens
cacaaatcattccatcattctt

SEQ ID NO: 7324349 - DNA, 21 bp, Homo sapiens
cactcaataaatgtcatatgc

SEQ ID NO: 7324350 - DNA, 22 bp, Homo sapiens
cactcaatacaatggttggcac

SEQ ID NO: 7324351 - DNA, 22 bp, Homo sapiens
caccaggataaaacctctagat

SEQ ID NO: 7324352 - DNA, 22 bp, Homo sapiens
ggcaagtgtgagaagggactgg

SEQ ID NO: 7324353 - DNA, 22 bp, Homo sapiens
ggagagctgaagcatggacagg

SEQ ID NO: 7324354 - DNA, 22 bp, Homo sapiens
cacaggtgctcctcggggagct

SEQ ID NO: 7324355 - DNA, 22 bp, Homo sapiens
cacaggtgcaagaagttgcagt

SEQ ID NO: 7324356 - DNA, 22 bp, Homo sapiens
ggcaagtggaggtgttcatcag

SEQ ID NO: 7324357 - DNA, 22 bp, Homo sapiens
ggcaagtgatcctggagcaccg

SEQ ID NO: 7324358 - DNA, 17 bp, Homo sapiens
cacaggtgtggtttgag

SEQ ID NO: 7324359 - DNA, 22 bp, Homo sapiens
cacaggtgtgtcctggtcttgt

SEQ ID NO: 7324360 - DNA, 17 bp, Homo sapiens
gagctctgtggcacaag

SEQ ID NO: 7324361 - DNA, 22 bp, Homo sapiens
gagctctgtgaatgtggggagg

SEQ ID NO: 7324362 - DNA, 22 bp, Homo sapiens
atgggagggtggaaaggctctg

SEQ ID NO: 7324363 - DNA, 22 bp, Homo sapiens
gagacagtgcaggaaatctaaa

SEQ ID NO: 7324364 - DNA, 22 bp, Homo sapiens
gagacaggccaggtggtactta

SEQ ID NO: 7324365 - DNA, 22 bp, Homo sapiens
gagacaggcagctagtgggtca

SEQ ID NO: 7324366 - DNA, 22 bp, Homo sapiens
atgcttaactctgtacatagtt

SEQ ID NO: 7324367 - DNA, 22 bp, Homo sapiens
atgcttaactctgtacatagtt

SEQ ID NO: 7324368 - DNA, 22 bp, Homo sapiens
gagaagtttctggtttgcatag

SEQ ID NO: 7324369 - DNA, 22 bp, Homo sapiens
gagtgcagtatcttctgtgtcc

SEQ ID NO: 7324370 - DNA, 22 bp, Homo sapiens
gaggtgtgaggaatgaatgggg

SEQ ID NO: 7324371 - DNA, 22 bp, Homo sapiens
atgttactgtgatcatgatact

SEQ ID NO: 7324372 - DNA, 23 bp, Homo sapiens
atgttaaacataactgaagagcc

SEQ ID NO: 7324373 - DNA, 22 bp, Homo sapiens
atgtgccctcttagagtctctg

SEQ ID NO: 7324374 - DNA, 22 bp, Homo sapiens
atgtgccctttctgctttgcag

SEQ ID NO: 7324375 - DNA, 22 bp, Homo sapiens
gaggagctgggtcagggagaca

SEQ ID NO: 7324376 - DNA, 22 bp, Homo sapiens
atgtattgaccatactactaaa

SEQ ID NO: 7324377 - DNA, 22 bp, Homo sapiens
atgagaaatttattacaagcta

SEQ ID NO: 7324378 - DNA, 22 bp, Homo sapiens
atgagaaagagttgtatctaga

SEQ ID NO: 7324379 - DNA, 22 bp, Homo sapiens
atgagacaagagtctaaattca

SEQ ID NO: 7324380 - DNA, 22 bp, Homo sapiens
ctttggcttttagatatccatt

SEQ ID NO: 7324381 - DNA, 22 bp, Homo sapiens
ctttggcttgcactattacact

SEQ ID NO: 7324382 - DNA, 22 bp, Homo sapiens
atgaatttttctaagcttttgt

SEQ ID NO: 7324383 - DNA, 22 bp, Homo sapiens
ctttctttcgaagacgtgatta

SEQ ID NO: 7324384 - DNA, 22 bp, Homo sapiens
ctttattagatgtagactttct

SEQ ID NO: 7324385 - DNA, 22 bp, Homo sapiens
ctttattgtccttcttaggtgg

SEQ ID NO: 7324386 - DNA, 22 bp, Homo sapiens
atctttctatggtactttctcc

SEQ ID NO: 7324387 - DNA, 22 bp, Homo sapiens
atctttctctgcactatacaat

SEQ ID NO: 7324388 - DNA, 22 bp, Homo sapiens
atgctatacatatgacatcaca

SEQ ID NO: 7324389 - DNA, 22 bp, Homo sapiens
gaattttaagtgttcgcctctt

SEQ ID NO: 7324390 - DNA, 22 bp, Homo sapiens
gaattttaataaaggtttatca

SEQ ID NO: 7324391 - DNA, 22 bp, Homo sapiens
gaattttagaatatgtgggctt

SEQ ID NO: 7324392 - DNA, 22 bp, Homo sapiens
atgagcaggtttaagagaggcc

SEQ ID NO: 7324393 - DNA, 22 bp, Homo sapiens
atgagctagaaaaccatgtgga

SEQ ID NO: 7324394 - DNA, 22 bp, Homo sapiens
gaagagagagccctggggtccg

SEQ ID NO: 7324395 - DNA, 22 bp, Homo sapiens
gaagagagccgcgggacatcag

SEQ ID NO: 7324396 - DNA, 22 bp, Homo sapiens
gaagagcatatgaagagcatat

SEQ ID NO: 7324397 - DNA, 22 bp, Homo sapiens
gaaggaggtgtcagttggactg

SEQ ID NO: 7324398 - DNA, 22 bp, Homo sapiens
gaagccttgaactgcaaacccc

SEQ ID NO: 7324399 - DNA, 22 bp, Homo sapiens
attttgaagggaattgaagttc

SEQ ID NO: 7324400 - DNA, 22 bp, Homo sapiens
attttgaatcaccttggaagaa

SEQ ID NO: 7324401 - DNA, 22 bp, Homo sapiens
gctcagagagaggctcaccatt

SEQ ID NO: 7324402 - DNA, 22 bp, Homo sapiens
caaagaatgagtgagtacataa

SEQ ID NO: 7324403 - DNA, 22 bp, Homo sapiens
gctccccaaaagctccaggaaa

SEQ ID NO: 7324404 - DNA, 22 bp, Homo sapiens
gctccagggacccaagagaaaa

SEQ ID NO: 7324405 - DNA, 21 bp, Homo sapiens
attttcattaattcagtgtgg

SEQ ID NO: 7324406 - DNA, 22 bp, Homo sapiens
attttcctctggtttccccaga

SEQ ID NO: 7324407 - DNA, 22 bp, Homo sapiens
attttagatttaagaataaggt

SEQ ID NO: 7324408 - DNA, 22 bp, Homo sapiens
atttgggaatgtgcattatact

SEQ ID NO: 7324409 - DNA, 22 bp, Homo sapiens
gccagccagtttgctgatggct

SEQ ID NO: 7324410 - DNA, 22 bp, Homo sapiens
gccagccagagtggctgtgtgt

SEQ ID NO: 7324411 - DNA, 22 bp, Homo sapiens
gccagccagagtccatctgaga

SEQ ID NO: 7324412 - DNA, 22 bp, Homo sapiens
gccagccagaaacgtcacactg

SEQ ID NO: 7324413 - DNA, 22 bp, Homo sapiens
gccagccacttcccagactggc

SEQ ID NO: 7324414 - DNA, 22 bp, Homo sapiens
gccagccacttcagctatggct

SEQ ID NO: 7324415 - DNA, 22 bp, Homo sapiens
atttattaagcatctgctatgt

SEQ ID NO: 7324416 - DNA, 22 bp, Homo sapiens
atttattacctcggagtttctg

SEQ ID NO: 7324417 - DNA, 22 bp, Homo sapiens
atttattatgggatttggcaca

SEQ ID NO: 7324418 - DNA, 22 bp, Homo sapiens
atttcccaatacgctaagtgga

SEQ ID NO: 7324419 - DNA, 22 bp, Homo sapiens
atttcccactctactacatgct

SEQ ID NO: 7324420 - DNA, 22 bp, Homo sapiens
atttcccaggactagaaatata

SEQ ID NO: 7324421 - DNA, 22 bp, Homo sapiens
atttcttatgaatattgactgt

SEQ ID NO: 7324422 - DNA, 19 bp, Homo sapiens
atttattgtatgattccat

SEQ ID NO: 7324423 - DNA, 22 bp, Homo sapiens
gcccagggtgaagtgcagttgt

SEQ ID NO: 7324424 - DNA, 22 bp, Homo sapiens
gcccaggttggagagcagtggc

SEQ ID NO: 7324425 - DNA, 22 bp, Homo sapiens
gcagggcagtgtgtctgtgggg

SEQ ID NO: 7324426 - DNA, 22 bp, Homo sapiens
gcagggcatagaggcacggagg

SEQ ID NO: 7324427 - DNA, 22 bp, Homo sapiens
gcagggcatccctgagcgggtg

SEQ ID NO: 7324428 - DNA, 22 bp, Homo sapiens
attctttccagacactgattgc

SEQ ID NO: 7324429 - DNA, 22 bp, Homo sapiens
attctgcacatccaagaacagg

SEQ ID NO: 7324430 - DNA, 22 bp, Homo sapiens
gcatgcttttatatctgtttaa

SEQ ID NO: 7324431 - DNA, 22 bp, Homo sapiens
gcagtaagatgtaagtgctata

SEQ ID NO: 7324432 - DNA, 22 bp, Homo sapiens
gcagtaagatgtaagtgctata

SEQ ID NO: 7324433 - DNA, 22 bp, Homo sapiens
gcaggttagatttaatccattc

SEQ ID NO: 7324434 - DNA, 19 bp, Homo sapiens
gcaggtggatgtggtcagc

SEQ ID NO: 7324435 - DNA, 22 bp, Homo sapiens
attccaaacagtgctgcagact

SEQ ID NO: 7324436 - DNA, 22 bp, Homo sapiens
attccaaaaggatgttagaatg

SEQ ID NO: 7324437 - DNA, 20 bp, Homo sapiens
attcacaaagccagtgttgc

SEQ ID NO: 7324438 - DNA, 20 bp, Homo sapiens
attccacttatatgaggtcc

SEQ ID NO: 7324439 - DNA, 22 bp, Homo sapiens
attccaaagcacatcagaacta

SEQ ID NO: 7324440 - DNA, 22 bp, Homo sapiens
attccaaagcctgaataatgga

SEQ ID NO: 7324441 - DNA, 22 bp, Homo sapiens
attccaaaggttaatgcccatt

SEQ ID NO: 7324442 - DNA, 22 bp, Homo sapiens
gcaggcaattttggaaggtcag

SEQ ID NO: 7324443 - DNA, 22 bp, Homo sapiens
gcaggcaagaatttgggtctga

SEQ ID NO: 7324444 - DNA, 20 bp, Homo sapiens
attccacttgtttgaggtac

SEQ ID NO: 7324445 - DNA, 22 bp, Homo sapiens
gcagagaccccgcagtgaggcc

SEQ ID NO: 7324446 - DNA, 22 bp, Homo sapiens
gcagagactagtagtgcagact

SEQ ID NO: 7324447 - DNA, 23 bp, Homo sapiens
gcagagacagccccagcgcgatg

SEQ ID NO: 7324448 - DNA, 22 bp, Homo sapiens
gcagagacaggataatgggttc

SEQ ID NO: 7324449 - DNA, 22 bp, Homo sapiens
attattaaaatgtgtttctctt

SEQ ID NO: 7324450 - DNA, 22 bp, Homo sapiens
attatccagcaccaatgtcaga

SEQ ID NO: 7324451 - DNA, 22 bp, Homo sapiens
gattcttaagacattatgtatt

SEQ ID NO: 7324452 - DNA, 22 bp, Homo sapiens
attaaattggacgctgggggaa

SEQ ID NO: 7324453 - DNA, 22 bp, Homo sapiens
attaaattggatctgcatagtt

SEQ ID NO: 7324454 - DNA, 22 bp, Homo sapiens
attaaattggatctgcatagtt

SEQ ID NO: 7324455 - DNA, 22 bp, Homo sapiens
attaaattggacgctgggggaa

SEQ ID NO: 7324456 - DNA, 22 bp, Homo sapiens
attaaattttcactaggctccc

SEQ ID NO: 7324457 - DNA, 22 bp, Homo sapiens
attaaattttcactaggctccc

SEQ ID NO: 7324458 - DNA, 22 bp, Homo sapiens
gattcactcatattttacgttt

SEQ ID NO: 7324459 - DNA, 22 bp, Homo sapiens
atgttatttctgaaagatcatt

SEQ ID NO: 7324460 - DNA, 22 bp, Homo sapiens
gatggcagtcaaccaggtgagg

SEQ ID NO: 7324461 - DNA, 22 bp, Homo sapiens
gatggcaggtgatagccgagtc

SEQ ID NO: 7324462 - DNA, 22 bp, Homo sapiens
gatggcagtcaaccaggtgagg

SEQ ID NO: 7324463 - DNA, 22 bp, Homo sapiens
gatggcagcagcagccagggat

SEQ ID NO: 7324464 - DNA, 22 bp, Homo sapiens
atgttattcaatttgaatccaa

SEQ ID NO: 7324465 - DNA, 22 bp, Homo sapiens
atgttattaaagtacagattct

SEQ ID NO: 7324466 - DNA, 22 bp, Homo sapiens
atattttcacagaacttgcaaa

SEQ ID NO: 7324467 - DNA, 22 bp, Homo sapiens
atattttcactgaaccaaagta

SEQ ID NO: 7324468 - DNA, 22 bp, Homo sapiens
ctgtattaaaggcagtgatctt

SEQ ID NO: 7324469 - DNA, 22 bp, Homo sapiens
ctggtgggaagatggaaaacat

SEQ ID NO: 7324470 - DNA, 22 bp, Homo sapiens
ctggtgggagcagcaggcagct

SEQ ID NO: 7324471 - DNA, 22 bp, Homo sapiens
atatattttttgagacagagtc

SEQ ID NO: 7324472 - DNA, 22 bp, Homo sapiens
atatcaaaataaacagcatgca

SEQ ID NO: 7324473 - DNA, 22 bp, Homo sapiens
atatcacaaacaagtctgtact

SEQ ID NO: 7324474 - DNA, 22 bp, Homo sapiens
atatcacagtagttgtttagtt

SEQ ID NO: 7324475 - DNA, 22 bp, Homo sapiens
atatcacagctctttcattgct

SEQ ID NO: 7324476 - DNA, 22 bp, Homo sapiens
atagtcataggcaaatagaaga

SEQ ID NO: 7324477 - DNA, 22 bp, Homo sapiens
atatattttgcggtcacgtggc

SEQ ID NO: 7324478 - DNA, 22 bp, Homo sapiens
atatattttgaatagcctctgt

SEQ ID NO: 7324479 - DNA, 22 bp, Homo sapiens
ctgggcctggggctgttgagag

SEQ ID NO: 7324480 - DNA, 22 bp, Homo sapiens
cttcatcagctggcttactgtt

SEQ ID NO: 7324481 - DNA, 22 bp, Homo sapiens
cttcatgctgagaagctgaatg

SEQ ID NO: 7324482 - DNA, 22 bp, Homo sapiens
atcctttaagttaataaaattc

SEQ ID NO: 7324483 - DNA, 19 bp, Homo sapiens
cttcagcatctccggagct

SEQ ID NO: 7324484 - DNA, 22 bp, Homo sapiens
ctgtgtcccacacgaggtgtat

SEQ ID NO: 7324485 - DNA, 22 bp, Homo sapiens
atcattcaagtgctctaaaatg

SEQ ID NO: 7324486 - DNA, 22 bp, Homo sapiens
ctgtgtgtgaacacagcccagc

SEQ ID NO: 7324487 - DNA, 22 bp, Homo sapiens
ctgtttattctcatctaaaatg

SEQ ID NO: 7324488 - DNA, 22 bp, Homo sapiens
ctgttatttgagagtgttgaat

SEQ ID NO: 7324489 - DNA, 22 bp, Homo sapiens
ctgttattccccttgctgtggt

SEQ ID NO: 7324490 - DNA, 22 bp, Homo sapiens
ctgttagtcttttgcaggagag

SEQ ID NO: 7324491 - DNA, 22 bp, Homo sapiens
ctgttagtgatcaaagggagag

SEQ ID NO: 7324492 - DNA, 22 bp, Homo sapiens
atcaggaatcttttgtcagaca

SEQ ID NO: 7324493 - DNA, 22 bp, Homo sapiens
atcaggaatgaatacttttgga

SEQ ID NO: 7324494 - DNA, 22 bp, Homo sapiens
atcaggaagcgtctggtatttt

SEQ ID NO: 7324495 - DNA, 22 bp, Homo sapiens
atcaggaagcctgcactgagct

SEQ ID NO: 7324496 - DNA, 22 bp, Homo sapiens
atcaggaagcctgcactgagct

SEQ ID NO: 7324497 - DNA, 22 bp, Homo sapiens
atcaggaagccagtctaatgga

SEQ ID NO: 7324498 - DNA, 22 bp, Homo sapiens
atcaggaacgttcatggactgt

SEQ ID NO: 7324499 - DNA, 22 bp, Homo sapiens
atcaggaagaagaatgtgttgg

SEQ ID NO: 7324500 - DNA, 22 bp, Homo sapiens
atcaggaaatacttatttataa

SEQ ID NO: 7324501 - DNA, 22 bp, Homo sapiens
atcaggaaatacttatttataa

SEQ ID NO: 7324502 - DNA, 22 bp, Homo sapiens
ctggaaatcactactagtcaat

SEQ ID NO: 7324503 - DNA, 22 bp, Homo sapiens
atacagaagaactatagccact

SEQ ID NO: 7324504 - DNA, 22 bp, Homo sapiens
atacatatatggtacttcctgg

SEQ ID NO: 7324505 - DNA, 22 bp, Homo sapiens
atacatgaggaggctggaaaca

SEQ ID NO: 7324506 - DNA, 22 bp, Homo sapiens
atacatctggatgtatgcattt

SEQ ID NO: 7324507 - DNA, 20 bp, Homo sapiens
atacacattcatagaaaaat

SEQ ID NO: 7324508 - DNA, 22 bp, Homo sapiens
ctggagctgtcttcacaggcct

SEQ ID NO: 7324509 - DNA, 19 bp, Homo sapiens
atagaaagggttaaagaca

SEQ ID NO: 7324510 - DNA, 22 bp, Homo sapiens
atagaatagcatagaaaattga

SEQ ID NO: 7324511 - DNA, 22 bp, Homo sapiens
atagtaaattatcgtggagaga

SEQ ID NO: 7324512 - DNA, 22 bp, Homo sapiens
agtgttactggttcatgaatct

SEQ ID NO: 7324513 - DNA, 22 bp, Homo sapiens
ctgcccgcaccatccccgggct

SEQ ID NO: 7324514 - DNA, 18 bp, Homo sapiens
ctgcccagagcatttcat

SEQ ID NO: 7324515 - DNA, 22 bp, Homo sapiens
agttttctctgtgttctgctta

SEQ ID NO: 7324516 - DNA, 22 bp, Homo sapiens
ataataaaccaggatgggtctg

SEQ ID NO: 7324517 - DNA, 22 bp, Homo sapiens
ctgcctgcttctgagccagagg

SEQ ID NO: 7324518 - DNA, 22 bp, Homo sapiens
ctgccctgtgcacaggaaactg

SEQ ID NO: 7324519 - DNA, 22 bp, Homo sapiens
aggttaggaatttggacagaga

SEQ ID NO: 7324520 - DNA, 22 bp, Homo sapiens
aggttattctctatctcatccc

SEQ ID NO: 7324521 - DNA, 22 bp, Homo sapiens
aggtgtggctggggcagaggcc

SEQ ID NO: 7324522 - DNA, 22 bp, Homo sapiens
aggtgtggcttgaagtctctat

SEQ ID NO: 7324523 - DNA, 17 bp, Homo sapiens
aggtgtggtcaagggag

SEQ ID NO: 7324524 - DNA, 22 bp, Homo sapiens
aggtggggttcagtctcagccg

SEQ ID NO: 7324525 - DNA, 22 bp, Homo sapiens
aggtggggttcagtctcagccg

SEQ ID NO: 7324526 - DNA, 22 bp, Homo sapiens
cctttattcaattagtcctaat

SEQ ID NO: 7324527 - DNA, 20 bp, Homo sapiens
cctttattatttgtatgatg

SEQ ID NO: 7324528 - DNA, 20 bp, Homo sapiens
cctttattatttgtatgatg

SEQ ID NO: 7324529 - DNA, 20 bp, Homo sapiens
cctttattatttgtatgatg

SEQ ID NO: 7324530 - DNA, 22 bp, Homo sapiens
ctaaacaatgaacaaagcactg

SEQ ID NO: 7324531 - DNA, 22 bp, Homo sapiens
ctaaacaagggattataattga

SEQ ID NO: 7324532 - DNA, 22 bp, Homo sapiens
ctacactagagttgcaatggaa

SEQ ID NO: 7324533 - DNA, 21 bp, Homo sapiens
agtcagacttaagctctgcat

SEQ ID NO: 7324534 - DNA, 22 bp, Homo sapiens
cctgggtttggagcctgcagaa

SEQ ID NO: 7324535 - DNA, 22 bp, Homo sapiens
cctgggttccagcaccctctag

SEQ ID NO: 7324536 - DNA, 22 bp, Homo sapiens
aggtggagtgaaggaaaggcag

SEQ ID NO: 7324537 - DNA, 22 bp, Homo sapiens
aggtggagtgtgcagggagagc

SEQ ID NO: 7324538 - DNA, 22 bp, Homo sapiens
aggtgaggtttgggaggtgtca

SEQ ID NO: 7324539 - DNA, 22 bp, Homo sapiens
aggtctggaggcggagtcagga

SEQ ID NO: 7324540 - DNA, 22 bp, Homo sapiens
aggtctggctcttctccacaga

SEQ ID NO: 7324541 - DNA, 22 bp, Homo sapiens
agggtggctgtgaagtgcttgg

SEQ ID NO: 7324542 - DNA, 22 bp, Homo sapiens
cctgcctgcgtcctctgagggc

SEQ ID NO: 7324543 - DNA, 22 bp, Homo sapiens
ctgaagctaggtcaaaaaaggg

SEQ ID NO: 7324544 - DNA, 22 bp, Homo sapiens
ctgaagccacgatagcttccta

SEQ ID NO: 7324545 - DNA, 22 bp, Homo sapiens
ctgagaggatgctgcagtggag

SEQ ID NO: 7324546 - DNA, 21 bp, Homo sapiens
agtgtgtgtggaatgagaata

SEQ ID NO: 7324547 - DNA, 22 bp, Homo sapiens
agtgtgtgcctttggatacctg

SEQ ID NO: 7324548 - DNA, 22 bp, Homo sapiens
ctcttaaagaatgttccagctg

SEQ ID NO: 7324549 - DNA, 22 bp, Homo sapiens
agtgggagggccatatggtgaa

SEQ ID NO: 7324550 - DNA, 22 bp, Homo sapiens
agtccaagattagggtgacagc

SEQ ID NO: 7324551 - DNA, 22 bp, Homo sapiens
agtcattttctgcctgtaatct

SEQ ID NO: 7324552 - DNA, 22 bp, Homo sapiens
agtcatcaccagtacagtgtgc

SEQ ID NO: 7324553 - DNA, 22 bp, Homo sapiens
agtcatcatctgccctcactgg

SEQ ID NO: 7324554 - DNA, 22 bp, Homo sapiens
agtcatcatggaaaatgttgtt

SEQ ID NO: 7324555 - DNA, 22 bp, Homo sapiens
agtcattatgggtaaagttttt

SEQ ID NO: 7324556 - DNA, 22 bp, Homo sapiens
ctcccaggggagtcatctgctt

SEQ ID NO: 7324557 - DNA, 22 bp, Homo sapiens
agtgcagctccctcacctgctt

SEQ ID NO: 7324558 - DNA, 22 bp, Homo sapiens
agtgcagagacctggtcaggca

SEQ ID NO: 7324559 - DNA, 20 bp, Homo sapiens
agtgactgggagaatggatt

SEQ ID NO: 7324560 - DNA, 22 bp, Homo sapiens
ccgaggaagggacagggctctg

SEQ ID NO: 7324561 - DNA, 22 bp, Homo sapiens
ccgaggagcttttccaaggtgt

SEQ ID NO: 7324562 - DNA, 22 bp, Homo sapiens
cctcctgcggcgtccgcgctct

SEQ ID NO: 7324563 - DNA, 22 bp, Homo sapiens
agggcagagagatgaatgggat

SEQ ID NO: 7324564 - DNA, 22 bp, Homo sapiens
agggcagagcactgaattggga

SEQ ID NO: 7324565 - DNA, 22 bp, Homo sapiens
agggcagagatctgagtgggca

SEQ ID NO: 7324566 - DNA, 17 bp, Homo sapiens
agggagtcagaggatcg

SEQ ID NO: 7324567 - DNA, 22 bp, Homo sapiens
agggagaaggtccatgcctgtc

SEQ ID NO: 7324568 - DNA, 22 bp, Homo sapiens
agggagtggttaagaaggtgca

SEQ ID NO: 7324569 - DNA, 22 bp, Homo sapiens
agggagtccattttagaggtgg

SEQ ID NO: 7324570 - DNA, 17 bp, Homo sapiens
agggagtcagtaggagc

SEQ ID NO: 7324571 - DNA, 22 bp, Homo sapiens
agggactggctctctgagcagg

SEQ ID NO: 7324572 - DNA, 22 bp, Homo sapiens
agggagtgtaaatggtgctcag

SEQ ID NO: 7324573 - DNA, 22 bp, Homo sapiens
agggagtgttacataatgggtt

SEQ ID NO: 7324574 - DNA, 22 bp, Homo sapiens
agggatggagcccagctgttct

SEQ ID NO: 7324575 - DNA, 22 bp, Homo sapiens
aggcatggatgtagcagtgacc

SEQ ID NO: 7324576 - DNA, 22 bp, Homo sapiens
aggcatggcactgagcagcttc

SEQ ID NO: 7324577 - DNA, 19 bp, Homo sapiens
ccagcagacacagctgccc

SEQ ID NO: 7324578 - DNA, 17 bp, Homo sapiens
aggcaggtaagagttat

SEQ ID NO: 7324579 - DNA, 22 bp, Homo sapiens
ccacagcttcgcagtctgctgc

SEQ ID NO: 7324580 - DNA, 22 bp, Homo sapiens
aggcagggtcttgctatgttgc

SEQ ID NO: 7324581 - DNA, 22 bp, Homo sapiens
aggcaggggagctggaagggta

SEQ ID NO: 7324582 - DNA, 22 bp, Homo sapiens
ccaggagagctctcgttcagtg

SEQ ID NO: 7324583 - DNA, 22 bp, Homo sapiens
ccaggacaattcgtcactttct

SEQ ID NO: 7324584 - DNA, 22 bp, Homo sapiens
aggctgagtcgggaggatcact

SEQ ID NO: 7324585 - DNA, 17 bp, Homo sapiens
ccaggagcgtgggtctc

SEQ ID NO: 7324586 - DNA, 17 bp, Homo sapiens
ccaggagcgtgggtctc

SEQ ID NO: 7324587 - DNA, 22 bp, Homo sapiens
caggcactgtgcaagggtctcg

SEQ ID NO: 7324588 - DNA, 22 bp, Homo sapiens
caggagccccaggctgacaata

SEQ ID NO: 7324589 - DNA, 22 bp, Homo sapiens
caggagccccaggctgacaata

SEQ ID NO: 7324590 - DNA, 22 bp, Homo sapiens
caggagccccaggctgacaata

SEQ ID NO: 7324591 - DNA, 22 bp, Homo sapiens
caggcacttctgctgcttgtct

SEQ ID NO: 7324592 - DNA, 22 bp, Homo sapiens
caggcactgtgttaggcactgt

SEQ ID NO: 7324593 - DNA, 20 bp, Homo sapiens
cagctctgggcaggtcgagg

SEQ ID NO: 7324594 - DNA, 22 bp, Homo sapiens
cagctctggggcagagtgacta

SEQ ID NO: 7324595 - DNA, 22 bp, Homo sapiens
cagctctgggtgacaggagggc

SEQ ID NO: 7324596 - DNA, 22 bp, Homo sapiens
cagctctggtccagggagggca

SEQ ID NO: 7324597 - DNA, 22 bp, Homo sapiens
cagctctgtaaattccttcatc

SEQ ID NO: 7324598 - DNA, 22 bp, Homo sapiens
cagctctggttcctgggcccag

SEQ ID NO: 7324599 - DNA, 22 bp, Homo sapiens
agctgccacatgcccaagggca

SEQ ID NO: 7324600 - DNA, 22 bp, Homo sapiens
caggaaggcgcggctgtgcctg

SEQ ID NO: 7324601 - DNA, 22 bp, Homo sapiens
caggtgagtaacaatgggtgat

SEQ ID NO: 7324602 - DNA, 22 bp, Homo sapiens
agctgtggcaaccttgtcagac

SEQ ID NO: 7324603 - DNA, 22 bp, Homo sapiens
caggctggagttacctttaggg

SEQ ID NO: 7324604 - DNA, 22 bp, Homo sapiens
catggcaataggaatgatgtga

SEQ ID NO: 7324605 - DNA, 21 bp, Homo sapiens
aggagggcacaaggccaggaa

SEQ ID NO: 7324606 - DNA, 22 bp, Homo sapiens
ccaagcaaggctaattcacttg

SEQ ID NO: 7324607 - DNA, 22 bp, Homo sapiens
ccaagtcctgtctctcaatcat

SEQ ID NO: 7324608 - DNA, 22 bp, Homo sapiens
ccaagtcttggttctgtatctt

SEQ ID NO: 7324609 - DNA, 22 bp, Homo sapiens
aggacgctctcgctgaacttct

SEQ ID NO: 7324610 - DNA, 22 bp, Homo sapiens
aggacctggatcacagagatct

SEQ ID NO: 7324611 - DNA, 22 bp, Homo sapiens
aggaccatgcagtcatcaccaa

SEQ ID NO: 7324612 - DNA, 22 bp, Homo sapiens
caggtgggagccacagcgtaca

SEQ ID NO: 7324613 - DNA, 22 bp, Homo sapiens
caggtgggaccatgatagggca

SEQ ID NO: 7324614 - DNA, 22 bp, Homo sapiens
caggtgggagcgaggagctact

SEQ ID NO: 7324615 - DNA, 22 bp, Homo sapiens
cagtggcgtgatctctgctcac

SEQ ID NO: 7324616 - DNA, 22 bp, Homo sapiens
catagctgtgtgccatgtaaaa

SEQ ID NO: 7324617 - DNA, 22 bp, Homo sapiens
catataaatacaacatgtgtta

SEQ ID NO: 7324618 - DNA, 22 bp, Homo sapiens
catagcaacagcatcaagtcaa

SEQ ID NO: 7324619 - DNA, 22 bp, Homo sapiens
aggagggagcttaagccaggca

SEQ ID NO: 7324620 - DNA, 22 bp, Homo sapiens
aggagggagcactatatgggga

SEQ ID NO: 7324621 - DNA, 21 bp, Homo sapiens
aggaagaaaggttggaggttg

SEQ ID NO: 7324622 - DNA, 21 bp, Homo sapiens
aggaagaaaggttggaggttg

SEQ ID NO: 7324623 - DNA, 23 bp, Homo sapiens
aggaagagagagtgcctctttct

SEQ ID NO: 7324624 - DNA, 22 bp, Homo sapiens
aggaagacaatctgtgtgctgt

SEQ ID NO: 7324625 - DNA, 22 bp, Homo sapiens
acagggctcccagcaggtctgt

SEQ ID NO: 7324626 - DNA, 22 bp, Homo sapiens
acaggcaggagctccccattcc

SEQ ID NO: 7324627 - DNA, 22 bp, Homo sapiens
agctggcaccaaatatagtaaa

SEQ ID NO: 7324628 - DNA, 23 bp, Homo sapiens
acaggaggggacaggtggccgtg

SEQ ID NO: 7324629 - DNA, 22 bp, Homo sapiens
agctgaatgttctcagaccaga

SEQ ID NO: 7324630 - DNA, 21 bp, Homo sapiens
aggatgccgcaggcggagaag

SEQ ID NO: 7324631 - DNA, 22 bp, Homo sapiens
aggatgagattccagggtcaat

SEQ ID NO: 7324632 - DNA, 22 bp, Homo sapiens
acagttcagacaagtgttccat

SEQ ID NO: 7324633 - DNA, 22 bp, Homo sapiens
acatatttccatgcagcatgtc

SEQ ID NO: 7324634 - DNA, 22 bp, Homo sapiens
acagtatttgcgatactgatga

SEQ ID NO: 7324635 - DNA, 19 bp, Homo sapiens
acagtgtctgtatataaat

SEQ ID NO: 7324636 - DNA, 22 bp, Homo sapiens
acaggtgttgactcacaggccc

SEQ ID NO: 7324637 - DNA, 22 bp, Homo sapiens
acagtacaccactgtgtacagt

SEQ ID NO: 7324638 - DNA, 22 bp, Homo sapiens
aggagcagaatttaatgtgcag

SEQ ID NO: 7324639 - DNA, 22 bp, Homo sapiens
aggagcagaactgttgtggagg

SEQ ID NO: 7324640 - DNA, 22 bp, Homo sapiens
acatgcttctgtttcaagaact

SEQ ID NO: 7324641 - DNA, 22 bp, Homo sapiens
acatgctacagtgaaggaggaa

SEQ ID NO: 7324642 - DNA, 22 bp, Homo sapiens
acatcatttgtctgtagctgaa

SEQ ID NO: 7324643 - DNA, 22 bp, Homo sapiens
acatcattttcttcagtgtttg

SEQ ID NO: 7324644 - DNA, 22 bp, Homo sapiens
acatcatcgtgcacatacataa

SEQ ID NO: 7324645 - DNA, 22 bp, Homo sapiens
acatcattgtccgttgtcatga

SEQ ID NO: 7324646 - DNA, 22 bp, Homo sapiens
acatgtttaagtttaatgaaaa

SEQ ID NO: 7324647 - DNA, 22 bp, Homo sapiens
acatgttaaacatcatggaatg

SEQ ID NO: 7324648 - DNA, 22 bp, Homo sapiens
acatgttagggacagagtatgt

SEQ ID NO: 7324649 - DNA, 22 bp, Homo sapiens
acatgttagctactattgttat

SEQ ID NO: 7324650 - DNA, 22 bp, Homo sapiens
acatttgagatgccttttaggt

SEQ ID NO: 7324651 - DNA, 22 bp, Homo sapiens
acatttcactgttcacagcagg

SEQ ID NO: 7324652 - DNA, 22 bp, Homo sapiens
acattgtataatgattatcaca

SEQ ID NO: 7324653 - DNA, 22 bp, Homo sapiens
acattgtagacttttcatatgt

SEQ ID NO: 7324654 - DNA, 22 bp, Homo sapiens
agggagaggagggtcttgttga

SEQ ID NO: 7324655 - DNA, 19 bp, Homo sapiens
accagcccactcccagttt

SEQ ID NO: 7324656 - DNA, 18 bp, Homo sapiens
aggcttgggcccagcagc

SEQ ID NO: 7324657 - DNA, 19 bp, Homo sapiens
accagcccactcccagttt

SEQ ID NO: 7324658 - DNA, 22 bp, Homo sapiens
accaggctggagtgcagtggcg

SEQ ID NO: 7324659 - DNA, 22 bp, Homo sapiens
agggggcattatgaggcttttc

SEQ ID NO: 7324660 - DNA, 22 bp, Homo sapiens
agaaaggtcacttagcctcagc

SEQ ID NO: 7324661 - DNA, 22 bp, Homo sapiens
agaacacttgctcctgattctc

SEQ ID NO: 7324662 - DNA, 22 bp, Homo sapiens
agaacagggactggaggcttca

SEQ ID NO: 7324663 - DNA, 22 bp, Homo sapiens
atcatcttatctgactcatttt

SEQ ID NO: 7324664 - DNA, 22 bp, Homo sapiens
atcatcttgaaagtctatgttt

SEQ ID NO: 7324665 - DNA, 22 bp, Homo sapiens
actttcatgttcatttggaacc

SEQ ID NO: 7324666 - DNA, 22 bp, Homo sapiens
actttctcaaatcagactttaa

SEQ ID NO: 7324667 - DNA, 22 bp, Homo sapiens
atatgcttatgatgtctcaagt

SEQ ID NO: 7324668 - DNA, 22 bp, Homo sapiens
atatgcttacagcttaaaatcc

SEQ ID NO: 7324669 - DNA, 22 bp, Homo sapiens
actttctcccacccacccgtct

SEQ ID NO: 7324670 - DNA, 22 bp, Homo sapiens
actttctcaggaattcacagac

SEQ ID NO: 7324671 - DNA, 22 bp, Homo sapiens
actttctccagaaaaccaagga

SEQ ID NO: 7324672 - DNA, 19 bp, Homo sapiens
actttctccaggacctgtt

SEQ ID NO: 7324673 - DNA, 22 bp, Homo sapiens
atatgcttgggactgatacagt

SEQ ID NO: 7324674 - DNA, 22 bp, Homo sapiens
agaaaaggttgaaagtaggatt

SEQ ID NO: 7324675 - DNA, 22 bp, Homo sapiens
ataaacaagactggccaacttt

SEQ ID NO: 7324676 - DNA, 22 bp, Homo sapiens
ataaacaagactggccaacttt

SEQ ID NO: 7324677 - DNA, 22 bp, Homo sapiens
ataaaaactgacccatcctttg

SEQ ID NO: 7324678 - DNA, 22 bp, Homo sapiens
ataaacagtaaatgtgagcagt

SEQ ID NO: 7324679 - DNA, 22 bp, Homo sapiens
actgtgccacaattcaccaggg

SEQ ID NO: 7324680 - DNA, 22 bp, Homo sapiens
actgtcaccatcagagcgggaa

SEQ ID NO: 7324681 - DNA, 22 bp, Homo sapiens
actgtcactccaactgagtcgt

SEQ ID NO: 7324682 - DNA, 19 bp, Homo sapiens
acttctgaggaactgcaca

SEQ ID NO: 7324683 - DNA, 22 bp, Homo sapiens
atacagattgctatacttacaa

SEQ ID NO: 7324684 - DNA, 22 bp, Homo sapiens
acttaaagttataatttgctaa

SEQ ID NO: 7324685 - DNA, 22 bp, Homo sapiens
acttaaagtagttttactgtgg

SEQ ID NO: 7324686 - DNA, 22 bp, Homo sapiens
acttaaatagaactcctcaata

SEQ ID NO: 7324687 - DNA, 22 bp, Homo sapiens
atacagatgttaaagcaatttc

SEQ ID NO: 7324688 - DNA, 22 bp, Homo sapiens
atacagatgttgaatgttatat

SEQ ID NO: 7324689 - DNA, 22 bp, Homo sapiens
atacatgttgagaaaatatctg

SEQ ID NO: 7324690 - DNA, 22 bp, Homo sapiens
atacatgttgtaccatatgttt

SEQ ID NO: 7324691 - DNA, 22 bp, Homo sapiens
atactgaaggcattcagataac

SEQ ID NO: 7324692 - DNA, 21 bp, Homo sapiens
atactgaacctcataagccca

SEQ ID NO: 7324693 - DNA, 22 bp, Homo sapiens
atactgaattaggtaaagcata

SEQ ID NO: 7324694 - DNA, 22 bp, Homo sapiens
atactgaaaaatgatttgctgt

SEQ ID NO: 7324695 - DNA, 22 bp, Homo sapiens
atactgaaaataagtgagttga

SEQ ID NO: 7324696 - DNA, 23 bp, Homo sapiens
atactgaaactgttgtttatctg

SEQ ID NO: 7324697 - DNA, 22 bp, Homo sapiens
atactgaacatgtttgcagtca

SEQ ID NO: 7324698 - DNA, 22 bp, Homo sapiens
atactgaaagggtgttacctaa

SEQ ID NO: 7324699 - DNA, 22 bp, Homo sapiens
actttagtaaacttatgttact

SEQ ID NO: 7324700 - DNA, 22 bp, Homo sapiens
actttatttcctattgcatcca

SEQ ID NO: 7324701 - DNA, 23 bp, Homo sapiens
actgctttattcatgaggctctc

SEQ ID NO: 7324702 - DNA, 22 bp, Homo sapiens
agtgtagggtggtcagagcaga

SEQ ID NO: 7324703 - DNA, 22 bp, Homo sapiens
agtgtaggtgagggcctgggtt

SEQ ID NO: 7324704 - DNA, 22 bp, Homo sapiens
agtgtttaaactgaagtgatga

SEQ ID NO: 7324705 - DNA, 22 bp, Homo sapiens
agtgcaattttgctttcccaat

SEQ ID NO: 7324706 - DNA, 22 bp, Homo sapiens
actgaggacagtgaggagggct

SEQ ID NO: 7324707 - DNA, 22 bp, Homo sapiens
agtctttaagtaatgataggca

SEQ ID NO: 7324708 - DNA, 22 bp, Homo sapiens
agtctttaatgatcatgtattt

SEQ ID NO: 7324709 - DNA, 22 bp, Homo sapiens
acctgaattgatttgacctgta

SEQ ID NO: 7324710 - DNA, 22 bp, Homo sapiens
acctgaattttggatgagctgt

SEQ ID NO: 7324711 - DNA, 22 bp, Homo sapiens
acctctttgaacctcagtgtga

SEQ ID NO: 7324712 - DNA, 22 bp, Homo sapiens
accctctgagaggcacactttg

SEQ ID NO: 7324713 - DNA, 22 bp, Homo sapiens
accctccaggctgcagctcctg

SEQ ID NO: 7324714 - DNA, 22 bp, Homo sapiens
acctgcaggggtgctctctggg

SEQ ID NO: 7324715 - DNA, 22 bp, Homo sapiens
acctgcagtggccactcctaat

SEQ ID NO: 7324716 - DNA, 22 bp, Homo sapiens
aggtggcatgcctgagacataa

SEQ ID NO: 7324717 - DNA, 20 bp, Homo sapiens
acctggctctcaggagcaac

SEQ ID NO: 7324718 - DNA, 22 bp, Homo sapiens
aggtggcatttacaccatggga

SEQ ID NO: 7324719 - DNA, 22 bp, Homo sapiens
aggtggctcctcccatggctgg

SEQ ID NO: 7324720 - DNA, 22 bp, Homo sapiens
actagggaaagttatgttcaca

SEQ ID NO: 7324721 - DNA, 22 bp, Homo sapiens
agtcaaaacatgtactttcctt

SEQ ID NO: 7324722 - DNA, 22 bp, Homo sapiens
agtaaaatcttaagcacagtgg

SEQ ID NO: 7324723 - DNA, 22 bp, Homo sapiens
agtaaacagaaagcaagatgat

SEQ ID NO: 7324724 - DNA, 19 bp, Homo sapiens
agagtttaggtctatcagg

SEQ ID NO: 7324725 - DNA, 22 bp, Homo sapiens
attgctgactcaataattgaag

SEQ ID NO: 7324726 - DNA, 22 bp, Homo sapiens
agagttttatggctttaattct

SEQ ID NO: 7324727 - DNA, 22 bp, Homo sapiens
atttctcattttgcttcaaagg

SEQ ID NO: 7324728 - DNA, 22 bp, Homo sapiens
atttctcatgtacaaaaacact

SEQ ID NO: 7324729 - DNA, 22 bp, Homo sapiens
atttgcttttactatgttaaaa

SEQ ID NO: 7324730 - DNA, 22 bp, Homo sapiens
atttggctgtagtaactggatc

SEQ ID NO: 7324731 - DNA, 22 bp, Homo sapiens
agaggaggaagagctttaaaat

SEQ ID NO: 7324732 - DNA, 22 bp, Homo sapiens
agaggaggatttgtaaaggtct

SEQ ID NO: 7324733 - DNA, 22 bp, Homo sapiens
agaggaggcagcttaactcagt

SEQ ID NO: 7324734 - DNA, 22 bp, Homo sapiens
agaggaggccaggcccacacct

SEQ ID NO: 7324735 - DNA, 22 bp, Homo sapiens
agaggaggctgggtccagataa

SEQ ID NO: 7324736 - DNA, 22 bp, Homo sapiens
attataggcttgagccaccgtg

SEQ ID NO: 7324737 - DNA, 22 bp, Homo sapiens
attattaaagcttaggtcttat

SEQ ID NO: 7324738 - DNA, 23 bp, Homo sapiens
attattaaggacatggactttgt

SEQ ID NO: 7324739 - DNA, 22 bp, Homo sapiens
agaggcagaagtgttcaaaccc

SEQ ID NO: 7324740 - DNA, 22 bp, Homo sapiens
atgtttatgcaaacatgtgagt

SEQ ID NO: 7324741 - DNA, 22 bp, Homo sapiens
attgcattcattgacatatgag

SEQ ID NO: 7324742 - DNA, 22 bp, Homo sapiens
attgcagatgatccccaagtta

SEQ ID NO: 7324743 - DNA, 22 bp, Homo sapiens
attcatgttagcccacatgtag

SEQ ID NO: 7324744 - DNA, 22 bp, Homo sapiens
attcagtagaagttagctatta

SEQ ID NO: 7324745 - DNA, 22 bp, Homo sapiens
attcatgtcatagcaggatttc

SEQ ID NO: 7324746 - DNA, 22 bp, Homo sapiens
agaggcaggaagagctgatttt

SEQ ID NO: 7324747 - DNA, 22 bp, Homo sapiens
agaggcaggaggttgacttgag

SEQ ID NO: 7324748 - DNA, 22 bp, Homo sapiens
agaggcagcagtcatactacag

SEQ ID NO: 7324749 - DNA, 22 bp, Homo sapiens
agaggcagccgtatttcaaagg

SEQ ID NO: 7324750 - DNA, 17 bp, Homo sapiens
agaggcagatacttgga

SEQ ID NO: 7324751 - DNA, 22 bp, Homo sapiens
atgaaattttaattatacctct

SEQ ID NO: 7324752 - DNA, 22 bp, Homo sapiens
atgaaactctaacttaacaagt

SEQ ID NO: 7324753 - DNA, 22 bp, Homo sapiens
atgaaactctaacttaacaagt

SEQ ID NO: 7324754 - DNA, 22 bp, Homo sapiens
agaagttatccaccttagatgc

SEQ ID NO: 7324755 - DNA, 21 bp, Homo sapiens
agaagtcaattgaactgaaat

SEQ ID NO: 7324756 - DNA, 22 bp, Homo sapiens
atgacaaaatgaatgcagctag

SEQ ID NO: 7324757 - DNA, 22 bp, Homo sapiens
agagatggccttaggtgggaat

SEQ ID NO: 7324758 - DNA, 22 bp, Homo sapiens
agagagttgaggaagcaacact

SEQ ID NO: 7324759 - DNA, 22 bp, Homo sapiens
atggcctggggagcatgggaag

SEQ ID NO: 7324760 - DNA, 22 bp, Homo sapiens
atggcctggccagagctctgct

SEQ ID NO: 7324761 - DNA, 20 bp, Homo sapiens
atggcctgctagaagtctgt

SEQ ID NO: 7324762 - DNA, 22 bp, Homo sapiens
agagacagggttttgtcgtgtt

SEQ ID NO: 7324763 - DNA, 22 bp, Homo sapiens
agagacagaggcaatatagctt

SEQ ID NO: 7324764 - DNA, 22 bp, Homo sapiens
agagaagattcttatatgtctt

SEQ ID NO: 7324765 - DNA, 22 bp, Homo sapiens
agagaagcagggagtcatctgt

SEQ ID NO: 7324766 - DNA, 22 bp, Homo sapiens
agagacatggagaggcaaagtt

SEQ ID NO: 7324767 - DNA, 22 bp, Homo sapiens
agagacatagcacagtttttcg

SEQ ID NO: 7324768 - DNA, 22 bp, Homo sapiens
cagcagtttcctatggttcagc

SEQ ID NO: 7324769 - DNA, 16 bp, Homo sapiens
cagccctgaggaagaa

SEQ ID NO: 7324770 - DNA, 22 bp, Homo sapiens
cagccctgagttagcccacgga

SEQ ID NO: 7324771 - DNA, 23 bp, Homo sapiens
cagccctgaaatcgaggtgacac

SEQ ID NO: 7324772 - DNA, 22 bp, Homo sapiens
cagccccacacggtctagctct

SEQ ID NO: 7324773 - DNA, 22 bp, Homo sapiens
cagcgtctcgttgtgggcctcg

SEQ ID NO: 7324774 - DNA, 22 bp, Homo sapiens
agctcagcgggcttctggtaag

SEQ ID NO: 7324775 - DNA, 21 bp, Homo sapiens
agctcagcaagatggaggctc

SEQ ID NO: 7324776 - DNA, 18 bp, Homo sapiens
agctcctgaactctgtgg

SEQ ID NO: 7324777 - DNA, 22 bp, Homo sapiens
cagctctgacacagtacaaaat

SEQ ID NO: 7324778 - DNA, 22 bp, Homo sapiens
agcctctggccctagactgctt

SEQ ID NO: 7324779 - DNA, 22 bp, Homo sapiens
agcctctgctggccctggcact

SEQ ID NO: 7324780 - DNA, 22 bp, Homo sapiens
cagagggagtttctgaggttgc

SEQ ID NO: 7324781 - DNA, 22 bp, Homo sapiens
cagaaatatgtgccatgcctta

SEQ ID NO: 7324782 - DNA, 22 bp, Homo sapiens
cagaaatatatatgggtcagag

SEQ ID NO: 7324783 - DNA, 22 bp, Homo sapiens
agcatataaatggacatatttg

SEQ ID NO: 7324784 - DNA, 20 bp, Homo sapiens
agccacctcatttccctacc

SEQ ID NO: 7324785 - DNA, 16 bp, Homo sapiens
agccacctcagaggac

SEQ ID NO: 7324786 - DNA, 22 bp, Homo sapiens
agccacctcacctgctgccgtt

SEQ ID NO: 7324787 - DNA, 22 bp, Homo sapiens
agccacctggacacaggcttgc

SEQ ID NO: 7324788 - DNA, 22 bp, Homo sapiens
agccacctctatcttgggctcc

SEQ ID NO: 7324789 - DNA, 22 bp, Homo sapiens
agccacctctgtgcaggcctcg

SEQ ID NO: 7324790 - DNA, 22 bp, Homo sapiens
agccacctcctgctctgctcac

SEQ ID NO: 7324791 - DNA, 22 bp, Homo sapiens
agccaccttctccaaggcctag

SEQ ID NO: 7324792 - DNA, 22 bp, Homo sapiens
agccaccttcacatggtctatc

SEQ ID NO: 7324793 - DNA, 22 bp, Homo sapiens
cagaataccctatagacagaat

SEQ ID NO: 7324794 - DNA, 22 bp, Homo sapiens
cagaatctcgacttctggcccc

SEQ ID NO: 7324795 - DNA, 22 bp, Homo sapiens
cagaatgtagatcatcatcaag

SEQ ID NO: 7324796 - DNA, 22 bp, Homo sapiens
cagaatgtatatgatctaaggt

SEQ ID NO: 7324797 - DNA, 22 bp, Homo sapiens
agccactgtgcaggagcagtgt

SEQ ID NO: 7324798 - DNA, 22 bp, Homo sapiens
agccagactttaaaatagatga

SEQ ID NO: 7324799 - DNA, 22 bp, Homo sapiens
agccagacatggctcctgctcc

SEQ ID NO: 7324800 - DNA, 22 bp, Homo sapiens
agccagacctcggagtagtgag

SEQ ID NO: 7324801 - DNA, 22 bp, Homo sapiens
agccagactcatttggaagtat

SEQ ID NO: 7324802 - DNA, 22 bp, Homo sapiens
agccagactgtgatgtgattaa

SEQ ID NO: 7324803 - DNA, 22 bp, Homo sapiens
cagacagggttttggtctttgg

SEQ ID NO: 7324804 - DNA, 22 bp, Homo sapiens
cagacatccaggtacgagcttt

SEQ ID NO: 7324805 - DNA, 22 bp, Homo sapiens
cagacatctgtacccagcctgt

SEQ ID NO: 7324806 - DNA, 22 bp, Homo sapiens
cagacatcttttatcttcagga

SEQ ID NO: 7324807 - DNA, 20 bp, Homo sapiens
agcccaggcctgtgtgagtc

SEQ ID NO: 7324808 - DNA, 22 bp, Homo sapiens
agcccaggctggagtgcagtgg

SEQ ID NO: 7324809 - DNA, 22 bp, Homo sapiens
cagagggagccctccaggagca

SEQ ID NO: 7324810 - DNA, 22 bp, Homo sapiens
cagagggacagtgtaatgcata

SEQ ID NO: 7324811 - DNA, 22 bp, Homo sapiens
cagagggaccagaacatactgt

SEQ ID NO: 7324812 - DNA, 22 bp, Homo sapiens
agcccagggaaccaggaagtgg

SEQ ID NO: 7324813 - DNA, 22 bp, Homo sapiens
cagaggagttcagtacacagcc

SEQ ID NO: 7324814 - DNA, 22 bp, Homo sapiens
agcccagagacaatgctcagta

SEQ ID NO: 7324815 - DNA, 22 bp, Homo sapiens
agcccaaggcttccctgctggc

SEQ ID NO: 7324816 - DNA, 22 bp, Homo sapiens
caagacaatgggtaagtgtaac

SEQ ID NO: 7324817 - DNA, 22 bp, Homo sapiens
caagagacgggcaaggcaagag

SEQ ID NO: 7324818 - DNA, 23 bp, Homo sapiens
caacactgccttcaggtgaagaa

SEQ ID NO: 7324819 - DNA, 22 bp, Homo sapiens
cacaaggcacattccttgtcca

SEQ ID NO: 7324820 - DNA, 22 bp, Homo sapiens
agcagccacagcagatctgagt

SEQ ID NO: 7324821 - DNA, 22 bp, Homo sapiens
agcagccaattggaggatgaag

SEQ ID NO: 7324822 - DNA, 22 bp, Homo sapiens
agcagccagaaagggcagtcga

SEQ ID NO: 7324823 - DNA, 22 bp, Homo sapiens
agcagccacccagctgctcatt

SEQ ID NO: 7324824 - DNA, 22 bp, Homo sapiens
caagcaacgactttcaagctgt

SEQ ID NO: 7324825 - DNA, 22 bp, Homo sapiens
caagagcatttagttagctggt

SEQ ID NO: 7324826 - DNA, 22 bp, Homo sapiens
cacacactgttaatgtaggagt

SEQ ID NO: 7324827 - DNA, 22 bp, Homo sapiens
cacacactggagcaaggagatg

SEQ ID NO: 7324828 - DNA, 22 bp, Homo sapiens
cacacacagttttgtattctgt

SEQ ID NO: 7324829 - DNA, 22 bp, Homo sapiens
agcaggagtttgatgcttttat

SEQ ID NO: 7324830 - DNA, 22 bp, Homo sapiens
cacagttatatgttcacaagga

SEQ ID NO: 7324831 - DNA, 22 bp, Homo sapiens
cacagttagctccagtcttagc

SEQ ID NO: 7324832 - DNA, 22 bp, Homo sapiens
cacagttagaggtagagtccag

SEQ ID NO: 7324833 - DNA, 22 bp, Homo sapiens
cacagttaagggatgtcatgtt

SEQ ID NO: 7324834 - DNA, 22 bp, Homo sapiens
cacagttagaggtagagtccag

SEQ ID NO: 7324835 - DNA, 22 bp, Homo sapiens
agcaggcactatgccaggatct

SEQ ID NO: 7324836 - DNA, 22 bp, Homo sapiens
cacagtttggtatagaagtgat

SEQ ID NO: 7324837 - DNA, 16 bp, Homo sapiens
cacagttatgggtgtg

SEQ ID NO: 7324838 - DNA, 22 bp, Homo sapiens
cacagttatgggaaacgtagtt

SEQ ID NO: 7324839 - DNA, 22 bp, Homo sapiens
cacagttatgggaaacgtagtt

SEQ ID NO: 7324840 - DNA, 17 bp, Homo sapiens
agcaggctgcagaggcc

SEQ ID NO: 7324841 - DNA, 22 bp, Homo sapiens
agcaggggtctctgctaatgaa

SEQ ID NO: 7324842 - DNA, 22 bp, Homo sapiens
agcaggggcagggttttgtgct

SEQ ID NO: 7324843 - DNA, 23 bp, Homo sapiens
agcaggctgcttctccacagctg

SEQ ID NO: 7324844 - DNA, 22 bp, Homo sapiens
cactgctacctctgcctcccgg

SEQ ID NO: 7324845 - DNA, 22 bp, Homo sapiens
cacctcatgtcatcagtaaaat

SEQ ID NO: 7324846 - DNA, 22 bp, Homo sapiens
aacaggaatgaggagaaaaggt

SEQ ID NO: 7324847 - DNA, 22 bp, Homo sapiens
aagtccaagatgcagttgtcag

SEQ ID NO: 7324848 - DNA, 22 bp, Homo sapiens
aagtcatcttgagtctaagatt

SEQ ID NO: 7324849 - DNA, 22 bp, Homo sapiens
aacaaatgtaaaatgcagatgc

SEQ ID NO: 7324850 - DNA, 22 bp, Homo sapiens
aacaaatgtaaaatgcagatgc

SEQ ID NO: 7324851 - DNA, 22 bp, Homo sapiens
aacactaacatatagtcagtgg

SEQ ID NO: 7324852 - DNA, 22 bp, Homo sapiens
aacactgagaacaatacagagt

SEQ ID NO: 7324853 - DNA, 22 bp, Homo sapiens
aacactgaagaccaggtaattt

SEQ ID NO: 7324854 - DNA, 22 bp, Homo sapiens
aacactgaagccgttaaacctt

SEQ ID NO: 7324855 - DNA, 22 bp, Homo sapiens
aacactgaaatgtcttaagatt

SEQ ID NO: 7324856 - DNA, 22 bp, Homo sapiens
aacactgaagtagtgaatactg

SEQ ID NO: 7324857 - DNA, 22 bp, Homo sapiens
aaatgtgtttgataggaatatt

SEQ ID NO: 7324858 - DNA, 22 bp, Homo sapiens
aaatgtgttcctttgctacaga

SEQ ID NO: 7324859 - DNA, 22 bp, Homo sapiens
aaatgtgtttcgaaaactggtg

SEQ ID NO: 7324860 - DNA, 22 bp, Homo sapiens
aaatgtttctacttgtgagcat

SEQ ID NO: 7324861 - DNA, 22 bp, Homo sapiens
aaatgttttgctcccatgtggt

SEQ ID NO: 7324862 - DNA, 22 bp, Homo sapiens
aaatgtctatctggcatattcc

SEQ ID NO: 7324863 - DNA, 22 bp, Homo sapiens
aaatgtgtgtatgtacatatat

SEQ ID NO: 7324864 - DNA, 21 bp, Homo sapiens
aaatgtgttccataatgcttt

SEQ ID NO: 7324865 - DNA, 22 bp, Homo sapiens
aaatgtgtcatattcaaagtca

SEQ ID NO: 7324866 - DNA, 22 bp, Homo sapiens
aaatgtgtatatgaaacatgat

SEQ ID NO: 7324867 - DNA, 22 bp, Homo sapiens
aaatgtgtcagtttcattctct

SEQ ID NO: 7324868 - DNA, 22 bp, Homo sapiens
aaattttagaccaggcaaaact

SEQ ID NO: 7324869 - DNA, 22 bp, Homo sapiens
aacaaagtcgttgcctagaaga

SEQ ID NO: 7324870 - DNA, 22 bp, Homo sapiens
aactgcttagtgatggatgacc

SEQ ID NO: 7324871 - DNA, 22 bp, Homo sapiens
aatccacacatctggcatgtga

SEQ ID NO: 7324872 - DNA, 22 bp, Homo sapiens
aatcatcttcatcttacacaga

SEQ ID NO: 7324873 - DNA, 21 bp, Homo sapiens
aacatttcaggatccaaattg

SEQ ID NO: 7324874 - DNA, 22 bp, Homo sapiens
aataagaactccatttactcgt

SEQ ID NO: 7324875 - DNA, 22 bp, Homo sapiens
aacatgtaaatatcattgtact

SEQ ID NO: 7324876 - DNA, 22 bp, Homo sapiens
aaccaacataggaatgcagaga

SEQ ID NO: 7324877 - DNA, 22 bp, Homo sapiens
aaccaccattctctcctcttcc

SEQ ID NO: 7324878 - DNA, 22 bp, Homo sapiens
aatataaattcctgggcccagc

SEQ ID NO: 7324879 - DNA, 22 bp, Homo sapiens
aagagagtcagtctgagcacca

SEQ ID NO: 7324880 - DNA, 22 bp, Homo sapiens
aagaggaactgggggctgagtc

SEQ ID NO: 7324881 - DNA, 22 bp, Homo sapiens
aattggcagtttcatcagacag

SEQ ID NO: 7324882 - DNA, 22 bp, Homo sapiens
aagaaatgcagaaatgtgctgg

SEQ ID NO: 7324883 - DNA, 22 bp, Homo sapiens
aagccagcctgtttccttcttc

SEQ ID NO: 7324884 - DNA, 22 bp, Homo sapiens
aagcagcatgctatgctggtgg

SEQ ID NO: 7324885 - DNA, 18 bp, Homo sapiens
aaatggcagaatggatag

SEQ ID NO: 7324886 - DNA, 22 bp, Homo sapiens
aagcatcaacctgtatgctgca

SEQ ID NO: 7324887 - DNA, 22 bp, Homo sapiens
aaatgtattgcataggatattt

SEQ ID NO: 7324888 - DNA, 22 bp, Homo sapiens
aagctcttttcaccattaaagt

SEQ ID NO: 7324889 - DNA, 22 bp, Homo sapiens
aagctcttttcataagagcaaa

SEQ ID NO: 7324890 - DNA, 22 bp, Homo sapiens
aagctctttaatagtctaaaaa

SEQ ID NO: 7324891 - DNA, 22 bp, Homo sapiens
aaagtgtggcacaagtcacatc

SEQ ID NO: 7324892 - DNA, 22 bp, Homo sapiens
aaatcagtaaatgttcattaac

SEQ ID NO: 7324893 - DNA, 22 bp, Homo sapiens
aaatagctacatgatctctagg

SEQ ID NO: 7324894 - DNA, 22 bp, Homo sapiens
aaagtcaatgatttctcctgga

SEQ ID NO: 7324895 - DNA, 22 bp, Homo sapiens
aaagtgcagcttgtgatcccta

SEQ ID NO: 7324896 - DNA, 22 bp, Homo sapiens
aaagtgcagtaacttgcccaag

SEQ ID NO: 7324897 - DNA, 22 bp, Homo sapiens
aaagtcaaaatgctctcctgtc

SEQ ID NO: 7324898 - DNA, 22 bp, Homo sapiens
aaagtcaaggtttagactagag

SEQ ID NO: 7324899 - DNA, 22 bp, Homo sapiens
aaagtatcaagggaagcatttt

SEQ ID NO: 7324900 - DNA, 22 bp, Homo sapiens
aaagtatctgaccgattataaa

SEQ ID NO: 7324901 - DNA, 22 bp, Homo sapiens
aaaggtttatttaatcagggag

SEQ ID NO: 7324902 - DNA, 22 bp, Homo sapiens
aaaggtttattgattctgctct

SEQ ID NO: 7324903 - DNA, 22 bp, Homo sapiens
aaaggaaaataagtagttccat

SEQ ID NO: 7324904 - DNA, 22 bp, Homo sapiens
aaattttagtaaggaagttgag

SEQ ID NO: 7324905 - DNA, 22 bp, Homo sapiens
aaattttagactcctgggtcta

SEQ ID NO: 7324906 - DNA, 22 bp, Homo sapiens
aacaaacaaacattttgtcatc

SEQ ID NO: 7324907 - DNA, 22 bp, Homo sapiens
aaacactgtgtcaaactggggc

SEQ ID NO: 7324908 - DNA, 23 bp, Homo sapiens
aaaatcttctgcctatgaagaaa

SEQ ID NO: 7324909 - DNA, 20 bp, Homo sapiens
aaaaacagtaatgctgaaga

SEQ ID NO: 7324910 - DNA, 22 bp, Homo sapiens
aaacaagagtcttgctccacct

SEQ ID NO: 7324911 - DNA, 22 bp, Homo sapiens
aaacaaggtacacagtaatggt

SEQ ID NO: 7324912 - DNA, 22 bp, Homo sapiens
aaaattttgccctatccttcat

SEQ ID NO: 7324913 - DNA, 22 bp, Homo sapiens
aaaatccacaacgctcatttca

SEQ ID NO: 7324914 - DNA, 22 bp, Homo sapiens
aaaagtatggtggtccttttta

SEQ ID NO: 7324915 - DNA, 22 bp, Homo sapiens
aaaagtattggccaccatttct

SEQ ID NO: 7324916 - DNA, 22 bp, Homo sapiens
aaaagagaatcctgtacagaga

SEQ ID NO: 7324917 - DNA, 19 bp, Homo sapiens
aaactcatagactcatatt

SEQ ID NO: 7324918 - DNA, 22 bp, Homo sapiens
aaactcatgccattaatccttt

SEQ ID NO: 7324919 - DNA, 21 bp, Homo sapiens
aaagagcttttgtgctagtta

SEQ ID NO: 7324920 - DNA, 22 bp, Homo sapiens
aaagaggaaccaagagcacgtg

SEQ ID NO: 7324921 - DNA, 22 bp, Homo sapiens
aaagagggacaggcgcagacac

SEQ ID NO: 7324922 - DNA, 22 bp, Homo sapiens
aaagaaggtagggctggtgact

SEQ ID NO: 7324923 - DNA, 22 bp, Homo sapiens
aaacaatgtacacatgaatgtt

SEQ ID NO: 7324924 - DNA, 22 bp, Homo sapiens
aaacaatgtacatttataatgc

SEQ ID NO: 7324925 - DNA, 22 bp, Homo sapiens
aaacaatgttgtctccaagagg

SEQ ID NO: 7324926 - DNA, 22 bp, Homo sapiens
aaaggggtaatctaaggaattc

SEQ ID NO: 7324927 - DNA, 22 bp, Homo sapiens
aaacctgtctgattatggagac

SEQ ID NO: 7324928 - DNA, 18 bp, Homo sapiens
aaagttcagggagagttg

SEQ ID NO: 7324929 - DNA, 22 bp, Homo sapiens
aaagttcagtgccttctataca

SEQ ID NO: 7324930 - DNA, 22 bp, Homo sapiens
aaagttcactgaccagcactgg

SEQ ID NO: 7324931 - DNA, 22 bp, Homo sapiens
aaagttcagattagactcaaga

SEQ ID NO: 7324932 - DNA, 22 bp, Homo sapiens
aaagttcactatgtagcagcgt

SEQ ID NO: 7324933 - DNA, 22 bp, Homo sapiens
aaagttcattgatgactgaggt

SEQ ID NO: 7324934 - DNA, 20 bp, Homo sapiens
aaagttcatgtttgcacttt

SEQ ID NO: 7324935 - DNA, 22 bp, Homo sapiens
aaagttcatggtgttatagaaa

SEQ ID NO: 7324936 - DNA, 21 bp, Homo sapiens
aaagttcatgctttaatattc

SEQ ID NO: 7324937 - DNA, 22 bp, Homo sapiens
aagtgcttggctaatggttatg

SEQ ID NO: 7324938 - DNA, 22 bp, Homo sapiens
aagtgcatatttttgttgtaga

SEQ ID NO: 7324939 - DNA, 22 bp, Homo sapiens
aagtcacagagttggaagtcag

SEQ ID NO: 7324940 - DNA, 22 bp, Homo sapiens
aagtcacattctgaggtattgg

SEQ ID NO: 7324941 - DNA, 22 bp, Homo sapiens
aagttaggcttagttgagattt

SEQ ID NO: 7324942 - DNA, 20 bp, Homo sapiens
aagtgttttgacttctgacc

SEQ ID NO: 7324943 - DNA, 22 bp, Homo sapiens
aagtgttttggcttctgtacac

SEQ ID NO: 7324944 - DNA, 22 bp, Homo sapiens
aagttcaaggcaggtcctgagg

SEQ ID NO: 7324945 - DNA, 22 bp, Homo sapiens
aagttcaaaaatgtaatcagtg

SEQ ID NO: 7324946 - DNA, 22 bp, Homo sapiens
aagttcaaattggggcctgtga

SEQ ID NO: 7324947 - DNA, 22 bp, Homo sapiens
aagttcaagagtgacatattag

SEQ ID NO: 7324948 - DNA, 22 bp, Homo sapiens
aagttcaagatcaaggttccag

SEQ ID NO: 7324949 - DNA, 22 bp, Homo sapiens
aagttcaagctctgcctaaaat

SEQ ID NO: 7324950 - DNA, 22 bp, Homo sapiens
aagttcaaggaagcctccagtt

SEQ ID NO: 7324951 - DNA, 22 bp, Homo sapiens
aagtttcaaatgttgattatgc

SEQ ID NO: 7324952 - DNA, 22 bp, Homo sapiens
aagtttcatgacttggttatta

SEQ ID NO: 7324953 - DNA, 22 bp, Homo sapiens
aataatgttgacgatagtctta

SEQ ID NO: 7324954 - DNA, 22 bp, Homo sapiens
aataagattgacacaagtacct

SEQ ID NO: 7324955 - DNA, 22 bp, Homo sapiens
aatgactctgctgcagagacac

SEQ ID NO: 7324956 - DNA, 22 bp, Homo sapiens
aatgagcaaatgaagacgctgt

SEQ ID NO: 7324957 - DNA, 22 bp, Homo sapiens
agaaatactaggaatattcata

SEQ ID NO: 7324958 - DNA, 22 bp, Homo sapiens
agaaaaatcttggcgcttgtct

SEQ ID NO: 7324959 - DNA, 22 bp, Homo sapiens
aatccatttactctttacaaga

SEQ ID NO: 7324960 - DNA, 22 bp, Homo sapiens
aatccagctgtgtcacaggtga

SEQ ID NO: 7324961 - DNA, 22 bp, Homo sapiens
aatcaaaacctacagaggtaat

SEQ ID NO: 7324962 - DNA, 22 bp, Homo sapiens
aatatatagaagtacccgttgt

SEQ ID NO: 7324963 - DNA, 22 bp, Homo sapiens
acttcctggattcccaagggct

SEQ ID NO: 7324964 - DNA, 22 bp, Homo sapiens
aaggaagaagactctttactcc

SEQ ID NO: 7324965 - DNA, 22 bp, Homo sapiens
aaggaagaaatgaataggtgga

SEQ ID NO: 7324966 - DNA, 22 bp, Homo sapiens
aaggaagaaatgaataggtgga

SEQ ID NO: 7324967 - DNA, 22 bp, Homo sapiens
aaggcagtaggtgtttcaaact

SEQ ID NO: 7324968 - DNA, 22 bp, Homo sapiens
aaggcagtcaaagcagacttct

SEQ ID NO: 7324969 - DNA, 22 bp, Homo sapiens
acaggcagtgggccagatttgt

SEQ ID NO: 7324970 - DNA, 22 bp, Homo sapiens
aaggaaatctttgtaacatctt

SEQ ID NO: 7324971 - DNA, 22 bp, Homo sapiens
aagccagggattcctgagggag

SEQ ID NO: 7324972 - DNA, 22 bp, Homo sapiens
aagccaggggctgcttaggaga

SEQ ID NO: 7324973 - DNA, 22 bp, Homo sapiens
aagccaggccattctctggttc

SEQ ID NO: 7324974 - DNA, 22 bp, Homo sapiens
aagctcttcctggagcgcccac

SEQ ID NO: 7324975 - DNA, 21 bp, Homo sapiens
aagctcttctcagggtcacct

SEQ ID NO: 7324976 - DNA, 22 bp, Homo sapiens
aagctcttgaatgggatcaagg

SEQ ID NO: 7324977 - DNA, 22 bp, Homo sapiens
aagccagggtttgtggatctat

SEQ ID NO: 7324978 - DNA, 22 bp, Homo sapiens
aagccaggtgttgtggtaagag

SEQ ID NO: 7324979 - DNA, 22 bp, Homo sapiens
aaggtagggatgtattcagctt

SEQ ID NO: 7324980 - DNA, 22 bp, Homo sapiens
aaggtaggttaacctgcaggag

SEQ ID NO: 7324981 - DNA, 22 bp, Homo sapiens
aaggtaggctcagggttgttct

SEQ ID NO: 7324982 - DNA, 22 bp, Homo sapiens
aaggtggtaatagtgcaggatt

SEQ ID NO: 7324983 - DNA, 22 bp, Homo sapiens
aagtcaattagtaaacttggaa

SEQ ID NO: 7324984 - DNA, 22 bp, Homo sapiens
aagtcaatttatgttctcagac

SEQ ID NO: 7324985 - DNA, 22 bp, Homo sapiens
aagtcaatcaagggtgtaggca

SEQ ID NO: 7324986 - DNA, 22 bp, Homo sapiens
accccagggctgccagcctcct

SEQ ID NO: 7324987 - DNA, 23 bp, Homo sapiens
accccaggcatcgcattcctctt

SEQ ID NO: 7324988 - DNA, 22 bp, Homo sapiens
accccaggcccagggaagaggc

SEQ ID NO: 7324989 - DNA, 22 bp, Homo sapiens
accccaggtctccaggctctgg

SEQ ID NO: 7324990 - DNA, 22 bp, Homo sapiens
aagtacctcatagggttatttt

SEQ ID NO: 7324991 - DNA, 22 bp, Homo sapiens
aagggaaatcctcagcccagga

SEQ ID NO: 7324992 - DNA, 22 bp, Homo sapiens
acatgtgtgtatacgtatttat

SEQ ID NO: 7324993 - DNA, 22 bp, Homo sapiens
aatgttattgtcctttccaaaa

SEQ ID NO: 7324994 - DNA, 22 bp, Homo sapiens
aatgttatttctgcatagtagt

SEQ ID NO: 7324995 - DNA, 22 bp, Homo sapiens
aatgttgtgtttcagttcaaga

SEQ ID NO: 7324996 - DNA, 22 bp, Homo sapiens
aattatatgttaatcttcaatt

SEQ ID NO: 7324997 - DNA, 22 bp, Homo sapiens
aattatggtatgttcaacaact

SEQ ID NO: 7324998 - DNA, 22 bp, Homo sapiens
aattatcagatataaaactgca

SEQ ID NO: 7324999 - DNA, 22 bp, Homo sapiens
aattatccacctttgcatgatt

SEQ ID NO: 7325000 - DNA, 22 bp, Homo sapiens
aatttacagttgctgatggtac

SEQ ID NO: 7325001 - DNA, 22 bp, Homo sapiens
aatttacaggtgcactcgccat

SEQ ID NO: 7325002 - DNA, 22 bp, Homo sapiens
aatgtcatagcatttcttcaat

SEQ ID NO: 7325003 - DNA, 22 bp, Homo sapiens
agacagggagggagcgcggctg

SEQ ID NO: 7325004 - DNA, 22 bp, Homo sapiens
aatgtgtttagttaatgagttg

SEQ ID NO: 7325005 - DNA, 22 bp, Homo sapiens
aatgcaatgcagcacctccttg

SEQ ID NO: 7325006 - DNA, 22 bp, Homo sapiens
acaatgttttgaaacatctagg

SEQ ID NO: 7325007 - DNA, 22 bp, Homo sapiens
agcaccatcagatgcaatatct

SEQ ID NO: 7325008 - DNA, 22 bp, Homo sapiens
acaagttaggttttaatccaaa

SEQ ID NO: 7325009 - DNA, 22 bp, Homo sapiens
acaagtagtaaattattaggtg

SEQ ID NO: 7325010 - DNA, 22 bp, Homo sapiens
acaaatgtctacattgagaata

SEQ ID NO: 7325011 - DNA, 22 bp, Homo sapiens
acaaatgtggacatggataatg

SEQ ID NO: 7325012 - DNA, 20 bp, Homo sapiens
acaaggaaccaggaggtggc

SEQ ID NO: 7325013 - DNA, 20 bp, Homo sapiens
acaaaataggtactgggtag

SEQ ID NO: 7325014 - DNA, 22 bp, Homo sapiens
acaaatgcaagttttatgtcaa

SEQ ID NO: 7325015 - DNA, 22 bp, Homo sapiens
acaaaatagagttctcccctgg

SEQ ID NO: 7325016 - DNA, 22 bp, Homo sapiens
aattttatctctaagcaggctt

SEQ ID NO: 7325017 - DNA, 22 bp, Homo sapiens
acacatttgcataatacctcat

SEQ ID NO: 7325018 - DNA, 19 bp, Homo sapiens
acacatttgcacaatccac

SEQ ID NO: 7325019 - DNA, 22 bp, Homo sapiens
acacattttgttaaaccctgtg

SEQ ID NO: 7325020 - DNA, 22 bp, Homo sapiens
acacattttggctaggtggaga

SEQ ID NO: 7325021 - DNA, 22 bp, Homo sapiens
acacattttctaacagggatca

SEQ ID NO: 7325022 - DNA, 22 bp, Homo sapiens
agcagttactagttaaatgcat

SEQ ID NO: 7325023 - DNA, 22 bp, Homo sapiens
agcagtgttcaatgatacactg

SEQ ID NO: 7325024 - DNA, 22 bp, Homo sapiens
agcagtgggtgacagagctgag

SEQ ID NO: 7325025 - DNA, 22 bp, Homo sapiens
acactgtgtctagcattttaca

SEQ ID NO: 7325026 - DNA, 22 bp, Homo sapiens
acacatatctaagatagatgac

SEQ ID NO: 7325027 - DNA, 22 bp, Homo sapiens
acacatatatttgcatatacac

SEQ ID NO: 7325028 - DNA, 22 bp, Homo sapiens
acacatatgtatgcatcatgtg

SEQ ID NO: 7325029 - DNA, 20 bp, Homo sapiens
agcacctcccatatgctaga

SEQ ID NO: 7325030 - DNA, 22 bp, Homo sapiens
agcacctccttagctatgacca

SEQ ID NO: 7325031 - DNA, 22 bp, Homo sapiens
agcacccttcagcccagcctgg

SEQ ID NO: 7325032 - DNA, 22 bp, Homo sapiens
acacaggagatatgtaatggct

SEQ ID NO: 7325033 - DNA, 22 bp, Homo sapiens
agctaggataagcagagactgg

SEQ ID NO: 7325034 - DNA, 22 bp, Homo sapiens
acagcaatcaatatggcattct

SEQ ID NO: 7325035 - DNA, 22 bp, Homo sapiens
acagcaaaagacaagaacttaa

SEQ ID NO: 7325036 - DNA, 22 bp, Homo sapiens
agcctgcgatcccacctggcct

SEQ ID NO: 7325037 - DNA, 20 bp, Homo sapiens
agctctcagcatgctgcctg

SEQ ID NO: 7325038 - DNA, 22 bp, Homo sapiens
acagagtctgacaggtaggcgc

SEQ ID NO: 7325039 - DNA, 22 bp, Homo sapiens
agcccccaggagtctccacgcc

SEQ ID NO: 7325040 - DNA, 22 bp, Homo sapiens
agcccccaggatgcaaaatgac

SEQ ID NO: 7325041 - DNA, 22 bp, Homo sapiens
agcccccagtctaaactgttgg

SEQ ID NO: 7325042 - DNA, 15 bp, Homo sapiens
agccccctcagagga

SEQ ID NO: 7325043 - DNA, 22 bp, Homo sapiens
agccccctccctagtgactgga

SEQ ID NO: 7325044 - DNA, 22 bp, Homo sapiens
agccacagtcaacctgtccata

SEQ ID NO: 7325045 - DNA, 22 bp, Homo sapiens
agccatgcaccttactcttgct

SEQ ID NO: 7325046 - DNA, 22 bp, Homo sapiens
taccatttcagtaaaaacttag

SEQ ID NO: 7325047 - DNA, 22 bp, Homo sapiens
taccattgtaccaaggtaattt

SEQ ID NO: 7325048 - DNA, 22 bp, Homo sapiens
taccatttgagagagaacataa

SEQ ID NO: 7325049 - DNA, 23 bp, Homo sapiens
tactataacgctgtgtcagctcc

SEQ ID NO: 7325050 - DNA, 22 bp, Homo sapiens
tacttaaaactgatagaatctc

SEQ ID NO: 7325051 - DNA, 22 bp, Homo sapiens
tacttaaaaattatcaaagtgg

SEQ ID NO: 7325052 - DNA, 22 bp, Homo sapiens
tacagtatggaaaatgtatagt

SEQ ID NO: 7325053 - DNA, 22 bp, Homo sapiens
tacagtggggagctcaggagag

SEQ ID NO: 7325054 - DNA, 21 bp, Homo sapiens
tacagtgaggtgttaggatgt

SEQ ID NO: 7325055 - DNA, 22 bp, Homo sapiens
tacagttaaaaagttcaatggt

SEQ ID NO: 7325056 - DNA, 22 bp, Homo sapiens
tacagttaaaaagttcaatggt

SEQ ID NO: 7325057 - DNA, 20 bp, Homo sapiens
taccaacagcaggaagcata

SEQ ID NO: 7325058 - DNA, 22 bp, Homo sapiens
taccaaggcttgtgggggcaac

SEQ ID NO: 7325059 - DNA, 22 bp, Homo sapiens
tacatgcttctatatgtgaagt

SEQ ID NO: 7325060 - DNA, 22 bp, Homo sapiens
taagccatacatttcagactct

SEQ ID NO: 7325061 - DNA, 22 bp, Homo sapiens
taaggaaaatggacatcaaaca

SEQ ID NO: 7325062 - DNA, 22 bp, Homo sapiens
taaggaaagtgccatgatttct

SEQ ID NO: 7325063 - DNA, 22 bp, Homo sapiens
taaggaaagtacatgttttgac

SEQ ID NO: 7325064 - DNA, 22 bp, Homo sapiens
taaggaaacaacttgtattttt

SEQ ID NO: 7325065 - DNA, 22 bp, Homo sapiens
taaggaggctgctgtgaagaaa

SEQ ID NO: 7325066 - DNA, 22 bp, Homo sapiens
tacacagtaaatggtaaataca

SEQ ID NO: 7325067 - DNA, 22 bp, Homo sapiens
tacagaatgttatgaagcatag

SEQ ID NO: 7325068 - DNA, 22 bp, Homo sapiens
tacaagaaactacatgaatgca

SEQ ID NO: 7325069 - DNA, 22 bp, Homo sapiens
taaagcaagacacacccatagc

SEQ ID NO: 7325070 - DNA, 22 bp, Homo sapiens
taagacaaatactatttcaaga

SEQ ID NO: 7325071 - DNA, 22 bp, Homo sapiens
taagagcagaacagcaacatat

SEQ ID NO: 7325072 - DNA, 22 bp, Homo sapiens
taacagtattgaagataaacta

SEQ ID NO: 7325073 - DNA, 22 bp, Homo sapiens
gttatttaactttgtagcatgg

SEQ ID NO: 7325074 - DNA, 22 bp, Homo sapiens
gttatttataaggtgtaactcc

SEQ ID NO: 7325075 - DNA, 22 bp, Homo sapiens
gttattgctatacatgtacact

SEQ ID NO: 7325076 - DNA, 22 bp, Homo sapiens
gttatcttagggtacaaaggac

SEQ ID NO: 7325077 - DNA, 22 bp, Homo sapiens
gttaaattcgatgatggataaa

SEQ ID NO: 7325078 - DNA, 22 bp, Homo sapiens
gttaaattcgatgatggataaa

SEQ ID NO: 7325079 - DNA, 22 bp, Homo sapiens
gtgtttctggggcattcatagt

SEQ ID NO: 7325080 - DNA, 22 bp, Homo sapiens
gtttattaactgtcaagtgatt

SEQ ID NO: 7325081 - DNA, 22 bp, Homo sapiens
gtttattagagttttctgtctg

SEQ ID NO: 7325082 - DNA, 22 bp, Homo sapiens
gtttattatacaacaaaagcta

SEQ ID NO: 7325083 - DNA, 19 bp, Homo sapiens
gttctttcatagtaagagc

SEQ ID NO: 7325084 - DNA, 22 bp, Homo sapiens
tatgtacatatacacgtgtgtg

SEQ ID NO: 7325085 - DNA, 22 bp, Homo sapiens
tatgtacaagcacacatgtgac

SEQ ID NO: 7325086 - DNA, 22 bp, Homo sapiens
tatgctttgatttcctcagctg

SEQ ID NO: 7325087 - DNA, 19 bp, Homo sapiens
tatgtccctttcccccatt

SEQ ID NO: 7325088 - DNA, 22 bp, Homo sapiens
tattaatatgtgtgtgcatgta

SEQ ID NO: 7325089 - DNA, 22 bp, Homo sapiens
tatgtatagagtcttttaaatt

SEQ ID NO: 7325090 - DNA, 22 bp, Homo sapiens
tatcatttaacagaatcattgc

SEQ ID NO: 7325091 - DNA, 22 bp, Homo sapiens
tatcaggacttcattcctttta

SEQ ID NO: 7325092 - DNA, 22 bp, Homo sapiens
tatcaggaagaacacgtgaaat

SEQ ID NO: 7325093 - DNA, 22 bp, Homo sapiens
tatcacatagtgtttagtaaat

SEQ ID NO: 7325094 - DNA, 22 bp, Homo sapiens
tatcacaggtgtgatttacatt

SEQ ID NO: 7325095 - DNA, 22 bp, Homo sapiens
tataaagtgtgaactgtgagta

SEQ ID NO: 7325096 - DNA, 22 bp, Homo sapiens
tataaactcctcttgcattcct

SEQ ID NO: 7325097 - DNA, 18 bp, Homo sapiens
tataaacacacttaggtt

SEQ ID NO: 7325098 - DNA, 22 bp, Homo sapiens
tatcattttactgtgacatttt

SEQ ID NO: 7325099 - DNA, 22 bp, Homo sapiens
tatcaggaattgaatggcttca

SEQ ID NO: 7325100 - DNA, 22 bp, Homo sapiens
tatttgcaacataaaactctga

SEQ ID NO: 7325101 - DNA, 23 bp, Homo sapiens
tatttgctactggtaattctgga

SEQ ID NO: 7325102 - DNA, 22 bp, Homo sapiens
tatttgcaggcttttgtcatgg

SEQ ID NO: 7325103 - DNA, 23 bp, Homo sapiens
tattttccaaatgatgactacat

SEQ ID NO: 7325104 - DNA, 22 bp, Homo sapiens
tattttctggacagtcttgctt

SEQ ID NO: 7325105 - DNA, 22 bp, Homo sapiens
tattttctgtggaggaccagat

SEQ ID NO: 7325106 - DNA, 22 bp, Homo sapiens
tcaaagttacttgtggttttct

SEQ ID NO: 7325107 - DNA, 22 bp, Homo sapiens
tcaaagtttgtggcaatttatt

SEQ ID NO: 7325108 - DNA, 22 bp, Homo sapiens
tcaaagagctattcagttgtgg

SEQ ID NO: 7325109 - DNA, 22 bp, Homo sapiens
tagcaaataaaacagtattgaa

SEQ ID NO: 7325110 - DNA, 22 bp, Homo sapiens
tagcaaagttttgtggtgatta

SEQ ID NO: 7325111 - DNA, 22 bp, Homo sapiens
tagcaaaggtagagttttgaga

SEQ ID NO: 7325112 - DNA, 23 bp, Homo sapiens
tagcaaagttgtttgggaaattt

SEQ ID NO: 7325113 - DNA, 22 bp, Homo sapiens
tagcaaaggatgactatgtacc

SEQ ID NO: 7325114 - DNA, 22 bp, Homo sapiens
tagcaaaggatgactatgtacc

SEQ ID NO: 7325115 - DNA, 22 bp, Homo sapiens
tagcaaagggaaagaagggcct

SEQ ID NO: 7325116 - DNA, 22 bp, Homo sapiens
tagcaaaggccttggacacgct

SEQ ID NO: 7325117 - DNA, 22 bp, Homo sapiens
tagcaaatgtgttatgctatgc

SEQ ID NO: 7325118 - DNA, 22 bp, Homo sapiens
tagatctgatacaattcatctg

SEQ ID NO: 7325119 - DNA, 22 bp, Homo sapiens
tagcaaagaacctgatacccca

SEQ ID NO: 7325120 - DNA, 22 bp, Homo sapiens
tagcaaagcccttgctgtgtaa

SEQ ID NO: 7325121 - DNA, 22 bp, Homo sapiens
tagcaaagcgaaagagatttat

SEQ ID NO: 7325122 - DNA, 22 bp, Homo sapiens
tagcaaagctccgtagttattt

SEQ ID NO: 7325123 - DNA, 22 bp, Homo sapiens
tagcaaagcccttcaggccctg

SEQ ID NO: 7325124 - DNA, 22 bp, Homo sapiens
tagcaaagcccacgtgccaagc

SEQ ID NO: 7325125 - DNA, 21 bp, Homo sapiens
tagcaaagccagatgtatatt

SEQ ID NO: 7325126 - DNA, 18 bp, Homo sapiens
tagcaaagatgtggattg

SEQ ID NO: 7325127 - DNA, 22 bp, Homo sapiens
tagcaaagaggagacctaggca

SEQ ID NO: 7325128 - DNA, 22 bp, Homo sapiens
tagcaaagaagatattattgca

SEQ ID NO: 7325129 - DNA, 22 bp, Homo sapiens
tagcaaagaccaaagctagttg

SEQ ID NO: 7325130 - DNA, 22 bp, Homo sapiens
tagcaaagagaaaaattatgct

SEQ ID NO: 7325131 - DNA, 22 bp, Homo sapiens
tagactggtgaattagggggaa

SEQ ID NO: 7325132 - DNA, 22 bp, Homo sapiens
tagagaaacagaaccaacaggg

SEQ ID NO: 7325133 - DNA, 22 bp, Homo sapiens
tagtgcttattactgtgctgtc

SEQ ID NO: 7325134 - DNA, 22 bp, Homo sapiens
tagtgcttaacacaaagtgatt

SEQ ID NO: 7325135 - DNA, 22 bp, Homo sapiens
tagtttttaagtgtacaatttc

SEQ ID NO: 7325136 - DNA, 22 bp, Homo sapiens
tagttcaaagtctgtcaaagga

SEQ ID NO: 7325137 - DNA, 22 bp, Homo sapiens
tagttcaaccgtcttctcccct

SEQ ID NO: 7325138 - DNA, 22 bp, Homo sapiens
tagttcaacgagttggggttgc

SEQ ID NO: 7325139 - DNA, 21 bp, Homo sapiens
tagttcaagttctttcagttc

SEQ ID NO: 7325140 - DNA, 22 bp, Homo sapiens
tagctgttaagttgtttggaaa

SEQ ID NO: 7325141 - DNA, 22 bp, Homo sapiens
tagggcagccacccaggctgct

SEQ ID NO: 7325142 - DNA, 22 bp, Homo sapiens
tagggcagagtccaggatgggc

SEQ ID NO: 7325143 - DNA, 22 bp, Homo sapiens
tcagcagggaggctctgtgccc

SEQ ID NO: 7325144 - DNA, 22 bp, Homo sapiens
tcagcagggcatactgagccta

SEQ ID NO: 7325145 - DNA, 22 bp, Homo sapiens
tcagaattttctggaatggagc

SEQ ID NO: 7325146 - DNA, 21 bp, Homo sapiens
tcagaattacccctggatctg

SEQ ID NO: 7325147 - DNA, 22 bp, Homo sapiens
tcagagttctctgtccagatga

SEQ ID NO: 7325148 - DNA, 22 bp, Homo sapiens
tcagccaggcacaatggcagct

SEQ ID NO: 7325149 - DNA, 20 bp, Homo sapiens
tcagccagctaacatgggga

SEQ ID NO: 7325150 - DNA, 20 bp, Homo sapiens
tcagccagctaacatgggga

SEQ ID NO: 7325151 - DNA, 22 bp, Homo sapiens
tcagccaggcacaatggcagct

SEQ ID NO: 7325152 - DNA, 22 bp, Homo sapiens
tcagccagctcttggactctga

SEQ ID NO: 7325153 - DNA, 22 bp, Homo sapiens
tcagccagcatcagctaagtgc

SEQ ID NO: 7325154 - DNA, 22 bp, Homo sapiens
tcagccagaggtggatgagtca

SEQ ID NO: 7325155 - DNA, 22 bp, Homo sapiens
tcagccagaggcttcttggttt

SEQ ID NO: 7325156 - DNA, 22 bp, Homo sapiens
tcagccagaggcttcttggttt

SEQ ID NO: 7325157 - DNA, 22 bp, Homo sapiens
tcagccacttccctctggtcag

SEQ ID NO: 7325158 - DNA, 22 bp, Homo sapiens
tcaggacaccctgtgcttcctt

SEQ ID NO: 7325159 - DNA, 22 bp, Homo sapiens
tcaggacaacatgttgctaatc

SEQ ID NO: 7325160 - DNA, 22 bp, Homo sapiens
tcaggacaacctgttttcagac

SEQ ID NO: 7325161 - DNA, 22 bp, Homo sapiens
tcaggacatttgtcagcaggag

SEQ ID NO: 7325162 - DNA, 22 bp, Homo sapiens
tcaggacagttccctgcaaatt

SEQ ID NO: 7325163 - DNA, 22 bp, Homo sapiens
tcaggacaggttcgggtgggta

SEQ ID NO: 7325164 - DNA, 22 bp, Homo sapiens
tcaggacagggatcacatcatc

SEQ ID NO: 7325165 - DNA, 22 bp, Homo sapiens
tcaggacagccagggtgcagac

SEQ ID NO: 7325166 - DNA, 22 bp, Homo sapiens
tcaggacagagatcagaacttc

SEQ ID NO: 7325167 - DNA, 22 bp, Homo sapiens
tcaggacaacaagacttgttta

SEQ ID NO: 7325168 - DNA, 22 bp, Homo sapiens
tcaacactaaagaataatcttt

SEQ ID NO: 7325169 - DNA, 22 bp, Homo sapiens
tcaacagattgtattaaggtta

SEQ ID NO: 7325170 - DNA, 22 bp, Homo sapiens
tcaacagttgcactggagaggt

SEQ ID NO: 7325171 - DNA, 22 bp, Homo sapiens
tcaactcacaagaatgagcaag

SEQ ID NO: 7325172 - DNA, 22 bp, Homo sapiens
tcaactcatgttattctgtgaa

SEQ ID NO: 7325173 - DNA, 22 bp, Homo sapiens
tcacagttttagaaaatagata

SEQ ID NO: 7325174 - DNA, 22 bp, Homo sapiens
tcacagtgtcacaatgcctgga

SEQ ID NO: 7325175 - DNA, 22 bp, Homo sapiens
tcacatttctgattataccaaa

SEQ ID NO: 7325176 - DNA, 22 bp, Homo sapiens
tcacatttatttcaaagttact

SEQ ID NO: 7325177 - DNA, 22 bp, Homo sapiens
tcacatttcaagtgctcaaaag

SEQ ID NO: 7325178 - DNA, 22 bp, Homo sapiens
tcacatttctcagcactgatga

SEQ ID NO: 7325179 - DNA, 22 bp, Homo sapiens
tcagaagtttcaatcccagctg

SEQ ID NO: 7325180 - DNA, 22 bp, Homo sapiens
tcagaagttgataaagtagttg

SEQ ID NO: 7325181 - DNA, 22 bp, Homo sapiens
tcactgcaacctccacctcctg

SEQ ID NO: 7325182 - DNA, 22 bp, Homo sapiens
tcacattttatctattttaagt

SEQ ID NO: 7325183 - DNA, 22 bp, Homo sapiens
tcactgcaacctccacctcccg

SEQ ID NO: 7325184 - DNA, 22 bp, Homo sapiens
tcatttcagccatttttaaatg

SEQ ID NO: 7325185 - DNA, 22 bp, Homo sapiens
tcatttatcatttgtgctgtag

SEQ ID NO: 7325186 - DNA, 22 bp, Homo sapiens
tcatttctgttgtgcatcactg

SEQ ID NO: 7325187 - DNA, 22 bp, Homo sapiens
tcatttacagactgtgtgggtg

SEQ ID NO: 7325188 - DNA, 22 bp, Homo sapiens
tcatttacacttcacaaatgga

SEQ ID NO: 7325189 - DNA, 22 bp, Homo sapiens
tcatttacaggtgaagcaacta

SEQ ID NO: 7325190 - DNA, 22 bp, Homo sapiens
tcatttaattggttttgctcgt

SEQ ID NO: 7325191 - DNA, 22 bp, Homo sapiens
tcatttatattgtattctgtag

SEQ ID NO: 7325192 - DNA, 22 bp, Homo sapiens
tcatttactgtaggcaaaaatt

SEQ ID NO: 7325193 - DNA, 22 bp, Homo sapiens
tcatttacttctatgacaacat

SEQ ID NO: 7325194 - DNA, 22 bp, Homo sapiens
tcatttacatagaaacaatata

SEQ ID NO: 7325195 - DNA, 22 bp, Homo sapiens
tccaaattgacagtagtgatta

SEQ ID NO: 7325196 - DNA, 22 bp, Homo sapiens
tcagtagttttgatctgagcag

SEQ ID NO: 7325197 - DNA, 22 bp, Homo sapiens
tcagggcaggcgagcagctgct

SEQ ID NO: 7325198 - DNA, 22 bp, Homo sapiens
tcaggcttccaacaatgatgtt

SEQ ID NO: 7325199 - DNA, 22 bp, Homo sapiens
tcatgaaaatagatcagaaatt

SEQ ID NO: 7325200 - DNA, 22 bp, Homo sapiens
tcatctttgtatccctaacaca

SEQ ID NO: 7325201 - DNA, 22 bp, Homo sapiens
tcatctttcctcaaaagatcca

SEQ ID NO: 7325202 - DNA, 22 bp, Homo sapiens
tcatctttaccccttgcttcaa

SEQ ID NO: 7325203 - DNA, 22 bp, Homo sapiens
tcatctgttgattttaagtctt

SEQ ID NO: 7325204 - DNA, 22 bp, Homo sapiens
tcatctgttcatacacatgcgt

SEQ ID NO: 7325205 - DNA, 22 bp, Homo sapiens
tcatctgttatttatgcctgag

SEQ ID NO: 7325206 - DNA, 22 bp, Homo sapiens
tcatctgtgagtaaaggcacat

SEQ ID NO: 7325207 - DNA, 22 bp, Homo sapiens
tcatctgtgaataatgaactgg

SEQ ID NO: 7325208 - DNA, 22 bp, Homo sapiens
tcatctgtcatccacaaagctg

SEQ ID NO: 7325209 - DNA, 22 bp, Homo sapiens
tcatctgtcaaattgcaataag

SEQ ID NO: 7325210 - DNA, 22 bp, Homo sapiens
tcatacattcagcagatatttg

SEQ ID NO: 7325211 - DNA, 22 bp, Homo sapiens
tcatacattcagcagatatttg

SEQ ID NO: 7325212 - DNA, 22 bp, Homo sapiens
tcagtgttttaactgtctttta

SEQ ID NO: 7325213 - DNA, 22 bp, Homo sapiens
tcagtgttttccagggtctact

SEQ ID NO: 7325214 - DNA, 22 bp, Homo sapiens
tcagtgtttcctgtggtacagc

SEQ ID NO: 7325215 - DNA, 22 bp, Homo sapiens
tcagttaagaggccacggcagt

SEQ ID NO: 7325216 - DNA, 20 bp, Homo sapiens
tcagttaagttgctgaatct

SEQ ID NO: 7325217 - DNA, 22 bp, Homo sapiens
tcagttaagcactataccctaa

SEQ ID NO: 7325218 - DNA, 22 bp, Homo sapiens
tcagttaatatgggtaaagcat

SEQ ID NO: 7325219 - DNA, 22 bp, Homo sapiens
tcagttaatcaatgtggtctaa

SEQ ID NO: 7325220 - DNA, 22 bp, Homo sapiens
tcagttaatggattctgtcaga

SEQ ID NO: 7325221 - DNA, 22 bp, Homo sapiens
tcagttaacggaaaggggtgtg

SEQ ID NO: 7325222 - DNA, 23 bp, Homo sapiens
tcagttaactgtgttacctgtgc

SEQ ID NO: 7325223 - DNA, 22 bp, Homo sapiens
tcagttaagactgcactggact

SEQ ID NO: 7325224 - DNA, 22 bp, Homo sapiens
tcagttaacaactatttattga

SEQ ID NO: 7325225 - DNA, 22 bp, Homo sapiens
tcagttaatggtaagggtgaaa

SEQ ID NO: 7325226 - DNA, 22 bp, Homo sapiens
tcataaatagttgtgcctgaat

SEQ ID NO: 7325227 - DNA, 22 bp, Homo sapiens
tcagtgttggagataattgcac

SEQ ID NO: 7325228 - DNA, 22 bp, Homo sapiens
tcagtgttcttatttaattagg

SEQ ID NO: 7325229 - DNA, 22 bp, Homo sapiens
tcctctggtacttaaagtgctt

SEQ ID NO: 7325230 - DNA, 22 bp, Homo sapiens
tcctctttaaatgcttttatct

SEQ ID NO: 7325231 - DNA, 22 bp, Homo sapiens
tcctctttctcaacattagtta

SEQ ID NO: 7325232 - DNA, 22 bp, Homo sapiens
tcctcttccttctgtccaaatg

SEQ ID NO: 7325233 - DNA, 22 bp, Homo sapiens
tcctcttcaaaatagctctgaa

SEQ ID NO: 7325234 - DNA, 22 bp, Homo sapiens
tcctctgtggaccgggctttgg

SEQ ID NO: 7325235 - DNA, 22 bp, Homo sapiens
tcctgagtgagagctgggaggt

SEQ ID NO: 7325236 - DNA, 22 bp, Homo sapiens
tcccagagcagtactccaggag

SEQ ID NO: 7325237 - DNA, 22 bp, Homo sapiens
tcccagagcagatgtgctaaag

SEQ ID NO: 7325238 - DNA, 22 bp, Homo sapiens
tcccagagccaagctatggatg

SEQ ID NO: 7325239 - DNA, 22 bp, Homo sapiens
tcccagagacagagcctcctcc

SEQ ID NO: 7325240 - DNA, 22 bp, Homo sapiens
tcccagagatttcctctccttc

SEQ ID NO: 7325241 - DNA, 22 bp, Homo sapiens
tcccagaggttgagtcacttat

SEQ ID NO: 7325242 - DNA, 22 bp, Homo sapiens
tcccagaggtctctgctggttc

SEQ ID NO: 7325243 - DNA, 22 bp, Homo sapiens
tcccagaggctccagtctctat

SEQ ID NO: 7325244 - DNA, 22 bp, Homo sapiens
tcccagcctggaccctgccagt

SEQ ID NO: 7325245 - DNA, 22 bp, Homo sapiens
tccaggtgagtgcaggtgcaga

SEQ ID NO: 7325246 - DNA, 22 bp, Homo sapiens
tccatgctcttgtctagcctcc

SEQ ID NO: 7325247 - DNA, 22 bp, Homo sapiens
tcctcaggtcaaagcaggagaa

SEQ ID NO: 7325248 - DNA, 21 bp, Homo sapiens
tcctcagggccccagagcact

SEQ ID NO: 7325249 - DNA, 22 bp, Homo sapiens
tcctcacagggcaggaaggagg

SEQ ID NO: 7325250 - DNA, 22 bp, Homo sapiens
tccctgggaccggcagctcaca

SEQ ID NO: 7325251 - DNA, 22 bp, Homo sapiens
tccctgggaacaaaggatgaga

SEQ ID NO: 7325252 - DNA, 22 bp, Homo sapiens
tccctgggaattaatatttgga

SEQ ID NO: 7325253 - DNA, 22 bp, Homo sapiens
tccctgggaaatgtcagtttca

SEQ ID NO: 7325254 - DNA, 22 bp, Homo sapiens
tcctagcctggtgagaaactgt

SEQ ID NO: 7325255 - DNA, 22 bp, Homo sapiens
tccctgggactcagacatggaa

SEQ ID NO: 7325256 - DNA, 22 bp, Homo sapiens
tccctgggagatgatgatgagg

SEQ ID NO: 7325257 - DNA, 15 bp, Homo sapiens
tccctgggagatggt

SEQ ID NO: 7325258 - DNA, 22 bp, Homo sapiens
tccctgggacggccttttggag

SEQ ID NO: 7325259 - DNA, 18 bp, Homo sapiens
tccctgggatataattac

SEQ ID NO: 7325260 - DNA, 16 bp, Homo sapiens
tccctgggagtggtgg

SEQ ID NO: 7325261 - DNA, 22 bp, Homo sapiens
tccctccaggcagctgggtact

SEQ ID NO: 7325262 - DNA, 22 bp, Homo sapiens
tccctcagtccctggacaggca

SEQ ID NO: 7325263 - DNA, 22 bp, Homo sapiens
tccctcagcaggaatgtggcag

SEQ ID NO: 7325264 - DNA, 22 bp, Homo sapiens
gtaggcagataggagtgcagcc

SEQ ID NO: 7325265 - DNA, 22 bp, Homo sapiens
gtaggcagaccagtggatgggt

SEQ ID NO: 7325266 - DNA, 19 bp, Homo sapiens
gtacaatgtgttgttggta

SEQ ID NO: 7325267 - DNA, 22 bp, Homo sapiens
gtatttttaggtaaggaaagta

SEQ ID NO: 7325268 - DNA, 22 bp, Homo sapiens
gtcagaggaatggatgagtgat

SEQ ID NO: 7325269 - DNA, 22 bp, Homo sapiens
gtctttatttgagattgtcatt

SEQ ID NO: 7325270 - DNA, 22 bp, Homo sapiens
gtgaggagggctggtcccaggc

SEQ ID NO: 7325271 - DNA, 22 bp, Homo sapiens
gtgaggagtctgaagcacataa

SEQ ID NO: 7325272 - DNA, 22 bp, Homo sapiens
gtgaggagctgacactggggtg

SEQ ID NO: 7325273 - DNA, 22 bp, Homo sapiens
gtgagctgggtgaatggtaggg

SEQ ID NO: 7325274 - DNA, 22 bp, Homo sapiens
gtgcccagctccacctcacaga

SEQ ID NO: 7325275 - DNA, 22 bp, Homo sapiens
gtgcccagcagcagcgtccccg

SEQ ID NO: 7325276 - DNA, 22 bp, Homo sapiens
gtgccaggtgctaagctgtgct

SEQ ID NO: 7325277 - DNA, 22 bp, Homo sapiens
ggtgagggagtggaacgaggtg

SEQ ID NO: 7325278 - DNA, 21 bp, Homo sapiens
ggtgctcgctgatgaggagtg

SEQ ID NO: 7325279 - DNA, 22 bp, Homo sapiens
ggtggaaggcctggaaggaggc

SEQ ID NO: 7325280 - DNA, 22 bp, Homo sapiens
ggtgaggaattggggactgacc

SEQ ID NO: 7325281 - DNA, 22 bp, Homo sapiens
ggtgaggaaagatggtgacagt

SEQ ID NO: 7325282 - DNA, 22 bp, Homo sapiens
ggttggggcgagctggaggccc

SEQ ID NO: 7325283 - DNA, 22 bp, Homo sapiens
ggtggggattcctgatcactgt

SEQ ID NO: 7325284 - DNA, 22 bp, Homo sapiens
ggtggggagtcaggcattcttg

SEQ ID NO: 7325285 - DNA, 22 bp, Homo sapiens
ggtggcagagaggaggtagttt

SEQ ID NO: 7325286 - DNA, 22 bp, Homo sapiens
gggctctgggattcagagcaag

SEQ ID NO: 7325287 - DNA, 22 bp, Homo sapiens
gggctctggggtgccctggcat

SEQ ID NO: 7325288 - DNA, 22 bp, Homo sapiens
ggggaggagccatgtaactagt

SEQ ID NO: 7325289 - DNA, 22 bp, Homo sapiens
ggggaggcaagatgaagtgagg

SEQ ID NO: 7325290 - DNA, 22 bp, Homo sapiens
ggggcattgtgtctgggttcct

SEQ ID NO: 7325291 - DNA, 20 bp, Homo sapiens
ggggcaggtttttatggcta

SEQ ID NO: 7325292 - DNA, 22 bp, Homo sapiens
ggggccagatatcactaaggtt

SEQ ID NO: 7325293 - DNA, 21 bp, Homo sapiens
gggtggggttccagccttttc

SEQ ID NO: 7325294 - DNA, 21 bp, Homo sapiens
gggcaggtctctgatgtcaac

SEQ ID NO: 7325295 - DNA, 22 bp, Homo sapiens
gggcaggtgattttggctccat

SEQ ID NO: 7325296 - DNA, 21 bp, Homo sapiens
gggcagaggggcctcctgggt

SEQ ID NO: 7325297 - DNA, 22 bp, Homo sapiens
gggcagaggctctggcccatcc

SEQ ID NO: 7325298 - DNA, 20 bp, Homo sapiens
gggcagagccagccagtccc

SEQ ID NO: 7325299 - DNA, 22 bp, Homo sapiens
gggcagagagctggaactcctt

SEQ ID NO: 7325300 - DNA, 20 bp, Homo sapiens
gggcagagccagccagtccc

SEQ ID NO: 7325301 - DNA, 22 bp, Homo sapiens
gggcagagactcagaaacagaa

SEQ ID NO: 7325302 - DNA, 22 bp, Homo sapiens
gggagtgggtttggcctaggcc

SEQ ID NO: 7325303 - DNA, 22 bp, Homo sapiens
gggagcctgtggatgtctgact

SEQ ID NO: 7325304 - DNA, 19 bp, Homo sapiens
gggagtcaagagattagtt

SEQ ID NO: 7325305 - DNA, 22 bp, Homo sapiens
gggagtcagtgaaggagtcaga

SEQ ID NO: 7325306 - DNA, 22 bp, Homo sapiens
gggagtcagagaggtaatggga

SEQ ID NO: 7325307 - DNA, 22 bp, Homo sapiens
gggcaggtgtttccaaggtgag

SEQ ID NO: 7325308 - DNA, 22 bp, Homo sapiens
gggctctggacccaggcaagag

SEQ ID NO: 7325309 - DNA, 22 bp, Homo sapiens
gggagccacagtagcagctact

SEQ ID NO: 7325310 - DNA, 22 bp, Homo sapiens
gggagccccacctcggtgcccg

SEQ ID NO: 7325311 - DNA, 22 bp, Homo sapiens
ggctgtggggaccaacaggact

SEQ ID NO: 7325312 - DNA, 22 bp, Homo sapiens
gggaagagggagctggaatgat

SEQ ID NO: 7325313 - DNA, 22 bp, Homo sapiens
ggctggcagtgtgagagaggga

SEQ ID NO: 7325314 - DNA, 17 bp, Homo sapiens
ggctggagcagctcccc

SEQ ID NO: 7325315 - DNA, 23 bp, Homo sapiens
ggaggcacttaggcagagcagag

SEQ ID NO: 7325316 - DNA, 22 bp, Homo sapiens
ggaggcacacctcagactggga

SEQ ID NO: 7325317 - DNA, 22 bp, Homo sapiens
ggaggatgccaagctgtgcaca

SEQ ID NO: 7325318 - DNA, 17 bp, Homo sapiens
ggaggcaacagacaggg

SEQ ID NO: 7325319 - DNA, 22 bp, Homo sapiens
ggaggcaacacagggtgtgttt

SEQ ID NO: 7325320 - DNA, 22 bp, Homo sapiens
ggaggaggggtttacattggaa

SEQ ID NO: 7325321 - DNA, 22 bp, Homo sapiens
ggaggaggtgggttaagttgta

SEQ ID NO: 7325322 - DNA, 22 bp, Homo sapiens
ggaggagtcagttgggctgctt

SEQ ID NO: 7325323 - DNA, 22 bp, Homo sapiens
ggaggcagaacttcccgtcagt

SEQ ID NO: 7325324 - DNA, 22 bp, Homo sapiens
ggcagatggggtgacaagagag

SEQ ID NO: 7325325 - DNA, 22 bp, Homo sapiens
ggcagcagaactggccctgtat

SEQ ID NO: 7325326 - DNA, 22 bp, Homo sapiens
ggcagtgagctggagggaagga

SEQ ID NO: 7325327 - DNA, 22 bp, Homo sapiens
ggcagtgagtcccggagaggcc

SEQ ID NO: 7325328 - DNA, 17 bp, Homo sapiens
ggcagtggaggaagaga

SEQ ID NO: 7325329 - DNA, 22 bp, Homo sapiens
ggcaggggtcctggtgttgact

SEQ ID NO: 7325330 - DNA, 22 bp, Homo sapiens
ggcagggacaggatagggtttt

SEQ ID NO: 7325331 - DNA, 18 bp, Homo sapiens
ggcagggaaaagataggg

SEQ ID NO: 7325332 - DNA, 22 bp, Homo sapiens
ggcaggctttcagcatcaagtc

SEQ ID NO: 7325333 - DNA, 22 bp, Homo sapiens
ggcaggctttgagaaagagcat

SEQ ID NO: 7325334 - DNA, 20 bp, Homo sapiens
ggcaggctttatatggaggg

SEQ ID NO: 7325335 - DNA, 22 bp, Homo sapiens
ggcaggctttcagcatcaagtc

SEQ ID NO: 7325336 - DNA, 22 bp, Homo sapiens
ggccagagtctatatgcagaca

SEQ ID NO: 7325337 - DNA, 22 bp, Homo sapiens
ggcagtggcatgtgggtagtgg

SEQ ID NO: 7325338 - DNA, 22 bp, Homo sapiens
ggcagtgggaaataagtgagaa

SEQ ID NO: 7325339 - DNA, 22 bp, Homo sapiens
ggcccaggctggagtgcagtgg

SEQ ID NO: 7325340 - DNA, 22 bp, Homo sapiens
gcagggcagctcactgtggttc

SEQ ID NO: 7325341 - DNA, 22 bp, Homo sapiens
gcagggcagctgaagctaggtg

SEQ ID NO: 7325342 - DNA, 22 bp, Homo sapiens
gcagggcagggcaagaactggg

SEQ ID NO: 7325343 - DNA, 19 bp, Homo sapiens
gcaggtagagacagcagcc

SEQ ID NO: 7325344 - DNA, 22 bp, Homo sapiens
gcaggtagtgctaaagacttac

SEQ ID NO: 7325345 - DNA, 22 bp, Homo sapiens
gcagcaatatccatgtcttcac

SEQ ID NO: 7325346 - DNA, 22 bp, Homo sapiens
gcagcaatcttcacagtgtcat

SEQ ID NO: 7325347 - DNA, 22 bp, Homo sapiens
gcagcaattatcaatctcatta

SEQ ID NO: 7325348 - DNA, 22 bp, Homo sapiens
gcagccagcaggaagcgggaga

SEQ ID NO: 7325349 - DNA, 17 bp, Homo sapiens
gcagccagtgcagcagg

SEQ ID NO: 7325350 - DNA, 22 bp, Homo sapiens
gcagccagtatcctctgagatt

SEQ ID NO: 7325351 - DNA, 22 bp, Homo sapiens
gcagctgggacactgaggccag

SEQ ID NO: 7325352 - DNA, 20 bp, Homo sapiens
gcacagagatgagcaaagta

SEQ ID NO: 7325353 - DNA, 22 bp, Homo sapiens
gcacagagtgggtgagatgtgg

SEQ ID NO: 7325354 - DNA, 22 bp, Homo sapiens
gcagcaaacttccacaagtaga

SEQ ID NO: 7325355 - DNA, 19 bp, Homo sapiens
gcagcaaacaaaacaggta

SEQ ID NO: 7325356 - DNA, 22 bp, Homo sapiens
gcagcaaagctcttcatgtgat

SEQ ID NO: 7325357 - DNA, 21 bp, Homo sapiens
gcagcaaatgacaacagtgag

SEQ ID NO: 7325358 - DNA, 22 bp, Homo sapiens
gcattcttggtggagtgctaaa

SEQ ID NO: 7325359 - DNA, 22 bp, Homo sapiens
gcattcttcacagtattcctcc

SEQ ID NO: 7325360 - DNA, 17 bp, Homo sapiens
gcagttaaattaagatg

SEQ ID NO: 7325361 - DNA, 22 bp, Homo sapiens
gcagttaaaaataaaccttcat

SEQ ID NO: 7325362 - DNA, 21 bp, Homo sapiens
gcagttaatagcagagcacac

SEQ ID NO: 7325363 - DNA, 17 bp, Homo sapiens
gcagttaaattaagatg

SEQ ID NO: 7325364 - DNA, 22 bp, Homo sapiens
gcagtgtttgtgttctcacatg

SEQ ID NO: 7325365 - DNA, 22 bp, Homo sapiens
gccacctgcgggccgtggtgga

SEQ ID NO: 7325366 - DNA, 22 bp, Homo sapiens
gcatttaaatttgaacttcaga

SEQ ID NO: 7325367 - DNA, 22 bp, Homo sapiens
gcattgcaactgacagatcatt

SEQ ID NO: 7325368 - DNA, 22 bp, Homo sapiens
gcattgcaggtgtacccagtta

SEQ ID NO: 7325369 - DNA, 18 bp, Homo sapiens
gccaccctcctcgtctcc

SEQ ID NO: 7325370 - DNA, 22 bp, Homo sapiens
gccaggaaagccactggcatac

SEQ ID NO: 7325371 - DNA, 22 bp, Homo sapiens
gccaggaaaagaagctggtgct

SEQ ID NO: 7325372 - DNA, 22 bp, Homo sapiens
gccaggaaaaacgtggtgggag

SEQ ID NO: 7325373 - DNA, 22 bp, Homo sapiens
gccaggaaaaaccggccctgct

SEQ ID NO: 7325374 - DNA, 22 bp, Homo sapiens
gccaggaatcactgctgagtaa

SEQ ID NO: 7325375 - DNA, 22 bp, Homo sapiens
gccaggaagttgggccagtcta

SEQ ID NO: 7325376 - DNA, 22 bp, Homo sapiens
gccaggaagtgcagccctgcca

SEQ ID NO: 7325377 - DNA, 22 bp, Homo sapiens
gccaggaagtcagccaagccca

SEQ ID NO: 7325378 - DNA, 22 bp, Homo sapiens
gccaggaaggctccctggtcac

SEQ ID NO: 7325379 - DNA, 22 bp, Homo sapiens
gccaggaagagagagccctcca

SEQ ID NO: 7325380 - DNA, 22 bp, Homo sapiens
gccaggaaattcatgccagatc

SEQ ID NO: 7325381 - DNA, 22 bp, Homo sapiens
gccaggaacacaatgccaagct

SEQ ID NO: 7325382 - DNA, 22 bp, Homo sapiens
gccaggaaagggaattccctga

SEQ ID NO: 7325383 - DNA, 22 bp, Homo sapiens
gccagaaagaggaggacctggg

SEQ ID NO: 7325384 - DNA, 22 bp, Homo sapiens
gccagacactcccctgggcagg

SEQ ID NO: 7325385 - DNA, 22 bp, Homo sapiens
gcctcaggtaaaacttgagttt

SEQ ID NO: 7325386 - DNA, 22 bp, Homo sapiens
gccctggacagtgacggtgacc

SEQ ID NO: 7325387 - DNA, 21 bp, Homo sapiens
gccctaggctacctggagcgc

SEQ ID NO: 7325388 - DNA, 22 bp, Homo sapiens
gcccgcgccagcctctccatct

SEQ ID NO: 7325389 - DNA, 22 bp, Homo sapiens
gccccaggttgcctgtcccagg

SEQ ID NO: 7325390 - DNA, 22 bp, Homo sapiens
gccccaggtggtaaacctaaga

SEQ ID NO: 7325391 - DNA, 22 bp, Homo sapiens
gcctccctgtttcctgctccaa

SEQ ID NO: 7325392 - DNA, 22 bp, Homo sapiens
gctctccaggtctcatgcactg

SEQ ID NO: 7325393 - DNA, 22 bp, Homo sapiens
gctctccaggggctcccaggat

SEQ ID NO: 7325394 - DNA, 21 bp, Homo sapiens
gctctccagggccagcccagg

SEQ ID NO: 7325395 - DNA, 22 bp, Homo sapiens
gctccctctgctcaggcacttg

SEQ ID NO: 7325396 - DNA, 22 bp, Homo sapiens
gctccccaggctggtcccctcg

SEQ ID NO: 7325397 - DNA, 22 bp, Homo sapiens
gctccccttggtcctcctggga

SEQ ID NO: 7325398 - DNA, 20 bp, Homo sapiens
gctccccttctctgggcctc

SEQ ID NO: 7325399 - DNA, 22 bp, Homo sapiens
gctccctcccaccagcctgcag

SEQ ID NO: 7325400 - DNA, 22 bp, Homo sapiens
gctccctccatgaggcagaccg

SEQ ID NO: 7325401 - DNA, 22 bp, Homo sapiens
gctctctgcctttctcaatgac

SEQ ID NO: 7325402 - DNA, 22 bp, Homo sapiens
gctctgtccagcgtgcacagaa

SEQ ID NO: 7325403 - DNA, 21 bp, Homo sapiens
gctctgtccctgctgtgtgtc

SEQ ID NO: 7325404 - DNA, 23 bp, Homo sapiens
gctcatcaggcttagagtcaagg

SEQ ID NO: 7325405 - DNA, 23 bp, Homo sapiens
gctcatctagaatggtttcagct

SEQ ID NO: 7325406 - DNA, 22 bp, Homo sapiens
gctagtgagctctttgtcatct

SEQ ID NO: 7325407 - DNA, 22 bp, Homo sapiens
gctgctgtcagtggtggcagtt

SEQ ID NO: 7325408 - DNA, 22 bp, Homo sapiens
gctgctgtcacggtgctaaggg

SEQ ID NO: 7325409 - DNA, 22 bp, Homo sapiens
gctgctgtaatgtgttaagtca

SEQ ID NO: 7325410 - DNA, 22 bp, Homo sapiens
gctgctgtaacactaagtgcag

SEQ ID NO: 7325411 - DNA, 22 bp, Homo sapiens
gctgctggggtggagaaacgct

SEQ ID NO: 7325412 - DNA, 22 bp, Homo sapiens
gctgcaggggggtctggacttg

SEQ ID NO: 7325413 - DNA, 22 bp, Homo sapiens
ggaggaggcggcagaagttcct

SEQ ID NO: 7325414 - DNA, 22 bp, Homo sapiens
ggaggaggggcgctttgtctat

SEQ ID NO: 7325415 - DNA, 22 bp, Homo sapiens
ggaggaggggtgactgaatgct

SEQ ID NO: 7325416 - DNA, 22 bp, Homo sapiens
ggagctgttgcgcatgcgctcg

SEQ ID NO: 7325417 - DNA, 22 bp, Homo sapiens
ggagctgtaacgagccattgct

SEQ ID NO: 7325418 - DNA, 22 bp, Homo sapiens
ggagcctggtcaggttggctcc

SEQ ID NO: 7325419 - DNA, 22 bp, Homo sapiens
ggagctgcatttagggagcctt

SEQ ID NO: 7325420 - DNA, 22 bp, Homo sapiens
ggagcctggtatagtgttgcat

SEQ ID NO: 7325421 - DNA, 22 bp, Homo sapiens
ggagcctgggcctcctgccctt

SEQ ID NO: 7325422 - DNA, 22 bp, Homo sapiens
ggagcctgggcattagtaattt

SEQ ID NO: 7325423 - DNA, 22 bp, Homo sapiens
ggagcctggcctggctctgtgt

SEQ ID NO: 7325424 - DNA, 22 bp, Homo sapiens
ggagaagaggagctggaagcct

SEQ ID NO: 7325425 - DNA, 17 bp, Homo sapiens
ggagccaggagcccacc

SEQ ID NO: 7325426 - DNA, 22 bp, Homo sapiens
ggagccaggcatatcggggcac

SEQ ID NO: 7325427 - DNA, 22 bp, Homo sapiens
ggagcccaggttgtttgtgcag

SEQ ID NO: 7325428 - DNA, 22 bp, Homo sapiens
ggagcccagtcggggtgtaggt

SEQ ID NO: 7325429 - DNA, 22 bp, Homo sapiens
ggagcctggcaatgctgcgtcc

SEQ ID NO: 7325430 - DNA, 22 bp, Homo sapiens
ggagcctggagtttctgatggg

SEQ ID NO: 7325431 - DNA, 22 bp, Homo sapiens
ggagcctggcccggcccttggc

SEQ ID NO: 7325432 - DNA, 23 bp, Homo sapiens
ggagcctggcatatgagacgcat

SEQ ID NO: 7325433 - DNA, 19 bp, Homo sapiens
ggagcctggcaggggcgtg

SEQ ID NO: 7325434 - DNA, 18 bp, Homo sapiens
ggagcccagaggacagga

SEQ ID NO: 7325435 - DNA, 18 bp, Homo sapiens
ggagcccagaggtgagtt

SEQ ID NO: 7325436 - DNA, 22 bp, Homo sapiens
ggagcccaagtctgcactcggc

SEQ ID NO: 7325437 - DNA, 22 bp, Homo sapiens
ggacaggatgctgaagatgaag

SEQ ID NO: 7325438 - DNA, 22 bp, Homo sapiens
ggaagggaatccatctggttag

SEQ ID NO: 7325439 - DNA, 22 bp, Homo sapiens
ggacaggctgcatctgagcatg

SEQ ID NO: 7325440 - DNA, 22 bp, Homo sapiens
ggacaggggcgtggggattgtt

SEQ ID NO: 7325441 - DNA, 22 bp, Homo sapiens
gcttaaagttgtaaattagaga

SEQ ID NO: 7325442 - DNA, 22 bp, Homo sapiens
gctgtgtgttcaataatgtgat

SEQ ID NO: 7325443 - DNA, 22 bp, Homo sapiens
gctgtgtgctgggcatggcact

SEQ ID NO: 7325444 - DNA, 22 bp, Homo sapiens
gcttaaaatccatgatttttac

SEQ ID NO: 7325445 - DNA, 22 bp, Homo sapiens
gcttaaaagccacttagtctat

SEQ ID NO: 7325446 - DNA, 22 bp, Homo sapiens
gctgtcagttttacccacagac

SEQ ID NO: 7325447 - DNA, 22 bp, Homo sapiens
gctgtctgctgggtcgctcagg

SEQ ID NO: 7325448 - DNA, 22 bp, Homo sapiens
gctgtctcatacaaggccctgc

SEQ ID NO: 7325449 - DNA, 22 bp, Homo sapiens
gctgtcctcgtctctcacgcaa

SEQ ID NO: 7325450 - DNA, 22 bp, Homo sapiens
gctgtctggatatcttggaatt

SEQ ID NO: 7325451 - DNA, 22 bp, Homo sapiens
gctgtgtgctcacgtagtggaa

SEQ ID NO: 7325452 - DNA, 22 bp, Homo sapiens
gctgtactgacttgcttagctg

SEQ ID NO: 7325453 - DNA, 22 bp, Homo sapiens
ctggtagtttgcaaaatggtgt

SEQ ID NO: 7325454 - DNA, 22 bp, Homo sapiens
ctggtagtttgcaaaatggtgt

SEQ ID NO: 7325455 - DNA, 22 bp, Homo sapiens
ctggagctcagcccaggttcca

SEQ ID NO: 7325456 - DNA, 22 bp, Homo sapiens
ctgggcctcaccctagaccaat

SEQ ID NO: 7325457 - DNA, 22 bp, Homo sapiens
ctgtgaattttccaatattccg

SEQ ID NO: 7325458 - DNA, 22 bp, Homo sapiens
ctgtgaatctgggtcagttgta

SEQ ID NO: 7325459 - DNA, 22 bp, Homo sapiens
ctgtgaatgttgaataaatcct

SEQ ID NO: 7325460 - DNA, 22 bp, Homo sapiens
ctggttcaagtcctggctctgt

SEQ ID NO: 7325461 - DNA, 22 bp, Homo sapiens
ctggtttgtcttgggaggatgt

SEQ ID NO: 7325462 - DNA, 22 bp, Homo sapiens
ctgtcccaggatcctgactcca

SEQ ID NO: 7325463 - DNA, 22 bp, Homo sapiens
ctgtcccctgtgctttcacttg

SEQ ID NO: 7325464 - DNA, 18 bp, Homo sapiens
ctgtcccatcctcaggtt

SEQ ID NO: 7325465 - DNA, 20 bp, Homo sapiens
ctgttaaaaggtatgaattc

SEQ ID NO: 7325466 - DNA, 22 bp, Homo sapiens
cttcagaaataacaacaattac

SEQ ID NO: 7325467 - DNA, 22 bp, Homo sapiens
ctttcgatcaagggtcccttca

SEQ ID NO: 7325468 - DNA, 21 bp, Homo sapiens
ctttgcatacagatgccaatt

SEQ ID NO: 7325469 - DNA, 22 bp, Homo sapiens
ctttgcataatgaatgatcata

SEQ ID NO: 7325470 - DNA, 22 bp, Homo sapiens
ctttctctgtgtttcacatgct

SEQ ID NO: 7325471 - DNA, 22 bp, Homo sapiens
ctttctcttcactgtcatgatc

SEQ ID NO: 7325472 - DNA, 22 bp, Homo sapiens
ctttctcttacccaaggatctg

SEQ ID NO: 7325473 - DNA, 22 bp, Homo sapiens
ctttctctggaggggagtggtt

SEQ ID NO: 7325474 - DNA, 22 bp, Homo sapiens
ctttctctgtgtggtaaagggc

SEQ ID NO: 7325475 - DNA, 22 bp, Homo sapiens
ctttctctgtggtgaggagggt

SEQ ID NO: 7325476 - DNA, 20 bp, Homo sapiens
ctttctctaatttataagta

SEQ ID NO: 7325477 - DNA, 23 bp, Homo sapiens
gaaatgtttcttgattaatccta

SEQ ID NO: 7325478 - DNA, 23 bp, Homo sapiens
gaaatgtttcttgattaatccta

SEQ ID NO: 7325479 - DNA, 22 bp, Homo sapiens
gaaatgttggacacttgaaatt

SEQ ID NO: 7325480 - DNA, 22 bp, Homo sapiens
gaaatgttgtcctgtctcttga

SEQ ID NO: 7325481 - DNA, 22 bp, Homo sapiens
gaaatgttatgagatatgtact

SEQ ID NO: 7325482 - DNA, 22 bp, Homo sapiens
gaaatgttatgagatatgtact

SEQ ID NO: 7325483 - DNA, 22 bp, Homo sapiens
gaaattctgtgtcccagagtgc

SEQ ID NO: 7325484 - DNA, 22 bp, Homo sapiens
gaagaagacatggaacaatagt

SEQ ID NO: 7325485 - DNA, 22 bp, Homo sapiens
gaagaagagataatggggagca

SEQ ID NO: 7325486 - DNA, 22 bp, Homo sapiens
gaaatatacattgcaggaagag

SEQ ID NO: 7325487 - DNA, 22 bp, Homo sapiens
gaaaaatgagctgatgtcaggg

SEQ ID NO: 7325488 - DNA, 22 bp, Homo sapiens
gaaagaagctttagatggctat

SEQ ID NO: 7325489 - DNA, 22 bp, Homo sapiens
ctttggatggctgtgtgtttat

SEQ ID NO: 7325490 - DNA, 21 bp, Homo sapiens
gacaaacatttcatagcttta

SEQ ID NO: 7325491 - DNA, 20 bp, Homo sapiens
gaattttatgaacactacca

SEQ ID NO: 7325492 - DNA, 22 bp, Homo sapiens
gaattttattactagtcaactg

SEQ ID NO: 7325493 - DNA, 22 bp, Homo sapiens
gacaaaggatcagaggttggga

SEQ ID NO: 7325494 - DNA, 19 bp, Homo sapiens
gaatgtttgtattcagcgc

SEQ ID NO: 7325495 - DNA, 22 bp, Homo sapiens
gaatgctttgggaattcagaat

SEQ ID NO: 7325496 - DNA, 22 bp, Homo sapiens
gaatgcttggaacctgaagttc

SEQ ID NO: 7325497 - DNA, 22 bp, Homo sapiens
gaatgtttttataagtgttaca

SEQ ID NO: 7325498 - DNA, 22 bp, Homo sapiens
gaatgtttttaggaatgttatg

SEQ ID NO: 7325499 - DNA, 22 bp, Homo sapiens
gaatgcattctcttagcatcta

SEQ ID NO: 7325500 - DNA, 22 bp, Homo sapiens
gaatgcatgtgaagcaaagaat

SEQ ID NO: 7325501 - DNA, 22 bp, Homo sapiens
gacatgcatgaatgcaggtctc

SEQ ID NO: 7325502 - DNA, 22 bp, Homo sapiens
gacatgcagttctcaagggtag

SEQ ID NO: 7325503 - DNA, 22 bp, Homo sapiens
gacctggtgctagctggtgtgt

SEQ ID NO: 7325504 - DNA, 22 bp, Homo sapiens
gacctggtgcaggtggacagag

SEQ ID NO: 7325505 - DNA, 19 bp, Homo sapiens
gactacagggggaagaagt

SEQ ID NO: 7325506 - DNA, 22 bp, Homo sapiens
gacagccatgcacttctgctgt

SEQ ID NO: 7325507 - DNA, 22 bp, Homo sapiens
gacagctggcagtggaaaggtg

SEQ ID NO: 7325508 - DNA, 22 bp, Homo sapiens
gacagctgcttatgaaccaacg

SEQ ID NO: 7325509 - DNA, 22 bp, Homo sapiens
gacagctgcctctgtgtagatc

SEQ ID NO: 7325510 - DNA, 22 bp, Homo sapiens
gagcaaatggagcttgtctact

SEQ ID NO: 7325511 - DNA, 22 bp, Homo sapiens
gagcaaaggtgcagtttgaaat

SEQ ID NO: 7325512 - DNA, 22 bp, Homo sapiens
gagcaaagcttttagggccttt

SEQ ID NO: 7325513 - DNA, 22 bp, Homo sapiens
gagaggagttactatttccgag

SEQ ID NO: 7325514 - DNA, 22 bp, Homo sapiens
gagcaatacatggcatgaaatt

SEQ ID NO: 7325515 - DNA, 22 bp, Homo sapiens
gagcaggaaggccagaagggtc

SEQ ID NO: 7325516 - DNA, 22 bp, Homo sapiens
gagcaggacgtgggaatgggaa

SEQ ID NO: 7325517 - DNA, 22 bp, Homo sapiens
gagcagagacagtacaactggc

SEQ ID NO: 7325518 - DNA, 22 bp, Homo sapiens
gagcagaactactcacatatcg

SEQ ID NO: 7325519 - DNA, 22 bp, Homo sapiens
gagagcaggaggcagcgggacg

SEQ ID NO: 7325520 - DNA, 22 bp, Homo sapiens
gagaggagtaggctgatggtgc

SEQ ID NO: 7325521 - DNA, 22 bp, Homo sapiens
gagaggagtccctatcacagtt

SEQ ID NO: 7325522 - DNA, 22 bp, Homo sapiens
gagaggagtaggctgatggtgc

SEQ ID NO: 7325523 - DNA, 22 bp, Homo sapiens
gagaggagtagacactttggtt

SEQ ID NO: 7325524 - DNA, 18 bp, Homo sapiens
gagaggagccagaatttt

SEQ ID NO: 7325525 - DNA, 22 bp, Homo sapiens
gagaggaggtggctatgacagc

SEQ ID NO: 7325526 - DNA, 22 bp, Homo sapiens
gagaggagacttatccagattg

SEQ ID NO: 7325527 - DNA, 22 bp, Homo sapiens
gagaggagaagcctgcgcttca

SEQ ID NO: 7325528 - DNA, 22 bp, Homo sapiens
gagagaagggacttctacactt

SEQ ID NO: 7325529 - DNA, 22 bp, Homo sapiens
gagtaaggctgctgatggagtg

SEQ ID NO: 7325530 - DNA, 22 bp, Homo sapiens
gaggtgagaagggggtcagatg

SEQ ID NO: 7325531 - DNA, 22 bp, Homo sapiens
gaggtgagtggatcacgaggtc

SEQ ID NO: 7325532 - DNA, 22 bp, Homo sapiens
gaggtggctccttcagggaata

SEQ ID NO: 7325533 - DNA, 22 bp, Homo sapiens
gaggtctgccttcaggagagtt

SEQ ID NO: 7325534 - DNA, 19 bp, Homo sapiens
gaggcgaggcgtgcaggag

SEQ ID NO: 7325535 - DNA, 22 bp, Homo sapiens
gaggctggtaggaaaggaaaca

SEQ ID NO: 7325536 - DNA, 22 bp, Homo sapiens
gaggctagagcaggggctcaat

SEQ ID NO: 7325537 - DNA, 22 bp, Homo sapiens
gaggctggttctgaagtactgt

SEQ ID NO: 7325538 - DNA, 22 bp, Homo sapiens
gaggctggtttgccttttggca

SEQ ID NO: 7325539 - DNA, 22 bp, Homo sapiens
gagggagaattgcagccagcgt

SEQ ID NO: 7325540 - DNA, 22 bp, Homo sapiens
gaggagagaagctaacggtgct

SEQ ID NO: 7325541 - DNA, 22 bp, Homo sapiens
gaggaggttccgggtggagaag

SEQ ID NO: 7325542 - DNA, 22 bp, Homo sapiens
gaggagtctttttagggcctga

SEQ ID NO: 7325543 - DNA, 22 bp, Homo sapiens
gaggagtgccagccgtggagtc

SEQ ID NO: 7325544 - DNA, 18 bp, Homo sapiens
gaggatggaaggagatgc

SEQ ID NO: 7325545 - DNA, 22 bp, Homo sapiens
gaggagacggggtgcctggagc

SEQ ID NO: 7325546 - DNA, 22 bp, Homo sapiens
gaggagaaagcagtgatttgtg

SEQ ID NO: 7325547 - DNA, 22 bp, Homo sapiens
gaggagagaagctaacggtgct

SEQ ID NO: 7325548 - DNA, 22 bp, Homo sapiens
gaggactacatgagccacatca

SEQ ID NO: 7325549 - DNA, 22 bp, Homo sapiens
gaggatggaggtgtgagctatg

SEQ ID NO: 7325550 - DNA, 22 bp, Homo sapiens
gaggatggtatgaggcaagcaa

SEQ ID NO: 7325551 - DNA, 22 bp, Homo sapiens
gaggatggtgagcaggacccag

SEQ ID NO: 7325552 - DNA, 22 bp, Homo sapiens
gaggcatggcctgaggctagga

SEQ ID NO: 7325553 - DNA, 22 bp, Homo sapiens
gaggcaagagaagccagctttc

SEQ ID NO: 7325554 - DNA, 22 bp, Homo sapiens
gagctcattgtggatggatggg

SEQ ID NO: 7325555 - DNA, 22 bp, Homo sapiens
gagctcagcccaaagagcagtg

SEQ ID NO: 7325556 - DNA, 19 bp, Homo sapiens
gagcaggccacacatgtgt

SEQ ID NO: 7325557 - DNA, 22 bp, Homo sapiens
gagcaggccagcaatggaaggg

SEQ ID NO: 7325558 - DNA, 22 bp, Homo sapiens
gagcaggcattctagtggctga

SEQ ID NO: 7325559 - DNA, 22 bp, Homo sapiens
gagcaggcaaagatgaaaggag

SEQ ID NO: 7325560 - DNA, 22 bp, Homo sapiens
gagcaggcaactctgcagtgcc

SEQ ID NO: 7325561 - DNA, 22 bp, Homo sapiens
gagctgggatttgaacctggga

SEQ ID NO: 7325562 - DNA, 22 bp, Homo sapiens
gagctgggcctcagaacacagt

SEQ ID NO: 7325563 - DNA, 22 bp, Homo sapiens
ttaaattttagaaacagactct

SEQ ID NO: 7325564 - DNA, 22 bp, Homo sapiens
ttaagatttgtagagaaaaagc

SEQ ID NO: 7325565 - DNA, 22 bp, Homo sapiens
ttaaatttctacgtgatccagg

SEQ ID NO: 7325566 - DNA, 22 bp, Homo sapiens
ttaaattattgagggattgtca

SEQ ID NO: 7325567 - DNA, 22 bp, Homo sapiens
ttacaaagattatattcagtta

SEQ ID NO: 7325568 - DNA, 22 bp, Homo sapiens
ttacaaagcaggtcagctgaaa

SEQ ID NO: 7325569 - DNA, 22 bp, Homo sapiens
ccttacactgcctggggccacg

SEQ ID NO: 7325570 - DNA, 22 bp, Homo sapiens
ccttaaaagaactatctcttct

SEQ ID NO: 7325571 - DNA, 23 bp, Homo sapiens
ttatcaggacatgctgtctcagg

SEQ ID NO: 7325572 - DNA, 22 bp, Homo sapiens
ttatatttctggtagccttcag

SEQ ID NO: 7325573 - DNA, 22 bp, Homo sapiens
ttatcacttatgagctttttgc

SEQ ID NO: 7325574 - DNA, 22 bp, Homo sapiens
ttagcaaagtttgccatctagt

SEQ ID NO: 7325575 - DNA, 22 bp, Homo sapiens
ttatttattgtgtacctactgt

SEQ ID NO: 7325576 - DNA, 16 bp, Homo sapiens
cgcctccctccctcgc

SEQ ID NO: 7325577 - DNA, 22 bp, Homo sapiens
ttcaaagtaccgtacttaatgg

SEQ ID NO: 7325578 - DNA, 21 bp, Homo sapiens
cctttttgcttatggacagac

SEQ ID NO: 7325579 - DNA, 22 bp, Homo sapiens
ccttttctgtttcctgtcactg

SEQ ID NO: 7325580 - DNA, 22 bp, Homo sapiens
cggggacacactggcagctcct

SEQ ID NO: 7325581 - DNA, 20 bp, Homo sapiens
ttcaaagtgtatgatatgca

SEQ ID NO: 7325582 - DNA, 18 bp, Homo sapiens
cggcagagtgcttctagc

SEQ ID NO: 7325583 - DNA, 22 bp, Homo sapiens
cggcagagcttcctgctcagcg

SEQ ID NO: 7325584 - DNA, 22 bp, Homo sapiens
cggcagagtgtgtgcgtgcatg

SEQ ID NO: 7325585 - DNA, 22 bp, Homo sapiens
cggcagagcggcgagcccctcc

SEQ ID NO: 7325586 - DNA, 22 bp, Homo sapiens
cggcagagacggcgctttgaac

SEQ ID NO: 7325587 - DNA, 22 bp, Homo sapiens
cggcagagccctgagtcagcct

SEQ ID NO: 7325588 - DNA, 17 bp, Homo sapiens
cgtgtgcttgtgtgcac

SEQ ID NO: 7325589 - DNA, 16 bp, Homo sapiens
cgtggtctgatttcct

SEQ ID NO: 7325590 - DNA, 22 bp, Homo sapiens
ctagagaaaatgttaatacagt

SEQ ID NO: 7325591 - DNA, 22 bp, Homo sapiens
ttctggcttagttgttgtatat

SEQ ID NO: 7325592 - DNA, 22 bp, Homo sapiens
ctataattatgctcaaaatgta

SEQ ID NO: 7325593 - DNA, 22 bp, Homo sapiens
ctcacaggttctgcagctcaca

SEQ ID NO: 7325594 - DNA, 22 bp, Homo sapiens
ctcaggaagcacaggccctaca

SEQ ID NO: 7325595 - DNA, 22 bp, Homo sapiens
ctcaggaagcctgtaatgtggg

SEQ ID NO: 7325596 - DNA, 22 bp, Homo sapiens
ctcaggaagcctgtaatgtggg

SEQ ID NO: 7325597 - DNA, 22 bp, Homo sapiens
ctcaggagatgacagaaggtat

SEQ ID NO: 7325598 - DNA, 22 bp, Homo sapiens
ttgcactttgaaataacagtgg

SEQ ID NO: 7325599 - DNA, 22 bp, Homo sapiens
ttgcccagagtccacagcgtac

SEQ ID NO: 7325600 - DNA, 22 bp, Homo sapiens
ttgcccaggctggagtgcagta

SEQ ID NO: 7325601 - DNA, 22 bp, Homo sapiens
ttgcccaggctggagtgcagtg

SEQ ID NO: 7325602 - DNA, 22 bp, Homo sapiens
ctcaggttttggctttgtgtac

SEQ ID NO: 7325603 - DNA, 22 bp, Homo sapiens
ctccaggacagattcagggcca

SEQ ID NO: 7325604 - DNA, 22 bp, Homo sapiens
ttggctgccgagcgcatcccgg

SEQ ID NO: 7325605 - DNA, 22 bp, Homo sapiens
ttggctgagagaggaaaagggc

SEQ ID NO: 7325606 - DNA, 22 bp, Homo sapiens
ttggatccatctcaggcatagg

SEQ ID NO: 7325607 - DNA, 22 bp, Homo sapiens
ctgccttggtttctagcagggc

SEQ ID NO: 7325608 - DNA, 22 bp, Homo sapiens
ctgctgtcaaaaatcactccat

SEQ ID NO: 7325609 - DNA, 22 bp, Homo sapiens
ctgctgtcatagccatccctcc

SEQ ID NO: 7325610 - DNA, 22 bp, Homo sapiens
ctgctgtcatctggcgctgtgc

SEQ ID NO: 7325611 - DNA, 22 bp, Homo sapiens
ctgctgtccaacctgcactcgc

SEQ ID NO: 7325612 - DNA, 22 bp, Homo sapiens
ctgctgtccaggagtgccctgt

SEQ ID NO: 7325613 - DNA, 22 bp, Homo sapiens
ctgctgtcccagcctcctcaca

SEQ ID NO: 7325614 - DNA, 22 bp, Homo sapiens
ctgctgtcctatctctttgttc

SEQ ID NO: 7325615 - DNA, 22 bp, Homo sapiens
ctgctgtcgccacggtcgccgc

SEQ ID NO: 7325616 - DNA, 22 bp, Homo sapiens
ctgctgtcgccgagctgcatgc

SEQ ID NO: 7325617 - DNA, 22 bp, Homo sapiens
ctgctgtaatgagtcagcatct

SEQ ID NO: 7325618 - DNA, 22 bp, Homo sapiens
ctggaaggagaaggaggctgtg

SEQ ID NO: 7325619 - DNA, 22 bp, Homo sapiens
ctgctgtctagtatcttaaaaa

SEQ ID NO: 7325620 - DNA, 22 bp, Homo sapiens
ctgctgtctttatttcactgct

SEQ ID NO: 7325621 - DNA, 22 bp, Homo sapiens
ctggaaggagcccgggcggatc

SEQ ID NO: 7325622 - DNA, 22 bp, Homo sapiens
ctggaaggtggatggcgaggcc

SEQ ID NO: 7325623 - DNA, 22 bp, Homo sapiens
ctgcagctttggaaacctgttt

SEQ ID NO: 7325624 - DNA, 22 bp, Homo sapiens
ctgcccaggctgaaggaacatc

SEQ ID NO: 7325625 - DNA, 22 bp, Homo sapiens
tttcatgttacagtgtaaaagt

SEQ ID NO: 7325626 - DNA, 22 bp, Homo sapiens
tttcagtttccagctttgtcat

SEQ ID NO: 7325627 - DNA, 22 bp, Homo sapiens
tttcagaaatggcactgaaatc

SEQ ID NO: 7325628 - DNA, 22 bp, Homo sapiens
tttattcattgtttcgtcgcag

SEQ ID NO: 7325629 - DNA, 22 bp, Homo sapiens
tttattcatcatctgttcatat

SEQ ID NO: 7325630 - DNA, 22 bp, Homo sapiens
ctccaggagggggatggctgta

SEQ ID NO: 7325631 - DNA, 19 bp, Homo sapiens
ctccaggatggctgggcga

SEQ ID NO: 7325632 - DNA, 22 bp, Homo sapiens
tttatgtaatttcataggtgtg

SEQ ID NO: 7325633 - DNA, 22 bp, Homo sapiens
tttattcagcagcagcagtggt

SEQ ID NO: 7325634 - DNA, 22 bp, Homo sapiens
tttcatgtttatggaaaatgag

SEQ ID NO: 7325635 - DNA, 22 bp, Homo sapiens
tttcatgttacatttaaaatgt

SEQ ID NO: 7325636 - DNA, 22 bp, Homo sapiens
tttctcaacctcaacactattt

SEQ ID NO: 7325637 - DNA, 18 bp, Homo sapiens
ctctctttccactctttg

SEQ ID NO: 7325638 - DNA, 22 bp, Homo sapiens
ctctctgtggtggctgtcccat

SEQ ID NO: 7325639 - DNA, 22 bp, Homo sapiens
ctctctttgatgtataaataat

SEQ ID NO: 7325640 - DNA, 22 bp, Homo sapiens
tttgcaaacacttaagaagaga

SEQ ID NO: 7325641 - DNA, 22 bp, Homo sapiens
tttgcaaagaaattattgctgt

SEQ ID NO: 7325642 - DNA, 22 bp, Homo sapiens
ctctgagtttcatttccctcct

SEQ ID NO: 7325643 - DNA, 22 bp, Homo sapiens
tttcttgattagctgtggctca

SEQ ID NO: 7325644 - DNA, 22 bp, Homo sapiens
tttgaaacccgtcactttgagt

SEQ ID NO: 7325645 - DNA, 22 bp, Homo sapiens
tttgaaacctagttatatgact

SEQ ID NO: 7325646 - DNA, 22 bp, Homo sapiens
tttgaaactctgaacatgtttc

SEQ ID NO: 7325647 - DNA, 19 bp, Homo sapiens
ctctgggctgcatcttggt

SEQ ID NO: 7325648 - DNA, 22 bp, Homo sapiens
ctctgtgccctactgctcagct

SEQ ID NO: 7325649 - DNA, 22 bp, Homo sapiens
tatcaggagttgacagttgcta

SEQ ID NO: 7325650 - DNA, 22 bp, Homo sapiens
tatcataggtgtcataatagca

SEQ ID NO: 7325651 - DNA, 22 bp, Homo sapiens
cagggtggccaggtagataata

SEQ ID NO: 7325652 - DNA, 22 bp, Homo sapiens
cagggtggcaggcaccatggcc

SEQ ID NO: 7325653 - DNA, 22 bp, Homo sapiens
tatcaggaggaaatttccattg

SEQ ID NO: 7325654 - DNA, 22 bp, Homo sapiens
tatattgtaggtgctatttgaa

SEQ ID NO: 7325655 - DNA, 22 bp, Homo sapiens
taggtaggtgcaattaaaagta

SEQ ID NO: 7325656 - DNA, 19 bp, Homo sapiens
taggtaggtaggtaggtat

SEQ ID NO: 7325657 - DNA, 22 bp, Homo sapiens
taggtagggaccaccttgggga

SEQ ID NO: 7325658 - DNA, 22 bp, Homo sapiens
taggtagggaaatggttcctgt

SEQ ID NO: 7325659 - DNA, 22 bp, Homo sapiens
taggtaggtaaacaggactaat

SEQ ID NO: 7325660 - DNA, 22 bp, Homo sapiens
taggtaggtgcaattaaaagta

SEQ ID NO: 7325661 - DNA, 22 bp, Homo sapiens
tagctacactgaggctgcttaa

SEQ ID NO: 7325662 - DNA, 22 bp, Homo sapiens
tagctacatacttggccattct

SEQ ID NO: 7325663 - DNA, 22 bp, Homo sapiens
tagctacatttatacactgtag

SEQ ID NO: 7325664 - DNA, 22 bp, Homo sapiens
tagctcaaaggttaagtgtgga

SEQ ID NO: 7325665 - DNA, 22 bp, Homo sapiens
tagctcaaaggttaagtgtgga

SEQ ID NO: 7325666 - DNA, 22 bp, Homo sapiens
taggaaattaagtctcttttgt

SEQ ID NO: 7325667 - DNA, 22 bp, Homo sapiens
taggaaattagaacttggaaac

SEQ ID NO: 7325668 - DNA, 22 bp, Homo sapiens
taggaaattctcttgctaagtt

SEQ ID NO: 7325669 - DNA, 22 bp, Homo sapiens
taggaaattgacacctgcttga

SEQ ID NO: 7325670 - DNA, 22 bp, Homo sapiens
taggaaattgccaatatatgac

SEQ ID NO: 7325671 - DNA, 22 bp, Homo sapiens
taggaaatttcatttgaggtct

SEQ ID NO: 7325672 - DNA, 22 bp, Homo sapiens
taggaaattggaaactcttcac

SEQ ID NO: 7325673 - DNA, 22 bp, Homo sapiens
taggaaatttatagaggtgttt

SEQ ID NO: 7325674 - DNA, 22 bp, Homo sapiens
taggaaatttgaaatatgtggg

SEQ ID NO: 7325675 - DNA, 22 bp, Homo sapiens
taggaaattttactggtctggg

SEQ ID NO: 7325676 - DNA, 22 bp, Homo sapiens
taggacataagtattctaactt

SEQ ID NO: 7325677 - DNA, 22 bp, Homo sapiens
taggagagctgaactattgtct

SEQ ID NO: 7325678 - DNA, 22 bp, Homo sapiens
taggagaagagtcagggcctaa

SEQ ID NO: 7325679 - DNA, 19 bp, Homo sapiens
taggaccctggtggccccc

SEQ ID NO: 7325680 - DNA, 19 bp, Homo sapiens
taggaccctggtggccccc

SEQ ID NO: 7325681 - DNA, 22 bp, Homo sapiens
taggagcctgctctgcagggac

SEQ ID NO: 7325682 - DNA, 18 bp, Homo sapiens
taggaggatactgagatg

SEQ ID NO: 7325683 - DNA, 18 bp, Homo sapiens
tagagttactacatgatt

SEQ ID NO: 7325684 - DNA, 22 bp, Homo sapiens
tagaggagaacacaaattatag

SEQ ID NO: 7325685 - DNA, 19 bp, Homo sapiens
tagaggagaagggaagtgg

SEQ ID NO: 7325686 - DNA, 22 bp, Homo sapiens
caggctgggctccggagataaa

SEQ ID NO: 7325687 - DNA, 22 bp, Homo sapiens
caggctggtcccagagcattgc

SEQ ID NO: 7325688 - DNA, 22 bp, Homo sapiens
tagctacaaatctgataagtgg

SEQ ID NO: 7325689 - DNA, 22 bp, Homo sapiens
tagctacaatcactgtcctttg

SEQ ID NO: 7325690 - DNA, 22 bp, Homo sapiens
tagctacacatctaaacagcaa

SEQ ID NO: 7325691 - DNA, 22 bp, Homo sapiens
tagctacaaggaagaatggaaa

SEQ ID NO: 7325692 - DNA, 22 bp, Homo sapiens
cagggcacagttatggaggtgg

SEQ ID NO: 7325693 - DNA, 22 bp, Homo sapiens
tagatacacacacagtcatgtg

SEQ ID NO: 7325694 - DNA, 22 bp, Homo sapiens
tactcatttcaaacagcacaaa

SEQ ID NO: 7325695 - DNA, 22 bp, Homo sapiens
tactcatcagactccagggtgg

SEQ ID NO: 7325696 - DNA, 22 bp, Homo sapiens
tactcaatttcttatgggtttc

SEQ ID NO: 7325697 - DNA, 22 bp, Homo sapiens
tactcaatgaagtagcctggtt

SEQ ID NO: 7325698 - DNA, 22 bp, Homo sapiens
tactcaatctaggtggcttacc

SEQ ID NO: 7325699 - DNA, 20 bp, Homo sapiens
tactcacaaatggtttagca

SEQ ID NO: 7325700 - DNA, 22 bp, Homo sapiens
tactcacattctgtttcttgct

SEQ ID NO: 7325701 - DNA, 22 bp, Homo sapiens
tactatttttgcaacgtataca

SEQ ID NO: 7325702 - DNA, 22 bp, Homo sapiens
tactcaaactcactaagacaga

SEQ ID NO: 7325703 - DNA, 22 bp, Homo sapiens
cagtgtttccgtcagtatgtga

SEQ ID NO: 7325704 - DNA, 22 bp, Homo sapiens
cagtgtttgtggaattcaggtg

SEQ ID NO: 7325705 - DNA, 22 bp, Homo sapiens
cagtgtttgcttaagttatatg

SEQ ID NO: 7325706 - DNA, 22 bp, Homo sapiens
cagtgtttgtatagaatatgca

SEQ ID NO: 7325707 - DNA, 22 bp, Homo sapiens
cagttaaacagattgagtgtta

SEQ ID NO: 7325708 - DNA, 22 bp, Homo sapiens
cagttaaaatgtgctataagaa

SEQ ID NO: 7325709 - DNA, 22 bp, Homo sapiens
cagttaaacagattgagtgtta

SEQ ID NO: 7325710 - DNA, 22 bp, Homo sapiens
cagttaaacgatgatggggtca

SEQ ID NO: 7325711 - DNA, 22 bp, Homo sapiens
cagttaaaagaagtctatctta

SEQ ID NO: 7325712 - DNA, 22 bp, Homo sapiens
cagttaaaaggtatgctaccaa

SEQ ID NO: 7325713 - DNA, 22 bp, Homo sapiens
tcagacttttaaagactgaatg

SEQ ID NO: 7325714 - DNA, 22 bp, Homo sapiens
tcagacttctactttgcagagc

SEQ ID NO: 7325715 - DNA, 22 bp, Homo sapiens
tcagactgtgtcataagtaggt

SEQ ID NO: 7325716 - DNA, 23 bp, Homo sapiens
tcagaagtgggatacaaagctga

SEQ ID NO: 7325717 - DNA, 20 bp, Homo sapiens
cagttaatgactaggcatca

SEQ ID NO: 7325718 - DNA, 22 bp, Homo sapiens
cagttaaattctccagttacca

SEQ ID NO: 7325719 - DNA, 22 bp, Homo sapiens
cagttaaagtgcttatcacaga

SEQ ID NO: 7325720 - DNA, 22 bp, Homo sapiens
cagttaaatgatgtgccctaga

SEQ ID NO: 7325721 - DNA, 22 bp, Homo sapiens
cagttaaatgatgtgccctaga

SEQ ID NO: 7325722 - DNA, 22 bp, Homo sapiens
cagttaaacgggccatgtgagt

SEQ ID NO: 7325723 - DNA, 22 bp, Homo sapiens
cagttaaagctgcatgtgtcag

SEQ ID NO: 7325724 - DNA, 22 bp, Homo sapiens
cagttaaacgggccatgtgagt

SEQ ID NO: 7325725 - DNA, 22 bp, Homo sapiens
tcaggaaagagtaatgtataca

SEQ ID NO: 7325726 - DNA, 22 bp, Homo sapiens
tcaggaaagaagatgctcagtg

SEQ ID NO: 7325727 - DNA, 22 bp, Homo sapiens
tcaggaaactacagttgaacta

SEQ ID NO: 7325728 - DNA, 22 bp, Homo sapiens
tcaggaaactgtcaagtgggat

SEQ ID NO: 7325729 - DNA, 22 bp, Homo sapiens
tcaggaaaatactgcttatcca

SEQ ID NO: 7325730 - DNA, 21 bp, Homo sapiens
tcaggaaacacctcttaagga

SEQ ID NO: 7325731 - DNA, 22 bp, Homo sapiens
cagtgagaaaactaagacatta

SEQ ID NO: 7325732 - DNA, 22 bp, Homo sapiens
cagtgagaattcagtaggtact

SEQ ID NO: 7325733 - DNA, 22 bp, Homo sapiens
cagtgacgtaaactgcatgtgc

SEQ ID NO: 7325734 - DNA, 22 bp, Homo sapiens
tcacaaatcgaagccttataat

SEQ ID NO: 7325735 - DNA, 22 bp, Homo sapiens
tcacaaatcattttatctgtgt

SEQ ID NO: 7325736 - DNA, 22 bp, Homo sapiens
tcacaaatgtttgcatgtgtct

SEQ ID NO: 7325737 - DNA, 22 bp, Homo sapiens
tcacaaatattttaacagtagg

SEQ ID NO: 7325738 - DNA, 22 bp, Homo sapiens
tcacaaatatagtgagaaccag

SEQ ID NO: 7325739 - DNA, 22 bp, Homo sapiens
tcacagttcatctgataaacta

SEQ ID NO: 7325740 - DNA, 22 bp, Homo sapiens
tcacaggaggactgaaagatat

SEQ ID NO: 7325741 - DNA, 22 bp, Homo sapiens
tcacaggagtcaaggaatagta

SEQ ID NO: 7325742 - DNA, 22 bp, Homo sapiens
tcacaggaggaacctggcctgg

SEQ ID NO: 7325743 - DNA, 22 bp, Homo sapiens
tcacaggagattatgtgtgcta

SEQ ID NO: 7325744 - DNA, 22 bp, Homo sapiens
tcacaggagcccaggggagctg

SEQ ID NO: 7325745 - DNA, 22 bp, Homo sapiens
tcacaggaccctgagggtggcg

SEQ ID NO: 7325746 - DNA, 22 bp, Homo sapiens
tcacaggaagggtaaatattta

SEQ ID NO: 7325747 - DNA, 22 bp, Homo sapiens
tcacagctttgagcagagacca

SEQ ID NO: 7325748 - DNA, 22 bp, Homo sapiens
tcacaggaaccatcagagaaat

SEQ ID NO: 7325749 - DNA, 22 bp, Homo sapiens
cagggtggccctgtggtctcat

SEQ ID NO: 7325750 - DNA, 22 bp, Homo sapiens
cagggtgggcacccagcctcca

SEQ ID NO: 7325751 - DNA, 22 bp, Homo sapiens
caggttgggctgcgaggaggag

SEQ ID NO: 7325752 - DNA, 22 bp, Homo sapiens
cagtaggtgctcaacaagtaca

SEQ ID NO: 7325753 - DNA, 22 bp, Homo sapiens
cagtagctaaattattttcatg

SEQ ID NO: 7325754 - DNA, 22 bp, Homo sapiens
cagtataatgccccctgtgggg

SEQ ID NO: 7325755 - DNA, 22 bp, Homo sapiens
catgaaaaatttactgttaaca

SEQ ID NO: 7325756 - DNA, 22 bp, Homo sapiens
catctttgttctgtaaactttt

SEQ ID NO: 7325757 - DNA, 22 bp, Homo sapiens
catctttgtaacttccacataa

SEQ ID NO: 7325758 - DNA, 22 bp, Homo sapiens
catctttggttttctatatgcc

SEQ ID NO: 7325759 - DNA, 22 bp, Homo sapiens
catctttgtttcatctgtccag

SEQ ID NO: 7325760 - DNA, 22 bp, Homo sapiens
catctttgttttggatataatc

SEQ ID NO: 7325761 - DNA, 22 bp, Homo sapiens
catctttgggctgcatggaagg

SEQ ID NO: 7325762 - DNA, 19 bp, Homo sapiens
catctttggtcacctagtc

SEQ ID NO: 7325763 - DNA, 22 bp, Homo sapiens
catctttggagaaacttccgtt

SEQ ID NO: 7325764 - DNA, 20 bp, Homo sapiens
catctttggcaggactcctt

SEQ ID NO: 7325765 - DNA, 22 bp, Homo sapiens
tcatcagtttagaaaaaatatg

SEQ ID NO: 7325766 - DNA, 22 bp, Homo sapiens
tccacagtctatttttagtcta

SEQ ID NO: 7325767 - DNA, 22 bp, Homo sapiens
tccacagtggttgaactagttt

SEQ ID NO: 7325768 - DNA, 22 bp, Homo sapiens
tccacagtggttgaactagtaa

SEQ ID NO: 7325769 - DNA, 22 bp, Homo sapiens
tccagacattttatagcagtct

SEQ ID NO: 7325770 - DNA, 22 bp, Homo sapiens
tcattcttgatcactagttagt

SEQ ID NO: 7325771 - DNA, 22 bp, Homo sapiens
tcatttatgtctttgccatcca

SEQ ID NO: 7325772 - DNA, 22 bp, Homo sapiens
catgtgtgtggacgagcgtggc

SEQ ID NO: 7325773 - DNA, 22 bp, Homo sapiens
catttgtatagtgcttagacca

SEQ ID NO: 7325774 - DNA, 22 bp, Homo sapiens
tcctcaggatctaggagtgctt

SEQ ID NO: 7325775 - DNA, 22 bp, Homo sapiens
tcctcaggctgcctggaagact

SEQ ID NO: 7325776 - DNA, 22 bp, Homo sapiens
tcctcaggcggtgaggaggggc

SEQ ID NO: 7325777 - DNA, 22 bp, Homo sapiens
tccctcactggttctgcatccc

SEQ ID NO: 7325778 - DNA, 22 bp, Homo sapiens
tccctagtcgcatctgtggaga

SEQ ID NO: 7325779 - DNA, 20 bp, Homo sapiens
cattgcaaagtagcagactg

SEQ ID NO: 7325780 - DNA, 22 bp, Homo sapiens
cattgcaacttcaaactcctgg

SEQ ID NO: 7325781 - DNA, 22 bp, Homo sapiens
cattgagagaatcacatagaag

SEQ ID NO: 7325782 - DNA, 22 bp, Homo sapiens
cattgagagtgacttggacaat

SEQ ID NO: 7325783 - DNA, 21 bp, Homo sapiens
cattgagataggagagattgt

SEQ ID NO: 7325784 - DNA, 22 bp, Homo sapiens
cattcaaatgtgccactgtcct

SEQ ID NO: 7325785 - DNA, 22 bp, Homo sapiens
catgttggctgaggctgtattt

SEQ ID NO: 7325786 - DNA, 22 bp, Homo sapiens
catgttaagtgtttgataacca

SEQ ID NO: 7325787 - DNA, 22 bp, Homo sapiens
catgttatttatccattaaaca

SEQ ID NO: 7325788 - DNA, 22 bp, Homo sapiens
tcccagaggaaatggcagctga

SEQ ID NO: 7325789 - DNA, 22 bp, Homo sapiens
cattcatttactttcaacagct

SEQ ID NO: 7325790 - DNA, 22 bp, Homo sapiens
tcccaggaattgaagccagtgt

SEQ ID NO: 7325791 - DNA, 22 bp, Homo sapiens
tctcctggctcaccaggctgga

SEQ ID NO: 7325792 - DNA, 22 bp, Homo sapiens
tctcctggccgggctgtcccct

SEQ ID NO: 7325793 - DNA, 22 bp, Homo sapiens
tctcctggctctaaaaggctgt

SEQ ID NO: 7325794 - DNA, 17 bp, Homo sapiens
tctcctggctctatcag

SEQ ID NO: 7325795 - DNA, 22 bp, Homo sapiens
tctctgccaccatgagatgggc

SEQ ID NO: 7325796 - DNA, 22 bp, Homo sapiens
ccagcccttagataaacctggc

SEQ ID NO: 7325797 - DNA, 22 bp, Homo sapiens
tctctgtgttccctgttttctc

SEQ ID NO: 7325798 - DNA, 22 bp, Homo sapiens
tctctgtgtgttggctgtatat

SEQ ID NO: 7325799 - DNA, 22 bp, Homo sapiens
tctctgtgtgccttcatctgcc

SEQ ID NO: 7325800 - DNA, 23 bp, Homo sapiens
tctctgtgtgcctcagtttcttc

SEQ ID NO: 7325801 - DNA, 22 bp, Homo sapiens
tctgaatcgttcccatgcagga

SEQ ID NO: 7325802 - DNA, 22 bp, Homo sapiens
ccacatttttgatactctcact

SEQ ID NO: 7325803 - DNA, 22 bp, Homo sapiens
ccaccagaaagactctgtgtga

SEQ ID NO: 7325804 - DNA, 22 bp, Homo sapiens
ccaccagagggcagactgtgat

SEQ ID NO: 7325805 - DNA, 22 bp, Homo sapiens
tcgcgcccccaagcgtcattgg

SEQ ID NO: 7325806 - DNA, 22 bp, Homo sapiens
tcgcgccctcctcaccaacgtg

SEQ ID NO: 7325807 - DNA, 22 bp, Homo sapiens
tcctgacctcttgctctgacct

SEQ ID NO: 7325808 - DNA, 22 bp, Homo sapiens
tcctgaccactaggaccaggct

SEQ ID NO: 7325809 - DNA, 22 bp, Homo sapiens
tgtaatttcctgatgttagaac

SEQ ID NO: 7325810 - DNA, 22 bp, Homo sapiens
cctgctgttagatttcagtcac

SEQ ID NO: 7325811 - DNA, 21 bp, Homo sapiens
cctgctgtgatcttagtgagt

SEQ ID NO: 7325812 - DNA, 20 bp, Homo sapiens
cctgctgtgctttccatgga

SEQ ID NO: 7325813 - DNA, 22 bp, Homo sapiens
cctgctgtgtccctggctttct

SEQ ID NO: 7325814 - DNA, 22 bp, Homo sapiens
cctgctgttttcttcacttcag

SEQ ID NO: 7325815 - DNA, 22 bp, Homo sapiens
cctgctgttctgtttagtgaac

SEQ ID NO: 7325816 - DNA, 22 bp, Homo sapiens
tggtctgcatttattcaagact

SEQ ID NO: 7325817 - DNA, 22 bp, Homo sapiens
cctgctgtgaagccaggcctgt

SEQ ID NO: 7325818 - DNA, 22 bp, Homo sapiens
cctgctgtccctctgggctcca

SEQ ID NO: 7325819 - DNA, 22 bp, Homo sapiens
cctgctgtgaaactggcatatg

SEQ ID NO: 7325820 - DNA, 22 bp, Homo sapiens
cctgctgtccctctgggctcca

SEQ ID NO: 7325821 - DNA, 22 bp, Homo sapiens
cctgctgtcagcatcctcgcga

SEQ ID NO: 7325822 - DNA, 22 bp, Homo sapiens
cctgctgtaatgtgtctttatt

SEQ ID NO: 7325823 - DNA, 22 bp, Homo sapiens
cctgctggccagtggagggctg

SEQ ID NO: 7325824 - DNA, 22 bp, Homo sapiens
cctgccagtcactatgtcacct

SEQ ID NO: 7325825 - DNA, 22 bp, Homo sapiens
cctgccagggccagaggccagc

SEQ ID NO: 7325826 - DNA, 22 bp, Homo sapiens
cctgccagggccttggaagaaa

SEQ ID NO: 7325827 - DNA, 22 bp, Homo sapiens
cctgccaggctttgggcttctg

SEQ ID NO: 7325828 - DNA, 22 bp, Homo sapiens
cctgccaggcgagtctaggcca

SEQ ID NO: 7325829 - DNA, 22 bp, Homo sapiens
cctgccaggctttcaggtttgg

SEQ ID NO: 7325830 - DNA, 22 bp, Homo sapiens
cctgccaggccagtgagcttcc

SEQ ID NO: 7325831 - DNA, 22 bp, Homo sapiens
cctctttaatcccatccatgtg

SEQ ID NO: 7325832 - DNA, 22 bp, Homo sapiens
cctctttaagtggtaaccctta

SEQ ID NO: 7325833 - DNA, 22 bp, Homo sapiens
cctgaatactggtgctgaaagt

SEQ ID NO: 7325834 - DNA, 22 bp, Homo sapiens
cctgccaggagctggtgctgca

SEQ ID NO: 7325835 - DNA, 22 bp, Homo sapiens
cctgccagacgcaccagggggc

SEQ ID NO: 7325836 - DNA, 22 bp, Homo sapiens
tggaagaatgctccacagggaa

SEQ ID NO: 7325837 - DNA, 22 bp, Homo sapiens
cccgtcccttttgcccgctggt

SEQ ID NO: 7325838 - DNA, 20 bp, Homo sapiens
tggaagaagaactcaggctt

SEQ ID NO: 7325839 - DNA, 22 bp, Homo sapiens
tggaagaaggcagagaggcatt

SEQ ID NO: 7325840 - DNA, 22 bp, Homo sapiens
tggaagaataggatagaagaac

SEQ ID NO: 7325841 - DNA, 22 bp, Homo sapiens
tggaagaatatgggggtacaga

SEQ ID NO: 7325842 - DNA, 22 bp, Homo sapiens
tgctttcaatgaattgtatact

SEQ ID NO: 7325843 - DNA, 22 bp, Homo sapiens
tgctttcagctggtaaagaaac

SEQ ID NO: 7325844 - DNA, 22 bp, Homo sapiens
tgctttattgcatcagtgtggg

SEQ ID NO: 7325845 - DNA, 22 bp, Homo sapiens
tggaggtgacggggcctcgttg

SEQ ID NO: 7325846 - DNA, 22 bp, Homo sapiens
tggaggtgagtgtggtacagca

SEQ ID NO: 7325847 - DNA, 22 bp, Homo sapiens
tggaggggcaatggagcgcgga

SEQ ID NO: 7325848 - DNA, 22 bp, Homo sapiens
ccctggttcaggtttctctgaa

SEQ ID NO: 7325849 - DNA, 22 bp, Homo sapiens
cctcacatgaatgtaagctcca

SEQ ID NO: 7325850 - DNA, 22 bp, Homo sapiens
ccgtccccagccacctgctgat

SEQ ID NO: 7325851 - DNA, 22 bp, Homo sapiens
ccgtcccctctgaccttgctga

SEQ ID NO: 7325852 - DNA, 22 bp, Homo sapiens
tgaaagcttgttggaaatgtag

SEQ ID NO: 7325853 - DNA, 22 bp, Homo sapiens
ccaggctgcagtcaaggggcat

SEQ ID NO: 7325854 - DNA, 22 bp, Homo sapiens
ccaggctgccgaggaaagaaag

SEQ ID NO: 7325855 - DNA, 22 bp, Homo sapiens
tcttgccttatgccatgaagca

SEQ ID NO: 7325856 - DNA, 22 bp, Homo sapiens
tcttgtttctgtatataatgac

SEQ ID NO: 7325857 - DNA, 22 bp, Homo sapiens
tcttgttacagtttattacatg

SEQ ID NO: 7325858 - DNA, 22 bp, Homo sapiens
ccagcccttgaggtctgtccat

SEQ ID NO: 7325859 - DNA, 22 bp, Homo sapiens
tctttattttatgcttgtgcaa

SEQ ID NO: 7325860 - DNA, 22 bp, Homo sapiens
tctttattttatgcttgtgcaa

SEQ ID NO: 7325861 - DNA, 22 bp, Homo sapiens
tctttatttctgaatcccccat

SEQ ID NO: 7325862 - DNA, 22 bp, Homo sapiens
tctttatttaagtctgttgtaa

SEQ ID NO: 7325863 - DNA, 22 bp, Homo sapiens
tctttatttctgaatcccccat

SEQ ID NO: 7325864 - DNA, 22 bp, Homo sapiens
tctttatttaagtctgttgtaa

SEQ ID NO: 7325865 - DNA, 22 bp, Homo sapiens
tgacatttttataagagtcaaa

SEQ ID NO: 7325866 - DNA, 22 bp, Homo sapiens
ccagggcatgtaactaatggtg

SEQ ID NO: 7325867 - DNA, 22 bp, Homo sapiens
ccagggcatgtccaagacttag

SEQ ID NO: 7325868 - DNA, 22 bp, Homo sapiens
ccagggcatgggaagaactgaa

SEQ ID NO: 7325869 - DNA, 22 bp, Homo sapiens
tgagcccaggagttggaggctg

SEQ ID NO: 7325870 - DNA, 22 bp, Homo sapiens
cccagcagatggctatgtgcta

SEQ ID NO: 7325871 - DNA, 19 bp, Homo sapiens
cccagagagatctcttgcc

SEQ ID NO: 7325872 - DNA, 22 bp, Homo sapiens
tgattacattggtaatgtttat

SEQ ID NO: 7325873 - DNA, 22 bp, Homo sapiens
tgattacagtatttgagatcca

SEQ ID NO: 7325874 - DNA, 22 bp, Homo sapiens
tgattacagtctgacagatgtt

SEQ ID NO: 7325875 - DNA, 23 bp, Homo sapiens
tgattacaggaagttcaagtgtt

SEQ ID NO: 7325876 - DNA, 22 bp, Homo sapiens
tgattacacagcagtaatttca

SEQ ID NO: 7325877 - DNA, 22 bp, Homo sapiens
tgaggcagtgctgggaagcctg

SEQ ID NO: 7325878 - DNA, 22 bp, Homo sapiens
tgaggcagtgatgtttaagcac

SEQ ID NO: 7325879 - DNA, 22 bp, Homo sapiens
tgaggcagtattctccattcca

SEQ ID NO: 7325880 - DNA, 22 bp, Homo sapiens
tgaggcaggtggattacaaggt

SEQ ID NO: 7325881 - DNA, 22 bp, Homo sapiens
tgaggcaggtaagcaagttttg

SEQ ID NO: 7325882 - DNA, 22 bp, Homo sapiens
tgaggcagtattttagtgactt

SEQ ID NO: 7325883 - DNA, 22 bp, Homo sapiens
tgaggcagtcaccccctcctgc

SEQ ID NO: 7325884 - DNA, 18 bp, Homo sapiens
tgaggcagtcagtgatgg

SEQ ID NO: 7325885 - DNA, 19 bp, Homo sapiens
cccaggaggcggaggttgc

SEQ ID NO: 7325886 - DNA, 22 bp, Homo sapiens
cccaggaggcagaggttggagc

SEQ ID NO: 7325887 - DNA, 22 bp, Homo sapiens
cccaggaggccaaggttgcagt

SEQ ID NO: 7325888 - DNA, 22 bp, Homo sapiens
cccaggaggcagaggttgcagt

SEQ ID NO: 7325889 - DNA, 22 bp, Homo sapiens
cccaggagttagaggttgtggt

SEQ ID NO: 7325890 - DNA, 22 bp, Homo sapiens
tgccctcagcagcagctcctgc

SEQ ID NO: 7325891 - DNA, 22 bp, Homo sapiens
tgccctcagaattgctccctgc

SEQ ID NO: 7325892 - DNA, 22 bp, Homo sapiens
cccaggaggcggaggttgtggt

SEQ ID NO: 7325893 - DNA, 22 bp, Homo sapiens
cccaggaggcggaggttgcagt

SEQ ID NO: 7325894 - DNA, 22 bp, Homo sapiens
tgccctcagtttcacatgagtg

SEQ ID NO: 7325895 - DNA, 22 bp, Homo sapiens
tgccctcagccacctccaagtt

SEQ ID NO: 7325896 - DNA, 22 bp, Homo sapiens
tgccctcaggagtccctgacca

SEQ ID NO: 7325897 - DNA, 22 bp, Homo sapiens
tgccctcattataagaggctca

SEQ ID NO: 7325898 - DNA, 22 bp, Homo sapiens
cccagcaggtcggtgctgcctg

SEQ ID NO: 7325899 - DNA, 18 bp, Homo sapiens
cccagcccaccatttctc

SEQ ID NO: 7325900 - DNA, 22 bp, Homo sapiens
cccagcccagcgttcgaggggt

SEQ ID NO: 7325901 - DNA, 22 bp, Homo sapiens
cccagcccacggtcctgggtgg

SEQ ID NO: 7325902 - DNA, 22 bp, Homo sapiens
cccagcccatctcaaaggtcta

SEQ ID NO: 7325903 - DNA, 22 bp, Homo sapiens
cccagcccccgagtgtctggaa

SEQ ID NO: 7325904 - DNA, 22 bp, Homo sapiens
cccagccctgacctattggaaa

SEQ ID NO: 7325905 - DNA, 20 bp, Homo sapiens
cccagcccgggccgcgctcg

SEQ ID NO: 7325906 - DNA, 20 bp, Homo sapiens
cccagcccctacctgttgcc

SEQ ID NO: 7325907 - DNA, 22 bp, Homo sapiens
cccaggaattggaggctgcagt

SEQ ID NO: 7325908 - DNA, 22 bp, Homo sapiens
cccaggaattggaggctgcagt

SEQ ID NO: 7325909 - DNA, 22 bp, Homo sapiens
cccaggaattcagggctcaagg

SEQ ID NO: 7325910 - DNA, 22 bp, Homo sapiens
cccaggaaatagccaggaggtg

SEQ ID NO: 7325911 - DNA, 22 bp, Homo sapiens
cccaggaaagtggaggcggctg

SEQ ID NO: 7325912 - DNA, 22 bp, Homo sapiens
cccaggaaagtggaggcggctg

SEQ ID NO: 7325913 - DNA, 22 bp, Homo sapiens
tttgaagactactgggagtgaa

SEQ ID NO: 7325914 - DNA, 22 bp, Homo sapiens
tttgacaaataggggaataagg

SEQ ID NO: 7325915 - DNA, 22 bp, Homo sapiens
tttgacaaaggaaaaatgcaca

SEQ ID NO: 7325916 - DNA, 18 bp, Homo sapiens
tttctttctgcctggggc

SEQ ID NO: 7325917 - DNA, 21 bp, Homo sapiens
tttctttctggctctcacagt

SEQ ID NO: 7325918 - DNA, 22 bp, Homo sapiens
tttgataatacacaagagaaag

SEQ ID NO: 7325919 - DNA, 22 bp, Homo sapiens
tttggtgagctgcgagtgagga

SEQ ID NO: 7325920 - DNA, 22 bp, Homo sapiens
ttttattggagtgataccaagc

SEQ ID NO: 7325921 - DNA, 22 bp, Homo sapiens
ttttattgcaataaagtgtgta

SEQ ID NO: 7325922 - DNA, 22 bp, Homo sapiens
ttttattatctttgaatgggac

SEQ ID NO: 7325923 - DNA, 22 bp, Homo sapiens
ttttattagtggctagatgggg

SEQ ID NO: 7325924 - DNA, 22 bp, Homo sapiens
ttttctcttgttaatgtactga

SEQ ID NO: 7325925 - DNA, 22 bp, Homo sapiens
ttttctgacctatctacattta

SEQ ID NO: 7325926 - DNA, 19 bp, Homo sapiens
ttttctcagcttctagcgg

SEQ ID NO: 7325927 - DNA, 22 bp, Homo sapiens
ttttcattgttcctcgagcatt

SEQ ID NO: 7325928 - DNA, 22 bp, Homo sapiens
ttttccaaattagaagtagaga

SEQ ID NO: 7325929 - DNA, 22 bp, Homo sapiens
ttttccaaagtaccatgtccct

SEQ ID NO: 7325930 - DNA, 22 bp, Homo sapiens
ttttctgacctatctacattta

SEQ ID NO: 7325931 - DNA, 22 bp, Homo sapiens
ttttctgtaagaggactttaat

SEQ ID NO: 7325932 - DNA, 22 bp, Homo sapiens
ttttctgtttgcttcaagacat

SEQ ID NO: 7325933 - DNA, 22 bp, Homo sapiens
ttttctgtttacagagggacct

SEQ ID NO: 7325934 - DNA, 22 bp, Homo sapiens
ttttctgttacaaagtacagcg

SEQ ID NO: 7325935 - DNA, 22 bp, Homo sapiens
ttttctgtgtgtccctcgacag

SEQ ID NO: 7325936 - DNA, 22 bp, Homo sapiens
ttttctgtgtatccaggcttcc

SEQ ID NO: 7325937 - DNA, 22 bp, Homo sapiens
ttttctgtgccctgctagctgg

SEQ ID NO: 7325938 - DNA, 22 bp, Homo sapiens
ttttaatactgctattgtagga

SEQ ID NO: 7325939 - DNA, 22 bp, Homo sapiens
ttttaagaaatgtatgactgtc

SEQ ID NO: 7325940 - DNA, 22 bp, Homo sapiens
tttgtaaaaggaggaagcatgg

SEQ ID NO: 7325941 - DNA, 21 bp, Homo sapiens
tttgtgtgtcacgtgcacagg

SEQ ID NO: 7325942 - DNA, 22 bp, Homo sapiens
tttgttaagatgctgttctgct

SEQ ID NO: 7325943 - DNA, 22 bp, Homo sapiens
tttttacacttagcattgagcg

SEQ ID NO: 7325944 - DNA, 22 bp, Homo sapiens
tttttatctacagattctcagc

SEQ ID NO: 7325945 - DNA, 22 bp, Homo sapiens
ttcagttttgcttttaatcatg

SEQ ID NO: 7325946 - DNA, 22 bp, Homo sapiens
ttcatttaatcagaatctctaa

SEQ ID NO: 7325947 - DNA, 22 bp, Homo sapiens
ttcatttaatttgtgtattaac

SEQ ID NO: 7325948 - DNA, 22 bp, Homo sapiens
ttcatttagcatgctaaacctg

SEQ ID NO: 7325949 - DNA, 19 bp, Homo sapiens
ttcacagctctgtgtcagt

SEQ ID NO: 7325950 - DNA, 22 bp, Homo sapiens
ttcacagctccttttactcaac

SEQ ID NO: 7325951 - DNA, 22 bp, Homo sapiens
ttcacagctaagagctaagtaa

SEQ ID NO: 7325952 - DNA, 22 bp, Homo sapiens
ttcacagctcatactgttctca

SEQ ID NO: 7325953 - DNA, 22 bp, Homo sapiens
ttcacagcctctgccccaggca

SEQ ID NO: 7325954 - DNA, 22 bp, Homo sapiens
ttcagcaactgagtgtctttta

SEQ ID NO: 7325955 - DNA, 22 bp, Homo sapiens
ttcacagcttaataaggctcag

SEQ ID NO: 7325956 - DNA, 22 bp, Homo sapiens
ttagctcagaaaatttaaactt

SEQ ID NO: 7325957 - DNA, 22 bp, Homo sapiens
ttatataactcaggtgggctca

SEQ ID NO: 7325958 - DNA, 22 bp, Homo sapiens
ttatactttatactacatcatt

SEQ ID NO: 7325959 - DNA, 22 bp, Homo sapiens
ttatagaaggagcattcactta

SEQ ID NO: 7325960 - DNA, 22 bp, Homo sapiens
ttaggaaagttcttcagacatg

SEQ ID NO: 7325961 - DNA, 22 bp, Homo sapiens
ttaggaaatcactttgctcacc

SEQ ID NO: 7325962 - DNA, 22 bp, Homo sapiens
ttaggaaagaagcagctaggag

SEQ ID NO: 7325963 - DNA, 22 bp, Homo sapiens
ttaggaaacgctgctattgact

SEQ ID NO: 7325964 - DNA, 22 bp, Homo sapiens
ttaggaaagcattgtgtaaaag

SEQ ID NO: 7325965 - DNA, 22 bp, Homo sapiens
ttaggaaagggttttctaacag

SEQ ID NO: 7325966 - DNA, 22 bp, Homo sapiens
ttaggaaagtctcttggctggg

SEQ ID NO: 7325967 - DNA, 22 bp, Homo sapiens
ttaggaaaggaacattgaaacg

SEQ ID NO: 7325968 - DNA, 22 bp, Homo sapiens
ttaggaaacatcatttttgctg

SEQ ID NO: 7325969 - DNA, 19 bp, Homo sapiens
ttaggaaaccactttcctt

SEQ ID NO: 7325970 - DNA, 22 bp, Homo sapiens
ttaggaaacaaatacacccagt

SEQ ID NO: 7325971 - DNA, 22 bp, Homo sapiens
ttaggaaaatggagtcctttta

SEQ ID NO: 7325972 - DNA, 22 bp, Homo sapiens
ttaggaaacagtagcctttgct

SEQ ID NO: 7325973 - DNA, 22 bp, Homo sapiens
ttaggaaaagaagacatttcta

SEQ ID NO: 7325974 - DNA, 22 bp, Homo sapiens
ttaggaaaatcatgagagatga

SEQ ID NO: 7325975 - DNA, 22 bp, Homo sapiens
ttaggaaaatgaaattacctgt

SEQ ID NO: 7325976 - DNA, 22 bp, Homo sapiens
ttattctttaaacatatatgtt

SEQ ID NO: 7325977 - DNA, 22 bp, Homo sapiens
ttcaaacagatgactctgctct

SEQ ID NO: 7325978 - DNA, 22 bp, Homo sapiens
ttattgttaggcttttggaatt

SEQ ID NO: 7325979 - DNA, 22 bp, Homo sapiens
ttcaaacagttgcacaacttat

SEQ ID NO: 7325980 - DNA, 22 bp, Homo sapiens
ttattgacttgtttgtcctggt

SEQ ID NO: 7325981 - DNA, 22 bp, Homo sapiens
ttattgacttgtttgtcctggt

SEQ ID NO: 7325982 - DNA, 22 bp, Homo sapiens
ttattgactgaaatgagagtga

SEQ ID NO: 7325983 - DNA, 21 bp, Homo sapiens
ttattgaatgtttaccgtgtg

SEQ ID NO: 7325984 - DNA, 22 bp, Homo sapiens
ttattgtagcactttggcagtg

SEQ ID NO: 7325985 - DNA, 22 bp, Homo sapiens
ttctgtgtcttcttgttctgtg

SEQ ID NO: 7325986 - DNA, 22 bp, Homo sapiens
ttcttatattgggtcatggata

SEQ ID NO: 7325987 - DNA, 22 bp, Homo sapiens
ttctgtgtgcttactggtgttc

SEQ ID NO: 7325988 - DNA, 22 bp, Homo sapiens
ttctgtgtgctgtcttggcttt

SEQ ID NO: 7325989 - DNA, 23 bp, Homo sapiens
ttcttatttactttggaatctcc

SEQ ID NO: 7325990 - DNA, 22 bp, Homo sapiens
ttcttattcttgaaatgtggga

SEQ ID NO: 7325991 - DNA, 22 bp, Homo sapiens
ttgaaatggcagcagctgacct

SEQ ID NO: 7325992 - DNA, 20 bp, Homo sapiens
ttgaaattggatggtagcta

SEQ ID NO: 7325993 - DNA, 22 bp, Homo sapiens
ttgaaattgggtgtggctgtca

SEQ ID NO: 7325994 - DNA, 22 bp, Homo sapiens
ttgaaattgggtgtggctgtca

SEQ ID NO: 7325995 - DNA, 19 bp, Homo sapiens
ttgaaattgtttgatatgg

SEQ ID NO: 7325996 - DNA, 22 bp, Homo sapiens
ttgaacaatttggtatacaaac

SEQ ID NO: 7325997 - DNA, 22 bp, Homo sapiens
ttgaattggcaaaactgcagct

SEQ ID NO: 7325998 - DNA, 22 bp, Homo sapiens
ttgaaatgatctatttcagtag

SEQ ID NO: 7325999 - DNA, 22 bp, Homo sapiens
ttgaaatgcatcatcatttaga

SEQ ID NO: 7326000 - DNA, 22 bp, Homo sapiens
ttctcctgagttcccaggtcta

SEQ ID NO: 7326001 - DNA, 22 bp, Homo sapiens
ttctccaagtagaagctaagtt

SEQ ID NO: 7326002 - DNA, 22 bp, Homo sapiens
ttctccacatggtgtgctgtga

SEQ ID NO: 7326003 - DNA, 22 bp, Homo sapiens
ttctcaggaactcagtgtcagc

SEQ ID NO: 7326004 - DNA, 22 bp, Homo sapiens
ttctctgcagctcctggctggg

SEQ ID NO: 7326005 - DNA, 22 bp, Homo sapiens
ttctctaagagttatatgaatt

SEQ ID NO: 7326006 - DNA, 22 bp, Homo sapiens
tttaagattcagtaaggcaaac

SEQ ID NO: 7326007 - DNA, 22 bp, Homo sapiens
tttaagatggtattttataaag

SEQ ID NO: 7326008 - DNA, 22 bp, Homo sapiens
tttaagcacagggataaagtta

SEQ ID NO: 7326009 - DNA, 22 bp, Homo sapiens
tttatctgaaaaaactcttgga

SEQ ID NO: 7326010 - DNA, 22 bp, Homo sapiens
tttatctattgtattgttgatg

SEQ ID NO: 7326011 - DNA, 22 bp, Homo sapiens
tttatcatcttgtttttaaagc

SEQ ID NO: 7326012 - DNA, 22 bp, Homo sapiens
tttatcatcttgtttttaaagc

SEQ ID NO: 7326013 - DNA, 23 bp, Homo sapiens
tttatattcctaatgtcttgagc

SEQ ID NO: 7326014 - DNA, 22 bp, Homo sapiens
tttagagagaaataaatgagat

SEQ ID NO: 7326015 - DNA, 22 bp, Homo sapiens
tttagagaccctctgctatttt

SEQ ID NO: 7326016 - DNA, 22 bp, Homo sapiens
tttaccaaagtactctgaggca

SEQ ID NO: 7326017 - DNA, 20 bp, Homo sapiens
tttacattttgaaacagtga

SEQ ID NO: 7326018 - DNA, 22 bp, Homo sapiens
tttcagagaactgagtccttgc

SEQ ID NO: 7326019 - DNA, 22 bp, Homo sapiens
tttcagagatgtctagcctatt

SEQ ID NO: 7326020 - DNA, 22 bp, Homo sapiens
tttcagagcctttatctctcta

SEQ ID NO: 7326021 - DNA, 22 bp, Homo sapiens
tttcagagctgagatgccacag

SEQ ID NO: 7326022 - DNA, 22 bp, Homo sapiens
tttcatgtgttgaatgtgtaca

SEQ ID NO: 7326023 - DNA, 22 bp, Homo sapiens
tttcatgtgcaattagcaatat

SEQ ID NO: 7326024 - DNA, 22 bp, Homo sapiens
tttcatgtggcgatgtctctgg

SEQ ID NO: 7326025 - DNA, 22 bp, Homo sapiens
tttcatgtctgaattctttagt

SEQ ID NO: 7326026 - DNA, 22 bp, Homo sapiens
tttcattgagactatagacatc

SEQ ID NO: 7326027 - DNA, 22 bp, Homo sapiens
tttcattgagaatataagattt

SEQ ID NO: 7326028 - DNA, 21 bp, Homo sapiens
tttcattgaatgagataaggt

SEQ ID NO: 7326029 - DNA, 22 bp, Homo sapiens
tttcattgatgggtgatagaaa

SEQ ID NO: 7326030 - DNA, 22 bp, Homo sapiens
tttcacacaacgtgaatatact

SEQ ID NO: 7326031 - DNA, 22 bp, Homo sapiens
tttcaacatataccataatgcc

SEQ ID NO: 7326032 - DNA, 22 bp, Homo sapiens
tttcaacatcacctagcagttc

SEQ ID NO: 7326033 - DNA, 22 bp, Homo sapiens
tttcaacatacctcagtgtatg

SEQ ID NO: 7326034 - DNA, 22 bp, Homo sapiens
tttcaacagctctcaaatgatc

SEQ ID NO: 7326035 - DNA, 23 bp, Homo sapiens
tttcaacaggcagagaagactta

SEQ ID NO: 7326036 - DNA, 22 bp, Homo sapiens
tttattctgtgctacatgaaga

SEQ ID NO: 7326037 - DNA, 22 bp, Homo sapiens
tttattcttgagagtgagaaga

SEQ ID NO: 7326038 - DNA, 22 bp, Homo sapiens
tttattgaacacttgcactggc

SEQ ID NO: 7326039 - DNA, 23 bp, Homo sapiens
tttcaacaatgcttagagaaaac

SEQ ID NO: 7326040 - DNA, 22 bp, Homo sapiens
tttcaaaggttttgtcatgtct

SEQ ID NO: 7326041 - DNA, 22 bp, Homo sapiens
tttcaacactgcatcctcccta

SEQ ID NO: 7326042 - DNA, 22 bp, Homo sapiens
tttcaacaccagagaccatgcg

SEQ ID NO: 7326043 - DNA, 22 bp, Homo sapiens
tttcaacagaatatgatcagag

SEQ ID NO: 7326044 - DNA, 22 bp, Homo sapiens
tttcaacagctctcaaatgatc

SEQ ID NO: 7326045 - DNA, 22 bp, Homo sapiens
tttattgacttcagtgagtctt

SEQ ID NO: 7326046 - DNA, 22 bp, Homo sapiens
tttattgacttcagtgagtctt

SEQ ID NO: 7326047 - DNA, 22 bp, Homo sapiens
tttattgagcacccgttgtgcg

SEQ ID NO: 7326048 - DNA, 20 bp, Homo sapiens
tttattgagcacgtactgtg

SEQ ID NO: 7326049 - DNA, 22 bp, Homo sapiens
ttgcttatttgattaaatgtct

SEQ ID NO: 7326050 - DNA, 22 bp, Homo sapiens
ttggaaacttggatggaaaacc

SEQ ID NO: 7326051 - DNA, 22 bp, Homo sapiens
ttggaaacgtcaccttttcctt

SEQ ID NO: 7326052 - DNA, 22 bp, Homo sapiens
ttgcttaattctgaaaatatag

SEQ ID NO: 7326053 - DNA, 22 bp, Homo sapiens
ttgcattacatttgctcagtct

SEQ ID NO: 7326054 - DNA, 22 bp, Homo sapiens
ttgcattgatgtctatacgctg

SEQ ID NO: 7326055 - DNA, 22 bp, Homo sapiens
ttgcattgcttggtcttcaaga

SEQ ID NO: 7326056 - DNA, 22 bp, Homo sapiens
ttgcattgttgcaatgaagtat

SEQ ID NO: 7326057 - DNA, 22 bp, Homo sapiens
ttgcagaggcaaaaatgaactc

SEQ ID NO: 7326058 - DNA, 22 bp, Homo sapiens
ttgcagatgaagaaagtggtag

SEQ ID NO: 7326059 - DNA, 22 bp, Homo sapiens
ttggagatatcacaccttcaca

SEQ ID NO: 7326060 - DNA, 22 bp, Homo sapiens
ttggcagtctcagtcagatggc

SEQ ID NO: 7326061 - DNA, 20 bp, Homo sapiens
ttggcagcagttccaagtga

SEQ ID NO: 7326062 - DNA, 22 bp, Homo sapiens
ttgggcaggtgtggctctcctt

SEQ ID NO: 7326063 - DNA, 22 bp, Homo sapiens
ttgtgtctatggtttgagcatc

SEQ ID NO: 7326064 - DNA, 22 bp, Homo sapiens
ttgtccattttattggatggtg

SEQ ID NO: 7326065 - DNA, 22 bp, Homo sapiens
cagatggaggataaaacatgca

SEQ ID NO: 7326066 - DNA, 22 bp, Homo sapiens
cagatggattttgtaggctgat

SEQ ID NO: 7326067 - DNA, 22 bp, Homo sapiens
ggtggcagtcttaagagatctt

SEQ ID NO: 7326068 - DNA, 22 bp, Homo sapiens
ggggtgagatcaaggaagccct

SEQ ID NO: 7326069 - DNA, 22 bp, Homo sapiens
cagaggctgccagccatgtgca

SEQ ID NO: 7326070 - DNA, 22 bp, Homo sapiens
gggggcagtaaggatatggaaa

SEQ ID NO: 7326071 - DNA, 22 bp, Homo sapiens
cagaggaaggctctgggaatgt

SEQ ID NO: 7326072 - DNA, 22 bp, Homo sapiens
cagaggaaagtatttctggaag

SEQ ID NO: 7326073 - DNA, 22 bp, Homo sapiens
gggccaggagtggagatatggg

SEQ ID NO: 7326074 - DNA, 22 bp, Homo sapiens
gggccctggatttaagcatgga

SEQ ID NO: 7326075 - DNA, 22 bp, Homo sapiens
cagagcagcctccagggggagc

SEQ ID NO: 7326076 - DNA, 22 bp, Homo sapiens
gtctttctctggaacagtaaaa

SEQ ID NO: 7326077 - DNA, 22 bp, Homo sapiens
gtctttctgctgcacggactgc

SEQ ID NO: 7326078 - DNA, 22 bp, Homo sapiens
gtctcttagaatcgcatattgt

SEQ ID NO: 7326079 - DNA, 20 bp, Homo sapiens
gtctccactgggggttaacc

SEQ ID NO: 7326080 - DNA, 22 bp, Homo sapiens
gtcctcttagccacttaattat

SEQ ID NO: 7326081 - DNA, 22 bp, Homo sapiens
gtcctcttgctcattggggcag

SEQ ID NO: 7326082 - DNA, 22 bp, Homo sapiens
gtctcaagggggaactcactgt

SEQ ID NO: 7326083 - DNA, 22 bp, Homo sapiens
cagcatcttctagatccaggct

SEQ ID NO: 7326084 - DNA, 22 bp, Homo sapiens
cagcagtctgtttcaacaggtc

SEQ ID NO: 7326085 - DNA, 22 bp, Homo sapiens
cagcagtcacacaaactctgga

SEQ ID NO: 7326086 - DNA, 22 bp, Homo sapiens
cagcaggtcatgaaagaaaacc

SEQ ID NO: 7326087 - DNA, 22 bp, Homo sapiens
cagctcctctggccagccctgc

SEQ ID NO: 7326088 - DNA, 22 bp, Homo sapiens
cagctctgaggaacactccttt

SEQ ID NO: 7326089 - DNA, 22 bp, Homo sapiens
cagctctgatgaaatgtaccag

SEQ ID NO: 7326090 - DNA, 22 bp, Homo sapiens
cagctctgagactgaggctatg

SEQ ID NO: 7326091 - DNA, 17 bp, Homo sapiens
cagctctgcagacttcc

SEQ ID NO: 7326092 - DNA, 20 bp, Homo sapiens
cactgccctccagcctgagc

SEQ ID NO: 7326093 - DNA, 22 bp, Homo sapiens
cagaagaggactgggtagctca

SEQ ID NO: 7326094 - DNA, 22 bp, Homo sapiens
cagaacagggcccaaggggtcg

SEQ ID NO: 7326095 - DNA, 22 bp, Homo sapiens
ggctgggagccccacagagtca

SEQ ID NO: 7326096 - DNA, 22 bp, Homo sapiens
ggctgggacgatgaggattagt

SEQ ID NO: 7326097 - DNA, 22 bp, Homo sapiens
cacatttctctacctcacacaa

SEQ ID NO: 7326098 - DNA, 20 bp, Homo sapiens
ggcaggaccccagtggcatc

SEQ ID NO: 7326099 - DNA, 22 bp, Homo sapiens
ggcaggacagccccggaaatct

SEQ ID NO: 7326100 - DNA, 22 bp, Homo sapiens
ggcaggacaggggaatgtttgg

SEQ ID NO: 7326101 - DNA, 20 bp, Homo sapiens
ggcaggacccggtagggagc

SEQ ID NO: 7326102 - DNA, 22 bp, Homo sapiens
ggcaggactcttctgtgggccg

SEQ ID NO: 7326103 - DNA, 22 bp, Homo sapiens
ggcaggactctcaggaccaagc

SEQ ID NO: 7326104 - DNA, 22 bp, Homo sapiens
ggcaggactgatcagtgggatg

SEQ ID NO: 7326105 - DNA, 21 bp, Homo sapiens
ggagtttttctggaagggact

SEQ ID NO: 7326106 - DNA, 22 bp, Homo sapiens
ggagtctgggaattggagagaa

SEQ ID NO: 7326107 - DNA, 22 bp, Homo sapiens
ggatcctgatatgtgtttctca

SEQ ID NO: 7326108 - DNA, 22 bp, Homo sapiens
ggatcattaagaatagctacta

SEQ ID NO: 7326109 - DNA, 22 bp, Homo sapiens
cacccaggcatgggttgagatg

SEQ ID NO: 7326110 - DNA, 19 bp, Homo sapiens
cacattttgagtctgagat

SEQ ID NO: 7326111 - DNA, 19 bp, Homo sapiens
cacattttgagtctgagat

SEQ ID NO: 7326112 - DNA, 22 bp, Homo sapiens
ggccccagcttcaaccccgtgg

SEQ ID NO: 7326113 - DNA, 22 bp, Homo sapiens
ggccccaggacctccacggtcc

SEQ ID NO: 7326114 - DNA, 22 bp, Homo sapiens
ggccccaggcctttggtctggc

SEQ ID NO: 7326115 - DNA, 22 bp, Homo sapiens
ggccccagggaagaaggtggtc

SEQ ID NO: 7326116 - DNA, 22 bp, Homo sapiens
ggccccagggattaggccaacc

SEQ ID NO: 7326117 - DNA, 22 bp, Homo sapiens
ggccccagggaagaaggtggtc

SEQ ID NO: 7326118 - DNA, 22 bp, Homo sapiens
ggcgcccccttcaaacagagca

SEQ ID NO: 7326119 - DNA, 22 bp, Homo sapiens
ggcgcccatcggtgcagagggc

SEQ ID NO: 7326120 - DNA, 22 bp, Homo sapiens
ggccccagcctcagtcccctga

SEQ ID NO: 7326121 - DNA, 21 bp, Homo sapiens
ggccccagcccatgggttctc

SEQ ID NO: 7326122 - DNA, 19 bp, Homo sapiens
ggccccagccagggtatca

SEQ ID NO: 7326123 - DNA, 22 bp, Homo sapiens
caagttcaagtcctggctctgc

SEQ ID NO: 7326124 - DNA, 22 bp, Homo sapiens
caagttcacatgcatccttgct

SEQ ID NO: 7326125 - DNA, 20 bp, Homo sapiens
caagttcaccttctcctctc

SEQ ID NO: 7326126 - DNA, 22 bp, Homo sapiens
caagttcacgttgctttttgag

SEQ ID NO: 7326127 - DNA, 22 bp, Homo sapiens
caagttgtacagattgtattag

SEQ ID NO: 7326128 - DNA, 22 bp, Homo sapiens
caagtggtttatgggagttcca

SEQ ID NO: 7326129 - DNA, 22 bp, Homo sapiens
gctggttcacctggctcctccc

SEQ ID NO: 7326130 - DNA, 22 bp, Homo sapiens
gctggtctccgccgctccctga

SEQ ID NO: 7326131 - DNA, 22 bp, Homo sapiens
gctgggaggaatttggggaata

SEQ ID NO: 7326132 - DNA, 19 bp, Homo sapiens
ggaagagaggaaaggtgga

SEQ ID NO: 7326133 - DNA, 22 bp, Homo sapiens
ggaagagagatcccatagatgt

SEQ ID NO: 7326134 - DNA, 22 bp, Homo sapiens
ggaagagaatgatggctatggg

SEQ ID NO: 7326135 - DNA, 22 bp, Homo sapiens
ggaacactgccttttattttcc

SEQ ID NO: 7326136 - DNA, 22 bp, Homo sapiens
ggagagctgaagcatggacagg

SEQ ID NO: 7326137 - DNA, 18 bp, Homo sapiens
ggagagtgacagagtcgt

SEQ ID NO: 7326138 - DNA, 22 bp, Homo sapiens
ggagagtggattccagctgtat

SEQ ID NO: 7326139 - DNA, 17 bp, Homo sapiens
ggagagtgggaatggcc

SEQ ID NO: 7326140 - DNA, 22 bp, Homo sapiens
ggaggggatttagtagatgcta

SEQ ID NO: 7326141 - DNA, 22 bp, Homo sapiens
ggaggagagaggttgcaaacac

SEQ ID NO: 7326142 - DNA, 22 bp, Homo sapiens
cacagcccccttgacactctgg

SEQ ID NO: 7326143 - DNA, 22 bp, Homo sapiens
gaaatatacatgaagtcggctg

SEQ ID NO: 7326144 - DNA, 22 bp, Homo sapiens
gaacatgatggctgttattttg

SEQ ID NO: 7326145 - DNA, 22 bp, Homo sapiens
atgcaatgttacagaatgtact

SEQ ID NO: 7326146 - DNA, 22 bp, Homo sapiens
gaaaactaacggaaaagttagg

SEQ ID NO: 7326147 - DNA, 22 bp, Homo sapiens
gaaaagaactgcatgggattaa

SEQ ID NO: 7326148 - DNA, 22 bp, Homo sapiens
cttgagaaaggaacaggaagct

SEQ ID NO: 7326149 - DNA, 22 bp, Homo sapiens
cttgagaagcattaagaggtag

SEQ ID NO: 7326150 - DNA, 22 bp, Homo sapiens
cttgagaaggaggaagggcttt

SEQ ID NO: 7326151 - DNA, 22 bp, Homo sapiens
atgcatatatacatacacagtc

SEQ ID NO: 7326152 - DNA, 22 bp, Homo sapiens
atgcatataaggcacatgtatt

SEQ ID NO: 7326153 - DNA, 22 bp, Homo sapiens
atgcatactgtatgtgtattta

SEQ ID NO: 7326154 - DNA, 22 bp, Homo sapiens
gaagcagagcctaaggcagaca

SEQ ID NO: 7326155 - DNA, 22 bp, Homo sapiens
gacaggaaatatgggggttgtt

SEQ ID NO: 7326156 - DNA, 22 bp, Homo sapiens
gacaggaaaggggtctgttttc

SEQ ID NO: 7326157 - DNA, 22 bp, Homo sapiens
gacaggaaatatgggggttgtt

SEQ ID NO: 7326158 - DNA, 22 bp, Homo sapiens
gacagggactccctggttagaa

SEQ ID NO: 7326159 - DNA, 22 bp, Homo sapiens
atgctttcttctttcctgtaag

SEQ ID NO: 7326160 - DNA, 22 bp, Homo sapiens
gacagttacccccaaaagaatt

SEQ ID NO: 7326161 - DNA, 22 bp, Homo sapiens
gacagttaggacaactgacttc

SEQ ID NO: 7326162 - DNA, 22 bp, Homo sapiens
gacagttaggggctggatgcca

SEQ ID NO: 7326163 - DNA, 22 bp, Homo sapiens
atgcttaacttcctagtctata

SEQ ID NO: 7326164 - DNA, 22 bp, Homo sapiens
atgtacaaaatgttttgaaatg

SEQ ID NO: 7326165 - DNA, 22 bp, Homo sapiens
atgtcaagactatactttgcct

SEQ ID NO: 7326166 - DNA, 22 bp, Homo sapiens
gagctctgtccacacttggaga

SEQ ID NO: 7326167 - DNA, 22 bp, Homo sapiens
gagctctgtacacagagggtgt

SEQ ID NO: 7326168 - DNA, 22 bp, Homo sapiens
gagctctgggtgtgttgtcagt

SEQ ID NO: 7326169 - DNA, 22 bp, Homo sapiens
gagctctgggtggcaggtgtct

SEQ ID NO: 7326170 - DNA, 22 bp, Homo sapiens
gagctctggacgaggggagtgg

SEQ ID NO: 7326171 - DNA, 20 bp, Homo sapiens
atggttcaggccagctgtct

SEQ ID NO: 7326172 - DNA, 22 bp, Homo sapiens
gaggaaggctaaggggcttaga

SEQ ID NO: 7326173 - DNA, 22 bp, Homo sapiens
atggttgaatcaaggtagacaa

SEQ ID NO: 7326174 - DNA, 22 bp, Homo sapiens
gaggaaggaatgcagtgtatgc

SEQ ID NO: 7326175 - DNA, 22 bp, Homo sapiens
gaggaagatggttgagtggtcc

SEQ ID NO: 7326176 - DNA, 22 bp, Homo sapiens
gaggaagcagggcttggctgag

SEQ ID NO: 7326177 - DNA, 22 bp, Homo sapiens
gagcctgtgagccccaactcca

SEQ ID NO: 7326178 - DNA, 19 bp, Homo sapiens
gagcgcagagggcagggga

SEQ ID NO: 7326179 - DNA, 22 bp, Homo sapiens
gagaggtgaatgtggatgccac

SEQ ID NO: 7326180 - DNA, 17 bp, Homo sapiens
gaggtaggaagtgagtc

SEQ ID NO: 7326181 - DNA, 22 bp, Homo sapiens
gaggtaggctgtgaaagggggt

SEQ ID NO: 7326182 - DNA, 22 bp, Homo sapiens
gaggtaggaggtaggtattgtg

SEQ ID NO: 7326183 - DNA, 22 bp, Homo sapiens
gaggtagcatgctggaagggac

SEQ ID NO: 7326184 - DNA, 22 bp, Homo sapiens
gaggtaggcagggtgacttggc

SEQ ID NO: 7326185 - DNA, 22 bp, Homo sapiens
gaggtagggaagacaaatatgc

SEQ ID NO: 7326186 - DNA, 22 bp, Homo sapiens
gagggggctccctgaagccagt

SEQ ID NO: 7326187 - DNA, 22 bp, Homo sapiens
gaggctttataactatttgttc

SEQ ID NO: 7326188 - DNA, 22 bp, Homo sapiens
atgtttcaccagcaaattacct

SEQ ID NO: 7326189 - DNA, 22 bp, Homo sapiens
atgtttatgttgggctatattt

SEQ ID NO: 7326190 - DNA, 22 bp, Homo sapiens
atgtttcatgactgagcaaaat

SEQ ID NO: 7326191 - DNA, 22 bp, Homo sapiens
atgtttcatttagatatcaggc

SEQ ID NO: 7326192 - DNA, 22 bp, Homo sapiens
gagttaaatattttctgaagtt

SEQ ID NO: 7326193 - DNA, 20 bp, Homo sapiens
gagtccaggggcctgtagca

SEQ ID NO: 7326194 - DNA, 22 bp, Homo sapiens
gagtccagtgatgttcctggtc

SEQ ID NO: 7326195 - DNA, 21 bp, Homo sapiens
gagtgcaggtctgatgccatc

SEQ ID NO: 7326196 - DNA, 22 bp, Homo sapiens
gagtgcaggcctgagcaccatc

SEQ ID NO: 7326197 - DNA, 21 bp, Homo sapiens
gagtgcagcaaggtagagtct

SEQ ID NO: 7326198 - DNA, 22 bp, Homo sapiens
gagtgcagatgccagccccagt

SEQ ID NO: 7326199 - DNA, 17 bp, Homo sapiens
gagtgcagacacaagca

SEQ ID NO: 7326200 - DNA, 17 bp, Homo sapiens
gagtgcagacacaagca

SEQ ID NO: 7326201 - DNA, 22 bp, Homo sapiens
gatctggaatctgaaggctgag

SEQ ID NO: 7326202 - DNA, 22 bp, Homo sapiens
atgtttccagctcagctgcagg

SEQ ID NO: 7326203 - DNA, 22 bp, Homo sapiens
atgtttccatagaagtcacagt

SEQ ID NO: 7326204 - DNA, 22 bp, Homo sapiens
gagttaattcgaatattctagc

SEQ ID NO: 7326205 - DNA, 22 bp, Homo sapiens
gagttatctatttaaaatgtcc

SEQ ID NO: 7326206 - DNA, 22 bp, Homo sapiens
gagttattgagtatagaatgta

SEQ ID NO: 7326207 - DNA, 17 bp, Homo sapiens
gctccaggcgtgagtga

SEQ ID NO: 7326208 - DNA, 22 bp, Homo sapiens
gctcaaagaatattcagaatga

SEQ ID NO: 7326209 - DNA, 22 bp, Homo sapiens
caaattcacatgattgcttctg

SEQ ID NO: 7326210 - DNA, 22 bp, Homo sapiens
gctgaggaaaccaatgctcaga

SEQ ID NO: 7326211 - DNA, 22 bp, Homo sapiens
caaatccagatcccagtcgtag

SEQ ID NO: 7326212 - DNA, 22 bp, Homo sapiens
caaatcatggaataactagaga

SEQ ID NO: 7326213 - DNA, 22 bp, Homo sapiens
atttgcatttacatagcataga

SEQ ID NO: 7326214 - DNA, 21 bp, Homo sapiens
atttgcattaaaatattacgc

SEQ ID NO: 7326215 - DNA, 22 bp, Homo sapiens
attttctgtgtgcagataaata

SEQ ID NO: 7326216 - DNA, 22 bp, Homo sapiens
attttgaaaccaagttatttcc

SEQ ID NO: 7326217 - DNA, 22 bp, Homo sapiens
gcctggctccctctgcagctcc

SEQ ID NO: 7326218 - DNA, 22 bp, Homo sapiens
atttacataatagactttaggt

SEQ ID NO: 7326219 - DNA, 22 bp, Homo sapiens
atttaccagctgtgcactgata

SEQ ID NO: 7326220 - DNA, 22 bp, Homo sapiens
atttaccagctgtgcactgata

SEQ ID NO: 7326221 - DNA, 22 bp, Homo sapiens
atttaccatatgtactgagtat

SEQ ID NO: 7326222 - DNA, 21 bp, Homo sapiens
gccccctggactcctcatcca

SEQ ID NO: 7326223 - DNA, 19 bp, Homo sapiens
gccctgcaggaggtggggc

SEQ ID NO: 7326224 - DNA, 22 bp, Homo sapiens
gccctgcagtgcggaggtggca

SEQ ID NO: 7326225 - DNA, 22 bp, Homo sapiens
gccctgcaccccaatggcatga

SEQ ID NO: 7326226 - DNA, 17 bp, Homo sapiens
gcacagaggccaaagga

SEQ ID NO: 7326227 - DNA, 22 bp, Homo sapiens
gcacagagctggccctccaggc

SEQ ID NO: 7326228 - DNA, 20 bp, Homo sapiens
gcaaaataggctctgttggt

SEQ ID NO: 7326229 - DNA, 22 bp, Homo sapiens
atgtttctagttgtatgtcact

SEQ ID NO: 7326230 - DNA, 22 bp, Homo sapiens
gatttctgggctttatttcaga

SEQ ID NO: 7326231 - DNA, 22 bp, Homo sapiens
gcaaacaaggacatacatcctg

SEQ ID NO: 7326232 - DNA, 22 bp, Homo sapiens
gcaaacaagctgcctgaagatt

SEQ ID NO: 7326233 - DNA, 22 bp, Homo sapiens
gcaacagcccaggttctgtgtg

SEQ ID NO: 7326234 - DNA, 22 bp, Homo sapiens
gcaacagcattctcattgacat

SEQ ID NO: 7326235 - DNA, 22 bp, Homo sapiens
gcaggagagtctgtgccaggtt

SEQ ID NO: 7326236 - DNA, 18 bp, Homo sapiens
gcaggagatgggtggggt

SEQ ID NO: 7326237 - DNA, 22 bp, Homo sapiens
gcagctttctaagctttattgc

SEQ ID NO: 7326238 - DNA, 21 bp, Homo sapiens
gcagccaggactttgggctgg

SEQ ID NO: 7326239 - DNA, 22 bp, Homo sapiens
gcagagggcaggggtgtttgtt

SEQ ID NO: 7326240 - DNA, 22 bp, Homo sapiens
attgtaattttagagaaagtgg

SEQ ID NO: 7326241 - DNA, 22 bp, Homo sapiens
attgtacaatgcctggaacatt

SEQ ID NO: 7326242 - DNA, 21 bp, Homo sapiens
gcagtgcagcttggagggtag

SEQ ID NO: 7326243 - DNA, 22 bp, Homo sapiens
gcagtgattggatcagagatgg

SEQ ID NO: 7326244 - DNA, 22 bp, Homo sapiens
gcagtgattggctttcacaaaa

SEQ ID NO: 7326245 - DNA, 20 bp, Homo sapiens
gcagtgatttgtctatgttt

SEQ ID NO: 7326246 - DNA, 22 bp, Homo sapiens
atttaaatgcttaagagggttt

SEQ ID NO: 7326247 - DNA, 23 bp, Homo sapiens
attgtttttggctctcagggaat

SEQ ID NO: 7326248 - DNA, 22 bp, Homo sapiens
gcattcatcttcatgaaagcac

SEQ ID NO: 7326249 - DNA, 22 bp, Homo sapiens
gcaggatggtggaaggcctgct

SEQ ID NO: 7326250 - DNA, 22 bp, Homo sapiens
gcaggagcagtcaggggcagct

SEQ ID NO: 7326251 - DNA, 22 bp, Homo sapiens
atcataaagtgctatctgattg

SEQ ID NO: 7326252 - DNA, 22 bp, Homo sapiens
atcataaaattgcaccatttct

SEQ ID NO: 7326253 - DNA, 23 bp, Homo sapiens
ctgtctcctgggctaggtggaat

SEQ ID NO: 7326254 - DNA, 22 bp, Homo sapiens
ctgtctcctccactgcatggga

SEQ ID NO: 7326255 - DNA, 22 bp, Homo sapiens
ctgtctccgccctcttggtagg

SEQ ID NO: 7326256 - DNA, 22 bp, Homo sapiens
ctgtctcctcctttgttcttaa

SEQ ID NO: 7326257 - DNA, 22 bp, Homo sapiens
ctgtctcctccactgcatggga

SEQ ID NO: 7326258 - DNA, 22 bp, Homo sapiens
ctgtctccagggcaggtgcagg

SEQ ID NO: 7326259 - DNA, 22 bp, Homo sapiens
atcacacagagcattaggggcc

SEQ ID NO: 7326260 - DNA, 22 bp, Homo sapiens
atcacaaaggtctcagagcaca

SEQ ID NO: 7326261 - DNA, 22 bp, Homo sapiens
atcacaaagggttttctctgag

SEQ ID NO: 7326262 - DNA, 22 bp, Homo sapiens
atcacagcacacctgacatgta

SEQ ID NO: 7326263 - DNA, 22 bp, Homo sapiens
atcacagctagtaagtggagga

SEQ ID NO: 7326264 - DNA, 22 bp, Homo sapiens
atcacagctcccttatacacag

SEQ ID NO: 7326265 - DNA, 22 bp, Homo sapiens
atcatacatgtaactaagtaaa

SEQ ID NO: 7326266 - DNA, 22 bp, Homo sapiens
ctgtttctccacactcttccca

SEQ ID NO: 7326267 - DNA, 22 bp, Homo sapiens
cttatctcatttaatcatcaca

SEQ ID NO: 7326268 - DNA, 22 bp, Homo sapiens
cttcaacatacacagagagagg

SEQ ID NO: 7326269 - DNA, 22 bp, Homo sapiens
cttattaatggaatcctaatga

SEQ ID NO: 7326270 - DNA, 22 bp, Homo sapiens
atctgtgtgttattgtttatca

SEQ ID NO: 7326271 - DNA, 22 bp, Homo sapiens
cttctgagatgttgttttacag

SEQ ID NO: 7326272 - DNA, 22 bp, Homo sapiens
cttctccttatatgtcccgttc

SEQ ID NO: 7326273 - DNA, 22 bp, Homo sapiens
cttctgtgcgcctctattccct

SEQ ID NO: 7326274 - DNA, 22 bp, Homo sapiens
atagtggaaactggagggaaga

SEQ ID NO: 7326275 - DNA, 23 bp, Homo sapiens
atataaacaccagatagattgta

SEQ ID NO: 7326276 - DNA, 22 bp, Homo sapiens
atataaagtgtttagaaagctg

SEQ ID NO: 7326277 - DNA, 19 bp, Homo sapiens
atatacatactgtgtgcat

SEQ ID NO: 7326278 - DNA, 22 bp, Homo sapiens
atatacatgggaatatgtggag

SEQ ID NO: 7326279 - DNA, 22 bp, Homo sapiens
ctgggagaggctgctccgctct

SEQ ID NO: 7326280 - DNA, 22 bp, Homo sapiens
ctgggagctgtcaggagcgtgt

SEQ ID NO: 7326281 - DNA, 22 bp, Homo sapiens
atatacactgtttcagttgaag

SEQ ID NO: 7326282 - DNA, 22 bp, Homo sapiens
atatacactccactgatacagg

SEQ ID NO: 7326283 - DNA, 22 bp, Homo sapiens
atatacacatgtgtatacattt

SEQ ID NO: 7326284 - DNA, 22 bp, Homo sapiens
ctggctgatctcaatcatggct

SEQ ID NO: 7326285 - DNA, 22 bp, Homo sapiens
atacatgtcatcatatgtttgt

SEQ ID NO: 7326286 - DNA, 22 bp, Homo sapiens
atacatgtaactgcattgtaat

SEQ ID NO: 7326287 - DNA, 22 bp, Homo sapiens
atacatgtgtccctgatttatt

SEQ ID NO: 7326288 - DNA, 22 bp, Homo sapiens
atacatgtgtccctgatttatt

SEQ ID NO: 7326289 - DNA, 22 bp, Homo sapiens
atacatgtgggtctaaacatat

SEQ ID NO: 7326290 - DNA, 22 bp, Homo sapiens
atacacatgtgtatgtgcatgc

SEQ ID NO: 7326291 - DNA, 22 bp, Homo sapiens
atacacatgttattgtggaagc

SEQ ID NO: 7326292 - DNA, 22 bp, Homo sapiens
ataaagaggatgtatttacagc

SEQ ID NO: 7326293 - DNA, 22 bp, Homo sapiens
ataaagaggatgtatttacagc

SEQ ID NO: 7326294 - DNA, 22 bp, Homo sapiens
ataaacatctgtttctcttctg

SEQ ID NO: 7326295 - DNA, 17 bp, Homo sapiens
agttttgatataatggc

SEQ ID NO: 7326296 - DNA, 22 bp, Homo sapiens
atacacatatgtgtgtatatgt

SEQ ID NO: 7326297 - DNA, 22 bp, Homo sapiens
atacacatgcacacatgtgtgt

SEQ ID NO: 7326298 - DNA, 21 bp, Homo sapiens
atacacatacacataaatgtg

SEQ ID NO: 7326299 - DNA, 19 bp, Homo sapiens
atacacatacgtaaactga

SEQ ID NO: 7326300 - DNA, 22 bp, Homo sapiens
ctgcctgggttcaagtcctgtt

SEQ ID NO: 7326301 - DNA, 19 bp, Homo sapiens
ctgctcaggtcagtctgtc

SEQ ID NO: 7326302 - DNA, 22 bp, Homo sapiens
agtgttttatttcagcactttg

SEQ ID NO: 7326303 - DNA, 19 bp, Homo sapiens
agtgtttcatgtgctttta

SEQ ID NO: 7326304 - DNA, 22 bp, Homo sapiens
agtgtttctggcaaatgaaagt

SEQ ID NO: 7326305 - DNA, 22 bp, Homo sapiens
agtgtttcaagtgatgctttgg

SEQ ID NO: 7326306 - DNA, 22 bp, Homo sapiens
agttaacacaagtaagattcca

SEQ ID NO: 7326307 - DNA, 22 bp, Homo sapiens
agttcatattgaaagcaggtga

SEQ ID NO: 7326308 - DNA, 22 bp, Homo sapiens
agttatttcagtaacataatag

SEQ ID NO: 7326309 - DNA, 21 bp, Homo sapiens
agtgtcatttgatcattgtta

SEQ ID NO: 7326310 - DNA, 22 bp, Homo sapiens
agtgtcatgaatcaaagattat

SEQ ID NO: 7326311 - DNA, 21 bp, Homo sapiens
agtgtcattcccaagctgtga

SEQ ID NO: 7326312 - DNA, 22 bp, Homo sapiens
agtggtctagtctgaggattat

SEQ ID NO: 7326313 - DNA, 22 bp, Homo sapiens
agtgaaatagcatttatgaagc

SEQ ID NO: 7326314 - DNA, 22 bp, Homo sapiens
agtctttatttagagttaggac

SEQ ID NO: 7326315 - DNA, 22 bp, Homo sapiens
ctcaccagacatggaacctgtc

SEQ ID NO: 7326316 - DNA, 22 bp, Homo sapiens
agtctcaaagtcagtgtcatgg

SEQ ID NO: 7326317 - DNA, 22 bp, Homo sapiens
agtctcaagcaccgaaagctgt

SEQ ID NO: 7326318 - DNA, 23 bp, Homo sapiens
agtctcaagctggagaattacct

SEQ ID NO: 7326319 - DNA, 22 bp, Homo sapiens
agtctcaagtgttagtattatt

SEQ ID NO: 7326320 - DNA, 22 bp, Homo sapiens
agtggaagagccatgttccaac

SEQ ID NO: 7326321 - DNA, 22 bp, Homo sapiens
agtggaaggctgggaaatgcgg

SEQ ID NO: 7326322 - DNA, 22 bp, Homo sapiens
agtgcttttatatcattaatcc

SEQ ID NO: 7326323 - DNA, 22 bp, Homo sapiens
agtgcttttgtcattgaatctt

SEQ ID NO: 7326324 - DNA, 22 bp, Homo sapiens
agtggaggcactaattggattt

SEQ ID NO: 7326325 - DNA, 22 bp, Homo sapiens
agtggagtgagtggcagaagga

SEQ ID NO: 7326326 - DNA, 19 bp, Homo sapiens
aggtcctgatcagcaagga

SEQ ID NO: 7326327 - DNA, 22 bp, Homo sapiens
cctgggtcaccaggcccaggca

SEQ ID NO: 7326328 - DNA, 21 bp, Homo sapiens
cctgtgccagtctatgtgttc

SEQ ID NO: 7326329 - DNA, 22 bp, Homo sapiens
aggtggcagagtgacaggctga

SEQ ID NO: 7326330 - DNA, 22 bp, Homo sapiens
aggtggcagcagaatcagggag

SEQ ID NO: 7326331 - DNA, 22 bp, Homo sapiens
aggtggcagatgggggtgctcg

SEQ ID NO: 7326332 - DNA, 22 bp, Homo sapiens
aggtggcaggaggtcagagaaa

SEQ ID NO: 7326333 - DNA, 21 bp, Homo sapiens
cctgaggtttctggcctctgt

SEQ ID NO: 7326334 - DNA, 22 bp, Homo sapiens
ctatatatatcatcttccagtt

SEQ ID NO: 7326335 - DNA, 22 bp, Homo sapiens
agtcagcatctgcactgtgctg

SEQ ID NO: 7326336 - DNA, 22 bp, Homo sapiens
agtcagcattttcactgagcta

SEQ ID NO: 7326337 - DNA, 20 bp, Homo sapiens
ctatctcctggcgtgccttc

SEQ ID NO: 7326338 - DNA, 22 bp, Homo sapiens
ctatttacgctgctggggatca

SEQ ID NO: 7326339 - DNA, 19 bp, Homo sapiens
agtcacagaccttgtctcc

SEQ ID NO: 7326340 - DNA, 22 bp, Homo sapiens
ctaggaaagtgattcttcaatt

SEQ ID NO: 7326341 - DNA, 22 bp, Homo sapiens
ctaggaaatttaaaatatgatt

SEQ ID NO: 7326342 - DNA, 22 bp, Homo sapiens
agtaggaggcgggagcatgaag

SEQ ID NO: 7326343 - DNA, 22 bp, Homo sapiens
agtagacatgagcaatgataat

SEQ ID NO: 7326344 - DNA, 22 bp, Homo sapiens
agtaaacagtttcttagaagaa

SEQ ID NO: 7326345 - DNA, 22 bp, Homo sapiens
cagttcaagagaaatactactg

SEQ ID NO: 7326346 - DNA, 22 bp, Homo sapiens
cagttcaaagttaagcagcagt

SEQ ID NO: 7326347 - DNA, 22 bp, Homo sapiens
cagttcaaaattttgaagaagg

SEQ ID NO: 7326348 - DNA, 22 bp, Homo sapiens
cagttattatgaggtcattagg

SEQ ID NO: 7326349 - DNA, 22 bp, Homo sapiens
catcacatttaattaaaatgtc

SEQ ID NO: 7326350 - DNA, 22 bp, Homo sapiens
cagttccctccgccagcacttc

SEQ ID NO: 7326351 - DNA, 22 bp, Homo sapiens
aggaggtgagcggtcatgtggt

SEQ ID NO: 7326352 - DNA, 22 bp, Homo sapiens
aggaggtagtcttataaatgtt

SEQ ID NO: 7326353 - DNA, 22 bp, Homo sapiens
aggaggtcagagccccatgctg

SEQ ID NO: 7326354 - DNA, 22 bp, Homo sapiens
aggagtgggggcgagaagttaa

SEQ ID NO: 7326355 - DNA, 22 bp, Homo sapiens
catcatttgttcacttgattcc

SEQ ID NO: 7326356 - DNA, 22 bp, Homo sapiens
catcatttcacttagatgaagt

SEQ ID NO: 7326357 - DNA, 22 bp, Homo sapiens
catcatttgtttgcatgcagga

SEQ ID NO: 7326358 - DNA, 20 bp, Homo sapiens
catcattttaaaatctctcc

SEQ ID NO: 7326359 - DNA, 22 bp, Homo sapiens
catcatttaattataggggctg

SEQ ID NO: 7326360 - DNA, 22 bp, Homo sapiens
cagtggaatatataggggattt

SEQ ID NO: 7326361 - DNA, 22 bp, Homo sapiens
aggagccaaggaaaacagtatt

SEQ ID NO: 7326362 - DNA, 22 bp, Homo sapiens
aggagccacctaggagctgttt

SEQ ID NO: 7326363 - DNA, 22 bp, Homo sapiens
aggatcctttttctgctgtttg

SEQ ID NO: 7326364 - DNA, 22 bp, Homo sapiens
aggatctgtgcctcaacccaga

SEQ ID NO: 7326365 - DNA, 22 bp, Homo sapiens
aggatcaggccctctagggtag

SEQ ID NO: 7326366 - DNA, 22 bp, Homo sapiens
aggagtgttgcttcagggaagc

SEQ ID NO: 7326367 - DNA, 22 bp, Homo sapiens
catgtgtgaatcttgtgatcat

SEQ ID NO: 7326368 - DNA, 22 bp, Homo sapiens
aggcagagagcagtggccgtct

SEQ ID NO: 7326369 - DNA, 16 bp, Homo sapiens
aggcagagatttaccc

SEQ ID NO: 7326370 - DNA, 22 bp, Homo sapiens
aggcacagtggccctgtttggg

SEQ ID NO: 7326371 - DNA, 22 bp, Homo sapiens
aggcagaggagaatgatcttcc

SEQ ID NO: 7326372 - DNA, 22 bp, Homo sapiens
aggcagagctgggttttgaaat

SEQ ID NO: 7326373 - DNA, 22 bp, Homo sapiens
aggcagaggaagggtggatttg

SEQ ID NO: 7326374 - DNA, 22 bp, Homo sapiens
aggcagaggaagggtggatttg

SEQ ID NO: 7326375 - DNA, 22 bp, Homo sapiens
aggcagagctaggaagaattgt

SEQ ID NO: 7326376 - DNA, 22 bp, Homo sapiens
aggcagagctgatgttctgtga

SEQ ID NO: 7326377 - DNA, 23 bp, Homo sapiens
aggcagagccaaggtcaaaaccc

SEQ ID NO: 7326378 - DNA, 20 bp, Homo sapiens
aggcagagcgcacttttaga

SEQ ID NO: 7326379 - DNA, 22 bp, Homo sapiens
ccaaaataacagcccaattcac

SEQ ID NO: 7326380 - DNA, 22 bp, Homo sapiens
ccaaaatattagtgcttaagta

SEQ ID NO: 7326381 - DNA, 22 bp, Homo sapiens
ccaaacaaatccccattcttag

SEQ ID NO: 7326382 - DNA, 22 bp, Homo sapiens
ccaaacttaacgatgtttttgt

SEQ ID NO: 7326383 - DNA, 21 bp, Homo sapiens
ccaaagaactgccatttgtca

SEQ ID NO: 7326384 - DNA, 21 bp, Homo sapiens
aggcaggattcaaacacagag

SEQ ID NO: 7326385 - DNA, 22 bp, Homo sapiens
aggcaggcccctgagaatagac

SEQ ID NO: 7326386 - DNA, 22 bp, Homo sapiens
aggcaggccctctggaaaggta

SEQ ID NO: 7326387 - DNA, 22 bp, Homo sapiens
aggcaggctcaggcccatgctt

SEQ ID NO: 7326388 - DNA, 22 bp, Homo sapiens
aggaagaggtgtgcaatggtgt

SEQ ID NO: 7326389 - DNA, 22 bp, Homo sapiens
aggaagaggtgtgcaatggtgt

SEQ ID NO: 7326390 - DNA, 21 bp, Homo sapiens
aggaagatctggaggtcggcg

SEQ ID NO: 7326391 - DNA, 22 bp, Homo sapiens
cagggtggtaccagcatctagt

SEQ ID NO: 7326392 - DNA, 22 bp, Homo sapiens
aggaaacatccttatctattct

SEQ ID NO: 7326393 - DNA, 22 bp, Homo sapiens
aggaaacatccttatctattct

SEQ ID NO: 7326394 - DNA, 22 bp, Homo sapiens
aggaaacatgaatctgccttga

SEQ ID NO: 7326395 - DNA, 22 bp, Homo sapiens
aggaagtgaaagggaaggagtt

SEQ ID NO: 7326396 - DNA, 22 bp, Homo sapiens
aggaaggtaatgaactgaggag

SEQ ID NO: 7326397 - DNA, 22 bp, Homo sapiens
aggaagggtgtcatgagccctt

SEQ ID NO: 7326398 - DNA, 22 bp, Homo sapiens
agctttctctcagccaggctgc

SEQ ID NO: 7326399 - DNA, 20 bp, Homo sapiens
agctttctccttggagctcc

SEQ ID NO: 7326400 - DNA, 22 bp, Homo sapiens
aggaaaatcgagtctggaggca

SEQ ID NO: 7326401 - DNA, 22 bp, Homo sapiens
aggaaaagtgtgaagtatggag

SEQ ID NO: 7326402 - DNA, 21 bp, Homo sapiens
agctgaaaagttgtttacaag

SEQ ID NO: 7326403 - DNA, 22 bp, Homo sapiens
caggaaatcactctgattttgg

SEQ ID NO: 7326404 - DNA, 21 bp, Homo sapiens
caggaaatcagtgtgaattag

SEQ ID NO: 7326405 - DNA, 22 bp, Homo sapiens
caggaacccaatgggccaggcc

SEQ ID NO: 7326406 - DNA, 22 bp, Homo sapiens
caggaagaagggtggtgagtcc

SEQ ID NO: 7326407 - DNA, 22 bp, Homo sapiens
caggaagaagggtggtgagtcc

SEQ ID NO: 7326408 - DNA, 22 bp, Homo sapiens
caggaagaaagaggtgaggtgt

SEQ ID NO: 7326409 - DNA, 22 bp, Homo sapiens
caggaagaaagaggtgaggtgt

SEQ ID NO: 7326410 - DNA, 22 bp, Homo sapiens
caggaacctgtgcgtagggatg

SEQ ID NO: 7326411 - DNA, 22 bp, Homo sapiens
caggaacctgctccaagaggca

SEQ ID NO: 7326412 - DNA, 14 bp, Homo sapiens
caggaagactcagc

SEQ ID NO: 7326413 - DNA, 22 bp, Homo sapiens
caggaagaccagggctgtggct

SEQ ID NO: 7326414 - DNA, 22 bp, Homo sapiens
caggcagaggcttttcatggct

SEQ ID NO: 7326415 - DNA, 22 bp, Homo sapiens
caggcagaggtaccaagattga

SEQ ID NO: 7326416 - DNA, 22 bp, Homo sapiens
caggcagaggaagtctgggtct

SEQ ID NO: 7326417 - DNA, 22 bp, Homo sapiens
caggcagagtgaggtggtctaa

SEQ ID NO: 7326418 - DNA, 23 bp, Homo sapiens
aggggcagcaagttttggtgtta

SEQ ID NO: 7326419 - DNA, 18 bp, Homo sapiens
aggggcagcttgtgtgga

SEQ ID NO: 7326420 - DNA, 22 bp, Homo sapiens
cctgaaatgactccagctgagt

SEQ ID NO: 7326421 - DNA, 21 bp, Homo sapiens
cctgaaattctcactagctta

SEQ ID NO: 7326422 - DNA, 22 bp, Homo sapiens
agggtagggcccggagacagac

SEQ ID NO: 7326423 - DNA, 22 bp, Homo sapiens
agggtagggccgtagggccatg

SEQ ID NO: 7326424 - DNA, 22 bp, Homo sapiens
cctgaggtggctgcagcactgc

SEQ ID NO: 7326425 - DNA, 22 bp, Homo sapiens
agggcgacaatggagagcgttt

SEQ ID NO: 7326426 - DNA, 22 bp, Homo sapiens
cccatgcaccctctaagaagga

SEQ ID NO: 7326427 - DNA, 22 bp, Homo sapiens
ccctcaccaggctccaggcatg

SEQ ID NO: 7326428 - DNA, 22 bp, Homo sapiens
ccctcagcagatatttgtgttt

SEQ ID NO: 7326429 - DNA, 23 bp, Homo sapiens
ccctgcatctgtccctcaccagt

SEQ ID NO: 7326430 - DNA, 22 bp, Homo sapiens
ccctgctgtccctcagtcctgc

SEQ ID NO: 7326431 - DNA, 22 bp, Homo sapiens
ccctgctgcatggcctccacga

SEQ ID NO: 7326432 - DNA, 22 bp, Homo sapiens
ccctgcccatcggggcggcctg

SEQ ID NO: 7326433 - DNA, 18 bp, Homo sapiens
cccaggctttgtgggtct

SEQ ID NO: 7326434 - DNA, 22 bp, Homo sapiens
cccagtcatcctgcaggtgaaa

SEQ ID NO: 7326435 - DNA, 22 bp, Homo sapiens
cccagtattgagctacaggcct

SEQ ID NO: 7326436 - DNA, 22 bp, Homo sapiens
cccagtttcaactttccagtgg

SEQ ID NO: 7326437 - DNA, 22 bp, Homo sapiens
cccatccctgattttcactcgt

SEQ ID NO: 7326438 - DNA, 22 bp, Homo sapiens
cccaggctgatgggatgggcca

SEQ ID NO: 7326439 - DNA, 22 bp, Homo sapiens
cccaggaatgaggggcggaggc

SEQ ID NO: 7326440 - DNA, 22 bp, Homo sapiens
cccaggaatgggaaggaggaat

SEQ ID NO: 7326441 - DNA, 22 bp, Homo sapiens
cccaggagatggaggttgcagt

SEQ ID NO: 7326442 - DNA, 22 bp, Homo sapiens
cccaggagcttctctctgcctc

SEQ ID NO: 7326443 - DNA, 22 bp, Homo sapiens
cccaggaggtagaggttgcagt

SEQ ID NO: 7326444 - DNA, 22 bp, Homo sapiens
cccaggaatgagcaggcagggg

SEQ ID NO: 7326445 - DNA, 22 bp, Homo sapiens
cccaggaatgaggggcggaggc

SEQ ID NO: 7326446 - DNA, 22 bp, Homo sapiens
ccatttaacacagagttttcca

SEQ ID NO: 7326447 - DNA, 22 bp, Homo sapiens
aggctggaaagggaccagagtg

SEQ ID NO: 7326448 - DNA, 22 bp, Homo sapiens
aggctgaggcaagaggatcact

SEQ ID NO: 7326449 - DNA, 22 bp, Homo sapiens
ccaggctgtaaacaccttcaaa

SEQ ID NO: 7326450 - DNA, 22 bp, Homo sapiens
ccagggcagcgcccctccacgc

SEQ ID NO: 7326451 - DNA, 22 bp, Homo sapiens
aggctacatgttggggtggaag

SEQ ID NO: 7326452 - DNA, 22 bp, Homo sapiens
aggctagaggcttctggcttca

SEQ ID NO: 7326453 - DNA, 22 bp, Homo sapiens
ccagaacacagtggaagaatat

SEQ ID NO: 7326454 - DNA, 22 bp, Homo sapiens
ccagacatattgacatttgatc

SEQ ID NO: 7326455 - DNA, 22 bp, Homo sapiens
ccagacatgtgcccttgaggaa

SEQ ID NO: 7326456 - DNA, 22 bp, Homo sapiens
aggccaccaccctatctcctgg

SEQ ID NO: 7326457 - DNA, 21 bp, Homo sapiens
ccagctctgcctccagttggt

SEQ ID NO: 7326458 - DNA, 22 bp, Homo sapiens
ccagctctggcttcttgctggg

SEQ ID NO: 7326459 - DNA, 22 bp, Homo sapiens
ccagctctgtaagctgtgaaat

SEQ ID NO: 7326460 - DNA, 22 bp, Homo sapiens
ccaggaagtatgacccaacaga

SEQ ID NO: 7326461 - DNA, 22 bp, Homo sapiens
ccaggaaggcaggcctccccgc

SEQ ID NO: 7326462 - DNA, 22 bp, Homo sapiens
agtcacccaggtgtgatggatg

SEQ ID NO: 7326463 - DNA, 22 bp, Homo sapiens
agtaccatctatgtgccaagca

SEQ ID NO: 7326464 - DNA, 22 bp, Homo sapiens
agtaccatctctgcctctgcct

SEQ ID NO: 7326465 - DNA, 22 bp, Homo sapiens
aggtggggaaaccagcgatccc

SEQ ID NO: 7326466 - DNA, 22 bp, Homo sapiens
aggtgggcttggtgccaacatg

SEQ ID NO: 7326467 - DNA, 22 bp, Homo sapiens
aggtgggcggattcatgaggtc

SEQ ID NO: 7326468 - DNA, 22 bp, Homo sapiens
aggtgggcggatcacaaggtca

SEQ ID NO: 7326469 - DNA, 22 bp, Homo sapiens
agtacttttttgatatctgagt

SEQ ID NO: 7326470 - DNA, 22 bp, Homo sapiens
agtagtcagcagataatatagg

SEQ ID NO: 7326471 - DNA, 22 bp, Homo sapiens
agtactttcttccgagagagaa

SEQ ID NO: 7326472 - DNA, 22 bp, Homo sapiens
agtactttagcataaagcagtt

SEQ ID NO: 7326473 - DNA, 22 bp, Homo sapiens
agtactgtcagcagggtgttga

SEQ ID NO: 7326474 - DNA, 22 bp, Homo sapiens
aggtaggagttgatggatgttc

SEQ ID NO: 7326475 - DNA, 22 bp, Homo sapiens
aggtaggaaagtctccttgtat

SEQ ID NO: 7326476 - DNA, 22 bp, Homo sapiens
aggtatttcaaagcccacttcc

SEQ ID NO: 7326477 - DNA, 22 bp, Homo sapiens
accttcctctaagacatttagc

SEQ ID NO: 7326478 - DNA, 22 bp, Homo sapiens
acgaggagcctgtggcctggta

SEQ ID NO: 7326479 - DNA, 22 bp, Homo sapiens
acgaggttggagagttgtttgg

SEQ ID NO: 7326480 - DNA, 22 bp, Homo sapiens
actactgaatattagttctgaa

SEQ ID NO: 7326481 - DNA, 22 bp, Homo sapiens
actctgccatcccaggtgctgt

SEQ ID NO: 7326482 - DNA, 22 bp, Homo sapiens
actgccagttgttttgtccagt

SEQ ID NO: 7326483 - DNA, 23 bp, Homo sapiens
actgccagttttaccacagacgg

SEQ ID NO: 7326484 - DNA, 22 bp, Homo sapiens
actgccaggtgctccatctgaa

SEQ ID NO: 7326485 - DNA, 22 bp, Homo sapiens
actgccagtattcacgttcctg

SEQ ID NO: 7326486 - DNA, 22 bp, Homo sapiens
actgccagtcattccacaattt

SEQ ID NO: 7326487 - DNA, 22 bp, Homo sapiens
actgccaggatggcactagagg

SEQ ID NO: 7326488 - DNA, 21 bp, Homo sapiens
actgccaggagagtaggggga

SEQ ID NO: 7326489 - DNA, 22 bp, Homo sapiens
actgccaggccagtagaacata

SEQ ID NO: 7326490 - DNA, 22 bp, Homo sapiens
actgccaggccttgttagttga

SEQ ID NO: 7326491 - DNA, 22 bp, Homo sapiens
actgccaggtaagtgctcctgc

SEQ ID NO: 7326492 - DNA, 22 bp, Homo sapiens
actgccagaagacagcttttca

SEQ ID NO: 7326493 - DNA, 22 bp, Homo sapiens
actgccagaatcattcaaggaa

SEQ ID NO: 7326494 - DNA, 22 bp, Homo sapiens
actgccagaggaggtatctgaa

SEQ ID NO: 7326495 - DNA, 22 bp, Homo sapiens
actgccagatataaaaactgtg

SEQ ID NO: 7326496 - DNA, 22 bp, Homo sapiens
actgccagagacaaggatgagt

SEQ ID NO: 7326497 - DNA, 23 bp, Homo sapiens
actgccagagcaggctttgcctg

SEQ ID NO: 7326498 - DNA, 23 bp, Homo sapiens
actgccagattgaaggtttctta

SEQ ID NO: 7326499 - DNA, 22 bp, Homo sapiens
actgccagatattaaacatatt

SEQ ID NO: 7326500 - DNA, 20 bp, Homo sapiens
actgccagccttgtctactg

SEQ ID NO: 7326501 - DNA, 22 bp, Homo sapiens
actgccagcaatgtgaaagaaa

SEQ ID NO: 7326502 - DNA, 22 bp, Homo sapiens
actgccagcctcagtgaaggca

SEQ ID NO: 7326503 - DNA, 22 bp, Homo sapiens
ataatttttgtttgatgtccaa

SEQ ID NO: 7326504 - DNA, 22 bp, Homo sapiens
atacatatccacaggagataaa

SEQ ID NO: 7326505 - DNA, 22 bp, Homo sapiens
atacatcacctatatattcaca

SEQ ID NO: 7326506 - DNA, 22 bp, Homo sapiens
atacatcacctatatattcaca

SEQ ID NO: 7326507 - DNA, 22 bp, Homo sapiens
atacatatgaatgatttggctc

SEQ ID NO: 7326508 - DNA, 20 bp, Homo sapiens
actttctcggtttctcacct

SEQ ID NO: 7326509 - DNA, 22 bp, Homo sapiens
atacatcatgctccatatattt

SEQ ID NO: 7326510 - DNA, 22 bp, Homo sapiens
acttaaaaagaatcttttcacg

SEQ ID NO: 7326511 - DNA, 22 bp, Homo sapiens
acttaaaaccagacagcgtcat

SEQ ID NO: 7326512 - DNA, 22 bp, Homo sapiens
actgttttcctaatgagcaaga

SEQ ID NO: 7326513 - DNA, 22 bp, Homo sapiens
actgttttctaaagaacagatg

SEQ ID NO: 7326514 - DNA, 22 bp, Homo sapiens
acttaaaaacagatccagcagg

SEQ ID NO: 7326515 - DNA, 22 bp, Homo sapiens
actgttttctgtaaagggccag

SEQ ID NO: 7326516 - DNA, 22 bp, Homo sapiens
acttcctgtgttggtcttgctg

SEQ ID NO: 7326517 - DNA, 22 bp, Homo sapiens
acttcctgtatttatccatagc

SEQ ID NO: 7326518 - DNA, 22 bp, Homo sapiens
acttcctgtaaatagaattcca

SEQ ID NO: 7326519 - DNA, 22 bp, Homo sapiens
acttcctgggtgttgtaaggtc

SEQ ID NO: 7326520 - DNA, 22 bp, Homo sapiens
acttcctgggcatgcagagtcc

SEQ ID NO: 7326521 - DNA, 22 bp, Homo sapiens
acttctatgcacagagcttgga

SEQ ID NO: 7326522 - DNA, 22 bp, Homo sapiens
ataaagtggaggtagtattcat

SEQ ID NO: 7326523 - DNA, 22 bp, Homo sapiens
acttcctggcgtagctgacatt

SEQ ID NO: 7326524 - DNA, 22 bp, Homo sapiens
agaaatctgactgctgtgcaca

SEQ ID NO: 7326525 - DNA, 22 bp, Homo sapiens
atccaggagtcgtggcgctcag

SEQ ID NO: 7326526 - DNA, 22 bp, Homo sapiens
agaaatcccaaggcatcaacca

SEQ ID NO: 7326527 - DNA, 22 bp, Homo sapiens
atcccatttcctagtacatcat

SEQ ID NO: 7326528 - DNA, 22 bp, Homo sapiens
agaaccatgagtttgagtatct

SEQ ID NO: 7326529 - DNA, 22 bp, Homo sapiens
agaaccattttgacagatatac

SEQ ID NO: 7326530 - DNA, 22 bp, Homo sapiens
atcccattttataccataagag

SEQ ID NO: 7326531 - DNA, 22 bp, Homo sapiens
agaagccacaggaaagcagctt

SEQ ID NO: 7326532 - DNA, 22 bp, Homo sapiens
agaagccaattctgtgtgagtc

SEQ ID NO: 7326533 - DNA, 22 bp, Homo sapiens
agaagccaatccttgtctctct

SEQ ID NO: 7326534 - DNA, 22 bp, Homo sapiens
agaagccaatcagctctctgct

SEQ ID NO: 7326535 - DNA, 22 bp, Homo sapiens
agaagccaagaacagacagtgc

SEQ ID NO: 7326536 - DNA, 22 bp, Homo sapiens
agaagccaacagggcaggagag

SEQ ID NO: 7326537 - DNA, 22 bp, Homo sapiens
agaagccaagaacagacagtgc

SEQ ID NO: 7326538 - DNA, 20 bp, Homo sapiens
agaagccaagtgacatgttt

SEQ ID NO: 7326539 - DNA, 22 bp, Homo sapiens
agaagccacaggaaagcagctt

SEQ ID NO: 7326540 - DNA, 22 bp, Homo sapiens
agaagccacaggcctcgtctgg

SEQ ID NO: 7326541 - DNA, 22 bp, Homo sapiens
agaaatcaggaacagtaaggag

SEQ ID NO: 7326542 - DNA, 22 bp, Homo sapiens
atcagtctgttggaatatcgct

SEQ ID NO: 7326543 - DNA, 21 bp, Homo sapiens
agaaaaaccagcatgttttca

SEQ ID NO: 7326544 - DNA, 22 bp, Homo sapiens
agaaaaagtcaaggaattggac

SEQ ID NO: 7326545 - DNA, 21 bp, Homo sapiens
agaaaaacacgatataagccc

SEQ ID NO: 7326546 - DNA, 22 bp, Homo sapiens
actttttgcatagtaagtgtct

SEQ ID NO: 7326547 - DNA, 22 bp, Homo sapiens
aggaaactaacttatctttata

SEQ ID NO: 7326548 - DNA, 22 bp, Homo sapiens
aggaaactaaggctcagtgaag

SEQ ID NO: 7326549 - DNA, 22 bp, Homo sapiens
aggaaactcaaagtgtcaggta

SEQ ID NO: 7326550 - DNA, 22 bp, Homo sapiens
aggaaactgggtatggttatac

SEQ ID NO: 7326551 - DNA, 22 bp, Homo sapiens
aggaagagcattcacatggtag

SEQ ID NO: 7326552 - DNA, 22 bp, Homo sapiens
aggaagccacgagtggcacggg

SEQ ID NO: 7326553 - DNA, 22 bp, Homo sapiens
agcttcatctttatgtacagga

SEQ ID NO: 7326554 - DNA, 22 bp, Homo sapiens
agcttatcttgttagtttcatt

SEQ ID NO: 7326555 - DNA, 22 bp, Homo sapiens
acagcccaagtcacctgcagga

SEQ ID NO: 7326556 - DNA, 22 bp, Homo sapiens
agctgcaggattatggaatgga

SEQ ID NO: 7326557 - DNA, 22 bp, Homo sapiens
agctgcaggaagtagaagcgga

SEQ ID NO: 7326558 - DNA, 22 bp, Homo sapiens
aggagggaataagaaagagtca

SEQ ID NO: 7326559 - DNA, 20 bp, Homo sapiens
aggagggacctggattggcg

SEQ ID NO: 7326560 - DNA, 22 bp, Homo sapiens
aggatggcttgcaggaggctgt

SEQ ID NO: 7326561 - DNA, 22 bp, Homo sapiens
aggcacaagaaactgctcccca

SEQ ID NO: 7326562 - DNA, 22 bp, Homo sapiens
aggagcctgagtcacagtgcct

SEQ ID NO: 7326563 - DNA, 22 bp, Homo sapiens
aggagcctgaatcagagggtga

SEQ ID NO: 7326564 - DNA, 22 bp, Homo sapiens
aggagcctccttctcatgtgca

SEQ ID NO: 7326565 - DNA, 22 bp, Homo sapiens
aggagcctccatggtcacattc

SEQ ID NO: 7326566 - DNA, 22 bp, Homo sapiens
aggagcccagcctgggctcgga

SEQ ID NO: 7326567 - DNA, 23 bp, Homo sapiens
aggagcccaaggagaggtaactt

SEQ ID NO: 7326568 - DNA, 23 bp, Homo sapiens
aggagcccaaggagaggtaactt

SEQ ID NO: 7326569 - DNA, 23 bp, Homo sapiens
aggagcccctaattctgggcagc

SEQ ID NO: 7326570 - DNA, 22 bp, Homo sapiens
aggagccctgcgggaggcagag

SEQ ID NO: 7326571 - DNA, 22 bp, Homo sapiens
aggagccctgcgggaggcagag

SEQ ID NO: 7326572 - DNA, 22 bp, Homo sapiens
aggagccctccgttgcttcatc

SEQ ID NO: 7326573 - DNA, 22 bp, Homo sapiens
aggagcccctcttcagtcctgg

SEQ ID NO: 7326574 - DNA, 22 bp, Homo sapiens
aggagctgcttaaatggttggt

SEQ ID NO: 7326575 - DNA, 21 bp, Homo sapiens
aggagccatgtggtctgatgg

SEQ ID NO: 7326576 - DNA, 20 bp, Homo sapiens
aggagccattgactgcagca

SEQ ID NO: 7326577 - DNA, 17 bp, Homo sapiens
aggaagcgagctggcct

SEQ ID NO: 7326578 - DNA, 22 bp, Homo sapiens
aggaagcccaagtctcatcttc

SEQ ID NO: 7326579 - DNA, 22 bp, Homo sapiens
aggaagggatacataggatagt

SEQ ID NO: 7326580 - DNA, 22 bp, Homo sapiens
aggagacagccaggggcctgag

SEQ ID NO: 7326581 - DNA, 22 bp, Homo sapiens
aggagacccaatgccagaaaga

SEQ ID NO: 7326582 - DNA, 22 bp, Homo sapiens
aggagacatggaatagtgaggc

SEQ ID NO: 7326583 - DNA, 22 bp, Homo sapiens
aggagacatctaactgtaggtt

SEQ ID NO: 7326584 - DNA, 22 bp, Homo sapiens
aggagacatactataggaatat

SEQ ID NO: 7326585 - DNA, 22 bp, Homo sapiens
accaggagcattttttattagt

SEQ ID NO: 7326586 - DNA, 22 bp, Homo sapiens
accaggaggaagtgttaatgat

SEQ ID NO: 7326587 - DNA, 22 bp, Homo sapiens
accaggaggccttggttctgag

SEQ ID NO: 7326588 - DNA, 22 bp, Homo sapiens
accaggaggctacactgtccca

SEQ ID NO: 7326589 - DNA, 23 bp, Homo sapiens
accaggagaaaagctttgcggga

SEQ ID NO: 7326590 - DNA, 19 bp, Homo sapiens
accaggagacagtgagctt

SEQ ID NO: 7326591 - DNA, 22 bp, Homo sapiens
accaggagagattttattgaga

SEQ ID NO: 7326592 - DNA, 22 bp, Homo sapiens
accagggctgggataggtcagg

SEQ ID NO: 7326593 - DNA, 22 bp, Homo sapiens
accagggctgacaatctgatgg

SEQ ID NO: 7326594 - DNA, 22 bp, Homo sapiens
accagggcttacagcagtagct

SEQ ID NO: 7326595 - DNA, 22 bp, Homo sapiens
accagggccgcgggcgactagc

SEQ ID NO: 7326596 - DNA, 22 bp, Homo sapiens
accagggcggcttgaggaggca

SEQ ID NO: 7326597 - DNA, 22 bp, Homo sapiens
accagggcccgggagagctctc

SEQ ID NO: 7326598 - DNA, 22 bp, Homo sapiens
accagggcagccgaggtgtgtc

SEQ ID NO: 7326599 - DNA, 22 bp, Homo sapiens
accagggcacattccggccaga

SEQ ID NO: 7326600 - DNA, 22 bp, Homo sapiens
accagggcacaggagtctgaag

SEQ ID NO: 7326601 - DNA, 23 bp, Homo sapiens
acccatctctcctgtcatgcaga

SEQ ID NO: 7326602 - DNA, 22 bp, Homo sapiens
acccatggtctggtggggccct

SEQ ID NO: 7326603 - DNA, 19 bp, Homo sapiens
acccattttcagtattggc

SEQ ID NO: 7326604 - DNA, 22 bp, Homo sapiens
acccatttcataaacatgcttt

SEQ ID NO: 7326605 - DNA, 18 bp, Homo sapiens
acccaggttttgaagctt

SEQ ID NO: 7326606 - DNA, 22 bp, Homo sapiens
acccacagccgctgtgcgtccc

SEQ ID NO: 7326607 - DNA, 22 bp, Homo sapiens
acattctacagttaaccattag

SEQ ID NO: 7326608 - DNA, 22 bp, Homo sapiens
aggccctgatccgaatccagat

SEQ ID NO: 7326609 - DNA, 22 bp, Homo sapiens
aggcatggggctgcagtcaggt

SEQ ID NO: 7326610 - DNA, 22 bp, Homo sapiens
aggcatgggtagaagagaagcc

SEQ ID NO: 7326611 - DNA, 19 bp, Homo sapiens
aggcatgggaagagaagtc

SEQ ID NO: 7326612 - DNA, 22 bp, Homo sapiens
aggcatggctttaggcaggcgt

SEQ ID NO: 7326613 - DNA, 22 bp, Homo sapiens
aggcatggcattcctcaagcaa

SEQ ID NO: 7326614 - DNA, 20 bp, Homo sapiens
acatgaaaggaaacaggaaa

SEQ ID NO: 7326615 - DNA, 22 bp, Homo sapiens
acatctttgtttcttagtgtat

SEQ ID NO: 7326616 - DNA, 22 bp, Homo sapiens
acatcttttactctggttcggg

SEQ ID NO: 7326617 - DNA, 22 bp, Homo sapiens
acatctttttggaaacggctga

SEQ ID NO: 7326618 - DNA, 22 bp, Homo sapiens
acatctttgctcttatagagct

SEQ ID NO: 7326619 - DNA, 22 bp, Homo sapiens
acatcttttttctctaattgtg

SEQ ID NO: 7326620 - DNA, 22 bp, Homo sapiens
agatggagtggagatgagtaaa

SEQ ID NO: 7326621 - DNA, 22 bp, Homo sapiens
agatggagaccttggatgaact

SEQ ID NO: 7326622 - DNA, 19 bp, Homo sapiens
agatggcaaaatgcaaaga

SEQ ID NO: 7326623 - DNA, 22 bp, Homo sapiens
agatggagttgtagcagtgact

SEQ ID NO: 7326624 - DNA, 22 bp, Homo sapiens
attggtagttttgtatttctct

SEQ ID NO: 7326625 - DNA, 22 bp, Homo sapiens
attggctccctgtgatctggtg

SEQ ID NO: 7326626 - DNA, 22 bp, Homo sapiens
agcaacaggcataatgtgttga

SEQ ID NO: 7326627 - DNA, 22 bp, Homo sapiens
agcaacaggcataatgtgttga

SEQ ID NO: 7326628 - DNA, 23 bp, Homo sapiens
agcaacagtgggtgagtgttgct

SEQ ID NO: 7326629 - DNA, 22 bp, Homo sapiens
agcaacagtgtatatcataggc

SEQ ID NO: 7326630 - DNA, 20 bp, Homo sapiens
agcaagagtaaggacagcga

SEQ ID NO: 7326631 - DNA, 22 bp, Homo sapiens
agcaagagatttccctacctcc

SEQ ID NO: 7326632 - DNA, 22 bp, Homo sapiens
agcaagagcatgtcggcctggt

SEQ ID NO: 7326633 - DNA, 22 bp, Homo sapiens
caaagcaaggctcagtttgaac

SEQ ID NO: 7326634 - DNA, 22 bp, Homo sapiens
caaagcaagggctgaagactcc

SEQ ID NO: 7326635 - DNA, 22 bp, Homo sapiens
caaagcaagggctgaagactcc

SEQ ID NO: 7326636 - DNA, 22 bp, Homo sapiens
caaacattttgagtggtttctg

SEQ ID NO: 7326637 - DNA, 20 bp, Homo sapiens
agcaagagtgtacctggcca

SEQ ID NO: 7326638 - DNA, 22 bp, Homo sapiens
agcaacagccctgtttcattag

SEQ ID NO: 7326639 - DNA, 22 bp, Homo sapiens
agcaaatgggtttatatttgac

SEQ ID NO: 7326640 - DNA, 18 bp, Homo sapiens
agcaacagaaacatatgg

SEQ ID NO: 7326641 - DNA, 22 bp, Homo sapiens
attacagtaacagctacaatgc

SEQ ID NO: 7326642 - DNA, 23 bp, Homo sapiens
agaggcaggagtggcttgcccgg

SEQ ID NO: 7326643 - DNA, 22 bp, Homo sapiens
attacagatagactttgaagct

SEQ ID NO: 7326644 - DNA, 18 bp, Homo sapiens
agagtccagggtgaggtg

SEQ ID NO: 7326645 - DNA, 22 bp, Homo sapiens
agaggtggagctcttggcatca

SEQ ID NO: 7326646 - DNA, 22 bp, Homo sapiens
agagtccaaatgtgcagttatg

SEQ ID NO: 7326647 - DNA, 22 bp, Homo sapiens
agaggggaaggatgtgatgtga

SEQ ID NO: 7326648 - DNA, 22 bp, Homo sapiens
agagggcagtctcagattggga

SEQ ID NO: 7326649 - DNA, 23 bp, Homo sapiens
agaggggagcatctgctggctga

SEQ ID NO: 7326650 - DNA, 18 bp, Homo sapiens
agaggggaggtaagtctg

SEQ ID NO: 7326651 - DNA, 22 bp, Homo sapiens
agactgtaattgacatgtcagc

SEQ ID NO: 7326652 - DNA, 22 bp, Homo sapiens
atgccaagtatgattcacatgt

SEQ ID NO: 7326653 - DNA, 22 bp, Homo sapiens
agacctggagtgaagagttccc

SEQ ID NO: 7326654 - DNA, 22 bp, Homo sapiens
atgatacatcttcatgtcagtg

SEQ ID NO: 7326655 - DNA, 22 bp, Homo sapiens
atctgctgttcttcacagcttg

SEQ ID NO: 7326656 - DNA, 22 bp, Homo sapiens
atgaagctgtttattttagcag

SEQ ID NO: 7326657 - DNA, 22 bp, Homo sapiens
atgaagctctaaatgtacttag

SEQ ID NO: 7326658 - DNA, 22 bp, Homo sapiens
atgaagctgaccttgtcttgct

SEQ ID NO: 7326659 - DNA, 22 bp, Homo sapiens
atgaagctgaggttctctttga

SEQ ID NO: 7326660 - DNA, 22 bp, Homo sapiens
agacaaggcaaggcggccagat

SEQ ID NO: 7326661 - DNA, 22 bp, Homo sapiens
atgagggaggcaaggagatgct

SEQ ID NO: 7326662 - DNA, 22 bp, Homo sapiens
agagattgctagctggctttaa

SEQ ID NO: 7326663 - DNA, 22 bp, Homo sapiens
agagaggtttgctggaagattc

SEQ ID NO: 7326664 - DNA, 22 bp, Homo sapiens
agagcacagggttttgtgccgg

SEQ ID NO: 7326665 - DNA, 22 bp, Homo sapiens
agagaaggtcactaaggaccca

SEQ ID NO: 7326666 - DNA, 22 bp, Homo sapiens
agagaaggtcactaaggaccca

SEQ ID NO: 7326667 - DNA, 21 bp, Homo sapiens
agagagaaggccatatggtcc

SEQ ID NO: 7326668 - DNA, 19 bp, Homo sapiens
agcagggagtggttgtggg

SEQ ID NO: 7326669 - DNA, 18 bp, Homo sapiens
agcaggactgtggggtgg

SEQ ID NO: 7326670 - DNA, 22 bp, Homo sapiens
agcaggacaatatgggatcagg

SEQ ID NO: 7326671 - DNA, 22 bp, Homo sapiens
agcaggacacgatgcggcagga

SEQ ID NO: 7326672 - DNA, 22 bp, Homo sapiens
agcaggaccaagaaggggaaaa

SEQ ID NO: 7326673 - DNA, 22 bp, Homo sapiens
agcagggaggcggtgtgctggc

SEQ ID NO: 7326674 - DNA, 17 bp, Homo sapiens
agcagggagtcaaggga

SEQ ID NO: 7326675 - DNA, 22 bp, Homo sapiens
cacttaaagtcttagcttacag

SEQ ID NO: 7326676 - DNA, 22 bp, Homo sapiens
cactgtgtctggagtgagctgg

SEQ ID NO: 7326677 - DNA, 23 bp, Homo sapiens
agcagtcagggtggtaagccatc

SEQ ID NO: 7326678 - DNA, 22 bp, Homo sapiens
agcagtcaggcctcagagccgt

SEQ ID NO: 7326679 - DNA, 21 bp, Homo sapiens
agcagtgctcctgggatgagg

SEQ ID NO: 7326680 - DNA, 22 bp, Homo sapiens
agcagccagagaatgatgcagt

SEQ ID NO: 7326681 - DNA, 22 bp, Homo sapiens
caaagggcatggcctgagcact

SEQ ID NO: 7326682 - DNA, 22 bp, Homo sapiens
caaagggcattttagtgaactg

SEQ ID NO: 7326683 - DNA, 22 bp, Homo sapiens
agcccccacgtttcctgggtcc

SEQ ID NO: 7326684 - DNA, 22 bp, Homo sapiens
agcccccaaaagtgcttatgat

SEQ ID NO: 7326685 - DNA, 22 bp, Homo sapiens
agcccaggttgaggctgcagtg

SEQ ID NO: 7326686 - DNA, 22 bp, Homo sapiens
cagagctctgacagctacagcc

SEQ ID NO: 7326687 - DNA, 22 bp, Homo sapiens
cagagaaagggtgaattccttc

SEQ ID NO: 7326688 - DNA, 22 bp, Homo sapiens
agccagctaccggggctcctgg

SEQ ID NO: 7326689 - DNA, 18 bp, Homo sapiens
cagagctcctggatgcag

SEQ ID NO: 7326690 - DNA, 18 bp, Homo sapiens
cagagctcctggatgcag

SEQ ID NO: 7326691 - DNA, 22 bp, Homo sapiens
cagagctcagagctgccaggca

SEQ ID NO: 7326692 - DNA, 22 bp, Homo sapiens
cagagctcagagcagggcactc

SEQ ID NO: 7326693 - DNA, 22 bp, Homo sapiens
cactttctgtgttgtgcaaaaa

SEQ ID NO: 7326694 - DNA, 22 bp, Homo sapiens
cactttataaaattggtgtgag

SEQ ID NO: 7326695 - DNA, 22 bp, Homo sapiens
agccagcctgatctcttcttgc

SEQ ID NO: 7326696 - DNA, 20 bp, Homo sapiens
agccagccacttcctgctcc

SEQ ID NO: 7326697 - DNA, 22 bp, Homo sapiens
cagcaaatactactagttttta

SEQ ID NO: 7326698 - DNA, 22 bp, Homo sapiens
agctacagtggacaagtgaact

SEQ ID NO: 7326699 - DNA, 22 bp, Homo sapiens
agctacagttgccctcagcagg

SEQ ID NO: 7326700 - DNA, 22 bp, Homo sapiens
agctacagtcggaaggacagac

SEQ ID NO: 7326701 - DNA, 22 bp, Homo sapiens
agctacagggaactaaaagcta

SEQ ID NO: 7326702 - DNA, 22 bp, Homo sapiens
agctacagctgtactctgcagg

SEQ ID NO: 7326703 - DNA, 19 bp, Homo sapiens
agctacagcatggcgaggt

SEQ ID NO: 7326704 - DNA, 22 bp, Homo sapiens
agctacagatgagcccagtatc

SEQ ID NO: 7326705 - DNA, 22 bp, Homo sapiens
agcctggtttaagcattttata

SEQ ID NO: 7326706 - DNA, 22 bp, Homo sapiens
agctaggaaattgaggctgaga

SEQ ID NO: 7326707 - DNA, 22 bp, Homo sapiens
agctcctgggcacctctttcac

SEQ ID NO: 7326708 - DNA, 22 bp, Homo sapiens
agctctgttactgattttcctg

SEQ ID NO: 7326709 - DNA, 20 bp, Homo sapiens
agctcttactttgcagcagc

SEQ ID NO: 7326710 - DNA, 22 bp, Homo sapiens
aaggactgaataattctctttc

SEQ ID NO: 7326711 - DNA, 22 bp, Homo sapiens
aaggactctccagctagcaaat

SEQ ID NO: 7326712 - DNA, 22 bp, Homo sapiens
aaggagaaggcatcattcaagt

SEQ ID NO: 7326713 - DNA, 22 bp, Homo sapiens
aaattgtggcgtctgtaagagt

SEQ ID NO: 7326714 - DNA, 22 bp, Homo sapiens
aaatttaaaaagcagcattgca

SEQ ID NO: 7326715 - DNA, 22 bp, Homo sapiens
aaattataggtgccaccttgga

SEQ ID NO: 7326716 - DNA, 22 bp, Homo sapiens
aaattagtcatgttgtattact

SEQ ID NO: 7326717 - DNA, 22 bp, Homo sapiens
aaatgttttgctcccatgtggt

SEQ ID NO: 7326718 - DNA, 22 bp, Homo sapiens
aagctgtagaggcagtacattt

SEQ ID NO: 7326719 - DNA, 22 bp, Homo sapiens
aagggaggaggatttattgtac

SEQ ID NO: 7326720 - DNA, 22 bp, Homo sapiens
aagggaggccagaggttttgca

SEQ ID NO: 7326721 - DNA, 22 bp, Homo sapiens
aacaatcaagtttctaaatgac

SEQ ID NO: 7326722 - DNA, 22 bp, Homo sapiens
aacaagcagatgcaatgcactt

SEQ ID NO: 7326723 - DNA, 22 bp, Homo sapiens
aaatttcaagcaaagtagctat

SEQ ID NO: 7326724 - DNA, 22 bp, Homo sapiens
aacataaatttgaagtggcaaa

SEQ ID NO: 7326725 - DNA, 22 bp, Homo sapiens
aacatgttgctttaataatatt

SEQ ID NO: 7326726 - DNA, 22 bp, Homo sapiens
aacattgccatggttaatttta

SEQ ID NO: 7326727 - DNA, 22 bp, Homo sapiens
aacatttcagcacctgattcct

SEQ ID NO: 7326728 - DNA, 22 bp, Homo sapiens
aactcatttgcatttttcctgt

SEQ ID NO: 7326729 - DNA, 22 bp, Homo sapiens
aactcatcccagtttgaccgga

SEQ ID NO: 7326730 - DNA, 22 bp, Homo sapiens
aactcatctgggtgagtttgtc

SEQ ID NO: 7326731 - DNA, 22 bp, Homo sapiens
aactcatcttcgagtgaggctg

SEQ ID NO: 7326732 - DNA, 22 bp, Homo sapiens
aactccaggcagggaggccact

SEQ ID NO: 7326733 - DNA, 20 bp, Homo sapiens
aaccaggatagaccagggaa

SEQ ID NO: 7326734 - DNA, 21 bp, Homo sapiens
aagtcaatacagataagtctt

SEQ ID NO: 7326735 - DNA, 22 bp, Homo sapiens
aacactgagggaaaagagatag

SEQ ID NO: 7326736 - DNA, 22 bp, Homo sapiens
aacactggaagggacatcaagt

SEQ ID NO: 7326737 - DNA, 22 bp, Homo sapiens
aacactggtttggcattagatg

SEQ ID NO: 7326738 - DNA, 22 bp, Homo sapiens
aacactgtaacagcatcatttt

SEQ ID NO: 7326739 - DNA, 22 bp, Homo sapiens
acaagaaaggtaggattcaggt

SEQ ID NO: 7326740 - DNA, 22 bp, Homo sapiens
acaacaaaatcactagtcttcc

SEQ ID NO: 7326741 - DNA, 22 bp, Homo sapiens
aagacacagcgaaatgttcctg

SEQ ID NO: 7326742 - DNA, 22 bp, Homo sapiens
acaactgtcttcttcatgctcc

SEQ ID NO: 7326743 - DNA, 22 bp, Homo sapiens
aagacaatgcattactaagaag

SEQ ID NO: 7326744 - DNA, 22 bp, Homo sapiens
aagacaatcctggacagtcagc

SEQ ID NO: 7326745 - DNA, 22 bp, Homo sapiens
aagacaagccttgtttttctgc

SEQ ID NO: 7326746 - DNA, 17 bp, Homo sapiens
aagacaagacaaatgca

SEQ ID NO: 7326747 - DNA, 22 bp, Homo sapiens
aatgttattacacttgtgaaat

SEQ ID NO: 7326748 - DNA, 22 bp, Homo sapiens
aactttctaattttggctgagc

SEQ ID NO: 7326749 - DNA, 22 bp, Homo sapiens
aatgtattctgggaaaatgtta

SEQ ID NO: 7326750 - DNA, 22 bp, Homo sapiens
aactcttcttataatgcgtgat

SEQ ID NO: 7326751 - DNA, 22 bp, Homo sapiens
aactctatttaccctactaaac

SEQ ID NO: 7326752 - DNA, 22 bp, Homo sapiens
aactctatttaccctactaaac

SEQ ID NO: 7326753 - DNA, 22 bp, Homo sapiens
aatgtcaacacaagagaaatgc

SEQ ID NO: 7326754 - DNA, 22 bp, Homo sapiens
aatgtctttaaagtgcaataga

SEQ ID NO: 7326755 - DNA, 22 bp, Homo sapiens
aagacatttatttgaatcaatt

SEQ ID NO: 7326756 - DNA, 22 bp, Homo sapiens
aagaggaggattgatgtgggag

SEQ ID NO: 7326757 - DNA, 22 bp, Homo sapiens
aagaggaagtctccatggagag

SEQ ID NO: 7326758 - DNA, 21 bp, Homo sapiens
aagaggaagcattatggcata

SEQ ID NO: 7326759 - DNA, 22 bp, Homo sapiens
aagaggagtagatgtggttggt

SEQ ID NO: 7326760 - DNA, 23 bp, Homo sapiens
aagaggaggccctgctcccgtcc

SEQ ID NO: 7326761 - DNA, 22 bp, Homo sapiens
aagaggagggcagattcaaggc

SEQ ID NO: 7326762 - DNA, 22 bp, Homo sapiens
aagaggtgagaagctacactta

SEQ ID NO: 7326763 - DNA, 20 bp, Homo sapiens
aagaggtgataacaggtgag

SEQ ID NO: 7326764 - DNA, 20 bp, Homo sapiens
aagaggtgataacaggtgag

SEQ ID NO: 7326765 - DNA, 22 bp, Homo sapiens
aagaggttattgttcccagctt

SEQ ID NO: 7326766 - DNA, 22 bp, Homo sapiens
aagagtttaattttgtctagac

SEQ ID NO: 7326767 - DNA, 22 bp, Homo sapiens
acactagagagcaggcattccc

SEQ ID NO: 7326768 - DNA, 22 bp, Homo sapiens
acactaaggttggagtcacagt

SEQ ID NO: 7326769 - DNA, 22 bp, Homo sapiens
acacatttctcccagtctccat

SEQ ID NO: 7326770 - DNA, 22 bp, Homo sapiens
acacatttctctttttgtaagt

SEQ ID NO: 7326771 - DNA, 22 bp, Homo sapiens
aagcacatttggaaaacatgga

SEQ ID NO: 7326772 - DNA, 22 bp, Homo sapiens
acagatgaatttatggatggaa

SEQ ID NO: 7326773 - DNA, 22 bp, Homo sapiens
aagcaaagacagtttgagtgga

SEQ ID NO: 7326774 - DNA, 19 bp, Homo sapiens
aagatttggtcattgataa

SEQ ID NO: 7326775 - DNA, 22 bp, Homo sapiens
aagatactgatgatgtaggcta

SEQ ID NO: 7326776 - DNA, 22 bp, Homo sapiens
acagaagaaagggaggttttgc

SEQ ID NO: 7326777 - DNA, 22 bp, Homo sapiens
aacatttcattggaagctatgt

SEQ ID NO: 7326778 - DNA, 22 bp, Homo sapiens
aacatttcataacttgactttt

SEQ ID NO: 7326779 - DNA, 22 bp, Homo sapiens
aacatttctgagaatatcagtt

SEQ ID NO: 7326780 - DNA, 22 bp, Homo sapiens
aacattcaagttctggtttatg

SEQ ID NO: 7326781 - DNA, 22 bp, Homo sapiens
aacagtcaaagtttggttcctt

SEQ ID NO: 7326782 - DNA, 22 bp, Homo sapiens
aacagtagtggtcaatatgcca

SEQ ID NO: 7326783 - DNA, 22 bp, Homo sapiens
aacatttcttctgaaactgagt

SEQ ID NO: 7326784 - DNA, 22 bp, Homo sapiens
aactatgttaataagtttcatt

SEQ ID NO: 7326785 - DNA, 22 bp, Homo sapiens
aactcactttgtggcttctgaa

SEQ ID NO: 7326786 - DNA, 22 bp, Homo sapiens
aactcagatatgatagcaggag

SEQ ID NO: 7326787 - DNA, 23 bp, Homo sapiens
aactgagataatgtatgtaaagc

SEQ ID NO: 7326788 - DNA, 22 bp, Homo sapiens
aacacaaagaagctgcaggatc

SEQ ID NO: 7326789 - DNA, 22 bp, Homo sapiens
aacaatgttcttttagcttgaa

SEQ ID NO: 7326790 - DNA, 22 bp, Homo sapiens
aacaatgtgattgaagctagaa

SEQ ID NO: 7326791 - DNA, 22 bp, Homo sapiens
aacaatgtgttcagcactgtgg

SEQ ID NO: 7326792 - DNA, 22 bp, Homo sapiens
aacaaatgtgttttgtaattaa

SEQ ID NO: 7326793 - DNA, 22 bp, Homo sapiens
aagaatgttcttgtagtcatga

SEQ ID NO: 7326794 - DNA, 22 bp, Homo sapiens
aagagcatggaatggagatcca

SEQ ID NO: 7326795 - DNA, 22 bp, Homo sapiens
aagagcatttaattaggagagt

SEQ ID NO: 7326796 - DNA, 22 bp, Homo sapiens
aagaggacttgtgaagatgtac

SEQ ID NO: 7326797 - DNA, 22 bp, Homo sapiens
aagaggagaaaggctggctttg

SEQ ID NO: 7326798 - DNA, 22 bp, Homo sapiens
aactttctttgcatctaagttt

SEQ ID NO: 7326799 - DNA, 22 bp, Homo sapiens
aagcaaattggatgtctgtgag

SEQ ID NO: 7326800 - DNA, 22 bp, Homo sapiens
aagcaaaggcaggagcttgtga

SEQ ID NO: 7326801 - DNA, 22 bp, Homo sapiens
aagcaaagtgctttgcctccag

SEQ ID NO: 7326802 - DNA, 22 bp, Homo sapiens
aagcaaagtgaattttgccaag

SEQ ID NO: 7326803 - DNA, 22 bp, Homo sapiens
aagcaaaggaaagctgactttt

SEQ ID NO: 7326804 - DNA, 22 bp, Homo sapiens
aagcaaagagtttagtgggtga

SEQ ID NO: 7326805 - DNA, 22 bp, Homo sapiens
aagcaaagagataaccttttgg

SEQ ID NO: 7326806 - DNA, 18 bp, Homo sapiens
aagaggaggagcaggttg

SEQ ID NO: 7326807 - DNA, 18 bp, Homo sapiens
aagaggaggagcaggttg

SEQ ID NO: 7326808 - DNA, 18 bp, Homo sapiens
aagaggaggaaacccagg

SEQ ID NO: 7326809 - DNA, 22 bp, Homo sapiens
aagaggaggacggttcccagaa

SEQ ID NO: 7326810 - DNA, 22 bp, Homo sapiens
aagaggagacttcagcaacttg

SEQ ID NO: 7326811 - DNA, 22 bp, Homo sapiens
aagaggagacttcagcaacttg

SEQ ID NO: 7326812 - DNA, 22 bp, Homo sapiens
aagcacagctggaacagcagga

SEQ ID NO: 7326813 - DNA, 22 bp, Homo sapiens
aaatatccataagcacatctat

SEQ ID NO: 7326814 - DNA, 22 bp, Homo sapiens
aaatatcatttataacttttaa

SEQ ID NO: 7326815 - DNA, 22 bp, Homo sapiens
aaatatcattctggtgcacaga

SEQ ID NO: 7326816 - DNA, 22 bp, Homo sapiens
aagccaccctggctgcacatgc

SEQ ID NO: 7326817 - DNA, 22 bp, Homo sapiens
aaagaagatggagacctgacta

SEQ ID NO: 7326818 - DNA, 22 bp, Homo sapiens
aaagaagagctggaaggagtct

SEQ ID NO: 7326819 - DNA, 22 bp, Homo sapiens
aaagatctatgggcatttagct

SEQ ID NO: 7326820 - DNA, 22 bp, Homo sapiens
aaacatgagcacttgcttcata

SEQ ID NO: 7326821 - DNA, 22 bp, Homo sapiens
aaacaactcggcaactgctttt

SEQ ID NO: 7326822 - DNA, 22 bp, Homo sapiens
aaacaagagcttacatggctgc

SEQ ID NO: 7326823 - DNA, 22 bp, Homo sapiens
aaacaaatagtgcatgggaatt

SEQ ID NO: 7326824 - DNA, 22 bp, Homo sapiens
aaacaaatttcaagctgtgaca

SEQ ID NO: 7326825 - DNA, 22 bp, Homo sapiens
aaaatagatgaaaggaagtctg

SEQ ID NO: 7326826 - DNA, 22 bp, Homo sapiens
aaaagtattttggatctcagat

SEQ ID NO: 7326827 - DNA, 22 bp, Homo sapiens
aaaagtattttgagcactttat

SEQ ID NO: 7326828 - DNA, 22 bp, Homo sapiens
aaaaatgtcattatggaactga

SEQ ID NO: 7326829 - DNA, 22 bp, Homo sapiens
aaaaatgaattcttcagtggca

SEQ ID NO: 7326830 - DNA, 22 bp, Homo sapiens
aaatagaattggaagcagagtt

SEQ ID NO: 7326831 - DNA, 22 bp, Homo sapiens
aaatacagattccagggtctta

SEQ ID NO: 7326832 - DNA, 22 bp, Homo sapiens
aaatcagttgttatattaaaga

SEQ ID NO: 7326833 - DNA, 23 bp, Homo sapiens
aaatggccaaggttaaaaataca

SEQ ID NO: 7326834 - DNA, 22 bp, Homo sapiens
aaacactgtacaatctgcaggg

SEQ ID NO: 7326835 - DNA, 22 bp, Homo sapiens
aaacactgtctctggtattgaa

SEQ ID NO: 7326836 - DNA, 22 bp, Homo sapiens
aaagtgcatagagtagtgccta

SEQ ID NO: 7326837 - DNA, 22 bp, Homo sapiens
aaagtgcatcaaatgacttccc

SEQ ID NO: 7326838 - DNA, 22 bp, Homo sapiens
aaagtgcattgtttgtgttcct

SEQ ID NO: 7326839 - DNA, 22 bp, Homo sapiens
aaagcaatgcccgttcattatc

SEQ ID NO: 7326840 - DNA, 21 bp, Homo sapiens
agaaaatggcgttttagattt

SEQ ID NO: 7326841 - DNA, 22 bp, Homo sapiens
acttcctgcagcttctcagccc

SEQ ID NO: 7326842 - DNA, 22 bp, Homo sapiens
aatatgaattattgttacaagt

SEQ ID NO: 7326843 - DNA, 22 bp, Homo sapiens
acttatctgcaattagtacata

SEQ ID NO: 7326844 - DNA, 23 bp, Homo sapiens
actcatccttgatttgcagatgt

SEQ ID NO: 7326845 - DNA, 20 bp, Homo sapiens
actcatctactccagaccct

SEQ ID NO: 7326846 - DNA, 22 bp, Homo sapiens
actcatctgactggtgggaatg

SEQ ID NO: 7326847 - DNA, 19 bp, Homo sapiens
actcatctgccacctctgt

SEQ ID NO: 7326848 - DNA, 22 bp, Homo sapiens
actcatctattagatatctgtt

SEQ ID NO: 7326849 - DNA, 22 bp, Homo sapiens
actcatctgaaaaatgaggaga

SEQ ID NO: 7326850 - DNA, 22 bp, Homo sapiens
actcatgtaagcggaatgtagt

SEQ ID NO: 7326851 - DNA, 22 bp, Homo sapiens
actcatgtcctaggagtaaagc

SEQ ID NO: 7326852 - DNA, 22 bp, Homo sapiens
actcatcttccctcctggaggg

SEQ ID NO: 7326853 - DNA, 22 bp, Homo sapiens
actcatctgccattcctgtacc

SEQ ID NO: 7326854 - DNA, 23 bp, Homo sapiens
actcatcttctggtatccacagt

SEQ ID NO: 7326855 - DNA, 21 bp, Homo sapiens
actcatctttttggagaccag

SEQ ID NO: 7326856 - DNA, 19 bp, Homo sapiens
actcatctttccagaatat

SEQ ID NO: 7326857 - DNA, 22 bp, Homo sapiens
actcatctttgaattttcagta

SEQ ID NO: 7326858 - DNA, 22 bp, Homo sapiens
aagttttaacaagtacttacta

SEQ ID NO: 7326859 - DNA, 21 bp, Homo sapiens
aagttttatgttgccatttgt

SEQ ID NO: 7326860 - DNA, 22 bp, Homo sapiens
actgagaaatagcaagtgtctc

SEQ ID NO: 7326861 - DNA, 22 bp, Homo sapiens
actgagaagctcgcagtgatgc

SEQ ID NO: 7326862 - DNA, 22 bp, Homo sapiens
actgagactgcccctgtaacaa

SEQ ID NO: 7326863 - DNA, 22 bp, Homo sapiens
actgagaatacaatgttgcagg

SEQ ID NO: 7326864 - DNA, 19 bp, Homo sapiens
accttctgggaaacattcc

SEQ ID NO: 7326865 - DNA, 20 bp, Homo sapiens
acctggcttgggggaggagt

SEQ ID NO: 7326866 - DNA, 22 bp, Homo sapiens
acctggctttggggataggctt

SEQ ID NO: 7326867 - DNA, 22 bp, Homo sapiens
acctggcttcagagtctggcca

SEQ ID NO: 7326868 - DNA, 22 bp, Homo sapiens
acctggcttccaatctaggagc

SEQ ID NO: 7326869 - DNA, 22 bp, Homo sapiens
acctttatatgaaagatgacat

SEQ ID NO: 7326870 - DNA, 22 bp, Homo sapiens
acctttatcgccatcattgtgc

SEQ ID NO: 7326871 - DNA, 22 bp, Homo sapiens
acctttatagcaacctggtgaa

SEQ ID NO: 7326872 - DNA, 22 bp, Homo sapiens
aagtgcaaatttaagaaggcat

SEQ ID NO: 7326873 - DNA, 22 bp, Homo sapiens
aagtgagtcacaagtttgcttt

SEQ ID NO: 7326874 - DNA, 22 bp, Homo sapiens
aaggtttccagtgatattgtgg

SEQ ID NO: 7326875 - DNA, 22 bp, Homo sapiens
acaggaaccaggcaggtcgatt

SEQ ID NO: 7326876 - DNA, 22 bp, Homo sapiens
acaggaacagcttgatggcatc

SEQ ID NO: 7326877 - DNA, 22 bp, Homo sapiens
acaggagaccctgctggttctg

SEQ ID NO: 7326878 - DNA, 22 bp, Homo sapiens
acaggagcaacagactaagaca

SEQ ID NO: 7326879 - DNA, 22 bp, Homo sapiens
acaggtagatacatacttctaa

SEQ ID NO: 7326880 - DNA, 22 bp, Homo sapiens
acaggtaggttaaaatgtgtca

SEQ ID NO: 7326881 - DNA, 23 bp, Homo sapiens
acagggcttatctgtcactcatc

SEQ ID NO: 7326882 - DNA, 22 bp, Homo sapiens
acaggctgaggatgattgcatc

SEQ ID NO: 7326883 - DNA, 22 bp, Homo sapiens
acaggctgacttcctgccatgt

SEQ ID NO: 7326884 - DNA, 22 bp, Homo sapiens
acaggctgccacttgcatccaa

SEQ ID NO: 7326885 - DNA, 22 bp, Homo sapiens
acaggctgccacttgcatccaa

SEQ ID NO: 7326886 - DNA, 22 bp, Homo sapiens
acaggctgatagaccataaata

SEQ ID NO: 7326887 - DNA, 22 bp, Homo sapiens
acagtgtccccagctctgtgag

SEQ ID NO: 7326888 - DNA, 22 bp, Homo sapiens
acagtgcattattgctgaatgc

SEQ ID NO: 7326889 - DNA, 20 bp, Homo sapiens
acagtgcatggggggacagc

SEQ ID NO: 7326890 - DNA, 22 bp, Homo sapiens
acagtgcagtgtgatgagtatt

SEQ ID NO: 7326891 - DNA, 22 bp, Homo sapiens
acaaaaaccgtggattcagcat

SEQ ID NO: 7326892 - DNA, 22 bp, Homo sapiens
aattttgttttagtggaggctg

SEQ ID NO: 7326893 - DNA, 22 bp, Homo sapiens
agaggtggccatgggcgctgga

SEQ ID NO: 7326894 - DNA, 22 bp, Homo sapiens
agaggtgggagcctggtcacat

SEQ ID NO: 7326895 - DNA, 22 bp, Homo sapiens
agaggttcagagaaggcgatct

SEQ ID NO: 7326896 - DNA, 22 bp, Homo sapiens
agattacagaagaataagtaga

SEQ ID NO: 7326897 - DNA, 22 bp, Homo sapiens
agattacaacatgggacgcata

SEQ ID NO: 7326898 - DNA, 21 bp, Homo sapiens
agattacaggtgtgatccacc

SEQ ID NO: 7326899 - DNA, 22 bp, Homo sapiens
agattacagcatgggaatggga

SEQ ID NO: 7326900 - DNA, 20 bp, Homo sapiens
agattaggggctttcttctt

SEQ ID NO: 7326901 - DNA, 22 bp, Homo sapiens
agattacaaatcctctgtgttt

SEQ ID NO: 7326902 - DNA, 22 bp, Homo sapiens
agatgttttagagtttgacttg

SEQ ID NO: 7326903 - DNA, 20 bp, Homo sapiens
agatgttttgaagtcttgga

SEQ ID NO: 7326904 - DNA, 22 bp, Homo sapiens
agagggcatgcttggtggcctg

SEQ ID NO: 7326905 - DNA, 21 bp, Homo sapiens
aattttgaaggaagattaagg

SEQ ID NO: 7326906 - DNA, 22 bp, Homo sapiens
aatttcaagtggcatctttgat

SEQ ID NO: 7326907 - DNA, 22 bp, Homo sapiens
aatttcaaagctcactggcata

SEQ ID NO: 7326908 - DNA, 22 bp, Homo sapiens
aatttcaaactcttgccctcag

SEQ ID NO: 7326909 - DNA, 22 bp, Homo sapiens
agaggcagtatacaatccgagc

SEQ ID NO: 7326910 - DNA, 21 bp, Homo sapiens
agaggcaggcattaagtacac

SEQ ID NO: 7326911 - DNA, 19 bp, Homo sapiens
agaggcagtctccaacagg

SEQ ID NO: 7326912 - DNA, 22 bp, Homo sapiens
agaatttcaaaaggaagccagc

SEQ ID NO: 7326913 - DNA, 23 bp, Homo sapiens
agaatttcaaagtccagcacatt

SEQ ID NO: 7326914 - DNA, 22 bp, Homo sapiens
aatgtataaagtgttaataact

SEQ ID NO: 7326915 - DNA, 19 bp, Homo sapiens
aatggacaggcaatagtct

SEQ ID NO: 7326916 - DNA, 22 bp, Homo sapiens
agagatcaaagcttgccaagta

SEQ ID NO: 7326917 - DNA, 22 bp, Homo sapiens
agagatctctgaagctgctgct

SEQ ID NO: 7326918 - DNA, 22 bp, Homo sapiens
aattcacagaaccatggtgctc

SEQ ID NO: 7326919 - DNA, 22 bp, Homo sapiens
agagagttgtatgtttctaaaa

SEQ ID NO: 7326920 - DNA, 22 bp, Homo sapiens
agagaaagtaaagattctacct

SEQ ID NO: 7326921 - DNA, 22 bp, Homo sapiens
acagacatatttggcccatagc

SEQ ID NO: 7326922 - DNA, 22 bp, Homo sapiens
acagacatctatccatttaatt

SEQ ID NO: 7326923 - DNA, 16 bp, Homo sapiens
acagacatgagtgagc

SEQ ID NO: 7326924 - DNA, 22 bp, Homo sapiens
acagacatcatcaacatcttcc

SEQ ID NO: 7326925 - DNA, 22 bp, Homo sapiens
agcatcctgcttgctgtctgtg

SEQ ID NO: 7326926 - DNA, 22 bp, Homo sapiens
agcattcatgatgacaacagga

SEQ ID NO: 7326927 - DNA, 22 bp, Homo sapiens
agcattccagtgcacagtagaa

SEQ ID NO: 7326928 - DNA, 22 bp, Homo sapiens
agccttagaggaaaacattagt

SEQ ID NO: 7326929 - DNA, 22 bp, Homo sapiens
agcctgtgggagccgctcccgt

SEQ ID NO: 7326930 - DNA, 22 bp, Homo sapiens
agcctgtgtgaagccctcagag

SEQ ID NO: 7326931 - DNA, 22 bp, Homo sapiens
agcctgtgctgtgtttgctcca

SEQ ID NO: 7326932 - DNA, 22 bp, Homo sapiens
agctcattgaagtcatgacctg

SEQ ID NO: 7326933 - DNA, 22 bp, Homo sapiens
agccctgccattctctggagct

SEQ ID NO: 7326934 - DNA, 22 bp, Homo sapiens
agccctgcaggaggtgggagag

SEQ ID NO: 7326935 - DNA, 22 bp, Homo sapiens
acagacatggaccaagcactgt

SEQ ID NO: 7326936 - DNA, 22 bp, Homo sapiens
acagacatgctgtttgggtggt

SEQ ID NO: 7326937 - DNA, 22 bp, Homo sapiens
agatttctctttccctggctga

SEQ ID NO: 7326938 - DNA, 21 bp, Homo sapiens
acacactgagttttccactgt

SEQ ID NO: 7326939 - DNA, 21 bp, Homo sapiens
agcagcaaccacatagttttt

SEQ ID NO: 7326940 - DNA, 21 bp, Homo sapiens
agcagccatttcacagagact

SEQ ID NO: 7326941 - DNA, 22 bp, Homo sapiens
agcagccatccttagagaaaga

SEQ ID NO: 7326942 - DNA, 22 bp, Homo sapiens
agcagccagtgggagtgataca

SEQ ID NO: 7326943 - DNA, 22 bp, Homo sapiens
agcagttatattgaaataaaaa

SEQ ID NO: 7326944 - DNA, 22 bp, Homo sapiens
tcagtttgctcataggtgaggg

SEQ ID NO: 7326945 - DNA, 22 bp, Homo sapiens
tcataaaagtactcatgttcat

SEQ ID NO: 7326946 - DNA, 22 bp, Homo sapiens
tcataaacacactagtatgatt

SEQ ID NO: 7326947 - DNA, 22 bp, Homo sapiens
tcataaacaaaacagtttatgc

SEQ ID NO: 7326948 - DNA, 22 bp, Homo sapiens
tcataaactcactagtttatgt

SEQ ID NO: 7326949 - DNA, 22 bp, Homo sapiens
tcatccaaggagaccttgcaga

SEQ ID NO: 7326950 - DNA, 22 bp, Homo sapiens
tcatctaagagtcttacattta

SEQ ID NO: 7326951 - DNA, 22 bp, Homo sapiens
tcatcgtgctgctctgtccata

SEQ ID NO: 7326952 - DNA, 22 bp, Homo sapiens
tcaggcctttgaacttggagtg

SEQ ID NO: 7326953 - DNA, 22 bp, Homo sapiens
tcagggcacattctgcagtggc

SEQ ID NO: 7326954 - DNA, 20 bp, Homo sapiens
tcaggtagatctttgaggtc

SEQ ID NO: 7326955 - DNA, 22 bp, Homo sapiens
tcaggtagtggttaagttctgt

SEQ ID NO: 7326956 - DNA, 22 bp, Homo sapiens
tcagtgcagtgaaaggtttact

SEQ ID NO: 7326957 - DNA, 22 bp, Homo sapiens
tcagtgcattaataatatcagt

SEQ ID NO: 7326958 - DNA, 22 bp, Homo sapiens
tcagtgcatggacagatttaga

SEQ ID NO: 7326959 - DNA, 22 bp, Homo sapiens
tcagggcacgtttctgcaatgc

SEQ ID NO: 7326960 - DNA, 22 bp, Homo sapiens
tcaggagctgcactgggcccac

SEQ ID NO: 7326961 - DNA, 22 bp, Homo sapiens
tcaggagctcaggctgatggaa

SEQ ID NO: 7326962 - DNA, 22 bp, Homo sapiens
tcaggagcctgaaagaggtcta

SEQ ID NO: 7326963 - DNA, 22 bp, Homo sapiens
tcaggagcaggttgtttggttt

SEQ ID NO: 7326964 - DNA, 22 bp, Homo sapiens
tcaggagcatatattgatgtct

SEQ ID NO: 7326965 - DNA, 22 bp, Homo sapiens
tcaggaaatggaattcttgtgt

SEQ ID NO: 7326966 - DNA, 22 bp, Homo sapiens
tcaggaaatggcttcatggttt

SEQ ID NO: 7326967 - DNA, 22 bp, Homo sapiens
tcaggaaatggacatctttgct

SEQ ID NO: 7326968 - DNA, 22 bp, Homo sapiens
tcaggaaattaaacacttgaaa

SEQ ID NO: 7326969 - DNA, 22 bp, Homo sapiens
tcaggaaatggtgatttggttg

SEQ ID NO: 7326970 - DNA, 22 bp, Homo sapiens
tcaggaaatgtcccaggttgtg

SEQ ID NO: 7326971 - DNA, 22 bp, Homo sapiens
tcaggagcagccttggagagcg

SEQ ID NO: 7326972 - DNA, 22 bp, Homo sapiens
tcaggagcagcatgggtgagag

SEQ ID NO: 7326973 - DNA, 22 bp, Homo sapiens
tcaggaaagcctagaagagaac

SEQ ID NO: 7326974 - DNA, 22 bp, Homo sapiens
tcaggaaagctgcggtcacctg

SEQ ID NO: 7326975 - DNA, 22 bp, Homo sapiens
tcaggaaaggcagagtgtctgt

SEQ ID NO: 7326976 - DNA, 22 bp, Homo sapiens
tcaggaaatacaagtgacatca

SEQ ID NO: 7326977 - DNA, 22 bp, Homo sapiens
tcaggaaagtgttctcagagga

SEQ ID NO: 7326978 - DNA, 22 bp, Homo sapiens
tcaggaaaggtttgttgaatgg

SEQ ID NO: 7326979 - DNA, 22 bp, Homo sapiens
tcaggaaagagtgtatccatca

SEQ ID NO: 7326980 - DNA, 22 bp, Homo sapiens
tcaggaaagagttagatgatta

SEQ ID NO: 7326981 - DNA, 19 bp, Homo sapiens
tcaggaggtcgacctggca

SEQ ID NO: 7326982 - DNA, 22 bp, Homo sapiens
tcaggaggtccgcccgggaggg

SEQ ID NO: 7326983 - DNA, 22 bp, Homo sapiens
tcagccagttgccccagttagt

SEQ ID NO: 7326984 - DNA, 22 bp, Homo sapiens
tcagccagttgccccagttagt

SEQ ID NO: 7326985 - DNA, 22 bp, Homo sapiens
tcagccagttaaggcttagaca

SEQ ID NO: 7326986 - DNA, 22 bp, Homo sapiens
tcagccagtgccttgatcttgc

SEQ ID NO: 7326987 - DNA, 22 bp, Homo sapiens
tcagccagtgtgcacctggagt

SEQ ID NO: 7326988 - DNA, 22 bp, Homo sapiens
tcagaggcttctgctcacctca

SEQ ID NO: 7326989 - DNA, 22 bp, Homo sapiens
tcagaggtaaaaactcactgta

SEQ ID NO: 7326990 - DNA, 22 bp, Homo sapiens
tcagccagtatttgagtgctca

SEQ ID NO: 7326991 - DNA, 22 bp, Homo sapiens
tcagccaggtaatgtggagatg

SEQ ID NO: 7326992 - DNA, 22 bp, Homo sapiens
tcagccagggggagagaatgga

SEQ ID NO: 7326993 - DNA, 22 bp, Homo sapiens
tcagagtcctcaccctgaggat

SEQ ID NO: 7326994 - DNA, 20 bp, Homo sapiens
tcaaaataggtgtgggcgga

SEQ ID NO: 7326995 - DNA, 18 bp, Homo sapiens
tcaaaatatttctgtgga

SEQ ID NO: 7326996 - DNA, 22 bp, Homo sapiens
tcaattctgcatacatttcact

SEQ ID NO: 7326997 - DNA, 22 bp, Homo sapiens
tcaattctgcctctaaatattt

SEQ ID NO: 7326998 - DNA, 22 bp, Homo sapiens
tcaccgaggctggagtgcagtg

SEQ ID NO: 7326999 - DNA, 20 bp, Homo sapiens
tcacctaaaccagcagtttc

SEQ ID NO: 7327000 - DNA, 22 bp, Homo sapiens
tcagaggacaagctccctggtg

SEQ ID NO: 7327001 - DNA, 22 bp, Homo sapiens
tcagaacatcctggtttaaaat

SEQ ID NO: 7327002 - DNA, 22 bp, Homo sapiens
tccctgggcttctccagacttg

SEQ ID NO: 7327003 - DNA, 22 bp, Homo sapiens
tccctggggaagggcaagcaag

SEQ ID NO: 7327004 - DNA, 22 bp, Homo sapiens
tccctggggcagtggctcggag

SEQ ID NO: 7327005 - DNA, 22 bp, Homo sapiens
tccctggggatgttggcctgcc

SEQ ID NO: 7327006 - DNA, 22 bp, Homo sapiens
tccctgggcctatcttagctcc

SEQ ID NO: 7327007 - DNA, 22 bp, Homo sapiens
tccctgggcctcctgctatgca

SEQ ID NO: 7327008 - DNA, 22 bp, Homo sapiens
tccctgggcggacattctccca

SEQ ID NO: 7327009 - DNA, 22 bp, Homo sapiens
tccctgtggaagactgccagag

SEQ ID NO: 7327010 - DNA, 22 bp, Homo sapiens
tccctgtggatatctgcagctg

SEQ ID NO: 7327011 - DNA, 20 bp, Homo sapiens
tccctggggccctacttcct

SEQ ID NO: 7327012 - DNA, 22 bp, Homo sapiens
tcccaggatgtttatggctggt

SEQ ID NO: 7327013 - DNA, 22 bp, Homo sapiens
tcccaggattttaggctctcag

SEQ ID NO: 7327014 - DNA, 22 bp, Homo sapiens
tccctgggcaagtttactcttc

SEQ ID NO: 7327015 - DNA, 22 bp, Homo sapiens
tccctgggcacaatctgctggc

SEQ ID NO: 7327016 - DNA, 22 bp, Homo sapiens
tccctgggcatcacgttgcttc

SEQ ID NO: 7327017 - DNA, 22 bp, Homo sapiens
tccctgggccacagctgtgagc

SEQ ID NO: 7327018 - DNA, 23 bp, Homo sapiens
tccctgggcccgtgccagcggtg

SEQ ID NO: 7327019 - DNA, 22 bp, Homo sapiens
tcctcatctcggaacctgccac

SEQ ID NO: 7327020 - DNA, 22 bp, Homo sapiens
tcctcagtctctcaaatgaggc

SEQ ID NO: 7327021 - DNA, 22 bp, Homo sapiens
tcctcagttttctagtatggca

SEQ ID NO: 7327022 - DNA, 22 bp, Homo sapiens
tcctcatcaataaaatcaggat

SEQ ID NO: 7327023 - DNA, 18 bp, Homo sapiens
tcatggctttagtccctc

SEQ ID NO: 7327024 - DNA, 22 bp, Homo sapiens
tcatgtgtcctagttcatataa

SEQ ID NO: 7327025 - DNA, 22 bp, Homo sapiens
tcatgttatcagacacagagta

SEQ ID NO: 7327026 - DNA, 22 bp, Homo sapiens
tcatgtgtgtttcatgtatgga

SEQ ID NO: 7327027 - DNA, 22 bp, Homo sapiens
tcattaaatgtttgttgtgcca

SEQ ID NO: 7327028 - DNA, 22 bp, Homo sapiens
tccacagactattaagtgatct

SEQ ID NO: 7327029 - DNA, 22 bp, Homo sapiens
tccactgtggtcccttgctgcc

SEQ ID NO: 7327030 - DNA, 22 bp, Homo sapiens
tccactgtgcagctctgctgat

SEQ ID NO: 7327031 - DNA, 18 bp, Homo sapiens
tccaccagtcaatctgtc

SEQ ID NO: 7327032 - DNA, 22 bp, Homo sapiens
tccacagggatgttgagttctt

SEQ ID NO: 7327033 - DNA, 22 bp, Homo sapiens
tccaggaacgagaggctgggca

SEQ ID NO: 7327034 - DNA, 21 bp, Homo sapiens
tccaggaatgtctgttcatct

SEQ ID NO: 7327035 - DNA, 22 bp, Homo sapiens
tccaggaatgtgtgtgggctag

SEQ ID NO: 7327036 - DNA, 17 bp, Homo sapiens
tcccaggaacagggaat

SEQ ID NO: 7327037 - DNA, 22 bp, Homo sapiens
tcccagagtttcctgtgtccca

SEQ ID NO: 7327038 - DNA, 19 bp, Homo sapiens
tcccagagtctagaggttg

SEQ ID NO: 7327039 - DNA, 22 bp, Homo sapiens
tcccagagaaagtcaaggtctt

SEQ ID NO: 7327040 - DNA, 22 bp, Homo sapiens
tcccagaatctccagtgctaca

SEQ ID NO: 7327041 - DNA, 21 bp, Homo sapiens
taaacataaccttgtatggct

SEQ ID NO: 7327042 - DNA, 22 bp, Homo sapiens
taaacagagagtgcagttatag

SEQ ID NO: 7327043 - DNA, 22 bp, Homo sapiens
taaacagagaagactttgagca

SEQ ID NO: 7327044 - DNA, 17 bp, Homo sapiens
taaatacacaagggtat

SEQ ID NO: 7327045 - DNA, 17 bp, Homo sapiens
taaatacacaagggtat

SEQ ID NO: 7327046 - DNA, 19 bp, Homo sapiens
taaagttgaaatcaagtcc

SEQ ID NO: 7327047 - DNA, 22 bp, Homo sapiens
taaagaacacagggaatagcac

SEQ ID NO: 7327048 - DNA, 22 bp, Homo sapiens
taagaaactgtcacagtactat

SEQ ID NO: 7327049 - DNA, 22 bp, Homo sapiens
taagataaggaacattctgtga

SEQ ID NO: 7327050 - DNA, 22 bp, Homo sapiens
taagataataagtatgtctatg

SEQ ID NO: 7327051 - DNA, 22 bp, Homo sapiens
taacacagttctctgttgcaca

SEQ ID NO: 7327052 - DNA, 22 bp, Homo sapiens
taaatttttgttaacagcctct

SEQ ID NO: 7327053 - DNA, 22 bp, Homo sapiens
gttaggaatttgttactgtgta

SEQ ID NO: 7327054 - DNA, 22 bp, Homo sapiens
gttaggaacattaatgtgattt

SEQ ID NO: 7327055 - DNA, 22 bp, Homo sapiens
gttataaaggtgataatggtca

SEQ ID NO: 7327056 - DNA, 22 bp, Homo sapiens
gttataaaatgcacagttgttt

SEQ ID NO: 7327057 - DNA, 22 bp, Homo sapiens
gttccaaatttggatctttagg

SEQ ID NO: 7327058 - DNA, 22 bp, Homo sapiens
gtgtgttcagcaagaggtaagg

SEQ ID NO: 7327059 - DNA, 22 bp, Homo sapiens
gttcctttgtttagcagagaca

SEQ ID NO: 7327060 - DNA, 22 bp, Homo sapiens
gttcctttcctatttggataag

SEQ ID NO: 7327061 - DNA, 22 bp, Homo sapiens
gtttctctttgaagcctggctg

SEQ ID NO: 7327062 - DNA, 22 bp, Homo sapiens
gtttctctgtctgttacattgg

SEQ ID NO: 7327063 - DNA, 22 bp, Homo sapiens
tacagttaagctactggagaat

SEQ ID NO: 7327064 - DNA, 22 bp, Homo sapiens
tacagttactgcatttctaata

SEQ ID NO: 7327065 - DNA, 22 bp, Homo sapiens
tacagttacgctgagaaacgaa

SEQ ID NO: 7327066 - DNA, 22 bp, Homo sapiens
tacagttactgttatatgtgct

SEQ ID NO: 7327067 - DNA, 22 bp, Homo sapiens
tacattcacagttgttcatctc

SEQ ID NO: 7327068 - DNA, 22 bp, Homo sapiens
tacattcatggtgacttgtatg

SEQ ID NO: 7327069 - DNA, 20 bp, Homo sapiens
tacattcaaaacaaactctg

SEQ ID NO: 7327070 - DNA, 22 bp, Homo sapiens
tacattcaacatgtcactatgt

SEQ ID NO: 7327071 - DNA, 21 bp, Homo sapiens
tactgagacctcacagtgtgc

SEQ ID NO: 7327072 - DNA, 22 bp, Homo sapiens
tactgcaaaactactcagtaat

SEQ ID NO: 7327073 - DNA, 22 bp, Homo sapiens
tactgtaagtcaaatgaaacat

SEQ ID NO: 7327074 - DNA, 22 bp, Homo sapiens
tacccagagggagagcaactat

SEQ ID NO: 7327075 - DNA, 21 bp, Homo sapiens
tacgtgtgtgcatgtttatat

SEQ ID NO: 7327076 - DNA, 22 bp, Homo sapiens
taagcaatgagataatcatggg

SEQ ID NO: 7327077 - DNA, 22 bp, Homo sapiens
taagttggctgttgctatagtt

SEQ ID NO: 7327078 - DNA, 22 bp, Homo sapiens
taagttggaaaggctatgaggc

SEQ ID NO: 7327079 - DNA, 22 bp, Homo sapiens
taatgagatcatatcttctgag

SEQ ID NO: 7327080 - DNA, 22 bp, Homo sapiens
taatggattaacgtccctgtcg

SEQ ID NO: 7327081 - DNA, 22 bp, Homo sapiens
taattttacttcctgagcacct

SEQ ID NO: 7327082 - DNA, 22 bp, Homo sapiens
taattttaatagtatgtggcat

SEQ ID NO: 7327083 - DNA, 22 bp, Homo sapiens
taattttaactgtgctgtttgg

SEQ ID NO: 7327084 - DNA, 22 bp, Homo sapiens
taattttatgacagtgtatttt

SEQ ID NO: 7327085 - DNA, 23 bp, Homo sapiens
taattttagccttacaggaccct

SEQ ID NO: 7327086 - DNA, 22 bp, Homo sapiens
tacacattacataatactatct

SEQ ID NO: 7327087 - DNA, 22 bp, Homo sapiens
tacacattacataatactatct

SEQ ID NO: 7327088 - DNA, 22 bp, Homo sapiens
tacacatatgtccattaatcag

SEQ ID NO: 7327089 - DNA, 22 bp, Homo sapiens
tactttctgtccttctgttaaa

SEQ ID NO: 7327090 - DNA, 22 bp, Homo sapiens
tactttctaagacatacaactt

SEQ ID NO: 7327091 - DNA, 22 bp, Homo sapiens
tagaggagcggcgagctgagct

SEQ ID NO: 7327092 - DNA, 23 bp, Homo sapiens
tagaggaggatgtgatgcatatt

SEQ ID NO: 7327093 - DNA, 22 bp, Homo sapiens
tagaggagagttgctggatgga

SEQ ID NO: 7327094 - DNA, 22 bp, Homo sapiens
tagaggaggcaaggccctccct

SEQ ID NO: 7327095 - DNA, 22 bp, Homo sapiens
tagaggagggctgttcttcagt

SEQ ID NO: 7327096 - DNA, 22 bp, Homo sapiens
tagaggaggtgattcttgagct

SEQ ID NO: 7327097 - DNA, 22 bp, Homo sapiens
tagagcaatgctctactccttg

SEQ ID NO: 7327098 - DNA, 22 bp, Homo sapiens
tagattttgcatttctaacaag

SEQ ID NO: 7327099 - DNA, 22 bp, Homo sapiens
tagcagtactgggcatgtgttt

SEQ ID NO: 7327100 - DNA, 22 bp, Homo sapiens
tagcacccacctcgtggggttt

SEQ ID NO: 7327101 - DNA, 22 bp, Homo sapiens
tagcacccatggaatctgctgg

SEQ ID NO: 7327102 - DNA, 22 bp, Homo sapiens
tagccaatctgaccagtctttt

SEQ ID NO: 7327103 - DNA, 22 bp, Homo sapiens
tagccaggtcacactgtgtgtt

SEQ ID NO: 7327104 - DNA, 22 bp, Homo sapiens
tagccagggagacactgtggag

SEQ ID NO: 7327105 - DNA, 22 bp, Homo sapiens
tagccaggcgaggtcagtgtcg

SEQ ID NO: 7327106 - DNA, 17 bp, Homo sapiens
tagtcaagtttacatgt

SEQ ID NO: 7327107 - DNA, 22 bp, Homo sapiens
tagtcacaggaagtttcaatgt

SEQ ID NO: 7327108 - DNA, 22 bp, Homo sapiens
tagtagtgagtctttataaata

SEQ ID NO: 7327109 - DNA, 22 bp, Homo sapiens
tagtacagtttactttcagcgc

SEQ ID NO: 7327110 - DNA, 22 bp, Homo sapiens
tagtacagtttaaatattaata

SEQ ID NO: 7327111 - DNA, 22 bp, Homo sapiens
taggacagagttccctgatggc

SEQ ID NO: 7327112 - DNA, 22 bp, Homo sapiens
taggcctcaggaccccagggct

SEQ ID NO: 7327113 - DNA, 22 bp, Homo sapiens
taggaaggcctgtcactacttg

SEQ ID NO: 7327114 - DNA, 22 bp, Homo sapiens
taggaaggaggccatcttggcg

SEQ ID NO: 7327115 - DNA, 22 bp, Homo sapiens
taggaaatgctccattgcataa

SEQ ID NO: 7327116 - DNA, 22 bp, Homo sapiens
taggaaatgctgtcttattgta

SEQ ID NO: 7327117 - DNA, 22 bp, Homo sapiens
taggaaatgccagccttcctcc

SEQ ID NO: 7327118 - DNA, 22 bp, Homo sapiens
taggaaatgaggccaacatgtg

SEQ ID NO: 7327119 - DNA, 22 bp, Homo sapiens
taggaaatgaatgcaggctccc

SEQ ID NO: 7327120 - DNA, 22 bp, Homo sapiens
taggaagaagcagccttgctta

SEQ ID NO: 7327121 - DNA, 22 bp, Homo sapiens
taggaagaaactttccctgcag

SEQ ID NO: 7327122 - DNA, 22 bp, Homo sapiens
taggaaatggctcagttactgc

SEQ ID NO: 7327123 - DNA, 22 bp, Homo sapiens
taggaagatcaagtttatctca

SEQ ID NO: 7327124 - DNA, 22 bp, Homo sapiens
taggaagataaacatttgtatg

SEQ ID NO: 7327125 - DNA, 22 bp, Homo sapiens
taggaagagctataggtcccca

SEQ ID NO: 7327126 - DNA, 22 bp, Homo sapiens
taggaagagctataggtcccca

SEQ ID NO: 7327127 - DNA, 23 bp, Homo sapiens
taggaagacagcaaaagaatgga

SEQ ID NO: 7327128 - DNA, 22 bp, Homo sapiens
taggaagatgagtatcaacttg

SEQ ID NO: 7327129 - DNA, 18 bp, Homo sapiens
taggaaatagggctgtga

SEQ ID NO: 7327130 - DNA, 20 bp, Homo sapiens
taggaaatatgtttttaccc

SEQ ID NO: 7327131 - DNA, 22 bp, Homo sapiens
taggaaatactgtaagtttggg

SEQ ID NO: 7327132 - DNA, 22 bp, Homo sapiens
taggaaataaatacttatggtt

SEQ ID NO: 7327133 - DNA, 22 bp, Homo sapiens
taggaaataattcactctggct

SEQ ID NO: 7327134 - DNA, 22 bp, Homo sapiens
taggaaatattgatttcagtca

SEQ ID NO: 7327135 - DNA, 22 bp, Homo sapiens
taggaaatcagagaaagaggtg

SEQ ID NO: 7327136 - DNA, 22 bp, Homo sapiens
taggaaatatttgaacatagga

SEQ ID NO: 7327137 - DNA, 20 bp, Homo sapiens
taggaaatcgaggcagggtg

SEQ ID NO: 7327138 - DNA, 22 bp, Homo sapiens
tagcccagaagagggaagcaac

SEQ ID NO: 7327139 - DNA, 22 bp, Homo sapiens
taggaaactctcagctggtcat

SEQ ID NO: 7327140 - DNA, 22 bp, Homo sapiens
taggaaactctcagctggtcat

SEQ ID NO: 7327141 - DNA, 16 bp, Homo sapiens
taggaaactgcatgtg

SEQ ID NO: 7327142 - DNA, 22 bp, Homo sapiens
tatctttgtatcaatctccatt

SEQ ID NO: 7327143 - DNA, 22 bp, Homo sapiens
tatgccactgctctccatccta

SEQ ID NO: 7327144 - DNA, 19 bp, Homo sapiens
tatctgtttcctgcttgtc

SEQ ID NO: 7327145 - DNA, 23 bp, Homo sapiens
tatctgttctctgagtgtttggt

SEQ ID NO: 7327146 - DNA, 22 bp, Homo sapiens
tatattaacttgtgatcctgga

SEQ ID NO: 7327147 - DNA, 22 bp, Homo sapiens
tatattaaatgaccagttttaa

SEQ ID NO: 7327148 - DNA, 22 bp, Homo sapiens
tatattaaagtgctttgcagtg

SEQ ID NO: 7327149 - DNA, 22 bp, Homo sapiens
tatatgcatgcccatgtataca

SEQ ID NO: 7327150 - DNA, 22 bp, Homo sapiens
tatactgagagcaaatacattc

SEQ ID NO: 7327151 - DNA, 22 bp, Homo sapiens
tatactgatttgtctatactct

SEQ ID NO: 7327152 - DNA, 22 bp, Homo sapiens
tatacatgttttacataagtga

SEQ ID NO: 7327153 - DNA, 22 bp, Homo sapiens
tagttaaaccaccattctggta

SEQ ID NO: 7327154 - DNA, 22 bp, Homo sapiens
tatttcagcacatgggataggt

SEQ ID NO: 7327155 - DNA, 22 bp, Homo sapiens
tattgcacatgcgctagaacca

SEQ ID NO: 7327156 - DNA, 22 bp, Homo sapiens
tattgcaatttggctaaagaat

SEQ ID NO: 7327157 - DNA, 22 bp, Homo sapiens
tattgagaaccctcaggaggca

SEQ ID NO: 7327158 - DNA, 22 bp, Homo sapiens
gtagctttaaagactggctgat

SEQ ID NO: 7327159 - DNA, 17 bp, Homo sapiens
gtaaggcttgcagatgc

SEQ ID NO: 7327160 - DNA, 22 bp, Homo sapiens
gtaaggttaccaggttttgaga

SEQ ID NO: 7327161 - DNA, 22 bp, Homo sapiens
gtaaattatttcaagatcatct

SEQ ID NO: 7327162 - DNA, 22 bp, Homo sapiens
gtcattctctggtgtggttgtt

SEQ ID NO: 7327163 - DNA, 22 bp, Homo sapiens
gtcattcttaacaactcagtag

SEQ ID NO: 7327164 - DNA, 22 bp, Homo sapiens
gtcattgagtcgtcagagtctt

SEQ ID NO: 7327165 - DNA, 22 bp, Homo sapiens
gtcattattctgggattctata

SEQ ID NO: 7327166 - DNA, 22 bp, Homo sapiens
gtcattatttaatgtaggctaa

SEQ ID NO: 7327167 - DNA, 22 bp, Homo sapiens
gtcattcaactgcacattaggt

SEQ ID NO: 7327168 - DNA, 22 bp, Homo sapiens
gtcattcagagatgcaggtaga

SEQ ID NO: 7327169 - DNA, 22 bp, Homo sapiens
gtcacaaagcgcggtggtcggt

SEQ ID NO: 7327170 - DNA, 22 bp, Homo sapiens
gtcacaaaggtgagggacatga

SEQ ID NO: 7327171 - DNA, 22 bp, Homo sapiens
gtcacaaatcccctcagcaact

SEQ ID NO: 7327172 - DNA, 22 bp, Homo sapiens
gtctcccatcgtttgtgaggaa

SEQ ID NO: 7327173 - DNA, 22 bp, Homo sapiens
gtcttagatttcaccgataatg

SEQ ID NO: 7327174 - DNA, 22 bp, Homo sapiens
gtctcctgccacactcagtccc

SEQ ID NO: 7327175 - DNA, 22 bp, Homo sapiens
gtctcctggcttttgtcccagt

SEQ ID NO: 7327176 - DNA, 22 bp, Homo sapiens
gtctctcaaaactagaagagaa

SEQ ID NO: 7327177 - DNA, 22 bp, Homo sapiens
gtgcccaggggccagctgccgg

SEQ ID NO: 7327178 - DNA, 22 bp, Homo sapiens
gggcatcttctgtagccatctc

SEQ ID NO: 7327179 - DNA, 22 bp, Homo sapiens
ggggcagaaagcccacagagtg

SEQ ID NO: 7327180 - DNA, 22 bp, Homo sapiens
ggtaggcactggtgggaagaga

SEQ ID NO: 7327181 - DNA, 22 bp, Homo sapiens
ggtaggagtgaagacttaagat

SEQ ID NO: 7327182 - DNA, 22 bp, Homo sapiens
ggtaggcaaactacagttagct

SEQ ID NO: 7327183 - DNA, 22 bp, Homo sapiens
ggtaggagtattttgcagcagt

SEQ ID NO: 7327184 - DNA, 18 bp, Homo sapiens
ggtaggagccaggaatgt

SEQ ID NO: 7327185 - DNA, 22 bp, Homo sapiens
ggtgggagtggaacgtggaaga

SEQ ID NO: 7327186 - DNA, 16 bp, Homo sapiens
ggtgggaggtgaggtg

SEQ ID NO: 7327187 - DNA, 22 bp, Homo sapiens
ggtgggcaacatttggcctgag

SEQ ID NO: 7327188 - DNA, 22 bp, Homo sapiens
ggtgggaggactgtttgaggca

SEQ ID NO: 7327189 - DNA, 22 bp, Homo sapiens
ggtgggagagcttgctttgatg

SEQ ID NO: 7327190 - DNA, 22 bp, Homo sapiens
ggtgaagccagggcatcaatat

SEQ ID NO: 7327191 - DNA, 22 bp, Homo sapiens
ggtgaagcctctagttacattt

SEQ ID NO: 7327192 - DNA, 21 bp, Homo sapiens
ggtgcaggtaatgatgatata

SEQ ID NO: 7327193 - DNA, 22 bp, Homo sapiens
ggcatcgtcctgggcataggga

SEQ ID NO: 7327194 - DNA, 22 bp, Homo sapiens
ggcatcttgttgctcaaatcta

SEQ ID NO: 7327195 - DNA, 22 bp, Homo sapiens
ggcatgagaggtcctggggatt

SEQ ID NO: 7327196 - DNA, 22 bp, Homo sapiens
ggcaggtgacctggcctcccag

SEQ ID NO: 7327197 - DNA, 22 bp, Homo sapiens
ggcaggtgacggggatgagtat

SEQ ID NO: 7327198 - DNA, 22 bp, Homo sapiens
ggcaggagctctccagtttgcc

SEQ ID NO: 7327199 - DNA, 22 bp, Homo sapiens
ggcaggggtggccttcctttgg

SEQ ID NO: 7327200 - DNA, 22 bp, Homo sapiens
ggcaggggttcattttgtctta

SEQ ID NO: 7327201 - DNA, 22 bp, Homo sapiens
ggcctggcatggggactaaggg

SEQ ID NO: 7327202 - DNA, 17 bp, Homo sapiens
ggattgcatatacagtg

SEQ ID NO: 7327203 - DNA, 23 bp, Homo sapiens
ggatggacgtgatgccttagcca

SEQ ID NO: 7327204 - DNA, 22 bp, Homo sapiens
ggatgctgctgcacatcctgca

SEQ ID NO: 7327205 - DNA, 22 bp, Homo sapiens
ggatgcaggaggtcggggagca

SEQ ID NO: 7327206 - DNA, 22 bp, Homo sapiens
ggatgcaggacggcatggatgt

SEQ ID NO: 7327207 - DNA, 22 bp, Homo sapiens
ggatggcagtctgcatgagaaa

SEQ ID NO: 7327208 - DNA, 22 bp, Homo sapiens
ggatgggaacttggtagggcat

SEQ ID NO: 7327209 - DNA, 22 bp, Homo sapiens
ggatctgttttgcctctgaggg

SEQ ID NO: 7327210 - DNA, 23 bp, Homo sapiens
gggcaggtttttataggcttcag

SEQ ID NO: 7327211 - DNA, 22 bp, Homo sapiens
gggcagtgacaaaggggatgaa

SEQ ID NO: 7327212 - DNA, 22 bp, Homo sapiens
gggagggagaggacagttctat

SEQ ID NO: 7327213 - DNA, 22 bp, Homo sapiens
gggagggacacaaagagttccc

SEQ ID NO: 7327214 - DNA, 22 bp, Homo sapiens
gggagggatctgctaggcaatg

SEQ ID NO: 7327215 - DNA, 22 bp, Homo sapiens
gggagggaggtgctggttcacg

SEQ ID NO: 7327216 - DNA, 22 bp, Homo sapiens
gggaggtgttccagtgttggta

SEQ ID NO: 7327217 - DNA, 22 bp, Homo sapiens
gggaggtgattaggaccatgta

SEQ ID NO: 7327218 - DNA, 22 bp, Homo sapiens
gggaggtgatggcaagcagcgg

SEQ ID NO: 7327219 - DNA, 20 bp, Homo sapiens
ggctttctgtgatcctcagt

SEQ ID NO: 7327220 - DNA, 22 bp, Homo sapiens
gggaagggacttgtttaaggtc

SEQ ID NO: 7327221 - DNA, 22 bp, Homo sapiens
gggaagggagggcctccagtca

SEQ ID NO: 7327222 - DNA, 22 bp, Homo sapiens
gggaagggagggacctcagtct

SEQ ID NO: 7327223 - DNA, 22 bp, Homo sapiens
gggaagggctccttttattgca

SEQ ID NO: 7327224 - DNA, 23 bp, Homo sapiens
gggaagtggggatttgaagtcat

SEQ ID NO: 7327225 - DNA, 22 bp, Homo sapiens
gggaagtgccctcttcaggaga

SEQ ID NO: 7327226 - DNA, 22 bp, Homo sapiens
gggaagtgtgcagagttctctt

SEQ ID NO: 7327227 - DNA, 22 bp, Homo sapiens
ggctacagcggggtggagacgg

SEQ ID NO: 7327228 - DNA, 22 bp, Homo sapiens
ggctacagactgcataagggca

SEQ ID NO: 7327229 - DNA, 22 bp, Homo sapiens
ggctacagaaggagaaagaaat

SEQ ID NO: 7327230 - DNA, 22 bp, Homo sapiens
ggctacagaggccgtgagcctg

SEQ ID NO: 7327231 - DNA, 22 bp, Homo sapiens
ggctacagggcctggccaaggt

SEQ ID NO: 7327232 - DNA, 22 bp, Homo sapiens
ggctacagggtacaccacatct

SEQ ID NO: 7327233 - DNA, 22 bp, Homo sapiens
ggctacagtggcactgggcttt

SEQ ID NO: 7327234 - DNA, 22 bp, Homo sapiens
ggctacagtggctcagtgctgg

SEQ ID NO: 7327235 - DNA, 21 bp, Homo sapiens
ggctggacatcccaggagact

SEQ ID NO: 7327236 - DNA, 22 bp, Homo sapiens
ggctgagggtcccagaccctaa

SEQ ID NO: 7327237 - DNA, 22 bp, Homo sapiens
ggctgagtctgtgacccatgcg

SEQ ID NO: 7327238 - DNA, 22 bp, Homo sapiens
ggacccttggcttctgcagatt

SEQ ID NO: 7327239 - DNA, 22 bp, Homo sapiens
ggagaggcgatgagtcacagcc

SEQ ID NO: 7327240 - DNA, 22 bp, Homo sapiens
ggagaggagctattgggggctc

SEQ ID NO: 7327241 - DNA, 22 bp, Homo sapiens
ggagaggagattgtggcatttt

SEQ ID NO: 7327242 - DNA, 22 bp, Homo sapiens
ggagagctggtatatgaagaca

SEQ ID NO: 7327243 - DNA, 22 bp, Homo sapiens
ggagagctggtatatgaagaca

SEQ ID NO: 7327244 - DNA, 21 bp, Homo sapiens
ggaacattgttaatagtctct

SEQ ID NO: 7327245 - DNA, 22 bp, Homo sapiens
ggaagccagaaagtgagaatat

SEQ ID NO: 7327246 - DNA, 22 bp, Homo sapiens
ggaagccacccagctttgatag

SEQ ID NO: 7327247 - DNA, 22 bp, Homo sapiens
ggaagccaaggtggcctctatt

SEQ ID NO: 7327248 - DNA, 19 bp, Homo sapiens
ggaagccaggtcagcccac

SEQ ID NO: 7327249 - DNA, 20 bp, Homo sapiens
ggaagccagggtgcagggga

SEQ ID NO: 7327250 - DNA, 22 bp, Homo sapiens
ggaagccaggctgggggatctg

SEQ ID NO: 7327251 - DNA, 20 bp, Homo sapiens
ggaagccagcatccttgagg

SEQ ID NO: 7327252 - DNA, 22 bp, Homo sapiens
ggaagccagagtgctgggcagg

SEQ ID NO: 7327253 - DNA, 22 bp, Homo sapiens
ggaagccaggccaatgagaaca

SEQ ID NO: 7327254 - DNA, 22 bp, Homo sapiens
ggaagccaggcccagagatgct

SEQ ID NO: 7327255 - DNA, 22 bp, Homo sapiens
ggaaggaacaaaccctgtgtgg

SEQ ID NO: 7327256 - DNA, 20 bp, Homo sapiens
ggaagctgtgggtccccagg

SEQ ID NO: 7327257 - DNA, 21 bp, Homo sapiens
ggaagcttccttggtgatcac

SEQ ID NO: 7327258 - DNA, 22 bp, Homo sapiens
ggaagccatgagggacagttct

SEQ ID NO: 7327259 - DNA, 22 bp, Homo sapiens
ggaagccataccctgatttctg

SEQ ID NO: 7327260 - DNA, 22 bp, Homo sapiens
ggaagccagttgcttggtgtgg

SEQ ID NO: 7327261 - DNA, 22 bp, Homo sapiens
ggaagccaggttactgttcaga

SEQ ID NO: 7327262 - DNA, 22 bp, Homo sapiens
ggaaaggagatgaataggatta

SEQ ID NO: 7327263 - DNA, 22 bp, Homo sapiens
ggaaaggagatattggagagtg

SEQ ID NO: 7327264 - DNA, 22 bp, Homo sapiens
gctggctctgccccacctgttc

SEQ ID NO: 7327265 - DNA, 22 bp, Homo sapiens
gctggctgcagattttagaggt

SEQ ID NO: 7327266 - DNA, 22 bp, Homo sapiens
gctgggacggctcagtaagaag

SEQ ID NO: 7327267 - DNA, 22 bp, Homo sapiens
gctggctcaagtgtgcttccca

SEQ ID NO: 7327268 - DNA, 22 bp, Homo sapiens
gctgtctttcccctgctccaga

SEQ ID NO: 7327269 - DNA, 22 bp, Homo sapiens
gctgtgcccagctccagctctg

SEQ ID NO: 7327270 - DNA, 16 bp, Homo sapiens
gctgggagggagaggt

SEQ ID NO: 7327271 - DNA, 22 bp, Homo sapiens
gctcaatgctcaatgctgcaaa

SEQ ID NO: 7327272 - DNA, 22 bp, Homo sapiens
gctcaatcctagaggctcaggg

SEQ ID NO: 7327273 - DNA, 22 bp, Homo sapiens
gctcaagccttctgcccacctc

SEQ ID NO: 7327274 - DNA, 22 bp, Homo sapiens
gctcacatcatagtaagctcat

SEQ ID NO: 7327275 - DNA, 23 bp, Homo sapiens
gctcacagaatgttgaagggaat

SEQ ID NO: 7327276 - DNA, 22 bp, Homo sapiens
gctcacagccggctggcagggg

SEQ ID NO: 7327277 - DNA, 16 bp, Homo sapiens
gcgcctcctcggcctc

SEQ ID NO: 7327278 - DNA, 22 bp, Homo sapiens
gcctggctgggctgaatgctta

SEQ ID NO: 7327279 - DNA, 22 bp, Homo sapiens
gcctgggtgaatttgatcctaa

SEQ ID NO: 7327280 - DNA, 22 bp, Homo sapiens
gctgccaggccctggggctatg

SEQ ID NO: 7327281 - DNA, 21 bp, Homo sapiens
gctgccaggattttgcaggaa

SEQ ID NO: 7327282 - DNA, 22 bp, Homo sapiens
gctgccaggacggagaggagcg

SEQ ID NO: 7327283 - DNA, 19 bp, Homo sapiens
gctgccaggacagttactg

SEQ ID NO: 7327284 - DNA, 22 bp, Homo sapiens
gctgccagctgcggcccacgcg

SEQ ID NO: 7327285 - DNA, 22 bp, Homo sapiens
gctgccagctttccttggctga

SEQ ID NO: 7327286 - DNA, 22 bp, Homo sapiens
gctgccagcgtcagacctgggg

SEQ ID NO: 7327287 - DNA, 22 bp, Homo sapiens
gctgccagccctcggggtctga

SEQ ID NO: 7327288 - DNA, 22 bp, Homo sapiens
gctgccagctcactctcctgag

SEQ ID NO: 7327289 - DNA, 22 bp, Homo sapiens
gctgccagcccagcaaggtgtg

SEQ ID NO: 7327290 - DNA, 22 bp, Homo sapiens
gctgccagccagggtgggatcc

SEQ ID NO: 7327291 - DNA, 22 bp, Homo sapiens
gctgccagggaggtggtggagg

SEQ ID NO: 7327292 - DNA, 20 bp, Homo sapiens
gctgccagggcggagacatc

SEQ ID NO: 7327293 - DNA, 22 bp, Homo sapiens
gctgccaggggcagctgtctca

SEQ ID NO: 7327294 - DNA, 22 bp, Homo sapiens
gctgccaggggcagctgtctca

SEQ ID NO: 7327295 - DNA, 22 bp, Homo sapiens
gctgccagtctaatgggaaaca

SEQ ID NO: 7327296 - DNA, 22 bp, Homo sapiens
gctgccagtagttggagctcca

SEQ ID NO: 7327297 - DNA, 22 bp, Homo sapiens
gctgccagtgtggcatgatgca

SEQ ID NO: 7327298 - DNA, 22 bp, Homo sapiens
gctgccagttccttcttactcc

SEQ ID NO: 7327299 - DNA, 20 bp, Homo sapiens
gctgccagtgcctgatgctt

SEQ ID NO: 7327300 - DNA, 22 bp, Homo sapiens
gctgccagccaacttgctgtgc

SEQ ID NO: 7327301 - DNA, 22 bp, Homo sapiens
gctgccagcacacaggtgttag

SEQ ID NO: 7327302 - DNA, 22 bp, Homo sapiens
gctgccagcacagttcagctgt

SEQ ID NO: 7327303 - DNA, 22 bp, Homo sapiens
gctgccagaagaggaggggtta

SEQ ID NO: 7327304 - DNA, 22 bp, Homo sapiens
gctgccagaatgggaaatctga

SEQ ID NO: 7327305 - DNA, 22 bp, Homo sapiens
gctgccagagattttagaacta

SEQ ID NO: 7327306 - DNA, 22 bp, Homo sapiens
gctgccagagctcacttaatgc

SEQ ID NO: 7327307 - DNA, 22 bp, Homo sapiens
gcaagcaagcaggtagagctga

SEQ ID NO: 7327308 - DNA, 22 bp, Homo sapiens
gcaagcaaaatgggagattccc

SEQ ID NO: 7327309 - DNA, 22 bp, Homo sapiens
gcaagcaaattatttataggca

SEQ ID NO: 7327310 - DNA, 22 bp, Homo sapiens
gcaagagacttttatgtctgcc

SEQ ID NO: 7327311 - DNA, 22 bp, Homo sapiens
gagggggcgaacagaagcaagg

SEQ ID NO: 7327312 - DNA, 22 bp, Homo sapiens
gcaaggaagagcaggtggtgct

SEQ ID NO: 7327313 - DNA, 22 bp, Homo sapiens
gcactctgtttctcctgtcagc

SEQ ID NO: 7327314 - DNA, 22 bp, Homo sapiens
gcagaggagatgaagatacttt

SEQ ID NO: 7327315 - DNA, 22 bp, Homo sapiens
gcaggagtgtatttgcatgtaa

SEQ ID NO: 7327316 - DNA, 22 bp, Homo sapiens
gcaggagtatgcagctatggtt

SEQ ID NO: 7327317 - DNA, 22 bp, Homo sapiens
gcaggagtgacatggatgtgga

SEQ ID NO: 7327318 - DNA, 22 bp, Homo sapiens
gcaggagtcccagaaggttttg

SEQ ID NO: 7327319 - DNA, 22 bp, Homo sapiens
gcaggagctggaaagtgatgtt

SEQ ID NO: 7327320 - DNA, 22 bp, Homo sapiens
gcagaggagcaagttgctacag

SEQ ID NO: 7327321 - DNA, 22 bp, Homo sapiens
gcatctgttagagtgtgcatgc

SEQ ID NO: 7327322 - DNA, 22 bp, Homo sapiens
gcatctttctgtccattcagca

SEQ ID NO: 7327323 - DNA, 22 bp, Homo sapiens
gcatctttagcctctccgtggc

SEQ ID NO: 7327324 - DNA, 22 bp, Homo sapiens
gcagtcagtgttgactacatgc

SEQ ID NO: 7327325 - DNA, 22 bp, Homo sapiens
gcagtcagacaggaggagctcc

SEQ ID NO: 7327326 - DNA, 22 bp, Homo sapiens
gcagtattcattgtttccctga

SEQ ID NO: 7327327 - DNA, 22 bp, Homo sapiens
gcagggctcagccgctcccacc

SEQ ID NO: 7327328 - DNA, 21 bp, Homo sapiens
gcagtcatcatcaagctttgg

SEQ ID NO: 7327329 - DNA, 22 bp, Homo sapiens
gcagtcatccagcctttccact

SEQ ID NO: 7327330 - DNA, 22 bp, Homo sapiens
gcagtcatggaaaaatgtatac

SEQ ID NO: 7327331 - DNA, 22 bp, Homo sapiens
gcagtctttgaatgtgaaatag

SEQ ID NO: 7327332 - DNA, 22 bp, Homo sapiens
gcagtgaaaaagtgcaccctgt

SEQ ID NO: 7327333 - DNA, 22 bp, Homo sapiens
gccagccataggccagcactgg

SEQ ID NO: 7327334 - DNA, 22 bp, Homo sapiens
gccagcattccttggctcctgg

SEQ ID NO: 7327335 - DNA, 23 bp, Homo sapiens
gcccagagaggctcaccaggaat

SEQ ID NO: 7327336 - DNA, 22 bp, Homo sapiens
gcccagagagatgctgtagacc

SEQ ID NO: 7327337 - DNA, 22 bp, Homo sapiens
gccaggacggtgaatgggctac

SEQ ID NO: 7327338 - DNA, 22 bp, Homo sapiens
gccaggaatggagaggtggcct

SEQ ID NO: 7327339 - DNA, 22 bp, Homo sapiens
gcccagtttcagctctgccttt

SEQ ID NO: 7327340 - DNA, 18 bp, Homo sapiens
gccctctggctgctgatg

SEQ ID NO: 7327341 - DNA, 22 bp, Homo sapiens
tggttcagatatggagctggga

SEQ ID NO: 7327342 - DNA, 22 bp, Homo sapiens
tggttcaggcagggtgttgctg

SEQ ID NO: 7327343 - DNA, 22 bp, Homo sapiens
tggttcagttgcacaggctgtt

SEQ ID NO: 7327344 - DNA, 22 bp, Homo sapiens
tggttcagagagttgctgacca

SEQ ID NO: 7327345 - DNA, 22 bp, Homo sapiens
tggttcagatatggagctggga

SEQ ID NO: 7327346 - DNA, 22 bp, Homo sapiens
tgttttcctcctggtttctgcc

SEQ ID NO: 7327347 - DNA, 17 bp, Homo sapiens
tgttttcattcattgct

SEQ ID NO: 7327348 - DNA, 22 bp, Homo sapiens
tgtttcttacgtttttagaggc

SEQ ID NO: 7327349 - DNA, 20 bp, Homo sapiens
tgtttctgacggtaggagag

SEQ ID NO: 7327350 - DNA, 22 bp, Homo sapiens
ttaaggaaacatttttccatag

SEQ ID NO: 7327351 - DNA, 22 bp, Homo sapiens
cctgtaggatattgtagaatac

SEQ ID NO: 7327352 - DNA, 22 bp, Homo sapiens
ttaaaagtctgatgatttacat

SEQ ID NO: 7327353 - DNA, 23 bp, Homo sapiens
ttaaaagtggagagagaagctgg

SEQ ID NO: 7327354 - DNA, 22 bp, Homo sapiens
tgttttctcttgaaaagcagtc

SEQ ID NO: 7327355 - DNA, 21 bp, Homo sapiens
ttacaaagctacagatgttgc

SEQ ID NO: 7327356 - DNA, 22 bp, Homo sapiens
cctttaaatggatgttcaactg

SEQ ID NO: 7327357 - DNA, 22 bp, Homo sapiens
ttacagaagagaaagaattcag

SEQ ID NO: 7327358 - DNA, 22 bp, Homo sapiens
cgaggtgggcagatcacagagt

SEQ ID NO: 7327359 - DNA, 22 bp, Homo sapiens
cgcaactcagcaacttaactgc

SEQ ID NO: 7327360 - DNA, 22 bp, Homo sapiens
ttctgaaatttcaactttacta

SEQ ID NO: 7327361 - DNA, 20 bp, Homo sapiens
ttcttaaagacctcactttg

SEQ ID NO: 7327362 - DNA, 21 bp, Homo sapiens
ttcttcatgatgattaatggc

SEQ ID NO: 7327363 - DNA, 22 bp, Homo sapiens
ttgcacagtttgaagatgactc

SEQ ID NO: 7327364 - DNA, 22 bp, Homo sapiens
ttcagtttccacttacatttaa

SEQ ID NO: 7327365 - DNA, 19 bp, Homo sapiens
ttcagtttcctcatctgga

SEQ ID NO: 7327366 - DNA, 22 bp, Homo sapiens
ttcagtttctaaatgctcctct

SEQ ID NO: 7327367 - DNA, 22 bp, Homo sapiens
ttcagtttcaaatcctgtgaag

SEQ ID NO: 7327368 - DNA, 22 bp, Homo sapiens
cggctgtgtcttcacaggagcc

SEQ ID NO: 7327369 - DNA, 22 bp, Homo sapiens
ttccactggctttcagtgatct

SEQ ID NO: 7327370 - DNA, 22 bp, Homo sapiens
ctacagtgactgtgacagagca

SEQ ID NO: 7327371 - DNA, 22 bp, Homo sapiens
ctacagtgtgacaggcttggtg

SEQ ID NO: 7327372 - DNA, 22 bp, Homo sapiens
ttctacagtgactgcagccata

SEQ ID NO: 7327373 - DNA, 22 bp, Homo sapiens
ttctatttttgtggaactgtag

SEQ ID NO: 7327374 - DNA, 22 bp, Homo sapiens
ctacatttacacagttaggctt

SEQ ID NO: 7327375 - DNA, 20 bp, Homo sapiens
ttctccaaaggagacactag

SEQ ID NO: 7327376 - DNA, 22 bp, Homo sapiens
ttctcctgcgcaggcccaggga

SEQ ID NO: 7327377 - DNA, 21 bp, Homo sapiens
ttctcctgttttgcaccacag

SEQ ID NO: 7327378 - DNA, 22 bp, Homo sapiens
ctagtttaaagcagctgaaagg

SEQ ID NO: 7327379 - DNA, 22 bp, Homo sapiens
ctagttctagatccctgaggaa

SEQ ID NO: 7327380 - DNA, 18 bp, Homo sapiens
ctgaggctggcaggagcc

SEQ ID NO: 7327381 - DNA, 22 bp, Homo sapiens
ctgagaggtaagcagcgcagtg

SEQ ID NO: 7327382 - DNA, 22 bp, Homo sapiens
ctgagctgggactcagtagcaa

SEQ ID NO: 7327383 - DNA, 22 bp, Homo sapiens
ttttcctgggctttctgtgtaa

SEQ ID NO: 7327384 - DNA, 19 bp, Homo sapiens
ttttctcgtgcttgtctgc

SEQ ID NO: 7327385 - DNA, 22 bp, Homo sapiens
ttttctctacaaaataaccagc

SEQ ID NO: 7327386 - DNA, 22 bp, Homo sapiens
tttttctgagaatatgagagga

SEQ ID NO: 7327387 - DNA, 22 bp, Homo sapiens
tttttctgagcggtaatcatca

SEQ ID NO: 7327388 - DNA, 18 bp, Homo sapiens
tttttctgataaaacaag

SEQ ID NO: 7327389 - DNA, 22 bp, Homo sapiens
tttttctgccattcaaagagga

SEQ ID NO: 7327390 - DNA, 22 bp, Homo sapiens
ctgaaagaataagatgtttaca

SEQ ID NO: 7327391 - DNA, 22 bp, Homo sapiens
tttttctgtctcttacattgca

SEQ ID NO: 7327392 - DNA, 22 bp, Homo sapiens
tttttctggataactgtatctc

SEQ ID NO: 7327393 - DNA, 22 bp, Homo sapiens
tttttctgtaaagggccagaga

SEQ ID NO: 7327394 - DNA, 20 bp, Homo sapiens
tttttctgggcttccatagc

SEQ ID NO: 7327395 - DNA, 19 bp, Homo sapiens
ctgctccctccttctggca

SEQ ID NO: 7327396 - DNA, 22 bp, Homo sapiens
ctgctcctctgaggtagccaca

SEQ ID NO: 7327397 - DNA, 22 bp, Homo sapiens
ctgctgctcagtgtcatcatgt

SEQ ID NO: 7327398 - DNA, 22 bp, Homo sapiens
ctgctgctgagaatgcctcagg

SEQ ID NO: 7327399 - DNA, 22 bp, Homo sapiens
ctgctgctgagagctcagcctg

SEQ ID NO: 7327400 - DNA, 22 bp, Homo sapiens
ctgctggcaagcccagttggag

SEQ ID NO: 7327401 - DNA, 22 bp, Homo sapiens
ctgctggcctagcccatcctct

SEQ ID NO: 7327402 - DNA, 22 bp, Homo sapiens
ctgctggcctcggccatgcctg

SEQ ID NO: 7327403 - DNA, 17 bp, Homo sapiens
ctgctggctggggcttg

SEQ ID NO: 7327404 - DNA, 22 bp, Homo sapiens
ctgctctctgttcccctggatc

SEQ ID NO: 7327405 - DNA, 19 bp, Homo sapiens
ctgctctccttgacttgga

SEQ ID NO: 7327406 - DNA, 22 bp, Homo sapiens
ctgctctccccaggccagtctg

SEQ ID NO: 7327407 - DNA, 20 bp, Homo sapiens
ctgctgccctgtcagcctct

SEQ ID NO: 7327408 - DNA, 22 bp, Homo sapiens
ctgctgcccctgagctcagcct

SEQ ID NO: 7327409 - DNA, 22 bp, Homo sapiens
ctgccctgagtcatgccagatg

SEQ ID NO: 7327410 - DNA, 22 bp, Homo sapiens
ctgccctgcagctccacggact

SEQ ID NO: 7327411 - DNA, 22 bp, Homo sapiens
ctgccctgcttgatgacagcga

SEQ ID NO: 7327412 - DNA, 22 bp, Homo sapiens
ctgccctgcttctgagggaagc

SEQ ID NO: 7327413 - DNA, 22 bp, Homo sapiens
ctgccctgctctccgggatctt

SEQ ID NO: 7327414 - DNA, 22 bp, Homo sapiens
ctgccctgctggagatcacagt

SEQ ID NO: 7327415 - DNA, 22 bp, Homo sapiens
ctgccctgctaatgagttccaa

SEQ ID NO: 7327416 - DNA, 22 bp, Homo sapiens
ctgccctgggccaggaagcggc

SEQ ID NO: 7327417 - DNA, 22 bp, Homo sapiens
ctgcagtcatctgaagattttg

SEQ ID NO: 7327418 - DNA, 22 bp, Homo sapiens
ctgcagtctgacatacgaggac

SEQ ID NO: 7327419 - DNA, 22 bp, Homo sapiens
ctccccaggttcaggaggtggg

SEQ ID NO: 7327420 - DNA, 22 bp, Homo sapiens
ttgtttacaagttactcagtct

SEQ ID NO: 7327421 - DNA, 22 bp, Homo sapiens
ctccctgcttgtttcccttcag

SEQ ID NO: 7327422 - DNA, 22 bp, Homo sapiens
ctccctggaggcccagacctgg

SEQ ID NO: 7327423 - DNA, 22 bp, Homo sapiens
ctccctggctttgtcctgaggc

SEQ ID NO: 7327424 - DNA, 22 bp, Homo sapiens
ctccctggtgtcccctccagga

SEQ ID NO: 7327425 - DNA, 22 bp, Homo sapiens
tttcaaagttgggaattgtaat

SEQ ID NO: 7327426 - DNA, 22 bp, Homo sapiens
ctcgtgatccgcccacctcagc

SEQ ID NO: 7327427 - DNA, 22 bp, Homo sapiens
tttacacaaaagatagcacacc

SEQ ID NO: 7327428 - DNA, 22 bp, Homo sapiens
tttcttctgtttgtagttacac

SEQ ID NO: 7327429 - DNA, 22 bp, Homo sapiens
tttcttgaatatgggttaaact

SEQ ID NO: 7327430 - DNA, 21 bp, Homo sapiens
ctctgctgtctaccagctgtt

SEQ ID NO: 7327431 - DNA, 22 bp, Homo sapiens
ctctgctgctttgccagtggaa

SEQ ID NO: 7327432 - DNA, 22 bp, Homo sapiens
tttcttgagctaggaacctggg

SEQ ID NO: 7327433 - DNA, 22 bp, Homo sapiens
tttgaagggcacgacaatagtt

SEQ ID NO: 7327434 - DNA, 22 bp, Homo sapiens
ctctatttatggcatctttatg

SEQ ID NO: 7327435 - DNA, 22 bp, Homo sapiens
tttctgcagtctctcagaagcc

SEQ ID NO: 7327436 - DNA, 21 bp, Homo sapiens
tttctgcaatgcacgttgagg

SEQ ID NO: 7327437 - DNA, 22 bp, Homo sapiens
ctctgaggtcctacagtgaccc

SEQ ID NO: 7327438 - DNA, 22 bp, Homo sapiens
ctctgagggtctaaggagtcac

SEQ ID NO: 7327439 - DNA, 22 bp, Homo sapiens
ctctgagggctcgagggacgcg

SEQ ID NO: 7327440 - DNA, 22 bp, Homo sapiens
gaaaatacttcagtgttctggc

SEQ ID NO: 7327441 - DNA, 22 bp, Homo sapiens
gaaaatgttagcttcatagtca

SEQ ID NO: 7327442 - DNA, 22 bp, Homo sapiens
gaaaatgtttcctgttatttgc

SEQ ID NO: 7327443 - DNA, 22 bp, Homo sapiens
gaaaattattgaaaatggctct

SEQ ID NO: 7327444 - DNA, 22 bp, Homo sapiens
gaaacaatacttgtcctcacta

SEQ ID NO: 7327445 - DNA, 22 bp, Homo sapiens
gaaacactatgccaagacaggg

SEQ ID NO: 7327446 - DNA, 22 bp, Homo sapiens
ctttgattccaggcacatgttt

SEQ ID NO: 7327447 - DNA, 22 bp, Homo sapiens
cttttctgtcagtgcccaaatt

SEQ ID NO: 7327448 - DNA, 22 bp, Homo sapiens
cttttctgggccccacgctgga

SEQ ID NO: 7327449 - DNA, 22 bp, Homo sapiens
cttttctgtatcaaaaggatta

SEQ ID NO: 7327450 - DNA, 22 bp, Homo sapiens
cttttctggccaggaacttgcc

SEQ ID NO: 7327451 - DNA, 22 bp, Homo sapiens
cttttctggaatcatctctaac

SEQ ID NO: 7327452 - DNA, 22 bp, Homo sapiens
cttttctgagagggccaagatt

SEQ ID NO: 7327453 - DNA, 21 bp, Homo sapiens
cttttctgtgttcctccctgt

SEQ ID NO: 7327454 - DNA, 22 bp, Homo sapiens
cttttctgtgatgctgacagtc

SEQ ID NO: 7327455 - DNA, 22 bp, Homo sapiens
ctttctcttcagcacccagccc

SEQ ID NO: 7327456 - DNA, 22 bp, Homo sapiens
ctttaaataatacaaggtccag

SEQ ID NO: 7327457 - DNA, 22 bp, Homo sapiens
ctttaattaggaagtataatga

SEQ ID NO: 7327458 - DNA, 22 bp, Homo sapiens
ctttctcttcgaaaacctgccc

SEQ ID NO: 7327459 - DNA, 22 bp, Homo sapiens
ctttgattatcggtgtgaatgt

SEQ ID NO: 7327460 - DNA, 22 bp, Homo sapiens
cttgttttcttctgcagtctat

SEQ ID NO: 7327461 - DNA, 19 bp, Homo sapiens
ctgtttctgagcttgcttt

SEQ ID NO: 7327462 - DNA, 19 bp, Homo sapiens
ctgtttctgagcttgcttt

SEQ ID NO: 7327463 - DNA, 22 bp, Homo sapiens
ctgttttctacagtctgggtct

SEQ ID NO: 7327464 - DNA, 22 bp, Homo sapiens
ctgttttcctgggttccatgag

SEQ ID NO: 7327465 - DNA, 20 bp, Homo sapiens
cttaaacacagagatagatt

SEQ ID NO: 7327466 - DNA, 22 bp, Homo sapiens
cttaaaagttgcttccctaact

SEQ ID NO: 7327467 - DNA, 22 bp, Homo sapiens
cttaaattcttaatgccctcat

SEQ ID NO: 7327468 - DNA, 22 bp, Homo sapiens
cttaaattcttaatgccctcat

SEQ ID NO: 7327469 - DNA, 22 bp, Homo sapiens
cttaaattggatgagttaagtt

SEQ ID NO: 7327470 - DNA, 22 bp, Homo sapiens
cttaaattggatgagttaagtt

SEQ ID NO: 7327471 - DNA, 22 bp, Homo sapiens
cttaaattttcatctacaagaa

SEQ ID NO: 7327472 - DNA, 22 bp, Homo sapiens
cttaaattttcatctacaagaa

SEQ ID NO: 7327473 - DNA, 22 bp, Homo sapiens
cttaattacccaatgtggtagg

SEQ ID NO: 7327474 - DNA, 22 bp, Homo sapiens
cttaggaaagttggctgatttc

SEQ ID NO: 7327475 - DNA, 22 bp, Homo sapiens
cttaggaaagtttctgcttatg

SEQ ID NO: 7327476 - DNA, 22 bp, Homo sapiens
cttaggaaagttttctgctgca

SEQ ID NO: 7327477 - DNA, 22 bp, Homo sapiens
cttaggaatgcgtttcctgggt

SEQ ID NO: 7327478 - DNA, 22 bp, Homo sapiens
cttaggaagttgttacacactt

SEQ ID NO: 7327479 - DNA, 22 bp, Homo sapiens
cttaggaacgctctgcctagtg

SEQ ID NO: 7327480 - DNA, 22 bp, Homo sapiens
cttaggaagcgggacctgtgca

SEQ ID NO: 7327481 - DNA, 22 bp, Homo sapiens
cttccaaaatttatatgttgaa

SEQ ID NO: 7327482 - DNA, 22 bp, Homo sapiens
cttcattacttgctcgtagcac

SEQ ID NO: 7327483 - DNA, 22 bp, Homo sapiens
cttctattcactggtcacagtt

SEQ ID NO: 7327484 - DNA, 22 bp, Homo sapiens
ctgcttatggagatgagtaaga

SEQ ID NO: 7327485 - DNA, 19 bp, Homo sapiens
ctgggactcctgatacctt

SEQ ID NO: 7327486 - DNA, 22 bp, Homo sapiens
ctgggccttggattgacactgt

SEQ ID NO: 7327487 - DNA, 22 bp, Homo sapiens
ctgggagcgcagcaggcacaac

SEQ ID NO: 7327488 - DNA, 18 bp, Homo sapiens
ctggtctcccttcgcttt

SEQ ID NO: 7327489 - DNA, 18 bp, Homo sapiens
ctggtctcccttcgcttt

SEQ ID NO: 7327490 - DNA, 22 bp, Homo sapiens
ctggtgagactcagggatgctt

SEQ ID NO: 7327491 - DNA, 22 bp, Homo sapiens
ctgtattttttaagaatatctc

SEQ ID NO: 7327492 - DNA, 22 bp, Homo sapiens
ctgtatatggcttactttatat

SEQ ID NO: 7327493 - DNA, 22 bp, Homo sapiens
ctgtctgaatcctaagcttcct

SEQ ID NO: 7327494 - DNA, 22 bp, Homo sapiens
ctgtcactgatgctcctgccac

SEQ ID NO: 7327495 - DNA, 22 bp, Homo sapiens
ctgtctgtgacctctgcatgtc

SEQ ID NO: 7327496 - DNA, 22 bp, Homo sapiens
gaggagaggctggacgcggtga

SEQ ID NO: 7327497 - DNA, 22 bp, Homo sapiens
gaggagagatggtagattgggt

SEQ ID NO: 7327498 - DNA, 22 bp, Homo sapiens
gaggagagatggtagattgggt

SEQ ID NO: 7327499 - DNA, 22 bp, Homo sapiens
gaggagagcctgcactttgacc

SEQ ID NO: 7327500 - DNA, 22 bp, Homo sapiens
gaggagaggccatcgttgttat

SEQ ID NO: 7327501 - DNA, 22 bp, Homo sapiens
gaggagccaaggtatgtgtgtt

SEQ ID NO: 7327502 - DNA, 20 bp, Homo sapiens
gaggagccaccttgagctgg

SEQ ID NO: 7327503 - DNA, 22 bp, Homo sapiens
gaggagccaaggtatgtgtgtt

SEQ ID NO: 7327504 - DNA, 20 bp, Homo sapiens
gaggagccaccttgagctgg

SEQ ID NO: 7327505 - DNA, 22 bp, Homo sapiens
gaggcaggcagattgcttgagg

SEQ ID NO: 7327506 - DNA, 22 bp, Homo sapiens
gaggcaggcactgttatcagca

SEQ ID NO: 7327507 - DNA, 22 bp, Homo sapiens
gaggcaggcactgttatcagca

SEQ ID NO: 7327508 - DNA, 22 bp, Homo sapiens
gaggcaggaggattgcttgagc

SEQ ID NO: 7327509 - DNA, 22 bp, Homo sapiens
gaggagcccccactgggctcac

SEQ ID NO: 7327510 - DNA, 22 bp, Homo sapiens
gaggagcccagcaccatcactt

SEQ ID NO: 7327511 - DNA, 22 bp, Homo sapiens
gaggagccatagatagtgctgc

SEQ ID NO: 7327512 - DNA, 22 bp, Homo sapiens
gaggagccaggaggtctccctg

SEQ ID NO: 7327513 - DNA, 16 bp, Homo sapiens
gaggagcccctctgcc

SEQ ID NO: 7327514 - DNA, 22 bp, Homo sapiens
gaggagcccccactgggctcac

SEQ ID NO: 7327515 - DNA, 22 bp, Homo sapiens
gaggcagtgcattgtctagggg

SEQ ID NO: 7327516 - DNA, 22 bp, Homo sapiens
gaggcagtgttgaaaaggagag

SEQ ID NO: 7327517 - DNA, 22 bp, Homo sapiens
gaggcagtgtcggtggcaggat

SEQ ID NO: 7327518 - DNA, 22 bp, Homo sapiens
gaggcagggtgttgattacaga

SEQ ID NO: 7327519 - DNA, 22 bp, Homo sapiens
gagggagagtgatggaccattg

SEQ ID NO: 7327520 - DNA, 22 bp, Homo sapiens
gagggaggcatcatgaatccag

SEQ ID NO: 7327521 - DNA, 22 bp, Homo sapiens
gagggagggactagcattctct

SEQ ID NO: 7327522 - DNA, 22 bp, Homo sapiens
gagggagggaaagtttaacact

SEQ ID NO: 7327523 - DNA, 22 bp, Homo sapiens
gagggaggggagctccaccctc

SEQ ID NO: 7327524 - DNA, 22 bp, Homo sapiens
gagggagggccaggtcccaacc

SEQ ID NO: 7327525 - DNA, 22 bp, Homo sapiens
gagggaggtgatactgaacgta

SEQ ID NO: 7327526 - DNA, 22 bp, Homo sapiens
gagcccaggcagaggttgcagt

SEQ ID NO: 7327527 - DNA, 21 bp, Homo sapiens
gagcccaggcatctcattaat

SEQ ID NO: 7327528 - DNA, 22 bp, Homo sapiens
gagcccaggctggggttcagag

SEQ ID NO: 7327529 - DNA, 22 bp, Homo sapiens
gagcccagggcaggcaaggcag

SEQ ID NO: 7327530 - DNA, 22 bp, Homo sapiens
gagccaggtttgaatctcagtc

SEQ ID NO: 7327531 - DNA, 22 bp, Homo sapiens
gagcccagctctacctcagact

SEQ ID NO: 7327532 - DNA, 22 bp, Homo sapiens
gagcccaggaagtggaggctga

SEQ ID NO: 7327533 - DNA, 22 bp, Homo sapiens
gagcccaggagtttgatgctgc

SEQ ID NO: 7327534 - DNA, 22 bp, Homo sapiens
gagcccagcttgcacatggagc

SEQ ID NO: 7327535 - DNA, 22 bp, Homo sapiens
gagcccagctgcggccctcagc

SEQ ID NO: 7327536 - DNA, 22 bp, Homo sapiens
gaggaagaaagcataggtgggg

SEQ ID NO: 7327537 - DNA, 22 bp, Homo sapiens
gaggaaccactctgagaagcca

SEQ ID NO: 7327538 - DNA, 22 bp, Homo sapiens
gaggaacctcctgaaaagtata

SEQ ID NO: 7327539 - DNA, 22 bp, Homo sapiens
gaggaaccaaatcagcttgcac

SEQ ID NO: 7327540 - DNA, 22 bp, Homo sapiens
gaggaaccaaatcagcttgcac

SEQ ID NO: 7327541 - DNA, 21 bp, Homo sapiens
gaggaaatgctctggtgttca

SEQ ID NO: 7327542 - DNA, 22 bp, Homo sapiens
gaggaagaatcagggtggtgag

SEQ ID NO: 7327543 - DNA, 22 bp, Homo sapiens
gaggaagaatcagggtggtgag

SEQ ID NO: 7327544 - DNA, 22 bp, Homo sapiens
gaggaagaagggattagaactc

SEQ ID NO: 7327545 - DNA, 22 bp, Homo sapiens
gaggaagaagcaaaccagctaa

SEQ ID NO: 7327546 - DNA, 22 bp, Homo sapiens
gaggaagaaagcataggtgggg

SEQ ID NO: 7327547 - DNA, 22 bp, Homo sapiens
gagctgagtagaggctgctccc

SEQ ID NO: 7327548 - DNA, 22 bp, Homo sapiens
gagctgaggctcaggctggcgt

SEQ ID NO: 7327549 - DNA, 22 bp, Homo sapiens
gagccctgtagcaagtcatgtc

SEQ ID NO: 7327550 - DNA, 22 bp, Homo sapiens
gagccctgtgattctgttgtgt

SEQ ID NO: 7327551 - DNA, 22 bp, Homo sapiens
gagccctgttcaggcctcctca

SEQ ID NO: 7327552 - DNA, 22 bp, Homo sapiens
gagccctggcagtctgggatgg

SEQ ID NO: 7327553 - DNA, 22 bp, Homo sapiens
gagccctgcggagccccgaggc

SEQ ID NO: 7327554 - DNA, 22 bp, Homo sapiens
gaagccaacattccaagtagaa

SEQ ID NO: 7327555 - DNA, 22 bp, Homo sapiens
gaaggcactgaactccttctgg

SEQ ID NO: 7327556 - DNA, 22 bp, Homo sapiens
gaagccacagagattgtggggg

SEQ ID NO: 7327557 - DNA, 22 bp, Homo sapiens
gaagccacagggaaggagaaca

SEQ ID NO: 7327558 - DNA, 22 bp, Homo sapiens
gaagccacaactttttcttagc

SEQ ID NO: 7327559 - DNA, 23 bp, Homo sapiens
gaagccacacaaaggtcgccaag

SEQ ID NO: 7327560 - DNA, 22 bp, Homo sapiens
gaagccaccctccttccagccc

SEQ ID NO: 7327561 - DNA, 20 bp, Homo sapiens
gaagccaccctcagattcca

SEQ ID NO: 7327562 - DNA, 22 bp, Homo sapiens
gaagccacgttaaattggctgt

SEQ ID NO: 7327563 - DNA, 22 bp, Homo sapiens
gaagccactatagatattctaa

SEQ ID NO: 7327564 - DNA, 22 bp, Homo sapiens
gaagccactgtgagtggttcca

SEQ ID NO: 7327565 - DNA, 22 bp, Homo sapiens
gaaggtggcgagcggattgctg

SEQ ID NO: 7327566 - DNA, 22 bp, Homo sapiens
gaatccatcatgcagaacaatg

SEQ ID NO: 7327567 - DNA, 22 bp, Homo sapiens
gacatttaaattgcaggcagcc

SEQ ID NO: 7327568 - DNA, 22 bp, Homo sapiens
gacatttactgaatactgatta

SEQ ID NO: 7327569 - DNA, 22 bp, Homo sapiens
gacattcaagtttgcagttagg

SEQ ID NO: 7327570 - DNA, 22 bp, Homo sapiens
gactgagggacagggcagtgga

SEQ ID NO: 7327571 - DNA, 22 bp, Homo sapiens
gacatttagaagttagattcaa

SEQ ID NO: 7327572 - DNA, 22 bp, Homo sapiens
gagaaagacgtaggctgggagg

SEQ ID NO: 7327573 - DNA, 22 bp, Homo sapiens
gagaaagatgaagagtggcgtt

SEQ ID NO: 7327574 - DNA, 22 bp, Homo sapiens
gagaaacaggaattgagtcgct

SEQ ID NO: 7327575 - DNA, 22 bp, Homo sapiens
gactgaggtgacctaggactac

SEQ ID NO: 7327576 - DNA, 22 bp, Homo sapiens
gagacagatgctgctggagcat

SEQ ID NO: 7327577 - DNA, 22 bp, Homo sapiens
gagaaagatgtaggctgggagg

SEQ ID NO: 7327578 - DNA, 22 bp, Homo sapiens
gagagaaccctaaatgagatat

SEQ ID NO: 7327579 - DNA, 18 bp, Homo sapiens
gagagggatccctcagga

SEQ ID NO: 7327580 - DNA, 22 bp, Homo sapiens
ccctttaaggtctgattttcag

SEQ ID NO: 7327581 - DNA, 22 bp, Homo sapiens
tggcaggaaaaacattggagat

SEQ ID NO: 7327582 - DNA, 22 bp, Homo sapiens
tggcagagaacacacatgattc

SEQ ID NO: 7327583 - DNA, 22 bp, Homo sapiens
tggagagaaaaaagacagttct

SEQ ID NO: 7327584 - DNA, 22 bp, Homo sapiens
tggagaattctatgttgagggg

SEQ ID NO: 7327585 - DNA, 22 bp, Homo sapiens
tggaggcatgacagtgtctgga

SEQ ID NO: 7327586 - DNA, 22 bp, Homo sapiens
tggaggcattgtgactgctgaa

SEQ ID NO: 7327587 - DNA, 22 bp, Homo sapiens
tggaggcattttaggttgtcac

SEQ ID NO: 7327588 - DNA, 22 bp, Homo sapiens
tggaggcatttgatgttcataa

SEQ ID NO: 7327589 - DNA, 22 bp, Homo sapiens
tggaggcatttctttttggtcg

SEQ ID NO: 7327590 - DNA, 16 bp, Homo sapiens
tggaggcatctggccc

SEQ ID NO: 7327591 - DNA, 22 bp, Homo sapiens
tggaggcataggcctgggccct

SEQ ID NO: 7327592 - DNA, 22 bp, Homo sapiens
tggaggcatcagagtgcttggc

SEQ ID NO: 7327593 - DNA, 22 bp, Homo sapiens
tggaggcagtttaagtctgaga

SEQ ID NO: 7327594 - DNA, 22 bp, Homo sapiens
tggagctgaggggaatgctgag

SEQ ID NO: 7327595 - DNA, 22 bp, Homo sapiens
tgctcaggtgccttggctgctg

SEQ ID NO: 7327596 - DNA, 22 bp, Homo sapiens
tgctacaggcgatcctcaacta

SEQ ID NO: 7327597 - DNA, 22 bp, Homo sapiens
tgctacagctgttcagtgccct

SEQ ID NO: 7327598 - DNA, 22 bp, Homo sapiens
tgctacagagccaggaagagtg

SEQ ID NO: 7327599 - DNA, 22 bp, Homo sapiens
tgctacagagcgggggctcagt

SEQ ID NO: 7327600 - DNA, 22 bp, Homo sapiens
tgctcaggagcttagagcacag

SEQ ID NO: 7327601 - DNA, 22 bp, Homo sapiens
tgctcaggaaataatgtctgtg

SEQ ID NO: 7327602 - DNA, 22 bp, Homo sapiens
tgctcaggaggaggctgtgagg

SEQ ID NO: 7327603 - DNA, 19 bp, Homo sapiens
tgctcaggccaaggagccc

SEQ ID NO: 7327604 - DNA, 22 bp, Homo sapiens
tgctcaggccagccggacagag

SEQ ID NO: 7327605 - DNA, 22 bp, Homo sapiens
tgctcagggacaatggagaggg

SEQ ID NO: 7327606 - DNA, 22 bp, Homo sapiens
cccagttgttgccggctctgga

SEQ ID NO: 7327607 - DNA, 22 bp, Homo sapiens
tgctgctcacacacagtgaatg

SEQ ID NO: 7327608 - DNA, 22 bp, Homo sapiens
ccctcccggcgtgctgggctcg

SEQ ID NO: 7327609 - DNA, 22 bp, Homo sapiens
tgggcagactaaggtcaaagct

SEQ ID NO: 7327610 - DNA, 21 bp, Homo sapiens
tgggatagaaatatggctgct

SEQ ID NO: 7327611 - DNA, 17 bp, Homo sapiens
cctcccacaccgccctg

SEQ ID NO: 7327612 - DNA, 22 bp, Homo sapiens
tggcagtgggaagctggaagtc

SEQ ID NO: 7327613 - DNA, 22 bp, Homo sapiens
tggcagtggtgtctgcacaggc

SEQ ID NO: 7327614 - DNA, 22 bp, Homo sapiens
tggtaggaatgattacgacttt

SEQ ID NO: 7327615 - DNA, 22 bp, Homo sapiens
cctgccagaaaagagggagttc

SEQ ID NO: 7327616 - DNA, 19 bp, Homo sapiens
cctgatggagctggtgcaa

SEQ ID NO: 7327617 - DNA, 22 bp, Homo sapiens
tggggagcacggtagggaaatg

SEQ ID NO: 7327618 - DNA, 22 bp, Homo sapiens
ccagttaaacaacatccatttc

SEQ ID NO: 7327619 - DNA, 22 bp, Homo sapiens
ccagttaaggaaacagcacgaa

SEQ ID NO: 7327620 - DNA, 22 bp, Homo sapiens
ccagttaatcactgagtcctgt

SEQ ID NO: 7327621 - DNA, 22 bp, Homo sapiens
ccagttaattgggtgggtctcg

SEQ ID NO: 7327622 - DNA, 21 bp, Homo sapiens
ccatacctacctcacctggtt

SEQ ID NO: 7327623 - DNA, 23 bp, Homo sapiens
ccatcaggcctccgtgtccagcc

SEQ ID NO: 7327624 - DNA, 22 bp, Homo sapiens
ccatcccttcaccacagcagta

SEQ ID NO: 7327625 - DNA, 22 bp, Homo sapiens
ccatcccttcaccacagcagta

SEQ ID NO: 7327626 - DNA, 22 bp, Homo sapiens
ccatcccttctctggccagcag

SEQ ID NO: 7327627 - DNA, 22 bp, Homo sapiens
ccatcctgaatggtctcagcca

SEQ ID NO: 7327628 - DNA, 23 bp, Homo sapiens
ccatcccttggaagctggtttta

SEQ ID NO: 7327629 - DNA, 22 bp, Homo sapiens
ccatccctgggccatgtcccct

SEQ ID NO: 7327630 - DNA, 22 bp, Homo sapiens
ccatccctgagtcacaggaggg

SEQ ID NO: 7327631 - DNA, 22 bp, Homo sapiens
ccatccctgagtcacaggaggg

SEQ ID NO: 7327632 - DNA, 22 bp, Homo sapiens
ccatccctgccattatagccca

SEQ ID NO: 7327633 - DNA, 22 bp, Homo sapiens
ccatccctcctactcacagtca

SEQ ID NO: 7327634 - DNA, 22 bp, Homo sapiens
ccatccctcctccaccagctag

SEQ ID NO: 7327635 - DNA, 22 bp, Homo sapiens
tgagcaggggagagcgaatgtg

SEQ ID NO: 7327636 - DNA, 22 bp, Homo sapiens
tgagcagggagctgggctgagc

SEQ ID NO: 7327637 - DNA, 22 bp, Homo sapiens
tgagcaggtcaggaagtacatt

SEQ ID NO: 7327638 - DNA, 18 bp, Homo sapiens
tgagcaggggctgacctt

SEQ ID NO: 7327639 - DNA, 22 bp, Homo sapiens
tgagcaggtcaagactccagct

SEQ ID NO: 7327640 - DNA, 21 bp, Homo sapiens
tgagcaggtgctgcttttatg

SEQ ID NO: 7327641 - DNA, 22 bp, Homo sapiens
tgagcaggtgagtctagggcag

SEQ ID NO: 7327642 - DNA, 21 bp, Homo sapiens
tgagcaggtgcagggaagtgg

SEQ ID NO: 7327643 - DNA, 22 bp, Homo sapiens
ccaggtggaggtgtgaggtcct

SEQ ID NO: 7327644 - DNA, 17 bp, Homo sapiens
ccaggtgggaggtgggg

SEQ ID NO: 7327645 - DNA, 22 bp, Homo sapiens
tgagcccaggaggcagaggttg

SEQ ID NO: 7327646 - DNA, 22 bp, Homo sapiens
tgagcccaggaggcagaggttg

SEQ ID NO: 7327647 - DNA, 22 bp, Homo sapiens
tgagcccaggagttggagaccg

SEQ ID NO: 7327648 - DNA, 22 bp, Homo sapiens
tgaggcagtgtgagataataaa

SEQ ID NO: 7327649 - DNA, 22 bp, Homo sapiens
tgcactttgcaggcatggaaac

SEQ ID NO: 7327650 - DNA, 22 bp, Homo sapiens
cccaaggcctctccttggcttg

SEQ ID NO: 7327651 - DNA, 22 bp, Homo sapiens
cccagcagggtctctgtgtcta

SEQ ID NO: 7327652 - DNA, 22 bp, Homo sapiens
tgcaggactttcagtgctcaaa

SEQ ID NO: 7327653 - DNA, 22 bp, Homo sapiens
tgcaggagaaagtacggagcgt

SEQ ID NO: 7327654 - DNA, 20 bp, Homo sapiens
tgcaggacagagcctgtgtg

SEQ ID NO: 7327655 - DNA, 22 bp, Homo sapiens
tgcaggacttcaggactctgag

SEQ ID NO: 7327656 - DNA, 22 bp, Homo sapiens
tgcaggactggggagcggaagg

SEQ ID NO: 7327657 - DNA, 22 bp, Homo sapiens
tgcaggactgaaggagggctgg

SEQ ID NO: 7327658 - DNA, 22 bp, Homo sapiens
tgcaggacccgggctgtggtca

SEQ ID NO: 7327659 - DNA, 23 bp, Homo sapiens
tgcaggactactcgagcactgct

SEQ ID NO: 7327660 - DNA, 22 bp, Homo sapiens
tgcagctgattaaagggcagac

SEQ ID NO: 7327661 - DNA, 22 bp, Homo sapiens
tgcagccaccacctctgctgaa

SEQ ID NO: 7327662 - DNA, 22 bp, Homo sapiens
tctgggcctcagtttcttcatc

SEQ ID NO: 7327663 - DNA, 22 bp, Homo sapiens
tctgggcctcacctgctgctca

SEQ ID NO: 7327664 - DNA, 22 bp, Homo sapiens
tctgggccgctgcgttccatga

SEQ ID NO: 7327665 - DNA, 22 bp, Homo sapiens
ccaggagcaaagatcactggga

SEQ ID NO: 7327666 - DNA, 22 bp, Homo sapiens
ccaggagcagagtaggtgttca

SEQ ID NO: 7327667 - DNA, 22 bp, Homo sapiens
ccaggagcagccggcccacctg

SEQ ID NO: 7327668 - DNA, 22 bp, Homo sapiens
ccaggagcagggctggctgcac

SEQ ID NO: 7327669 - DNA, 22 bp, Homo sapiens
ccaggagccactcaggcccaca

SEQ ID NO: 7327670 - DNA, 23 bp, Homo sapiens
tctgtggctccttcaggctgctg

SEQ ID NO: 7327671 - DNA, 22 bp, Homo sapiens
tcttaattctgtgtcttcacta

SEQ ID NO: 7327672 - DNA, 22 bp, Homo sapiens
ccagggcacgttgggacagtac

SEQ ID NO: 7327673 - DNA, 22 bp, Homo sapiens
ccagggcagggaccacgtgtct

SEQ ID NO: 7327674 - DNA, 22 bp, Homo sapiens
ccagggcaggagaaagactcac

SEQ ID NO: 7327675 - DNA, 22 bp, Homo sapiens
ccagggcaaatgagatcatagc

SEQ ID NO: 7327676 - DNA, 22 bp, Homo sapiens
ccagggcaacgctgtctcagag

SEQ ID NO: 7327677 - DNA, 22 bp, Homo sapiens
ccagggcaataggaacactttt

SEQ ID NO: 7327678 - DNA, 22 bp, Homo sapiens
ccagggcaattatttggagggt

SEQ ID NO: 7327679 - DNA, 22 bp, Homo sapiens
tgaagtgggggaacgagagttc

SEQ ID NO: 7327680 - DNA, 22 bp, Homo sapiens
ccagggcatcctcacatcgcag

SEQ ID NO: 7327681 - DNA, 22 bp, Homo sapiens
ccagggcaggggctggagttca

SEQ ID NO: 7327682 - DNA, 22 bp, Homo sapiens
ccagggcagtgggagaaggtgc

SEQ ID NO: 7327683 - DNA, 22 bp, Homo sapiens
ccagggcatcacatccagtgtt

SEQ ID NO: 7327684 - DNA, 22 bp, Homo sapiens
tgaagtgggaatacttcttccc

SEQ ID NO: 7327685 - DNA, 22 bp, Homo sapiens
ccaggcctgattgggaatcttg

SEQ ID NO: 7327686 - DNA, 22 bp, Homo sapiens
ccaggctgtggtttagatagag

SEQ ID NO: 7327687 - DNA, 22 bp, Homo sapiens
tacagttactttgaaaattgat

SEQ ID NO: 7327688 - DNA, 22 bp, Homo sapiens
tacagttatatgtgataagtaa

SEQ ID NO: 7327689 - DNA, 22 bp, Homo sapiens
tacagttagtgcctggctactt

SEQ ID NO: 7327690 - DNA, 17 bp, Homo sapiens
tacagttagaatctgga

SEQ ID NO: 7327691 - DNA, 22 bp, Homo sapiens
tacagttagcctgtctactccc

SEQ ID NO: 7327692 - DNA, 22 bp, Homo sapiens
tacagctgagtttaggtacagg

SEQ ID NO: 7327693 - DNA, 22 bp, Homo sapiens
tacagctggactggtagctgtg

SEQ ID NO: 7327694 - DNA, 23 bp, Homo sapiens
tacagttatgttcctgggtcact

SEQ ID NO: 7327695 - DNA, 22 bp, Homo sapiens
tacaatagggcttttgtttatg

SEQ ID NO: 7327696 - DNA, 17 bp, Homo sapiens
cagctctgcatcttcct

SEQ ID NO: 7327697 - DNA, 22 bp, Homo sapiens
cagctctgccatcatctgcctt

SEQ ID NO: 7327698 - DNA, 22 bp, Homo sapiens
cagctctgcctctggggctgag

SEQ ID NO: 7327699 - DNA, 22 bp, Homo sapiens
tacactggacaggagtaggaag

SEQ ID NO: 7327700 - DNA, 22 bp, Homo sapiens
tagcataacaggtaagagtgag

SEQ ID NO: 7327701 - DNA, 22 bp, Homo sapiens
tagcatctgtttctctttgtga

SEQ ID NO: 7327702 - DNA, 22 bp, Homo sapiens
cagggagggacaattgtcacct

SEQ ID NO: 7327703 - DNA, 22 bp, Homo sapiens
cagggagggaggaaaatttgct

SEQ ID NO: 7327704 - DNA, 22 bp, Homo sapiens
cagggaggatgggctgttttgc

SEQ ID NO: 7327705 - DNA, 23 bp, Homo sapiens
cagggaggagatactgtgtatct

SEQ ID NO: 7327706 - DNA, 22 bp, Homo sapiens
cagggaggctgtcttatgcctg

SEQ ID NO: 7327707 - DNA, 22 bp, Homo sapiens
tacctcatgctgtacagcacgt

SEQ ID NO: 7327708 - DNA, 22 bp, Homo sapiens
tacctcattacatctgcaatga

SEQ ID NO: 7327709 - DNA, 22 bp, Homo sapiens
tagaaagaacttcatgtaaaac

SEQ ID NO: 7327710 - DNA, 22 bp, Homo sapiens
tagaaagactgtccagatttca

SEQ ID NO: 7327711 - DNA, 22 bp, Homo sapiens
tagacaggagtcaggctagaat

SEQ ID NO: 7327712 - DNA, 22 bp, Homo sapiens
tatattgtagctgatgacaaat

SEQ ID NO: 7327713 - DNA, 22 bp, Homo sapiens
tatgaacatgctgtggttataa

SEQ ID NO: 7327714 - DNA, 23 bp, Homo sapiens
cagtacaatgtggaaaaggagtg

SEQ ID NO: 7327715 - DNA, 22 bp, Homo sapiens
cagtaaaagatggaaatagaat

SEQ ID NO: 7327716 - DNA, 22 bp, Homo sapiens
cagtacttggggggttctaagt

SEQ ID NO: 7327717 - DNA, 22 bp, Homo sapiens
cagtacttagttctcatggttt

SEQ ID NO: 7327718 - DNA, 22 bp, Homo sapiens
caggtggcttattagggtcagt

SEQ ID NO: 7327719 - DNA, 22 bp, Homo sapiens
caggtgggcgtggcgagaaggc

SEQ ID NO: 7327720 - DNA, 22 bp, Homo sapiens
caggtggggagagtgtggagca

SEQ ID NO: 7327721 - DNA, 22 bp, Homo sapiens
caggtgggcttgggagaacact

SEQ ID NO: 7327722 - DNA, 22 bp, Homo sapiens
caggtgggctgcctctccagct

SEQ ID NO: 7327723 - DNA, 22 bp, Homo sapiens
caggtggggcagctgtgggagc

SEQ ID NO: 7327724 - DNA, 22 bp, Homo sapiens
caggtggggcgccctcaggcag

SEQ ID NO: 7327725 - DNA, 22 bp, Homo sapiens
tatatagaaaagcagatgttgg

SEQ ID NO: 7327726 - DNA, 22 bp, Homo sapiens
tatatatatgcacacacaccta

SEQ ID NO: 7327727 - DNA, 22 bp, Homo sapiens
tagttttagcagcaatgggatg

SEQ ID NO: 7327728 - DNA, 22 bp, Homo sapiens
tatagtttcatgagctttttaa

SEQ ID NO: 7327729 - DNA, 22 bp, Homo sapiens
tatataattttctgccatatcc

SEQ ID NO: 7327730 - DNA, 22 bp, Homo sapiens
tagtacagtggcattcaaactt

SEQ ID NO: 7327731 - DNA, 22 bp, Homo sapiens
tagtacagtgctctgtaagttt

SEQ ID NO: 7327732 - DNA, 22 bp, Homo sapiens
tagtacagttccatcaaagcag

SEQ ID NO: 7327733 - DNA, 22 bp, Homo sapiens
tagtaagtagctaatatttact

SEQ ID NO: 7327734 - DNA, 22 bp, Homo sapiens
taggtaggtgtcataatccatg

SEQ ID NO: 7327735 - DNA, 22 bp, Homo sapiens
taggtaggtggaaaagtaattg

SEQ ID NO: 7327736 - DNA, 22 bp, Homo sapiens
tcacatgtcagtcttaaacaga

SEQ ID NO: 7327737 - DNA, 22 bp, Homo sapiens
tcactctgaatggtactgagga

SEQ ID NO: 7327738 - DNA, 22 bp, Homo sapiens
cagtggcagatcaccaactgga

SEQ ID NO: 7327739 - DNA, 22 bp, Homo sapiens
cagtactttgcatcattccact

SEQ ID NO: 7327740 - DNA, 22 bp, Homo sapiens
tattccaccagagatgtgaatt

SEQ ID NO: 7327741 - DNA, 22 bp, Homo sapiens
tcaaaagaaacaccatgttcct

SEQ ID NO: 7327742 - DNA, 22 bp, Homo sapiens
tcaaagcaatttcaccagtgcc

SEQ ID NO: 7327743 - DNA, 22 bp, Homo sapiens
cagtgaaatcacaactttagtt

SEQ ID NO: 7327744 - DNA, 22 bp, Homo sapiens
cagtgaaatcacaactttagtt

SEQ ID NO: 7327745 - DNA, 22 bp, Homo sapiens
cagtctttgatgcatcctagcc

SEQ ID NO: 7327746 - DNA, 22 bp, Homo sapiens
cagtcttagccttccctcaccc

SEQ ID NO: 7327747 - DNA, 22 bp, Homo sapiens
cagtctgggactgagctccacc

SEQ ID NO: 7327748 - DNA, 22 bp, Homo sapiens
cagtctggcacagcacactgaa

SEQ ID NO: 7327749 - DNA, 20 bp, Homo sapiens
ccaagagcatgcatgaggaa

SEQ ID NO: 7327750 - DNA, 22 bp, Homo sapiens
ccaagaggcagaatgcagagaa

SEQ ID NO: 7327751 - DNA, 22 bp, Homo sapiens
ccaagaggttgaggctgcagtg

SEQ ID NO: 7327752 - DNA, 16 bp, Homo sapiens
tcctggcctttggaag

SEQ ID NO: 7327753 - DNA, 22 bp, Homo sapiens
ccaccaggacagccctgagggg

SEQ ID NO: 7327754 - DNA, 22 bp, Homo sapiens
tcctggctaatgctgctgatgg

SEQ ID NO: 7327755 - DNA, 22 bp, Homo sapiens
tcctggcctgtctggagtagct

SEQ ID NO: 7327756 - DNA, 22 bp, Homo sapiens
ccacagctgaccgcaggtgagc

SEQ ID NO: 7327757 - DNA, 20 bp, Homo sapiens
catttcattgtgtcttcact

SEQ ID NO: 7327758 - DNA, 22 bp, Homo sapiens
catttcattcctttgaaagtgg

SEQ ID NO: 7327759 - DNA, 21 bp, Homo sapiens
catttcatgattatagaaatg

SEQ ID NO: 7327760 - DNA, 22 bp, Homo sapiens
catttcatagttgtcacaataa

SEQ ID NO: 7327761 - DNA, 22 bp, Homo sapiens
catttcactattcactaaaagg

SEQ ID NO: 7327762 - DNA, 22 bp, Homo sapiens
catttattggcatgtagtaggt

SEQ ID NO: 7327763 - DNA, 22 bp, Homo sapiens
cattttgtgctagacactatgg

SEQ ID NO: 7327764 - DNA, 19 bp, Homo sapiens
cattttctcattgtgcccc

SEQ ID NO: 7327765 - DNA, 22 bp, Homo sapiens
cattttgtaagtctctcttgtt

SEQ ID NO: 7327766 - DNA, 22 bp, Homo sapiens
tctcaggaatagagtggcagca

SEQ ID NO: 7327767 - DNA, 22 bp, Homo sapiens
tctataatcctatttcaactgc

SEQ ID NO: 7327768 - DNA, 22 bp, Homo sapiens
tctagaatttgcgtaggttaga

SEQ ID NO: 7327769 - DNA, 22 bp, Homo sapiens
tctcaggatctaatacatggta

SEQ ID NO: 7327770 - DNA, 21 bp, Homo sapiens
tctagaatcctgtataagact

SEQ ID NO: 7327771 - DNA, 22 bp, Homo sapiens
tcctgttgttcgcctgcgatgg

SEQ ID NO: 7327772 - DNA, 22 bp, Homo sapiens
ccaccaggcactcacagggaag

SEQ ID NO: 7327773 - DNA, 22 bp, Homo sapiens
ccagaggatcagtactggctgg

SEQ ID NO: 7327774 - DNA, 22 bp, Homo sapiens
catcagtttggtcaatgatggg

SEQ ID NO: 7327775 - DNA, 22 bp, Homo sapiens
catcaggatctctctggaatgc

SEQ ID NO: 7327776 - DNA, 22 bp, Homo sapiens
catcaggataagttccaggtgg

SEQ ID NO: 7327777 - DNA, 22 bp, Homo sapiens
catcaggaggagatgaagaaaa

SEQ ID NO: 7327778 - DNA, 22 bp, Homo sapiens
catcaggagaccaggtcctgct

SEQ ID NO: 7327779 - DNA, 20 bp, Homo sapiens
catcaggaccctcagttttt

SEQ ID NO: 7327780 - DNA, 22 bp, Homo sapiens
catcaggacagcttcttttcac

SEQ ID NO: 7327781 - DNA, 22 bp, Homo sapiens
catcaggaataaatgaggctgt

SEQ ID NO: 7327782 - DNA, 22 bp, Homo sapiens
catcaggaattatcctaattat

SEQ ID NO: 7327783 - DNA, 22 bp, Homo sapiens
catcaggaaaaaactggagcca

SEQ ID NO: 7327784 - DNA, 22 bp, Homo sapiens
catcaggaaaggacgtctagcc

SEQ ID NO: 7327785 - DNA, 22 bp, Homo sapiens
tcatcacatatgtcatgatttg

SEQ ID NO: 7327786 - DNA, 22 bp, Homo sapiens
catccctgtctgccactctgaa

SEQ ID NO: 7327787 - DNA, 22 bp, Homo sapiens
catcgtgtctaggtgtgcagca

SEQ ID NO: 7327788 - DNA, 22 bp, Homo sapiens
catctacctccaccctatatat

SEQ ID NO: 7327789 - DNA, 22 bp, Homo sapiens
catctaccagaattgctataaa

SEQ ID NO: 7327790 - DNA, 22 bp, Homo sapiens
tcaggctgcagtggcaaaagac

SEQ ID NO: 7327791 - DNA, 22 bp, Homo sapiens
catcaaagcttttttctgtgtt

SEQ ID NO: 7327792 - DNA, 22 bp, Homo sapiens
tcaggagggagtgtggatagag

SEQ ID NO: 7327793 - DNA, 22 bp, Homo sapiens
tcaggaggctcaagacctggca

SEQ ID NO: 7327794 - DNA, 22 bp, Homo sapiens
tcaggaggcggaggttgcagtg

SEQ ID NO: 7327795 - DNA, 22 bp, Homo sapiens
cattaattgtatttttcaaagt

SEQ ID NO: 7327796 - DNA, 22 bp, Homo sapiens
cattacaaagttataaacagtt

SEQ ID NO: 7327797 - DNA, 22 bp, Homo sapiens
cattacaaccccaaattacaaa

SEQ ID NO: 7327798 - DNA, 22 bp, Homo sapiens
catggtttggtctttgtagtgg

SEQ ID NO: 7327799 - DNA, 22 bp, Homo sapiens
catgcttacttgtctcagcaga

SEQ ID NO: 7327800 - DNA, 22 bp, Homo sapiens
tcatcaggaaacttatgcagtg

SEQ ID NO: 7327801 - DNA, 22 bp, Homo sapiens
tcatcaggaaacttatgcagtg

SEQ ID NO: 7327802 - DNA, 22 bp, Homo sapiens
tcatcagggatattggcctgaa

SEQ ID NO: 7327803 - DNA, 22 bp, Homo sapiens
catgctatttatacataagtct

SEQ ID NO: 7327804 - DNA, 22 bp, Homo sapiens
tccaagaagcttacaatctaat

SEQ ID NO: 7327805 - DNA, 22 bp, Homo sapiens
tccaagagaatactggagagta

SEQ ID NO: 7327806 - DNA, 22 bp, Homo sapiens
ttttaattttgcaaatctggtg

SEQ ID NO: 7327807 - DNA, 22 bp, Homo sapiens
ttttattgtcaatgaagacaga

SEQ ID NO: 7327808 - DNA, 22 bp, Homo sapiens
ttttattgtctgtattgcctat

SEQ ID NO: 7327809 - DNA, 22 bp, Homo sapiens
ttttattgtctcccagttctgg

SEQ ID NO: 7327810 - DNA, 16 bp, Homo sapiens
ttttattgtgacagcc

SEQ ID NO: 7327811 - DNA, 22 bp, Homo sapiens
ttttacttcattcctgacttca

SEQ ID NO: 7327812 - DNA, 22 bp, Homo sapiens
ttttattgggagtcctctactg

SEQ ID NO: 7327813 - DNA, 22 bp, Homo sapiens
ttttattgggagtcctctactg

SEQ ID NO: 7327814 - DNA, 19 bp, Homo sapiens
ttttcccaccctttagaat

SEQ ID NO: 7327815 - DNA, 22 bp, Homo sapiens
tttttgttctgattatactggt

SEQ ID NO: 7327816 - DNA, 22 bp, Homo sapiens
tttttgtcatctatttctggtg

SEQ ID NO: 7327817 - DNA, 22 bp, Homo sapiens
tttttgtctagcgtctctagtt

SEQ ID NO: 7327818 - DNA, 22 bp, Homo sapiens
ttttgtctaagaactttgcaaa

SEQ ID NO: 7327819 - DNA, 22 bp, Homo sapiens
tttctattggcgtcactgttgt

SEQ ID NO: 7327820 - DNA, 22 bp, Homo sapiens
tttctattctggatctgtggca

SEQ ID NO: 7327821 - DNA, 22 bp, Homo sapiens
tttctatatgaggagctaaagt

SEQ ID NO: 7327822 - DNA, 22 bp, Homo sapiens
tttgaaattaagatattgtcca

SEQ ID NO: 7327823 - DNA, 22 bp, Homo sapiens
tttgaaatatgaggcattatga

SEQ ID NO: 7327824 - DNA, 22 bp, Homo sapiens
tttgaaatatgtgatgagagag

SEQ ID NO: 7327825 - DNA, 22 bp, Homo sapiens
tttctagacatttctatgtaca

SEQ ID NO: 7327826 - DNA, 22 bp, Homo sapiens
tttctagagttcatcatggtaa

SEQ ID NO: 7327827 - DNA, 22 bp, Homo sapiens
tttctagatgcttttgaaaatc

SEQ ID NO: 7327828 - DNA, 22 bp, Homo sapiens
tttctaggtcttccatactgcc

SEQ ID NO: 7327829 - DNA, 22 bp, Homo sapiens
tttgacatctaagaattcttac

SEQ ID NO: 7327830 - DNA, 22 bp, Homo sapiens
tttgaacatgctgcatgataat

SEQ ID NO: 7327831 - DNA, 22 bp, Homo sapiens
tttgaaattggctcattggttt

SEQ ID NO: 7327832 - DNA, 22 bp, Homo sapiens
tttgaacaagagcttcacatta

SEQ ID NO: 7327833 - DNA, 22 bp, Homo sapiens
tttgaacaggagtatctatagt

SEQ ID NO: 7327834 - DNA, 22 bp, Homo sapiens
tttgcattctagaaaaatttct

SEQ ID NO: 7327835 - DNA, 22 bp, Homo sapiens
tttgcattgcagtggtttacag

SEQ ID NO: 7327836 - DNA, 22 bp, Homo sapiens
tttgcattgcattaagtattct

SEQ ID NO: 7327837 - DNA, 22 bp, Homo sapiens
tttgcattgtaatatttagttc

SEQ ID NO: 7327838 - DNA, 22 bp, Homo sapiens
tttgcattgtttcaaaagtgaa

SEQ ID NO: 7327839 - DNA, 22 bp, Homo sapiens
tttgcatttccagagtagcaga

SEQ ID NO: 7327840 - DNA, 22 bp, Homo sapiens
tttgcatttgcaaataatgaaa

SEQ ID NO: 7327841 - DNA, 22 bp, Homo sapiens
tttgcatttgttcaagtattga

SEQ ID NO: 7327842 - DNA, 22 bp, Homo sapiens
tttgcattatctcacttatata

SEQ ID NO: 7327843 - DNA, 22 bp, Homo sapiens
tttgcattatctcacttatata

SEQ ID NO: 7327844 - DNA, 22 bp, Homo sapiens
tttgcattatatttatagaaga

SEQ ID NO: 7327845 - DNA, 22 bp, Homo sapiens
tttgcatgggaggtagtaatca

SEQ ID NO: 7327846 - DNA, 22 bp, Homo sapiens
tttgcagttcatctgagaaaaa

SEQ ID NO: 7327847 - DNA, 22 bp, Homo sapiens
tttgcagtgttcatcagtattt

SEQ ID NO: 7327848 - DNA, 20 bp, Homo sapiens
tttgagaccagtctgcccaa

SEQ ID NO: 7327849 - DNA, 22 bp, Homo sapiens
tttggcaggtggcagctctggg

SEQ ID NO: 7327850 - DNA, 21 bp, Homo sapiens
tttggcattatgtcaccagag

SEQ ID NO: 7327851 - DNA, 22 bp, Homo sapiens
tttggcgtctctcaggagctca

SEQ ID NO: 7327852 - DNA, 22 bp, Homo sapiens
tttgtcatatagactattgtga

SEQ ID NO: 7327853 - DNA, 22 bp, Homo sapiens
tttgtcatgctttccttatgga

SEQ ID NO: 7327854 - DNA, 22 bp, Homo sapiens
tttatctttaggactttgcaga

SEQ ID NO: 7327855 - DNA, 22 bp, Homo sapiens
tttatctgtgggagttgtttgg

SEQ ID NO: 7327856 - DNA, 22 bp, Homo sapiens
tttagcttttgtgtcagataag

SEQ ID NO: 7327857 - DNA, 22 bp, Homo sapiens
tttattgtctatgaactgcttg

SEQ ID NO: 7327858 - DNA, 22 bp, Homo sapiens
tttattgtcttcgtggtgccta

SEQ ID NO: 7327859 - DNA, 22 bp, Homo sapiens
tttatttataagccacttgctg

SEQ ID NO: 7327860 - DNA, 22 bp, Homo sapiens
tttatctttggatcttcagaaa

SEQ ID NO: 7327861 - DNA, 22 bp, Homo sapiens
ttgttgttggagccaatatgca

SEQ ID NO: 7327862 - DNA, 23 bp, Homo sapiens
tttaacatttgaacatgtggcca

SEQ ID NO: 7327863 - DNA, 22 bp, Homo sapiens
tttcacaactgcttatttgaga

SEQ ID NO: 7327864 - DNA, 23 bp, Homo sapiens
tttatttatttaggctgagggat

SEQ ID NO: 7327865 - DNA, 22 bp, Homo sapiens
tttatttatccttctggattgc

SEQ ID NO: 7327866 - DNA, 21 bp, Homo sapiens
tttatttatataggacacatg

SEQ ID NO: 7327867 - DNA, 22 bp, Homo sapiens
tttcaagtagccctggctccca

SEQ ID NO: 7327868 - DNA, 22 bp, Homo sapiens
tttcatagtcaagtgtgtatga

SEQ ID NO: 7327869 - DNA, 22 bp, Homo sapiens
tttccaaataaggtcacattct

SEQ ID NO: 7327870 - DNA, 22 bp, Homo sapiens
tttccaaataaggtcacactca

SEQ ID NO: 7327871 - DNA, 22 bp, Homo sapiens
tttccaaataaggtcacattct

SEQ ID NO: 7327872 - DNA, 22 bp, Homo sapiens
tttcccaattgagaggttctgt

SEQ ID NO: 7327873 - DNA, 22 bp, Homo sapiens
tttcccaatgagtccttgagca

SEQ ID NO: 7327874 - DNA, 22 bp, Homo sapiens
tttcccaagtgtaaacatggca

SEQ ID NO: 7327875 - DNA, 22 bp, Homo sapiens
tttcccaagtgaagtgaagcca

SEQ ID NO: 7327876 - DNA, 22 bp, Homo sapiens
tttcccaacagtctctctcaaa

SEQ ID NO: 7327877 - DNA, 22 bp, Homo sapiens
tttcccaaagcctggggtgagt

SEQ ID NO: 7327878 - DNA, 22 bp, Homo sapiens
tttcccaagaccatagatggaa

SEQ ID NO: 7327879 - DNA, 22 bp, Homo sapiens
tttcccaagaaaaataattgga

SEQ ID NO: 7327880 - DNA, 22 bp, Homo sapiens
ttgttctagcctcctgttttga

SEQ ID NO: 7327881 - DNA, 22 bp, Homo sapiens
ttgggggcagagggagcatctg

SEQ ID NO: 7327882 - DNA, 22 bp, Homo sapiens
ttgggggcatattgagtagtgg

SEQ ID NO: 7327883 - DNA, 22 bp, Homo sapiens
ttgtatcagtgcctataaaatg

SEQ ID NO: 7327884 - DNA, 22 bp, Homo sapiens
ttgtattagtaagtcagctgct

SEQ ID NO: 7327885 - DNA, 22 bp, Homo sapiens
ttgggctcaggagtttgagacc

SEQ ID NO: 7327886 - DNA, 22 bp, Homo sapiens
ttggcagagggaccagcctaca

SEQ ID NO: 7327887 - DNA, 21 bp, Homo sapiens
ttggcctgatatcttggagca

SEQ ID NO: 7327888 - DNA, 22 bp, Homo sapiens
ttgctaaaaatggaattatagg

SEQ ID NO: 7327889 - DNA, 22 bp, Homo sapiens
ttgctcaggctggtgtgcagtg

SEQ ID NO: 7327890 - DNA, 22 bp, Homo sapiens
ttgctcagtggcagggctggta

SEQ ID NO: 7327891 - DNA, 22 bp, Homo sapiens
ttgccattggcaggcctcttgt

SEQ ID NO: 7327892 - DNA, 22 bp, Homo sapiens
ttgcccagagctgcctgttaca

SEQ ID NO: 7327893 - DNA, 22 bp, Homo sapiens
ttgcccagagtcacccagctca

SEQ ID NO: 7327894 - DNA, 22 bp, Homo sapiens
ttgcattttggttgtaaatatg

SEQ ID NO: 7327895 - DNA, 22 bp, Homo sapiens
tcctctgctggaagggcaagag

SEQ ID NO: 7327896 - DNA, 22 bp, Homo sapiens
tcctctggcccagctgcctctg

SEQ ID NO: 7327897 - DNA, 22 bp, Homo sapiens
ttagttaattgactatgttgca

SEQ ID NO: 7327898 - DNA, 22 bp, Homo sapiens
ttataattctggcataggctgt

SEQ ID NO: 7327899 - DNA, 22 bp, Homo sapiens
ttattaaaatgcggatttggct

SEQ ID NO: 7327900 - DNA, 22 bp, Homo sapiens
ttatttgtggcatatgagacga

SEQ ID NO: 7327901 - DNA, 22 bp, Homo sapiens
ttatttaggaggaaactgaggt

SEQ ID NO: 7327902 - DNA, 22 bp, Homo sapiens
ttatttactggatggccttggg

SEQ ID NO: 7327903 - DNA, 22 bp, Homo sapiens
ttatttacaactcttctcttcc

SEQ ID NO: 7327904 - DNA, 22 bp, Homo sapiens
ttcagaagtagctaagcagtca

SEQ ID NO: 7327905 - DNA, 22 bp, Homo sapiens
ttcatacaatgggatattatga

SEQ ID NO: 7327906 - DNA, 22 bp, Homo sapiens
ttcagaatgctatttctgaaat

SEQ ID NO: 7327907 - DNA, 22 bp, Homo sapiens
ttcagaatgtgaccttatttgg

SEQ ID NO: 7327908 - DNA, 22 bp, Homo sapiens
ttcatattatgatttgaaatgc

SEQ ID NO: 7327909 - DNA, 17 bp, Homo sapiens
ttcccctgaccaagcct

SEQ ID NO: 7327910 - DNA, 22 bp, Homo sapiens
ttccaagagtaaattcaaattg

SEQ ID NO: 7327911 - DNA, 22 bp, Homo sapiens
ttctccatttaacttccttatg

SEQ ID NO: 7327912 - DNA, 22 bp, Homo sapiens
ttctcctcagcaaggcagcttt

SEQ ID NO: 7327913 - DNA, 22 bp, Homo sapiens
ttctaaaataagtttatctggt

SEQ ID NO: 7327914 - DNA, 22 bp, Homo sapiens
ttcctttagggaaatcgtctca

SEQ ID NO: 7327915 - DNA, 22 bp, Homo sapiens
ttcctttagtgtcatatacttt

SEQ ID NO: 7327916 - DNA, 22 bp, Homo sapiens
ttctcaaagaaagctgtcatta

SEQ ID NO: 7327917 - DNA, 22 bp, Homo sapiens
ttctcacaggctggaatgatga

SEQ ID NO: 7327918 - DNA, 19 bp, Homo sapiens
ttgaaagattagctttcta

SEQ ID NO: 7327919 - DNA, 22 bp, Homo sapiens
ttgaaaatatcacaggagcagc

SEQ ID NO: 7327920 - DNA, 22 bp, Homo sapiens
ttgaaacagtagctcatagacc

SEQ ID NO: 7327921 - DNA, 22 bp, Homo sapiens
ttctttctcaacatgaatgttt

SEQ ID NO: 7327922 - DNA, 22 bp, Homo sapiens
ttcttcttgaaactttaggttg

SEQ ID NO: 7327923 - DNA, 22 bp, Homo sapiens
attattgttttaatagtagaga

SEQ ID NO: 7327924 - DNA, 22 bp, Homo sapiens
attatttacagtgtgctcgaag

SEQ ID NO: 7327925 - DNA, 22 bp, Homo sapiens
attatttagaaatcgattgaaa

SEQ ID NO: 7327926 - DNA, 22 bp, Homo sapiens
attcagtattctgctgcataat

SEQ ID NO: 7327927 - DNA, 22 bp, Homo sapiens
attcagtcaaaaatgatggaga

SEQ ID NO: 7327928 - DNA, 22 bp, Homo sapiens
attatttatcctcttggtctat

SEQ ID NO: 7327929 - DNA, 21 bp, Homo sapiens
attccacttttccttcaggga

SEQ ID NO: 7327930 - DNA, 22 bp, Homo sapiens
attcttactccatagaatgaat

SEQ ID NO: 7327931 - DNA, 22 bp, Homo sapiens
attcttacaaatgaaactgcaa

SEQ ID NO: 7327932 - DNA, 22 bp, Homo sapiens
attcttacaaagcagagtctgt

SEQ ID NO: 7327933 - DNA, 22 bp, Homo sapiens
attcttattaaatagccagaag

SEQ ID NO: 7327934 - DNA, 22 bp, Homo sapiens
attcttaaatttaggtctgtga

SEQ ID NO: 7327935 - DNA, 22 bp, Homo sapiens
attcttaattccaaagactgag

SEQ ID NO: 7327936 - DNA, 22 bp, Homo sapiens
attctatagacagaaggtcaat

SEQ ID NO: 7327937 - DNA, 22 bp, Homo sapiens
attgacagagctttcaccatga

SEQ ID NO: 7327938 - DNA, 22 bp, Homo sapiens
attgacatgtaggctacaagga

SEQ ID NO: 7327939 - DNA, 22 bp, Homo sapiens
attgacattaactatattagcc

SEQ ID NO: 7327940 - DNA, 22 bp, Homo sapiens
gcaagtagtgggaaagaagatg

SEQ ID NO: 7327941 - DNA, 22 bp, Homo sapiens
attattgccagctattacaaca

SEQ ID NO: 7327942 - DNA, 22 bp, Homo sapiens
attattaaagctacatcaagga

SEQ ID NO: 7327943 - DNA, 22 bp, Homo sapiens
attaatattggttcattagctg

SEQ ID NO: 7327944 - DNA, 22 bp, Homo sapiens
gatgagggcctggtggctgtgc

SEQ ID NO: 7327945 - DNA, 22 bp, Homo sapiens
gatgaggggtcattggctggga

SEQ ID NO: 7327946 - DNA, 22 bp, Homo sapiens
attaaattaagtggctaattta

SEQ ID NO: 7327947 - DNA, 22 bp, Homo sapiens
attaaattaagtggctaattta

SEQ ID NO: 7327948 - DNA, 22 bp, Homo sapiens
attaaattagcaaactgtgaaa

SEQ ID NO: 7327949 - DNA, 22 bp, Homo sapiens
attaaattagcaaactgtgaaa

SEQ ID NO: 7327950 - DNA, 22 bp, Homo sapiens
atgtttttgagatacaaacaga

SEQ ID NO: 7327951 - DNA, 22 bp, Homo sapiens
atgttttcaaagtaaacttgta

SEQ ID NO: 7327952 - DNA, 22 bp, Homo sapiens
atgttttccattgccatggaaa

SEQ ID NO: 7327953 - DNA, 22 bp, Homo sapiens
atgttttccccaaatgatcttc

SEQ ID NO: 7327954 - DNA, 22 bp, Homo sapiens
atgttttcctgggagagcactc

SEQ ID NO: 7327955 - DNA, 22 bp, Homo sapiens
atgttttcaaagtaaacttgta

SEQ ID NO: 7327956 - DNA, 22 bp, Homo sapiens
atgttttctagagtttaaaatc

SEQ ID NO: 7327957 - DNA, 22 bp, Homo sapiens
atgtgttttggtaatttctgct

SEQ ID NO: 7327958 - DNA, 22 bp, Homo sapiens
atgtgtgtgtatatacacacat

SEQ ID NO: 7327959 - DNA, 22 bp, Homo sapiens
atttattgagacttaacaaccc

SEQ ID NO: 7327960 - DNA, 22 bp, Homo sapiens
atttattatgggatttggctca

SEQ ID NO: 7327961 - DNA, 22 bp, Homo sapiens
atttattgagcctttcctatgt

SEQ ID NO: 7327962 - DNA, 22 bp, Homo sapiens
atttattgagagggaggggaat

SEQ ID NO: 7327963 - DNA, 22 bp, Homo sapiens
atttattggtttgcatggtgaa

SEQ ID NO: 7327964 - DNA, 22 bp, Homo sapiens
atttattggatgcttacttggg

SEQ ID NO: 7327965 - DNA, 22 bp, Homo sapiens
attggcagaaacagcagggcca

SEQ ID NO: 7327966 - DNA, 22 bp, Homo sapiens
attggcagccagacccagttct

SEQ ID NO: 7327967 - DNA, 22 bp, Homo sapiens
atttaatgtcgagctattgtag

SEQ ID NO: 7327968 - DNA, 22 bp, Homo sapiens
attgcttttcagacaatgaggc

SEQ ID NO: 7327969 - DNA, 22 bp, Homo sapiens
attggaaagttcttaagggata

SEQ ID NO: 7327970 - DNA, 22 bp, Homo sapiens
attggaaatacagtagaaaaat

SEQ ID NO: 7327971 - DNA, 22 bp, Homo sapiens
atttacactaaaggaaggagga

SEQ ID NO: 7327972 - DNA, 22 bp, Homo sapiens
caaaaaacacagatgtctgtgt

SEQ ID NO: 7327973 - DNA, 22 bp, Homo sapiens
attttttagaacctggcctgat

SEQ ID NO: 7327974 - DNA, 22 bp, Homo sapiens
gcgaggcagccctcaggtgtta

SEQ ID NO: 7327975 - DNA, 22 bp, Homo sapiens
gcctctctccttggcttgcagt

SEQ ID NO: 7327976 - DNA, 22 bp, Homo sapiens
atttctcactgagcagataaaa

SEQ ID NO: 7327977 - DNA, 22 bp, Homo sapiens
atttctcagtgaaatgacaggc

SEQ ID NO: 7327978 - DNA, 22 bp, Homo sapiens
gcctctctctacccagtatgat

SEQ ID NO: 7327979 - DNA, 22 bp, Homo sapiens
gcctgctgaagccagagtgtgt

SEQ ID NO: 7327980 - DNA, 22 bp, Homo sapiens
atgtctttcttgtgtcccaaga

SEQ ID NO: 7327981 - DNA, 22 bp, Homo sapiens
atgtctttgccatagttcatat

SEQ ID NO: 7327982 - DNA, 22 bp, Homo sapiens
gaggggagaggcttatggatca

SEQ ID NO: 7327983 - DNA, 22 bp, Homo sapiens
gagctggggcagcttaggagtg

SEQ ID NO: 7327984 - DNA, 21 bp, Homo sapiens
atggtaggtggagcaggtgat

SEQ ID NO: 7327985 - DNA, 22 bp, Homo sapiens
gaggagctgggctgagagggtc

SEQ ID NO: 7327986 - DNA, 22 bp, Homo sapiens
gagaaagggataatttgaagag

SEQ ID NO: 7327987 - DNA, 22 bp, Homo sapiens
atggaagagtccccatggatga

SEQ ID NO: 7327988 - DNA, 22 bp, Homo sapiens
atggaagacagataaggcagaa

SEQ ID NO: 7327989 - DNA, 23 bp, Homo sapiens
gacagagtgagaccttgtcttac

SEQ ID NO: 7327990 - DNA, 22 bp, Homo sapiens
gacagagggttccaaaattgat

SEQ ID NO: 7327991 - DNA, 22 bp, Homo sapiens
gagccaggaggcagagactgca

SEQ ID NO: 7327992 - DNA, 22 bp, Homo sapiens
gagccaggagatacctaagggg

SEQ ID NO: 7327993 - DNA, 22 bp, Homo sapiens
gagccaggaagaaggccttact

SEQ ID NO: 7327994 - DNA, 22 bp, Homo sapiens
gagccaggcccgtacttgctgt

SEQ ID NO: 7327995 - DNA, 22 bp, Homo sapiens
gagccaggcaccttctgtgttg

SEQ ID NO: 7327996 - DNA, 22 bp, Homo sapiens
gagccagggagggtctggtata

SEQ ID NO: 7327997 - DNA, 22 bp, Homo sapiens
gagaggaagccttctgtacttg

SEQ ID NO: 7327998 - DNA, 22 bp, Homo sapiens
gagaggaactcccagtgcctgg

SEQ ID NO: 7327999 - DNA, 22 bp, Homo sapiens
gagaggaagccagggggtgttg

SEQ ID NO: 7328000 - DNA, 22 bp, Homo sapiens
gagaggaaagatatatacttct

SEQ ID NO: 7328001 - DNA, 22 bp, Homo sapiens
gagaggaaagatatatacttct

SEQ ID NO: 7328002 - DNA, 22 bp, Homo sapiens
atggcagttttagaacttttca

SEQ ID NO: 7328003 - DNA, 22 bp, Homo sapiens
atggcagtgtttcagtttttgg

SEQ ID NO: 7328004 - DNA, 23 bp, Homo sapiens
gagaacagccacagagagctgtg

SEQ ID NO: 7328005 - DNA, 20 bp, Homo sapiens
atggcagtccgtgttcaggg

SEQ ID NO: 7328006 - DNA, 22 bp, Homo sapiens
atggcagtcagagacaggcaga

SEQ ID NO: 7328007 - DNA, 22 bp, Homo sapiens
atggcagtatttcagtacagag

SEQ ID NO: 7328008 - DNA, 22 bp, Homo sapiens
atggcagtatttgtatcacaga

SEQ ID NO: 7328009 - DNA, 22 bp, Homo sapiens
cttggtcttgggagcagggaca

SEQ ID NO: 7328010 - DNA, 22 bp, Homo sapiens
atctagaacaattattgtcaca

SEQ ID NO: 7328011 - DNA, 22 bp, Homo sapiens
atctttttatctgtttggaaca

SEQ ID NO: 7328012 - DNA, 22 bp, Homo sapiens
atctttttactaacactgctta

SEQ ID NO: 7328013 - DNA, 22 bp, Homo sapiens
atgaggtggtcttcagtaggtc

SEQ ID NO: 7328014 - DNA, 22 bp, Homo sapiens
atgcatgcattgtttatcatgg

SEQ ID NO: 7328015 - DNA, 22 bp, Homo sapiens
atgcatgcatgagtgtgtacct

SEQ ID NO: 7328016 - DNA, 22 bp, Homo sapiens
atgcaggaagtcggggagcggg

SEQ ID NO: 7328017 - DNA, 22 bp, Homo sapiens
atgcaggacataagcatcgaca

SEQ ID NO: 7328018 - DNA, 22 bp, Homo sapiens
atgcaggaagagccctggagct

SEQ ID NO: 7328019 - DNA, 22 bp, Homo sapiens
atgcaggagaccaattggatgg

SEQ ID NO: 7328020 - DNA, 23 bp, Homo sapiens
atgcaggacttataaggtaaggt

SEQ ID NO: 7328021 - DNA, 22 bp, Homo sapiens
atgcatgtttatagggtgcttc

SEQ ID NO: 7328022 - DNA, 21 bp, Homo sapiens
atgcatgttacagtatatgcc

SEQ ID NO: 7328023 - DNA, 22 bp, Homo sapiens
atgcatgtaacagtgttatgaa

SEQ ID NO: 7328024 - DNA, 22 bp, Homo sapiens
atgcatgtattcatgtgtgaca

SEQ ID NO: 7328025 - DNA, 22 bp, Homo sapiens
atgcattgctgctttcaaaaca

SEQ ID NO: 7328026 - DNA, 22 bp, Homo sapiens
gctgtctctcccaggatccatg

SEQ ID NO: 7328027 - DNA, 21 bp, Homo sapiens
gctgtctctggctcctgggaa

SEQ ID NO: 7328028 - DNA, 22 bp, Homo sapiens
gctgtctcggggctttctcctg

SEQ ID NO: 7328029 - DNA, 21 bp, Homo sapiens
gctgtctcctccttgcaccag

SEQ ID NO: 7328030 - DNA, 22 bp, Homo sapiens
gctgtctcgcctgacactggct

SEQ ID NO: 7328031 - DNA, 22 bp, Homo sapiens
gctgtctccccgcacccgaccg

SEQ ID NO: 7328032 - DNA, 22 bp, Homo sapiens
gctgtctccatagctgtgtgtc

SEQ ID NO: 7328033 - DNA, 22 bp, Homo sapiens
gctgtctcatgggtgctagtcc

SEQ ID NO: 7328034 - DNA, 22 bp, Homo sapiens
gcttggccagcagccgggatgc

SEQ ID NO: 7328035 - DNA, 22 bp, Homo sapiens
gcttctcttaatgcctggcttt

SEQ ID NO: 7328036 - DNA, 22 bp, Homo sapiens
gcttctcctcccgctcccaggc

SEQ ID NO: 7328037 - DNA, 22 bp, Homo sapiens
cacaaaatatcaagcactttta

SEQ ID NO: 7328038 - DNA, 22 bp, Homo sapiens
ggaaaactgaggctctcagcag

SEQ ID NO: 7328039 - DNA, 22 bp, Homo sapiens
cacacattaatatcaaaggctc

SEQ ID NO: 7328040 - DNA, 22 bp, Homo sapiens
cacaatttccttgcttcacttt

SEQ ID NO: 7328041 - DNA, 18 bp, Homo sapiens
cacaatttacagatgaca

SEQ ID NO: 7328042 - DNA, 19 bp, Homo sapiens
cacaattatgagacactta

SEQ ID NO: 7328043 - DNA, 22 bp, Homo sapiens
cacaattatagaagaaagcata

SEQ ID NO: 7328044 - DNA, 22 bp, Homo sapiens
cacacattccaaaatcaagggt

SEQ ID NO: 7328045 - DNA, 22 bp, Homo sapiens
caaagtatgaaccagtttctct

SEQ ID NO: 7328046 - DNA, 18 bp, Homo sapiens
gctcctggaccaggtcac

SEQ ID NO: 7328047 - DNA, 19 bp, Homo sapiens
gctcctggatgacctgtgg

SEQ ID NO: 7328048 - DNA, 22 bp, Homo sapiens
caacatgtctgatctctgtgaa

SEQ ID NO: 7328049 - DNA, 22 bp, Homo sapiens
caacactgacaatggactgatt

SEQ ID NO: 7328050 - DNA, 19 bp, Homo sapiens
caacagtactggtttgtcc

SEQ ID NO: 7328051 - DNA, 22 bp, Homo sapiens
caacactgattatggctgagct

SEQ ID NO: 7328052 - DNA, 22 bp, Homo sapiens
caaggagaaaacggcttctgaa

SEQ ID NO: 7328053 - DNA, 22 bp, Homo sapiens
caaggaggaagatgcaggggac

SEQ ID NO: 7328054 - DNA, 21 bp, Homo sapiens
caagatctcggcttgcttcct

SEQ ID NO: 7328055 - DNA, 22 bp, Homo sapiens
caagatcttcctcaatagacct

SEQ ID NO: 7328056 - DNA, 22 bp, Homo sapiens
caagacaagatctaagcatgct

SEQ ID NO: 7328057 - DNA, 22 bp, Homo sapiens
cacagtgtctgtgcttcagtgt

SEQ ID NO: 7328058 - DNA, 22 bp, Homo sapiens
ggagggagtttcattcctgccc

SEQ ID NO: 7328059 - DNA, 22 bp, Homo sapiens
ggatgggagcagaggacgacca

SEQ ID NO: 7328060 - DNA, 22 bp, Homo sapiens
ggagggagcatccccttgctga

SEQ ID NO: 7328061 - DNA, 22 bp, Homo sapiens
ggagggagcagagaacccaacc

SEQ ID NO: 7328062 - DNA, 22 bp, Homo sapiens
ggaggcggacacaggtagtgtt

SEQ ID NO: 7328063 - DNA, 22 bp, Homo sapiens
ggaggcggagcttgcagtgagc

SEQ ID NO: 7328064 - DNA, 22 bp, Homo sapiens
ggaggcggaggctgcagtgagc

SEQ ID NO: 7328065 - DNA, 22 bp, Homo sapiens
ggaggcggaagttgcagtgagc

SEQ ID NO: 7328066 - DNA, 22 bp, Homo sapiens
cacagctgtatccaggagatcc

SEQ ID NO: 7328067 - DNA, 22 bp, Homo sapiens
cacagctgtatccaggagatcc

SEQ ID NO: 7328068 - DNA, 22 bp, Homo sapiens
cacagctgttttctccaggcag

SEQ ID NO: 7328069 - DNA, 22 bp, Homo sapiens
cacagctgtgagaagggagcct

SEQ ID NO: 7328070 - DNA, 22 bp, Homo sapiens
cacagcttccattagaatgaga

SEQ ID NO: 7328071 - DNA, 22 bp, Homo sapiens
cacactgataggcttgacaggc

SEQ ID NO: 7328072 - DNA, 22 bp, Homo sapiens
cacactgactggaatcaaggat

SEQ ID NO: 7328073 - DNA, 22 bp, Homo sapiens
cactggaagttcattctcagaa

SEQ ID NO: 7328074 - DNA, 22 bp, Homo sapiens
cactgcttttcagacagttatt

SEQ ID NO: 7328075 - DNA, 22 bp, Homo sapiens
cactgccacctgcatgccctga

SEQ ID NO: 7328076 - DNA, 22 bp, Homo sapiens
cactgagagatgtgtcacagca

SEQ ID NO: 7328077 - DNA, 22 bp, Homo sapiens
cactgagagatgtgtcacagca

SEQ ID NO: 7328078 - DNA, 22 bp, Homo sapiens
caccatgcttgatttgtaatgt

SEQ ID NO: 7328079 - DNA, 22 bp, Homo sapiens
caccatcagcagcaggtgtcaa

SEQ ID NO: 7328080 - DNA, 22 bp, Homo sapiens
caccatgcccggctaattttgg

SEQ ID NO: 7328081 - DNA, 22 bp, Homo sapiens
caccatgcctggctaatttttt

SEQ ID NO: 7328082 - DNA, 20 bp, Homo sapiens
ggcagttaaggcacagtcat

SEQ ID NO: 7328083 - DNA, 22 bp, Homo sapiens
ggttcctgtgcctctagctggc

SEQ ID NO: 7328084 - DNA, 22 bp, Homo sapiens
cagagtcagctagtcttgggat

SEQ ID NO: 7328085 - DNA, 22 bp, Homo sapiens
cagagtcagagcacctgggatt

SEQ ID NO: 7328086 - DNA, 19 bp, Homo sapiens
gtatatttatatggctgta

SEQ ID NO: 7328087 - DNA, 22 bp, Homo sapiens
cagccaggttcaagtccttata

SEQ ID NO: 7328088 - DNA, 22 bp, Homo sapiens
cagccactcggccataaaggct

SEQ ID NO: 7328089 - DNA, 21 bp, Homo sapiens
cagaggcaggctctgtgtgtg

SEQ ID NO: 7328090 - DNA, 22 bp, Homo sapiens
gggcgagggcgaaagcgagagc

SEQ ID NO: 7328091 - DNA, 22 bp, Homo sapiens
gggcagagaaatggacagttgg

SEQ ID NO: 7328092 - DNA, 22 bp, Homo sapiens
gggcagaatttgtagatgacat

SEQ ID NO: 7328093 - DNA, 22 bp, Homo sapiens
gggaaactgtccagttctcccc

SEQ ID NO: 7328094 - DNA, 22 bp, Homo sapiens
gggaaactcaggcatttccact

SEQ ID NO: 7328095 - DNA, 22 bp, Homo sapiens
cactggctaaaaaagaggcaga

SEQ ID NO: 7328096 - DNA, 19 bp, Homo sapiens
gggactggaggatgtggag

SEQ ID NO: 7328097 - DNA, 22 bp, Homo sapiens
gggactggcacagggctgggag

SEQ ID NO: 7328098 - DNA, 22 bp, Homo sapiens
gggaaggacattctgggctcag

SEQ ID NO: 7328099 - DNA, 22 bp, Homo sapiens
cagacaggaagttcagaagaaa

SEQ ID NO: 7328100 - DNA, 22 bp, Homo sapiens
cagacaggcaggtgagagctcc

SEQ ID NO: 7328101 - DNA, 22 bp, Homo sapiens
cagacaggaattctggcgtggt

SEQ ID NO: 7328102 - DNA, 22 bp, Homo sapiens
cagacaggcaggtgctgctttg

SEQ ID NO: 7328103 - DNA, 19 bp, Homo sapiens
gggagcaggaaagctgtgg

SEQ ID NO: 7328104 - DNA, 22 bp, Homo sapiens
cagacagggccctgtgatggta

SEQ ID NO: 7328105 - DNA, 17 bp, Homo sapiens
cagacaggctgtcaccc

SEQ ID NO: 7328106 - DNA, 22 bp, Homo sapiens
gggcaagttgagaagaatgcta

SEQ ID NO: 7328107 - DNA, 22 bp, Homo sapiens
gggcaagtgtcaagcatgtcat

SEQ ID NO: 7328108 - DNA, 22 bp, Homo sapiens
gggcaagtgttttgtctgcctg

SEQ ID NO: 7328109 - DNA, 22 bp, Homo sapiens
gggcaaggcagaagagttggag

SEQ ID NO: 7328110 - DNA, 22 bp, Homo sapiens
gggaggtgaaaggtcatgtgtg

SEQ ID NO: 7328111 - DNA, 22 bp, Homo sapiens
gggaggtgaaaggttgctgcag

SEQ ID NO: 7328112 - DNA, 22 bp, Homo sapiens
gggaggtaaagatgagctcagt

SEQ ID NO: 7328113 - DNA, 22 bp, Homo sapiens
gggaggtagcaagcctgcagct

SEQ ID NO: 7328114 - DNA, 22 bp, Homo sapiens
atatgtatgtacgcacatattc

SEQ ID NO: 7328115 - DNA, 22 bp, Homo sapiens
atatggctgttgcacatctaag

SEQ ID NO: 7328116 - DNA, 22 bp, Homo sapiens
atatgcttacactacaagatga

SEQ ID NO: 7328117 - DNA, 20 bp, Homo sapiens
atatggctccgttcagtcgg

SEQ ID NO: 7328118 - DNA, 22 bp, Homo sapiens
atatccaccattctgcaccttc

SEQ ID NO: 7328119 - DNA, 22 bp, Homo sapiens
atatatacaactagattaaaag

SEQ ID NO: 7328120 - DNA, 22 bp, Homo sapiens
atatatacaactagattaaaag

SEQ ID NO: 7328121 - DNA, 22 bp, Homo sapiens
ctgggagacaagagagggctga

SEQ ID NO: 7328122 - DNA, 22 bp, Homo sapiens
ctgggagagaagcgaagctggg

SEQ ID NO: 7328123 - DNA, 22 bp, Homo sapiens
atatatatgctgatggctgcca

SEQ ID NO: 7328124 - DNA, 22 bp, Homo sapiens
ctggcagcttagcactctggtt

SEQ ID NO: 7328125 - DNA, 22 bp, Homo sapiens
atatataagctgatgagccaca

SEQ ID NO: 7328126 - DNA, 22 bp, Homo sapiens
atatataacctggataaggctt

SEQ ID NO: 7328127 - DNA, 20 bp, Homo sapiens
atataataaattttggttac

SEQ ID NO: 7328128 - DNA, 18 bp, Homo sapiens
ctgtcttttttctctcca

SEQ ID NO: 7328129 - DNA, 22 bp, Homo sapiens
ctgtcttttcatactttccctc

SEQ ID NO: 7328130 - DNA, 22 bp, Homo sapiens
atcatgttaaatatttcaatct

SEQ ID NO: 7328131 - DNA, 22 bp, Homo sapiens
atcacagttactcaaataatga

SEQ ID NO: 7328132 - DNA, 22 bp, Homo sapiens
atcacagctcccttatacacag

SEQ ID NO: 7328133 - DNA, 22 bp, Homo sapiens
atcattctagctgttgtgttga

SEQ ID NO: 7328134 - DNA, 22 bp, Homo sapiens
atcattctagtccttatggtct

SEQ ID NO: 7328135 - DNA, 22 bp, Homo sapiens
atcatgttggctctgacaaaaa

SEQ ID NO: 7328136 - DNA, 22 bp, Homo sapiens
atcatgttccagaaacagtgat

SEQ ID NO: 7328137 - DNA, 22 bp, Homo sapiens
atcatgttgctcaaaattaaac

SEQ ID NO: 7328138 - DNA, 22 bp, Homo sapiens
atccaaaatttactgtagcatt

SEQ ID NO: 7328139 - DNA, 18 bp, Homo sapiens
atccaaaaagatggaagt

SEQ ID NO: 7328140 - DNA, 22 bp, Homo sapiens
atcattctattgttgagctgcc

SEQ ID NO: 7328141 - DNA, 22 bp, Homo sapiens
atccaaagtagattaagtcaca

SEQ ID NO: 7328142 - DNA, 22 bp, Homo sapiens
atccacagaaggaacttgaaag

SEQ ID NO: 7328143 - DNA, 22 bp, Homo sapiens
atccacagagaggaagaatagt

SEQ ID NO: 7328144 - DNA, 22 bp, Homo sapiens
atccacaggagggtttggaaaa

SEQ ID NO: 7328145 - DNA, 22 bp, Homo sapiens
atccacaggtcatgtaatgtgg

SEQ ID NO: 7328146 - DNA, 22 bp, Homo sapiens
atccacagggtgtgttaagatg

SEQ ID NO: 7328147 - DNA, 22 bp, Homo sapiens
atccacagtgcagcaagggccc

SEQ ID NO: 7328148 - DNA, 22 bp, Homo sapiens
atccacagtgggggtggcggaa

SEQ ID NO: 7328149 - DNA, 22 bp, Homo sapiens
atccctggaagcaatgtttatt

SEQ ID NO: 7328150 - DNA, 22 bp, Homo sapiens
atccctggacggcgcctcccca

SEQ ID NO: 7328151 - DNA, 20 bp, Homo sapiens
atccctggtcagtaccaaag

SEQ ID NO: 7328152 - DNA, 22 bp, Homo sapiens
atccctggccacgaagctgccc

SEQ ID NO: 7328153 - DNA, 20 bp, Homo sapiens
atccctggccttaaggagtg

SEQ ID NO: 7328154 - DNA, 22 bp, Homo sapiens
atccctggctaattttttgtgt

SEQ ID NO: 7328155 - DNA, 22 bp, Homo sapiens
atccctgggcctcaccacctga

SEQ ID NO: 7328156 - DNA, 22 bp, Homo sapiens
atactcaatttgttggaaagca

SEQ ID NO: 7328157 - DNA, 22 bp, Homo sapiens
atactgaaaaagaagtgttgaa

SEQ ID NO: 7328158 - DNA, 22 bp, Homo sapiens
ctggagtgcagtggcatgatca

SEQ ID NO: 7328159 - DNA, 22 bp, Homo sapiens
ctggcagcgtgagcagcatcca

SEQ ID NO: 7328160 - DNA, 22 bp, Homo sapiens
ctggcagctctactcagagcct

SEQ ID NO: 7328161 - DNA, 22 bp, Homo sapiens
ctggcagctctactcagagcct

SEQ ID NO: 7328162 - DNA, 22 bp, Homo sapiens
atacagatcccacagcatgtga

SEQ ID NO: 7328163 - DNA, 22 bp, Homo sapiens
atacagatataagattgaggag

SEQ ID NO: 7328164 - DNA, 22 bp, Homo sapiens
atacagatgagatcaggcataa

SEQ ID NO: 7328165 - DNA, 22 bp, Homo sapiens
atacagatgaaatactaagcta

SEQ ID NO: 7328166 - DNA, 22 bp, Homo sapiens
ctgctttaagtattcaacaaag

SEQ ID NO: 7328167 - DNA, 22 bp, Homo sapiens
ctgcccagaatcactcactcga

SEQ ID NO: 7328168 - DNA, 18 bp, Homo sapiens
ctgcccagagcacttgtg

SEQ ID NO: 7328169 - DNA, 22 bp, Homo sapiens
agttggagtgaacatgagattg

SEQ ID NO: 7328170 - DNA, 22 bp, Homo sapiens
agttggcactgagctgtgattg

SEQ ID NO: 7328171 - DNA, 22 bp, Homo sapiens
ctgaggcttgtcctctcagctt

SEQ ID NO: 7328172 - DNA, 18 bp, Homo sapiens
ctgaggcttagagaggtt

SEQ ID NO: 7328173 - DNA, 22 bp, Homo sapiens
ctgccaggcactgggctctgca

SEQ ID NO: 7328174 - DNA, 22 bp, Homo sapiens
agtttgaaagcttaacagtaca

SEQ ID NO: 7328175 - DNA, 22 bp, Homo sapiens
agtgggagaatgaataagggcc

SEQ ID NO: 7328176 - DNA, 22 bp, Homo sapiens
agtgggaaactggagagacttc

SEQ ID NO: 7328177 - DNA, 21 bp, Homo sapiens
agtggtctttttcacccagtg

SEQ ID NO: 7328178 - DNA, 22 bp, Homo sapiens
ctctgtccttgcacagttccta

SEQ ID NO: 7328179 - DNA, 22 bp, Homo sapiens
agtggtctgcctgcctcagcct

SEQ ID NO: 7328180 - DNA, 22 bp, Homo sapiens
ctctcgcgtgtgcctttccgct

SEQ ID NO: 7328181 - DNA, 22 bp, Homo sapiens
ctctccattccctacagttttc

SEQ ID NO: 7328182 - DNA, 22 bp, Homo sapiens
ctcctgcagccctcagcagcca

SEQ ID NO: 7328183 - DNA, 22 bp, Homo sapiens
ctcaccatggatcttccatttc

SEQ ID NO: 7328184 - DNA, 23 bp, Homo sapiens
ctcagaggtgtttttcacttact

SEQ ID NO: 7328185 - DNA, 22 bp, Homo sapiens
cgggggcacccacaaatgagga

SEQ ID NO: 7328186 - DNA, 22 bp, Homo sapiens
cgggggcacccacaaatgagga

SEQ ID NO: 7328187 - DNA, 22 bp, Homo sapiens
cgggttcacgccattctcctgc

SEQ ID NO: 7328188 - DNA, 22 bp, Homo sapiens
cgggttcacgccattctcctgc

SEQ ID NO: 7328189 - DNA, 22 bp, Homo sapiens
agtctcagagtacctgagggac

SEQ ID NO: 7328190 - DNA, 22 bp, Homo sapiens
aggtggggctgggaaagattcc

SEQ ID NO: 7328191 - DNA, 22 bp, Homo sapiens
aggtggctggtccaggctgcag

SEQ ID NO: 7328192 - DNA, 22 bp, Homo sapiens
aggtggcagttgtggaaccatc

SEQ ID NO: 7328193 - DNA, 22 bp, Homo sapiens
cggagcctgcttgttgcagctg

SEQ ID NO: 7328194 - DNA, 23 bp, Homo sapiens
cggaggcaaatcggccatttaag

SEQ ID NO: 7328195 - DNA, 22 bp, Homo sapiens
cggaggcaaactcacctggctc

SEQ ID NO: 7328196 - DNA, 19 bp, Homo sapiens
cggcccctcctctcgcgcc

SEQ ID NO: 7328197 - DNA, 22 bp, Homo sapiens
agtagtcacttctattaatggc

SEQ ID NO: 7328198 - DNA, 22 bp, Homo sapiens
cggctcactgcagctccgcctc

SEQ ID NO: 7328199 - DNA, 22 bp, Homo sapiens
agtaggtatgatggtgacttga

SEQ ID NO: 7328200 - DNA, 22 bp, Homo sapiens
cctttattcaattagtcctaat

SEQ ID NO: 7328201 - DNA, 22 bp, Homo sapiens
cctttattcaattagtcctaat

SEQ ID NO: 7328202 - DNA, 22 bp, Homo sapiens
aggtgggggctgtgtccttgac

SEQ ID NO: 7328203 - DNA, 22 bp, Homo sapiens
aggtgggggctgtgtccttgac

SEQ ID NO: 7328204 - DNA, 22 bp, Homo sapiens
aggtggggtgagctgcagacta

SEQ ID NO: 7328205 - DNA, 22 bp, Homo sapiens
aggtggggtgagctgcagacta

SEQ ID NO: 7328206 - DNA, 22 bp, Homo sapiens
aggtggggtgttggatgtttat

SEQ ID NO: 7328207 - DNA, 22 bp, Homo sapiens
aggtggggtgttggatgtttat

SEQ ID NO: 7328208 - DNA, 22 bp, Homo sapiens
cgaggcagggaagctgcaaaag

SEQ ID NO: 7328209 - DNA, 22 bp, Homo sapiens
cgaggcagaggctgaaacggct

SEQ ID NO: 7328210 - DNA, 22 bp, Homo sapiens
cgaggcaggcaggcggaggata

SEQ ID NO: 7328211 - DNA, 18 bp, Homo sapiens
cgaggcaggcggatcacg

SEQ ID NO: 7328212 - DNA, 22 bp, Homo sapiens
cgaggcagacaaaagttggaag

SEQ ID NO: 7328213 - DNA, 22 bp, Homo sapiens
agggtccttctgttcctgagca

SEQ ID NO: 7328214 - DNA, 22 bp, Homo sapiens
agggtcctgagcctggggcgca

SEQ ID NO: 7328215 - DNA, 22 bp, Homo sapiens
agggtctgttgtttgttctgga

SEQ ID NO: 7328216 - DNA, 22 bp, Homo sapiens
agggtctctggagagctgagga

SEQ ID NO: 7328217 - DNA, 21 bp, Homo sapiens
cctgccaggaaactgagtgtc

SEQ ID NO: 7328218 - DNA, 22 bp, Homo sapiens
cctgccaggacattgcttgaag

SEQ ID NO: 7328219 - DNA, 22 bp, Homo sapiens
cctctgcatcccatataattct

SEQ ID NO: 7328220 - DNA, 22 bp, Homo sapiens
cctctctctcctgcacacacac

SEQ ID NO: 7328221 - DNA, 22 bp, Homo sapiens
cctgctctgccaagtcctcttt

SEQ ID NO: 7328222 - DNA, 22 bp, Homo sapiens
cctgctctaaatctcatggaac

SEQ ID NO: 7328223 - DNA, 22 bp, Homo sapiens
cctgctctagactctgggaagg

SEQ ID NO: 7328224 - DNA, 22 bp, Homo sapiens
cctgctctccatacactttcta

SEQ ID NO: 7328225 - DNA, 19 bp, Homo sapiens
cctgctgcccaccctctgc

SEQ ID NO: 7328226 - DNA, 22 bp, Homo sapiens
cctggaaagcggttcattttgt

SEQ ID NO: 7328227 - DNA, 22 bp, Homo sapiens
cctggacaagtggcttacttgg

SEQ ID NO: 7328228 - DNA, 22 bp, Homo sapiens
cctggaagctgatgtttaggac

SEQ ID NO: 7328229 - DNA, 22 bp, Homo sapiens
cctggctgcttcctctgccatg

SEQ ID NO: 7328230 - DNA, 22 bp, Homo sapiens
cctggctggtggcagcgacaag

SEQ ID NO: 7328231 - DNA, 22 bp, Homo sapiens
cctggctgggcctgatttctca

SEQ ID NO: 7328232 - DNA, 23 bp, Homo sapiens
cctggctggattctctgcattca

SEQ ID NO: 7328233 - DNA, 22 bp, Homo sapiens
ccccatgaagtagggtctctga

SEQ ID NO: 7328234 - DNA, 22 bp, Homo sapiens
agggagagtagatatcaggtgt

SEQ ID NO: 7328235 - DNA, 22 bp, Homo sapiens
agggagagtagatatcaggtgt

SEQ ID NO: 7328236 - DNA, 19 bp, Homo sapiens
agggaatccggctgaggga

SEQ ID NO: 7328237 - DNA, 22 bp, Homo sapiens
agggaaggtagaggtcaccggc

SEQ ID NO: 7328238 - DNA, 22 bp, Homo sapiens
agggaagggaaaaacactcgtc

SEQ ID NO: 7328239 - DNA, 22 bp, Homo sapiens
aggctgtgtttcccctggagct

SEQ ID NO: 7328240 - DNA, 22 bp, Homo sapiens
ccatgagtagcgatttcatttt

SEQ ID NO: 7328241 - DNA, 22 bp, Homo sapiens
cctcccatggagctctgtccat

SEQ ID NO: 7328242 - DNA, 22 bp, Homo sapiens
cctcccatccctgcaagagagc

SEQ ID NO: 7328243 - DNA, 22 bp, Homo sapiens
cctagacattaagcttgggttt

SEQ ID NO: 7328244 - DNA, 22 bp, Homo sapiens
agggaggaccaatgtgtggtta

SEQ ID NO: 7328245 - DNA, 20 bp, Homo sapiens
aggccccaggtggacactag

SEQ ID NO: 7328246 - DNA, 22 bp, Homo sapiens
aggccctattcaatggggccca

SEQ ID NO: 7328247 - DNA, 22 bp, Homo sapiens
aggccaagattttggatcagct

SEQ ID NO: 7328248 - DNA, 22 bp, Homo sapiens
aggccaagtagccgctgtccta

SEQ ID NO: 7328249 - DNA, 22 bp, Homo sapiens
aggcagtggcttttgttgtgtt

SEQ ID NO: 7328250 - DNA, 22 bp, Homo sapiens
aggcaggtttcccggctgtcaa

SEQ ID NO: 7328251 - DNA, 22 bp, Homo sapiens
aggcaggttggtgagaagactg

SEQ ID NO: 7328252 - DNA, 22 bp, Homo sapiens
aggcagcctggtttgaatggaa

SEQ ID NO: 7328253 - DNA, 22 bp, Homo sapiens
aggcagccctgtgctggatgct

SEQ ID NO: 7328254 - DNA, 22 bp, Homo sapiens
aggcagccattaccaagggcat

SEQ ID NO: 7328255 - DNA, 22 bp, Homo sapiens
aggcagccatctgcaggaagga

SEQ ID NO: 7328256 - DNA, 22 bp, Homo sapiens
aggcagtgctcaagacagcagc

SEQ ID NO: 7328257 - DNA, 22 bp, Homo sapiens
aggcagtgagcagggtgtcatg

SEQ ID NO: 7328258 - DNA, 22 bp, Homo sapiens
aggcagtggaaggagaaagcaa

SEQ ID NO: 7328259 - DNA, 22 bp, Homo sapiens
aggcagtggagctggaataggc

SEQ ID NO: 7328260 - DNA, 22 bp, Homo sapiens
aggcagtggatgtcaggaatgg

SEQ ID NO: 7328261 - DNA, 22 bp, Homo sapiens
aggctgaggcgggaggatcact

SEQ ID NO: 7328262 - DNA, 22 bp, Homo sapiens
aggcagcagaggttgaggaaag

SEQ ID NO: 7328263 - DNA, 22 bp, Homo sapiens
catttacagtgagagtttttac

SEQ ID NO: 7328264 - DNA, 21 bp, Homo sapiens
catttacatgacagattggtt

SEQ ID NO: 7328265 - DNA, 22 bp, Homo sapiens
catttacataacagtaacgctg

SEQ ID NO: 7328266 - DNA, 22 bp, Homo sapiens
aggcagccaatcagaggctgac

SEQ ID NO: 7328267 - DNA, 22 bp, Homo sapiens
catttacatttaaggttaatat

SEQ ID NO: 7328268 - DNA, 19 bp, Homo sapiens
aggcagaggcttggctagc

SEQ ID NO: 7328269 - DNA, 22 bp, Homo sapiens
cattccaagtatatacatgata

SEQ ID NO: 7328270 - DNA, 22 bp, Homo sapiens
catgcaggaggaaaaagcagct

SEQ ID NO: 7328271 - DNA, 22 bp, Homo sapiens
aggaggtggcctgagcgtgccc

SEQ ID NO: 7328272 - DNA, 22 bp, Homo sapiens
aggaggtggctgaacttgaggg

SEQ ID NO: 7328273 - DNA, 22 bp, Homo sapiens
aggaggtgctagagaagatgtt

SEQ ID NO: 7328274 - DNA, 22 bp, Homo sapiens
aggaggtgttgatagaaggttt

SEQ ID NO: 7328275 - DNA, 22 bp, Homo sapiens
aggaggcagatgcttggctgta

SEQ ID NO: 7328276 - DNA, 17 bp, Homo sapiens
catctttaaaatcctga

SEQ ID NO: 7328277 - DNA, 22 bp, Homo sapiens
aggaggcactcactctcagggt

SEQ ID NO: 7328278 - DNA, 22 bp, Homo sapiens
aggaggaggtgggacacagtga

SEQ ID NO: 7328279 - DNA, 22 bp, Homo sapiens
aggaggaggtaagaaaagcata

SEQ ID NO: 7328280 - DNA, 17 bp, Homo sapiens
aggaggatcagagagta

SEQ ID NO: 7328281 - DNA, 22 bp, Homo sapiens
aggaggataagttagttgggta

SEQ ID NO: 7328282 - DNA, 22 bp, Homo sapiens
aggaggcaaaggtctctgataa

SEQ ID NO: 7328283 - DNA, 22 bp, Homo sapiens
aggaggcaactgagatttagaa

SEQ ID NO: 7328284 - DNA, 20 bp, Homo sapiens
aggaggcaatgtagataagc

SEQ ID NO: 7328285 - DNA, 22 bp, Homo sapiens
aggaggactctctgagccagcc

SEQ ID NO: 7328286 - DNA, 22 bp, Homo sapiens
aggaggaggctggagtacaccc

SEQ ID NO: 7328287 - DNA, 22 bp, Homo sapiens
aggagatcagcttagggaaggt

SEQ ID NO: 7328288 - DNA, 22 bp, Homo sapiens
aggagccatgagcaggaggcaa

SEQ ID NO: 7328289 - DNA, 22 bp, Homo sapiens
aggagcctggctggcccacagg

SEQ ID NO: 7328290 - DNA, 22 bp, Homo sapiens
aggagcctgtgcctggcactcc

SEQ ID NO: 7328291 - DNA, 22 bp, Homo sapiens
aggagctcaaagatgccaggag

SEQ ID NO: 7328292 - DNA, 22 bp, Homo sapiens
aggagctcagcctgcagggagc

SEQ ID NO: 7328293 - DNA, 22 bp, Homo sapiens
aggagctcagcctgcagggagc

SEQ ID NO: 7328294 - DNA, 22 bp, Homo sapiens
aggagctccagcccagggaagt

SEQ ID NO: 7328295 - DNA, 21 bp, Homo sapiens
aggagctctccaaggacaaag

SEQ ID NO: 7328296 - DNA, 22 bp, Homo sapiens
aggagctcccgtgaggagacca

SEQ ID NO: 7328297 - DNA, 19 bp, Homo sapiens
aggagccttgagcagtgag

SEQ ID NO: 7328298 - DNA, 18 bp, Homo sapiens
aggagcctttgcactgga

SEQ ID NO: 7328299 - DNA, 22 bp, Homo sapiens
aggagagaatgttccaggcttg

SEQ ID NO: 7328300 - DNA, 22 bp, Homo sapiens
aggagagaattactgggtgtca

SEQ ID NO: 7328301 - DNA, 22 bp, Homo sapiens
aggagagagctgagctttgctg

SEQ ID NO: 7328302 - DNA, 22 bp, Homo sapiens
aggagagagaacacttgggtcc

SEQ ID NO: 7328303 - DNA, 22 bp, Homo sapiens
aggagagaggttttaaatgggg

SEQ ID NO: 7328304 - DNA, 22 bp, Homo sapiens
cagtctctgtgccagatcctgg

SEQ ID NO: 7328305 - DNA, 22 bp, Homo sapiens
cagtctctggcagctgctggcc

SEQ ID NO: 7328306 - DNA, 22 bp, Homo sapiens
aggagaaaacagtgttttgcct

SEQ ID NO: 7328307 - DNA, 22 bp, Homo sapiens
aggaagctgcctgggatgggaa

SEQ ID NO: 7328308 - DNA, 22 bp, Homo sapiens
aggaaggactccatggtccgtc

SEQ ID NO: 7328309 - DNA, 22 bp, Homo sapiens
cagctttgattctttctgccat

SEQ ID NO: 7328310 - DNA, 22 bp, Homo sapiens
agctgaggctctgagagggaag

SEQ ID NO: 7328311 - DNA, 22 bp, Homo sapiens
agctgaggctctgagagggaag

SEQ ID NO: 7328312 - DNA, 22 bp, Homo sapiens
agctgcaggcctctcctgggga

SEQ ID NO: 7328313 - DNA, 22 bp, Homo sapiens
caggacagaccaagatcgtgct

SEQ ID NO: 7328314 - DNA, 22 bp, Homo sapiens
caggacagaaataaggaatata

SEQ ID NO: 7328315 - DNA, 22 bp, Homo sapiens
agctggcatactttgctaggaa

SEQ ID NO: 7328316 - DNA, 22 bp, Homo sapiens
agctggcagtcatcctagtgag

SEQ ID NO: 7328317 - DNA, 22 bp, Homo sapiens
caggacagagcccagactgtgt

SEQ ID NO: 7328318 - DNA, 22 bp, Homo sapiens
caggagtctctcttgagcccag

SEQ ID NO: 7328319 - DNA, 22 bp, Homo sapiens
caggagtctctcttgagcccag

SEQ ID NO: 7328320 - DNA, 22 bp, Homo sapiens
caggagtctctcttgagcccag

SEQ ID NO: 7328321 - DNA, 22 bp, Homo sapiens
caggagtccctctggccagcat

SEQ ID NO: 7328322 - DNA, 22 bp, Homo sapiens
caggagtccctctggccagcat

SEQ ID NO: 7328323 - DNA, 22 bp, Homo sapiens
caggagtcccaggggtgggcca

SEQ ID NO: 7328324 - DNA, 22 bp, Homo sapiens
caggagtccatctggcctggtg

SEQ ID NO: 7328325 - DNA, 22 bp, Homo sapiens
caggagtccatctggcctggtg

SEQ ID NO: 7328326 - DNA, 22 bp, Homo sapiens
caggagtccatctggcctggtg

SEQ ID NO: 7328327 - DNA, 22 bp, Homo sapiens
caggagtccagagtgtcatttt

SEQ ID NO: 7328328 - DNA, 22 bp, Homo sapiens
agcttaaactctttgaagttat

SEQ ID NO: 7328329 - DNA, 21 bp, Homo sapiens
aggaaaggaagtccccagggt

SEQ ID NO: 7328330 - DNA, 22 bp, Homo sapiens
cagggccagccatcctgctggg

SEQ ID NO: 7328331 - DNA, 17 bp, Homo sapiens
agcttgtttttgaaagc

SEQ ID NO: 7328332 - DNA, 18 bp, Homo sapiens
agcttgtttttgccttct

SEQ ID NO: 7328333 - DNA, 17 bp, Homo sapiens
aggaaacattttctttc

SEQ ID NO: 7328334 - DNA, 22 bp, Homo sapiens
aggaaaggggtaggtgtggacg

SEQ ID NO: 7328335 - DNA, 22 bp, Homo sapiens
aggaaatgtagtcctcatctcc

SEQ ID NO: 7328336 - DNA, 22 bp, Homo sapiens
atgtcaaatgctgcaaactcat

SEQ ID NO: 7328337 - DNA, 22 bp, Homo sapiens
atgggaggcaggctcagaaccg

SEQ ID NO: 7328338 - DNA, 22 bp, Homo sapiens
atggttttcctctgctgcttaa

SEQ ID NO: 7328339 - DNA, 22 bp, Homo sapiens
atggcagatggctggagcaggt

SEQ ID NO: 7328340 - DNA, 22 bp, Homo sapiens
atggaggtgccaggtgtgaggg

SEQ ID NO: 7328341 - DNA, 22 bp, Homo sapiens
agaagaatacttgatgttcatg

SEQ ID NO: 7328342 - DNA, 22 bp, Homo sapiens
agaagaatttctctcatgattt

SEQ ID NO: 7328343 - DNA, 22 bp, Homo sapiens
agaagaggggtgtccctgtggc

SEQ ID NO: 7328344 - DNA, 22 bp, Homo sapiens
atctttgtcactctactgtcta

SEQ ID NO: 7328345 - DNA, 22 bp, Homo sapiens
atctttgtgaatctcaacttgg

SEQ ID NO: 7328346 - DNA, 22 bp, Homo sapiens
atctttatatatctcctctgaa

SEQ ID NO: 7328347 - DNA, 22 bp, Homo sapiens
agacagtgcaagaagagcaggc

SEQ ID NO: 7328348 - DNA, 22 bp, Homo sapiens
agacacagtacttgccctcatg

SEQ ID NO: 7328349 - DNA, 22 bp, Homo sapiens
agacacagtctgtctggaggag

SEQ ID NO: 7328350 - DNA, 22 bp, Homo sapiens
agacacagtgttgaaggctagt

SEQ ID NO: 7328351 - DNA, 22 bp, Homo sapiens
attaaacaatgtaaagttcttg

SEQ ID NO: 7328352 - DNA, 22 bp, Homo sapiens
attaaagaaacccagcatgtga

SEQ ID NO: 7328353 - DNA, 22 bp, Homo sapiens
attaaagctatccagtcatgaa

SEQ ID NO: 7328354 - DNA, 20 bp, Homo sapiens
attagctcaggtgaggtcat

SEQ ID NO: 7328355 - DNA, 22 bp, Homo sapiens
atgtgtgtacacacgtgactct

SEQ ID NO: 7328356 - DNA, 22 bp, Homo sapiens
atgttaaataatcccttaaagc

SEQ ID NO: 7328357 - DNA, 22 bp, Homo sapiens
attcacacacatttagagcaga

SEQ ID NO: 7328358 - DNA, 22 bp, Homo sapiens
attcacacacatttagagcaga

SEQ ID NO: 7328359 - DNA, 22 bp, Homo sapiens
attataaagaacatgtgtgtgg

SEQ ID NO: 7328360 - DNA, 22 bp, Homo sapiens
agagggagtgaaatggaataga

SEQ ID NO: 7328361 - DNA, 22 bp, Homo sapiens
agagggatcaccctgtttctgg

SEQ ID NO: 7328362 - DNA, 22 bp, Homo sapiens
attctgggaactttgtctctca

SEQ ID NO: 7328363 - DNA, 22 bp, Homo sapiens
attctgtatttctaataagatc

SEQ ID NO: 7328364 - DNA, 22 bp, Homo sapiens
agcaaacagtgtgctaagaaat

SEQ ID NO: 7328365 - DNA, 22 bp, Homo sapiens
agcaaaataaggtaatttattg

SEQ ID NO: 7328366 - DNA, 22 bp, Homo sapiens
atttgcttagattcagcacttt

SEQ ID NO: 7328367 - DNA, 22 bp, Homo sapiens
atttgcttcatagatctgtgga

SEQ ID NO: 7328368 - DNA, 22 bp, Homo sapiens
atttattgaagcttattacgtt

SEQ ID NO: 7328369 - DNA, 21 bp, Homo sapiens
atttccaagggtacctaagat

SEQ ID NO: 7328370 - DNA, 22 bp, Homo sapiens
atttaagattgcgtattcatgt

SEQ ID NO: 7328371 - DNA, 22 bp, Homo sapiens
atttaagaggctgctagagtat

SEQ ID NO: 7328372 - DNA, 22 bp, Homo sapiens
atttaagactgacttcaccagt

SEQ ID NO: 7328373 - DNA, 22 bp, Homo sapiens
agaggtagaaaataatggagag

SEQ ID NO: 7328374 - DNA, 22 bp, Homo sapiens
agaggtagaggttgcagtgagc

SEQ ID NO: 7328375 - DNA, 22 bp, Homo sapiens
agaggtagaggttgcagtgagc

SEQ ID NO: 7328376 - DNA, 22 bp, Homo sapiens
atttagtagagaaattaagaaa

SEQ ID NO: 7328377 - DNA, 22 bp, Homo sapiens
atttattattgtggttacttct

SEQ ID NO: 7328378 - DNA, 22 bp, Homo sapiens
atttattgaacactgactatgt

SEQ ID NO: 7328379 - DNA, 22 bp, Homo sapiens
atttagcaagagtacaaaataa

SEQ ID NO: 7328380 - DNA, 22 bp, Homo sapiens
agagtggggacagggcctgtcc

SEQ ID NO: 7328381 - DNA, 22 bp, Homo sapiens
agagtgggacacgggcgctgtc

SEQ ID NO: 7328382 - DNA, 22 bp, Homo sapiens
caaatgttaaatgtgttaagac

SEQ ID NO: 7328383 - DNA, 22 bp, Homo sapiens
caaatgatactgtttttagtct

SEQ ID NO: 7328384 - DNA, 22 bp, Homo sapiens
caaatgttttttagtataagta

SEQ ID NO: 7328385 - DNA, 22 bp, Homo sapiens
caaatgttaagacaggatcaag

SEQ ID NO: 7328386 - DNA, 22 bp, Homo sapiens
caaatgtttcttatctattgtt

SEQ ID NO: 7328387 - DNA, 22 bp, Homo sapiens
attttctatgttgtaattgtta

SEQ ID NO: 7328388 - DNA, 21 bp, Homo sapiens
agcaatttttcctcctctgca

SEQ ID NO: 7328389 - DNA, 22 bp, Homo sapiens
attttctgtaactatttctata

SEQ ID NO: 7328390 - DNA, 22 bp, Homo sapiens
attttctgtaaaaaggcactaa

SEQ ID NO: 7328391 - DNA, 22 bp, Homo sapiens
attttctggttgaggtttaaca

SEQ ID NO: 7328392 - DNA, 22 bp, Homo sapiens
attttctgagcacgtgacagca

SEQ ID NO: 7328393 - DNA, 22 bp, Homo sapiens
attttctgagtccagaatttac

SEQ ID NO: 7328394 - DNA, 22 bp, Homo sapiens
agcagcaatggaaagcaacaca

SEQ ID NO: 7328395 - DNA, 22 bp, Homo sapiens
agcagcaattttcactgtcaat

SEQ ID NO: 7328396 - DNA, 22 bp, Homo sapiens
agcagcaaggaacagaatggac

SEQ ID NO: 7328397 - DNA, 22 bp, Homo sapiens
caactcatgtccaactttcttt

SEQ ID NO: 7328398 - DNA, 22 bp, Homo sapiens
agcagacaattgcctggatgga

SEQ ID NO: 7328399 - DNA, 22 bp, Homo sapiens
agcagaattccatgtgagaggg

SEQ ID NO: 7328400 - DNA, 22 bp, Homo sapiens
caactcatttattcaattttct

SEQ ID NO: 7328401 - DNA, 22 bp, Homo sapiens
cacagtatttgtttttctgagt

SEQ ID NO: 7328402 - DNA, 22 bp, Homo sapiens
cacagtcaccttatcaggatgt

SEQ ID NO: 7328403 - DNA, 22 bp, Homo sapiens
cacatctgacttccagtgcagg

SEQ ID NO: 7328404 - DNA, 22 bp, Homo sapiens
cacatctatggagacagagagt

SEQ ID NO: 7328405 - DNA, 22 bp, Homo sapiens
cacatctactgaatgagcagtg

SEQ ID NO: 7328406 - DNA, 22 bp, Homo sapiens
cactctgcctgatgttacatgg

SEQ ID NO: 7328407 - DNA, 22 bp, Homo sapiens
cactctgattccacaaggctcc

SEQ ID NO: 7328408 - DNA, 22 bp, Homo sapiens
cactctgagcccaagcaggctg

SEQ ID NO: 7328409 - DNA, 20 bp, Homo sapiens
cactctgagggagtccatgt

SEQ ID NO: 7328410 - DNA, 22 bp, Homo sapiens
agcataaaggcactagaaagag

SEQ ID NO: 7328411 - DNA, 22 bp, Homo sapiens
agccacagcaacaagtgcaatt

SEQ ID NO: 7328412 - DNA, 22 bp, Homo sapiens
cactctgtgattgcagcattcc

SEQ ID NO: 7328413 - DNA, 23 bp, Homo sapiens
cagaagacagtctcaagacaagg

SEQ ID NO: 7328414 - DNA, 22 bp, Homo sapiens
cagaagcctaaatagtgcacca

SEQ ID NO: 7328415 - DNA, 22 bp, Homo sapiens
agccaggattggctgagcctta

SEQ ID NO: 7328416 - DNA, 22 bp, Homo sapiens
cagaagctttgctcataaccat

SEQ ID NO: 7328417 - DNA, 19 bp, Homo sapiens
agcccccagacagcaggcc

SEQ ID NO: 7328418 - DNA, 17 bp, Homo sapiens
agcccccactcccaagt

SEQ ID NO: 7328419 - DNA, 22 bp, Homo sapiens
agcccaggagtttgaggctgtg

SEQ ID NO: 7328420 - DNA, 22 bp, Homo sapiens
cagagcacagagcttgggacaa

SEQ ID NO: 7328421 - DNA, 22 bp, Homo sapiens
cagagatgggtcgcagagatgg

SEQ ID NO: 7328422 - DNA, 22 bp, Homo sapiens
cagagattattataactaatta

SEQ ID NO: 7328423 - DNA, 22 bp, Homo sapiens
agccagtcggggccatgctggg

SEQ ID NO: 7328424 - DNA, 22 bp, Homo sapiens
agctcaagttcttttaccatat

SEQ ID NO: 7328425 - DNA, 22 bp, Homo sapiens
agctcaagttttcaaatattat

SEQ ID NO: 7328426 - DNA, 22 bp, Homo sapiens
cagcaggaggcatggcttccct

SEQ ID NO: 7328427 - DNA, 22 bp, Homo sapiens
cagcaggagcagtcagactcct

SEQ ID NO: 7328428 - DNA, 22 bp, Homo sapiens
cagccagagaaagggcactgcc

SEQ ID NO: 7328429 - DNA, 22 bp, Homo sapiens
agctcctactctatgccagaca

SEQ ID NO: 7328430 - DNA, 22 bp, Homo sapiens
cagccctggctagggcgagggc

SEQ ID NO: 7328431 - DNA, 23 bp, Homo sapiens
agcctcagccggtggcagaagtg

SEQ ID NO: 7328432 - DNA, 23 bp, Homo sapiens
atcattctccaatctggagcagg

SEQ ID NO: 7328433 - DNA, 20 bp, Homo sapiens
atcatctttacaatgtcagt

SEQ ID NO: 7328434 - DNA, 22 bp, Homo sapiens
atcatcttgctttctgtttact

SEQ ID NO: 7328435 - DNA, 22 bp, Homo sapiens
atcattctgatggtcaatgcta

SEQ ID NO: 7328436 - DNA, 22 bp, Homo sapiens
atcattgagattttttacaact

SEQ ID NO: 7328437 - DNA, 22 bp, Homo sapiens
atcatttaaaacaagtctctat

SEQ ID NO: 7328438 - DNA, 22 bp, Homo sapiens
atcatttatgccccaattagat

SEQ ID NO: 7328439 - DNA, 22 bp, Homo sapiens
atcacaaaggctgcttcatgat

SEQ ID NO: 7328440 - DNA, 22 bp, Homo sapiens
atatatttgagaatattcatga

SEQ ID NO: 7328441 - DNA, 22 bp, Homo sapiens
atatatttactctcctgttgca

SEQ ID NO: 7328442 - DNA, 22 bp, Homo sapiens
atatacacatctttttaaatat

SEQ ID NO: 7328443 - DNA, 20 bp, Homo sapiens
actgttagtatacttgtgcc

SEQ ID NO: 7328444 - DNA, 22 bp, Homo sapiens
actgtgttaaatacagagatgg

SEQ ID NO: 7328445 - DNA, 22 bp, Homo sapiens
actgtgtggaccactctgaggc

SEQ ID NO: 7328446 - DNA, 20 bp, Homo sapiens
actgtgtgatctggaaagct

SEQ ID NO: 7328447 - DNA, 22 bp, Homo sapiens
actgtgaaagctaacatcttag

SEQ ID NO: 7328448 - DNA, 22 bp, Homo sapiens
actgtgtattcctatatagtaa

SEQ ID NO: 7328449 - DNA, 22 bp, Homo sapiens
actgtgcctttcacttgcactt

SEQ ID NO: 7328450 - DNA, 22 bp, Homo sapiens
actgtgccttcttattgggtcc

SEQ ID NO: 7328451 - DNA, 21 bp, Homo sapiens
actgaatgtgtccaagctgag

SEQ ID NO: 7328452 - DNA, 22 bp, Homo sapiens
actgaagtccacacatgtagga

SEQ ID NO: 7328453 - DNA, 22 bp, Homo sapiens
actgcaacctccgcctgccagg

SEQ ID NO: 7328454 - DNA, 22 bp, Homo sapiens
actgctattgatgtcacacttt

SEQ ID NO: 7328455 - DNA, 22 bp, Homo sapiens
actgctttagacctagagctct

SEQ ID NO: 7328456 - DNA, 22 bp, Homo sapiens
agtctctgcatgatgcagcaca

SEQ ID NO: 7328457 - DNA, 22 bp, Homo sapiens
agtctctggactgggagatggc

SEQ ID NO: 7328458 - DNA, 21 bp, Homo sapiens
actcatttgtctgcatctaat

SEQ ID NO: 7328459 - DNA, 22 bp, Homo sapiens
actccacaccacgggggccgcc

SEQ ID NO: 7328460 - DNA, 22 bp, Homo sapiens
actatataagattggcattttt

SEQ ID NO: 7328461 - DNA, 22 bp, Homo sapiens
actatatacacattatcttgtt

SEQ ID NO: 7328462 - DNA, 22 bp, Homo sapiens
acctgtttagaaagcttatgag

SEQ ID NO: 7328463 - DNA, 21 bp, Homo sapiens
acgggaatgaacatggtggag

SEQ ID NO: 7328464 - DNA, 22 bp, Homo sapiens
acgtgtgtttaacaaacctgca

SEQ ID NO: 7328465 - DNA, 20 bp, Homo sapiens
acgtgtgtgtgcacgcgcgc

SEQ ID NO: 7328466 - DNA, 22 bp, Homo sapiens
acgtgtgtatgagtgtacatat

SEQ ID NO: 7328467 - DNA, 22 bp, Homo sapiens
acctcccagctctgagcttggg

SEQ ID NO: 7328468 - DNA, 22 bp, Homo sapiens
aggtacgggtctgagagccatg

SEQ ID NO: 7328469 - DNA, 22 bp, Homo sapiens
aggtagagctccagtagaaaat

SEQ ID NO: 7328470 - DNA, 22 bp, Homo sapiens
acctggctgagaacgtgcagct

SEQ ID NO: 7328471 - DNA, 23 bp, Homo sapiens
acctggctgctcaacctgcaggg

SEQ ID NO: 7328472 - DNA, 22 bp, Homo sapiens
acctggttcctcctcactgctg

SEQ ID NO: 7328473 - DNA, 22 bp, Homo sapiens
acatttatataactcactagga

SEQ ID NO: 7328474 - DNA, 22 bp, Homo sapiens
acatttaatgatcctactgtga

SEQ ID NO: 7328475 - DNA, 19 bp, Homo sapiens
acatttaaattcagatctc

SEQ ID NO: 7328476 - DNA, 22 bp, Homo sapiens
acatttaaccaaactgtttaat

SEQ ID NO: 7328477 - DNA, 22 bp, Homo sapiens
acatttaacctttgaggaactg

SEQ ID NO: 7328478 - DNA, 22 bp, Homo sapiens
acattgtatacagacttagtca

SEQ ID NO: 7328479 - DNA, 22 bp, Homo sapiens
aggctaggggaacactagaatc

SEQ ID NO: 7328480 - DNA, 17 bp, Homo sapiens
aggcaggcagagcggga

SEQ ID NO: 7328481 - DNA, 22 bp, Homo sapiens
aggcaggggagctggaagggta

SEQ ID NO: 7328482 - DNA, 22 bp, Homo sapiens
acatggaagataaaaatactca

SEQ ID NO: 7328483 - DNA, 22 bp, Homo sapiens
accattctgtctctttacaaat

SEQ ID NO: 7328484 - DNA, 22 bp, Homo sapiens
accatgtttagtgcagtgttca

SEQ ID NO: 7328485 - DNA, 22 bp, Homo sapiens
agggagctcagttggaagcggt

SEQ ID NO: 7328486 - DNA, 22 bp, Homo sapiens
agggagctctaagtagagggac

SEQ ID NO: 7328487 - DNA, 22 bp, Homo sapiens
accatattagaaagcacagctc

SEQ ID NO: 7328488 - DNA, 22 bp, Homo sapiens
accaaaacctgctactaaagga

SEQ ID NO: 7328489 - DNA, 21 bp, Homo sapiens
accaaaacctatactttctgt

SEQ ID NO: 7328490 - DNA, 20 bp, Homo sapiens
aggctggcactcctggccag

SEQ ID NO: 7328491 - DNA, 22 bp, Homo sapiens
agggagccttcctggctgtggt

SEQ ID NO: 7328492 - DNA, 18 bp, Homo sapiens
acagggagggcgctgggg

SEQ ID NO: 7328493 - DNA, 22 bp, Homo sapiens
acagggagtctgaggggatagt

SEQ ID NO: 7328494 - DNA, 22 bp, Homo sapiens
acagggcaacctctgggagact

SEQ ID NO: 7328495 - DNA, 22 bp, Homo sapiens
acaggtggggaggctgaggttc

SEQ ID NO: 7328496 - DNA, 22 bp, Homo sapiens
acaggtggcttattggctgatt

SEQ ID NO: 7328497 - DNA, 22 bp, Homo sapiens
acaggtggccccgagggagtgg

SEQ ID NO: 7328498 - DNA, 23 bp, Homo sapiens
aggaggaaaagttatctgctgag

SEQ ID NO: 7328499 - DNA, 22 bp, Homo sapiens
aggagtcattgagaggggtcct

SEQ ID NO: 7328500 - DNA, 22 bp, Homo sapiens
aggagtccatgagcagctagag

SEQ ID NO: 7328501 - DNA, 17 bp, Homo sapiens
aggagtctcagatgagc

SEQ ID NO: 7328502 - DNA, 17 bp, Homo sapiens
aggagtctcagatgagc

SEQ ID NO: 7328503 - DNA, 22 bp, Homo sapiens
acagttcaagcaagtttctgtt

SEQ ID NO: 7328504 - DNA, 22 bp, Homo sapiens
acagttatttactgcataaact

SEQ ID NO: 7328505 - DNA, 22 bp, Homo sapiens
acagttcaagtcttagacaaca

SEQ ID NO: 7328506 - DNA, 22 bp, Homo sapiens
acagttaattgttgttgggtgt

SEQ ID NO: 7328507 - DNA, 22 bp, Homo sapiens
acagttaattgttgttgggtgt

SEQ ID NO: 7328508 - DNA, 22 bp, Homo sapiens
acagttaaggaaatggaggttc

SEQ ID NO: 7328509 - DNA, 22 bp, Homo sapiens
acagttaaggaaatggaggttc

SEQ ID NO: 7328510 - DNA, 22 bp, Homo sapiens
acagttaagcagtatgatcaca

SEQ ID NO: 7328511 - DNA, 22 bp, Homo sapiens
acagttaataagtagtaagtca

SEQ ID NO: 7328512 - DNA, 22 bp, Homo sapiens
acagttaataagtagtaagtca

SEQ ID NO: 7328513 - DNA, 22 bp, Homo sapiens
acagttaatcaaatggcatatg

SEQ ID NO: 7328514 - DNA, 22 bp, Homo sapiens
acagttaatatgtgacagaact

SEQ ID NO: 7328515 - DNA, 22 bp, Homo sapiens
acagttaatcaaatggcatatg

SEQ ID NO: 7328516 - DNA, 22 bp, Homo sapiens
acagttaatcctaaaggcggta

SEQ ID NO: 7328517 - DNA, 22 bp, Homo sapiens
acagttaattaacattaagggg

SEQ ID NO: 7328518 - DNA, 22 bp, Homo sapiens
acagttaattaacattaagggg

SEQ ID NO: 7328519 - DNA, 22 bp, Homo sapiens
acagtgatgggggtgcaggaag

SEQ ID NO: 7328520 - DNA, 22 bp, Homo sapiens
acagtgatgagccggctgaggc

SEQ ID NO: 7328521 - DNA, 22 bp, Homo sapiens
acagtgcaaaccctcgggaaag

SEQ ID NO: 7328522 - DNA, 22 bp, Homo sapiens
acagtgcaaataggactgtctt

SEQ ID NO: 7328523 - DNA, 22 bp, Homo sapiens
acagtgcacatcctgagtgatt

SEQ ID NO: 7328524 - DNA, 22 bp, Homo sapiens
acagttaaatatttctactggg

SEQ ID NO: 7328525 - DNA, 22 bp, Homo sapiens
acagttaactggagagcgagtt

SEQ ID NO: 7328526 - DNA, 22 bp, Homo sapiens
acagttaactggagagcgagtt

SEQ ID NO: 7328527 - DNA, 21 bp, Homo sapiens
acagttttaaggagcacatgg

SEQ ID NO: 7328528 - DNA, 22 bp, Homo sapiens
aggcaggattgctgacaacaat

SEQ ID NO: 7328529 - DNA, 22 bp, Homo sapiens
aggcagcatccagaggagaatg

SEQ ID NO: 7328530 - DNA, 22 bp, Homo sapiens
acaggcaggtaatttacatatt

SEQ ID NO: 7328531 - DNA, 22 bp, Homo sapiens
acaggcctcaagacacccaggt

SEQ ID NO: 7328532 - DNA, 22 bp, Homo sapiens
acaggctgcctaccaagtatca

SEQ ID NO: 7328533 - DNA, 22 bp, Homo sapiens
acaggctggaggaggaccaaga

SEQ ID NO: 7328534 - DNA, 22 bp, Homo sapiens
acaggctgctgggctccgtgct

SEQ ID NO: 7328535 - DNA, 22 bp, Homo sapiens
acaggctggtggtcctggccat

SEQ ID NO: 7328536 - DNA, 22 bp, Homo sapiens
aggaagggctgtttctccaaga

SEQ ID NO: 7328537 - DNA, 18 bp, Homo sapiens
acaggctgtgggaatggt

SEQ ID NO: 7328538 - DNA, 22 bp, Homo sapiens
agctgccagggactgggcatgg

SEQ ID NO: 7328539 - DNA, 22 bp, Homo sapiens
acagctgattggatcaaggaca

SEQ ID NO: 7328540 - DNA, 22 bp, Homo sapiens
acactgagcatctctagaggca

SEQ ID NO: 7328541 - DNA, 22 bp, Homo sapiens
acacattataggcaatcaaaag

SEQ ID NO: 7328542 - DNA, 22 bp, Homo sapiens
acacattatagagagtataata

SEQ ID NO: 7328543 - DNA, 22 bp, Homo sapiens
agcagcaaaagagaatagtttg

SEQ ID NO: 7328544 - DNA, 22 bp, Homo sapiens
agcagatgaatcccagataaag

SEQ ID NO: 7328545 - DNA, 18 bp, Homo sapiens
agcagagagtgaatggga

SEQ ID NO: 7328546 - DNA, 18 bp, Homo sapiens
agcagagagtgaatggga

SEQ ID NO: 7328547 - DNA, 22 bp, Homo sapiens
acacagataatgctcatatagg

SEQ ID NO: 7328548 - DNA, 22 bp, Homo sapiens
acacagagtatcttttgcctag

SEQ ID NO: 7328549 - DNA, 22 bp, Homo sapiens
acagcaattgtatgcatagcat

SEQ ID NO: 7328550 - DNA, 22 bp, Homo sapiens
acagatgaggctggcgagggca

SEQ ID NO: 7328551 - DNA, 20 bp, Homo sapiens
acagatatttgattttcagt

SEQ ID NO: 7328552 - DNA, 22 bp, Homo sapiens
acagagctaatgttgcataggc

SEQ ID NO: 7328553 - DNA, 22 bp, Homo sapiens
agcctctgatggctcccaagga

SEQ ID NO: 7328554 - DNA, 21 bp, Homo sapiens
acagagaaagagcagcctcct

SEQ ID NO: 7328555 - DNA, 22 bp, Homo sapiens
acagacattcatatcctcggta

SEQ ID NO: 7328556 - DNA, 22 bp, Homo sapiens
acagacattcagctaagtctat

SEQ ID NO: 7328557 - DNA, 22 bp, Homo sapiens
acagacatgggccgctcttgag

SEQ ID NO: 7328558 - DNA, 22 bp, Homo sapiens
acaagcatgtggtaaaaagacc

SEQ ID NO: 7328559 - DNA, 20 bp, Homo sapiens
acaatctgtttgttgtctgt

SEQ ID NO: 7328560 - DNA, 22 bp, Homo sapiens
acaacaaagacacttgaaatga

SEQ ID NO: 7328561 - DNA, 22 bp, Homo sapiens
acaagagccctttcagattgac

SEQ ID NO: 7328562 - DNA, 22 bp, Homo sapiens
acaagagcattgcaggtgtgtt

SEQ ID NO: 7328563 - DNA, 22 bp, Homo sapiens
aattgcatgttaatgactaagt

SEQ ID NO: 7328564 - DNA, 22 bp, Homo sapiens
aattgagatgacagaggaatag

SEQ ID NO: 7328565 - DNA, 22 bp, Homo sapiens
agacaatgtcaaggtgatcatc

SEQ ID NO: 7328566 - DNA, 22 bp, Homo sapiens
aatggcactttataaatgttaa

SEQ ID NO: 7328567 - DNA, 22 bp, Homo sapiens
aatgggaagtcactactgttac

SEQ ID NO: 7328568 - DNA, 22 bp, Homo sapiens
aatgtgtaaaaggttttcttca

SEQ ID NO: 7328569 - DNA, 22 bp, Homo sapiens
aatgttttaaaagagattgaga

SEQ ID NO: 7328570 - DNA, 22 bp, Homo sapiens
agagacaggatatctgctcatg

SEQ ID NO: 7328571 - DNA, 22 bp, Homo sapiens
agagacagggttttgccatgtt

SEQ ID NO: 7328572 - DNA, 23 bp, Homo sapiens
actctcaggttctttccagcagg

SEQ ID NO: 7328573 - DNA, 22 bp, Homo sapiens
actctcagggacagggtctggg

SEQ ID NO: 7328574 - DNA, 22 bp, Homo sapiens
aagtctcatccgtgtagctcca

SEQ ID NO: 7328575 - DNA, 22 bp, Homo sapiens
acctttatgattcacaatgtat

SEQ ID NO: 7328576 - DNA, 22 bp, Homo sapiens
acgggtggctgaggaggcctct

SEQ ID NO: 7328577 - DNA, 22 bp, Homo sapiens
actggctcagagttcctagaga

SEQ ID NO: 7328578 - DNA, 22 bp, Homo sapiens
aatcagaacttctcagggtggg

SEQ ID NO: 7328579 - DNA, 22 bp, Homo sapiens
aatcaggaactcaagtgcattg

SEQ ID NO: 7328580 - DNA, 22 bp, Homo sapiens
aatcaggaaactatcaacacat

SEQ ID NO: 7328581 - DNA, 22 bp, Homo sapiens
aatcaggagctagggggcaatg

SEQ ID NO: 7328582 - DNA, 19 bp, Homo sapiens
aatcaggagcctaattagg

SEQ ID NO: 7328583 - DNA, 22 bp, Homo sapiens
aatcaggagagctgcgaacgtt

SEQ ID NO: 7328584 - DNA, 22 bp, Homo sapiens
aatcaggactgtgccaaaccta

SEQ ID NO: 7328585 - DNA, 22 bp, Homo sapiens
aatcaggacccactctacagtt

SEQ ID NO: 7328586 - DNA, 21 bp, Homo sapiens
aatcaggaagtgtgtgtcctg

SEQ ID NO: 7328587 - DNA, 22 bp, Homo sapiens
aatcaggagtgtgcactttgat

SEQ ID NO: 7328588 - DNA, 22 bp, Homo sapiens
aatcaggaggataagggggtcc

SEQ ID NO: 7328589 - DNA, 22 bp, Homo sapiens
aatcaggagctgaggtttagcc

SEQ ID NO: 7328590 - DNA, 22 bp, Homo sapiens
aatcaggaggaagccttgggca

SEQ ID NO: 7328591 - DNA, 22 bp, Homo sapiens
aatcaggatagaacctcacgtg

SEQ ID NO: 7328592 - DNA, 22 bp, Homo sapiens
aatcaggatatgaacccaggta

SEQ ID NO: 7328593 - DNA, 22 bp, Homo sapiens
aatcaggatgactgtcatttca

SEQ ID NO: 7328594 - DNA, 22 bp, Homo sapiens
aatatagatttactcaagagaa

SEQ ID NO: 7328595 - DNA, 22 bp, Homo sapiens
aatatagttctggtattgttaa

SEQ ID NO: 7328596 - DNA, 22 bp, Homo sapiens
aatatagttctagaaatatttt

SEQ ID NO: 7328597 - DNA, 22 bp, Homo sapiens
aatatagtgttagctcatttga

SEQ ID NO: 7328598 - DNA, 23 bp, Homo sapiens
actttattgaccccaggtcagtt

SEQ ID NO: 7328599 - DNA, 22 bp, Homo sapiens
actttatttcctattgcatcca

SEQ ID NO: 7328600 - DNA, 23 bp, Homo sapiens
actttattgaccccaggtcagtt

SEQ ID NO: 7328601 - DNA, 22 bp, Homo sapiens
aagctcattaattagaagctaa

SEQ ID NO: 7328602 - DNA, 22 bp, Homo sapiens
aagctcatgggtgctgtacttt

SEQ ID NO: 7328603 - DNA, 22 bp, Homo sapiens
aagctctgctcagcagactagg

SEQ ID NO: 7328604 - DNA, 22 bp, Homo sapiens
aagctgcttggggctcctgcag

SEQ ID NO: 7328605 - DNA, 22 bp, Homo sapiens
acagggcagagggcagttggta

SEQ ID NO: 7328606 - DNA, 22 bp, Homo sapiens
aagcatttttcacagcaacagc

SEQ ID NO: 7328607 - DNA, 21 bp, Homo sapiens
aagctacagaaaataatttga

SEQ ID NO: 7328608 - DNA, 19 bp, Homo sapiens
aagctacagcccaggtctg

SEQ ID NO: 7328609 - DNA, 22 bp, Homo sapiens
aagctacagtttacccatggtt

SEQ ID NO: 7328610 - DNA, 22 bp, Homo sapiens
aagctacattaagcagatttac

SEQ ID NO: 7328611 - DNA, 22 bp, Homo sapiens
aagctacacatctgttgggtat

SEQ ID NO: 7328612 - DNA, 22 bp, Homo sapiens
aagctacaatgtgtttttgaaa

SEQ ID NO: 7328613 - DNA, 22 bp, Homo sapiens
aaggagagtacaggagttggta

SEQ ID NO: 7328614 - DNA, 21 bp, Homo sapiens
aaggagcctaggaggctcagg

SEQ ID NO: 7328615 - DNA, 20 bp, Homo sapiens
aaggagaatgacacggctgc

SEQ ID NO: 7328616 - DNA, 22 bp, Homo sapiens
acagtgtttaaaataatatgct

SEQ ID NO: 7328617 - DNA, 22 bp, Homo sapiens
acagtgtttaaaaatcagatct

SEQ ID NO: 7328618 - DNA, 22 bp, Homo sapiens
acagtctttaatttctttgtgg

SEQ ID NO: 7328619 - DNA, 22 bp, Homo sapiens
acagtgttcttgatattacagt

SEQ ID NO: 7328620 - DNA, 17 bp, Homo sapiens
acagtgtctatgaaatg

SEQ ID NO: 7328621 - DNA, 22 bp, Homo sapiens
acagtcttgcacttctatcagc

SEQ ID NO: 7328622 - DNA, 22 bp, Homo sapiens
acagtcttatgcatacactatt

SEQ ID NO: 7328623 - DNA, 22 bp, Homo sapiens
aaggcagagggctggatcagag

SEQ ID NO: 7328624 - DNA, 22 bp, Homo sapiens
aaggaggaatgtagccagctcc

SEQ ID NO: 7328625 - DNA, 22 bp, Homo sapiens
acagtgtttggcaatgcatgca

SEQ ID NO: 7328626 - DNA, 22 bp, Homo sapiens
aaggaggaatttcagggtgaat

SEQ ID NO: 7328627 - DNA, 22 bp, Homo sapiens
aaggaggcagaactcacatgga

SEQ ID NO: 7328628 - DNA, 22 bp, Homo sapiens
aaggaggcactcgctctcaggg

SEQ ID NO: 7328629 - DNA, 22 bp, Homo sapiens
aaggaggcaccctgagcctgcc

SEQ ID NO: 7328630 - DNA, 22 bp, Homo sapiens
acatttaaatacctatgtttct

SEQ ID NO: 7328631 - DNA, 22 bp, Homo sapiens
acatttaaatatgccttatatt

SEQ ID NO: 7328632 - DNA, 22 bp, Homo sapiens
aaggctggacctggatgaatct

SEQ ID NO: 7328633 - DNA, 19 bp, Homo sapiens
aaggctggagaaggcctct

SEQ ID NO: 7328634 - DNA, 22 bp, Homo sapiens
aaggctctctgatggcagcagt

SEQ ID NO: 7328635 - DNA, 22 bp, Homo sapiens
accagggcaaatgtttgtactc

SEQ ID NO: 7328636 - DNA, 22 bp, Homo sapiens
acattttgagaaatgacaagct

SEQ ID NO: 7328637 - DNA, 22 bp, Homo sapiens
acattttgaaagggaaattgtt

SEQ ID NO: 7328638 - DNA, 21 bp, Homo sapiens
acattttctgttttaggaagt

SEQ ID NO: 7328639 - DNA, 22 bp, Homo sapiens
aagatggagtagtgtaatggtt

SEQ ID NO: 7328640 - DNA, 22 bp, Homo sapiens
aagatggtcttgagatattata

SEQ ID NO: 7328641 - DNA, 22 bp, Homo sapiens
aagcaataatcccaaagtgctg

SEQ ID NO: 7328642 - DNA, 22 bp, Homo sapiens
acacatttattacatgcatgtg

SEQ ID NO: 7328643 - DNA, 22 bp, Homo sapiens
acacatttagcaccaggtttat

SEQ ID NO: 7328644 - DNA, 22 bp, Homo sapiens
acacatttaaaaaggaacatat

SEQ ID NO: 7328645 - DNA, 22 bp, Homo sapiens
acacattgcagacatctcatta

SEQ ID NO: 7328646 - DNA, 22 bp, Homo sapiens
aagcagaggccacagagtgggc

SEQ ID NO: 7328647 - DNA, 22 bp, Homo sapiens
aagcagaggaccgacggaggga

SEQ ID NO: 7328648 - DNA, 22 bp, Homo sapiens
acagcaaaagacaagaacttaa

SEQ ID NO: 7328649 - DNA, 19 bp, Homo sapiens
aagcaatgttgtgaatcta

SEQ ID NO: 7328650 - DNA, 20 bp, Homo sapiens
aagcaatatagtgcaaatgt

SEQ ID NO: 7328651 - DNA, 22 bp, Homo sapiens
aagcaatatactgatatgatta

SEQ ID NO: 7328652 - DNA, 22 bp, Homo sapiens
aagcagagcctgagacagggat

SEQ ID NO: 7328653 - DNA, 22 bp, Homo sapiens
aagactttctgtaaagctacag

SEQ ID NO: 7328654 - DNA, 22 bp, Homo sapiens
aattttaatcagtggtgctgag

SEQ ID NO: 7328655 - DNA, 22 bp, Homo sapiens
aattttactaatctgagtgtga

SEQ ID NO: 7328656 - DNA, 22 bp, Homo sapiens
aattttaagcatatgactggtt

SEQ ID NO: 7328657 - DNA, 22 bp, Homo sapiens
aagagaatatcgatagcactct

SEQ ID NO: 7328658 - DNA, 22 bp, Homo sapiens
aagaaatgtgaatattgaatag

SEQ ID NO: 7328659 - DNA, 22 bp, Homo sapiens
aagaacaactgctttaaaagca

SEQ ID NO: 7328660 - DNA, 22 bp, Homo sapiens
aatttacacttcatttggaggg

SEQ ID NO: 7328661 - DNA, 22 bp, Homo sapiens
aagaaaacaatgacttgccagc

SEQ ID NO: 7328662 - DNA, 22 bp, Homo sapiens
aagaaacaaccactgctctcct

SEQ ID NO: 7328663 - DNA, 19 bp, Homo sapiens
aactggataatggccacat

SEQ ID NO: 7328664 - DNA, 22 bp, Homo sapiens
aactggctgggaacacctagag

SEQ ID NO: 7328665 - DNA, 22 bp, Homo sapiens
aacatatttggctgatattccc

SEQ ID NO: 7328666 - DNA, 22 bp, Homo sapiens
aacatcaggatcttgttacagt

SEQ ID NO: 7328667 - DNA, 22 bp, Homo sapiens
aagtgcttggattgcaggtatg

SEQ ID NO: 7328668 - DNA, 22 bp, Homo sapiens
aagtggttgcttgtgagtcccc

SEQ ID NO: 7328669 - DNA, 22 bp, Homo sapiens
aacagctattcactactatggg

SEQ ID NO: 7328670 - DNA, 22 bp, Homo sapiens
aacagctaccttctcactgtgc

SEQ ID NO: 7328671 - DNA, 22 bp, Homo sapiens
aatagacaattctagccaacat

SEQ ID NO: 7328672 - DNA, 22 bp, Homo sapiens
aatagacaagcaccctggtaaa

SEQ ID NO: 7328673 - DNA, 23 bp, Homo sapiens
aatgacaggcaatgtaattgtgt

SEQ ID NO: 7328674 - DNA, 22 bp, Homo sapiens
aatgacagtgttgggccagatg

SEQ ID NO: 7328675 - DNA, 22 bp, Homo sapiens
aatggctctgatgttgttgtga

SEQ ID NO: 7328676 - DNA, 22 bp, Homo sapiens
aatggctctttgaggacagaag

SEQ ID NO: 7328677 - DNA, 22 bp, Homo sapiens
aacctcataggacttgaacata

SEQ ID NO: 7328678 - DNA, 22 bp, Homo sapiens
aacctcatttccttctttgtaa

SEQ ID NO: 7328679 - DNA, 22 bp, Homo sapiens
aacccgggaggcggaggttgtg

SEQ ID NO: 7328680 - DNA, 22 bp, Homo sapiens
aacccgggaggtggaggttatg

SEQ ID NO: 7328681 - DNA, 22 bp, Homo sapiens
aaatgtcaaggtgatagatgca

SEQ ID NO: 7328682 - DNA, 22 bp, Homo sapiens
aaatgtcagaggaacatattga

SEQ ID NO: 7328683 - DNA, 22 bp, Homo sapiens
aaggaagagtctagaacaggca

SEQ ID NO: 7328684 - DNA, 22 bp, Homo sapiens
aaggaagagcaaagaattatgt

SEQ ID NO: 7328685 - DNA, 22 bp, Homo sapiens
aaggaagagtctagaacaggca

SEQ ID NO: 7328686 - DNA, 22 bp, Homo sapiens
aaggaagaggcaggttttgctg

SEQ ID NO: 7328687 - DNA, 22 bp, Homo sapiens
aaggaagatgaaagtactgcta

SEQ ID NO: 7328688 - DNA, 22 bp, Homo sapiens
aaggaagatatatcaagcttaa

SEQ ID NO: 7328689 - DNA, 22 bp, Homo sapiens
aaggaagatgaggtgctgctta

SEQ ID NO: 7328690 - DNA, 22 bp, Homo sapiens
aaggaagatgaaagtactgcta

SEQ ID NO: 7328691 - DNA, 22 bp, Homo sapiens
aaatgtcaaagacgtgtttttg

SEQ ID NO: 7328692 - DNA, 22 bp, Homo sapiens
aaggaagagaatccttctcaga

SEQ ID NO: 7328693 - DNA, 22 bp, Homo sapiens
aaggaagacttgagaaggttcc

SEQ ID NO: 7328694 - DNA, 22 bp, Homo sapiens
aaggaagactcgcaggtctatg

SEQ ID NO: 7328695 - DNA, 22 bp, Homo sapiens
aaggaagacttgagaaggttcc

SEQ ID NO: 7328696 - DNA, 22 bp, Homo sapiens
aaggaagagaatccttctcaga

SEQ ID NO: 7328697 - DNA, 22 bp, Homo sapiens
aaggaagacacagatgaagtga

SEQ ID NO: 7328698 - DNA, 22 bp, Homo sapiens
aaggaagacacagatgaagtga

SEQ ID NO: 7328699 - DNA, 22 bp, Homo sapiens
aaggctgggtttgggatgtgat

SEQ ID NO: 7328700 - DNA, 22 bp, Homo sapiens
aaattttaaggctggaacttaa

SEQ ID NO: 7328701 - DNA, 22 bp, Homo sapiens
aaggctggtggattatgaggtc

SEQ ID NO: 7328702 - DNA, 20 bp, Homo sapiens
aacacagataccaaaggttg

SEQ ID NO: 7328703 - DNA, 22 bp, Homo sapiens
aacacagaagtgccaagagcca

SEQ ID NO: 7328704 - DNA, 22 bp, Homo sapiens
aacacagatcaaaatatttcct

SEQ ID NO: 7328705 - DNA, 22 bp, Homo sapiens
aacagaacccgagtgtgaatct

SEQ ID NO: 7328706 - DNA, 21 bp, Homo sapiens
aaaatgtgagcgtgatgctta

SEQ ID NO: 7328707 - DNA, 22 bp, Homo sapiens
aaactggattaccaggctggtg

SEQ ID NO: 7328708 - DNA, 22 bp, Homo sapiens
aaaatatgtataactcttctgc

SEQ ID NO: 7328709 - DNA, 22 bp, Homo sapiens
aaactgcacacgatgtgcctga

SEQ ID NO: 7328710 - DNA, 22 bp, Homo sapiens
aaaatatgaagttgtcagtatg

SEQ ID NO: 7328711 - DNA, 22 bp, Homo sapiens
aaacagtaagttctagtattat

SEQ ID NO: 7328712 - DNA, 22 bp, Homo sapiens
aaacagtattatcaatatattt

SEQ ID NO: 7328713 - DNA, 22 bp, Homo sapiens
aaaatgtgatctacaaatgcaa

SEQ ID NO: 7328714 - DNA, 22 bp, Homo sapiens
aaaattcattcctcagactgcc

SEQ ID NO: 7328715 - DNA, 22 bp, Homo sapiens
aaacacaagatggcctcttctg

SEQ ID NO: 7328716 - DNA, 22 bp, Homo sapiens
aaaattatggagtatcccaaag

SEQ ID NO: 7328717 - DNA, 22 bp, Homo sapiens
aaaattaagtgtctgggaagcc

SEQ ID NO: 7328718 - DNA, 22 bp, Homo sapiens
aaaagaacctagctcctcagtc

SEQ ID NO: 7328719 - DNA, 22 bp, Homo sapiens
aaaaggtagattctccttctat

SEQ ID NO: 7328720 - DNA, 22 bp, Homo sapiens
aaaagggcaaaaccatcatgga

SEQ ID NO: 7328721 - DNA, 22 bp, Homo sapiens
aaacatgtaattctgcttaaga

SEQ ID NO: 7328722 - DNA, 22 bp, Homo sapiens
aaacatgttttctgaatatttt

SEQ ID NO: 7328723 - DNA, 22 bp, Homo sapiens
aaacatgttttctgaatatttt

SEQ ID NO: 7328724 - DNA, 22 bp, Homo sapiens
aaactgtatatttatggcatgt

SEQ ID NO: 7328725 - DNA, 22 bp, Homo sapiens
aaacactgaagacctatctggt

SEQ ID NO: 7328726 - DNA, 22 bp, Homo sapiens
aaactttttattctaatgtcta

SEQ ID NO: 7328727 - DNA, 22 bp, Homo sapiens
aaacttttttaggttcataggc

SEQ ID NO: 7328728 - DNA, 22 bp, Homo sapiens
aaagaaacctatcagccacatg

SEQ ID NO: 7328729 - DNA, 22 bp, Homo sapiens
aaatagtcctgggaatagtact

SEQ ID NO: 7328730 - DNA, 22 bp, Homo sapiens
aaacttttcctgctcttgtcct

SEQ ID NO: 7328731 - DNA, 22 bp, Homo sapiens
aaagatgttaatagcaccattt

SEQ ID NO: 7328732 - DNA, 22 bp, Homo sapiens
aaagagaacttttacccaagaa

SEQ ID NO: 7328733 - DNA, 22 bp, Homo sapiens
aaagagaaaatgatctgtacat

SEQ ID NO: 7328734 - DNA, 22 bp, Homo sapiens
aacatttgtttggcttcaatta

SEQ ID NO: 7328735 - DNA, 22 bp, Homo sapiens
aacccgggaggcagaggttgtg

SEQ ID NO: 7328736 - DNA, 22 bp, Homo sapiens
aaaggttttgccctgggtattc

SEQ ID NO: 7328737 - DNA, 22 bp, Homo sapiens
aaaggtttttatttatcctgga

SEQ ID NO: 7328738 - DNA, 22 bp, Homo sapiens
aaagccattgcagagcaggatt

SEQ ID NO: 7328739 - DNA, 22 bp, Homo sapiens
aaagcccatgtggaagtacagg

SEQ ID NO: 7328740 - DNA, 22 bp, Homo sapiens
aacacttggagggagagtggga

SEQ ID NO: 7328741 - DNA, 22 bp, Homo sapiens
aaagatttcagaagcctgtgcc

SEQ ID NO: 7328742 - DNA, 22 bp, Homo sapiens
aaagatttgagttctgcttata

SEQ ID NO: 7328743 - DNA, 22 bp, Homo sapiens
aaagattcctttattctccaag

SEQ ID NO: 7328744 - DNA, 22 bp, Homo sapiens
aaagatgttttataagttatgg

SEQ ID NO: 7328745 - DNA, 21 bp, Homo sapiens
aaagatgtttcttttcctcac

SEQ ID NO: 7328746 - DNA, 22 bp, Homo sapiens
aaagtgattatgctgtcaaaga

SEQ ID NO: 7328747 - DNA, 22 bp, Homo sapiens
aaagtgcagaactgttctcact

SEQ ID NO: 7328748 - DNA, 22 bp, Homo sapiens
aaagtgcagctgaaaacatcct

SEQ ID NO: 7328749 - DNA, 22 bp, Homo sapiens
aaagtgcactagaatccagatt

SEQ ID NO: 7328750 - DNA, 20 bp, Homo sapiens
aaagtgcacagatacagctc

SEQ ID NO: 7328751 - DNA, 22 bp, Homo sapiens
aagactgaatttgcatagttgg

SEQ ID NO: 7328752 - DNA, 22 bp, Homo sapiens
aaagttttagaactaggaagca

SEQ ID NO: 7328753 - DNA, 22 bp, Homo sapiens
aagaggaggatgctttacagct

SEQ ID NO: 7328754 - DNA, 22 bp, Homo sapiens
aagagggaaattgttggctgct

SEQ ID NO: 7328755 - DNA, 22 bp, Homo sapiens
aagattcagttgatgtgttcca

SEQ ID NO: 7328756 - DNA, 22 bp, Homo sapiens
aagcaggagatgcaggaatgta

SEQ ID NO: 7328757 - DNA, 22 bp, Homo sapiens
aagatccatgggaatgtttggc

SEQ ID NO: 7328758 - DNA, 22 bp, Homo sapiens
aagatcataatatttatctcat

SEQ ID NO: 7328759 - DNA, 22 bp, Homo sapiens
aaatgcatgtagaataatagag

SEQ ID NO: 7328760 - DNA, 22 bp, Homo sapiens
aagccggctgggccgaggctgc

SEQ ID NO: 7328761 - DNA, 22 bp, Homo sapiens
gtatatatgtgtgaacatgtat

SEQ ID NO: 7328762 - DNA, 22 bp, Homo sapiens
gtatatatcggcactattttaa

SEQ ID NO: 7328763 - DNA, 22 bp, Homo sapiens
gtacatttactgatgaaaagta

SEQ ID NO: 7328764 - DNA, 22 bp, Homo sapiens
gtacatattataaaatacagct

SEQ ID NO: 7328765 - DNA, 22 bp, Homo sapiens
gtacatattataaaatacagct

SEQ ID NO: 7328766 - DNA, 22 bp, Homo sapiens
gtaaagaagtttttgaatgcat

SEQ ID NO: 7328767 - DNA, 22 bp, Homo sapiens
gtaaagaaggcaacctggttat

SEQ ID NO: 7328768 - DNA, 22 bp, Homo sapiens
gggtggggtgtatcggatccta

SEQ ID NO: 7328769 - DNA, 22 bp, Homo sapiens
gggtggggttcaggaatcttca

SEQ ID NO: 7328770 - DNA, 22 bp, Homo sapiens
gggtggggccaggcaatttgca

SEQ ID NO: 7328771 - DNA, 22 bp, Homo sapiens
gggtggggcccaggaaatctat

SEQ ID NO: 7328772 - DNA, 19 bp, Homo sapiens
ggtggcaggaataaaggtc

SEQ ID NO: 7328773 - DNA, 22 bp, Homo sapiens
ggtgtcacaggaggccgtgtgg

SEQ ID NO: 7328774 - DNA, 22 bp, Homo sapiens
gtctgaaaatatgattttgcct

SEQ ID NO: 7328775 - DNA, 22 bp, Homo sapiens
gtctgccatgtggagaaagcca

SEQ ID NO: 7328776 - DNA, 18 bp, Homo sapiens
gtctgccaacaactatca

SEQ ID NO: 7328777 - DNA, 22 bp, Homo sapiens
gtctggctgttcctgcctgtga

SEQ ID NO: 7328778 - DNA, 22 bp, Homo sapiens
gtcaggagagatcaggacagca

SEQ ID NO: 7328779 - DNA, 22 bp, Homo sapiens
gtcaggaaaacccgggttgact

SEQ ID NO: 7328780 - DNA, 22 bp, Homo sapiens
gtcagaggaggctgagtaggaa

SEQ ID NO: 7328781 - DNA, 22 bp, Homo sapiens
gtattacaaataaatgttactg

SEQ ID NO: 7328782 - DNA, 22 bp, Homo sapiens
gtccatccacgcccacacactc

SEQ ID NO: 7328783 - DNA, 22 bp, Homo sapiens
gtcccagggaggttcagggctt

SEQ ID NO: 7328784 - DNA, 22 bp, Homo sapiens
gtcccagggccaccatatatag

SEQ ID NO: 7328785 - DNA, 22 bp, Homo sapiens
gtcccagggcaaggctgtttct

SEQ ID NO: 7328786 - DNA, 22 bp, Homo sapiens
gtcccaggtgcccagtgggcag

SEQ ID NO: 7328787 - DNA, 22 bp, Homo sapiens
gtggacagcttctaggtgccag

SEQ ID NO: 7328788 - DNA, 22 bp, Homo sapiens
gtggaggcagtgacacagtagc

SEQ ID NO: 7328789 - DNA, 17 bp, Homo sapiens
gtggaggtgctctggta

SEQ ID NO: 7328790 - DNA, 22 bp, Homo sapiens
gtggaggtcccgggcaggagca

SEQ ID NO: 7328791 - DNA, 22 bp, Homo sapiens
gtggcagaggctgtgaggatgc

SEQ ID NO: 7328792 - DNA, 22 bp, Homo sapiens
gtgaccagccagtgctgtctgt

SEQ ID NO: 7328793 - DNA, 22 bp, Homo sapiens
gtggctctaggtgagcatggag

SEQ ID NO: 7328794 - DNA, 22 bp, Homo sapiens
gtggcctggcgagctggcgcgg

SEQ ID NO: 7328795 - DNA, 22 bp, Homo sapiens
gtggctctggctttccaggcgg

SEQ ID NO: 7328796 - DNA, 22 bp, Homo sapiens
gtggctctgtaaaatgcctgca

SEQ ID NO: 7328797 - DNA, 21 bp, Homo sapiens
gtggctctgccaggactgaaa

SEQ ID NO: 7328798 - DNA, 22 bp, Homo sapiens
gtggcctgagcttcagagttgg

SEQ ID NO: 7328799 - DNA, 22 bp, Homo sapiens
gtggcctgatgccagccctgtg

SEQ ID NO: 7328800 - DNA, 22 bp, Homo sapiens
gtggcctgccagcagatggcgc

SEQ ID NO: 7328801 - DNA, 22 bp, Homo sapiens
gtggcctggaaaggctggtctg

SEQ ID NO: 7328802 - DNA, 22 bp, Homo sapiens
gtgggagaaattagctctagtt

SEQ ID NO: 7328803 - DNA, 22 bp, Homo sapiens
gtgggagaatggccttgcaaac

SEQ ID NO: 7328804 - DNA, 22 bp, Homo sapiens
gtgggagaatggccttgcaaac

SEQ ID NO: 7328805 - DNA, 22 bp, Homo sapiens
gtgggagagaccccgcttaggg

SEQ ID NO: 7328806 - DNA, 20 bp, Homo sapiens
gtggcaggcagtgaaggagc

SEQ ID NO: 7328807 - DNA, 22 bp, Homo sapiens
gttgtgaatagtgccgcaataa

SEQ ID NO: 7328808 - DNA, 22 bp, Homo sapiens
gttgtttgtaatgacaggagac

SEQ ID NO: 7328809 - DNA, 22 bp, Homo sapiens
gttgttttaaaatactccagaa

SEQ ID NO: 7328810 - DNA, 22 bp, Homo sapiens
gttctcctggctcccaccctgc

SEQ ID NO: 7328811 - DNA, 22 bp, Homo sapiens
gttctcctcttgtcccaggctg

SEQ ID NO: 7328812 - DNA, 22 bp, Homo sapiens
gttctattcattgctccacgag

SEQ ID NO: 7328813 - DNA, 21 bp, Homo sapiens
gttctattttgcaaacttctg

SEQ ID NO: 7328814 - DNA, 22 bp, Homo sapiens
gttctcctcttagctgtgccac

SEQ ID NO: 7328815 - DNA, 22 bp, Homo sapiens
gttctattactccctgcttctt

SEQ ID NO: 7328816 - DNA, 23 bp, Homo sapiens
gtgtcattactgtaattattgtg

SEQ ID NO: 7328817 - DNA, 22 bp, Homo sapiens
gtgtcattaaccaccatgcaaa

SEQ ID NO: 7328818 - DNA, 22 bp, Homo sapiens
gtgtcattactgaaagattgaa

SEQ ID NO: 7328819 - DNA, 22 bp, Homo sapiens
gtgggcagccccttcaaggcca

SEQ ID NO: 7328820 - DNA, 22 bp, Homo sapiens
gtgggcagtgtgtcagtatctt

SEQ ID NO: 7328821 - DNA, 22 bp, Homo sapiens
gtgggggatgctgagttggaaa

SEQ ID NO: 7328822 - DNA, 22 bp, Homo sapiens
gtgggggacccaggtgctgtcc

SEQ ID NO: 7328823 - DNA, 22 bp, Homo sapiens
gtgggggcaggcagtgctagga

SEQ ID NO: 7328824 - DNA, 23 bp, Homo sapiens
gtggttcttaaaggtccccagtc

SEQ ID NO: 7328825 - DNA, 22 bp, Homo sapiens
gtggtcttactggagggactct

SEQ ID NO: 7328826 - DNA, 20 bp, Homo sapiens
gtttttcttgggcgagctat

SEQ ID NO: 7328827 - DNA, 22 bp, Homo sapiens
gtttttctttgtgtgaagacaa

SEQ ID NO: 7328828 - DNA, 22 bp, Homo sapiens
gttttttcatgagtagttatct

SEQ ID NO: 7328829 - DNA, 20 bp, Homo sapiens
gtttttctctcttgccacta

SEQ ID NO: 7328830 - DNA, 22 bp, Homo sapiens
gttgtttttgttctctatagct

SEQ ID NO: 7328831 - DNA, 22 bp, Homo sapiens
gttgttttcagcagtttatgac

SEQ ID NO: 7328832 - DNA, 22 bp, Homo sapiens
gttgttttgctgtctgtcttag

SEQ ID NO: 7328833 - DNA, 22 bp, Homo sapiens
gtttaagagggtttcattccca

SEQ ID NO: 7328834 - DNA, 22 bp, Homo sapiens
ggcaggtgctaagagaggtaaa

SEQ ID NO: 7328835 - DNA, 22 bp, Homo sapiens
ggcaggctgggagtcatcagag

SEQ ID NO: 7328836 - DNA, 22 bp, Homo sapiens
ggcaggctgggtgtcatggagt

SEQ ID NO: 7328837 - DNA, 22 bp, Homo sapiens
ggcaggctgggagtcatcagag

SEQ ID NO: 7328838 - DNA, 22 bp, Homo sapiens
ggcaggctgcttgggtcatgtc

SEQ ID NO: 7328839 - DNA, 19 bp, Homo sapiens
ggcaggctggatagagagg

SEQ ID NO: 7328840 - DNA, 22 bp, Homo sapiens
ggcaggcattagagattcccag

SEQ ID NO: 7328841 - DNA, 22 bp, Homo sapiens
ggcaggctccagagccctctcc

SEQ ID NO: 7328842 - DNA, 22 bp, Homo sapiens
ggcaggctcagcagccaaggag

SEQ ID NO: 7328843 - DNA, 22 bp, Homo sapiens
ggagtggcagcgaggatcagat

SEQ ID NO: 7328844 - DNA, 22 bp, Homo sapiens
ggagtggcctctcctgtgcagg

SEQ ID NO: 7328845 - DNA, 21 bp, Homo sapiens
ggcagagaagctggaagttgg

SEQ ID NO: 7328846 - DNA, 21 bp, Homo sapiens
ggcagagaagctggaagttgg

SEQ ID NO: 7328847 - DNA, 22 bp, Homo sapiens
ggcagacctgtagacatttgcc

SEQ ID NO: 7328848 - DNA, 22 bp, Homo sapiens
ggcagacctctccagccccaca

SEQ ID NO: 7328849 - DNA, 23 bp, Homo sapiens
ggcagagagcatggctggggccc

SEQ ID NO: 7328850 - DNA, 22 bp, Homo sapiens
ggcacagagctccagccttggc

SEQ ID NO: 7328851 - DNA, 22 bp, Homo sapiens
ggaggtggtttgatttctatat

SEQ ID NO: 7328852 - DNA, 22 bp, Homo sapiens
ggaggtgggctaaggactctct

SEQ ID NO: 7328853 - DNA, 16 bp, Homo sapiens
ggaggtgggtaaggtg

SEQ ID NO: 7328854 - DNA, 22 bp, Homo sapiens
ggaggtggtggcagtgacaatt

SEQ ID NO: 7328855 - DNA, 22 bp, Homo sapiens
ggaggtgggagtttagttcttg

SEQ ID NO: 7328856 - DNA, 22 bp, Homo sapiens
ggaggtgggattaggacctaaa

SEQ ID NO: 7328857 - DNA, 22 bp, Homo sapiens
ggaggtggcagggaacataatt

SEQ ID NO: 7328858 - DNA, 22 bp, Homo sapiens
ggaggtggcctgaaaatgtggc

SEQ ID NO: 7328859 - DNA, 22 bp, Homo sapiens
ggaggtgggagcctccagtggt

SEQ ID NO: 7328860 - DNA, 22 bp, Homo sapiens
ggaggtgggagacataggcggc

SEQ ID NO: 7328861 - DNA, 22 bp, Homo sapiens
ggaggtggcagagggacattct

SEQ ID NO: 7328862 - DNA, 22 bp, Homo sapiens
ggaggtcatagctgtgcaggta

SEQ ID NO: 7328863 - DNA, 22 bp, Homo sapiens
ggaggtcaaatggagggctggg

SEQ ID NO: 7328864 - DNA, 22 bp, Homo sapiens
ggagggtggcagcgtcctgggc

SEQ ID NO: 7328865 - DNA, 22 bp, Homo sapiens
ggaggggagatgtttgggctca

SEQ ID NO: 7328866 - DNA, 20 bp, Homo sapiens
ggagggcagctgagagttgg

SEQ ID NO: 7328867 - DNA, 21 bp, Homo sapiens
ggagggcagcccagactggct

SEQ ID NO: 7328868 - DNA, 22 bp, Homo sapiens
ggagggcatcaatcaggcctgg

SEQ ID NO: 7328869 - DNA, 22 bp, Homo sapiens
ggagggagagtgaccctaccaa

SEQ ID NO: 7328870 - DNA, 22 bp, Homo sapiens
ggagggaaccttggctggattg

SEQ ID NO: 7328871 - DNA, 22 bp, Homo sapiens
ggaggcggaggttgcagtgagc

SEQ ID NO: 7328872 - DNA, 22 bp, Homo sapiens
ggaggcctcctgggggaggttc

SEQ ID NO: 7328873 - DNA, 22 bp, Homo sapiens
ggaggcctaaggtacagtttgc

SEQ ID NO: 7328874 - DNA, 22 bp, Homo sapiens
ggaggcggaggttgcagtgagt

SEQ ID NO: 7328875 - DNA, 22 bp, Homo sapiens
ggaggctgaggcaggcggatca

SEQ ID NO: 7328876 - DNA, 22 bp, Homo sapiens
ggaggaaatccttagtaaggca

SEQ ID NO: 7328877 - DNA, 22 bp, Homo sapiens
ggaggaagaggttgttctctca

SEQ ID NO: 7328878 - DNA, 22 bp, Homo sapiens
ggaggaagcacacggcttgtat

SEQ ID NO: 7328879 - DNA, 22 bp, Homo sapiens
ggaggaagggcccaggctttat

SEQ ID NO: 7328880 - DNA, 16 bp, Homo sapiens
ggaggaaggcatagtg

SEQ ID NO: 7328881 - DNA, 22 bp, Homo sapiens
ggaggaagccctcggtgcccca

SEQ ID NO: 7328882 - DNA, 22 bp, Homo sapiens
ggaggagctgctgtgggggccc

SEQ ID NO: 7328883 - DNA, 22 bp, Homo sapiens
ggaggaagtgcagttctactac

SEQ ID NO: 7328884 - DNA, 22 bp, Homo sapiens
ggagctgatgacgtcaccatgg

SEQ ID NO: 7328885 - DNA, 22 bp, Homo sapiens
ggagctgagcagcgatggcgga

SEQ ID NO: 7328886 - DNA, 22 bp, Homo sapiens
ggagctcagtggggggactgtg

SEQ ID NO: 7328887 - DNA, 22 bp, Homo sapiens
ggagctgaaccccatcgtgctg

SEQ ID NO: 7328888 - DNA, 22 bp, Homo sapiens
ggagctgaaggggtgggctcag

SEQ ID NO: 7328889 - DNA, 22 bp, Homo sapiens
ggaggcagaatagagtgtgggt

SEQ ID NO: 7328890 - DNA, 22 bp, Homo sapiens
ggaggaggcaagtaccagatgc

SEQ ID NO: 7328891 - DNA, 18 bp, Homo sapiens
ggaaggtgctggagtgca

SEQ ID NO: 7328892 - DNA, 22 bp, Homo sapiens
ggaagtggtagagccatgagtg

SEQ ID NO: 7328893 - DNA, 22 bp, Homo sapiens
ggagaaggaagaaagctactat

SEQ ID NO: 7328894 - DNA, 22 bp, Homo sapiens
ggagacaacaatcatgtgtgaa

SEQ ID NO: 7328895 - DNA, 22 bp, Homo sapiens
ggagaatgatatatagctcagt

SEQ ID NO: 7328896 - DNA, 22 bp, Homo sapiens
ggagacagggttgaaccacgca

SEQ ID NO: 7328897 - DNA, 22 bp, Homo sapiens
ggagcctgtgggatgagatgtg

SEQ ID NO: 7328898 - DNA, 22 bp, Homo sapiens
ggagcctgtggctgcttgaagc

SEQ ID NO: 7328899 - DNA, 22 bp, Homo sapiens
ggagcctgtggccgtcacgact

SEQ ID NO: 7328900 - DNA, 22 bp, Homo sapiens
ggagcgagcccgatagcgctgg

SEQ ID NO: 7328901 - DNA, 22 bp, Homo sapiens
ggagcctgttagttgagtgctc

SEQ ID NO: 7328902 - DNA, 22 bp, Homo sapiens
ggagcctgtgcccaagcccaga

SEQ ID NO: 7328903 - DNA, 22 bp, Homo sapiens
ggagcctggttactagagcctg

SEQ ID NO: 7328904 - DNA, 20 bp, Homo sapiens
ggaaacatttttatttccat

SEQ ID NO: 7328905 - DNA, 22 bp, Homo sapiens
ggaaagatgtaatattatctaa

SEQ ID NO: 7328906 - DNA, 19 bp, Homo sapiens
ggaaggtgacagtggtgaa

SEQ ID NO: 7328907 - DNA, 22 bp, Homo sapiens
gcttcatgcttgctccaaagct

SEQ ID NO: 7328908 - DNA, 22 bp, Homo sapiens
gcttagagcagctcacaacatg

SEQ ID NO: 7328909 - DNA, 22 bp, Homo sapiens
gcttacagataatgaggagact

SEQ ID NO: 7328910 - DNA, 21 bp, Homo sapiens
gcttatagaaacatcaccaga

SEQ ID NO: 7328911 - DNA, 22 bp, Homo sapiens
gcttaatgagcagagaatctac

SEQ ID NO: 7328912 - DNA, 19 bp, Homo sapiens
ggctcagtcaactgactgt

SEQ ID NO: 7328913 - DNA, 22 bp, Homo sapiens
ggccccagattctgggctgggt

SEQ ID NO: 7328914 - DNA, 22 bp, Homo sapiens
ggccccaggtctgaacacgctg

SEQ ID NO: 7328915 - DNA, 22 bp, Homo sapiens
ggccccagcagaccctcctctg

SEQ ID NO: 7328916 - DNA, 22 bp, Homo sapiens
ggccccagttcactcctggccg

SEQ ID NO: 7328917 - DNA, 22 bp, Homo sapiens
ggccagactgagtgaggtcaag

SEQ ID NO: 7328918 - DNA, 22 bp, Homo sapiens
ggccagacatatcgctcccaaa

SEQ ID NO: 7328919 - DNA, 22 bp, Homo sapiens
ggccagaagttggaaaagagcc

SEQ ID NO: 7328920 - DNA, 20 bp, Homo sapiens
gggagaagggctgatgagag

SEQ ID NO: 7328921 - DNA, 22 bp, Homo sapiens
gggaggagggtgctggctaaac

SEQ ID NO: 7328922 - DNA, 20 bp, Homo sapiens
gggaggcgagggctgagcag

SEQ ID NO: 7328923 - DNA, 22 bp, Homo sapiens
gggatggggagctggaaagggg

SEQ ID NO: 7328924 - DNA, 22 bp, Homo sapiens
gggcagaggggcgcttccctct

SEQ ID NO: 7328925 - DNA, 22 bp, Homo sapiens
gggatggctcaaaggagtcagg

SEQ ID NO: 7328926 - DNA, 22 bp, Homo sapiens
gggatggctttgtggctgactc

SEQ ID NO: 7328927 - DNA, 22 bp, Homo sapiens
gggatggatcttggctgaggct

SEQ ID NO: 7328928 - DNA, 22 bp, Homo sapiens
gggagggaaggtacctgtgtga

SEQ ID NO: 7328929 - DNA, 22 bp, Homo sapiens
gggagggaaggaccttatgaat

SEQ ID NO: 7328930 - DNA, 22 bp, Homo sapiens
gggagggaaggaggcgccgtgt

SEQ ID NO: 7328931 - DNA, 22 bp, Homo sapiens
gggcagcccagaactgctgcag

SEQ ID NO: 7328932 - DNA, 22 bp, Homo sapiens
gggcagaggttcaacttcaaca

SEQ ID NO: 7328933 - DNA, 23 bp, Homo sapiens
gggtgggccaaattaggtagcct

SEQ ID NO: 7328934 - DNA, 22 bp, Homo sapiens
gggtgggcccagcccagagaag

SEQ ID NO: 7328935 - DNA, 22 bp, Homo sapiens
gggtgggccactgagcagcgtg

SEQ ID NO: 7328936 - DNA, 22 bp, Homo sapiens
gggggtaggcagacaaggacat

SEQ ID NO: 7328937 - DNA, 22 bp, Homo sapiens
ggggaccctcaggactgcgtct

SEQ ID NO: 7328938 - DNA, 22 bp, Homo sapiens
gggctctggtacttcctggctc

SEQ ID NO: 7328939 - DNA, 22 bp, Homo sapiens
gggctagggcctgctatggttt

SEQ ID NO: 7328940 - DNA, 22 bp, Homo sapiens
gggctaggaaatgtagttttaa

SEQ ID NO: 7328941 - DNA, 22 bp, Homo sapiens
gggctgagaagttgatcccaag

SEQ ID NO: 7328942 - DNA, 20 bp, Homo sapiens
gccctctgcctccctcagcg

SEQ ID NO: 7328943 - DNA, 22 bp, Homo sapiens
gccctctgcacagctctgagca

SEQ ID NO: 7328944 - DNA, 22 bp, Homo sapiens
gcctctgcatcatcactccagc

SEQ ID NO: 7328945 - DNA, 22 bp, Homo sapiens
gcccaggattctttcttcctta

SEQ ID NO: 7328946 - DNA, 22 bp, Homo sapiens
gcccaggataatgctgtccctg

SEQ ID NO: 7328947 - DNA, 22 bp, Homo sapiens
gcctgctcccagttggcgcctc

SEQ ID NO: 7328948 - DNA, 22 bp, Homo sapiens
gcctgtggcccaactgtctgtc

SEQ ID NO: 7328949 - DNA, 22 bp, Homo sapiens
gcctgtggccactgcgtctgca

SEQ ID NO: 7328950 - DNA, 22 bp, Homo sapiens
gcctgtggccgactgagagcct

SEQ ID NO: 7328951 - DNA, 22 bp, Homo sapiens
gcctgtggggctgaggctgcct

SEQ ID NO: 7328952 - DNA, 19 bp, Homo sapiens
gcctgtggcttgatgttgg

SEQ ID NO: 7328953 - DNA, 22 bp, Homo sapiens
gcctgtggtttgattaagcatt

SEQ ID NO: 7328954 - DNA, 22 bp, Homo sapiens
gcctgtggttgctttgggatcc

SEQ ID NO: 7328955 - DNA, 22 bp, Homo sapiens
gcctgtgggttggagcttggcc

SEQ ID NO: 7328956 - DNA, 22 bp, Homo sapiens
gctccaggagagggaagcagat

SEQ ID NO: 7328957 - DNA, 22 bp, Homo sapiens
gctccactgtcccatgggactt

SEQ ID NO: 7328958 - DNA, 22 bp, Homo sapiens
gctccacttgattgttacagca

SEQ ID NO: 7328959 - DNA, 22 bp, Homo sapiens
gctccactgcccctgggcaccg

SEQ ID NO: 7328960 - DNA, 22 bp, Homo sapiens
gctcctggctccaggcagccaa

SEQ ID NO: 7328961 - DNA, 22 bp, Homo sapiens
gctcatctggggctttcagctt

SEQ ID NO: 7328962 - DNA, 22 bp, Homo sapiens
gctcatctgtaaaacaggatta

SEQ ID NO: 7328963 - DNA, 22 bp, Homo sapiens
gctcatctgttttaactgtatt

SEQ ID NO: 7328964 - DNA, 22 bp, Homo sapiens
gctcatctcccttttgaagctg

SEQ ID NO: 7328965 - DNA, 22 bp, Homo sapiens
gctcatctgccatgatgagttt

SEQ ID NO: 7328966 - DNA, 22 bp, Homo sapiens
gctcatctgccccaggagatcc

SEQ ID NO: 7328967 - DNA, 22 bp, Homo sapiens
gcctgtttgttatgtcatggta

SEQ ID NO: 7328968 - DNA, 22 bp, Homo sapiens
gcctgtttggcatcattggttg

SEQ ID NO: 7328969 - DNA, 22 bp, Homo sapiens
gcctgtttgactggtctctgct

SEQ ID NO: 7328970 - DNA, 22 bp, Homo sapiens
gcctgtttgagaatagtcaggg

SEQ ID NO: 7328971 - DNA, 22 bp, Homo sapiens
gcctgtttctcctccttggccc

SEQ ID NO: 7328972 - DNA, 22 bp, Homo sapiens
gcctgtttactttgccgcagga

SEQ ID NO: 7328973 - DNA, 22 bp, Homo sapiens
gcctgtttatctatcatgaact

SEQ ID NO: 7328974 - DNA, 19 bp, Homo sapiens
gctcctgggcctcactcat

SEQ ID NO: 7328975 - DNA, 22 bp, Homo sapiens
gctcctgggctctaccttgcta

SEQ ID NO: 7328976 - DNA, 22 bp, Homo sapiens
gctcctgggtgtggctgcccct

SEQ ID NO: 7328977 - DNA, 19 bp, Homo sapiens
gctggcccctgggatccag

SEQ ID NO: 7328978 - DNA, 22 bp, Homo sapiens
gctggagccattggcttggcct

SEQ ID NO: 7328979 - DNA, 22 bp, Homo sapiens
gctgggagtgggcaagatgaga

SEQ ID NO: 7328980 - DNA, 22 bp, Homo sapiens
gctgggcagcccctacagagag

SEQ ID NO: 7328981 - DNA, 22 bp, Homo sapiens
gctgctctgggtctgcccagct

SEQ ID NO: 7328982 - DNA, 22 bp, Homo sapiens
gctgctctccaagcctccttga

SEQ ID NO: 7328983 - DNA, 22 bp, Homo sapiens
gctgctctcatagatggcttca

SEQ ID NO: 7328984 - DNA, 22 bp, Homo sapiens
gctgctctcagagctcatgctg

SEQ ID NO: 7328985 - DNA, 19 bp, Homo sapiens
gctgctctgggtctcatct

SEQ ID NO: 7328986 - DNA, 22 bp, Homo sapiens
gctgctctggctctgcagtgtc

SEQ ID NO: 7328987 - DNA, 22 bp, Homo sapiens
gcatggttagacatcaatgtga

SEQ ID NO: 7328988 - DNA, 22 bp, Homo sapiens
gccacacttattctcatgcaca

SEQ ID NO: 7328989 - DNA, 22 bp, Homo sapiens
gcagtaagttaatagtgctggt

SEQ ID NO: 7328990 - DNA, 22 bp, Homo sapiens
gcagtacacacatatgtattcg

SEQ ID NO: 7328991 - DNA, 22 bp, Homo sapiens
gcagtatacactgatacatgag

SEQ ID NO: 7328992 - DNA, 22 bp, Homo sapiens
gcagtgttatgttttctataat

SEQ ID NO: 7328993 - DNA, 22 bp, Homo sapiens
gcaggtggaagcagcagactca

SEQ ID NO: 7328994 - DNA, 22 bp, Homo sapiens
gcaggtgggggtcggtgcatct

SEQ ID NO: 7328995 - DNA, 22 bp, Homo sapiens
gcaggtggtccccgtggagtgg

SEQ ID NO: 7328996 - DNA, 22 bp, Homo sapiens
gcaggtggtgggggagccgttc

SEQ ID NO: 7328997 - DNA, 22 bp, Homo sapiens
gcagggcagaaggtgctgagga

SEQ ID NO: 7328998 - DNA, 22 bp, Homo sapiens
gcagggcacaaggacgcacagg

SEQ ID NO: 7328999 - DNA, 22 bp, Homo sapiens
gcagggcacacaagaatgataa

SEQ ID NO: 7329000 - DNA, 20 bp, Homo sapiens
gcagggcaagggatatgaaa

SEQ ID NO: 7329001 - DNA, 22 bp, Homo sapiens
gcagggcaaatgtggaaaggag

SEQ ID NO: 7329002 - DNA, 22 bp, Homo sapiens
gcagggcaaatgtggaaaggag

SEQ ID NO: 7329003 - DNA, 22 bp, Homo sapiens
gcagggcaaacccaggtgttca

SEQ ID NO: 7329004 - DNA, 22 bp, Homo sapiens
gcaggcttgcccggcctccttc

SEQ ID NO: 7329005 - DNA, 22 bp, Homo sapiens
gcaggcttgagagatcagatgg

SEQ ID NO: 7329006 - DNA, 22 bp, Homo sapiens
gcaggcttatggggagacagag

SEQ ID NO: 7329007 - DNA, 22 bp, Homo sapiens
gcaggcagaggtggaggagaca

SEQ ID NO: 7329008 - DNA, 22 bp, Homo sapiens
gcaggcactcctaggaccatca

SEQ ID NO: 7329009 - DNA, 22 bp, Homo sapiens
gcagctattgtctcctgggccc

SEQ ID NO: 7329010 - DNA, 22 bp, Homo sapiens
gcagctctgtctttcttaaagt

SEQ ID NO: 7329011 - DNA, 22 bp, Homo sapiens
gcaggagacaactgtaaggaga

SEQ ID NO: 7329012 - DNA, 22 bp, Homo sapiens
gcaggacctggcagatggggca

SEQ ID NO: 7329013 - DNA, 22 bp, Homo sapiens
gcaggacattcagtgaatgggc

SEQ ID NO: 7329014 - DNA, 22 bp, Homo sapiens
gcaggacagcaggatgcttaga

SEQ ID NO: 7329015 - DNA, 22 bp, Homo sapiens
gcaggcaccgggttgctcccct

SEQ ID NO: 7329016 - DNA, 22 bp, Homo sapiens
gatttacagctatacccaatgg

SEQ ID NO: 7329017 - DNA, 22 bp, Homo sapiens
gatttacaggttaggtcctgta

SEQ ID NO: 7329018 - DNA, 22 bp, Homo sapiens
gatttatttttaatcagcaggg

SEQ ID NO: 7329019 - DNA, 22 bp, Homo sapiens
gatttattggtctttcattggt

SEQ ID NO: 7329020 - DNA, 22 bp, Homo sapiens
gatttacaaagctctctagtgt

SEQ ID NO: 7329021 - DNA, 22 bp, Homo sapiens
gatttacagatctaagggtcac

SEQ ID NO: 7329022 - DNA, 22 bp, Homo sapiens
gattgcattgatttgctccaag

SEQ ID NO: 7329023 - DNA, 22 bp, Homo sapiens
gatgttttttaggatctcagca

SEQ ID NO: 7329024 - DNA, 22 bp, Homo sapiens
gatgctcatctgtcctttgatg

SEQ ID NO: 7329025 - DNA, 22 bp, Homo sapiens
gatgggaggaacctgggtccct

SEQ ID NO: 7329026 - DNA, 22 bp, Homo sapiens
gatggctcaagagcttttgaga

SEQ ID NO: 7329027 - DNA, 22 bp, Homo sapiens
gatggaagaaaaatgcatgtct

SEQ ID NO: 7329028 - DNA, 22 bp, Homo sapiens
gatggaggagatggcagggtgc

SEQ ID NO: 7329029 - DNA, 22 bp, Homo sapiens
gatttctgttgagaaacatggg

SEQ ID NO: 7329030 - DNA, 22 bp, Homo sapiens
gatttctgtggcttgtacatat

SEQ ID NO: 7329031 - DNA, 22 bp, Homo sapiens
gcaatgcaatcagatgattatt

SEQ ID NO: 7329032 - DNA, 22 bp, Homo sapiens
gcaattcaatggttgctgagac

SEQ ID NO: 7329033 - DNA, 22 bp, Homo sapiens
gcaaacattcaggagtacagga

SEQ ID NO: 7329034 - DNA, 22 bp, Homo sapiens
gcacaattccatgggacagccc

SEQ ID NO: 7329035 - DNA, 22 bp, Homo sapiens
gcacacacatgtgagtacatgc

SEQ ID NO: 7329036 - DNA, 22 bp, Homo sapiens
gcacccctgcgtgccttccctt

SEQ ID NO: 7329037 - DNA, 22 bp, Homo sapiens
gcagagcagtgcttgcccagcg

SEQ ID NO: 7329038 - DNA, 22 bp, Homo sapiens
gagtggagcaaaagaggtagat

SEQ ID NO: 7329039 - DNA, 21 bp, Homo sapiens
gagtgggacatgggagtggtt

SEQ ID NO: 7329040 - DNA, 22 bp, Homo sapiens
gagtgcagttggggtgagggga

SEQ ID NO: 7329041 - DNA, 23 bp, Homo sapiens
gagtgcagaatagacatgcagtg

SEQ ID NO: 7329042 - DNA, 22 bp, Homo sapiens
gagtgcagtatgagaggctgct

SEQ ID NO: 7329043 - DNA, 22 bp, Homo sapiens
gagtgcagtatgagaggctgct

SEQ ID NO: 7329044 - DNA, 22 bp, Homo sapiens
gagtgcagtatgagaggctgct

SEQ ID NO: 7329045 - DNA, 22 bp, Homo sapiens
gagtgcagtggcgtgatctctg

SEQ ID NO: 7329046 - DNA, 22 bp, Homo sapiens
gagtgcagttggggtgagggga

SEQ ID NO: 7329047 - DNA, 22 bp, Homo sapiens
gagtgctggaggtgtgagtggg

SEQ ID NO: 7329048 - DNA, 22 bp, Homo sapiens
gagtgatgtctgtagtgaagaa

SEQ ID NO: 7329049 - DNA, 22 bp, Homo sapiens
gagtgatgcttctatggaacca

SEQ ID NO: 7329050 - DNA, 22 bp, Homo sapiens
gagtgcaataaactgttttcta

SEQ ID NO: 7329051 - DNA, 22 bp, Homo sapiens
gagtgcaatgtagacatcaggg

SEQ ID NO: 7329052 - DNA, 22 bp, Homo sapiens
gagttaaaagccctctcagcag

SEQ ID NO: 7329053 - DNA, 22 bp, Homo sapiens
gagttaaagtacctttgtatgt

SEQ ID NO: 7329054 - DNA, 22 bp, Homo sapiens
gataaagggggaccaaatgact

SEQ ID NO: 7329055 - DNA, 22 bp, Homo sapiens
gatgaattctggcttggacaga

SEQ ID NO: 7329056 - DNA, 22 bp, Homo sapiens
gatgaaaaattgctgtgtcata

SEQ ID NO: 7329057 - DNA, 22 bp, Homo sapiens
gatctttgcaaactttgtcact

SEQ ID NO: 7329058 - DNA, 22 bp, Homo sapiens
gatccacagggccctggcccag

SEQ ID NO: 7329059 - DNA, 22 bp, Homo sapiens
gatccacagctgcggtaggaga

SEQ ID NO: 7329060 - DNA, 22 bp, Homo sapiens
gatccacaggaaccaaaacgca

SEQ ID NO: 7329061 - DNA, 22 bp, Homo sapiens
gatccacagcccgcttgggccc

SEQ ID NO: 7329062 - DNA, 22 bp, Homo sapiens
gatccacagtttgatgatcata

SEQ ID NO: 7329063 - DNA, 21 bp, Homo sapiens
gatccactgacctggggatcc

SEQ ID NO: 7329064 - DNA, 19 bp, Homo sapiens
gatataaagagatggtgaa

SEQ ID NO: 7329065 - DNA, 22 bp, Homo sapiens
gatataaattaatcaagtgcaa

SEQ ID NO: 7329066 - DNA, 22 bp, Homo sapiens
gatataaattaatcaagtgcaa

SEQ ID NO: 7329067 - DNA, 20 bp, Homo sapiens
gatcaggaagcggcttggga

SEQ ID NO: 7329068 - DNA, 19 bp, Homo sapiens
gatcaggagccgacaactg

SEQ ID NO: 7329069 - DNA, 18 bp, Homo sapiens
gatcaggatcaatcaccc

SEQ ID NO: 7329070 - DNA, 22 bp, Homo sapiens
gatcaggagatggcctcagacc

SEQ ID NO: 7329071 - DNA, 22 bp, Homo sapiens
gatcaggacatagctataggct

SEQ ID NO: 7329072 - DNA, 22 bp, Homo sapiens
gatcaggaatattggaaagtac

SEQ ID NO: 7329073 - DNA, 22 bp, Homo sapiens
gatcaaagccagtgaggagtga

SEQ ID NO: 7329074 - DNA, 18 bp, Homo sapiens
gatatataggaggaaagt

SEQ ID NO: 7329075 - DNA, 22 bp, Homo sapiens
gagagtggatggagctgcgaag

SEQ ID NO: 7329076 - DNA, 22 bp, Homo sapiens
gagatatttattcatactgtca

SEQ ID NO: 7329077 - DNA, 22 bp, Homo sapiens
gagatcatggcttctgctgata

SEQ ID NO: 7329078 - DNA, 22 bp, Homo sapiens
gagatccacttaatttttttgc

SEQ ID NO: 7329079 - DNA, 19 bp, Homo sapiens
gagatactgaagtgaggaa

SEQ ID NO: 7329080 - DNA, 22 bp, Homo sapiens
gagagttagttgagcagtctga

SEQ ID NO: 7329081 - DNA, 22 bp, Homo sapiens
gagctgggacttggaatccaca

SEQ ID NO: 7329082 - DNA, 22 bp, Homo sapiens
gagctgggagttatagcatgtt

SEQ ID NO: 7329083 - DNA, 18 bp, Homo sapiens
gagctgggagaaggaagg

SEQ ID NO: 7329084 - DNA, 22 bp, Homo sapiens
gaggaagaattggttattggag

SEQ ID NO: 7329085 - DNA, 22 bp, Homo sapiens
gaggaagagagctctgccttgt

SEQ ID NO: 7329086 - DNA, 22 bp, Homo sapiens
gaggaagatggttgagtggtcc

SEQ ID NO: 7329087 - DNA, 22 bp, Homo sapiens
gaggaagagcatggccagtttc

SEQ ID NO: 7329088 - DNA, 22 bp, Homo sapiens
gaggaagggctgcctgccgggc

SEQ ID NO: 7329089 - DNA, 22 bp, Homo sapiens
gaggaagttaggatacattggt

SEQ ID NO: 7329090 - DNA, 22 bp, Homo sapiens
gaggacaaagcccaggtgctgg

SEQ ID NO: 7329091 - DNA, 22 bp, Homo sapiens
gaggaggctgaacaatgccctg

SEQ ID NO: 7329092 - DNA, 22 bp, Homo sapiens
gaggaggctggcgccgcctgcc

SEQ ID NO: 7329093 - DNA, 19 bp, Homo sapiens
gaggaggcttcagctttct

SEQ ID NO: 7329094 - DNA, 22 bp, Homo sapiens
gaggaggcttccgggaggcacg

SEQ ID NO: 7329095 - DNA, 22 bp, Homo sapiens
gaggagggagaattaggcttaa

SEQ ID NO: 7329096 - DNA, 22 bp, Homo sapiens
gaggaggtcccccgacatgcct

SEQ ID NO: 7329097 - DNA, 22 bp, Homo sapiens
gaggaggtggagtcatgcagag

SEQ ID NO: 7329098 - DNA, 22 bp, Homo sapiens
gaggaggtggaattccaggaat

SEQ ID NO: 7329099 - DNA, 22 bp, Homo sapiens
gaggcagaggttgttgcagtga

SEQ ID NO: 7329100 - DNA, 22 bp, Homo sapiens
gaggcagagtcacaaagagtct

SEQ ID NO: 7329101 - DNA, 20 bp, Homo sapiens
gaggcctcagcctcagctcc

SEQ ID NO: 7329102 - DNA, 22 bp, Homo sapiens
gaggcagctgggatacaaggga

SEQ ID NO: 7329103 - DNA, 22 bp, Homo sapiens
gaggtcaggcttgcagcagggt

SEQ ID NO: 7329104 - DNA, 22 bp, Homo sapiens
gaggtgggatgtgtgtgctact

SEQ ID NO: 7329105 - DNA, 22 bp, Homo sapiens
gaggtgggcggatcacaaggtc

SEQ ID NO: 7329106 - DNA, 22 bp, Homo sapiens
gaggtaggtgtaggaggcctgc

SEQ ID NO: 7329107 - DNA, 22 bp, Homo sapiens
gaggtgggtgtatcacaggtca

SEQ ID NO: 7329108 - DNA, 22 bp, Homo sapiens
gaggctggagatattccaatct

SEQ ID NO: 7329109 - DNA, 22 bp, Homo sapiens
gaggctggagatattccaatct

SEQ ID NO: 7329110 - DNA, 22 bp, Homo sapiens
gaggctggaggtcaaagatgaa

SEQ ID NO: 7329111 - DNA, 22 bp, Homo sapiens
gaggggcacagtaaagggtccc

SEQ ID NO: 7329112 - DNA, 22 bp, Homo sapiens
ctttagtttaagaacatgatga

SEQ ID NO: 7329113 - DNA, 20 bp, Homo sapiens
ctttagttattaacagcact

SEQ ID NO: 7329114 - DNA, 22 bp, Homo sapiens
ctttatctagggtaagaaaacc

SEQ ID NO: 7329115 - DNA, 22 bp, Homo sapiens
ctttatgaaggaacaatgctcc

SEQ ID NO: 7329116 - DNA, 22 bp, Homo sapiens
cttctttcaagaatggattagg

SEQ ID NO: 7329117 - DNA, 22 bp, Homo sapiens
cttctttccttcctccagtggc

SEQ ID NO: 7329118 - DNA, 22 bp, Homo sapiens
cttctttcccaggcatgtttta

SEQ ID NO: 7329119 - DNA, 22 bp, Homo sapiens
cttctttcttttgatcacaggt

SEQ ID NO: 7329120 - DNA, 22 bp, Homo sapiens
gaaatttacaactttctcatgg

SEQ ID NO: 7329121 - DNA, 22 bp, Homo sapiens
gaactcattagcctgctttcag

SEQ ID NO: 7329122 - DNA, 22 bp, Homo sapiens
gaactcattagcctgctttcag

SEQ ID NO: 7329123 - DNA, 22 bp, Homo sapiens
gaacctgtttatgttacctgcg

SEQ ID NO: 7329124 - DNA, 22 bp, Homo sapiens
gaacctgtaagtatagatgtgg

SEQ ID NO: 7329125 - DNA, 22 bp, Homo sapiens
gaacactgaggacactgagaat

SEQ ID NO: 7329126 - DNA, 22 bp, Homo sapiens
gaacactggggtatcattgagc

SEQ ID NO: 7329127 - DNA, 22 bp, Homo sapiens
gaaaagagtcctgtgtgaggag

SEQ ID NO: 7329128 - DNA, 22 bp, Homo sapiens
gaaaaggaaatttatagagatc

SEQ ID NO: 7329129 - DNA, 22 bp, Homo sapiens
gaaaaggattggtaaaatatct

SEQ ID NO: 7329130 - DNA, 22 bp, Homo sapiens
ctttgttactgatttcagtggg

SEQ ID NO: 7329131 - DNA, 22 bp, Homo sapiens
ctttgttaggggctcagggtgg

SEQ ID NO: 7329132 - DNA, 22 bp, Homo sapiens
gaaagttcgtcctgtggcttct

SEQ ID NO: 7329133 - DNA, 22 bp, Homo sapiens
gaaagttctgctctgattggct

SEQ ID NO: 7329134 - DNA, 22 bp, Homo sapiens
gaaagttcaaattatagaaggt

SEQ ID NO: 7329135 - DNA, 22 bp, Homo sapiens
gaaggcttgattgaggaatgcc

SEQ ID NO: 7329136 - DNA, 21 bp, Homo sapiens
gaaggcttctgcctggaggag

SEQ ID NO: 7329137 - DNA, 22 bp, Homo sapiens
gaaggcttctccagggcttact

SEQ ID NO: 7329138 - DNA, 22 bp, Homo sapiens
gaaggcttcctggaggaggtgg

SEQ ID NO: 7329139 - DNA, 22 bp, Homo sapiens
gaaggcttcctgatgccaacca

SEQ ID NO: 7329140 - DNA, 22 bp, Homo sapiens
gaaggcttcccacctgatattt

SEQ ID NO: 7329141 - DNA, 22 bp, Homo sapiens
gaaggcttcaaaaggtgtaatt

SEQ ID NO: 7329142 - DNA, 22 bp, Homo sapiens
gaaggcttattttctttgtaaa

SEQ ID NO: 7329143 - DNA, 22 bp, Homo sapiens
gaaggcttttctaccagatctt

SEQ ID NO: 7329144 - DNA, 22 bp, Homo sapiens
gaaggctttagagagatataaa

SEQ ID NO: 7329145 - DNA, 22 bp, Homo sapiens
gaaggcttggttttttcaacac

SEQ ID NO: 7329146 - DNA, 19 bp, Homo sapiens
gaaggcttttggtatgttt

SEQ ID NO: 7329147 - DNA, 22 bp, Homo sapiens
gaaggctttttgggtaattgta

SEQ ID NO: 7329148 - DNA, 22 bp, Homo sapiens
gaaggcttgcagctctgtggca

SEQ ID NO: 7329149 - DNA, 22 bp, Homo sapiens
gaaggcttgcaagtggttcata

SEQ ID NO: 7329150 - DNA, 22 bp, Homo sapiens
gaaggcttgccgggaagcggca

SEQ ID NO: 7329151 - DNA, 20 bp, Homo sapiens
gaaggcttggacagtgacag

SEQ ID NO: 7329152 - DNA, 22 bp, Homo sapiens
gaagtgtagtcttgagccccca

SEQ ID NO: 7329153 - DNA, 22 bp, Homo sapiens
gaaggcctcactctgcagcata

SEQ ID NO: 7329154 - DNA, 22 bp, Homo sapiens
gaaggagaggattgtgaggctg

SEQ ID NO: 7329155 - DNA, 22 bp, Homo sapiens
gaaggagagagacatcgtccct

SEQ ID NO: 7329156 - DNA, 22 bp, Homo sapiens
gaaggagagaaaggcaattctg

SEQ ID NO: 7329157 - DNA, 22 bp, Homo sapiens
gaaggaagggctggctgtcttg

SEQ ID NO: 7329158 - DNA, 22 bp, Homo sapiens
gaaggaagtcattagtgcagac

SEQ ID NO: 7329159 - DNA, 22 bp, Homo sapiens
gaaggaagtgctcatactagtt

SEQ ID NO: 7329160 - DNA, 22 bp, Homo sapiens
gaatttaagaggatgaatctgt

SEQ ID NO: 7329161 - DNA, 22 bp, Homo sapiens
gaagttcaaaagacagatttga

SEQ ID NO: 7329162 - DNA, 21 bp, Homo sapiens
gaagttcatgatctttctgct

SEQ ID NO: 7329163 - DNA, 22 bp, Homo sapiens
gaagttcaactgccatgcttgg

SEQ ID NO: 7329164 - DNA, 22 bp, Homo sapiens
gaagttcactggctacattcca

SEQ ID NO: 7329165 - DNA, 22 bp, Homo sapiens
gaagttcaatgtcagcatctat

SEQ ID NO: 7329166 - DNA, 19 bp, Homo sapiens
gacaggaaggctaccagta

SEQ ID NO: 7329167 - DNA, 22 bp, Homo sapiens
gacaggaagtctgaaggaggga

SEQ ID NO: 7329168 - DNA, 20 bp, Homo sapiens
gacaggagagttaggtaggt

SEQ ID NO: 7329169 - DNA, 22 bp, Homo sapiens
gacagctgtgcaggagaagggg

SEQ ID NO: 7329170 - DNA, 18 bp, Homo sapiens
gactttaaaacactgctc

SEQ ID NO: 7329171 - DNA, 19 bp, Homo sapiens
gacttctgatgtccagatg

SEQ ID NO: 7329172 - DNA, 22 bp, Homo sapiens
gacccagggtatccagagctgc

SEQ ID NO: 7329173 - DNA, 22 bp, Homo sapiens
gacccaggcctggggcttaagg

SEQ ID NO: 7329174 - DNA, 22 bp, Homo sapiens
gacccaggagtgcagagagtgg

SEQ ID NO: 7329175 - DNA, 22 bp, Homo sapiens
gaccatttgttgaaaagattat

SEQ ID NO: 7329176 - DNA, 22 bp, Homo sapiens
gaccatgcttctccctggtgtg

SEQ ID NO: 7329177 - DNA, 22 bp, Homo sapiens
gagagtctaggaacctcatata

SEQ ID NO: 7329178 - DNA, 22 bp, Homo sapiens
gagacacaggcacagaagaggc

SEQ ID NO: 7329179 - DNA, 22 bp, Homo sapiens
gagacacacattctggagagaa

SEQ ID NO: 7329180 - DNA, 22 bp, Homo sapiens
gagacacacccaaggttatgag

SEQ ID NO: 7329181 - DNA, 22 bp, Homo sapiens
gagaaacaacacttgatgcctt

SEQ ID NO: 7329182 - DNA, 22 bp, Homo sapiens
cctgggcatctcatgcacctgc

SEQ ID NO: 7329183 - DNA, 20 bp, Homo sapiens
cctgggctcaaagcatcctc

SEQ ID NO: 7329184 - DNA, 22 bp, Homo sapiens
tgtgtgtataataatgtctgca

SEQ ID NO: 7329185 - DNA, 21 bp, Homo sapiens
tgtgtgtatgcacacacatgc

SEQ ID NO: 7329186 - DNA, 22 bp, Homo sapiens
tgtgtgtcatttagggtggagc

SEQ ID NO: 7329187 - DNA, 22 bp, Homo sapiens
cctgggtctcctcctgctggct

SEQ ID NO: 7329188 - DNA, 22 bp, Homo sapiens
cctgggtctgtattggtaggta

SEQ ID NO: 7329189 - DNA, 22 bp, Homo sapiens
cctgggtgacccgtgagcgtcc

SEQ ID NO: 7329190 - DNA, 22 bp, Homo sapiens
cctgggtgacagagtgagacct

SEQ ID NO: 7329191 - DNA, 22 bp, Homo sapiens
tgtgttcaatccctagtctcag

SEQ ID NO: 7329192 - DNA, 22 bp, Homo sapiens
tgtgttcatttaactgttcttt

SEQ ID NO: 7329193 - DNA, 19 bp, Homo sapiens
cctgggtccactcagacta

SEQ ID NO: 7329194 - DNA, 22 bp, Homo sapiens
tgtgccagcctctggctgtgtc

SEQ ID NO: 7329195 - DNA, 22 bp, Homo sapiens
tgtgccagcctctggctgtgtc

SEQ ID NO: 7329196 - DNA, 22 bp, Homo sapiens
tgtgcccatccctctggagtgt

SEQ ID NO: 7329197 - DNA, 20 bp, Homo sapiens
tgtgcccagcagaggctgcc

SEQ ID NO: 7329198 - DNA, 22 bp, Homo sapiens
tgtgcccagactgcctcagtga

SEQ ID NO: 7329199 - DNA, 22 bp, Homo sapiens
cctggctggttgtctgattcta

SEQ ID NO: 7329200 - DNA, 22 bp, Homo sapiens
cctggctgtcgttttgtgaaat

SEQ ID NO: 7329201 - DNA, 22 bp, Homo sapiens
cctggctgctatagcagcatgt

SEQ ID NO: 7329202 - DNA, 19 bp, Homo sapiens
cctggctgtgaagcctgca

SEQ ID NO: 7329203 - DNA, 20 bp, Homo sapiens
cctggctgcattcaggacgg

SEQ ID NO: 7329204 - DNA, 22 bp, Homo sapiens
cctggctgcattttgctggatg

SEQ ID NO: 7329205 - DNA, 22 bp, Homo sapiens
cctggctgccttgtgttgatct

SEQ ID NO: 7329206 - DNA, 22 bp, Homo sapiens
cctggctgccgagtgtgcagcg

SEQ ID NO: 7329207 - DNA, 22 bp, Homo sapiens
cctggctgtgtgaccttggcaa

SEQ ID NO: 7329208 - DNA, 22 bp, Homo sapiens
tgtctttacttagaagttcagg

SEQ ID NO: 7329209 - DNA, 22 bp, Homo sapiens
tgtctggtgggttgacaggcag

SEQ ID NO: 7329210 - DNA, 22 bp, Homo sapiens
cctggctctgaagtccacatca

SEQ ID NO: 7329211 - DNA, 22 bp, Homo sapiens
tgtgaggattaaatgcatagtg

SEQ ID NO: 7329212 - DNA, 22 bp, Homo sapiens
cctggctgcagtttttgcagaa

SEQ ID NO: 7329213 - DNA, 22 bp, Homo sapiens
tgtgaggaacccggaatgtggg

SEQ ID NO: 7329214 - DNA, 22 bp, Homo sapiens
tgtgaggataaaaaggaaggag

SEQ ID NO: 7329215 - DNA, 22 bp, Homo sapiens
tgtcatgtctgtaaatacacca

SEQ ID NO: 7329216 - DNA, 22 bp, Homo sapiens
cctggcactgaccaggcactga

SEQ ID NO: 7329217 - DNA, 22 bp, Homo sapiens
tgtaggagtccaatcaggagac

SEQ ID NO: 7329218 - DNA, 21 bp, Homo sapiens
tgtaggaggcaagcctgtctc

SEQ ID NO: 7329219 - DNA, 21 bp, Homo sapiens
tgtaggaggcatctggggctg

SEQ ID NO: 7329220 - DNA, 22 bp, Homo sapiens
tgtaaacatatgtatgtatgta

SEQ ID NO: 7329221 - DNA, 22 bp, Homo sapiens
cctggaaaatgccactttcaca

SEQ ID NO: 7329222 - DNA, 22 bp, Homo sapiens
tggtgggacatctgaggagagg

SEQ ID NO: 7329223 - DNA, 22 bp, Homo sapiens
tggtccgctcctattcgccgca

SEQ ID NO: 7329224 - DNA, 18 bp, Homo sapiens
cctgccagtctggagcag

SEQ ID NO: 7329225 - DNA, 22 bp, Homo sapiens
cctgccagtgaagctgacgggc

SEQ ID NO: 7329226 - DNA, 22 bp, Homo sapiens
cctgccagtgcctcccactggt

SEQ ID NO: 7329227 - DNA, 19 bp, Homo sapiens
tggtcccatactgctggcc

SEQ ID NO: 7329228 - DNA, 22 bp, Homo sapiens
tggtaggatagtgacttatatg

SEQ ID NO: 7329229 - DNA, 22 bp, Homo sapiens
tggtaggagggaaatgcgggtt

SEQ ID NO: 7329230 - DNA, 22 bp, Homo sapiens
tgtctatttgaattatcctaat

SEQ ID NO: 7329231 - DNA, 22 bp, Homo sapiens
tgtcctctccaacagcctctgt

SEQ ID NO: 7329232 - DNA, 19 bp, Homo sapiens
cctggccctgctgcgcggg

SEQ ID NO: 7329233 - DNA, 16 bp, Homo sapiens
cctggcccggcttcct

SEQ ID NO: 7329234 - DNA, 22 bp, Homo sapiens
cctggcccagggactttcgcct

SEQ ID NO: 7329235 - DNA, 22 bp, Homo sapiens
cctggccctggaatagggcagg

SEQ ID NO: 7329236 - DNA, 22 bp, Homo sapiens
cctggctctagaggccactcct

SEQ ID NO: 7329237 - DNA, 22 bp, Homo sapiens
tgtcattaaaatgcttctcaaa

SEQ ID NO: 7329238 - DNA, 22 bp, Homo sapiens
tgtcattaagtagggatttgtg

SEQ ID NO: 7329239 - DNA, 22 bp, Homo sapiens
tgtcattaagtcctttggcgga

SEQ ID NO: 7329240 - DNA, 21 bp, Homo sapiens
tgtcattaatcgctatagaag

SEQ ID NO: 7329241 - DNA, 16 bp, Homo sapiens
tgtcattaccacctgt

SEQ ID NO: 7329242 - DNA, 22 bp, Homo sapiens
tgtcattagagaaggaccactc

SEQ ID NO: 7329243 - DNA, 22 bp, Homo sapiens
tgtcattagtttcagccattct

SEQ ID NO: 7329244 - DNA, 22 bp, Homo sapiens
tgtcattatgaggattacaata

SEQ ID NO: 7329245 - DNA, 22 bp, Homo sapiens
tgtcattatggagcttccactg

SEQ ID NO: 7329246 - DNA, 22 bp, Homo sapiens
tgtcattattagagttgtgctt

SEQ ID NO: 7329247 - DNA, 22 bp, Homo sapiens
tgtcattatttgaggatagact

SEQ ID NO: 7329248 - DNA, 22 bp, Homo sapiens
tgtcattatttgcctactgact

SEQ ID NO: 7329249 - DNA, 22 bp, Homo sapiens
tgtcccagcactttgggagtct

SEQ ID NO: 7329250 - DNA, 19 bp, Homo sapiens
tgtcccagactccgtgtct

SEQ ID NO: 7329251 - DNA, 22 bp, Homo sapiens
tggccccattttacagatgaaa

SEQ ID NO: 7329252 - DNA, 22 bp, Homo sapiens
tggccccacagggccttttcag

SEQ ID NO: 7329253 - DNA, 22 bp, Homo sapiens
tggccccatcaagggatgagtt

SEQ ID NO: 7329254 - DNA, 22 bp, Homo sapiens
tggcccagtgcttatgctctga

SEQ ID NO: 7329255 - DNA, 22 bp, Homo sapiens
cctccactctggcctctcaggt

SEQ ID NO: 7329256 - DNA, 20 bp, Homo sapiens
cctctctgcatgctccctga

SEQ ID NO: 7329257 - DNA, 22 bp, Homo sapiens
cctctctgtaagggtccctccc

SEQ ID NO: 7329258 - DNA, 22 bp, Homo sapiens
cctctctgtagcagcccccagt

SEQ ID NO: 7329259 - DNA, 22 bp, Homo sapiens
cctctctgtgtggcctctccat

SEQ ID NO: 7329260 - DNA, 22 bp, Homo sapiens
tggagctgagcacctccagggc

SEQ ID NO: 7329261 - DNA, 23 bp, Homo sapiens
ccctggccttggggcacaggctg

SEQ ID NO: 7329262 - DNA, 22 bp, Homo sapiens
ccctggctgataccggaaaggc

SEQ ID NO: 7329263 - DNA, 22 bp, Homo sapiens
ccctggctcttcaccacctgcc

SEQ ID NO: 7329264 - DNA, 22 bp, Homo sapiens
ccctggctctgcctcagagccc

SEQ ID NO: 7329265 - DNA, 22 bp, Homo sapiens
ccctggctatttttacgcaagg

SEQ ID NO: 7329266 - DNA, 22 bp, Homo sapiens
tggatctggttccctgagcctt

SEQ ID NO: 7329267 - DNA, 22 bp, Homo sapiens
ccctcaggtgaaaggaaaaatt

SEQ ID NO: 7329268 - DNA, 22 bp, Homo sapiens
tggagctgagagccaggctggc

SEQ ID NO: 7329269 - DNA, 22 bp, Homo sapiens
tggagctgactcacaccagcta

SEQ ID NO: 7329270 - DNA, 22 bp, Homo sapiens
tggcagaggtaattcaaatccc

SEQ ID NO: 7329271 - DNA, 22 bp, Homo sapiens
tgcattaaaaccatcgaccatc

SEQ ID NO: 7329272 - DNA, 22 bp, Homo sapiens
tgcattaatttttgccaggttc

SEQ ID NO: 7329273 - DNA, 22 bp, Homo sapiens
cccaggaaaagcagtgccagca

SEQ ID NO: 7329274 - DNA, 22 bp, Homo sapiens
cccaggaaacccgaaggcgacc

SEQ ID NO: 7329275 - DNA, 22 bp, Homo sapiens
cccaggaaacccgaaggcgacc

SEQ ID NO: 7329276 - DNA, 22 bp, Homo sapiens
cccaggaggtggaggttgcagc

SEQ ID NO: 7329277 - DNA, 22 bp, Homo sapiens
cccaggaggtggaggttgcagt

SEQ ID NO: 7329278 - DNA, 22 bp, Homo sapiens
cccaggcagaattagtgtttca

SEQ ID NO: 7329279 - DNA, 22 bp, Homo sapiens
cccaggcaggagtgtggtggct

SEQ ID NO: 7329280 - DNA, 22 bp, Homo sapiens
cccaggcagtagaaagaagagg

SEQ ID NO: 7329281 - DNA, 22 bp, Homo sapiens
ccctcaggatgcagtggaagtg

SEQ ID NO: 7329282 - DNA, 19 bp, Homo sapiens
ccctcaggtctgagcagtc

SEQ ID NO: 7329283 - DNA, 22 bp, Homo sapiens
ccccgcgcgttgtcccgcaggt

SEQ ID NO: 7329284 - DNA, 22 bp, Homo sapiens
cccccaggctctgacacaggag

SEQ ID NO: 7329285 - DNA, 22 bp, Homo sapiens
ccccctgcgcccggcacgtcat

SEQ ID NO: 7329286 - DNA, 22 bp, Homo sapiens
cccccagctctgctgggtcccg

SEQ ID NO: 7329287 - DNA, 22 bp, Homo sapiens
cccccagccagcagtgctcagc

SEQ ID NO: 7329288 - DNA, 18 bp, Homo sapiens
cccccagccaaattctct

SEQ ID NO: 7329289 - DNA, 22 bp, Homo sapiens
cccccaccgtgttcctgctcgg

SEQ ID NO: 7329290 - DNA, 22 bp, Homo sapiens
ccccagcatatcatggtttcgt

SEQ ID NO: 7329291 - DNA, 22 bp, Homo sapiens
ccccagccagcttgtagtagaa

SEQ ID NO: 7329292 - DNA, 22 bp, Homo sapiens
ccccagccagcaggacctctga

SEQ ID NO: 7329293 - DNA, 22 bp, Homo sapiens
ccccaggcctgttggatggcgc

SEQ ID NO: 7329294 - DNA, 22 bp, Homo sapiens
ccccagccttccatgggaattg

SEQ ID NO: 7329295 - DNA, 22 bp, Homo sapiens
ccccagcccacaagcatattaa

SEQ ID NO: 7329296 - DNA, 22 bp, Homo sapiens
tgctgaatggtaaagaagtata

SEQ ID NO: 7329297 - DNA, 22 bp, Homo sapiens
tgctgaatcaaaacaaaggttt

SEQ ID NO: 7329298 - DNA, 22 bp, Homo sapiens
tgctgaatatagagcaagaagt

SEQ ID NO: 7329299 - DNA, 22 bp, Homo sapiens
cccaggctgagttagaggtgtc

SEQ ID NO: 7329300 - DNA, 22 bp, Homo sapiens
tttgtcttgtaagttaaattca

SEQ ID NO: 7329301 - DNA, 22 bp, Homo sapiens
tttgtctttcccctcctcattg

SEQ ID NO: 7329302 - DNA, 22 bp, Homo sapiens
ctctcctctgaagtggtgaccc

SEQ ID NO: 7329303 - DNA, 22 bp, Homo sapiens
tttgtgaataggttggcttcca

SEQ ID NO: 7329304 - DNA, 19 bp, Homo sapiens
ctctggcttccaaagcatc

SEQ ID NO: 7329305 - DNA, 22 bp, Homo sapiens
ctctgggcaaagatgcctcatc

SEQ ID NO: 7329306 - DNA, 23 bp, Homo sapiens
ttttattgatatgtagctgttgt

SEQ ID NO: 7329307 - DNA, 22 bp, Homo sapiens
ctgaaagcaaatacatgaatct

SEQ ID NO: 7329308 - DNA, 22 bp, Homo sapiens
tttttaatgcagtctgagacat

SEQ ID NO: 7329309 - DNA, 22 bp, Homo sapiens
ttttgtttgtgtccactgcagt

SEQ ID NO: 7329310 - DNA, 21 bp, Homo sapiens
ctctggtcctgtctggcaggc

SEQ ID NO: 7329311 - DNA, 22 bp, Homo sapiens
ctgccatgctcaagaagtcttt

SEQ ID NO: 7329312 - DNA, 22 bp, Homo sapiens
ctgccgttgtgaagctcttaga

SEQ ID NO: 7329313 - DNA, 22 bp, Homo sapiens
ctgccagtctaaagagggcttt

SEQ ID NO: 7329314 - DNA, 22 bp, Homo sapiens
ctgagagagtaaagtagaatta

SEQ ID NO: 7329315 - DNA, 22 bp, Homo sapiens
ctgaggagaaagatggtccaag

SEQ ID NO: 7329316 - DNA, 22 bp, Homo sapiens
ctgaggaggctaatttgaggat

SEQ ID NO: 7329317 - DNA, 22 bp, Homo sapiens
ctgaggagaacaatgagatcaa

SEQ ID NO: 7329318 - DNA, 22 bp, Homo sapiens
ctgaggagaaatgggatggttc

SEQ ID NO: 7329319 - DNA, 22 bp, Homo sapiens
ctgagacattatgacaagtgga

SEQ ID NO: 7329320 - DNA, 22 bp, Homo sapiens
ctgaggagtgggtgggcagtga

SEQ ID NO: 7329321 - DNA, 22 bp, Homo sapiens
ctgaggagttggtgaataagcc

SEQ ID NO: 7329322 - DNA, 22 bp, Homo sapiens
ctgaggagtcagttccactcag

SEQ ID NO: 7329323 - DNA, 22 bp, Homo sapiens
ctgaggagtcagcttactcact

SEQ ID NO: 7329324 - DNA, 22 bp, Homo sapiens
ctgaggaggggcctgagtgaga

SEQ ID NO: 7329325 - DNA, 22 bp, Homo sapiens
ctgaggagtttgggttgttcaa

SEQ ID NO: 7329326 - DNA, 22 bp, Homo sapiens
ctgatcctcctttaagtagctg

SEQ ID NO: 7329327 - DNA, 22 bp, Homo sapiens
ctgatgcccctggacctgtgac

SEQ ID NO: 7329328 - DNA, 22 bp, Homo sapiens
ctggaaaccaggcagttaagag

SEQ ID NO: 7329329 - DNA, 22 bp, Homo sapiens
ctgcctggagcattctgaaggt

SEQ ID NO: 7329330 - DNA, 22 bp, Homo sapiens
ctgcctggaatgccagcttctc

SEQ ID NO: 7329331 - DNA, 22 bp, Homo sapiens
ctgctttagctagtgctcttag

SEQ ID NO: 7329332 - DNA, 22 bp, Homo sapiens
ctgcctgggccatgcccagtcc

SEQ ID NO: 7329333 - DNA, 22 bp, Homo sapiens
ctggaccctgtttccctaggtc

SEQ ID NO: 7329334 - DNA, 22 bp, Homo sapiens
ctggcaagaaatatatatctta

SEQ ID NO: 7329335 - DNA, 22 bp, Homo sapiens
ctggcagaggatggggacccag

SEQ ID NO: 7329336 - DNA, 22 bp, Homo sapiens
ctggccaacatctggggcacat

SEQ ID NO: 7329337 - DNA, 22 bp, Homo sapiens
ctggccaagcactggggtcaaa

SEQ ID NO: 7329338 - DNA, 22 bp, Homo sapiens
ctggcagcattaacagagagca

SEQ ID NO: 7329339 - DNA, 22 bp, Homo sapiens
ctggctcctgtttaaccagctg

SEQ ID NO: 7329340 - DNA, 22 bp, Homo sapiens
ttgataaaatgatgaaatcact

SEQ ID NO: 7329341 - DNA, 22 bp, Homo sapiens
ttgaggagcaggatgggaggct

SEQ ID NO: 7329342 - DNA, 22 bp, Homo sapiens
ttgaggagcactagtcaggtat

SEQ ID NO: 7329343 - DNA, 22 bp, Homo sapiens
ttgaggaggaactgtgaggcaa

SEQ ID NO: 7329344 - DNA, 22 bp, Homo sapiens
ttgaggaggtagtacagagtat

SEQ ID NO: 7329345 - DNA, 22 bp, Homo sapiens
ttgaggaggtatgactaggtac

SEQ ID NO: 7329346 - DNA, 22 bp, Homo sapiens
ttgaggagtcaggggcacggaa

SEQ ID NO: 7329347 - DNA, 22 bp, Homo sapiens
ttgagctcccgcttcttctttg

SEQ ID NO: 7329348 - DNA, 22 bp, Homo sapiens
ctagcccttggtgagaacagcg

SEQ ID NO: 7329349 - DNA, 22 bp, Homo sapiens
ctaggctgtaaagagctaggag

SEQ ID NO: 7329350 - DNA, 22 bp, Homo sapiens
ttctgtatggaaacatcctcca

SEQ ID NO: 7329351 - DNA, 22 bp, Homo sapiens
ttctgtatctctgtgtttcttg

SEQ ID NO: 7329352 - DNA, 22 bp, Homo sapiens
ttcattcttcagagctgcgctt

SEQ ID NO: 7329353 - DNA, 22 bp, Homo sapiens
ttcattcttatttgtgatctgg

SEQ ID NO: 7329354 - DNA, 22 bp, Homo sapiens
ttcattcttgggatcagagagt

SEQ ID NO: 7329355 - DNA, 22 bp, Homo sapiens
ttcattctgcagttctcagctc

SEQ ID NO: 7329356 - DNA, 22 bp, Homo sapiens
ttcattctgtttggaaaggtgg

SEQ ID NO: 7329357 - DNA, 22 bp, Homo sapiens
ttcattctgggctctaaggaac

SEQ ID NO: 7329358 - DNA, 19 bp, Homo sapiens
ttcattctcttattgttgt

SEQ ID NO: 7329359 - DNA, 23 bp, Homo sapiens
ttcatgagattatctgcatgtgt

SEQ ID NO: 7329360 - DNA, 20 bp, Homo sapiens
ttcattcattccacaacttc

SEQ ID NO: 7329361 - DNA, 22 bp, Homo sapiens
ttcccaagtctccaatgtggga

SEQ ID NO: 7329362 - DNA, 22 bp, Homo sapiens
ttccaaagtgctggaattacat

SEQ ID NO: 7329363 - DNA, 22 bp, Homo sapiens
ttccaaagtgctggaattacat

SEQ ID NO: 7329364 - DNA, 22 bp, Homo sapiens
ttccaaagttagttattagaaa

SEQ ID NO: 7329365 - DNA, 22 bp, Homo sapiens
ttccaaagtcatgttgctgata

SEQ ID NO: 7329366 - DNA, 22 bp, Homo sapiens
ttccaaagttattcaagcagta

SEQ ID NO: 7329367 - DNA, 22 bp, Homo sapiens
ttccaaaggaatggggagctat

SEQ ID NO: 7329368 - DNA, 22 bp, Homo sapiens
ttccaaaggctgcaccttgccc

SEQ ID NO: 7329369 - DNA, 22 bp, Homo sapiens
ttccaaagcacttgatgtaaag

SEQ ID NO: 7329370 - DNA, 22 bp, Homo sapiens
ttccaaagctgctttatttagt

SEQ ID NO: 7329371 - DNA, 22 bp, Homo sapiens
ttccaaagaagttcacatttac

SEQ ID NO: 7329372 - DNA, 22 bp, Homo sapiens
ttccaaagaaattgaccaagac

SEQ ID NO: 7329373 - DNA, 22 bp, Homo sapiens
ttcccttaaattatggcatcta

SEQ ID NO: 7329374 - DNA, 22 bp, Homo sapiens
ttcccttaaattatggcatcta

SEQ ID NO: 7329375 - DNA, 22 bp, Homo sapiens
ttccttcctgtcttccttactg

SEQ ID NO: 7329376 - DNA, 17 bp, Homo sapiens
tttagaatacaatgttt

SEQ ID NO: 7329377 - DNA, 22 bp, Homo sapiens
tttacatttccctctgtcagtt

SEQ ID NO: 7329378 - DNA, 22 bp, Homo sapiens
tttacacatacctctttaaagt

SEQ ID NO: 7329379 - DNA, 22 bp, Homo sapiens
tttaaattctgtctgccgctta

SEQ ID NO: 7329380 - DNA, 22 bp, Homo sapiens
tttaaattctgtctgccgctta

SEQ ID NO: 7329381 - DNA, 22 bp, Homo sapiens
tttaaattatagttaatgtctg

SEQ ID NO: 7329382 - DNA, 22 bp, Homo sapiens
tttaaattatagttaatgtctg

SEQ ID NO: 7329383 - DNA, 22 bp, Homo sapiens
tttaaatttgtgtttagagggt

SEQ ID NO: 7329384 - DNA, 22 bp, Homo sapiens
tttaaatttagaagaaacactg

SEQ ID NO: 7329385 - DNA, 22 bp, Homo sapiens
tttaaatttagaagaaacactg

SEQ ID NO: 7329386 - DNA, 22 bp, Homo sapiens
tttaaatttgtgtttagagggt

SEQ ID NO: 7329387 - DNA, 22 bp, Homo sapiens
tttagacactagggatgcagtg

SEQ ID NO: 7329388 - DNA, 22 bp, Homo sapiens
ctcctcttctgagtaccaggga

SEQ ID NO: 7329389 - DNA, 22 bp, Homo sapiens
ctcctcttggaatgcgtggctc

SEQ ID NO: 7329390 - DNA, 22 bp, Homo sapiens
ctcctctttacccgcatggtct

SEQ ID NO: 7329391 - DNA, 22 bp, Homo sapiens
ctcctctttggggatttacaca

SEQ ID NO: 7329392 - DNA, 22 bp, Homo sapiens
ctcctctttagccccagctgga

SEQ ID NO: 7329393 - DNA, 22 bp, Homo sapiens
ctcctggctcgcccccagctga

SEQ ID NO: 7329394 - DNA, 22 bp, Homo sapiens
ctcctggctatgactacatttc

SEQ ID NO: 7329395 - DNA, 22 bp, Homo sapiens
ctctccactcagcgtcatgtcc

SEQ ID NO: 7329396 - DNA, 20 bp, Homo sapiens
tttcagttatcttgaccttc

SEQ ID NO: 7329397 - DNA, 22 bp, Homo sapiens
ttgttaaaatgaggtcattctg

SEQ ID NO: 7329398 - DNA, 22 bp, Homo sapiens
ctcatcagaaatacctgacaaa

SEQ ID NO: 7329399 - DNA, 22 bp, Homo sapiens
ctcatctgctcttattatctta

SEQ ID NO: 7329400 - DNA, 22 bp, Homo sapiens
ctcatctggcttcagtaacagt

SEQ ID NO: 7329401 - DNA, 22 bp, Homo sapiens
ctcatctcccacctgcgtgcag

SEQ ID NO: 7329402 - DNA, 22 bp, Homo sapiens
ttgctttgcagtgcctatagga

SEQ ID NO: 7329403 - DNA, 22 bp, Homo sapiens
ttggcattggagatgcaagaac

SEQ ID NO: 7329404 - DNA, 22 bp, Homo sapiens
taattgtcatcgtagtaaacat

SEQ ID NO: 7329405 - DNA, 22 bp, Homo sapiens
taattggcagagacattggcaa

SEQ ID NO: 7329406 - DNA, 22 bp, Homo sapiens
taattggcagtaatgtgattta

SEQ ID NO: 7329407 - DNA, 23 bp, Homo sapiens
taattggccttttaaaccaactc

SEQ ID NO: 7329408 - DNA, 22 bp, Homo sapiens
taattggctttacttaaagtcc

SEQ ID NO: 7329409 - DNA, 22 bp, Homo sapiens
caggcagagcaactggtccaga

SEQ ID NO: 7329410 - DNA, 22 bp, Homo sapiens
caggcagaaggaagtaccaggc

SEQ ID NO: 7329411 - DNA, 22 bp, Homo sapiens
caggcagagacgtcagtgtagg

SEQ ID NO: 7329412 - DNA, 22 bp, Homo sapiens
caggcaggagccagggattcca

SEQ ID NO: 7329413 - DNA, 22 bp, Homo sapiens
caggcaggagaggaggatttct

SEQ ID NO: 7329414 - DNA, 22 bp, Homo sapiens
caggcagcatcagtctgctgta

SEQ ID NO: 7329415 - DNA, 22 bp, Homo sapiens
tacatcatgaaagcatacatca

SEQ ID NO: 7329416 - DNA, 22 bp, Homo sapiens
tacatatgtaaacatgtataaa

SEQ ID NO: 7329417 - DNA, 22 bp, Homo sapiens
tacaggtggtaaaaatattgtt

SEQ ID NO: 7329418 - DNA, 22 bp, Homo sapiens
tacaaattaatgggcatgttta

SEQ ID NO: 7329419 - DNA, 22 bp, Homo sapiens
caggcagggagctggaaaggat

SEQ ID NO: 7329420 - DNA, 22 bp, Homo sapiens
tacaagtccgtaaagggcagat

SEQ ID NO: 7329421 - DNA, 22 bp, Homo sapiens
taagaaacatgatacttttcct

SEQ ID NO: 7329422 - DNA, 22 bp, Homo sapiens
caggatctgttaagttgttcca

SEQ ID NO: 7329423 - DNA, 22 bp, Homo sapiens
caggatcttttaatgtctccag

SEQ ID NO: 7329424 - DNA, 22 bp, Homo sapiens
caggatctgcccaggcctttgg

SEQ ID NO: 7329425 - DNA, 22 bp, Homo sapiens
caggatggagagtgaggggtca

SEQ ID NO: 7329426 - DNA, 22 bp, Homo sapiens
taacattaggtagacataagcc

SEQ ID NO: 7329427 - DNA, 22 bp, Homo sapiens
taacaacatgcaatttaacctt

SEQ ID NO: 7329428 - DNA, 22 bp, Homo sapiens
taagacaattcttcagtcacaa

SEQ ID NO: 7329429 - DNA, 22 bp, Homo sapiens
caggcacatgggagctcatcat

SEQ ID NO: 7329430 - DNA, 22 bp, Homo sapiens
caggcaagatccagaggctgct

SEQ ID NO: 7329431 - DNA, 22 bp, Homo sapiens
caggcaagattagagatgagca

SEQ ID NO: 7329432 - DNA, 22 bp, Homo sapiens
caggatggtgtgagtgtgagga

SEQ ID NO: 7329433 - DNA, 22 bp, Homo sapiens
caggcaaggaggcactgaggga

SEQ ID NO: 7329434 - DNA, 22 bp, Homo sapiens
taagatttttaaaatgtcctca

SEQ ID NO: 7329435 - DNA, 22 bp, Homo sapiens
taagatgtacttttgtcctcac

SEQ ID NO: 7329436 - DNA, 22 bp, Homo sapiens
caggcagaaattttgtttcatt

SEQ ID NO: 7329437 - DNA, 22 bp, Homo sapiens
caggcagaaagtattctgtgta

SEQ ID NO: 7329438 - DNA, 22 bp, Homo sapiens
taaggcagatgtggaatcaatt

SEQ ID NO: 7329439 - DNA, 22 bp, Homo sapiens
caggagctggatctccttgcgg

SEQ ID NO: 7329440 - DNA, 22 bp, Homo sapiens
caggagctggataggaccacaa

SEQ ID NO: 7329441 - DNA, 22 bp, Homo sapiens
caggagctctcatcgtcagggc

SEQ ID NO: 7329442 - DNA, 22 bp, Homo sapiens
caggagcctcctgattccaatt

SEQ ID NO: 7329443 - DNA, 22 bp, Homo sapiens
caggagccttaggaaatacatc

SEQ ID NO: 7329444 - DNA, 22 bp, Homo sapiens
caggagccctggtgggtggaca

SEQ ID NO: 7329445 - DNA, 22 bp, Homo sapiens
caggagcccgttgctccggcgg

SEQ ID NO: 7329446 - DNA, 22 bp, Homo sapiens
caggagcccgttgctccggcgg

SEQ ID NO: 7329447 - DNA, 22 bp, Homo sapiens
caggagcccgttgctccggcgg

SEQ ID NO: 7329448 - DNA, 22 bp, Homo sapiens
caggagccctggtgggtggaca

SEQ ID NO: 7329449 - DNA, 22 bp, Homo sapiens
caggagccctggtgggtggaca

SEQ ID NO: 7329450 - DNA, 22 bp, Homo sapiens
caggagccgccaggcacgttgg

SEQ ID NO: 7329451 - DNA, 22 bp, Homo sapiens
caggagccgccaggcacgttgg

SEQ ID NO: 7329452 - DNA, 22 bp, Homo sapiens
caggagccgccaggcacgttgg

SEQ ID NO: 7329453 - DNA, 22 bp, Homo sapiens
caggagcctcctgattccaatt

SEQ ID NO: 7329454 - DNA, 22 bp, Homo sapiens
caggagccgccaggcacgttgg

SEQ ID NO: 7329455 - DNA, 22 bp, Homo sapiens
caggagcctcctgattccaatt

SEQ ID NO: 7329456 - DNA, 22 bp, Homo sapiens
caggagccttaggaaatacatc

SEQ ID NO: 7329457 - DNA, 22 bp, Homo sapiens
caggagcaaggagcagtgggat

SEQ ID NO: 7329458 - DNA, 22 bp, Homo sapiens
caggagactcagcatccaggat

SEQ ID NO: 7329459 - DNA, 22 bp, Homo sapiens
taaagccacgctggaaatcagg

SEQ ID NO: 7329460 - DNA, 22 bp, Homo sapiens
taaagtcatctttaaacatgcc

SEQ ID NO: 7329461 - DNA, 22 bp, Homo sapiens
taaagtcatctttaaacatgcc

SEQ ID NO: 7329462 - DNA, 22 bp, Homo sapiens
taaatatcagtccagctcttcc

SEQ ID NO: 7329463 - DNA, 18 bp, Homo sapiens
taaatatatttccccctt

SEQ ID NO: 7329464 - DNA, 22 bp, Homo sapiens
caggaggctcctagggctctgt

SEQ ID NO: 7329465 - DNA, 22 bp, Homo sapiens
caggaggcgtcttcagtttgtt

SEQ ID NO: 7329466 - DNA, 22 bp, Homo sapiens
caggaggctttgggatccaagt

SEQ ID NO: 7329467 - DNA, 22 bp, Homo sapiens
caggaggcccaaagggcgcaga

SEQ ID NO: 7329468 - DNA, 22 bp, Homo sapiens
caggaggcccacaggcccctgc

SEQ ID NO: 7329469 - DNA, 22 bp, Homo sapiens
caggaggcccggccacagccca

SEQ ID NO: 7329470 - DNA, 22 bp, Homo sapiens
caggaggcatcatggagcggac

SEQ ID NO: 7329471 - DNA, 22 bp, Homo sapiens
caggaggcatcatggagcggac

SEQ ID NO: 7329472 - DNA, 22 bp, Homo sapiens
caggaggcatatttaaatccaa

SEQ ID NO: 7329473 - DNA, 22 bp, Homo sapiens
caggaggccaactgtgggactt

SEQ ID NO: 7329474 - DNA, 22 bp, Homo sapiens
caggagcttctgcccatggcca

SEQ ID NO: 7329475 - DNA, 22 bp, Homo sapiens
caggagctgggtctggaagcag

SEQ ID NO: 7329476 - DNA, 22 bp, Homo sapiens
caggaggcagcgctctcaggac

SEQ ID NO: 7329477 - DNA, 22 bp, Homo sapiens
caggaggcagcgctctcaggac

SEQ ID NO: 7329478 - DNA, 22 bp, Homo sapiens
caggaggcaggtgcattttgag

SEQ ID NO: 7329479 - DNA, 22 bp, Homo sapiens
caggaggcagtgggtgttgtct

SEQ ID NO: 7329480 - DNA, 22 bp, Homo sapiens
caggaggcagtttcagaagtca

SEQ ID NO: 7329481 - DNA, 22 bp, Homo sapiens
caggaggcagtgggtgttgtct

SEQ ID NO: 7329482 - DNA, 22 bp, Homo sapiens
caggaggcagtttcagaagtca

SEQ ID NO: 7329483 - DNA, 22 bp, Homo sapiens
caggaggcagaggatgcccagt

SEQ ID NO: 7329484 - DNA, 22 bp, Homo sapiens
caggaggcagaggttgcagcga

SEQ ID NO: 7329485 - DNA, 22 bp, Homo sapiens
caggaggcagaggttgcagtga

SEQ ID NO: 7329486 - DNA, 20 bp, Homo sapiens
caggaggcaaggtcaaggtc

SEQ ID NO: 7329487 - DNA, 22 bp, Homo sapiens
caggagactatggcccaaggcc

SEQ ID NO: 7329488 - DNA, 22 bp, Homo sapiens
taaacatttgttattcttgttt

SEQ ID NO: 7329489 - DNA, 22 bp, Homo sapiens
taaactgcttctctcagtctgt

SEQ ID NO: 7329490 - DNA, 19 bp, Homo sapiens
taaaaactgaaggaagcag

SEQ ID NO: 7329491 - DNA, 22 bp, Homo sapiens
taaaaagtagtgagaatggcgc

SEQ ID NO: 7329492 - DNA, 22 bp, Homo sapiens
gttttctggcagttattcctta

SEQ ID NO: 7329493 - DNA, 22 bp, Homo sapiens
gttttctgtttcttaacggcat

SEQ ID NO: 7329494 - DNA, 22 bp, Homo sapiens
gttttctgattagcaaatctga

SEQ ID NO: 7329495 - DNA, 22 bp, Homo sapiens
gttttctgccggtggtgggctc

SEQ ID NO: 7329496 - DNA, 22 bp, Homo sapiens
gttttctgcctgaaggtgacca

SEQ ID NO: 7329497 - DNA, 19 bp, Homo sapiens
gttttctgatcttgccccc

SEQ ID NO: 7329498 - DNA, 22 bp, Homo sapiens
taaaaatcttatgaatggcaag

SEQ ID NO: 7329499 - DNA, 22 bp, Homo sapiens
taaaaagttgaaaggacttatc

SEQ ID NO: 7329500 - DNA, 22 bp, Homo sapiens
caggaagccttccttgtctgct

SEQ ID NO: 7329501 - DNA, 22 bp, Homo sapiens
caggaaggaaagggtgtggaga

SEQ ID NO: 7329502 - DNA, 22 bp, Homo sapiens
caggaagtgtgagggtggtgta

SEQ ID NO: 7329503 - DNA, 22 bp, Homo sapiens
caggaagtgggtagaaggaata

SEQ ID NO: 7329504 - DNA, 22 bp, Homo sapiens
caggaagtggggtcatggagta

SEQ ID NO: 7329505 - DNA, 22 bp, Homo sapiens
caggaagtgcctggtgagagga

SEQ ID NO: 7329506 - DNA, 22 bp, Homo sapiens
caggaagttgtgtgttcgaggc

SEQ ID NO: 7329507 - DNA, 22 bp, Homo sapiens
caggaatccagagtgagcctcc

SEQ ID NO: 7329508 - DNA, 22 bp, Homo sapiens
caggaatccagagtgagcctcc

SEQ ID NO: 7329509 - DNA, 22 bp, Homo sapiens
caggacaaagccctttgagaaa

SEQ ID NO: 7329510 - DNA, 22 bp, Homo sapiens
gttattaaagtatttgatgtta

SEQ ID NO: 7329511 - DNA, 16 bp, Homo sapiens
caggaaacttaaagac

SEQ ID NO: 7329512 - DNA, 22 bp, Homo sapiens
caggaaactgtgggcttaaatc

SEQ ID NO: 7329513 - DNA, 21 bp, Homo sapiens
caggaaactgaggccatgggg

SEQ ID NO: 7329514 - DNA, 22 bp, Homo sapiens
caggaaacaaagccttgctcat

SEQ ID NO: 7329515 - DNA, 19 bp, Homo sapiens
caggaaacacctactgcta

SEQ ID NO: 7329516 - DNA, 22 bp, Homo sapiens
caggaaacattcttggtaagga

SEQ ID NO: 7329517 - DNA, 22 bp, Homo sapiens
caggaaacattcccataacaca

SEQ ID NO: 7329518 - DNA, 22 bp, Homo sapiens
caggaaacatatgtgcttgagg

SEQ ID NO: 7329519 - DNA, 22 bp, Homo sapiens
caggaaacggctattcttttgt

SEQ ID NO: 7329520 - DNA, 22 bp, Homo sapiens
caggaaaccgcatcccagtggg

SEQ ID NO: 7329521 - DNA, 22 bp, Homo sapiens
gttcacaagctgggtttctgca

SEQ ID NO: 7329522 - DNA, 22 bp, Homo sapiens
gttcacaagctgattgtctttc

SEQ ID NO: 7329523 - DNA, 22 bp, Homo sapiens
cagctttcatcagtgacactca

SEQ ID NO: 7329524 - DNA, 22 bp, Homo sapiens
gtgtgtgccaactttatgtgca

SEQ ID NO: 7329525 - DNA, 22 bp, Homo sapiens
gtgtgtgcaagaggtttattga

SEQ ID NO: 7329526 - DNA, 22 bp, Homo sapiens
gttacaatgttcttcagttctg

SEQ ID NO: 7329527 - DNA, 22 bp, Homo sapiens
gttacaagtgttcgagagtgac

SEQ ID NO: 7329528 - DNA, 22 bp, Homo sapiens
gttaaagaagaatagttccttt

SEQ ID NO: 7329529 - DNA, 22 bp, Homo sapiens
caggaagattgtggaggtggtt

SEQ ID NO: 7329530 - DNA, 22 bp, Homo sapiens
caggaagcaccagcccggcccc

SEQ ID NO: 7329531 - DNA, 22 bp, Homo sapiens
caggaagattgtggaggtggtt

SEQ ID NO: 7329532 - DNA, 22 bp, Homo sapiens
caggaagattagaccaagagct

SEQ ID NO: 7329533 - DNA, 22 bp, Homo sapiens
caggaagaggtggggctaaagt

SEQ ID NO: 7329534 - DNA, 22 bp, Homo sapiens
caggaagaggacaggcttcccc

SEQ ID NO: 7329535 - DNA, 22 bp, Homo sapiens
caggaagaggtatcaccgagca

SEQ ID NO: 7329536 - DNA, 22 bp, Homo sapiens
caggaagagaacatggaggctg

SEQ ID NO: 7329537 - DNA, 22 bp, Homo sapiens
caggaacaatgtaagtctcatt

SEQ ID NO: 7329538 - DNA, 22 bp, Homo sapiens
caggaacaatgtaagtctcatt

SEQ ID NO: 7329539 - DNA, 22 bp, Homo sapiens
caggaacacaatgagtctcaaa

SEQ ID NO: 7329540 - DNA, 22 bp, Homo sapiens
caggaacacaatgagtctcaaa

SEQ ID NO: 7329541 - DNA, 22 bp, Homo sapiens
gtttattattcaacttcatgtt

SEQ ID NO: 7329542 - DNA, 22 bp, Homo sapiens
gtttacatgtactcattatact

SEQ ID NO: 7329543 - DNA, 22 bp, Homo sapiens
gttggcagagagaagcctagca

SEQ ID NO: 7329544 - DNA, 22 bp, Homo sapiens
caggaaatttaagagtgtacaa

SEQ ID NO: 7329545 - DNA, 22 bp, Homo sapiens
caggaaattctttttaacagaa

SEQ ID NO: 7329546 - DNA, 22 bp, Homo sapiens
caggaaattttgtgatctgttc

SEQ ID NO: 7329547 - DNA, 22 bp, Homo sapiens
caggaaatgggtcgttttataa

SEQ ID NO: 7329548 - DNA, 22 bp, Homo sapiens
caggaaatggggtttagttatt

SEQ ID NO: 7329549 - DNA, 22 bp, Homo sapiens
caggaaatgtataattttataa

SEQ ID NO: 7329550 - DNA, 22 bp, Homo sapiens
caggaaatagacactgtatgat

SEQ ID NO: 7329551 - DNA, 22 bp, Homo sapiens
caggaaatagttcagtcaaact

SEQ ID NO: 7329552 - DNA, 22 bp, Homo sapiens
caggaaataaaaagtatcttct

SEQ ID NO: 7329553 - DNA, 22 bp, Homo sapiens
gtgtggaagcagatgggtgagc

SEQ ID NO: 7329554 - DNA, 22 bp, Homo sapiens
gtgtggaaccaaataacctaaa

SEQ ID NO: 7329555 - DNA, 22 bp, Homo sapiens
gtgtggaaacagagagggcaac

SEQ ID NO: 7329556 - DNA, 17 bp, Homo sapiens
gtgtgctactatcattt

SEQ ID NO: 7329557 - DNA, 22 bp, Homo sapiens
gtggggagggagatgctgaagt

SEQ ID NO: 7329558 - DNA, 22 bp, Homo sapiens
gtgggcagtgcctgacggatga

SEQ ID NO: 7329559 - DNA, 22 bp, Homo sapiens
gtgggcaggccctaggcgattt

SEQ ID NO: 7329560 - DNA, 22 bp, Homo sapiens
cagctctgttcaaactatccag

SEQ ID NO: 7329561 - DNA, 22 bp, Homo sapiens
cagctctgttcatagatggtgc

SEQ ID NO: 7329562 - DNA, 22 bp, Homo sapiens
gtggcctgtcagaagccgtggg

SEQ ID NO: 7329563 - DNA, 22 bp, Homo sapiens
gtggcagaagagtaggatgggc

SEQ ID NO: 7329564 - DNA, 22 bp, Homo sapiens
cagctctggctttggggagctt

SEQ ID NO: 7329565 - DNA, 22 bp, Homo sapiens
cagctctggctattgaggacca

SEQ ID NO: 7329566 - DNA, 22 bp, Homo sapiens
cagctctgtctgtagaaacttc

SEQ ID NO: 7329567 - DNA, 22 bp, Homo sapiens
cagctctgtgcaggcctgggga

SEQ ID NO: 7329568 - DNA, 22 bp, Homo sapiens
cagctctggccagatctatcct

SEQ ID NO: 7329569 - DNA, 22 bp, Homo sapiens
cagctctgctggtggtgccagg

SEQ ID NO: 7329570 - DNA, 22 bp, Homo sapiens
ccacagtctagctagaaggcat

SEQ ID NO: 7329571 - DNA, 22 bp, Homo sapiens
tcctggtcagtgccaaactggt

SEQ ID NO: 7329572 - DNA, 22 bp, Homo sapiens
ccacaggtacggattgaggacc

SEQ ID NO: 7329573 - DNA, 20 bp, Homo sapiens
ccagaagcactcttcatgtt

SEQ ID NO: 7329574 - DNA, 22 bp, Homo sapiens
ccagaggagcaggctggctcca

SEQ ID NO: 7329575 - DNA, 22 bp, Homo sapiens
tctcccaaggcacagaaagagt

SEQ ID NO: 7329576 - DNA, 22 bp, Homo sapiens
tctcctgggaggacaaggaagg

SEQ ID NO: 7329577 - DNA, 18 bp, Homo sapiens
ccagagctggctcctcgc

SEQ ID NO: 7329578 - DNA, 22 bp, Homo sapiens
catttgcaaaccaacaagatga

SEQ ID NO: 7329579 - DNA, 22 bp, Homo sapiens
catttgcaagagataaatgttt

SEQ ID NO: 7329580 - DNA, 22 bp, Homo sapiens
catttgaaattcttagaacaaa

SEQ ID NO: 7329581 - DNA, 22 bp, Homo sapiens
tccctgctgcactcacacctac

SEQ ID NO: 7329582 - DNA, 22 bp, Homo sapiens
tccctgcttgctctcagccctt

SEQ ID NO: 7329583 - DNA, 22 bp, Homo sapiens
tccctgctcagctcacctggca

SEQ ID NO: 7329584 - DNA, 22 bp, Homo sapiens
tccctgctgagagtgctctccc

SEQ ID NO: 7329585 - DNA, 22 bp, Homo sapiens
catttacagcagactgatgaaa

SEQ ID NO: 7329586 - DNA, 22 bp, Homo sapiens
ccaaatgtgcctgtttcaacaa

SEQ ID NO: 7329587 - DNA, 22 bp, Homo sapiens
tcctccccaaagcccagcctgg

SEQ ID NO: 7329588 - DNA, 22 bp, Homo sapiens
ccacaattttatgatttaggag

SEQ ID NO: 7329589 - DNA, 22 bp, Homo sapiens
tcctgcccacagctgctggaca

SEQ ID NO: 7329590 - DNA, 22 bp, Homo sapiens
tcctgccagctggggctgcttc

SEQ ID NO: 7329591 - DNA, 22 bp, Homo sapiens
ccacagctagggcaatctgatt

SEQ ID NO: 7329592 - DNA, 22 bp, Homo sapiens
ccacagctgaaagcagaggctc

SEQ ID NO: 7329593 - DNA, 22 bp, Homo sapiens
tctgccaggagccatgagcaag

SEQ ID NO: 7329594 - DNA, 22 bp, Homo sapiens
tctgccagcttctggtggttgc

SEQ ID NO: 7329595 - DNA, 22 bp, Homo sapiens
tctgccaggaagaaagcacaat

SEQ ID NO: 7329596 - DNA, 21 bp, Homo sapiens
tctgccagctgaagaggtgga

SEQ ID NO: 7329597 - DNA, 22 bp, Homo sapiens
tctgccagctctgtgggtctcg

SEQ ID NO: 7329598 - DNA, 22 bp, Homo sapiens
tctgccagaaccagtcaccgat

SEQ ID NO: 7329599 - DNA, 22 bp, Homo sapiens
tctgccagaactccattagaaa

SEQ ID NO: 7329600 - DNA, 22 bp, Homo sapiens
tctgccagacctgactcagtag

SEQ ID NO: 7329601 - DNA, 22 bp, Homo sapiens
tctgccagataatcattttctc

SEQ ID NO: 7329602 - DNA, 22 bp, Homo sapiens
tctgccagcaccatgatccttc

SEQ ID NO: 7329603 - DNA, 22 bp, Homo sapiens
tctgccagccctgtgagtcttg

SEQ ID NO: 7329604 - DNA, 22 bp, Homo sapiens
tctgccagaagttctgagagta

SEQ ID NO: 7329605 - DNA, 22 bp, Homo sapiens
tctgccagaagccagggtctgg

SEQ ID NO: 7329606 - DNA, 22 bp, Homo sapiens
ccagctctcaaggctccctggg

SEQ ID NO: 7329607 - DNA, 22 bp, Homo sapiens
tctgaaataggaaagcaaatgg

SEQ ID NO: 7329608 - DNA, 22 bp, Homo sapiens
tctgaaatatattttgagtgtt

SEQ ID NO: 7329609 - DNA, 22 bp, Homo sapiens
ccagccagtccagcattggtgt

SEQ ID NO: 7329610 - DNA, 19 bp, Homo sapiens
ccagcccatagtccatcac

SEQ ID NO: 7329611 - DNA, 22 bp, Homo sapiens
ccagcccatgcccttatagcat

SEQ ID NO: 7329612 - DNA, 21 bp, Homo sapiens
ccagcccagcctccttctctt

SEQ ID NO: 7329613 - DNA, 21 bp, Homo sapiens
ccagcccagctgtgtcccagc

SEQ ID NO: 7329614 - DNA, 19 bp, Homo sapiens
ccagcccacagtgactttc

SEQ ID NO: 7329615 - DNA, 22 bp, Homo sapiens
ccagcccaaagtcaccccggga

SEQ ID NO: 7329616 - DNA, 22 bp, Homo sapiens
ccagcccaaacaagccgccttc

SEQ ID NO: 7329617 - DNA, 22 bp, Homo sapiens
tctgaggcagcttgccactcta

SEQ ID NO: 7329618 - DNA, 22 bp, Homo sapiens
tctgaggcatttaattatgacc

SEQ ID NO: 7329619 - DNA, 22 bp, Homo sapiens
ccaggaggcggaaggtacagtg

SEQ ID NO: 7329620 - DNA, 22 bp, Homo sapiens
ccaggaagcctgtgtctctgga

SEQ ID NO: 7329621 - DNA, 22 bp, Homo sapiens
ccaggaagacacatgctcatcc

SEQ ID NO: 7329622 - DNA, 22 bp, Homo sapiens
ccaggaagaaacagtctttata

SEQ ID NO: 7329623 - DNA, 22 bp, Homo sapiens
ccaggaaacctgcgccatccag

SEQ ID NO: 7329624 - DNA, 22 bp, Homo sapiens
ccaggaagcctttttctttgac

SEQ ID NO: 7329625 - DNA, 22 bp, Homo sapiens
tattaaatatatctgttagttg

SEQ ID NO: 7329626 - DNA, 22 bp, Homo sapiens
tattggaaggaagcaagagagg

SEQ ID NO: 7329627 - DNA, 22 bp, Homo sapiens
tatgttttaggaattaattgtt

SEQ ID NO: 7329628 - DNA, 22 bp, Homo sapiens
tatctctgtaaaagaaatcaca

SEQ ID NO: 7329629 - DNA, 22 bp, Homo sapiens
cagggtggaacaggcaatactt

SEQ ID NO: 7329630 - DNA, 22 bp, Homo sapiens
tagttttagtcccattttacag

SEQ ID NO: 7329631 - DNA, 22 bp, Homo sapiens
tatacagttaagtttcttcagt

SEQ ID NO: 7329632 - DNA, 22 bp, Homo sapiens
tatacagtcttttgctatattc

SEQ ID NO: 7329633 - DNA, 22 bp, Homo sapiens
tatacagtcttttgctatattc

SEQ ID NO: 7329634 - DNA, 22 bp, Homo sapiens
tatacagattaacagatttaaa

SEQ ID NO: 7329635 - DNA, 22 bp, Homo sapiens
tatacagatggaaagatacaca

SEQ ID NO: 7329636 - DNA, 22 bp, Homo sapiens
cagggtggcactcagcgcatct

SEQ ID NO: 7329637 - DNA, 22 bp, Homo sapiens
cagggtggcacatcacagcatt

SEQ ID NO: 7329638 - DNA, 22 bp, Homo sapiens
tatttagttatctttcataaaa

SEQ ID NO: 7329639 - DNA, 22 bp, Homo sapiens
tattggaaggcattagtgaata

SEQ ID NO: 7329640 - DNA, 22 bp, Homo sapiens
cagtctaacttcacagcctgga

SEQ ID NO: 7329641 - DNA, 22 bp, Homo sapiens
cagtgcaattacaagctaattc

SEQ ID NO: 7329642 - DNA, 22 bp, Homo sapiens
cagtgcaatgcagatgacacca

SEQ ID NO: 7329643 - DNA, 22 bp, Homo sapiens
cagtgcaatgttaaataggaaa

SEQ ID NO: 7329644 - DNA, 22 bp, Homo sapiens
cagtgcaattagaacttattta

SEQ ID NO: 7329645 - DNA, 21 bp, Homo sapiens
cagtgcaattgattttttaga

SEQ ID NO: 7329646 - DNA, 22 bp, Homo sapiens
cagtgcaacttttgcctcccgg

SEQ ID NO: 7329647 - DNA, 22 bp, Homo sapiens
cagtgcaagctgatactgaggt

SEQ ID NO: 7329648 - DNA, 22 bp, Homo sapiens
cagtgcaagtgactgatcaagg

SEQ ID NO: 7329649 - DNA, 22 bp, Homo sapiens
cagtgcaatattcaaagtggag

SEQ ID NO: 7329650 - DNA, 22 bp, Homo sapiens
cagtgcaatattcaaagtggag

SEQ ID NO: 7329651 - DNA, 22 bp, Homo sapiens
cagtgattcagactcatcattt

SEQ ID NO: 7329652 - DNA, 22 bp, Homo sapiens
cagtgcaaactccctgaggtgg

SEQ ID NO: 7329653 - DNA, 22 bp, Homo sapiens
cagtgcaacagattcgagaagc

SEQ ID NO: 7329654 - DNA, 20 bp, Homo sapiens
cagtgcaactgaagaactga

SEQ ID NO: 7329655 - DNA, 22 bp, Homo sapiens
cagtgcaacgttgtgcattcaa

SEQ ID NO: 7329656 - DNA, 22 bp, Homo sapiens
tcaccattaaggactttcagct

SEQ ID NO: 7329657 - DNA, 22 bp, Homo sapiens
tcaccagggctccagccagcct

SEQ ID NO: 7329658 - DNA, 22 bp, Homo sapiens
cagtgcccaagatgtgccatgc

SEQ ID NO: 7329659 - DNA, 22 bp, Homo sapiens
catgcaaaggtcaagatcagga

SEQ ID NO: 7329660 - DNA, 18 bp, Homo sapiens
tcattttgtctgcctttg

SEQ ID NO: 7329661 - DNA, 22 bp, Homo sapiens
tcattttggggtttgtcatctt

SEQ ID NO: 7329662 - DNA, 22 bp, Homo sapiens
catgcacaaaggtaagatgcgt

SEQ ID NO: 7329663 - DNA, 22 bp, Homo sapiens
catgtgcagactctgacaggct

SEQ ID NO: 7329664 - DNA, 22 bp, Homo sapiens
catgtctttcaaaccacacagt

SEQ ID NO: 7329665 - DNA, 22 bp, Homo sapiens
tccaggcaaagtgctgggctgc

SEQ ID NO: 7329666 - DNA, 22 bp, Homo sapiens
tcagttcttagtaatgcagtct

SEQ ID NO: 7329667 - DNA, 22 bp, Homo sapiens
catctttgcccatccacttcca

SEQ ID NO: 7329668 - DNA, 22 bp, Homo sapiens
catctttgccatatgatgtaat

SEQ ID NO: 7329669 - DNA, 22 bp, Homo sapiens
catctttgcaccctcaaaacct

SEQ ID NO: 7329670 - DNA, 22 bp, Homo sapiens
catctttgagacagcattaccc

SEQ ID NO: 7329671 - DNA, 22 bp, Homo sapiens
catctttgagacagcattaccc

SEQ ID NO: 7329672 - DNA, 22 bp, Homo sapiens
catctttgaactctgtataaac

SEQ ID NO: 7329673 - DNA, 22 bp, Homo sapiens
catctttagtaggttctggaga

SEQ ID NO: 7329674 - DNA, 22 bp, Homo sapiens
tcaggtgggcagtgggttgagc

SEQ ID NO: 7329675 - DNA, 22 bp, Homo sapiens
catccctgacttctaggtgaca

SEQ ID NO: 7329676 - DNA, 22 bp, Homo sapiens
catccctgattcctagtacagt

SEQ ID NO: 7329677 - DNA, 22 bp, Homo sapiens
catccctgtcgtcaagtctctg

SEQ ID NO: 7329678 - DNA, 22 bp, Homo sapiens
catccctggttcctgtgtttaa

SEQ ID NO: 7329679 - DNA, 22 bp, Homo sapiens
catccctgccctcatgcctata

SEQ ID NO: 7329680 - DNA, 22 bp, Homo sapiens
catccctgctggtggaaggggt

SEQ ID NO: 7329681 - DNA, 22 bp, Homo sapiens
catccctgctggtggaaggggt

SEQ ID NO: 7329682 - DNA, 22 bp, Homo sapiens
catccctgggcgggacactctt

SEQ ID NO: 7329683 - DNA, 22 bp, Homo sapiens
catagacaaagatcagaagagt

SEQ ID NO: 7329684 - DNA, 19 bp, Homo sapiens
tcaggaagttgatgaggtg

SEQ ID NO: 7329685 - DNA, 22 bp, Homo sapiens
tcaggaagtggtaaaggatgtt

SEQ ID NO: 7329686 - DNA, 22 bp, Homo sapiens
tcaggaagtgcctaggctggcc

SEQ ID NO: 7329687 - DNA, 22 bp, Homo sapiens
catatccaatatgactagtgtt

SEQ ID NO: 7329688 - DNA, 22 bp, Homo sapiens
catatccaggtttctttggttt

SEQ ID NO: 7329689 - DNA, 20 bp, Homo sapiens
catatatacctagaagtgga

SEQ ID NO: 7329690 - DNA, 22 bp, Homo sapiens
tcagggcatggctgcacttggc

SEQ ID NO: 7329691 - DNA, 22 bp, Homo sapiens
catccagtggtcagggaagttg

SEQ ID NO: 7329692 - DNA, 22 bp, Homo sapiens
catcacatctactataagtgat

SEQ ID NO: 7329693 - DNA, 22 bp, Homo sapiens
catacattgctcattcagtatc

SEQ ID NO: 7329694 - DNA, 22 bp, Homo sapiens
cagtttgtatttattactcata

SEQ ID NO: 7329695 - DNA, 22 bp, Homo sapiens
tcagaagtattatgctaaagga

SEQ ID NO: 7329696 - DNA, 22 bp, Homo sapiens
tcagaagtcatgctcagtctgt

SEQ ID NO: 7329697 - DNA, 22 bp, Homo sapiens
tcagaagtcacttaggaaaggg

SEQ ID NO: 7329698 - DNA, 22 bp, Homo sapiens
tcagaagtactgtgctacaata

SEQ ID NO: 7329699 - DNA, 18 bp, Homo sapiens
tgtgcaatattaaccacc

SEQ ID NO: 7329700 - DNA, 22 bp, Homo sapiens
tgtgcatagactttcaccacct

SEQ ID NO: 7329701 - DNA, 22 bp, Homo sapiens
tgtgcctgagttggctgagtac

SEQ ID NO: 7329702 - DNA, 22 bp, Homo sapiens
tgtgagcactgtgatgctgttc

SEQ ID NO: 7329703 - DNA, 22 bp, Homo sapiens
tgtgaaatgctattgtgacaaa

SEQ ID NO: 7329704 - DNA, 22 bp, Homo sapiens
tgtgaatacagcatgtgcttct

SEQ ID NO: 7329705 - DNA, 23 bp, Homo sapiens
tgtgaattgaggacatcaaaagc

SEQ ID NO: 7329706 - DNA, 22 bp, Homo sapiens
tgtgaaaagggctttgtacaaa

SEQ ID NO: 7329707 - DNA, 22 bp, Homo sapiens
tgtctttaaaattaaacacatc

SEQ ID NO: 7329708 - DNA, 22 bp, Homo sapiens
tgtcttcgctacaatgaaaagg

SEQ ID NO: 7329709 - DNA, 22 bp, Homo sapiens
tgtctcccaggtgtgcccagtg

SEQ ID NO: 7329710 - DNA, 22 bp, Homo sapiens
tgtctcctaatgtctgtttcct

SEQ ID NO: 7329711 - DNA, 22 bp, Homo sapiens
tgtctcctactgcctgtggatc

SEQ ID NO: 7329712 - DNA, 22 bp, Homo sapiens
tgtctcctcaactcatgctcga

SEQ ID NO: 7329713 - DNA, 22 bp, Homo sapiens
tgtctcctatttcctgctaagg

SEQ ID NO: 7329714 - DNA, 19 bp, Homo sapiens
tgtctcctcatgcaagtgt

SEQ ID NO: 7329715 - DNA, 22 bp, Homo sapiens
tgtctcctctgtcctgtcagga

SEQ ID NO: 7329716 - DNA, 21 bp, Homo sapiens
tgtctcctgttggcacatggc

SEQ ID NO: 7329717 - DNA, 22 bp, Homo sapiens
tgtctcctgggtcccttccacc

SEQ ID NO: 7329718 - DNA, 22 bp, Homo sapiens
tgtggaagtcgcctctccttgg

SEQ ID NO: 7329719 - DNA, 22 bp, Homo sapiens
tgtgggaggaattagaatggga

SEQ ID NO: 7329720 - DNA, 22 bp, Homo sapiens
tgtgggaggaacacagccagaa

SEQ ID NO: 7329721 - DNA, 22 bp, Homo sapiens
tgtgggagaaggaagcaagctg

SEQ ID NO: 7329722 - DNA, 22 bp, Homo sapiens
tgtgtattaccattttacagct

SEQ ID NO: 7329723 - DNA, 19 bp, Homo sapiens
tgtgtgcatgcgcacgtgt

SEQ ID NO: 7329724 - DNA, 22 bp, Homo sapiens
tgtgtgtggggaggcagcagat

SEQ ID NO: 7329725 - DNA, 21 bp, Homo sapiens
tgtgtgtgcaggcacacacac

SEQ ID NO: 7329726 - DNA, 22 bp, Homo sapiens
tgtgtgtgtgcgcgcacgcata

SEQ ID NO: 7329727 - DNA, 22 bp, Homo sapiens
tgtgtgtgtcctcatttgcaga

SEQ ID NO: 7329728 - DNA, 22 bp, Homo sapiens
ttaaaatttccccaccatgtat

SEQ ID NO: 7329729 - DNA, 20 bp, Homo sapiens
ttaaaaagagtcacaggaga

SEQ ID NO: 7329730 - DNA, 17 bp, Homo sapiens
tgttttttccctgttct

SEQ ID NO: 7329731 - DNA, 22 bp, Homo sapiens
tgttttaatctcccattgctct

SEQ ID NO: 7329732 - DNA, 22 bp, Homo sapiens
tgtttggaaacactggcagaaa

SEQ ID NO: 7329733 - DNA, 22 bp, Homo sapiens
tgttaaatgctcagctcgggga

SEQ ID NO: 7329734 - DNA, 22 bp, Homo sapiens
tgttaaatgttcctttactgga

SEQ ID NO: 7329735 - DNA, 22 bp, Homo sapiens
tgttaaatgttttgctagtgtc

SEQ ID NO: 7329736 - DNA, 22 bp, Homo sapiens
tgttctttggcttcacagctct

SEQ ID NO: 7329737 - DNA, 22 bp, Homo sapiens
ttagaacatagcaacagaatta

SEQ ID NO: 7329738 - DNA, 22 bp, Homo sapiens
ttacattttgcacagatgtccc

SEQ ID NO: 7329739 - DNA, 22 bp, Homo sapiens
ttagaaaggttttgctctgaaa

SEQ ID NO: 7329740 - DNA, 22 bp, Homo sapiens
ttagaacaaagccaccaggtga

SEQ ID NO: 7329741 - DNA, 22 bp, Homo sapiens
ttagatttacaagcactgttta

SEQ ID NO: 7329742 - DNA, 22 bp, Homo sapiens
ttaggaaattccacctgtattc

SEQ ID NO: 7329743 - DNA, 22 bp, Homo sapiens
ttaggaaattatggtttcagat

SEQ ID NO: 7329744 - DNA, 20 bp, Homo sapiens
ttatctgtcaatctgtctca

SEQ ID NO: 7329745 - DNA, 22 bp, Homo sapiens
ttagtgcaaacctcagagacac

SEQ ID NO: 7329746 - DNA, 22 bp, Homo sapiens
ttagtctccagcttagggtttg

SEQ ID NO: 7329747 - DNA, 22 bp, Homo sapiens
ttatgaaagacatttctgttgg

SEQ ID NO: 7329748 - DNA, 22 bp, Homo sapiens
ttattcttcttctcttgccagg

SEQ ID NO: 7329749 - DNA, 22 bp, Homo sapiens
ttaataaagtatgaattggaaa

SEQ ID NO: 7329750 - DNA, 22 bp, Homo sapiens
ttaaactgcagactcagtgttc

SEQ ID NO: 7329751 - DNA, 22 bp, Homo sapiens
ttaaactgcttgaattgggttt

SEQ ID NO: 7329752 - DNA, 22 bp, Homo sapiens
ttaaagaatagtgcccctattg

SEQ ID NO: 7329753 - DNA, 22 bp, Homo sapiens
ttaaagaggtagttaggtttaa

SEQ ID NO: 7329754 - DNA, 22 bp, Homo sapiens
ttaaagagtttattacttgtaa

SEQ ID NO: 7329755 - DNA, 22 bp, Homo sapiens
ttacaacttgcagaggatgttg

SEQ ID NO: 7329756 - DNA, 22 bp, Homo sapiens
ttacaacatatgataggagtct

SEQ ID NO: 7329757 - DNA, 22 bp, Homo sapiens
ttacaacagacacatattctaa

SEQ ID NO: 7329758 - DNA, 17 bp, Homo sapiens
ttacaacaattcatgag

SEQ ID NO: 7329759 - DNA, 21 bp, Homo sapiens
ttacaaagctacagatgttgc

SEQ ID NO: 7329760 - DNA, 22 bp, Homo sapiens
ttacaaagttctgagttcaaac

SEQ ID NO: 7329761 - DNA, 22 bp, Homo sapiens
ttaattaagagatactgcagta

SEQ ID NO: 7329762 - DNA, 22 bp, Homo sapiens
ttaattaaattcatgagcattg

SEQ ID NO: 7329763 - DNA, 22 bp, Homo sapiens
ttacacaaaaataagatatggc

SEQ ID NO: 7329764 - DNA, 22 bp, Homo sapiens
ttacagaatgttcttccaacag

SEQ ID NO: 7329765 - DNA, 22 bp, Homo sapiens
ttacagaggtatgtatgtctct

SEQ ID NO: 7329766 - DNA, 22 bp, Homo sapiens
ttacaattgagtctattgtatg

SEQ ID NO: 7329767 - DNA, 22 bp, Homo sapiens
ttacatttcccccttggaggct

SEQ ID NO: 7329768 - DNA, 22 bp, Homo sapiens
ttacattttagttaacctgtga

SEQ ID NO: 7329769 - DNA, 22 bp, Homo sapiens
ttacatttggctatgtcctcta

SEQ ID NO: 7329770 - DNA, 22 bp, Homo sapiens
ttacagatggggttgcaataaa

SEQ ID NO: 7329771 - DNA, 22 bp, Homo sapiens
ttacagatggatctagcaaaat

SEQ ID NO: 7329772 - DNA, 22 bp, Homo sapiens
ttatttctactattttgcctga

SEQ ID NO: 7329773 - DNA, 22 bp, Homo sapiens
ttatttcttgtctatgtagcca

SEQ ID NO: 7329774 - DNA, 22 bp, Homo sapiens
ttcaggaaattggagtccttct

SEQ ID NO: 7329775 - DNA, 20 bp, Homo sapiens
ttcaggaataagatagcagc

SEQ ID NO: 7329776 - DNA, 22 bp, Homo sapiens
ttcaggaagcctttcttggtct

SEQ ID NO: 7329777 - DNA, 22 bp, Homo sapiens
ttcaggaaggtcctatagcaga

SEQ ID NO: 7329778 - DNA, 21 bp, Homo sapiens
ttcagcagtcctctagagata

SEQ ID NO: 7329779 - DNA, 22 bp, Homo sapiens
ttcagcagtttctgagaagcaa

SEQ ID NO: 7329780 - DNA, 19 bp, Homo sapiens
ttcagcagtgtctgctctt

SEQ ID NO: 7329781 - DNA, 22 bp, Homo sapiens
ttcattcaggtgtatttatggg

SEQ ID NO: 7329782 - DNA, 22 bp, Homo sapiens
ttcattcaggtgtatttatggg

SEQ ID NO: 7329783 - DNA, 22 bp, Homo sapiens
ttcattcagtgagactaggacg

SEQ ID NO: 7329784 - DNA, 22 bp, Homo sapiens
ttcattcagtgcatttgggaga

SEQ ID NO: 7329785 - DNA, 22 bp, Homo sapiens
ttcattcatcacatgcagctgg

SEQ ID NO: 7329786 - DNA, 22 bp, Homo sapiens
ttcattcatctctaaaatgcct

SEQ ID NO: 7329787 - DNA, 21 bp, Homo sapiens
ttcattcatggcataatatag

SEQ ID NO: 7329788 - DNA, 22 bp, Homo sapiens
ttcattcaaagaggcatccaag

SEQ ID NO: 7329789 - DNA, 22 bp, Homo sapiens
ttcattcaaggggttcctgatt

SEQ ID NO: 7329790 - DNA, 22 bp, Homo sapiens
ttcattcacccaggaaacatct

SEQ ID NO: 7329791 - DNA, 20 bp, Homo sapiens
ttcattcacgtagctgttga

SEQ ID NO: 7329792 - DNA, 22 bp, Homo sapiens
ttcattcagcacatatttattg

SEQ ID NO: 7329793 - DNA, 23 bp, Homo sapiens
ttcattcaaaaggaaaagtcatg

SEQ ID NO: 7329794 - DNA, 22 bp, Homo sapiens
ttcattaattcattcagtgact

SEQ ID NO: 7329795 - DNA, 22 bp, Homo sapiens
ttcaggaatcaaccaagtcatt

SEQ ID NO: 7329796 - DNA, 22 bp, Homo sapiens
ttcaggaatataggcattgaca

SEQ ID NO: 7329797 - DNA, 22 bp, Homo sapiens
ttcaggaataattatcatatga

SEQ ID NO: 7329798 - DNA, 22 bp, Homo sapiens
ttcattcttgtctttgtatagt

SEQ ID NO: 7329799 - DNA, 22 bp, Homo sapiens
ttcattcattcatgaatgttaa

SEQ ID NO: 7329800 - DNA, 22 bp, Homo sapiens
ttcattcattacgtgccaggca

SEQ ID NO: 7329801 - DNA, 22 bp, Homo sapiens
ttcattcatggtcttctgagat

SEQ ID NO: 7329802 - DNA, 22 bp, Homo sapiens
ttcattcatgtattgtctatgg

SEQ ID NO: 7329803 - DNA, 22 bp, Homo sapiens
ttcattcttttacatgtgaata

SEQ ID NO: 7329804 - DNA, 19 bp, Homo sapiens
ttcattctttctacttacc

SEQ ID NO: 7329805 - DNA, 22 bp, Homo sapiens
ttcattctttgaatctgaggta

SEQ ID NO: 7329806 - DNA, 22 bp, Homo sapiens
ttccagctcttgaaggtgggat

SEQ ID NO: 7329807 - DNA, 22 bp, Homo sapiens
tgtatgcaccattgtattacct

SEQ ID NO: 7329808 - DNA, 17 bp, Homo sapiens
tgtatgcatatgctttt

SEQ ID NO: 7329809 - DNA, 22 bp, Homo sapiens
tgtatgcataaaattatttaca

SEQ ID NO: 7329810 - DNA, 22 bp, Homo sapiens
tgtattttgtgaggatcactct

SEQ ID NO: 7329811 - DNA, 22 bp, Homo sapiens
tgtattttgagtccaatctcct

SEQ ID NO: 7329812 - DNA, 22 bp, Homo sapiens
tgtattttctgaagataatcaa

SEQ ID NO: 7329813 - DNA, 22 bp, Homo sapiens
tgtcaaaaagctgggacaagca

SEQ ID NO: 7329814 - DNA, 22 bp, Homo sapiens
tgtcaaaaataagagagattgt

SEQ ID NO: 7329815 - DNA, 22 bp, Homo sapiens
tgtcaaaaccttggaggcaagg

SEQ ID NO: 7329816 - DNA, 22 bp, Homo sapiens
tgtcacaaacatacattataga

SEQ ID NO: 7329817 - DNA, 22 bp, Homo sapiens
tgtatacatttggtgcatattt

SEQ ID NO: 7329818 - DNA, 22 bp, Homo sapiens
tgtatacaggattactcatagc

SEQ ID NO: 7329819 - DNA, 22 bp, Homo sapiens
tgtagcagtgtctaccacatta

SEQ ID NO: 7329820 - DNA, 22 bp, Homo sapiens
tgtcatatgttgatgaaagaga

SEQ ID NO: 7329821 - DNA, 22 bp, Homo sapiens
tgtcataagattaactttttgt

SEQ ID NO: 7329822 - DNA, 22 bp, Homo sapiens
tgtcataatcagttttgcatgt

SEQ ID NO: 7329823 - DNA, 22 bp, Homo sapiens
tgtcagttcagtgattacaaaa

SEQ ID NO: 7329824 - DNA, 22 bp, Homo sapiens
tgtcccagcagctgggttctct

SEQ ID NO: 7329825 - DNA, 22 bp, Homo sapiens
tgtcccagtcaaggctgtcatc

SEQ ID NO: 7329826 - DNA, 22 bp, Homo sapiens
tgtcccagctgtctctgttttt

SEQ ID NO: 7329827 - DNA, 22 bp, Homo sapiens
tgtcccctttacctccgcagcc

SEQ ID NO: 7329828 - DNA, 22 bp, Homo sapiens
tgtccccagagcctgttcctgc

SEQ ID NO: 7329829 - DNA, 22 bp, Homo sapiens
tgtcctcaaggagcttcagtct

SEQ ID NO: 7329830 - DNA, 21 bp, Homo sapiens
tgtcctggtcactgctctccc

SEQ ID NO: 7329831 - DNA, 22 bp, Homo sapiens
tggtgaggccaaagccatgaca

SEQ ID NO: 7329832 - DNA, 22 bp, Homo sapiens
tggtgatcagtcaactgtcttc

SEQ ID NO: 7329833 - DNA, 22 bp, Homo sapiens
tggtctctgcaggccaggctca

SEQ ID NO: 7329834 - DNA, 22 bp, Homo sapiens
tggtctcccagagcagggacgc

SEQ ID NO: 7329835 - DNA, 22 bp, Homo sapiens
tggtcagcgtttgtcagagcag

SEQ ID NO: 7329836 - DNA, 22 bp, Homo sapiens
tggtgggctgagtctcatcgga

SEQ ID NO: 7329837 - DNA, 16 bp, Homo sapiens
tggtggggaggacagc

SEQ ID NO: 7329838 - DNA, 22 bp, Homo sapiens
tggtgggcacagtgcccaggct

SEQ ID NO: 7329839 - DNA, 22 bp, Homo sapiens
tggtggggtcatcgtcagatgc

SEQ ID NO: 7329840 - DNA, 22 bp, Homo sapiens
tggtgggggaggctgtctagca

SEQ ID NO: 7329841 - DNA, 22 bp, Homo sapiens
tggtggggccagacttcagctc

SEQ ID NO: 7329842 - DNA, 22 bp, Homo sapiens
tggtggggattccctccctggc

SEQ ID NO: 7329843 - DNA, 22 bp, Homo sapiens
tggtggggctttccttctgctt

SEQ ID NO: 7329844 - DNA, 22 bp, Homo sapiens
tgtaattttctcaagtttctac

SEQ ID NO: 7329845 - DNA, 23 bp, Homo sapiens
tgtaaattttgtagtcacatttt

SEQ ID NO: 7329846 - DNA, 22 bp, Homo sapiens
tgtaaattgaaggaaatttgtg

SEQ ID NO: 7329847 - DNA, 23 bp, Homo sapiens
tgtaacaatttcatatacatgca

SEQ ID NO: 7329848 - DNA, 22 bp, Homo sapiens
tgtacagactttgcagtgtgca

SEQ ID NO: 7329849 - DNA, 20 bp, Homo sapiens
tgtaaataggcattgtagtt

SEQ ID NO: 7329850 - DNA, 22 bp, Homo sapiens
tggtttctgccctcagagctca

SEQ ID NO: 7329851 - DNA, 22 bp, Homo sapiens
tggtttctgtctgagttcctcc

SEQ ID NO: 7329852 - DNA, 22 bp, Homo sapiens
tggttgaacaagttgggtatat

SEQ ID NO: 7329853 - DNA, 23 bp, Homo sapiens
tggtggggtcttggagacagcac

SEQ ID NO: 7329854 - DNA, 22 bp, Homo sapiens
tgggcactcaggctgaggccgt

SEQ ID NO: 7329855 - DNA, 22 bp, Homo sapiens
tgggcaaggctggagcctgcag

SEQ ID NO: 7329856 - DNA, 22 bp, Homo sapiens
tgggaggccaaggcaggcggat

SEQ ID NO: 7329857 - DNA, 22 bp, Homo sapiens
tgggaggccgaggcaggtggat

SEQ ID NO: 7329858 - DNA, 22 bp, Homo sapiens
tgggagtgaggcagagtctatc

SEQ ID NO: 7329859 - DNA, 22 bp, Homo sapiens
tgggagtagatgaggagtgggc

SEQ ID NO: 7329860 - DNA, 22 bp, Homo sapiens
tgggatgaggcctctgttgtga

SEQ ID NO: 7329861 - DNA, 22 bp, Homo sapiens
tgggatgagggtgagccacatg

SEQ ID NO: 7329862 - DNA, 22 bp, Homo sapiens
tgggatgaatacaatgggatca

SEQ ID NO: 7329863 - DNA, 23 bp, Homo sapiens
tgggatagaatttcatggctgct

SEQ ID NO: 7329864 - DNA, 18 bp, Homo sapiens
tgggagtgggagtggata

SEQ ID NO: 7329865 - DNA, 22 bp, Homo sapiens
tgggagtgcacctgggacacga

SEQ ID NO: 7329866 - DNA, 22 bp, Homo sapiens
tgggagtgatacagtatggaat

SEQ ID NO: 7329867 - DNA, 22 bp, Homo sapiens
tgggcagggagctggaaccaca

SEQ ID NO: 7329868 - DNA, 22 bp, Homo sapiens
tgggcagggatctcttttgcaa

SEQ ID NO: 7329869 - DNA, 22 bp, Homo sapiens
tgggcagagttgtgatgaactg

SEQ ID NO: 7329870 - DNA, 22 bp, Homo sapiens
tgggcgaggcccagggctgcgt

SEQ ID NO: 7329871 - DNA, 22 bp, Homo sapiens
tgggcgaggagaatgctgtgaa

SEQ ID NO: 7329872 - DNA, 23 bp, Homo sapiens
tgggcgaggcaggagtggagcac

SEQ ID NO: 7329873 - DNA, 22 bp, Homo sapiens
tgggggagatagagtctgatgg

SEQ ID NO: 7329874 - DNA, 22 bp, Homo sapiens
tgggggagattgtgcatctcta

SEQ ID NO: 7329875 - DNA, 22 bp, Homo sapiens
tgggggagcgacagacataatt

SEQ ID NO: 7329876 - DNA, 22 bp, Homo sapiens
tgggggcacttcgaggtcgcct

SEQ ID NO: 7329877 - DNA, 22 bp, Homo sapiens
tgggtcctgtctccttgttctg

SEQ ID NO: 7329878 - DNA, 20 bp, Homo sapiens
tgggtcctgcttcttcctga

SEQ ID NO: 7329879 - DNA, 22 bp, Homo sapiens
tgggtactcctattagttcagt

SEQ ID NO: 7329880 - DNA, 22 bp, Homo sapiens
tggggggatacttgctactggc

SEQ ID NO: 7329881 - DNA, 22 bp, Homo sapiens
tggggggatacttgctactggc

SEQ ID NO: 7329882 - DNA, 22 bp, Homo sapiens
tgggggtgccctatgaggaagc

SEQ ID NO: 7329883 - DNA, 22 bp, Homo sapiens
tgggggtgctgagaagacagga

SEQ ID NO: 7329884 - DNA, 22 bp, Homo sapiens
tggtaactggattctgtctcac

SEQ ID NO: 7329885 - DNA, 20 bp, Homo sapiens
tgggttcaactcctacagtc

SEQ ID NO: 7329886 - DNA, 22 bp, Homo sapiens
tgggttcagatcccagctctgt

SEQ ID NO: 7329887 - DNA, 22 bp, Homo sapiens
tgggtgagtggagggcattcta

SEQ ID NO: 7329888 - DNA, 22 bp, Homo sapiens
tgggtgaggatgatgaggcagc

SEQ ID NO: 7329889 - DNA, 22 bp, Homo sapiens
tgggtgaggagaggctgtctaa

SEQ ID NO: 7329890 - DNA, 22 bp, Homo sapiens
tgggtgagccacaggagttgtc

SEQ ID NO: 7329891 - DNA, 19 bp, Homo sapiens
tgggtgtgaccatctctgc

SEQ ID NO: 7329892 - DNA, 16 bp, Homo sapiens
tgggtgggaggagcgg

SEQ ID NO: 7329893 - DNA, 21 bp, Homo sapiens
tgggtgggcagagtctcttca

SEQ ID NO: 7329894 - DNA, 16 bp, Homo sapiens
tgggtgggaggagcgg

SEQ ID NO: 7329895 - DNA, 22 bp, Homo sapiens
tggcgaggtttcagagagcggc

SEQ ID NO: 7329896 - DNA, 22 bp, Homo sapiens
tggcctgggtgctgctgacatc

SEQ ID NO: 7329897 - DNA, 22 bp, Homo sapiens
tggcctggctcacagtgagatt

SEQ ID NO: 7329898 - DNA, 22 bp, Homo sapiens
tggcctgggtcacaccagggtc

SEQ ID NO: 7329899 - DNA, 22 bp, Homo sapiens
tggcctggtccttgtcaaggca

SEQ ID NO: 7329900 - DNA, 22 bp, Homo sapiens
tggctattgagtgatctctaga

SEQ ID NO: 7329901 - DNA, 22 bp, Homo sapiens
tggcgcgacgtgccccctgctt

SEQ ID NO: 7329902 - DNA, 22 bp, Homo sapiens
tggctggaatatgtggagacca

SEQ ID NO: 7329903 - DNA, 22 bp, Homo sapiens
tggctgaatctgcagcaggaag

SEQ ID NO: 7329904 - DNA, 22 bp, Homo sapiens
tggcttcactgctcaagtgatt

SEQ ID NO: 7329905 - DNA, 17 bp, Homo sapiens
tggcttcagatgtacat

SEQ ID NO: 7329906 - DNA, 22 bp, Homo sapiens
tggctgtgggatgagagcctca

SEQ ID NO: 7329907 - DNA, 21 bp, Homo sapiens
tggctggatagatgggaactg

SEQ ID NO: 7329908 - DNA, 22 bp, Homo sapiens
tgggaggaatgtcactgagcca

SEQ ID NO: 7329909 - DNA, 22 bp, Homo sapiens
tgggaggacttgtgggcttcat

SEQ ID NO: 7329910 - DNA, 22 bp, Homo sapiens
tgggaggatcgcttgagcccag

SEQ ID NO: 7329911 - DNA, 22 bp, Homo sapiens
tgggaggagccctctgggaagg

SEQ ID NO: 7329912 - DNA, 22 bp, Homo sapiens
tgggaggcagaagttgactgga

SEQ ID NO: 7329913 - DNA, 22 bp, Homo sapiens
tgggaggatctcttgaggccag

SEQ ID NO: 7329914 - DNA, 19 bp, Homo sapiens
tgggagaggcaacagagta

SEQ ID NO: 7329915 - DNA, 22 bp, Homo sapiens
tgggaagatgaggtgccatggg

SEQ ID NO: 7329916 - DNA, 22 bp, Homo sapiens
tgggaagatggagtgacaggca

SEQ ID NO: 7329917 - DNA, 22 bp, Homo sapiens
tgggactcactcttttggccag

SEQ ID NO: 7329918 - DNA, 22 bp, Homo sapiens
tgggaagttaggatgccaggga

SEQ ID NO: 7329919 - DNA, 22 bp, Homo sapiens
tgggaagtcgtagagttcatgt

SEQ ID NO: 7329920 - DNA, 18 bp, Homo sapiens
tggcctggagacaactct

SEQ ID NO: 7329921 - DNA, 22 bp, Homo sapiens
tggcagtgaagctgtctttagg

SEQ ID NO: 7329922 - DNA, 22 bp, Homo sapiens
tggcagtagatccagtctctct

SEQ ID NO: 7329923 - DNA, 22 bp, Homo sapiens
tggcatggctactggaatggcg

SEQ ID NO: 7329924 - DNA, 21 bp, Homo sapiens
tggcagagtgcagtctataca

SEQ ID NO: 7329925 - DNA, 22 bp, Homo sapiens
tggcagagtgcggcatcccctg

SEQ ID NO: 7329926 - DNA, 22 bp, Homo sapiens
tggcagagtgcggcatcccctg

SEQ ID NO: 7329927 - DNA, 22 bp, Homo sapiens
tggcagagtgcagaagaggcat

SEQ ID NO: 7329928 - DNA, 22 bp, Homo sapiens
tggcagagtgcagaagaggcat

SEQ ID NO: 7329929 - DNA, 22 bp, Homo sapiens
tggcagagtctgggcttgggca

SEQ ID NO: 7329930 - DNA, 22 bp, Homo sapiens
tggcagagtctctcctttccag

SEQ ID NO: 7329931 - DNA, 22 bp, Homo sapiens
tggcagagtctctcctttccag

SEQ ID NO: 7329932 - DNA, 22 bp, Homo sapiens
tggcagagtaggatggccctgt

SEQ ID NO: 7329933 - DNA, 22 bp, Homo sapiens
tggcagagtcatcacatctgga

SEQ ID NO: 7329934 - DNA, 20 bp, Homo sapiens
tggcagagttgtcccaccca

SEQ ID NO: 7329935 - DNA, 22 bp, Homo sapiens
tggcagagttggaggtggaaga

SEQ ID NO: 7329936 - DNA, 21 bp, Homo sapiens
tggcagagttgagtagttatg

SEQ ID NO: 7329937 - DNA, 22 bp, Homo sapiens
tggcagagttcgctcctattca

SEQ ID NO: 7329938 - DNA, 22 bp, Homo sapiens
tggcagagttcgctgtgccttt

SEQ ID NO: 7329939 - DNA, 22 bp, Homo sapiens
tggcagagttatgggtatttat

SEQ ID NO: 7329940 - DNA, 22 bp, Homo sapiens
tggcagagttcgctcctattca

SEQ ID NO: 7329941 - DNA, 22 bp, Homo sapiens
tggcagagtggaccatactcaa

SEQ ID NO: 7329942 - DNA, 18 bp, Homo sapiens
tggcagagtgtctgttct

SEQ ID NO: 7329943 - DNA, 22 bp, Homo sapiens
tggcagccttctctgagaaggt

SEQ ID NO: 7329944 - DNA, 22 bp, Homo sapiens
tggcagccatcagagcaggggt

SEQ ID NO: 7329945 - DNA, 22 bp, Homo sapiens
tggcagcctgcgtgaaggagct

SEQ ID NO: 7329946 - DNA, 22 bp, Homo sapiens
tggcaggatttgcccggaagga

SEQ ID NO: 7329947 - DNA, 22 bp, Homo sapiens
tggcaggatctttgagagtgaa

SEQ ID NO: 7329948 - DNA, 22 bp, Homo sapiens
tggcaggaaccaggaggctctc

SEQ ID NO: 7329949 - DNA, 18 bp, Homo sapiens
tggcaggaaatgcacttt

SEQ ID NO: 7329950 - DNA, 22 bp, Homo sapiens
tggcaggaagacgtggggcacc

SEQ ID NO: 7329951 - DNA, 23 bp, Homo sapiens
tggcaggaaatgagaatgttcct

SEQ ID NO: 7329952 - DNA, 22 bp, Homo sapiens
tggcaggaaagtaacagagcac

SEQ ID NO: 7329953 - DNA, 22 bp, Homo sapiens
tggcaggaggatgaggcggcta

SEQ ID NO: 7329954 - DNA, 22 bp, Homo sapiens
tggcaggagcctgcggggaggt

SEQ ID NO: 7329955 - DNA, 20 bp, Homo sapiens
tggcaggagccactggaagc

SEQ ID NO: 7329956 - DNA, 20 bp, Homo sapiens
tggcaggaggcagcagtgga

SEQ ID NO: 7329957 - DNA, 22 bp, Homo sapiens
tggcaggagagcgtcagatcag

SEQ ID NO: 7329958 - DNA, 22 bp, Homo sapiens
tggcaggagacacatggcatag

SEQ ID NO: 7329959 - DNA, 22 bp, Homo sapiens
tggcaggaagcatctataggtc

SEQ ID NO: 7329960 - DNA, 22 bp, Homo sapiens
tggcaggaaggagactcagccc

SEQ ID NO: 7329961 - DNA, 20 bp, Homo sapiens
tggcaggaatagggccagag

SEQ ID NO: 7329962 - DNA, 22 bp, Homo sapiens
tggcagagagagtgcagtcgac

SEQ ID NO: 7329963 - DNA, 22 bp, Homo sapiens
tggcagagagactctccttgat

SEQ ID NO: 7329964 - DNA, 22 bp, Homo sapiens
tggcagagactcctcctgggag

SEQ ID NO: 7329965 - DNA, 23 bp, Homo sapiens
tggcagagacccagaatctacat

SEQ ID NO: 7329966 - DNA, 22 bp, Homo sapiens
tggcagagaataaatcttgact

SEQ ID NO: 7329967 - DNA, 22 bp, Homo sapiens
tggcagagacaaggccgggcct

SEQ ID NO: 7329968 - DNA, 22 bp, Homo sapiens
tggcagagaacctgggctttgt

SEQ ID NO: 7329969 - DNA, 22 bp, Homo sapiens
tggcagagaacacggctgatct

SEQ ID NO: 7329970 - DNA, 22 bp, Homo sapiens
tggcagagaacacggctgatct

SEQ ID NO: 7329971 - DNA, 22 bp, Homo sapiens
tggcagagcccagaactgagca

SEQ ID NO: 7329972 - DNA, 22 bp, Homo sapiens
tggcagagcccagaactgagca

SEQ ID NO: 7329973 - DNA, 22 bp, Homo sapiens
tggcagagatgaagagttgttt

SEQ ID NO: 7329974 - DNA, 22 bp, Homo sapiens
tggcagagcaaaaagatagaat

SEQ ID NO: 7329975 - DNA, 22 bp, Homo sapiens
tggcagagcaaaaagatagaat

SEQ ID NO: 7329976 - DNA, 22 bp, Homo sapiens
tggcagagctggctgcggatga

SEQ ID NO: 7329977 - DNA, 22 bp, Homo sapiens
tggcagagcccagactccagtc

SEQ ID NO: 7329978 - DNA, 22 bp, Homo sapiens
tggcagagccttgccaaactcc

SEQ ID NO: 7329979 - DNA, 22 bp, Homo sapiens
tggcagaggtatattgggagga

SEQ ID NO: 7329980 - DNA, 22 bp, Homo sapiens
tggcagaggaaaaagtcactgg

SEQ ID NO: 7329981 - DNA, 16 bp, Homo sapiens
tggcagaggttcagcc

SEQ ID NO: 7329982 - DNA, 22 bp, Homo sapiens
tggcagagctggctgcggatga

SEQ ID NO: 7329983 - DNA, 22 bp, Homo sapiens
tggcagaggaaaaagtcactgg

SEQ ID NO: 7329984 - DNA, 22 bp, Homo sapiens
tgcttattctttccacaattca

SEQ ID NO: 7329985 - DNA, 22 bp, Homo sapiens
tgcttatttaggtagatattaa

SEQ ID NO: 7329986 - DNA, 22 bp, Homo sapiens
tgcttctgctcagcttcctact

SEQ ID NO: 7329987 - DNA, 22 bp, Homo sapiens
tgcttaaaaacagtatggtagt

SEQ ID NO: 7329988 - DNA, 22 bp, Homo sapiens
tgcttaaaatgatgattatttt

SEQ ID NO: 7329989 - DNA, 22 bp, Homo sapiens
tgcttaaaatagttcatttttg

SEQ ID NO: 7329990 - DNA, 22 bp, Homo sapiens
tgctgtctgtttactggctata

SEQ ID NO: 7329991 - DNA, 22 bp, Homo sapiens
tgctgtcttttcccaatcctgg

SEQ ID NO: 7329992 - DNA, 22 bp, Homo sapiens
tgctgtcttttcccaatcctgg

SEQ ID NO: 7329993 - DNA, 22 bp, Homo sapiens
tgctgtctttttcccttcctaa

SEQ ID NO: 7329994 - DNA, 22 bp, Homo sapiens
tgcttataatgttactgacaac

SEQ ID NO: 7329995 - DNA, 22 bp, Homo sapiens
tgcttaatcaagaagcctattt

SEQ ID NO: 7329996 - DNA, 22 bp, Homo sapiens
tgcttaataggagttgaacatt

SEQ ID NO: 7329997 - DNA, 22 bp, Homo sapiens
tgcttaaagtagtggattgtta

SEQ ID NO: 7329998 - DNA, 22 bp, Homo sapiens
tgcttaaacatccagacagtat

SEQ ID NO: 7329999 - DNA, 22 bp, Homo sapiens
tgcttaaaccctgatcatgtgt

SEQ ID NO: 7330000 - DNA, 22 bp, Homo sapiens
tgcttaaacatactatttatat

SEQ ID NO: 7330001 - DNA, 22 bp, Homo sapiens
tgcttaaacacatacatacata

SEQ ID NO: 7330002 - DNA, 22 bp, Homo sapiens
tgcttaaacacatacatacata

SEQ ID NO: 7330003 - DNA, 20 bp, Homo sapiens
tgctggttacaccaccaagg

SEQ ID NO: 7330004 - DNA, 22 bp, Homo sapiens
tgctggcttcctgtgcacagca

SEQ ID NO: 7330005 - DNA, 22 bp, Homo sapiens
tgctggcacgtgactgggaagt

SEQ ID NO: 7330006 - DNA, 22 bp, Homo sapiens
tgctggctgtgtaccatctcaa

SEQ ID NO: 7330007 - DNA, 22 bp, Homo sapiens
tgctgctttggaactccacagg

SEQ ID NO: 7330008 - DNA, 19 bp, Homo sapiens
tgctgcttccagctcactc

SEQ ID NO: 7330009 - DNA, 22 bp, Homo sapiens
tgctatttctatctcatttaaa

SEQ ID NO: 7330010 - DNA, 22 bp, Homo sapiens
tgctataataatacagaggtga

SEQ ID NO: 7330011 - DNA, 22 bp, Homo sapiens
tgctataagtagacattcaaca

SEQ ID NO: 7330012 - DNA, 19 bp, Homo sapiens
tgctcagctcctgtgagtc

SEQ ID NO: 7330013 - DNA, 22 bp, Homo sapiens
tgctcagcgccaaagctgatgg

SEQ ID NO: 7330014 - DNA, 22 bp, Homo sapiens
tgctcagagctccagctctcct

SEQ ID NO: 7330015 - DNA, 22 bp, Homo sapiens
tgcctgtggaaaggctggtgct

SEQ ID NO: 7330016 - DNA, 22 bp, Homo sapiens
tgcctgtggagccactagtttt

SEQ ID NO: 7330017 - DNA, 22 bp, Homo sapiens
tgcctgtgccctttgctgggag

SEQ ID NO: 7330018 - DNA, 22 bp, Homo sapiens
tgccttggaggaatgatgagag

SEQ ID NO: 7330019 - DNA, 22 bp, Homo sapiens
tgcctggcatgttatagacaca

SEQ ID NO: 7330020 - DNA, 22 bp, Homo sapiens
tgcctggccagaccctatagag

SEQ ID NO: 7330021 - DNA, 20 bp, Homo sapiens
tgctctgggggtggagagac

SEQ ID NO: 7330022 - DNA, 22 bp, Homo sapiens
tgctgagcgcatccggcggccg

SEQ ID NO: 7330023 - DNA, 22 bp, Homo sapiens
tgctgaggtcatttccaagtga

SEQ ID NO: 7330024 - DNA, 17 bp, Homo sapiens
tgctcctgtggcagcct

SEQ ID NO: 7330025 - DNA, 23 bp, Homo sapiens
tgctctgggaggccctggagagc

SEQ ID NO: 7330026 - DNA, 23 bp, Homo sapiens
tgctctgggaggccctggagagc

SEQ ID NO: 7330027 - DNA, 22 bp, Homo sapiens
tgctctcctgctcctcagccca

SEQ ID NO: 7330028 - DNA, 22 bp, Homo sapiens
tgctctgggctatctgagaaag

SEQ ID NO: 7330029 - DNA, 22 bp, Homo sapiens
tgctcctgctggccctcgtgcc

SEQ ID NO: 7330030 - DNA, 22 bp, Homo sapiens
tgctcctgctgcatgcatctcc

SEQ ID NO: 7330031 - DNA, 22 bp, Homo sapiens
tgctcccaggcattctctgttg

SEQ ID NO: 7330032 - DNA, 20 bp, Homo sapiens
tggaggcagagccagaggga

SEQ ID NO: 7330033 - DNA, 22 bp, Homo sapiens
tggaggcactaaatggccacaa

SEQ ID NO: 7330034 - DNA, 19 bp, Homo sapiens
tggaggcaagacatggagg

SEQ ID NO: 7330035 - DNA, 20 bp, Homo sapiens
tggaggcacctgtggagatc

SEQ ID NO: 7330036 - DNA, 22 bp, Homo sapiens
tggaggcaccactggctgcccg

SEQ ID NO: 7330037 - DNA, 22 bp, Homo sapiens
tggaggcagccgtgaaccacct

SEQ ID NO: 7330038 - DNA, 22 bp, Homo sapiens
tggaggcaggagacagggcaaa

SEQ ID NO: 7330039 - DNA, 18 bp, Homo sapiens
tggaggcagagttctggc

SEQ ID NO: 7330040 - DNA, 22 bp, Homo sapiens
tggaggcagatacactgtaaaa

SEQ ID NO: 7330041 - DNA, 22 bp, Homo sapiens
tggaggcaggtggaggagtgaa

SEQ ID NO: 7330042 - DNA, 23 bp, Homo sapiens
tggaggcaggatgctaaggagtc

SEQ ID NO: 7330043 - DNA, 22 bp, Homo sapiens
tggaggcaggggatacaggtca

SEQ ID NO: 7330044 - DNA, 22 bp, Homo sapiens
tggaggcagtaactgagcaaca

SEQ ID NO: 7330045 - DNA, 22 bp, Homo sapiens
tggaggcaggttagccagacga

SEQ ID NO: 7330046 - DNA, 22 bp, Homo sapiens
tggaggcagtcaaatgactgac

SEQ ID NO: 7330047 - DNA, 22 bp, Homo sapiens
tggaggcagtcacctgaagtca

SEQ ID NO: 7330048 - DNA, 22 bp, Homo sapiens
tggagctgggatttgaactgca

SEQ ID NO: 7330049 - DNA, 22 bp, Homo sapiens
tggagctggtaaacagtgacat

SEQ ID NO: 7330050 - DNA, 20 bp, Homo sapiens
tggagctgtaatcttgtctg

SEQ ID NO: 7330051 - DNA, 22 bp, Homo sapiens
tggaggcaactgaagatgtagt

SEQ ID NO: 7330052 - DNA, 22 bp, Homo sapiens
tggagtgcaatagtaataaggt

SEQ ID NO: 7330053 - DNA, 22 bp, Homo sapiens
tggaggtgtccaactcgtgggt

SEQ ID NO: 7330054 - DNA, 22 bp, Homo sapiens
tggaggtgtataaggtagcttc

SEQ ID NO: 7330055 - DNA, 22 bp, Homo sapiens
tggaggtggtgcccagcaattt

SEQ ID NO: 7330056 - DNA, 20 bp, Homo sapiens
tggaggtggtctgctgtcct

SEQ ID NO: 7330057 - DNA, 22 bp, Homo sapiens
tggaggtggcacaagggaggtc

SEQ ID NO: 7330058 - DNA, 22 bp, Homo sapiens
tggagggaacaaaggagtccca

SEQ ID NO: 7330059 - DNA, 22 bp, Homo sapiens
tggagggcgcttagatggaggg

SEQ ID NO: 7330060 - DNA, 19 bp, Homo sapiens
tggagaggaaatgctgctc

SEQ ID NO: 7330061 - DNA, 22 bp, Homo sapiens
tggagagatgtctgttcaaggt

SEQ ID NO: 7330062 - DNA, 22 bp, Homo sapiens
tggagcagaaatttgaagccat

SEQ ID NO: 7330063 - DNA, 22 bp, Homo sapiens
tggagcagcattcatccagcag

SEQ ID NO: 7330064 - DNA, 22 bp, Homo sapiens
tggagctgatacagctggcttt

SEQ ID NO: 7330065 - DNA, 18 bp, Homo sapiens
tggagctgagtgctgtgc

SEQ ID NO: 7330066 - DNA, 17 bp, Homo sapiens
tggagctgcgtgtgttc

SEQ ID NO: 7330067 - DNA, 21 bp, Homo sapiens
tggagctgccacttgtcctcc

SEQ ID NO: 7330068 - DNA, 22 bp, Homo sapiens
tggagctggaagacagtgatat

SEQ ID NO: 7330069 - DNA, 22 bp, Homo sapiens
tggagctggaatttgagctgga

SEQ ID NO: 7330070 - DNA, 22 bp, Homo sapiens
tggagcccaggtgcaagagagt

SEQ ID NO: 7330071 - DNA, 22 bp, Homo sapiens
tggagcccatgagccataccag

SEQ ID NO: 7330072 - DNA, 22 bp, Homo sapiens
tggagcccctcacccacacctg

SEQ ID NO: 7330073 - DNA, 22 bp, Homo sapiens
tggagcccaggagaggataaac

SEQ ID NO: 7330074 - DNA, 22 bp, Homo sapiens
tggagcccagggtgagaaggag

SEQ ID NO: 7330075 - DNA, 22 bp, Homo sapiens
tggagcccagacactggcattg

SEQ ID NO: 7330076 - DNA, 22 bp, Homo sapiens
tggagcccacggatgtcgcttt

SEQ ID NO: 7330077 - DNA, 22 bp, Homo sapiens
tggagctgaactttgaggccag

SEQ ID NO: 7330078 - DNA, 22 bp, Homo sapiens
tggagcctgtgtttctgcccag

SEQ ID NO: 7330079 - DNA, 18 bp, Homo sapiens
tggagcaggaagcctggc

SEQ ID NO: 7330080 - DNA, 22 bp, Homo sapiens
tgcttctttactataggcaatt

SEQ ID NO: 7330081 - DNA, 21 bp, Homo sapiens
tgctttatgggaaaaatgtca

SEQ ID NO: 7330082 - DNA, 22 bp, Homo sapiens
tgctttatcaaagctatagtga

SEQ ID NO: 7330083 - DNA, 22 bp, Homo sapiens
tgctttatcaaagctatagtga

SEQ ID NO: 7330084 - DNA, 22 bp, Homo sapiens
tgctttctttagctcctgagtc

SEQ ID NO: 7330085 - DNA, 22 bp, Homo sapiens
tgctttctgctctggaaacagg

SEQ ID NO: 7330086 - DNA, 22 bp, Homo sapiens
tgctttctgtttttcatataat

SEQ ID NO: 7330087 - DNA, 22 bp, Homo sapiens
tgctttattaagagagaaattt

SEQ ID NO: 7330088 - DNA, 18 bp, Homo sapiens
tgctttctagcttcagat

SEQ ID NO: 7330089 - DNA, 18 bp, Homo sapiens
tgctttctagcttcagat

SEQ ID NO: 7330090 - DNA, 22 bp, Homo sapiens
tgctttattcccttctgatgtg

SEQ ID NO: 7330091 - DNA, 21 bp, Homo sapiens
tgctttctaaaaatactattg

SEQ ID NO: 7330092 - DNA, 22 bp, Homo sapiens
tgctttattcgacatctggtag

SEQ ID NO: 7330093 - DNA, 22 bp, Homo sapiens
tggaaagggacttatgagttcc

SEQ ID NO: 7330094 - DNA, 22 bp, Homo sapiens
tggaagagaaaggagtggatct

SEQ ID NO: 7330095 - DNA, 22 bp, Homo sapiens
tggaagagaaaggagtggatct

SEQ ID NO: 7330096 - DNA, 22 bp, Homo sapiens
tggaagatcaaccaggattgac

SEQ ID NO: 7330097 - DNA, 22 bp, Homo sapiens
tggaagaggcccatgactgcct

SEQ ID NO: 7330098 - DNA, 20 bp, Homo sapiens
tggaagaggagatgcctctg

SEQ ID NO: 7330099 - DNA, 19 bp, Homo sapiens
tggaagaggaagggaaata

SEQ ID NO: 7330100 - DNA, 20 bp, Homo sapiens
tggaagaggagatgcctctg

SEQ ID NO: 7330101 - DNA, 22 bp, Homo sapiens
tggaagcatcacttcttgcctg

SEQ ID NO: 7330102 - DNA, 22 bp, Homo sapiens
tggaaggaagccaaggaaggtt

SEQ ID NO: 7330103 - DNA, 22 bp, Homo sapiens
tggaaggggagctggaaagggg

SEQ ID NO: 7330104 - DNA, 22 bp, Homo sapiens
tggaaggagactgggaagtgtg

SEQ ID NO: 7330105 - DNA, 16 bp, Homo sapiens
tggaaggggtctccgg

SEQ ID NO: 7330106 - DNA, 22 bp, Homo sapiens
tggaagggggaagacagctctg

SEQ ID NO: 7330107 - DNA, 22 bp, Homo sapiens
tggaaggggagttgttccacgt

SEQ ID NO: 7330108 - DNA, 23 bp, Homo sapiens
tggaagtgtcttgggtattccag

SEQ ID NO: 7330109 - DNA, 22 bp, Homo sapiens
tggaccctgaagcaacagggag

SEQ ID NO: 7330110 - DNA, 22 bp, Homo sapiens
tggactgaattgaagcaggaag

SEQ ID NO: 7330111 - DNA, 22 bp, Homo sapiens
tggacaggtgagtgactcaggg

SEQ ID NO: 7330112 - DNA, 22 bp, Homo sapiens
tggacaacatagtgagacctca

SEQ ID NO: 7330113 - DNA, 22 bp, Homo sapiens
tggacaggcaagcaagacatac

SEQ ID NO: 7330114 - DNA, 22 bp, Homo sapiens
tggacaggatctgagactgaga

SEQ ID NO: 7330115 - DNA, 22 bp, Homo sapiens
tgagtattttaagttctcaatc

SEQ ID NO: 7330116 - DNA, 22 bp, Homo sapiens
tgagtcacacatttcttcatac

SEQ ID NO: 7330117 - DNA, 22 bp, Homo sapiens
tgagtcactatcactttctctg

SEQ ID NO: 7330118 - DNA, 22 bp, Homo sapiens
tgaggtggctggatctcagcct

SEQ ID NO: 7330119 - DNA, 22 bp, Homo sapiens
tgaggtgggcttgtggatttgc

SEQ ID NO: 7330120 - DNA, 22 bp, Homo sapiens
tgaggtgggtgtcaggtcagag

SEQ ID NO: 7330121 - DNA, 22 bp, Homo sapiens
tgaggtgggtggcttctgttat

SEQ ID NO: 7330122 - DNA, 22 bp, Homo sapiens
tgaggtggcacacacttcctgc

SEQ ID NO: 7330123 - DNA, 22 bp, Homo sapiens
tgaggtggaaggatcctttgaa

SEQ ID NO: 7330124 - DNA, 22 bp, Homo sapiens
tgaggtggctagggaggcactc

SEQ ID NO: 7330125 - DNA, 22 bp, Homo sapiens
tgaggtggccgaggagcaggac

SEQ ID NO: 7330126 - DNA, 22 bp, Homo sapiens
tgaggtggtgctaatctctgct

SEQ ID NO: 7330127 - DNA, 22 bp, Homo sapiens
tgaggtggttactgtggtgctc

SEQ ID NO: 7330128 - DNA, 22 bp, Homo sapiens
tgaggtggtccaaagactgttt

SEQ ID NO: 7330129 - DNA, 22 bp, Homo sapiens
tgaggtggttcaagagccttgt

SEQ ID NO: 7330130 - DNA, 22 bp, Homo sapiens
tgaggtggtttgtatcactggg

SEQ ID NO: 7330131 - DNA, 22 bp, Homo sapiens
tgaggtaggataagacaatgag

SEQ ID NO: 7330132 - DNA, 22 bp, Homo sapiens
tgaggtaggagggtgatcagca

SEQ ID NO: 7330133 - DNA, 22 bp, Homo sapiens
tgaggtagctgtttagaaagac

SEQ ID NO: 7330134 - DNA, 22 bp, Homo sapiens
tgagggagagggcgaaaatgaa

SEQ ID NO: 7330135 - DNA, 22 bp, Homo sapiens
tgagggagcacacactgaagtg

SEQ ID NO: 7330136 - DNA, 22 bp, Homo sapiens
tgagggagtcatgattaaggaa

SEQ ID NO: 7330137 - DNA, 22 bp, Homo sapiens
tgaggggcagagaggtgtccag

SEQ ID NO: 7330138 - DNA, 22 bp, Homo sapiens
tgaggggaggttggggcacatc

SEQ ID NO: 7330139 - DNA, 22 bp, Homo sapiens
tgaggcctgtcattgtcttgtt

SEQ ID NO: 7330140 - DNA, 20 bp, Homo sapiens
tgaggcaggagaatggcatg

SEQ ID NO: 7330141 - DNA, 22 bp, Homo sapiens
tgaggcaggagaatcaccggaa

SEQ ID NO: 7330142 - DNA, 22 bp, Homo sapiens
tgaggcaggagaatcacatgaa

SEQ ID NO: 7330143 - DNA, 22 bp, Homo sapiens
tgaggcaggacttgcataaagt

SEQ ID NO: 7330144 - DNA, 22 bp, Homo sapiens
tgaggcaggactgagcgggatg

SEQ ID NO: 7330145 - DNA, 22 bp, Homo sapiens
tgaggcagaaaatagcagttca

SEQ ID NO: 7330146 - DNA, 22 bp, Homo sapiens
tgaggcagctttttctgtgtgt

SEQ ID NO: 7330147 - DNA, 22 bp, Homo sapiens
tgaggcaggaagttatataatg

SEQ ID NO: 7330148 - DNA, 22 bp, Homo sapiens
tgaggcaggacatggacaactg

SEQ ID NO: 7330149 - DNA, 22 bp, Homo sapiens
tgaggcaggaatggggaaaagt

SEQ ID NO: 7330150 - DNA, 21 bp, Homo sapiens
tgaggatgtgcagcagcagga

SEQ ID NO: 7330151 - DNA, 22 bp, Homo sapiens
tgaggaagttgatctcatcagt

SEQ ID NO: 7330152 - DNA, 22 bp, Homo sapiens
tgaggaagtggttgtatggttt

SEQ ID NO: 7330153 - DNA, 22 bp, Homo sapiens
tgaggaagttgatctcatcagt

SEQ ID NO: 7330154 - DNA, 22 bp, Homo sapiens
tgaggaagtggttgtatggttt

SEQ ID NO: 7330155 - DNA, 23 bp, Homo sapiens
tgaggaagtaattgtaaaggtct

SEQ ID NO: 7330156 - DNA, 23 bp, Homo sapiens
tgaggaagtaattgtaaaggtct

SEQ ID NO: 7330157 - DNA, 18 bp, Homo sapiens
tgaggaaggggaagtatt

SEQ ID NO: 7330158 - DNA, 22 bp, Homo sapiens
tgaggaagggcacacggaccct

SEQ ID NO: 7330159 - DNA, 22 bp, Homo sapiens
tgaggaagggtgtgacggcacc

SEQ ID NO: 7330160 - DNA, 22 bp, Homo sapiens
tgaggaagccaaacagctacac

SEQ ID NO: 7330161 - DNA, 22 bp, Homo sapiens
tgaggaagccaaacagctacac

SEQ ID NO: 7330162 - DNA, 22 bp, Homo sapiens
tgaggaagcaaaggcttgtgtg

SEQ ID NO: 7330163 - DNA, 22 bp, Homo sapiens
tgaggagcttctggaaagtgca

SEQ ID NO: 7330164 - DNA, 23 bp, Homo sapiens
tgaggagcatagctgactgacag

SEQ ID NO: 7330165 - DNA, 22 bp, Homo sapiens
tgaggagcgggcagggatgcag

SEQ ID NO: 7330166 - DNA, 22 bp, Homo sapiens
tgaggaggtgggcacacagagt

SEQ ID NO: 7330167 - DNA, 22 bp, Homo sapiens
tgaggatggtgttggagagggc

SEQ ID NO: 7330168 - DNA, 22 bp, Homo sapiens
tgaggagtcgagaaggggtaat

SEQ ID NO: 7330169 - DNA, 22 bp, Homo sapiens
tgaggcctcatttagggagagg

SEQ ID NO: 7330170 - DNA, 22 bp, Homo sapiens
tgaggcctgcattgaactagaa

SEQ ID NO: 7330171 - DNA, 22 bp, Homo sapiens
tgaggcaggagttaatgtgctc

SEQ ID NO: 7330172 - DNA, 22 bp, Homo sapiens
tgaggcaggaggttgagaactg

SEQ ID NO: 7330173 - DNA, 22 bp, Homo sapiens
tgaggcaggagaatggcgggaa

SEQ ID NO: 7330174 - DNA, 22 bp, Homo sapiens
tgaggcaggaggattgcaggat

SEQ ID NO: 7330175 - DNA, 22 bp, Homo sapiens
tgaggcaggatgcttgcacagg

SEQ ID NO: 7330176 - DNA, 23 bp, Homo sapiens
tgaggcaggcggatcacgaggtc

SEQ ID NO: 7330177 - DNA, 22 bp, Homo sapiens
tgaggcaggagttcaggctgcg

SEQ ID NO: 7330178 - DNA, 22 bp, Homo sapiens
tgaggcagttcttacttgtatt

SEQ ID NO: 7330179 - DNA, 22 bp, Homo sapiens
tgaggcagttgagcttcctgag

SEQ ID NO: 7330180 - DNA, 21 bp, Homo sapiens
tgaggcaggggtgcttttgtc

SEQ ID NO: 7330181 - DNA, 22 bp, Homo sapiens
tgaggcagggagtttaattgtc

SEQ ID NO: 7330182 - DNA, 22 bp, Homo sapiens
tgaggcagggagagtggatatg

SEQ ID NO: 7330183 - DNA, 22 bp, Homo sapiens
tgagaattttttgtcatgcatt

SEQ ID NO: 7330184 - DNA, 22 bp, Homo sapiens
tgagaatttgcatttctaacaa

SEQ ID NO: 7330185 - DNA, 22 bp, Homo sapiens
tgagacagcctctgcactcatg

SEQ ID NO: 7330186 - DNA, 22 bp, Homo sapiens
tgagacaggcttccttcttggg

SEQ ID NO: 7330187 - DNA, 22 bp, Homo sapiens
tgagacaggagaggcccctcct

SEQ ID NO: 7330188 - DNA, 18 bp, Homo sapiens
tgagacagctaccacttg

SEQ ID NO: 7330189 - DNA, 22 bp, Homo sapiens
tgagacagtatcgccccaaggc

SEQ ID NO: 7330190 - DNA, 22 bp, Homo sapiens
tgagacagggtcttgctctgtt

SEQ ID NO: 7330191 - DNA, 17 bp, Homo sapiens
tgagacagggcaggccc

SEQ ID NO: 7330192 - DNA, 22 bp, Homo sapiens
tgagaaatggcagcattactgg

SEQ ID NO: 7330193 - DNA, 22 bp, Homo sapiens
tgagaaaggtatttcatgcact

SEQ ID NO: 7330194 - DNA, 22 bp, Homo sapiens
tgagaaacttgccaagcatctc

SEQ ID NO: 7330195 - DNA, 22 bp, Homo sapiens
tgagaacagttggaagcagtca

SEQ ID NO: 7330196 - DNA, 22 bp, Homo sapiens
tgagcaaagggatgaatcactg

SEQ ID NO: 7330197 - DNA, 22 bp, Homo sapiens
tgagatcattgacttgttcctg

SEQ ID NO: 7330198 - DNA, 22 bp, Homo sapiens
tgagatgaataactcctgctaa

SEQ ID NO: 7330199 - DNA, 22 bp, Homo sapiens
tgagagagcgcctgggatcatt

SEQ ID NO: 7330200 - DNA, 22 bp, Homo sapiens
tgagcctgtcattattcagaga

SEQ ID NO: 7330201 - DNA, 22 bp, Homo sapiens
tgagcctgcaataagcacagcc

SEQ ID NO: 7330202 - DNA, 23 bp, Homo sapiens
tgagcctgctgatagacacaatt

SEQ ID NO: 7330203 - DNA, 22 bp, Homo sapiens
tgagcctggcctgcagagacca

SEQ ID NO: 7330204 - DNA, 22 bp, Homo sapiens
tgagcctggagcccagatgttt

SEQ ID NO: 7330205 - DNA, 22 bp, Homo sapiens
tgagccctacctgctcatctcc

SEQ ID NO: 7330206 - DNA, 22 bp, Homo sapiens
tgagctgtaaggctgtcactga

SEQ ID NO: 7330207 - DNA, 22 bp, Homo sapiens
tgagctgtcaaggtacagtgaa

SEQ ID NO: 7330208 - DNA, 22 bp, Homo sapiens
tgagcagggactttggagtctg

SEQ ID NO: 7330209 - DNA, 22 bp, Homo sapiens
tgagcagggactttgagtgtag

SEQ ID NO: 7330210 - DNA, 22 bp, Homo sapiens
tgagcaggactgaccggcctta

SEQ ID NO: 7330211 - DNA, 22 bp, Homo sapiens
tgagcaggactcactgcagcct

SEQ ID NO: 7330212 - DNA, 22 bp, Homo sapiens
tgagcaggactgaccggcctta

SEQ ID NO: 7330213 - DNA, 22 bp, Homo sapiens
tgagcaggattcgcctcttgca

SEQ ID NO: 7330214 - DNA, 21 bp, Homo sapiens
tgagcaggagtcatgggaatg

SEQ ID NO: 7330215 - DNA, 22 bp, Homo sapiens
tgagcaggagataaacaggtag

SEQ ID NO: 7330216 - DNA, 22 bp, Homo sapiens
tgagcaggattcgcctcttgca

SEQ ID NO: 7330217 - DNA, 22 bp, Homo sapiens
tgagcaggcaaacaatggttat

SEQ ID NO: 7330218 - DNA, 22 bp, Homo sapiens
tgagcaggctcccacttcagtg

SEQ ID NO: 7330219 - DNA, 22 bp, Homo sapiens
tgagcaggcgcagcaggaggtc

SEQ ID NO: 7330220 - DNA, 22 bp, Homo sapiens
tgaaggctgggctcagccagct

SEQ ID NO: 7330221 - DNA, 22 bp, Homo sapiens
tgaaggctttttaaagcatttg

SEQ ID NO: 7330222 - DNA, 22 bp, Homo sapiens
tgaagcccctaagtcccaggca

SEQ ID NO: 7330223 - DNA, 22 bp, Homo sapiens
tgaagccatccctcagatggcc

SEQ ID NO: 7330224 - DNA, 22 bp, Homo sapiens
tgaagccaatctgccaggcaga

SEQ ID NO: 7330225 - DNA, 22 bp, Homo sapiens
tgaagccacagagcatctgcct

SEQ ID NO: 7330226 - DNA, 22 bp, Homo sapiens
tgaagccaaggatgcctttctc

SEQ ID NO: 7330227 - DNA, 22 bp, Homo sapiens
tgaagccaccgaaccagaagag

SEQ ID NO: 7330228 - DNA, 22 bp, Homo sapiens
tgaagccactttccagaatcac

SEQ ID NO: 7330229 - DNA, 22 bp, Homo sapiens
tgaagccagggactgacacttc

SEQ ID NO: 7330230 - DNA, 21 bp, Homo sapiens
tgaagccaggatcacgattct

SEQ ID NO: 7330231 - DNA, 22 bp, Homo sapiens
tgaagcttgagtgtcagttcct

SEQ ID NO: 7330232 - DNA, 21 bp, Homo sapiens
tgaatttccctctatcattct

SEQ ID NO: 7330233 - DNA, 22 bp, Homo sapiens
tgaattgggcctggaaactggt

SEQ ID NO: 7330234 - DNA, 22 bp, Homo sapiens
tgaattgtgacccctctgtatt

SEQ ID NO: 7330235 - DNA, 22 bp, Homo sapiens
tgaattcaggttgacgttgcca

SEQ ID NO: 7330236 - DNA, 22 bp, Homo sapiens
tgaattcataggacacagggtg

SEQ ID NO: 7330237 - DNA, 20 bp, Homo sapiens
tgacacaaattgctttctca

SEQ ID NO: 7330238 - DNA, 22 bp, Homo sapiens
tgaattacatccatggacacac

SEQ ID NO: 7330239 - DNA, 22 bp, Homo sapiens
tgaatgtgatgctaaacatatg

SEQ ID NO: 7330240 - DNA, 22 bp, Homo sapiens
tgaatccagagctatttcgtcc

SEQ ID NO: 7330241 - DNA, 19 bp, Homo sapiens
tgaatacagagatacagaa

SEQ ID NO: 7330242 - DNA, 22 bp, Homo sapiens
tgaatacactaaaaatcacttt

SEQ ID NO: 7330243 - DNA, 21 bp, Homo sapiens
tgactgaggcttcttcacaca

SEQ ID NO: 7330244 - DNA, 22 bp, Homo sapiens
tgacatttatcaaagaaatggt

SEQ ID NO: 7330245 - DNA, 18 bp, Homo sapiens
tgacatttccagagtgta

SEQ ID NO: 7330246 - DNA, 22 bp, Homo sapiens
tgaaatcagtatgtctttctca

SEQ ID NO: 7330247 - DNA, 22 bp, Homo sapiens
tgaaataacttttgggtgagtt

SEQ ID NO: 7330248 - DNA, 22 bp, Homo sapiens
tgaagaaacgcagagaggtagg

SEQ ID NO: 7330249 - DNA, 22 bp, Homo sapiens
tgaagcaagtctattgccctgg

SEQ ID NO: 7330250 - DNA, 22 bp, Homo sapiens
tgaagcaacaagtctggcccca

SEQ ID NO: 7330251 - DNA, 22 bp, Homo sapiens
tgaaattccaggagagttaaaa

SEQ ID NO: 7330252 - DNA, 22 bp, Homo sapiens
tgaactcctgacctcatgatcc

SEQ ID NO: 7330253 - DNA, 22 bp, Homo sapiens
tgaaacatttgatgatctttgg

SEQ ID NO: 7330254 - DNA, 22 bp, Homo sapiens
tgaaacattgcactgtatgaat

SEQ ID NO: 7330255 - DNA, 22 bp, Homo sapiens
tgaaacattatagaatatttat

SEQ ID NO: 7330256 - DNA, 22 bp, Homo sapiens
tgaaacataaagttatcttcag

SEQ ID NO: 7330257 - DNA, 22 bp, Homo sapiens
tgaaaatttccatcagttatat

SEQ ID NO: 7330258 - DNA, 22 bp, Homo sapiens
tgaaaaaacaagttggcccatt

SEQ ID NO: 7330259 - DNA, 22 bp, Homo sapiens
tcttttatagtgaattttcttg

SEQ ID NO: 7330260 - DNA, 22 bp, Homo sapiens
tgcccaggctggagtgcagagg

SEQ ID NO: 7330261 - DNA, 22 bp, Homo sapiens
tgcccaggcttcaccctcagag

SEQ ID NO: 7330262 - DNA, 19 bp, Homo sapiens
tgcccccagcacctccctg

SEQ ID NO: 7330263 - DNA, 22 bp, Homo sapiens
tgccccctggtggccagagccg

SEQ ID NO: 7330264 - DNA, 22 bp, Homo sapiens
tgcccccttttcttgttacact

SEQ ID NO: 7330265 - DNA, 22 bp, Homo sapiens
tgcccaggtttgagtgcccaag

SEQ ID NO: 7330266 - DNA, 22 bp, Homo sapiens
tgcccagggtttctaagagcag

SEQ ID NO: 7330267 - DNA, 22 bp, Homo sapiens
tgcccaggtttgagtgcccaag

SEQ ID NO: 7330268 - DNA, 22 bp, Homo sapiens
tgccatttgccccagcactgtc

SEQ ID NO: 7330269 - DNA, 22 bp, Homo sapiens
tgccatttacgagcagtatgac

SEQ ID NO: 7330270 - DNA, 22 bp, Homo sapiens
tgccagtatagttaaggtctta

SEQ ID NO: 7330271 - DNA, 22 bp, Homo sapiens
tgccaggatggccagggggcca

SEQ ID NO: 7330272 - DNA, 22 bp, Homo sapiens
tgcctagtagggttgttgtagg

SEQ ID NO: 7330273 - DNA, 22 bp, Homo sapiens
tgccctgggacatgcagcggag

SEQ ID NO: 7330274 - DNA, 22 bp, Homo sapiens
tgccctgggaacacagatgcca

SEQ ID NO: 7330275 - DNA, 22 bp, Homo sapiens
tgccctggctcctcccacgctg

SEQ ID NO: 7330276 - DNA, 22 bp, Homo sapiens
tgccctggcacacacacagctg

SEQ ID NO: 7330277 - DNA, 22 bp, Homo sapiens
tgccctggatgctgcaggtgtg

SEQ ID NO: 7330278 - DNA, 22 bp, Homo sapiens
tgccctggaaccatctacagtc

SEQ ID NO: 7330279 - DNA, 22 bp, Homo sapiens
tgccctggaggggcttacagtc

SEQ ID NO: 7330280 - DNA, 22 bp, Homo sapiens
tgcctgccatgcagaaagctga

SEQ ID NO: 7330281 - DNA, 22 bp, Homo sapiens
tgcctggcaatgccagaagcca

SEQ ID NO: 7330282 - DNA, 22 bp, Homo sapiens
tgcctggcactcctggagctca

SEQ ID NO: 7330283 - DNA, 22 bp, Homo sapiens
tgcctcagtctaaagtctctca

SEQ ID NO: 7330284 - DNA, 19 bp, Homo sapiens
tgcctcagggctttgagga

SEQ ID NO: 7330285 - DNA, 22 bp, Homo sapiens
tgcaggtgtggttcctcagcca

SEQ ID NO: 7330286 - DNA, 20 bp, Homo sapiens
tgcaggtgttggagaaggta

SEQ ID NO: 7330287 - DNA, 22 bp, Homo sapiens
tgcaggctcttggtgacgtggg

SEQ ID NO: 7330288 - DNA, 22 bp, Homo sapiens
tgcaggctctgtgtgtgcctgg

SEQ ID NO: 7330289 - DNA, 22 bp, Homo sapiens
tgcaggctccatgaggacaggc

SEQ ID NO: 7330290 - DNA, 22 bp, Homo sapiens
tgcaggctggggaggcagactt

SEQ ID NO: 7330291 - DNA, 22 bp, Homo sapiens
tgcaggctgggaagagggacaa

SEQ ID NO: 7330292 - DNA, 22 bp, Homo sapiens
tgcaggctggcagtgctgaaat

SEQ ID NO: 7330293 - DNA, 21 bp, Homo sapiens
tgcaggctgtgcgctcctgcc

SEQ ID NO: 7330294 - DNA, 21 bp, Homo sapiens
tgcaggctgtttaagaggcaa

SEQ ID NO: 7330295 - DNA, 17 bp, Homo sapiens
tgcaggctgttatagcc

SEQ ID NO: 7330296 - DNA, 22 bp, Homo sapiens
tgcatcatataatgtctatgga

SEQ ID NO: 7330297 - DNA, 22 bp, Homo sapiens
tgcatcagagtttgctgctgct

SEQ ID NO: 7330298 - DNA, 18 bp, Homo sapiens
tgcatcatttatgggtca

SEQ ID NO: 7330299 - DNA, 22 bp, Homo sapiens
tgcatctgcctggagtagcgcc

SEQ ID NO: 7330300 - DNA, 22 bp, Homo sapiens
tgcatccttaaccagcatcact

SEQ ID NO: 7330301 - DNA, 20 bp, Homo sapiens
tgcatacgtatgtatttgga

SEQ ID NO: 7330302 - DNA, 19 bp, Homo sapiens
tgcatacatgttaacatgt

SEQ ID NO: 7330303 - DNA, 22 bp, Homo sapiens
tgcatagtcgctctgtgcttca

SEQ ID NO: 7330304 - DNA, 22 bp, Homo sapiens
tgcatacacaagcatacatgta

SEQ ID NO: 7330305 - DNA, 22 bp, Homo sapiens
tgcatgctctgtagaaagcagg

SEQ ID NO: 7330306 - DNA, 23 bp, Homo sapiens
tgcatgctaacacagtgcacagg

SEQ ID NO: 7330307 - DNA, 17 bp, Homo sapiens
tgcatgcgtctgtgata

SEQ ID NO: 7330308 - DNA, 22 bp, Homo sapiens
tgcatgcgttagttggcgtgtt

SEQ ID NO: 7330309 - DNA, 22 bp, Homo sapiens
tgcatctttttccaagtttatt

SEQ ID NO: 7330310 - DNA, 22 bp, Homo sapiens
tgcatttaagaaaacatgagtc

SEQ ID NO: 7330311 - DNA, 22 bp, Homo sapiens
tgcattgcagttaactcagtat

SEQ ID NO: 7330312 - DNA, 22 bp, Homo sapiens
tgcattgcatagcatgcaccaa

SEQ ID NO: 7330313 - DNA, 22 bp, Homo sapiens
tgcattcttggaagaagctctc

SEQ ID NO: 7330314 - DNA, 22 bp, Homo sapiens
tgcatttagttttaataaagga

SEQ ID NO: 7330315 - DNA, 22 bp, Homo sapiens
tgccagactctggggtgctaga

SEQ ID NO: 7330316 - DNA, 22 bp, Homo sapiens
tgccagactttaatttgatgat

SEQ ID NO: 7330317 - DNA, 22 bp, Homo sapiens
tgccagactttcttaccagtgt

SEQ ID NO: 7330318 - DNA, 22 bp, Homo sapiens
tgccacctcctctaacaagtgg

SEQ ID NO: 7330319 - DNA, 22 bp, Homo sapiens
tgccacctagtggtctttagtc

SEQ ID NO: 7330320 - DNA, 22 bp, Homo sapiens
tgccagcacttctggctgtctg

SEQ ID NO: 7330321 - DNA, 21 bp, Homo sapiens
tgccagcatgtaggctagttg

SEQ ID NO: 7330322 - DNA, 22 bp, Homo sapiens
tgagtgaggtgcttagggcaca

SEQ ID NO: 7330323 - DNA, 22 bp, Homo sapiens
tgagtggacacctgcttcttta

SEQ ID NO: 7330324 - DNA, 22 bp, Homo sapiens
tgatgcgtctcctctttcaggt

SEQ ID NO: 7330325 - DNA, 22 bp, Homo sapiens
tgattacacaccacagtgctcc

SEQ ID NO: 7330326 - DNA, 22 bp, Homo sapiens
tgattacaattgtcttagattt

SEQ ID NO: 7330327 - DNA, 22 bp, Homo sapiens
tgattacaacagagtcatccat

SEQ ID NO: 7330328 - DNA, 22 bp, Homo sapiens
tgattaaattaattaagatgag

SEQ ID NO: 7330329 - DNA, 22 bp, Homo sapiens
tgattaaaggtggaaggcaggt

SEQ ID NO: 7330330 - DNA, 23 bp, Homo sapiens
tgcaagagttccaaactgttcaa

SEQ ID NO: 7330331 - DNA, 22 bp, Homo sapiens
tgcaagagggtgttcagtttgt

SEQ ID NO: 7330332 - DNA, 22 bp, Homo sapiens
tgcaagaggtaaaatgaaagga

SEQ ID NO: 7330333 - DNA, 22 bp, Homo sapiens
tgcaagaggtaaaatgaaagga

SEQ ID NO: 7330334 - DNA, 22 bp, Homo sapiens
tgcaagaggttggattttaaga

SEQ ID NO: 7330335 - DNA, 22 bp, Homo sapiens
tgcaagaggcatcttttaaaaa

SEQ ID NO: 7330336 - DNA, 22 bp, Homo sapiens
tgcaagaggagactgtactcag

SEQ ID NO: 7330337 - DNA, 22 bp, Homo sapiens
tgcaagaggattgtatcaataa

SEQ ID NO: 7330338 - DNA, 22 bp, Homo sapiens
tgcaagaggaattctagaagca

SEQ ID NO: 7330339 - DNA, 22 bp, Homo sapiens
tgcaagagctgtggcaaaagca

SEQ ID NO: 7330340 - DNA, 22 bp, Homo sapiens
tgcaagagcccagggccaggaa

SEQ ID NO: 7330341 - DNA, 22 bp, Homo sapiens
tgcaagagcccaccacacactt

SEQ ID NO: 7330342 - DNA, 22 bp, Homo sapiens
tgcaagagcccaccacacactt

SEQ ID NO: 7330343 - DNA, 22 bp, Homo sapiens
tgcaagagcccaaactatatac

SEQ ID NO: 7330344 - DNA, 22 bp, Homo sapiens
tgcaagagacatgggttgtgtg

SEQ ID NO: 7330345 - DNA, 22 bp, Homo sapiens
tgcaagagattcaaaccataaa

SEQ ID NO: 7330346 - DNA, 22 bp, Homo sapiens
tgcaagagacagacatgactca

SEQ ID NO: 7330347 - DNA, 22 bp, Homo sapiens
tgcaagagcagaaagaactgag

SEQ ID NO: 7330348 - DNA, 22 bp, Homo sapiens
tgcaaatttgacttcacacatc

SEQ ID NO: 7330349 - DNA, 22 bp, Homo sapiens
tgcaacagtggggcatgctgaa

SEQ ID NO: 7330350 - DNA, 22 bp, Homo sapiens
tgcaatttcaaatatcagaaag

SEQ ID NO: 7330351 - DNA, 22 bp, Homo sapiens
tgcaatttgacgtcagcacagt

SEQ ID NO: 7330352 - DNA, 22 bp, Homo sapiens
tgcaattatgggcaatttttaa

SEQ ID NO: 7330353 - DNA, 22 bp, Homo sapiens
tgcaaatgagttgcagatcagg

SEQ ID NO: 7330354 - DNA, 22 bp, Homo sapiens
tgcaaatgcccatttattttct

SEQ ID NO: 7330355 - DNA, 22 bp, Homo sapiens
tgcaaatgggcatctccaagtg

SEQ ID NO: 7330356 - DNA, 22 bp, Homo sapiens
tgcaaaacttctcagagccttt

SEQ ID NO: 7330357 - DNA, 22 bp, Homo sapiens
tgcaaaaagagcgaggagccct

SEQ ID NO: 7330358 - DNA, 22 bp, Homo sapiens
tgatttaccagttactatcttg

SEQ ID NO: 7330359 - DNA, 22 bp, Homo sapiens
tgcacaggtgagactcaggaag

SEQ ID NO: 7330360 - DNA, 21 bp, Homo sapiens
tgcactttgggggacaggctg

SEQ ID NO: 7330361 - DNA, 22 bp, Homo sapiens
tgcacgtgtgagcattcacatg

SEQ ID NO: 7330362 - DNA, 22 bp, Homo sapiens
tgcagccatcgcagagtctgta

SEQ ID NO: 7330363 - DNA, 22 bp, Homo sapiens
tgcagccatctttcttggagga

SEQ ID NO: 7330364 - DNA, 21 bp, Homo sapiens
tgcagccattcagccctatgc

SEQ ID NO: 7330365 - DNA, 22 bp, Homo sapiens
tgcaggagacataatagggact

SEQ ID NO: 7330366 - DNA, 22 bp, Homo sapiens
tgcaggagagtgagtcagtagg

SEQ ID NO: 7330367 - DNA, 22 bp, Homo sapiens
tgcaggagagctggtctggccc

SEQ ID NO: 7330368 - DNA, 22 bp, Homo sapiens
tgcaggagcaccagctcaccct

SEQ ID NO: 7330369 - DNA, 22 bp, Homo sapiens
tgcaggagcagagatggctgga

SEQ ID NO: 7330370 - DNA, 18 bp, Homo sapiens
tgcaggagtgaccccggc

SEQ ID NO: 7330371 - DNA, 21 bp, Homo sapiens
tgcaggagtgtaatgtgaccc

SEQ ID NO: 7330372 - DNA, 22 bp, Homo sapiens
tgcaggagttcccctctgcctg

SEQ ID NO: 7330373 - DNA, 21 bp, Homo sapiens
tgcaggagtctgtgagtcagg

SEQ ID NO: 7330374 - DNA, 22 bp, Homo sapiens
tgcaggagtccaatcaggagac

SEQ ID NO: 7330375 - DNA, 22 bp, Homo sapiens
tgcaggagcccttgggctctgg

SEQ ID NO: 7330376 - DNA, 22 bp, Homo sapiens
tgcaggagccttggacttgaaa

SEQ ID NO: 7330377 - DNA, 22 bp, Homo sapiens
tgcaggagcttggctctgtccc

SEQ ID NO: 7330378 - DNA, 22 bp, Homo sapiens
tgcaggagctgtgcggtgaggg

SEQ ID NO: 7330379 - DNA, 19 bp, Homo sapiens
tgcaggaggactgagcaga

SEQ ID NO: 7330380 - DNA, 19 bp, Homo sapiens
tctctgccgatcagggccc

SEQ ID NO: 7330381 - DNA, 20 bp, Homo sapiens
tctctggccagaaacaacag

SEQ ID NO: 7330382 - DNA, 22 bp, Homo sapiens
tctctttgtctgctcttagttg

SEQ ID NO: 7330383 - DNA, 22 bp, Homo sapiens
tctctttaagtataatcttata

SEQ ID NO: 7330384 - DNA, 22 bp, Homo sapiens
tctgaaattgttagtaaaaatg

SEQ ID NO: 7330385 - DNA, 22 bp, Homo sapiens
tctgaaatggggctgaagcact

SEQ ID NO: 7330386 - DNA, 22 bp, Homo sapiens
tctctgtgacagctgggtatgt

SEQ ID NO: 7330387 - DNA, 22 bp, Homo sapiens
tctctgtgcaggatgctgagtt

SEQ ID NO: 7330388 - DNA, 22 bp, Homo sapiens
tctctgtgcccagtagttctct

SEQ ID NO: 7330389 - DNA, 22 bp, Homo sapiens
tctctgtggagcagtgtgttca

SEQ ID NO: 7330390 - DNA, 22 bp, Homo sapiens
tctctgtggcaagcatgctgct

SEQ ID NO: 7330391 - DNA, 22 bp, Homo sapiens
tctctgtgtctcatgttcctat

SEQ ID NO: 7330392 - DNA, 21 bp, Homo sapiens
tctctgtgtacagtctcaccc

SEQ ID NO: 7330393 - DNA, 22 bp, Homo sapiens
tctctgtgggtttcaccagcgc

SEQ ID NO: 7330394 - DNA, 20 bp, Homo sapiens
tctcttcaggaggtccatgt

SEQ ID NO: 7330395 - DNA, 22 bp, Homo sapiens
tctcttcatagtgacacccatc

SEQ ID NO: 7330396 - DNA, 22 bp, Homo sapiens
tctccagggactgaggctggag

SEQ ID NO: 7330397 - DNA, 22 bp, Homo sapiens
tctccaggggcagggtctggag

SEQ ID NO: 7330398 - DNA, 22 bp, Homo sapiens
tctccaggtgctaagtgtgcct

SEQ ID NO: 7330399 - DNA, 22 bp, Homo sapiens
tctcgatctcctgaccttgtga

SEQ ID NO: 7330400 - DNA, 22 bp, Homo sapiens
tctcctttctggagcctgctca

SEQ ID NO: 7330401 - DNA, 22 bp, Homo sapiens
tctcctggtatgtatgcacctg

SEQ ID NO: 7330402 - DNA, 22 bp, Homo sapiens
tctcctgggtgctttatcagaa

SEQ ID NO: 7330403 - DNA, 22 bp, Homo sapiens
tctcctgggtaaaagggttgat

SEQ ID NO: 7330404 - DNA, 18 bp, Homo sapiens
tctcctgggtaggggcct

SEQ ID NO: 7330405 - DNA, 21 bp, Homo sapiens
tctcctgggtccaacccatgc

SEQ ID NO: 7330406 - DNA, 20 bp, Homo sapiens
tctcctggtctggtccgtgc

SEQ ID NO: 7330407 - DNA, 22 bp, Homo sapiens
tctcctggtcacctcagaagtc

SEQ ID NO: 7330408 - DNA, 21 bp, Homo sapiens
tctcctcccggggagaggccg

SEQ ID NO: 7330409 - DNA, 22 bp, Homo sapiens
tctcctcccaggctcttccagg

SEQ ID NO: 7330410 - DNA, 22 bp, Homo sapiens
tctcctctgtgccacagcttgg

SEQ ID NO: 7330411 - DNA, 22 bp, Homo sapiens
tctcctggccctgtcgccatct

SEQ ID NO: 7330412 - DNA, 22 bp, Homo sapiens
tctcctggcatgtgggtcatct

SEQ ID NO: 7330413 - DNA, 22 bp, Homo sapiens
tctcctggatggaccttctctt

SEQ ID NO: 7330414 - DNA, 22 bp, Homo sapiens
tctcctggagcaggaaggtggg

SEQ ID NO: 7330415 - DNA, 22 bp, Homo sapiens
tctcctggagcccagatgctgg

SEQ ID NO: 7330416 - DNA, 22 bp, Homo sapiens
tctcctggaagaataccacact

SEQ ID NO: 7330417 - DNA, 22 bp, Homo sapiens
tctcctgctcccaactgctgca

SEQ ID NO: 7330418 - DNA, 22 bp, Homo sapiens
tctcctgcagtcagcagtctca

SEQ ID NO: 7330419 - DNA, 18 bp, Homo sapiens
tctcattacaatctttgt

SEQ ID NO: 7330420 - DNA, 22 bp, Homo sapiens
tctcattcataccctacatgct

SEQ ID NO: 7330421 - DNA, 22 bp, Homo sapiens
tctcatttgcctcatctataaa

SEQ ID NO: 7330422 - DNA, 22 bp, Homo sapiens
tctcatttggctttgttttaaa

SEQ ID NO: 7330423 - DNA, 19 bp, Homo sapiens
tctccaaaaccaatcacta

SEQ ID NO: 7330424 - DNA, 22 bp, Homo sapiens
tctccaggcacttggctgctac

SEQ ID NO: 7330425 - DNA, 22 bp, Homo sapiens
tctccaaatcaatcaatatgaa

SEQ ID NO: 7330426 - DNA, 22 bp, Homo sapiens
tctcataatagcatttctcacc

SEQ ID NO: 7330427 - DNA, 19 bp, Homo sapiens
tctcatccagcattcaaga

SEQ ID NO: 7330428 - DNA, 22 bp, Homo sapiens
tctcatctcaaattgtaatccc

SEQ ID NO: 7330429 - DNA, 22 bp, Homo sapiens
tctcatctccattatagcatca

SEQ ID NO: 7330430 - DNA, 22 bp, Homo sapiens
tctcatctagactctgcccttg

SEQ ID NO: 7330431 - DNA, 22 bp, Homo sapiens
tctcatctattcacattaactg

SEQ ID NO: 7330432 - DNA, 22 bp, Homo sapiens
tctcatctttaaatgaaaattt

SEQ ID NO: 7330433 - DNA, 22 bp, Homo sapiens
tctcatcttgttcatctaccct

SEQ ID NO: 7330434 - DNA, 22 bp, Homo sapiens
tctcatctgcgagctctgccag

SEQ ID NO: 7330435 - DNA, 22 bp, Homo sapiens
tctcatcttcattgtctcccat

SEQ ID NO: 7330436 - DNA, 22 bp, Homo sapiens
tctcatcttcatatctgaaaga

SEQ ID NO: 7330437 - DNA, 22 bp, Homo sapiens
tctcatctgccatttgcaggag

SEQ ID NO: 7330438 - DNA, 22 bp, Homo sapiens
tctcatctcggatcagaagtga

SEQ ID NO: 7330439 - DNA, 21 bp, Homo sapiens
tctcatctcctgacctgtgcc

SEQ ID NO: 7330440 - DNA, 23 bp, Homo sapiens
tctcagggtggctgggcccatcc

SEQ ID NO: 7330441 - DNA, 22 bp, Homo sapiens
tctcagggcgcagtgaggcagt

SEQ ID NO: 7330442 - DNA, 22 bp, Homo sapiens
tctaaagtatgctaatatgtga

SEQ ID NO: 7330443 - DNA, 22 bp, Homo sapiens
tctaaattactttgggcagtat

SEQ ID NO: 7330444 - DNA, 21 bp, Homo sapiens
tctaattgtaaatgaggctgt

SEQ ID NO: 7330445 - DNA, 22 bp, Homo sapiens
tctaattgaatctaagcatgtt

SEQ ID NO: 7330446 - DNA, 22 bp, Homo sapiens
tctacaaagccattcaggatct

SEQ ID NO: 7330447 - DNA, 23 bp, Homo sapiens
tctacaaagctgtgtcaggaccc

SEQ ID NO: 7330448 - DNA, 22 bp, Homo sapiens
tctactgccacttaagacattt

SEQ ID NO: 7330449 - DNA, 22 bp, Homo sapiens
tctaggaatttcatctagttct

SEQ ID NO: 7330450 - DNA, 22 bp, Homo sapiens
tctaggaacctgacatctctca

SEQ ID NO: 7330451 - DNA, 22 bp, Homo sapiens
tctaggaaataatgactcatcc

SEQ ID NO: 7330452 - DNA, 22 bp, Homo sapiens
tctagctgagggtaggagacct

SEQ ID NO: 7330453 - DNA, 22 bp, Homo sapiens
tctagaggccagggacactgct

SEQ ID NO: 7330454 - DNA, 22 bp, Homo sapiens
tctagacctggcactgccctgt

SEQ ID NO: 7330455 - DNA, 22 bp, Homo sapiens
tctattttatactcaaatcttc

SEQ ID NO: 7330456 - DNA, 22 bp, Homo sapiens
tctagttctagatccctgagga

SEQ ID NO: 7330457 - DNA, 22 bp, Homo sapiens
tctataaaactcaagagcaatt

SEQ ID NO: 7330458 - DNA, 22 bp, Homo sapiens
tccttagacaaagagtgggctt

SEQ ID NO: 7330459 - DNA, 22 bp, Homo sapiens
tccttagacctggcaaatgggg

SEQ ID NO: 7330460 - DNA, 22 bp, Homo sapiens
tcgtgatctgtccacctcggcc

SEQ ID NO: 7330461 - DNA, 20 bp, Homo sapiens
tcgtttatttgaaattgctc

SEQ ID NO: 7330462 - DNA, 22 bp, Homo sapiens
tctaaagatgtttattgacata

SEQ ID NO: 7330463 - DNA, 22 bp, Homo sapiens
tctaaagatttggattcatttg

SEQ ID NO: 7330464 - DNA, 22 bp, Homo sapiens
tctaaagatttggattcatttg

SEQ ID NO: 7330465 - DNA, 22 bp, Homo sapiens
tcctggcttcctgctcttgtca

SEQ ID NO: 7330466 - DNA, 22 bp, Homo sapiens
tcctggcttaggtttccagaac

SEQ ID NO: 7330467 - DNA, 22 bp, Homo sapiens
tcctgcttccttgtctttagac

SEQ ID NO: 7330468 - DNA, 22 bp, Homo sapiens
tcctggccaagttactctctgc

SEQ ID NO: 7330469 - DNA, 21 bp, Homo sapiens
tcctggccagggcactaggca

SEQ ID NO: 7330470 - DNA, 22 bp, Homo sapiens
tcctggccagaggacaaagctg

SEQ ID NO: 7330471 - DNA, 22 bp, Homo sapiens
tcctggctctctacaaaccaga

SEQ ID NO: 7330472 - DNA, 22 bp, Homo sapiens
tcctggctctaagtcctgagtg

SEQ ID NO: 7330473 - DNA, 22 bp, Homo sapiens
tcctggcctccgttctctgcat

SEQ ID NO: 7330474 - DNA, 22 bp, Homo sapiens
tcctggcctccgttctctgcat

SEQ ID NO: 7330475 - DNA, 17 bp, Homo sapiens
tcctggcctggtgtgtg

SEQ ID NO: 7330476 - DNA, 22 bp, Homo sapiens
tcctggcccactatgccagcat

SEQ ID NO: 7330477 - DNA, 22 bp, Homo sapiens
tcctggcctagagtttgtgttc

SEQ ID NO: 7330478 - DNA, 21 bp, Homo sapiens
tcttgaaaagttagattctct

SEQ ID NO: 7330479 - DNA, 22 bp, Homo sapiens
tcttctcagtttctctaggatg

SEQ ID NO: 7330480 - DNA, 22 bp, Homo sapiens
tcttcctggtttctgggccatc

SEQ ID NO: 7330481 - DNA, 23 bp, Homo sapiens
tcttcctgaactatcaggcacat

SEQ ID NO: 7330482 - DNA, 21 bp, Homo sapiens
tcttcctgctccacactcccc

SEQ ID NO: 7330483 - DNA, 22 bp, Homo sapiens
tcttcaaatgctagtaatatca

SEQ ID NO: 7330484 - DNA, 22 bp, Homo sapiens
tcttcaaatacagtcatattga

SEQ ID NO: 7330485 - DNA, 22 bp, Homo sapiens
tcttcacaggagcctgcctgcc

SEQ ID NO: 7330486 - DNA, 22 bp, Homo sapiens
tcttcacagatgcatatacttc

SEQ ID NO: 7330487 - DNA, 22 bp, Homo sapiens
tcttcacagctttgtccagaag

SEQ ID NO: 7330488 - DNA, 22 bp, Homo sapiens
tcttcacatggaacatgaagct

SEQ ID NO: 7330489 - DNA, 22 bp, Homo sapiens
tcttattttgttagatgctgta

SEQ ID NO: 7330490 - DNA, 22 bp, Homo sapiens
tcttcataacctagagatagca

SEQ ID NO: 7330491 - DNA, 22 bp, Homo sapiens
tcttcatactcatcacataggt

SEQ ID NO: 7330492 - DNA, 22 bp, Homo sapiens
tcttcatgcacctcacagctag

SEQ ID NO: 7330493 - DNA, 22 bp, Homo sapiens
tcttccaattagaatatttggg

SEQ ID NO: 7330494 - DNA, 22 bp, Homo sapiens
tctttataaaagtcattatgtc

SEQ ID NO: 7330495 - DNA, 22 bp, Homo sapiens
tctttattgctactggtttgtc

SEQ ID NO: 7330496 - DNA, 22 bp, Homo sapiens
tctttattgctactggtttgtc

SEQ ID NO: 7330497 - DNA, 19 bp, Homo sapiens
tctttcatttctagctctg

SEQ ID NO: 7330498 - DNA, 22 bp, Homo sapiens
tctttctctctaatcaagcaca

SEQ ID NO: 7330499 - DNA, 20 bp, Homo sapiens
tctgggcttcccccagctcc

SEQ ID NO: 7330500 - DNA, 22 bp, Homo sapiens
tctgggctttaagaactctgtt

SEQ ID NO: 7330501 - DNA, 22 bp, Homo sapiens
tctgtaaaattagtataattgt

SEQ ID NO: 7330502 - DNA, 22 bp, Homo sapiens
tctgtatttatgttggtggtgc

SEQ ID NO: 7330503 - DNA, 22 bp, Homo sapiens
tctgtcatctctaaaatagaaa

SEQ ID NO: 7330504 - DNA, 20 bp, Homo sapiens
tctgtctctgagctagactt

SEQ ID NO: 7330505 - DNA, 20 bp, Homo sapiens
tctgtctctgagctagactt

SEQ ID NO: 7330506 - DNA, 22 bp, Homo sapiens
tctgtctcctgccagtgcctct

SEQ ID NO: 7330507 - DNA, 21 bp, Homo sapiens
tctgtctctccactgccctgc

SEQ ID NO: 7330508 - DNA, 22 bp, Homo sapiens
tctgtctcaagttcttgcactc

SEQ ID NO: 7330509 - DNA, 22 bp, Homo sapiens
tctgtggctggagaacttgtct

SEQ ID NO: 7330510 - DNA, 22 bp, Homo sapiens
tctgtgtctgcagaagttcagc

SEQ ID NO: 7330511 - DNA, 22 bp, Homo sapiens
tctgtgtcccttctaatttcag

SEQ ID NO: 7330512 - DNA, 22 bp, Homo sapiens
tctgtgcctcatctggttcagg

SEQ ID NO: 7330513 - DNA, 22 bp, Homo sapiens
tctgtgccctcggtgctgggcc

SEQ ID NO: 7330514 - DNA, 22 bp, Homo sapiens
tctgtgtgggatagtttgagga

SEQ ID NO: 7330515 - DNA, 22 bp, Homo sapiens
tctgtgtgtgcctgttaatatt

SEQ ID NO: 7330516 - DNA, 20 bp, Homo sapiens
tctgtgtgccatcacctaac

SEQ ID NO: 7330517 - DNA, 22 bp, Homo sapiens
tctgttgaccaagtcttcttcc

SEQ ID NO: 7330518 - DNA, 22 bp, Homo sapiens
tcttaaatgactgataagagga

SEQ ID NO: 7330519 - DNA, 22 bp, Homo sapiens
tctgtttcttcttctgttatat

SEQ ID NO: 7330520 - DNA, 22 bp, Homo sapiens
tcttaaaagtatgccaattgga

SEQ ID NO: 7330521 - DNA, 22 bp, Homo sapiens
tctgtttttgaggctatcttct

SEQ ID NO: 7330522 - DNA, 22 bp, Homo sapiens
tctgtttttgaggctatcttct

SEQ ID NO: 7330523 - DNA, 22 bp, Homo sapiens
tctgttttgtgtctctctggtg

SEQ ID NO: 7330524 - DNA, 22 bp, Homo sapiens
tctggagtgggactttgcatct

SEQ ID NO: 7330525 - DNA, 22 bp, Homo sapiens
tctggagttttttctgtctgtg

SEQ ID NO: 7330526 - DNA, 22 bp, Homo sapiens
tctggcaggttcccatgttatg

SEQ ID NO: 7330527 - DNA, 22 bp, Homo sapiens
tctggcccagcccctgaggtca

SEQ ID NO: 7330528 - DNA, 22 bp, Homo sapiens
tctgctgtgggcagagacccct

SEQ ID NO: 7330529 - DNA, 22 bp, Homo sapiens
tctgctgtgggtctatatttta

SEQ ID NO: 7330530 - DNA, 22 bp, Homo sapiens
tctgctgtattaggttgaactg

SEQ ID NO: 7330531 - DNA, 22 bp, Homo sapiens
tctgctgtcctttatatagatt

SEQ ID NO: 7330532 - DNA, 22 bp, Homo sapiens
tctgctgttcattcttttagct

SEQ ID NO: 7330533 - DNA, 22 bp, Homo sapiens
tctgctgtgttgaatgattggt

SEQ ID NO: 7330534 - DNA, 22 bp, Homo sapiens
tctgctggtgatgacctcataa

SEQ ID NO: 7330535 - DNA, 22 bp, Homo sapiens
tctggacagtagagcaatgatt

SEQ ID NO: 7330536 - DNA, 21 bp, Homo sapiens
tctgggcccatgctgcctcac

SEQ ID NO: 7330537 - DNA, 23 bp, Homo sapiens
tctgggccacttgtctgcacttc

SEQ ID NO: 7330538 - DNA, 21 bp, Homo sapiens
tctgggctgctgctgcccatc

SEQ ID NO: 7330539 - DNA, 22 bp, Homo sapiens
tctgggaagtcctctgtcatgc

SEQ ID NO: 7330540 - DNA, 22 bp, Homo sapiens
tctgggaagtgagatgctgtgt

SEQ ID NO: 7330541 - DNA, 22 bp, Homo sapiens
tctgggaagtcctctgtcatgc

SEQ ID NO: 7330542 - DNA, 22 bp, Homo sapiens
tctgggagtgtgtctggccatc

SEQ ID NO: 7330543 - DNA, 22 bp, Homo sapiens
tctggctccctggagctccaca

SEQ ID NO: 7330544 - DNA, 22 bp, Homo sapiens
tctggccccgcatgcactttat

SEQ ID NO: 7330545 - DNA, 22 bp, Homo sapiens
tctggccccggtcttcacagct

SEQ ID NO: 7330546 - DNA, 22 bp, Homo sapiens
tctggcccctggtctctggtgt

SEQ ID NO: 7330547 - DNA, 22 bp, Homo sapiens
tctgggaacagcctggctgtgt

SEQ ID NO: 7330548 - DNA, 22 bp, Homo sapiens
tctgcaggctctagatgaggtt

SEQ ID NO: 7330549 - DNA, 19 bp, Homo sapiens
tctgcccacaagaaaggga

SEQ ID NO: 7330550 - DNA, 22 bp, Homo sapiens
tctgccatcaagatgctctggc

SEQ ID NO: 7330551 - DNA, 22 bp, Homo sapiens
tctgccagtttatagacaagcc

SEQ ID NO: 7330552 - DNA, 21 bp, Homo sapiens
tctgccagtttctcttacttt

SEQ ID NO: 7330553 - DNA, 17 bp, Homo sapiens
tctgccagttttagaat

SEQ ID NO: 7330554 - DNA, 23 bp, Homo sapiens
tctgccagttccttgatcatgga

SEQ ID NO: 7330555 - DNA, 23 bp, Homo sapiens
tctgccagtgtgtgccaggagcc

SEQ ID NO: 7330556 - DNA, 22 bp, Homo sapiens
tctgccagttagaaactggtta

SEQ ID NO: 7330557 - DNA, 21 bp, Homo sapiens
tctgccaggttagattgacta

SEQ ID NO: 7330558 - DNA, 22 bp, Homo sapiens
tctgccaggtggggagaggcca

SEQ ID NO: 7330559 - DNA, 22 bp, Homo sapiens
tctgccaggttgttatgctact

SEQ ID NO: 7330560 - DNA, 22 bp, Homo sapiens
tctgccagtggtttggccctga

SEQ ID NO: 7330561 - DNA, 22 bp, Homo sapiens
tctgccagtggattcttattct

SEQ ID NO: 7330562 - DNA, 22 bp, Homo sapiens
tctgccagtattcacggcccgt

SEQ ID NO: 7330563 - DNA, 22 bp, Homo sapiens
tctgccagtgagcggggaatta

SEQ ID NO: 7330564 - DNA, 22 bp, Homo sapiens
tctgccagtgccagagtacata

SEQ ID NO: 7330565 - DNA, 22 bp, Homo sapiens
tctgccaggcctgcttccgggg

SEQ ID NO: 7330566 - DNA, 22 bp, Homo sapiens
tctgccaggccacacagggcac

SEQ ID NO: 7330567 - DNA, 22 bp, Homo sapiens
tctgccaggcttggtgctagat

SEQ ID NO: 7330568 - DNA, 16 bp, Homo sapiens
tctgccagggacaggc

SEQ ID NO: 7330569 - DNA, 22 bp, Homo sapiens
tctgccaggggcacttgcggct

SEQ ID NO: 7330570 - DNA, 22 bp, Homo sapiens
tctgccaggcattgtgctgctc

SEQ ID NO: 7330571 - DNA, 22 bp, Homo sapiens
tctgcccagtttgtgctcaggt

SEQ ID NO: 7330572 - DNA, 18 bp, Homo sapiens
tctgcccaggacttggac

SEQ ID NO: 7330573 - DNA, 19 bp, Homo sapiens
tctgcccagttgtctgccc

SEQ ID NO: 7330574 - DNA, 20 bp, Homo sapiens
tctgcccaccccggctccca

SEQ ID NO: 7330575 - DNA, 22 bp, Homo sapiens
tctgagctgtggccattcttcc

SEQ ID NO: 7330576 - DNA, 22 bp, Homo sapiens
tctgagaagctagaggacaaag

SEQ ID NO: 7330577 - DNA, 22 bp, Homo sapiens
tctgagaagtcctgtatttcta

SEQ ID NO: 7330578 - DNA, 22 bp, Homo sapiens
tctgagaatggagctaaaaatc

SEQ ID NO: 7330579 - DNA, 17 bp, Homo sapiens
tctgagaacttgaagca

SEQ ID NO: 7330580 - DNA, 23 bp, Homo sapiens
tctgaccatttgacaacatcctg

SEQ ID NO: 7330581 - DNA, 22 bp, Homo sapiens
tctgaccaggctggctcagggc

SEQ ID NO: 7330582 - DNA, 22 bp, Homo sapiens
tctgacccagatggcaccgtgg

SEQ ID NO: 7330583 - DNA, 22 bp, Homo sapiens
tctgaccacagacaacctgcta

SEQ ID NO: 7330584 - DNA, 17 bp, Homo sapiens
tctgaggcctctaggag

SEQ ID NO: 7330585 - DNA, 22 bp, Homo sapiens
tctgaggctgcatctatgtgac

SEQ ID NO: 7330586 - DNA, 22 bp, Homo sapiens
tctgaggctgaatggactccgt

SEQ ID NO: 7330587 - DNA, 22 bp, Homo sapiens
tctgattccagaaggggcatac

SEQ ID NO: 7330588 - DNA, 22 bp, Homo sapiens
tctgatgttgtgacatcacttc

SEQ ID NO: 7330589 - DNA, 22 bp, Homo sapiens
tctgatgtggagacactgtttt

SEQ ID NO: 7330590 - DNA, 21 bp, Homo sapiens
tctgatgttcacaccctgtat

SEQ ID NO: 7330591 - DNA, 22 bp, Homo sapiens
aagaggggtggtctgtgaggat

SEQ ID NO: 7330592 - DNA, 22 bp, Homo sapiens
aaacactgaagacctatctggt

SEQ ID NO: 7330593 - DNA, 22 bp, Homo sapiens
aaagccagagcaagctgtcaca

SEQ ID NO: 7330594 - DNA, 22 bp, Homo sapiens
aaacactgtgggacatcttact

SEQ ID NO: 7330595 - DNA, 22 bp, Homo sapiens
aaacatggccattcagactgtg

SEQ ID NO: 7330596 - DNA, 22 bp, Homo sapiens
aaaagtaattgcaattttgtag

SEQ ID NO: 7330597 - DNA, 22 bp, Homo sapiens
aaaagtaatcgcagtttttgcc

SEQ ID NO: 7330598 - DNA, 22 bp, Homo sapiens
aaaagtaatcgcagtttttgcc

SEQ ID NO: 7330599 - DNA, 22 bp, Homo sapiens
aaaagtaattgtggtttttgcc

SEQ ID NO: 7330600 - DNA, 22 bp, Homo sapiens
aaaagtaattgtggttttggcc

SEQ ID NO: 7330601 - DNA, 22 bp, Homo sapiens
aaaagtaattgcggtttttgct

SEQ ID NO: 7330602 - DNA, 22 bp, Homo sapiens
aaaagtaattgcggtttttgct

SEQ ID NO: 7330603 - DNA, 22 bp, Homo sapiens
aaaagtaattgcagtttttgcc

SEQ ID NO: 7330604 - DNA, 22 bp, Homo sapiens
aaaagtaattgcggtttttgcc

SEQ ID NO: 7330605 - DNA, 22 bp, Homo sapiens
aaaagtaattgcggtttttgcc

SEQ ID NO: 7330606 - DNA, 22 bp, Homo sapiens
aaaagtaattgcagttttgcca

SEQ ID NO: 7330607 - DNA, 22 bp, Homo sapiens
aaaagtaattgcagttttcgcc

SEQ ID NO: 7330608 - DNA, 22 bp, Homo sapiens
aaaagtaattgcagttttgtca

SEQ ID NO: 7330609 - DNA, 22 bp, Homo sapiens
aaaagtaattgcagtttttgcc

SEQ ID NO: 7330610 - DNA, 22 bp, Homo sapiens
aaaagtaattgcagttttgtca

SEQ ID NO: 7330611 - DNA, 18 bp, Homo sapiens
aaattattcttccttttc

SEQ ID NO: 7330612 - DNA, 22 bp, Homo sapiens
aatgaattctgaagtcttccaa

SEQ ID NO: 7330613 - DNA, 22 bp, Homo sapiens
aatgaattgcagtactgacttg

SEQ ID NO: 7330614 - DNA, 23 bp, Homo sapiens
aatgacagtgtgtgattgaagaa

SEQ ID NO: 7330615 - DNA, 22 bp, Homo sapiens
aacatgaaaagcccagagaggt

SEQ ID NO: 7330616 - DNA, 22 bp, Homo sapiens
aacatgaaaactacctgtgatt

SEQ ID NO: 7330617 - DNA, 22 bp, Homo sapiens
aagaaaacgttttgaggagttt

SEQ ID NO: 7330618 - DNA, 22 bp, Homo sapiens
aagagaaggtgaggaagccggt

SEQ ID NO: 7330619 - DNA, 20 bp, Homo sapiens
aagcaatatagtgcaaatgt

SEQ ID NO: 7330620 - DNA, 22 bp, Homo sapiens
aagcaatatactgatatgatta

SEQ ID NO: 7330621 - DNA, 22 bp, Homo sapiens
aagcaatagggtaatctactca

SEQ ID NO: 7330622 - DNA, 22 bp, Homo sapiens
aagcacaatttaggactgaaat

SEQ ID NO: 7330623 - DNA, 22 bp, Homo sapiens
aagcaattcacagttcacttaa

SEQ ID NO: 7330624 - DNA, 22 bp, Homo sapiens
aagatgaatcagtatgtgtcct

SEQ ID NO: 7330625 - DNA, 22 bp, Homo sapiens
aagatgcttattgctcctgcag

SEQ ID NO: 7330626 - DNA, 22 bp, Homo sapiens
aagatgctggcaggaatagcta

SEQ ID NO: 7330627 - DNA, 22 bp, Homo sapiens
aagatgctcttaatgggtttat

SEQ ID NO: 7330628 - DNA, 22 bp, Homo sapiens
aagatgcttgagaactgtttga

SEQ ID NO: 7330629 - DNA, 22 bp, Homo sapiens
aagatgcttgcaaatttctgaa

SEQ ID NO: 7330630 - DNA, 22 bp, Homo sapiens
aagatgcttccactgcagtggc

SEQ ID NO: 7330631 - DNA, 22 bp, Homo sapiens
aagatgctaattgtggaagttg

SEQ ID NO: 7330632 - DNA, 22 bp, Homo sapiens
acatagaacctggcacatagta

SEQ ID NO: 7330633 - DNA, 22 bp, Homo sapiens
agaaatgacaagactgatcagg

SEQ ID NO: 7330634 - DNA, 22 bp, Homo sapiens
acagagagaaacaatcagcagc

SEQ ID NO: 7330635 - DNA, 22 bp, Homo sapiens
acagatgaggcccatcagtctg

SEQ ID NO: 7330636 - DNA, 22 bp, Homo sapiens
acagatgagttaaagcagagtg

SEQ ID NO: 7330637 - DNA, 17 bp, Homo sapiens
acagatgctgataagaa

SEQ ID NO: 7330638 - DNA, 22 bp, Homo sapiens
acagatgcttactggtggttcc

SEQ ID NO: 7330639 - DNA, 19 bp, Homo sapiens
acagatgcttttgctgccc

SEQ ID NO: 7330640 - DNA, 22 bp, Homo sapiens
acagatggaatgtgttatggga

SEQ ID NO: 7330641 - DNA, 22 bp, Homo sapiens
acagatgctctgatgtctgggt

SEQ ID NO: 7330642 - DNA, 22 bp, Homo sapiens
acagatgcgcttggttgccaga

SEQ ID NO: 7330643 - DNA, 22 bp, Homo sapiens
acagatgcaaggaaatgattgc

SEQ ID NO: 7330644 - DNA, 22 bp, Homo sapiens
acagatggagctactaggtaaa

SEQ ID NO: 7330645 - DNA, 22 bp, Homo sapiens
acagatggccatattactatat

SEQ ID NO: 7330646 - DNA, 22 bp, Homo sapiens
acagatggttattgtcatttct

SEQ ID NO: 7330647 - DNA, 21 bp, Homo sapiens
acagatgggatgagcacactg

SEQ ID NO: 7330648 - DNA, 22 bp, Homo sapiens
acatgagaagctgcaacatgac

SEQ ID NO: 7330649 - DNA, 22 bp, Homo sapiens
acatgagatcacaaagataaat

SEQ ID NO: 7330650 - DNA, 22 bp, Homo sapiens
aggcgcattgaggccctgttgc

SEQ ID NO: 7330651 - DNA, 22 bp, Homo sapiens
actttgggtaagttgattaatc

SEQ ID NO: 7330652 - DNA, 22 bp, Homo sapiens
acttgggagttctggaagcctg

SEQ ID NO: 7330653 - DNA, 22 bp, Homo sapiens
acttgggaggctgaaggacatt

SEQ ID NO: 7330654 - DNA, 22 bp, Homo sapiens
agaaacatcattggaacacaag

SEQ ID NO: 7330655 - DNA, 22 bp, Homo sapiens
cagaagaatggtgtctgagctc

SEQ ID NO: 7330656 - DNA, 22 bp, Homo sapiens
cagaagaaagtggggagacaag

SEQ ID NO: 7330657 - DNA, 22 bp, Homo sapiens
caatgaaagcaactgcctataa

SEQ ID NO: 7330658 - DNA, 22 bp, Homo sapiens
atttattatgggatttggctca

SEQ ID NO: 7330659 - DNA, 22 bp, Homo sapiens
atttattattgtggttacttct

SEQ ID NO: 7330660 - DNA, 22 bp, Homo sapiens
attcttcatacctactgaggtt

SEQ ID NO: 7330661 - DNA, 22 bp, Homo sapiens
attcttcatttactgttacttg

SEQ ID NO: 7330662 - DNA, 22 bp, Homo sapiens
attcttcatgttgaagctgtca

SEQ ID NO: 7330663 - DNA, 23 bp, Homo sapiens
attcttcattatcttctagaaaa

SEQ ID NO: 7330664 - DNA, 23 bp, Homo sapiens
atttaatgctgagttgaatgtta

SEQ ID NO: 7330665 - DNA, 22 bp, Homo sapiens
agatgaagatgccactaagacc

SEQ ID NO: 7330666 - DNA, 22 bp, Homo sapiens
agatgaagatatctgcaggggc

SEQ ID NO: 7330667 - DNA, 22 bp, Homo sapiens
attctgggcaagccttcttata

SEQ ID NO: 7330668 - DNA, 22 bp, Homo sapiens
attctggggctggttattttga

SEQ ID NO: 7330669 - DNA, 22 bp, Homo sapiens
attctgggttcatgagtgagct

SEQ ID NO: 7330670 - DNA, 22 bp, Homo sapiens
atgcaggattagaaagttgcct

SEQ ID NO: 7330671 - DNA, 21 bp, Homo sapiens
agacaggtcagggagaggtga

SEQ ID NO: 7330672 - DNA, 22 bp, Homo sapiens
agactaaataatgatttactgg

SEQ ID NO: 7330673 - DNA, 22 bp, Homo sapiens
atggacaggtggataggtggat

SEQ ID NO: 7330674 - DNA, 22 bp, Homo sapiens
aggaaatgtacaaatgaagatg

SEQ ID NO: 7330675 - DNA, 22 bp, Homo sapiens
aggaaatgtagtcctcatctcc

SEQ ID NO: 7330676 - DNA, 22 bp, Homo sapiens
aggaacaattgataaactcaca

SEQ ID NO: 7330677 - DNA, 22 bp, Homo sapiens
aggaacaactgattcagtcaac

SEQ ID NO: 7330678 - DNA, 22 bp, Homo sapiens
aggaacaagggagccttttctc

SEQ ID NO: 7330679 - DNA, 22 bp, Homo sapiens
aggaaatgggaatagatggtat

SEQ ID NO: 7330680 - DNA, 22 bp, Homo sapiens
aggaaatgcaggcaaatactct

SEQ ID NO: 7330681 - DNA, 22 bp, Homo sapiens
aggaaactaaagcccagagagg

SEQ ID NO: 7330682 - DNA, 22 bp, Homo sapiens
aggagaggcatcaagaaaatcg

SEQ ID NO: 7330683 - DNA, 21 bp, Homo sapiens
aggctcccagaaatgggcatc

SEQ ID NO: 7330684 - DNA, 22 bp, Homo sapiens
agggagagtagatatcaggtgt

SEQ ID NO: 7330685 - DNA, 22 bp, Homo sapiens
cggccgcagcagtgtcggccca

SEQ ID NO: 7330686 - DNA, 22 bp, Homo sapiens
agtgaattctgcactactgaag

SEQ ID NO: 7330687 - DNA, 22 bp, Homo sapiens
ctcagatgtagaaagattgtga

SEQ ID NO: 7330688 - DNA, 22 bp, Homo sapiens
ctcagatgtgttggatggaaaa

SEQ ID NO: 7330689 - DNA, 22 bp, Homo sapiens
ctctgggtcccacgtcattgct

SEQ ID NO: 7330690 - DNA, 22 bp, Homo sapiens
agttggaccttgtagagtttcc

SEQ ID NO: 7330691 - DNA, 22 bp, Homo sapiens
atcctagaatcagcccttgctg

SEQ ID NO: 7330692 - DNA, 22 bp, Homo sapiens
atcctttaagttaataaaattc

SEQ ID NO: 7330693 - DNA, 17 bp, Homo sapiens
atccccagcatctagaa

SEQ ID NO: 7330694 - DNA, 22 bp, Homo sapiens
atcatgtacttgacaaatatgt

SEQ ID NO: 7330695 - DNA, 22 bp, Homo sapiens
atatgtattgagtgccaactgt

SEQ ID NO: 7330696 - DNA, 22 bp, Homo sapiens
gggagggtctgccatgctccct

SEQ ID NO: 7330697 - DNA, 22 bp, Homo sapiens
gggacttaatgcagagagggac

SEQ ID NO: 7330698 - DNA, 22 bp, Homo sapiens
gggcgccgtgggaaacagccgg

SEQ ID NO: 7330699 - DNA, 22 bp, Homo sapiens
gggcgcatcacctgaggtcagg

SEQ ID NO: 7330700 - DNA, 22 bp, Homo sapiens
ggggaacaccgggcagaggcgc

SEQ ID NO: 7330701 - DNA, 22 bp, Homo sapiens
gtatgaaagcatcattcctgct

SEQ ID NO: 7330702 - DNA, 22 bp, Homo sapiens
ggtgggtcttgtggggcagctt

SEQ ID NO: 7330703 - DNA, 22 bp, Homo sapiens
ggtgggtcttgcggggcagctt

SEQ ID NO: 7330704 - DNA, 22 bp, Homo sapiens
ggttggacactaggtaggagcg

SEQ ID NO: 7330705 - DNA, 22 bp, Homo sapiens
ggagggagcatccccttgctga

SEQ ID NO: 7330706 - DNA, 22 bp, Homo sapiens
ggagggagtttcattcctgccc

SEQ ID NO: 7330707 - DNA, 23 bp, Homo sapiens
cacaaaggttccattctctcacc

SEQ ID NO: 7330708 - DNA, 23 bp, Homo sapiens
atgcaggacttataaggtaaggt

SEQ ID NO: 7330709 - DNA, 22 bp, Homo sapiens
atgcagctatttgagcatgtca

SEQ ID NO: 7330710 - DNA, 22 bp, Homo sapiens
atgcagctgacattttcatgtt

SEQ ID NO: 7330711 - DNA, 22 bp, Homo sapiens
atgaagcaacagccctcctatt

SEQ ID NO: 7330712 - DNA, 22 bp, Homo sapiens
atgaagcagaatttcccactct

SEQ ID NO: 7330713 - DNA, 22 bp, Homo sapiens
gaaagcacaggctcaggaacag

SEQ ID NO: 7330714 - DNA, 21 bp, Homo sapiens
gaaagcacagaaaggactctt

SEQ ID NO: 7330715 - DNA, 22 bp, Homo sapiens
cttgttcatctcattgggactg

SEQ ID NO: 7330716 - DNA, 22 bp, Homo sapiens
atggggctgaaacatggaagag

SEQ ID NO: 7330717 - DNA, 22 bp, Homo sapiens
atgtcttttatggagatgtcat

SEQ ID NO: 7330718 - DNA, 22 bp, Homo sapiens
gcgagcctctggagtcctctgg

SEQ ID NO: 7330719 - DNA, 22 bp, Homo sapiens
gcgagcctctggagtcctctgg

SEQ ID NO: 7330720 - DNA, 22 bp, Homo sapiens
atttaatgtcgagctattgtag

SEQ ID NO: 7330721 - DNA, 22 bp, Homo sapiens
atttattggatgcttacttggg

SEQ ID NO: 7330722 - DNA, 22 bp, Homo sapiens
atttattggtttgcatggtgaa

SEQ ID NO: 7330723 - DNA, 22 bp, Homo sapiens
atttattgagagggaggggaat

SEQ ID NO: 7330724 - DNA, 22 bp, Homo sapiens
atttattatgggatttggctca

SEQ ID NO: 7330725 - DNA, 22 bp, Homo sapiens
atttattatgggatttggcaca

SEQ ID NO: 7330726 - DNA, 22 bp, Homo sapiens
attaattttacctttgtaaaca

SEQ ID NO: 7330727 - DNA, 22 bp, Homo sapiens
attaatatgagaaagtggcaga

SEQ ID NO: 7330728 - DNA, 22 bp, Homo sapiens
attattctttgataaatggcag

SEQ ID NO: 7330729 - DNA, 22 bp, Homo sapiens
attcttcagcaggggacactat

SEQ ID NO: 7330730 - DNA, 22 bp, Homo sapiens
attctcagctttcaaatagaca

SEQ ID NO: 7330731 - DNA, 22 bp, Homo sapiens
attcttcaccatggataatttg

SEQ ID NO: 7330732 - DNA, 22 bp, Homo sapiens
tcatgggtgctccaggtggctg

SEQ ID NO: 7330733 - DNA, 22 bp, Homo sapiens
tcatggggtttggctggatgtc

SEQ ID NO: 7330734 - DNA, 22 bp, Homo sapiens
catgatgttatctaaatctggt

SEQ ID NO: 7330735 - DNA, 22 bp, Homo sapiens
tcacccagcagctgcttctgct

SEQ ID NO: 7330736 - DNA, 22 bp, Homo sapiens
tattgggtaaagatccagtttt

SEQ ID NO: 7330737 - DNA, 23 bp, Homo sapiens
tatctcagaggaatgtagttact

SEQ ID NO: 7330738 - DNA, 22 bp, Homo sapiens
tcctggggagggttctggctcc

SEQ ID NO: 7330739 - DNA, 22 bp, Homo sapiens
tctctaaatgctctcccatccc

SEQ ID NO: 7330740 - DNA, 21 bp, Homo sapiens
ccagatgcaaatgcagacatt

SEQ ID NO: 7330741 - DNA, 17 bp, Homo sapiens
ccagatgccctgtctcc

SEQ ID NO: 7330742 - DNA, 22 bp, Homo sapiens
gtgtacagtaagtgaatctagg

SEQ ID NO: 7330743 - DNA, 22 bp, Homo sapiens
gttcttcagattccatttcagt

SEQ ID NO: 7330744 - DNA, 22 bp, Homo sapiens
gttcttcagccctcaggtccta

SEQ ID NO: 7330745 - DNA, 22 bp, Homo sapiens
gtttattatacaacaaaagcta

SEQ ID NO: 7330746 - DNA, 22 bp, Homo sapiens
gtttattattcaacttcatgtt

SEQ ID NO: 7330747 - DNA, 22 bp, Homo sapiens
gttattagaagtgaaggattgt

SEQ ID NO: 7330748 - DNA, 22 bp, Homo sapiens
gttattagtaagactcgcacat

SEQ ID NO: 7330749 - DNA, 22 bp, Homo sapiens
tacatatttgtctttgtactgt

SEQ ID NO: 7330750 - DNA, 22 bp, Homo sapiens
tttagacacactttgtatattt

SEQ ID NO: 7330751 - DNA, 22 bp, Homo sapiens
ttcatgaggtacctgtgatcat

SEQ ID NO: 7330752 - DNA, 23 bp, Homo sapiens
ttcatgagattatctgcatgtgt

SEQ ID NO: 7330753 - DNA, 22 bp, Homo sapiens
ttctgtcatgctcatgtaattg

SEQ ID NO: 7330754 - DNA, 22 bp, Homo sapiens
ctagggaatgagagactggatc

SEQ ID NO: 7330755 - DNA, 22 bp, Homo sapiens
ctagggaaggacaacctcttcc

SEQ ID NO: 7330756 - DNA, 22 bp, Homo sapiens
ctggatcttgctgcattgagaa

SEQ ID NO: 7330757 - DNA, 22 bp, Homo sapiens
ctggacagtgctgcttgagatg

SEQ ID NO: 7330758 - DNA, 22 bp, Homo sapiens
ctggacaggaagaattgggagc

SEQ ID NO: 7330759 - DNA, 22 bp, Homo sapiens
ctctgggttcactgaggctctg

SEQ ID NO: 7330760 - DNA, 22 bp, Homo sapiens
ttttattatctttgaatgggac

SEQ ID NO: 7330761 - DNA, 22 bp, Homo sapiens
tgtcatggctgaaagtgggggc

SEQ ID NO: 7330762 - DNA, 22 bp, Homo sapiens
tgtcatggcactggtaggagtg

SEQ ID NO: 7330763 - DNA, 22 bp, Homo sapiens
tgtcatggcactagagtggggt

SEQ ID NO: 7330764 - DNA, 22 bp, Homo sapiens
tgtcatggaggcctcccctaaa

SEQ ID NO: 7330765 - DNA, 22 bp, Homo sapiens
tgtattatcaagtaaatacatg

SEQ ID NO: 7330766 - DNA, 22 bp, Homo sapiens
cctggggaatagagtcaagggg

SEQ ID NO: 7330767 - DNA, 22 bp, Homo sapiens
gagaaaatcttgggtcaagaat

SEQ ID NO: 7330768 - DNA, 22 bp, Homo sapiens
gaaggaagtcattagtgcagac

SEQ ID NO: 7330769 - DNA, 22 bp, Homo sapiens
gaagtgaaggttactctagatt

SEQ ID NO: 7330770 - DNA, 22 bp, Homo sapiens
gaagtgaagagattagaaatca

SEQ ID NO: 7330771 - DNA, 22 bp, Homo sapiens
gaacctttttccaagtaaacaa

SEQ ID NO: 7330772 - DNA, 22 bp, Homo sapiens
cttctttcaagaatggattagg

SEQ ID NO: 7330773 - DNA, 22 bp, Homo sapiens
gagtccattatatagttcagaa

SEQ ID NO: 7330774 - DNA, 22 bp, Homo sapiens
gatcatgtgatttgaagtaatg

SEQ ID NO: 7330775 - DNA, 22 bp, Homo sapiens
gatagaaagaatatagattcca

SEQ ID NO: 7330776 - DNA, 22 bp, Homo sapiens
gatgaaaatcttgagatgtcga

SEQ ID NO: 7330777 - DNA, 22 bp, Homo sapiens
gatgaaggggctggtgccctct

SEQ ID NO: 7330778 - DNA, 22 bp, Homo sapiens
gagtctctgctatgttttctct

SEQ ID NO: 7330779 - DNA, 22 bp, Homo sapiens
gcaatcattttgtatctccagc

SEQ ID NO: 7330780 - DNA, 22 bp, Homo sapiens
gatgggggccagggcctgcttt

SEQ ID NO: 7330781 - DNA, 22 bp, Homo sapiens
gattattttgtgcaataatcgg

SEQ ID NO: 7330782 - DNA, 22 bp, Homo sapiens
gatttagtggcccttggtacac

SEQ ID NO: 7330783 - DNA, 22 bp, Homo sapiens
gcagtagtgtcagtacagcaaa

SEQ ID NO: 7330784 - DNA, 22 bp, Homo sapiens
gctgggcaggcctcgtgagggc

SEQ ID NO: 7330785 - DNA, 22 bp, Homo sapiens
gccgtgtcatctgcgggtggca

SEQ ID NO: 7330786 - DNA, 22 bp, Homo sapiens
ggggacgggacttagcatgagt

SEQ ID NO: 7330787 - DNA, 22 bp, Homo sapiens
gggagggaaggtacctgtgtga

SEQ ID NO: 7330788 - DNA, 22 bp, Homo sapiens
gggagggaaagcttgatctgtc

SEQ ID NO: 7330789 - DNA, 22 bp, Homo sapiens
gggatggggagctggaaagggg

SEQ ID NO: 7330790 - DNA, 20 bp, Homo sapiens
gggaggcgagggctgagcag

SEQ ID NO: 7330791 - DNA, 22 bp, Homo sapiens
gggacgggcagtccaaggggtc

SEQ ID NO: 7330792 - DNA, 22 bp, Homo sapiens
ggaactgaggaacgaactggga

SEQ ID NO: 7330793 - DNA, 22 bp, Homo sapiens
ggaactgattaagtcatgagaa

SEQ ID NO: 7330794 - DNA, 22 bp, Homo sapiens
ggaactgaatgtctcggtataa

SEQ ID NO: 7330795 - DNA, 22 bp, Homo sapiens
ggagaggggaacttgttgcttg

SEQ ID NO: 7330796 - DNA, 22 bp, Homo sapiens
ggagagggggctccctgcttgg

SEQ ID NO: 7330797 - DNA, 23 bp, Homo sapiens
ggagaggggtgtgggcatcttta

SEQ ID NO: 7330798 - DNA, 22 bp, Homo sapiens
ggagagggtaggggtcctgccc

SEQ ID NO: 7330799 - DNA, 22 bp, Homo sapiens
ggagaaggaagaaagctactat

SEQ ID NO: 7330800 - DNA, 22 bp, Homo sapiens
ggaggaaatccttagtaaggca

SEQ ID NO: 7330801 - DNA, 22 bp, Homo sapiens
ggaggaaatgaaaggagggttt

SEQ ID NO: 7330802 - DNA, 22 bp, Homo sapiens
ggaggggaggtccagctgatct

SEQ ID NO: 7330803 - DNA, 22 bp, Homo sapiens
ggagggtccactgtgaggcaga

SEQ ID NO: 7330804 - DNA, 22 bp, Homo sapiens
taacactgatttgttctcaggg

SEQ ID NO: 7330805 - DNA, 22 bp, Homo sapiens
taacagagtaacaggtatgtaa

SEQ ID NO: 7330806 - DNA, 22 bp, Homo sapiens
gtgtaagtatctttgtatcttt

SEQ ID NO: 7330807 - DNA, 22 bp, Homo sapiens
gtgggggtttcattaagacaat

SEQ ID NO: 7330808 - DNA, 22 bp, Homo sapiens
gtgggggtggaaaggcaagttg

SEQ ID NO: 7330809 - DNA, 22 bp, Homo sapiens
gtgtccagcctgcacagggtgc

SEQ ID NO: 7330810 - DNA, 22 bp, Homo sapiens
gttcaagaccagcctggccaac

SEQ ID NO: 7330811 - DNA, 22 bp, Homo sapiens
gtcccagggcaaggctgtttct

SEQ ID NO: 7330812 - DNA, 22 bp, Homo sapiens
gtcctgggtccccgcaggtcag

SEQ ID NO: 7330813 - DNA, 22 bp, Homo sapiens
gtctggggcagcaaggcgcgcg

SEQ ID NO: 7330814 - DNA, 22 bp, Homo sapiens
gtataggtttggctctctccag

SEQ ID NO: 7330815 - DNA, 22 bp, Homo sapiens
tctggctccactctgtgcatgc

SEQ ID NO: 7330816 - DNA, 22 bp, Homo sapiens
tctggagagcagatgcctctgg

SEQ ID NO: 7330817 - DNA, 22 bp, Homo sapiens
tctgtgatagtttttcagctat

SEQ ID NO: 7330818 - DNA, 22 bp, Homo sapiens
tctgtgctcaagttctgcctct

SEQ ID NO: 7330819 - DNA, 22 bp, Homo sapiens
tctgggtgccactgtctgtaca

SEQ ID NO: 7330820 - DNA, 22 bp, Homo sapiens
tctgggggaggaggcatggccc

SEQ ID NO: 7330821 - DNA, 22 bp, Homo sapiens
tctttaatatctgccccagagc

SEQ ID NO: 7330822 - DNA, 22 bp, Homo sapiens
tctttaatcataaccaagatgg

SEQ ID NO: 7330823 - DNA, 22 bp, Homo sapiens
tctttaatgtactttctttcac

SEQ ID NO: 7330824 - DNA, 22 bp, Homo sapiens
tctttaatgtgattgtaattat

SEQ ID NO: 7330825 - DNA, 22 bp, Homo sapiens
tctttaattcagcatgatgcgg

SEQ ID NO: 7330826 - DNA, 22 bp, Homo sapiens
tctttaattgtggaagagcagc

SEQ ID NO: 7330827 - DNA, 22 bp, Homo sapiens
tcttgggatagtgtctcatggc

SEQ ID NO: 7330828 - DNA, 22 bp, Homo sapiens
tcttctttggatgaaagaatat

SEQ ID NO: 7330829 - DNA, 22 bp, Homo sapiens
tcctggggaggtcgaggctgag

SEQ ID NO: 7330830 - DNA, 22 bp, Homo sapiens
tcctggggccagcactggtgga

SEQ ID NO: 7330831 - DNA, 19 bp, Homo sapiens
tcctggggatgtggtcacc

SEQ ID NO: 7330832 - DNA, 20 bp, Homo sapiens
tcctggggtaagccatggtc

SEQ ID NO: 7330833 - DNA, 21 bp, Homo sapiens
tcctggggggtaggtgagttt

SEQ ID NO: 7330834 - DNA, 22 bp, Homo sapiens
tctaggtggatgaggaacatag

SEQ ID NO: 7330835 - DNA, 19 bp, Homo sapiens
tctccaaaaccaatcacta

SEQ ID NO: 7330836 - DNA, 22 bp, Homo sapiens
tctcttcacattcctggcaaac

SEQ ID NO: 7330837 - DNA, 22 bp, Homo sapiens
tctgaaataggaaagcaaatgg

SEQ ID NO: 7330838 - DNA, 22 bp, Homo sapiens
tgcagaaacagtcattaatgta

SEQ ID NO: 7330839 - DNA, 19 bp, Homo sapiens
tgatgctcactggtttggg

SEQ ID NO: 7330840 - DNA, 23 bp, Homo sapiens
tgatgctcagaatgcaggtatag

SEQ ID NO: 7330841 - DNA, 22 bp, Homo sapiens
tgatgctctcctaatatgaaaa

SEQ ID NO: 7330842 - DNA, 22 bp, Homo sapiens
tgatggaaataaaagcatagct

SEQ ID NO: 7330843 - DNA, 22 bp, Homo sapiens
tgatcaaaacattactccacca

SEQ ID NO: 7330844 - DNA, 22 bp, Homo sapiens
tgccgcagtgcggggagggccc

SEQ ID NO: 7330845 - DNA, 22 bp, Homo sapiens
tgccattacccaagagtaagat

SEQ ID NO: 7330846 - DNA, 22 bp, Homo sapiens
tgaagaaacgcagagaggtagg

SEQ ID NO: 7330847 - DNA, 22 bp, Homo sapiens
tgaagaaacagaccaagaggat

SEQ ID NO: 7330848 - DNA, 22 bp, Homo sapiens
tgaaagtatttgatttctatta

SEQ ID NO: 7330849 - DNA, 22 bp, Homo sapiens
tgaatcatggataaatagctta

SEQ ID NO: 7330850 - DNA, 22 bp, Homo sapiens
tgaatcatgccactgagctccc

SEQ ID NO: 7330851 - DNA, 22 bp, Homo sapiens
tgaatttaaaataaatgtagtt

SEQ ID NO: 7330852 - DNA, 22 bp, Homo sapiens
tgaatttaagcactgatgttaa

SEQ ID NO: 7330853 - DNA, 22 bp, Homo sapiens
tgaatttatcaaagattcttaa

SEQ ID NO: 7330854 - DNA, 22 bp, Homo sapiens
tgaagcagttctcagaagtggg

SEQ ID NO: 7330855 - DNA, 22 bp, Homo sapiens
tgagatgtaaggtatgcttact

SEQ ID NO: 7330856 - DNA, 22 bp, Homo sapiens
tgagaacatttgcagggagagt

SEQ ID NO: 7330857 - DNA, 22 bp, Homo sapiens
tgagacagcagtcagggaaata

SEQ ID NO: 7330858 - DNA, 19 bp, Homo sapiens
tgagacagaagatgagcct

SEQ ID NO: 7330859 - DNA, 22 bp, Homo sapiens
tgaggaaagaaaggcatgcatg

SEQ ID NO: 7330860 - DNA, 22 bp, Homo sapiens
tgaggctcagagcacctgctcc

SEQ ID NO: 7330861 - DNA, 21 bp, Homo sapiens
tgaggctcatcttatgtggct

SEQ ID NO: 7330862 - DNA, 22 bp, Homo sapiens
tgagggtcatttggaagtggaa

SEQ ID NO: 7330863 - DNA, 22 bp, Homo sapiens
tggactatcatatctctgtgca

SEQ ID NO: 7330864 - DNA, 22 bp, Homo sapiens
tggaacaatcccggtttagctc

SEQ ID NO: 7330865 - DNA, 22 bp, Homo sapiens
tggaacaattcttgaagggaat

SEQ ID NO: 7330866 - DNA, 22 bp, Homo sapiens
tggaacaagggttcatttaaat

SEQ ID NO: 7330867 - DNA, 22 bp, Homo sapiens
tggaacaagggcgtggcggtcg

SEQ ID NO: 7330868 - DNA, 22 bp, Homo sapiens
tggaacaagacagcatagagct

SEQ ID NO: 7330869 - DNA, 22 bp, Homo sapiens
tggaacaagaagcaggtcgctt

SEQ ID NO: 7330870 - DNA, 22 bp, Homo sapiens
tggaacaactccctcggagcct

SEQ ID NO: 7330871 - DNA, 22 bp, Homo sapiens
tggaacaacatgctggaaaatt

SEQ ID NO: 7330872 - DNA, 22 bp, Homo sapiens
tggaacaaacatggtgatggct

SEQ ID NO: 7330873 - DNA, 22 bp, Homo sapiens
tggaacaaaatatttatgtttg

SEQ ID NO: 7330874 - DNA, 22 bp, Homo sapiens
tggaacaaattttggggacctt

SEQ ID NO: 7330875 - DNA, 19 bp, Homo sapiens
tggaacaaactgcaatgac

SEQ ID NO: 7330876 - DNA, 22 bp, Homo sapiens
tggaacaaattacaattaactt

SEQ ID NO: 7330877 - DNA, 22 bp, Homo sapiens
tggagagatgtctgttcaaggt

SEQ ID NO: 7330878 - DNA, 21 bp, Homo sapiens
tggacttatggagtgtttctt

SEQ ID NO: 7330879 - DNA, 22 bp, Homo sapiens
tgcgggtcatcagggagaacgt

SEQ ID NO: 7330880 - DNA, 21 bp, Homo sapiens
tgctggtcacaggtggcccca

SEQ ID NO: 7330881 - DNA, 22 bp, Homo sapiens
tggcttttgcctttcaaattgg

SEQ ID NO: 7330882 - DNA, 22 bp, Homo sapiens
tgggaacagaggacttgactgt

SEQ ID NO: 7330883 - DNA, 22 bp, Homo sapiens
tgggaacaacatgcactgccac

SEQ ID NO: 7330884 - DNA, 22 bp, Homo sapiens
tgggaacacctgctgcccagtg

SEQ ID NO: 7330885 - DNA, 22 bp, Homo sapiens
tgggaacattttgagctgagag

SEQ ID NO: 7330886 - DNA, 22 bp, Homo sapiens
tgggaacagtagctgctgagct

SEQ ID NO: 7330887 - DNA, 22 bp, Homo sapiens
tggctcattctggggaagtcag

SEQ ID NO: 7330888 - DNA, 22 bp, Homo sapiens
tgggggtcctcctctgcttaag

SEQ ID NO: 7330889 - DNA, 21 bp, Homo sapiens
tgggggtcttcacggtgttgt

SEQ ID NO: 7330890 - DNA, 22 bp, Homo sapiens
tggggtgtgctcagagcagggg

SEQ ID NO: 7330891 - DNA, 22 bp, Homo sapiens
tggggtgtgagaagtagaggga

SEQ ID NO: 7330892 - DNA, 22 bp, Homo sapiens
tgggggagcgacagacataatt

SEQ ID NO: 7330893 - DNA, 22 bp, Homo sapiens
tggggctcctcctggcaggagg

SEQ ID NO: 7330894 - DNA, 22 bp, Homo sapiens
tggggctcatgcctgctggaac

SEQ ID NO: 7330895 - DNA, 22 bp, Homo sapiens
tggggctcacctaggctggaag

SEQ ID NO: 7330896 - DNA, 22 bp, Homo sapiens
tggggaggatatgtgagttatt

SEQ ID NO: 7330897 - DNA, 22 bp, Homo sapiens
tggggaggacgggcgccttcct

SEQ ID NO: 7330898 - DNA, 23 bp, Homo sapiens
tggggagggaagtcatttctgta

SEQ ID NO: 7330899 - DNA, 21 bp, Homo sapiens
tggggaggggacctgattatg

SEQ ID NO: 7330900 - DNA, 22 bp, Homo sapiens
tggggaggttcgggaatcttgt

SEQ ID NO: 7330901 - DNA, 22 bp, Homo sapiens
tggggaggtaacaatttcaggc

SEQ ID NO: 7330902 - DNA, 22 bp, Homo sapiens
tggggagtgatgcctcggataa

SEQ ID NO: 7330903 - DNA, 22 bp, Homo sapiens
tgggagtctgaggcgggtcgat

SEQ ID NO: 7330904 - DNA, 22 bp, Homo sapiens
tgggagtccaaggcaggcggat

SEQ ID NO: 7330905 - DNA, 22 bp, Homo sapiens
tgggaggtctcttgcggcctag

SEQ ID NO: 7330906 - DNA, 22 bp, Homo sapiens
tggtgggtcggctgggagagct

SEQ ID NO: 7330907 - DNA, 22 bp, Homo sapiens
tgtaagaaaagtaaatagtgac

SEQ ID NO: 7330908 - DNA, 22 bp, Homo sapiens
tggtgcaggtgttgatgcagga

SEQ ID NO: 7330909 - DNA, 22 bp, Homo sapiens
tggtcctggaaggtcctgaggg

SEQ ID NO: 7330910 - DNA, 22 bp, Homo sapiens
tggtcctgctacaggggattag

SEQ ID NO: 7330911 - DNA, 23 bp, Homo sapiens
tggtcctggttgaggtgggcccc

SEQ ID NO: 7330912 - DNA, 22 bp, Homo sapiens
tggtcctggtagcggtgtgctt

SEQ ID NO: 7330913 - DNA, 22 bp, Homo sapiens
tggtcctggggtgcaggctgac

SEQ ID NO: 7330914 - DNA, 22 bp, Homo sapiens
tgtagaaattagtaagatcaac

SEQ ID NO: 7330915 - DNA, 22 bp, Homo sapiens
tgtatgcacatatataggtaca

SEQ ID NO: 7330916 - DNA, 22 bp, Homo sapiens
ttcattcatgtattgtctatgg

SEQ ID NO: 7330917 - DNA, 22 bp, Homo sapiens
ttcattcaggtgtatttatggg

SEQ ID NO: 7330918 - DNA, 22 bp, Homo sapiens
ttcattcagcacatatttattg

SEQ ID NO: 7330919 - DNA, 22 bp, Homo sapiens
ttcattcacccaggaaacatct

SEQ ID NO: 7330920 - DNA, 23 bp, Homo sapiens
ttatttggattttagtggaaaga

SEQ ID NO: 7330921 - DNA, 22 bp, Homo sapiens
ttagtagtgatgttatttcaag

SEQ ID NO: 7330922 - DNA, 22 bp, Homo sapiens
tgtttttccatgtgcagaacaa

SEQ ID NO: 7330923 - DNA, 19 bp, Homo sapiens
tgtgcctctatagcatgtg

SEQ ID NO: 7330924 - DNA, 20 bp, Homo sapiens
agagagaggtaaattgagca

SEQ ID NO: 7330925 - DNA, 22 bp, Homo sapiens
agagagagggaaactgctaaac

SEQ ID NO: 7330926 - DNA, 19 bp, Homo sapiens
agaatcatcttgaagtgat

SEQ ID NO: 7330927 - DNA, 22 bp, Homo sapiens
aatttattatatcctaggggaa

SEQ ID NO: 7330928 - DNA, 22 bp, Homo sapiens
aatttattcccgtctctgggct

SEQ ID NO: 7330929 - DNA, 20 bp, Homo sapiens
agaggttcagtctggagaag

SEQ ID NO: 7330930 - DNA, 22 bp, Homo sapiens
acagatgaggaagagtcagcca

SEQ ID NO: 7330931 - DNA, 21 bp, Homo sapiens
acctttaattcaagcatcagg

SEQ ID NO: 7330932 - DNA, 22 bp, Homo sapiens
aagtaaatatctgtttatagca

SEQ ID NO: 7330933 - DNA, 22 bp, Homo sapiens
actgagaactcaagagaaaagg

SEQ ID NO: 7330934 - DNA, 22 bp, Homo sapiens
aatattatcaaaagctttttca

SEQ ID NO: 7330935 - DNA, 22 bp, Homo sapiens
aatctattccctttctgtaaaa

SEQ ID NO: 7330936 - DNA, 22 bp, Homo sapiens
aaagcaatgcttgtggaatgta

SEQ ID NO: 7330937 - DNA, 22 bp, Homo sapiens
aaagcaatgcccgttcattatc

SEQ ID NO: 7330938 - DNA, 22 bp, Homo sapiens
aaagcaatgatggtagacacgt

SEQ ID NO: 7330939 - DNA, 22 bp, Homo sapiens
aaagcaatcagattcagatgtc

SEQ ID NO: 7330940 - DNA, 22 bp, Homo sapiens
aaagcaatagtaatggtaatag

SEQ ID NO: 7330941 - DNA, 22 bp, Homo sapiens
aaagcaatggatgagaatctgt

SEQ ID NO: 7330942 - DNA, 22 bp, Homo sapiens
aaatcatgaggacattatgcca

SEQ ID NO: 7330943 - DNA, 22 bp, Homo sapiens
aaatcatgtgcagagatcagga

SEQ ID NO: 7330944 - DNA, 22 bp, Homo sapiens
aaaccttttcagctgaatggag

SEQ ID NO: 7330945 - DNA, 23 bp, Homo sapiens
aaaccttttgtagaacaattgct

SEQ ID NO: 7330946 - DNA, 22 bp, Homo sapiens
aaaaagatagcattgtgctcct

SEQ ID NO: 7330947 - DNA, 22 bp, Homo sapiens
aaacatgaatagatattaaaca

SEQ ID NO: 7330948 - DNA, 22 bp, Homo sapiens
aacaagaagggaaggcatgatt

SEQ ID NO: 7330949 - DNA, 22 bp, Homo sapiens
aacttgccaagagctttgctag

SEQ ID NO: 7330950 - DNA, 22 bp, Homo sapiens
aactgacttagccagtggagct

SEQ ID NO: 7330951 - DNA, 21 bp, Homo sapiens
aactgagaccagctaaagtgg

SEQ ID NO: 7330952 - DNA, 22 bp, Homo sapiens
aactgactcccatgattaggtc

SEQ ID NO: 7330953 - DNA, 23 bp, Homo sapiens
acagatgaaagtgtggctcagag

SEQ ID NO: 7330954 - DNA, 22 bp, Homo sapiens
acagatgagaaggctgaccagt

SEQ ID NO: 7330955 - DNA, 22 bp, Homo sapiens
aagcacattatagctatctagg

SEQ ID NO: 7330956 - DNA, 22 bp, Homo sapiens
aagcacatctcaaacttcatct

SEQ ID NO: 7330957 - DNA, 22 bp, Homo sapiens
aatgtattttgggagtttcttt

SEQ ID NO: 7330958 - DNA, 20 bp, Homo sapiens
aatgtattgttttgtttcag

SEQ ID NO: 7330959 - DNA, 22 bp, Homo sapiens
aatgttattacacttgtgaaat

SEQ ID NO: 7330960 - DNA, 22 bp, Homo sapiens
aatgttatgtggttcaacttaa

SEQ ID NO: 7330961 - DNA, 22 bp, Homo sapiens
aattatttaactcctttggaga

SEQ ID NO: 7330962 - DNA, 22 bp, Homo sapiens
aaattattatgcccctctataa

SEQ ID NO: 7330963 - DNA, 22 bp, Homo sapiens
agccagatgaagaggtccttaa

SEQ ID NO: 7330964 - DNA, 22 bp, Homo sapiens
atgaaggatagggcaaaatttt

SEQ ID NO: 7330965 - DNA, 22 bp, Homo sapiens
atgaaggcagttaaacgtcatc

SEQ ID NO: 7330966 - DNA, 22 bp, Homo sapiens
agaggccagatcatcatagatg

SEQ ID NO: 7330967 - DNA, 22 bp, Homo sapiens
agatcagactttgtgactagga

SEQ ID NO: 7330968 - DNA, 22 bp, Homo sapiens
acccagtcatcctggtgtgaga

SEQ ID NO: 7330969 - DNA, 22 bp, Homo sapiens
acataacaatcataggacatag

SEQ ID NO: 7330970 - DNA, 22 bp, Homo sapiens
aggaaactgaagcccagagagg

SEQ ID NO: 7330971 - DNA, 22 bp, Homo sapiens
agaagccacaggcctcgtctgg

SEQ ID NO: 7330972 - DNA, 22 bp, Homo sapiens
agaagccaatcagctctctgct

SEQ ID NO: 7330973 - DNA, 22 bp, Homo sapiens
agaagccaatccttgtctctct

SEQ ID NO: 7330974 - DNA, 22 bp, Homo sapiens
agaacctcaattatttttgcac

SEQ ID NO: 7330975 - DNA, 18 bp, Homo sapiens
agtttttaggaagaaatg

SEQ ID NO: 7330976 - DNA, 22 bp, Homo sapiens
actttaattaatgaactgtggc

SEQ ID NO: 7330977 - DNA, 21 bp, Homo sapiens
actttaatatacatgaggagg

SEQ ID NO: 7330978 - DNA, 22 bp, Homo sapiens
cccagtttcaactttccagtgg

SEQ ID NO: 7330979 - DNA, 22 bp, Homo sapiens
aggggaggtgtccccaaatctc

SEQ ID NO: 7330980 - DNA, 22 bp, Homo sapiens
aggggaggcagcgataaacctg

SEQ ID NO: 7330981 - DNA, 22 bp, Homo sapiens
caggaaatgaacaggaatgaac

SEQ ID NO: 7330982 - DNA, 23 bp, Homo sapiens
caggaaatgaatccaggaggatg

SEQ ID NO: 7330983 - DNA, 22 bp, Homo sapiens
caggaaatgctatcatagctga

SEQ ID NO: 7330984 - DNA, 22 bp, Homo sapiens
caggaaatcagaactcaagtgg

SEQ ID NO: 7330985 - DNA, 22 bp, Homo sapiens
caggaaatatctcctggcagag

SEQ ID NO: 7330986 - DNA, 19 bp, Homo sapiens
ccaaaggaagtttccctcc

SEQ ID NO: 7330987 - DNA, 23 bp, Homo sapiens
catgtgtgacagtatcactgttt

SEQ ID NO: 7330988 - DNA, 18 bp, Homo sapiens
agtaaatggtttattttc

SEQ ID NO: 7330989 - DNA, 22 bp, Homo sapiens
agtaaatggtggtttttatcat

SEQ ID NO: 7330990 - DNA, 22 bp, Homo sapiens
ccttcattcattaatttagccc

SEQ ID NO: 7330991 - DNA, 22 bp, Homo sapiens
ccttccaagtgctgctttttcc

SEQ ID NO: 7330992 - DNA, 22 bp, Homo sapiens
cctgtggggctgaaagaggctt

SEQ ID NO: 7330993 - DNA, 22 bp, Homo sapiens
cctgggggccaggaaggtgtga

SEQ ID NO: 7330994 - DNA, 22 bp, Homo sapiens
agtgcatgttcactggcatggt

SEQ ID NO: 7330995 - DNA, 22 bp, Homo sapiens
ctgctaaacctctctgagagct

SEQ ID NO: 7330996 - DNA, 22 bp, Homo sapiens
ataaagcaagcataccattaag

SEQ ID NO: 7330997 - DNA, 22 bp, Homo sapiens
atctggttcttcttaggcatca

SEQ ID NO: 7330998 - DNA, 22 bp, Homo sapiens
cttattagaaagaaaagacatg

SEQ ID NO: 7330999 - DNA, 22 bp, Homo sapiens
cttattagagttgtgttctgtt

SEQ ID NO: 7331000 - DNA, 19 bp, Homo sapiens
cttattagagtgagagctt

SEQ ID NO: 7331001 - DNA, 22 bp, Homo sapiens
cttattagtgtctgtctgagtt

SEQ ID NO: 7331002 - DNA, 22 bp, Homo sapiens
cttcaagaagacagcagagcat

SEQ ID NO: 7331003 - DNA, 22 bp, Homo sapiens
cttcaagatatttctagaatca

SEQ ID NO: 7331004 - DNA, 22 bp, Homo sapiens
atattattttccctggagttgt

SEQ ID NO: 7331005 - DNA, 22 bp, Homo sapiens
gcagatgcatcttggtttaaac

SEQ ID NO: 7331006 - DNA, 22 bp, Homo sapiens
gcagatgccactaggtgaagtg

SEQ ID NO: 7331007 - DNA, 22 bp, Homo sapiens
gcagatgcagagatggctgggg

SEQ ID NO: 7331008 - DNA, 22 bp, Homo sapiens
gcagatgcaagggtactggggc

SEQ ID NO: 7331009 - DNA, 22 bp, Homo sapiens
gcagatgcagaactcagtgggt

SEQ ID NO: 7331010 - DNA, 22 bp, Homo sapiens
gcagatgcaactgcaggtgagt

SEQ ID NO: 7331011 - DNA, 22 bp, Homo sapiens
gcagatgctgagatttatttct

SEQ ID NO: 7331012 - DNA, 22 bp, Homo sapiens
gcagatgcctgaaggagctggg

SEQ ID NO: 7331013 - DNA, 22 bp, Homo sapiens
gcagatgccagatcatgcaggg

SEQ ID NO: 7331014 - DNA, 22 bp, Homo sapiens
caaatgaatatttccatgggtt

SEQ ID NO: 7331015 - DNA, 22 bp, Homo sapiens
caaatgaagggagctgaagtct

SEQ ID NO: 7331016 - DNA, 22 bp, Homo sapiens
caaatgaagtccaaagggctta

SEQ ID NO: 7331017 - DNA, 22 bp, Homo sapiens
caaatgaatagggagtgtgatg

SEQ ID NO: 7331018 - DNA, 22 bp, Homo sapiens
caaatgaaggtggtgggtcatt

SEQ ID NO: 7331019 - DNA, 18 bp, Homo sapiens
gatcgggggcgccccaag

SEQ ID NO: 7331020 - DNA, 22 bp, Homo sapiens
gaggggtcacatgggctggctt

SEQ ID NO: 7331021 - DNA, 22 bp, Homo sapiens
atgtatttgaaatttgagacat

SEQ ID NO: 7331022 - DNA, 22 bp, Homo sapiens
atgtaatttagaaatgaacaca

SEQ ID NO: 7331023 - DNA, 22 bp, Homo sapiens
atgaagcaggcacagcttcagg

SEQ ID NO: 7331024 - DNA, 22 bp, Homo sapiens
atgaattgaggaaaacagtcgt

SEQ ID NO: 7331025 - DNA, 22 bp, Homo sapiens
atgaatgtgatgattctgttac

SEQ ID NO: 7331026 - DNA, 22 bp, Homo sapiens
gaaatgaaacaggcttttaagg

SEQ ID NO: 7331027 - DNA, 22 bp, Homo sapiens
gaacatcaaggtctgtgtctag

SEQ ID NO: 7331028 - DNA, 22 bp, Homo sapiens
caaatttaagtgaggtctttgt

SEQ ID NO: 7331029 - DNA, 22 bp, Homo sapiens
gctggtctagggatgggcgtat

SEQ ID NO: 7331030 - DNA, 22 bp, Homo sapiens
gtgcatgcaaattactgtaaag

SEQ ID NO: 7331031 - DNA, 22 bp, Homo sapiens
gtctttggaggcactgttgagt

SEQ ID NO: 7331032 - DNA, 22 bp, Homo sapiens
gtgcagctgccgatcagatagg

SEQ ID NO: 7331033 - DNA, 19 bp, Homo sapiens
gggcggagcctgacctggg

SEQ ID NO: 7331034 - DNA, 22 bp, Homo sapiens
cagaggaaatgggaaggagata

SEQ ID NO: 7331035 - DNA, 22 bp, Homo sapiens
gggggaggtgaatgcaataagg

SEQ ID NO: 7331036 - DNA, 16 bp, Homo sapiens
cagatgcttgctggca

SEQ ID NO: 7331037 - DNA, 22 bp, Homo sapiens
cagatgcttcgtgggtgagcac

SEQ ID NO: 7331038 - DNA, 22 bp, Homo sapiens
cagatgctggtatgggggaggt

SEQ ID NO: 7331039 - DNA, 22 bp, Homo sapiens
cagatgctgctcacctgattat

SEQ ID NO: 7331040 - DNA, 20 bp, Homo sapiens
cagatgctggatcttggtcc

SEQ ID NO: 7331041 - DNA, 22 bp, Homo sapiens
cagatgctgctatttcaccctg

SEQ ID NO: 7331042 - DNA, 22 bp, Homo sapiens
cagatgctgcctgggaatgtct

SEQ ID NO: 7331043 - DNA, 22 bp, Homo sapiens
cagatgctatgtattatgtatg

SEQ ID NO: 7331044 - DNA, 18 bp, Homo sapiens
cagatgctaggcctccag

SEQ ID NO: 7331045 - DNA, 22 bp, Homo sapiens
cagatgctatagtgctgccata

SEQ ID NO: 7331046 - DNA, 22 bp, Homo sapiens
cagatggattttgtaggctgat

SEQ ID NO: 7331047 - DNA, 22 bp, Homo sapiens
cagatggagtcccgtggagttc

SEQ ID NO: 7331048 - DNA, 22 bp, Homo sapiens
cagatggaaggcatagaggttt

SEQ ID NO: 7331049 - DNA, 22 bp, Homo sapiens
cagatgcttgttggctggtctc

SEQ ID NO: 7331050 - DNA, 22 bp, Homo sapiens
cagatgcttttgattctggggt

SEQ ID NO: 7331051 - DNA, 22 bp, Homo sapiens
cagatgcttggaggacacttgg

SEQ ID NO: 7331052 - DNA, 22 bp, Homo sapiens
gtaaccttgggaaatttgacct

SEQ ID NO: 7331053 - DNA, 22 bp, Homo sapiens
tcacttcacacccactatcatg

SEQ ID NO: 7331054 - DNA, 22 bp, Homo sapiens
tctagaatgacatgcaagagta

SEQ ID NO: 7331055 - DNA, 22 bp, Homo sapiens
tcctgagggactggttcctcgc

SEQ ID NO: 7331056 - DNA, 22 bp, Homo sapiens
tcctgaggtgctcagccaggaa

SEQ ID NO: 7331057 - DNA, 22 bp, Homo sapiens
tcaaagcaatttcaccagtgcc

SEQ ID NO: 7331058 - DNA, 22 bp, Homo sapiens
tcaaaggaatttgattttgatg

SEQ ID NO: 7331059 - DNA, 22 bp, Homo sapiens
tgaaatgaatgtgattcgatag

SEQ ID NO: 7331060 - DNA, 22 bp, Homo sapiens
tcttttctggactctgcatgga

SEQ ID NO: 7331061 - DNA, 22 bp, Homo sapiens
tgaaatgagataatttaagtgc

SEQ ID NO: 7331062 - DNA, 22 bp, Homo sapiens
tgcaggaagtttcctgaacttt

SEQ ID NO: 7331063 - DNA, 22 bp, Homo sapiens
tgcaggaatattgatgaactta

SEQ ID NO: 7331064 - DNA, 22 bp, Homo sapiens
tgcactccaggctgggtgacag

SEQ ID NO: 7331065 - DNA, 22 bp, Homo sapiens
tgagcagagacttcaagggcag

SEQ ID NO: 7331066 - DNA, 18 bp, Homo sapiens
ccatcaccctaactagtg

SEQ ID NO: 7331067 - DNA, 22 bp, Homo sapiens
cctgcagggaatcgaggcagaa

SEQ ID NO: 7331068 - DNA, 22 bp, Homo sapiens
cctgcaggttgcagaggcggaa

SEQ ID NO: 7331069 - DNA, 19 bp, Homo sapiens
cctgcagggatgagaggtt

SEQ ID NO: 7331070 - DNA, 23 bp, Homo sapiens
tggaggaaacacatcagaagacc

SEQ ID NO: 7331071 - DNA, 22 bp, Homo sapiens
tggaggaatcagggcttaggct

SEQ ID NO: 7331072 - DNA, 22 bp, Homo sapiens
tggaggaataacagcaacctta

SEQ ID NO: 7331073 - DNA, 20 bp, Homo sapiens
ccctttaagctttagtatgc

SEQ ID NO: 7331074 - DNA, 22 bp, Homo sapiens
ccctttaaggaaaggaaggatg

SEQ ID NO: 7331075 - DNA, 22 bp, Homo sapiens
ccctttaaggtctgattttcag

SEQ ID NO: 7331076 - DNA, 23 bp, Homo sapiens
ccctttaagatttgaatagtcag

SEQ ID NO: 7331077 - DNA, 22 bp, Homo sapiens
ccctttaaagttttaccagcag

SEQ ID NO: 7331078 - DNA, 22 bp, Homo sapiens
ccctttaacacacagaggctgc

SEQ ID NO: 7331079 - DNA, 22 bp, Homo sapiens
ccctttaagtcctggaacaaag

SEQ ID NO: 7331080 - DNA, 22 bp, Homo sapiens
ccctttaagtagaatatattat

SEQ ID NO: 7331081 - DNA, 22 bp, Homo sapiens
ccctttaattccaacacaggaa

SEQ ID NO: 7331082 - DNA, 22 bp, Homo sapiens
gagagggcaaacttgtagctaa

SEQ ID NO: 7331083 - DNA, 22 bp, Homo sapiens
gagacggggtttgagacgggtt

SEQ ID NO: 7331084 - DNA, 22 bp, Homo sapiens
gacagagattgaatcaggaaat

SEQ ID NO: 7331085 - DNA, 22 bp, Homo sapiens
gaatgaagcaggtcacacagtt

SEQ ID NO: 7331086 - DNA, 22 bp, Homo sapiens
gaagccacagggaaggagaaca

SEQ ID NO: 7331087 - DNA, 22 bp, Homo sapiens
gagaggggacctgtgtgtctag

SEQ ID NO: 7331088 - DNA, 22 bp, Homo sapiens
gagggagggactagcattctct

SEQ ID NO: 7331089 - DNA, 22 bp, Homo sapiens
gagggaggcatcatgaatccag

SEQ ID NO: 7331090 - DNA, 22 bp, Homo sapiens
gagggagccgccacagactggg

SEQ ID NO: 7331091 - DNA, 22 bp, Homo sapiens
ctggtgaccggacctcagtttt

SEQ ID NO: 7331092 - DNA, 22 bp, Homo sapiens
ctggtctggtttgtttagacag

SEQ ID NO: 7331093 - DNA, 22 bp, Homo sapiens
cttctagatttttgtaattgtt

SEQ ID NO: 7331094 - DNA, 22 bp, Homo sapiens
cttagtaggcttcacccctctc

SEQ ID NO: 7331095 - DNA, 22 bp, Homo sapiens
cttagtagaacgtggatgggaa

SEQ ID NO: 7331096 - DNA, 22 bp, Homo sapiens
cttagtagccattatataattt

SEQ ID NO: 7331097 - DNA, 21 bp, Homo sapiens
ctgtttcttgtgaagtgacac

SEQ ID NO: 7331098 - DNA, 22 bp, Homo sapiens
ctttctttgtccaccaacaatg

SEQ ID NO: 7331099 - DNA, 22 bp, Homo sapiens
ctctcaaagaaattgcctgtca

SEQ ID NO: 7331100 - DNA, 20 bp, Homo sapiens
ctcctgtgcctctctgggcc

SEQ ID NO: 7331101 - DNA, 22 bp, Homo sapiens
ctccctggcacagcgagaggtt

SEQ ID NO: 7331102 - DNA, 22 bp, Homo sapiens
ctgagggaaggggtacatggct

SEQ ID NO: 7331103 - DNA, 22 bp, Homo sapiens
ctgagggagacagtgcggacta

SEQ ID NO: 7331104 - DNA, 22 bp, Homo sapiens
ctgagggagaagtcacgggcag

SEQ ID NO: 7331105 - DNA, 22 bp, Homo sapiens
cgggaacatgctttcatttcag

SEQ ID NO: 7331106 - DNA, 22 bp, Homo sapiens
cgggaggaaaggcgaggctctg

SEQ ID NO: 7331107 - DNA, 23 bp, Homo sapiens
ttcttcattttcagagttgagca

SEQ ID NO: 7331108 - DNA, 21 bp, Homo sapiens
ttcttcatgatgattaatggc

SEQ ID NO: 7331109 - DNA, 17 bp, Homo sapiens
ttattttttgggctgag

SEQ ID NO: 7331110 - DNA, 22 bp, Homo sapiens
cctttaatttacaatgttaatt

SEQ ID NO: 7331111 - DNA, 22 bp, Homo sapiens
ttaatactataatttgaagtac

SEQ ID NO: 7331112 - DNA, 22 bp, Homo sapiens
tgttttcatttgatgtaacaaa

SEQ ID NO: 7331113 - DNA, 22 bp, Homo sapiens
tggttcatgctcatggtgatag

SEQ ID NO: 7331114 - DNA, 22 bp, Homo sapiens
cctgcgggctggtaagaggctt

SEQ ID NO: 7331115 - DNA, 22 bp, Homo sapiens
gagggggacgtatcctggtatg

SEQ ID NO: 7331116 - DNA, 22 bp, Homo sapiens
gcaaatgaaggtggtgctacag

SEQ ID NO: 7331117 - DNA, 22 bp, Homo sapiens
gcctggtctctggggttgggta

SEQ ID NO: 7331118 - DNA, 22 bp, Homo sapiens
gctggtaaacttctggtgccat

SEQ ID NO: 7331119 - DNA, 22 bp, Homo sapiens
ggagaggcgatgagtcacagcc

SEQ ID NO: 7331120 - DNA, 22 bp, Homo sapiens
ggctggtctcagtgctgggttc

SEQ ID NO: 7331121 - DNA, 21 bp, Homo sapiens
ggctccctggcaggggtctgg

SEQ ID NO: 7331122 - DNA, 17 bp, Homo sapiens
ggctccctgactatgga

SEQ ID NO: 7331123 - DNA, 22 bp, Homo sapiens
gggaggtgattaggaccatgta

SEQ ID NO: 7331124 - DNA, 22 bp, Homo sapiens
ggatgcaggaacacagcgacct

SEQ ID NO: 7331125 - DNA, 22 bp, Homo sapiens
ggatgctctcctcggcgtgacc

SEQ ID NO: 7331126 - DNA, 22 bp, Homo sapiens
ggatgctctgtctcttgctgtt

SEQ ID NO: 7331127 - DNA, 22 bp, Homo sapiens
ggatgctcagtgcctgtgtcca

SEQ ID NO: 7331128 - DNA, 22 bp, Homo sapiens
ggcggtctcagcaccctcttgg

SEQ ID NO: 7331129 - DNA, 22 bp, Homo sapiens
ggtgcatggtggaggtgaccct

SEQ ID NO: 7331130 - DNA, 22 bp, Homo sapiens
ggtgcatgtagccatcaagata

SEQ ID NO: 7331131 - DNA, 22 bp, Homo sapiens
ggtgcatggaaagagtaagtaa

SEQ ID NO: 7331132 - DNA, 22 bp, Homo sapiens
ggtccagggaactttgaaggat

SEQ ID NO: 7331133 - DNA, 22 bp, Homo sapiens
ggtccaggtttgctctacttgt

SEQ ID NO: 7331134 - DNA, 22 bp, Homo sapiens
gggggagagacgagcggctctg

SEQ ID NO: 7331135 - DNA, 23 bp, Homo sapiens
gggggccgtcctggggattatag

SEQ ID NO: 7331136 - DNA, 18 bp, Homo sapiens
gtgcaatgaatagcagag

SEQ ID NO: 7331137 - DNA, 23 bp, Homo sapiens
gtctctagagtgtggagcaaaga

SEQ ID NO: 7331138 - DNA, 22 bp, Homo sapiens
gtctggtcctcttcacagtggc

SEQ ID NO: 7331139 - DNA, 22 bp, Homo sapiens
gtaaatgtgaatgtcatttagc

SEQ ID NO: 7331140 - DNA, 22 bp, Homo sapiens
gtaacagaaagtcatgctcatt

SEQ ID NO: 7331141 - DNA, 22 bp, Homo sapiens
gtaacacttggctgcaacctgg

SEQ ID NO: 7331142 - DNA, 22 bp, Homo sapiens
gtaacactagctctgtcacttt

SEQ ID NO: 7331143 - DNA, 22 bp, Homo sapiens
gtaacactggcaccgtctcaca

SEQ ID NO: 7331144 - DNA, 22 bp, Homo sapiens
gtaatctcagctacttgggagg

SEQ ID NO: 7331145 - DNA, 22 bp, Homo sapiens
gtaatacttgaagaattcagag

SEQ ID NO: 7331146 - DNA, 22 bp, Homo sapiens
gtaatagtctcaaactcctgga

SEQ ID NO: 7331147 - DNA, 22 bp, Homo sapiens
gtagccattggcaatgaagcct

SEQ ID NO: 7331148 - DNA, 21 bp, Homo sapiens
tattgattcaatttcttgagt

SEQ ID NO: 7331149 - DNA, 22 bp, Homo sapiens
tatttcccagggagcaacaagc

SEQ ID NO: 7331150 - DNA, 22 bp, Homo sapiens
tatcttctcagtatatgggatg

SEQ ID NO: 7331151 - DNA, 22 bp, Homo sapiens
tatgcagcaccactcactgcag

SEQ ID NO: 7331152 - DNA, 22 bp, Homo sapiens
taggaaatgctccattgcataa

SEQ ID NO: 7331153 - DNA, 22 bp, Homo sapiens
taggaatgtaatctctgttatg

SEQ ID NO: 7331154 - DNA, 22 bp, Homo sapiens
taggacagagttccctgatggc

SEQ ID NO: 7331155 - DNA, 22 bp, Homo sapiens
taggacaggatcatgatgctgg

SEQ ID NO: 7331156 - DNA, 22 bp, Homo sapiens
taggttcagagaactgaaaata

SEQ ID NO: 7331157 - DNA, 22 bp, Homo sapiens
taggttcacttagctgtgggaa

SEQ ID NO: 7331158 - DNA, 22 bp, Homo sapiens
taggttcagtgtcttgttctgc

SEQ ID NO: 7331159 - DNA, 22 bp, Homo sapiens
taggttcatattctagaatcat

SEQ ID NO: 7331160 - DNA, 22 bp, Homo sapiens
taggttcatgaaattttcagga

SEQ ID NO: 7331161 - DNA, 22 bp, Homo sapiens
taggttcacacatcttccagat

SEQ ID NO: 7331162 - DNA, 22 bp, Homo sapiens
taggttcactgtcttgaggagc

SEQ ID NO: 7331163 - DNA, 22 bp, Homo sapiens
tagatgctacaattttgtactc

SEQ ID NO: 7331164 - DNA, 22 bp, Homo sapiens
tagatgctagtagcacctgacc

SEQ ID NO: 7331165 - DNA, 22 bp, Homo sapiens
tagatgctactttacatagggt

SEQ ID NO: 7331166 - DNA, 22 bp, Homo sapiens
tagatgcttgctatgtatagag

SEQ ID NO: 7331167 - DNA, 22 bp, Homo sapiens
tagatgcttgcagacagaatga

SEQ ID NO: 7331168 - DNA, 22 bp, Homo sapiens
tagatgcttcatgagaaatata

SEQ ID NO: 7331169 - DNA, 22 bp, Homo sapiens
tagatgcttcagaaggcctgca

SEQ ID NO: 7331170 - DNA, 22 bp, Homo sapiens
tagatgcttgttcagaaatagg

SEQ ID NO: 7331171 - DNA, 22 bp, Homo sapiens
tagatgcttgtcagtttctgtc

SEQ ID NO: 7331172 - DNA, 22 bp, Homo sapiens
tagatgcttgggcaaaggtaga

SEQ ID NO: 7331173 - DNA, 22 bp, Homo sapiens
tagatgctattatggcagtgtt

SEQ ID NO: 7331174 - DNA, 22 bp, Homo sapiens
tagatgctcatgagtcagccag

SEQ ID NO: 7331175 - DNA, 22 bp, Homo sapiens
tagatgctgagcttaagagaat

SEQ ID NO: 7331176 - DNA, 22 bp, Homo sapiens
tagatgctcgctttccccctga

SEQ ID NO: 7331177 - DNA, 22 bp, Homo sapiens
tagatgctgaaacatggaggcg

SEQ ID NO: 7331178 - DNA, 22 bp, Homo sapiens
tagatgcttatagggtggttaa

SEQ ID NO: 7331179 - DNA, 22 bp, Homo sapiens
tagatgcttataaagagcatat

SEQ ID NO: 7331180 - DNA, 22 bp, Homo sapiens
tagatgctgtgggcacatggaa

SEQ ID NO: 7331181 - DNA, 22 bp, Homo sapiens
tagatgctgtagaaatacttat

SEQ ID NO: 7331182 - DNA, 22 bp, Homo sapiens
tagatgctgggaaggctgctgg

SEQ ID NO: 7331183 - DNA, 20 bp, Homo sapiens
tagatgctgccataagattc

SEQ ID NO: 7331184 - DNA, 22 bp, Homo sapiens
taatgactgccgtctctcttca

SEQ ID NO: 7331185 - DNA, 22 bp, Homo sapiens
taatgactaagcatcattaaac

SEQ ID NO: 7331186 - DNA, 22 bp, Homo sapiens
gttagtagtaaagcagggattc

SEQ ID NO: 7331187 - DNA, 22 bp, Homo sapiens
gttagtagcatttcatgacatg

SEQ ID NO: 7331188 - DNA, 22 bp, Homo sapiens
gttagtaggaggtggtatcttg

SEQ ID NO: 7331189 - DNA, 22 bp, Homo sapiens
gttagtaggttgcaaatttgga

SEQ ID NO: 7331190 - DNA, 22 bp, Homo sapiens
taacacataagctgagaccatg

SEQ ID NO: 7331191 - DNA, 22 bp, Homo sapiens
taacacatatctacaacatgtg

SEQ ID NO: 7331192 - DNA, 23 bp, Homo sapiens
gttttcaacacaataaatgtaac

SEQ ID NO: 7331193 - DNA, 22 bp, Homo sapiens
tccagggagatggcagaggctg

SEQ ID NO: 7331194 - DNA, 22 bp, Homo sapiens
tccgggaggcagaggttgcagt

SEQ ID NO: 7331195 - DNA, 22 bp, Homo sapiens
tcagagaattcgattaaatgca

SEQ ID NO: 7331196 - DNA, 22 bp, Homo sapiens
tcagagaattgtttaatggaat

SEQ ID NO: 7331197 - DNA, 22 bp, Homo sapiens
tcagagaatctctccttagttt

SEQ ID NO: 7331198 - DNA, 22 bp, Homo sapiens
tcagagaagtaaggtggggtgc

SEQ ID NO: 7331199 - DNA, 22 bp, Homo sapiens
tcagagaagtaggctaatggtg

SEQ ID NO: 7331200 - DNA, 22 bp, Homo sapiens
tcacatctgttgatacagcatc

SEQ ID NO: 7331201 - DNA, 20 bp, Homo sapiens
tcacatctggcagctgatga

SEQ ID NO: 7331202 - DNA, 22 bp, Homo sapiens
tcactgggccctgaggtgggac

SEQ ID NO: 7331203 - DNA, 22 bp, Homo sapiens
tcactggggccatgtgagggac

SEQ ID NO: 7331204 - DNA, 22 bp, Homo sapiens
tcagctgtgatccatctatcta

SEQ ID NO: 7331205 - DNA, 22 bp, Homo sapiens
tcaggcaaggcccttagagtgt

SEQ ID NO: 7331206 - DNA, 22 bp, Homo sapiens
tcagtggggtcgatgtgaggga

SEQ ID NO: 7331207 - DNA, 22 bp, Homo sapiens
ttctgagggctaatgtactgta

SEQ ID NO: 7331208 - DNA, 22 bp, Homo sapiens
ttctgaggcatagaggatgaga

SEQ ID NO: 7331209 - DNA, 22 bp, Homo sapiens
ttcataggtttgctgtgaacat

SEQ ID NO: 7331210 - DNA, 22 bp, Homo sapiens
ttcatagcagtccctttctggg

SEQ ID NO: 7331211 - DNA, 22 bp, Homo sapiens
tttcaagtggcgagataaggaa

SEQ ID NO: 7331212 - DNA, 20 bp, Homo sapiens
tttattggcctttcaggaac

SEQ ID NO: 7331213 - DNA, 22 bp, Homo sapiens
tttattggatatttacaagata

SEQ ID NO: 7331214 - DNA, 23 bp, Homo sapiens
tttgaacatttctagattacata

SEQ ID NO: 7331215 - DNA, 22 bp, Homo sapiens
ttttggttctgggatacagaga

SEQ ID NO: 7331216 - DNA, 22 bp, Homo sapiens
acagaaagataggcacaaggtc

SEQ ID NO: 7331217 - DNA, 21 bp, Homo sapiens
agacagagtgcagtctacata

SEQ ID NO: 7331218 - DNA, 22 bp, Homo sapiens
aatgttattgtcctttccaaaa

SEQ ID NO: 7331219 - DNA, 22 bp, Homo sapiens
aagtatctttctagcaactaaa

SEQ ID NO: 7331220 - DNA, 22 bp, Homo sapiens
acagttgacagggagagggtta

SEQ ID NO: 7331221 - DNA, 22 bp, Homo sapiens
aatgagatggaattcccgccta

SEQ ID NO: 7331222 - DNA, 20 bp, Homo sapiens
aatgactactatatccatgg

SEQ ID NO: 7331223 - DNA, 22 bp, Homo sapiens
aatgactaataagttttactgt

SEQ ID NO: 7331224 - DNA, 22 bp, Homo sapiens
aaacctttgcctggaagggagt

SEQ ID NO: 7331225 - DNA, 22 bp, Homo sapiens
aaacctttgtgtgtctgtgcct

SEQ ID NO: 7331226 - DNA, 22 bp, Homo sapiens
aaacctttctgctctcagcgta

SEQ ID NO: 7331227 - DNA, 22 bp, Homo sapiens
aaacctttctcagtgctaaaat

SEQ ID NO: 7331228 - DNA, 22 bp, Homo sapiens
aaacctttaccagactagcaag

SEQ ID NO: 7331229 - DNA, 22 bp, Homo sapiens
aaactgaaacatcatcatgttg

SEQ ID NO: 7331230 - DNA, 22 bp, Homo sapiens
aaaagtaattgtggtttttgct

SEQ ID NO: 7331231 - DNA, 22 bp, Homo sapiens
aaaagtaattgtggtttttgcc

SEQ ID NO: 7331232 - DNA, 22 bp, Homo sapiens
aaaagtaattgtggtttttgct

SEQ ID NO: 7331233 - DNA, 22 bp, Homo sapiens
aaaatgaagcaaaggcattcag

SEQ ID NO: 7331234 - DNA, 22 bp, Homo sapiens
aaagtggggtctagagggcctg

SEQ ID NO: 7331235 - DNA, 22 bp, Homo sapiens
aaagtgggaacaatggagagtg

SEQ ID NO: 7331236 - DNA, 22 bp, Homo sapiens
aagcatcaacctgtatgctgca

SEQ ID NO: 7331237 - DNA, 22 bp, Homo sapiens
acagagtattggaaaggcagtg

SEQ ID NO: 7331238 - DNA, 22 bp, Homo sapiens
aattggactgtgctgctcaaaa

SEQ ID NO: 7331239 - DNA, 22 bp, Homo sapiens
aacttaggaaaataaggcatga

SEQ ID NO: 7331240 - DNA, 22 bp, Homo sapiens
caagcaatgctatactcattat

SEQ ID NO: 7331241 - DNA, 22 bp, Homo sapiens
cagaggagttcagtacacagcc

SEQ ID NO: 7331242 - DNA, 22 bp, Homo sapiens
atgcacctgaactccatcagct

SEQ ID NO: 7331243 - DNA, 22 bp, Homo sapiens
atgaaagtgaaggtttactaag

SEQ ID NO: 7331244 - DNA, 22 bp, Homo sapiens
attattaggtgctctctgacaa

SEQ ID NO: 7331245 - DNA, 22 bp, Homo sapiens
attattaggactactggggttg

SEQ ID NO: 7331246 - DNA, 22 bp, Homo sapiens
attattagattcttaattgtaa

SEQ ID NO: 7331247 - DNA, 22 bp, Homo sapiens
attattagacttatatggtagt

SEQ ID NO: 7331248 - DNA, 22 bp, Homo sapiens
attattagtgatgttgttactg

SEQ ID NO: 7331249 - DNA, 22 bp, Homo sapiens
agaggtcagctgcatgccacat

SEQ ID NO: 7331250 - DNA, 22 bp, Homo sapiens
acgctggtgaaagggtggtttt

SEQ ID NO: 7331251 - DNA, 22 bp, Homo sapiens
acctgcaggcacaggtgtgcgc

SEQ ID NO: 7331252 - DNA, 22 bp, Homo sapiens
agtgcatgtatctacagtcaca

SEQ ID NO: 7331253 - DNA, 18 bp, Homo sapiens
agtgcatgctaggggaag

SEQ ID NO: 7331254 - DNA, 19 bp, Homo sapiens
agtgcatgggcgaggtgca

SEQ ID NO: 7331255 - DNA, 20 bp, Homo sapiens
agtgcatggagggagagggc

SEQ ID NO: 7331256 - DNA, 22 bp, Homo sapiens
agtgcatgccttcctgtggatg

SEQ ID NO: 7331257 - DNA, 22 bp, Homo sapiens
actcttcaccgctactgaaata

SEQ ID NO: 7331258 - DNA, 22 bp, Homo sapiens
agaaaagtgctctagtgagagc

SEQ ID NO: 7331259 - DNA, 22 bp, Homo sapiens
atctcaaacatctttgaccata

SEQ ID NO: 7331260 - DNA, 22 bp, Homo sapiens
agaacagaggccttatgtttca

SEQ ID NO: 7331261 - DNA, 22 bp, Homo sapiens
agaaagtgtgtcatactaagtg

SEQ ID NO: 7331262 - DNA, 22 bp, Homo sapiens
acatagcataaagaatgactct

SEQ ID NO: 7331263 - DNA, 22 bp, Homo sapiens
cagtttcagctcaagcactcag

SEQ ID NO: 7331264 - DNA, 22 bp, Homo sapiens
ccaagcaaggctaattcacttg

SEQ ID NO: 7331265 - DNA, 22 bp, Homo sapiens
catttgttcaaccattctcgct

SEQ ID NO: 7331266 - DNA, 22 bp, Homo sapiens
aggaggggcaatgatagtctgg

SEQ ID NO: 7331267 - DNA, 20 bp, Homo sapiens
aggaggggatagaatcaaag

SEQ ID NO: 7331268 - DNA, 22 bp, Homo sapiens
aggattcagaatgtatgcagtg

SEQ ID NO: 7331269 - DNA, 22 bp, Homo sapiens
aggattgtgcctccagtcagaa

SEQ ID NO: 7331270 - DNA, 22 bp, Homo sapiens
catgggggctgaggctgctgta

SEQ ID NO: 7331271 - DNA, 22 bp, Homo sapiens
agctgccacatggtgtcactgt

SEQ ID NO: 7331272 - DNA, 22 bp, Homo sapiens
agctgattccactttttcccca

SEQ ID NO: 7331273 - DNA, 22 bp, Homo sapiens
agggaacagtgaaaggcatcag

SEQ ID NO: 7331274 - DNA, 22 bp, Homo sapiens
agggaacatttgcactgttggt

SEQ ID NO: 7331275 - DNA, 20 bp, Homo sapiens
agggaacaatggacgctgtc

SEQ ID NO: 7331276 - DNA, 22 bp, Homo sapiens
agggaacaaaactctaaaattc

SEQ ID NO: 7331277 - DNA, 23 bp, Homo sapiens
agggaacaagcaagctgctagtc

SEQ ID NO: 7331278 - DNA, 22 bp, Homo sapiens
ctccagttggccccagttggtt

SEQ ID NO: 7331279 - DNA, 22 bp, Homo sapiens
aggtttcatgggagacaactca

SEQ ID NO: 7331280 - DNA, 23 bp, Homo sapiens
aggttatgattatagagcgagga

SEQ ID NO: 7331281 - DNA, 22 bp, Homo sapiens
aggttcaaatgcaagagatgct

SEQ ID NO: 7331282 - DNA, 22 bp, Homo sapiens
aggttcaaattgttgcagtttc

SEQ ID NO: 7331283 - DNA, 20 bp, Homo sapiens
agtttattccaggagaactg

SEQ ID NO: 7331284 - DNA, 19 bp, Homo sapiens
agtttattataggtgattc

SEQ ID NO: 7331285 - DNA, 22 bp, Homo sapiens
agtttattctctggtcttagta

SEQ ID NO: 7331286 - DNA, 22 bp, Homo sapiens
atagaatgtattatagtacaga

SEQ ID NO: 7331287 - DNA, 22 bp, Homo sapiens
ataatttaattttcacagtggt

SEQ ID NO: 7331288 - DNA, 23 bp, Homo sapiens
cttcatgagagccctgaggaaaa

SEQ ID NO: 7331289 - DNA, 22 bp, Homo sapiens
atagtcttacttttctctgcta

SEQ ID NO: 7331290 - DNA, 22 bp, Homo sapiens
gatgtgtagagggaatttcaaa

SEQ ID NO: 7331291 - DNA, 22 bp, Homo sapiens
attagtttggtgcaaaagtaat

SEQ ID NO: 7331292 - DNA, 22 bp, Homo sapiens
attataggcttgagccaccgtg

SEQ ID NO: 7331293 - DNA, 22 bp, Homo sapiens
gcagagaaggattgaaaccaga

SEQ ID NO: 7331294 - DNA, 19 bp, Homo sapiens
atttattgtatgattccat

SEQ ID NO: 7331295 - DNA, 22 bp, Homo sapiens
atttattacctcggagtttctg

SEQ ID NO: 7331296 - DNA, 22 bp, Homo sapiens
atttattaagcatctgctatgt

SEQ ID NO: 7331297 - DNA, 22 bp, Homo sapiens
gccatcatatcccctgtgacct

SEQ ID NO: 7331298 - DNA, 22 bp, Homo sapiens
atttgggaatgtgcattatact

SEQ ID NO: 7331299 - DNA, 22 bp, Homo sapiens
atttgggagttgctagtgagtt

SEQ ID NO: 7331300 - DNA, 22 bp, Homo sapiens
caaagaagagatttacagagct

SEQ ID NO: 7331301 - DNA, 20 bp, Homo sapiens
caaaagcaatgaagttatga

SEQ ID NO: 7331302 - DNA, 22 bp, Homo sapiens
caaaagcagcaagtttatatgt

SEQ ID NO: 7331303 - DNA, 22 bp, Homo sapiens
atgcaggagccctcttgagggc

SEQ ID NO: 7331304 - DNA, 22 bp, Homo sapiens
ctttattagatgtagactttct

SEQ ID NO: 7331305 - DNA, 22 bp, Homo sapiens
atgaatttttctaagcttttgt

SEQ ID NO: 7331306 - DNA, 22 bp, Homo sapiens
atgagaggtttcgtcagaggaa

SEQ ID NO: 7331307 - DNA, 22 bp, Homo sapiens
atgtatttctatgtagtgaaga

SEQ ID NO: 7331308 - DNA, 22 bp, Homo sapiens
gaggctccctcaactctgggtg

SEQ ID NO: 7331309 - DNA, 22 bp, Homo sapiens
gaggttcacaggctatcacagt

SEQ ID NO: 7331310 - DNA, 22 bp, Homo sapiens
gaggttcagtaaggaatactga

SEQ ID NO: 7331311 - DNA, 19 bp, Homo sapiens
gaggttcacgcgctggatg

SEQ ID NO: 7331312 - DNA, 22 bp, Homo sapiens
gaggttcacttcctgaaatagc

SEQ ID NO: 7331313 - DNA, 22 bp, Homo sapiens
gaggttcacttcctggatcctt

SEQ ID NO: 7331314 - DNA, 22 bp, Homo sapiens
gaggttcagctgctgcctggta

SEQ ID NO: 7331315 - DNA, 22 bp, Homo sapiens
gaggttcaggaaatgggcaaag

SEQ ID NO: 7331316 - DNA, 22 bp, Homo sapiens
atggctccatagcttcgtttag

SEQ ID NO: 7331317 - DNA, 22 bp, Homo sapiens
caatttcattaatagatataga

SEQ ID NO: 7331318 - DNA, 22 bp, Homo sapiens
cagatgctaaacaaaggacttt

SEQ ID NO: 7331319 - DNA, 22 bp, Homo sapiens
cagatgctaagttatcagcagg

SEQ ID NO: 7331320 - DNA, 22 bp, Homo sapiens
cagatgctaggccaattcctga

SEQ ID NO: 7331321 - DNA, 22 bp, Homo sapiens
ggtcctggaagtgtaagtggca

SEQ ID NO: 7331322 - DNA, 22 bp, Homo sapiens
ggtcctggcagctctgtgtcca

SEQ ID NO: 7331323 - DNA, 18 bp, Homo sapiens
cagatgagatgcaatctc

SEQ ID NO: 7331324 - DNA, 19 bp, Homo sapiens
cagatgagaaaagtgaggt

SEQ ID NO: 7331325 - DNA, 23 bp, Homo sapiens
cagatgaggttggcagcatggtc

SEQ ID NO: 7331326 - DNA, 22 bp, Homo sapiens
cagatgaggggcatataacaat

SEQ ID NO: 7331327 - DNA, 22 bp, Homo sapiens
cagatgaggacagatgactggg

SEQ ID NO: 7331328 - DNA, 22 bp, Homo sapiens
cagatgaggcaacctcattgct

SEQ ID NO: 7331329 - DNA, 22 bp, Homo sapiens
gggtccaggtttagtcatttgt

SEQ ID NO: 7331330 - DNA, 19 bp, Homo sapiens
ggtatatgggcctcacttg

SEQ ID NO: 7331331 - DNA, 22 bp, Homo sapiens
gtgaatttctgactaaaagtgc

SEQ ID NO: 7331332 - DNA, 22 bp, Homo sapiens
gtaggcagtgcttgattttcca

SEQ ID NO: 7331333 - DNA, 22 bp, Homo sapiens
tgacagagcatgtagtgacagc

SEQ ID NO: 7331334 - DNA, 22 bp, Homo sapiens
tctttaatataaaggaatgaat

SEQ ID NO: 7331335 - DNA, 22 bp, Homo sapiens
tgaaatgattatatggtgtttg

SEQ ID NO: 7331336 - DNA, 18 bp, Homo sapiens
tgaacagatgagttgaag

SEQ ID NO: 7331337 - DNA, 19 bp, Homo sapiens
tggaggtccaggagtaggg

SEQ ID NO: 7331338 - DNA, 22 bp, Homo sapiens
tggaggtcctgcaggatggcac

SEQ ID NO: 7331339 - DNA, 22 bp, Homo sapiens
tggaggtcgctagcgagcgggc

SEQ ID NO: 7331340 - DNA, 22 bp, Homo sapiens
tggaggtctgcaaggcgctgga

SEQ ID NO: 7331341 - DNA, 22 bp, Homo sapiens
cctgagggctcagcccccagcc

SEQ ID NO: 7331342 - DNA, 22 bp, Homo sapiens
cctgaggggctgcaggccagct

SEQ ID NO: 7331343 - DNA, 22 bp, Homo sapiens
tggtctgatttttcatctgttg

SEQ ID NO: 7331344 - DNA, 22 bp, Homo sapiens
tggtctgatttctttctggagt

SEQ ID NO: 7331345 - DNA, 22 bp, Homo sapiens
tggtctgaatgacttgttagtt

SEQ ID NO: 7331346 - DNA, 22 bp, Homo sapiens
tgtaattttacgtgacacagtt

SEQ ID NO: 7331347 - DNA, 22 bp, Homo sapiens
cctggaggctctgggagggcag

SEQ ID NO: 7331348 - DNA, 22 bp, Homo sapiens
tctcaaatttgctggaccagta

SEQ ID NO: 7331349 - DNA, 22 bp, Homo sapiens
ccagcactgctctcagactgag

SEQ ID NO: 7331350 - DNA, 20 bp, Homo sapiens
catttgggatcatgaggttt

SEQ ID NO: 7331351 - DNA, 22 bp, Homo sapiens
cataacagtggcttcagcaagt

SEQ ID NO: 7331352 - DNA, 22 bp, Homo sapiens
tcacagctttcagattgttccc

SEQ ID NO: 7331353 - DNA, 22 bp, Homo sapiens
cagtgccaagccacagatcact

SEQ ID NO: 7331354 - DNA, 22 bp, Homo sapiens
tcagatgcgatgcattcaggct

SEQ ID NO: 7331355 - DNA, 22 bp, Homo sapiens
tcagatgccctttgttttagac

SEQ ID NO: 7331356 - DNA, 22 bp, Homo sapiens
tcagatgccaactgaacaacag

SEQ ID NO: 7331357 - DNA, 22 bp, Homo sapiens
tcagatgcctgtggggtctagg

SEQ ID NO: 7331358 - DNA, 22 bp, Homo sapiens
tcagagaaatgaagtagggatt

SEQ ID NO: 7331359 - DNA, 22 bp, Homo sapiens
cagtgccatgatgcagagcaat

SEQ ID NO: 7331360 - DNA, 22 bp, Homo sapiens
cagtgggggtgaggccgaggta

SEQ ID NO: 7331361 - DNA, 22 bp, Homo sapiens
cagtggggtttctgtgggtgct

SEQ ID NO: 7331362 - DNA, 22 bp, Homo sapiens
taggaaatttgaaatatgtggg

SEQ ID NO: 7331363 - DNA, 22 bp, Homo sapiens
taggaaattgccaatatatgac

SEQ ID NO: 7331364 - DNA, 22 bp, Homo sapiens
caggggaagatgccaagggaga

SEQ ID NO: 7331365 - DNA, 22 bp, Homo sapiens
caggggagtgagtccctctctg

SEQ ID NO: 7331366 - DNA, 22 bp, Homo sapiens
ctctgggtcctggggctacaag

SEQ ID NO: 7331367 - DNA, 22 bp, Homo sapiens
ctctgggtgtcatggcctcagc

SEQ ID NO: 7331368 - DNA, 18 bp, Homo sapiens
tttctcaaggctgacatt

SEQ ID NO: 7331369 - DNA, 22 bp, Homo sapiens
tttctcaagtactgcacatgaa

SEQ ID NO: 7331370 - DNA, 22 bp, Homo sapiens
tttctcaaatactgttccagga

SEQ ID NO: 7331371 - DNA, 22 bp, Homo sapiens
tttattcatcatctgttcatat

SEQ ID NO: 7331372 - DNA, 22 bp, Homo sapiens
cgtttattttgaagattccact

SEQ ID NO: 7331373 - DNA, 22 bp, Homo sapiens
cgtttagttgtcccttcttaaa

SEQ ID NO: 7331374 - DNA, 22 bp, Homo sapiens
ttctggaagggtggagtagctt

SEQ ID NO: 7331375 - DNA, 22 bp, Homo sapiens
ttctggaagctgcaggtggccg

SEQ ID NO: 7331376 - DNA, 22 bp, Homo sapiens
cggggaggcttcggattaaagc

SEQ ID NO: 7331377 - DNA, 22 bp, Homo sapiens
cggggagggcagaggctccctc

SEQ ID NO: 7331378 - DNA, 22 bp, Homo sapiens
ttataacactgccttgtcacca

SEQ ID NO: 7331379 - DNA, 22 bp, Homo sapiens
gagggaccccaggctggccctt

SEQ ID NO: 7331380 - DNA, 22 bp, Homo sapiens
gacctggggtggaaggaaggca

SEQ ID NO: 7331381 - DNA, 22 bp, Homo sapiens
gaatttatctacgttaagtatg

SEQ ID NO: 7331382 - DNA, 22 bp, Homo sapiens
gaaactgaatataagaaaggta

SEQ ID NO: 7331383 - DNA, 22 bp, Homo sapiens
gaaactgagtaggctagagcac

SEQ ID NO: 7331384 - DNA, 22 bp, Homo sapiens
cttcttcagttgcatgtattgg

SEQ ID NO: 7331385 - DNA, 20 bp, Homo sapiens
cttcttcagtagtttgttct

SEQ ID NO: 7331386 - DNA, 20 bp, Homo sapiens
cttcttcagcctatgcttca

SEQ ID NO: 7331387 - DNA, 22 bp, Homo sapiens
cttcttcagcacaatattgatg

SEQ ID NO: 7331388 - DNA, 22 bp, Homo sapiens
cttcttcaagagaatgggagac

SEQ ID NO: 7331389 - DNA, 22 bp, Homo sapiens
ctgtgtctttcctactttgtgg

SEQ ID NO: 7331390 - DNA, 22 bp, Homo sapiens
ctgtgggagcagcaccaaggac

SEQ ID NO: 7331391 - DNA, 22 bp, Homo sapiens
ctgggggtcttgaaagggagag

SEQ ID NO: 7331392 - DNA, 22 bp, Homo sapiens
ctgggggtgagcagcagcgacg

SEQ ID NO: 7331393 - DNA, 22 bp, Homo sapiens
ctgggggtcgcgcctctgggca

SEQ ID NO: 7331394 - DNA, 19 bp, Homo sapiens
ctgggggtgctcacgctct

SEQ ID NO: 7331395 - DNA, 22 bp, Homo sapiens
gctttaatgcttcgtggggcca

SEQ ID NO: 7331396 - DNA, 22 bp, Homo sapiens
gctttaatgcaatttcacctca

SEQ ID NO: 7331397 - DNA, 22 bp, Homo sapiens
gctttaatgaagtcacgcaaag

SEQ ID NO: 7331398 - DNA, 22 bp, Homo sapiens
gctgagggtaacacttcgggat

SEQ ID NO: 7331399 - DNA, 22 bp, Homo sapiens
gctctcctgtgcagatgctgct

SEQ ID NO: 7331400 - DNA, 22 bp, Homo sapiens
ggctctcttaactggccatcct

SEQ ID NO: 7331401 - DNA, 22 bp, Homo sapiens
gggccgtagaccacgtccgggc

SEQ ID NO: 7331402 - DNA, 22 bp, Homo sapiens
gggccggagctgggtcccgcgc

SEQ ID NO: 7331403 - DNA, 22 bp, Homo sapiens
gggtggtctggcaggctggaaa

SEQ ID NO: 7331404 - DNA, 22 bp, Homo sapiens
ggtgagggacatcactcagcca

SEQ ID NO: 7331405 - DNA, 22 bp, Homo sapiens
tcctagaatctttgtaagattg

SEQ ID NO: 7331406 - DNA, 22 bp, Homo sapiens
tcctcaaaggatacccaggctt

SEQ ID NO: 7331407 - DNA, 22 bp, Homo sapiens
tccagggaagagcagaggctac

SEQ ID NO: 7331408 - DNA, 21 bp, Homo sapiens
tccaatttttaagactatggc

SEQ ID NO: 7331409 - DNA, 22 bp, Homo sapiens
tccattatacttctgattcaaa

SEQ ID NO: 7331410 - DNA, 22 bp, Homo sapiens
tccatggggcccaggatgagag

SEQ ID NO: 7331411 - DNA, 22 bp, Homo sapiens
tcctgaggcacaatcctagaat

SEQ ID NO: 7331412 - DNA, 22 bp, Homo sapiens
tcctgaggaccctgtcaggggc

SEQ ID NO: 7331413 - DNA, 22 bp, Homo sapiens
tcctgaggactaacaggaagga

SEQ ID NO: 7331414 - DNA, 22 bp, Homo sapiens
tcatgcagagccagtcaggata

SEQ ID NO: 7331415 - DNA, 22 bp, Homo sapiens
tccaatttgtttgatgatggaa

SEQ ID NO: 7331416 - DNA, 22 bp, Homo sapiens
tcatgcagttactgttatgcaa

SEQ ID NO: 7331417 - DNA, 22 bp, Homo sapiens
tcatgcagtttcttatctgcca

SEQ ID NO: 7331418 - DNA, 22 bp, Homo sapiens
tcatgcagtttgaagttcaggg

SEQ ID NO: 7331419 - DNA, 20 bp, Homo sapiens
tcatgcaggtgttctaggtt

SEQ ID NO: 7331420 - DNA, 21 bp, Homo sapiens
tcatgcaggcagagtttggta

SEQ ID NO: 7331421 - DNA, 22 bp, Homo sapiens
tcaaatgaggctgatgaatgtg

SEQ ID NO: 7331422 - DNA, 22 bp, Homo sapiens
tcagatgctaaagatggaatta

SEQ ID NO: 7331423 - DNA, 22 bp, Homo sapiens
tcagatgctagggctgagctat

SEQ ID NO: 7331424 - DNA, 22 bp, Homo sapiens
tcagatgcttagtgactacaca

SEQ ID NO: 7331425 - DNA, 19 bp, Homo sapiens
tcagatgcttctcgtctca

SEQ ID NO: 7331426 - DNA, 22 bp, Homo sapiens
tcagatgctgttttcttatata

SEQ ID NO: 7331427 - DNA, 22 bp, Homo sapiens
tcagatgcttagagattagact

SEQ ID NO: 7331428 - DNA, 22 bp, Homo sapiens
tatttaaccagttaaatttcca

SEQ ID NO: 7331429 - DNA, 22 bp, Homo sapiens
tatgaattctgttcattgatga

SEQ ID NO: 7331430 - DNA, 22 bp, Homo sapiens
tatgaaggatacacctctgatt

SEQ ID NO: 7331431 - DNA, 22 bp, Homo sapiens
tatcagatttagaggagtcata

SEQ ID NO: 7331432 - DNA, 22 bp, Homo sapiens
gtttattaactgtcaagtgatt

SEQ ID NO: 7331433 - DNA, 22 bp, Homo sapiens
gtttattagagttttctgtctg

SEQ ID NO: 7331434 - DNA, 22 bp, Homo sapiens
gttcttcagttcaggctgttca

SEQ ID NO: 7331435 - DNA, 22 bp, Homo sapiens
taaagataagacatcaactgag

SEQ ID NO: 7331436 - DNA, 22 bp, Homo sapiens
taatttatttcaactgccaagg

SEQ ID NO: 7331437 - DNA, 22 bp, Homo sapiens
taatttatggtatgtgtgtaat

SEQ ID NO: 7331438 - DNA, 21 bp, Homo sapiens
taatttattcagcacagtgtt

SEQ ID NO: 7331439 - DNA, 22 bp, Homo sapiens
taatttatagaatttcttggat

SEQ ID NO: 7331440 - DNA, 22 bp, Homo sapiens
taatttatatggaattgttgct

SEQ ID NO: 7331441 - DNA, 22 bp, Homo sapiens
taatttatgatgcaaagaaaag

SEQ ID NO: 7331442 - DNA, 22 bp, Homo sapiens
tactaggaagcagctgcattgg

SEQ ID NO: 7331443 - DNA, 22 bp, Homo sapiens
ttgtaagtcacaccagggcagg

SEQ ID NO: 7331444 - DNA, 22 bp, Homo sapiens
ttggacagaatttatcttcagt

SEQ ID NO: 7331445 - DNA, 22 bp, Homo sapiens
tttcaactcatgctaaaggaag

SEQ ID NO: 7331446 - DNA, 22 bp, Homo sapiens
tttagataatgctcaagcaatt

SEQ ID NO: 7331447 - DNA, 21 bp, Homo sapiens
ttctcagatcgagtagtgaga

SEQ ID NO: 7331448 - DNA, 22 bp, Homo sapiens
ttcttcagactactgatgattg

SEQ ID NO: 7331449 - DNA, 22 bp, Homo sapiens
ttattgttaggcttttggaatt

SEQ ID NO: 7331450 - DNA, 22 bp, Homo sapiens
ttattaggttattctctgtact

SEQ ID NO: 7331451 - DNA, 22 bp, Homo sapiens
ttattaggaactcaggattttt

SEQ ID NO: 7331452 - DNA, 22 bp, Homo sapiens
ttcatttaatcagaatctctaa

SEQ ID NO: 7331453 - DNA, 22 bp, Homo sapiens
tttttcagccatgaattacact

SEQ ID NO: 7331454 - DNA, 22 bp, Homo sapiens
tttgtaaatagcagtactcatg

SEQ ID NO: 7331455 - DNA, 22 bp, Homo sapiens
ttttctcaagatccaatgcact

SEQ ID NO: 7331456 - DNA, 22 bp, Homo sapiens
ttttattagtggctagatgggg

SEQ ID NO: 7331457 - DNA, 22 bp, Homo sapiens
tttgaggttagctagcagatca

SEQ ID NO: 7331458 - DNA, 22 bp, Homo sapiens
aagggtccaaggctttgcgttt

SEQ ID NO: 7331459 - DNA, 22 bp, Homo sapiens
aatgaataccgtttcactcagt

SEQ ID NO: 7331460 - DNA, 22 bp, Homo sapiens
aatagcaaatgctcatttgaaa

SEQ ID NO: 7331461 - DNA, 22 bp, Homo sapiens
agaggagtattttctaagggaa

SEQ ID NO: 7331462 - DNA, 22 bp, Homo sapiens
aattccagaggaggacagtcct

SEQ ID NO: 7331463 - DNA, 22 bp, Homo sapiens
agacatgacagatagttgctag

SEQ ID NO: 7331464 - DNA, 22 bp, Homo sapiens
aatgtattatacataatttgtg

SEQ ID NO: 7331465 - DNA, 22 bp, Homo sapiens
aatgtattcctcatgcaagagt

SEQ ID NO: 7331466 - DNA, 22 bp, Homo sapiens
agatgctcttgccaaagaagtc

SEQ ID NO: 7331467 - DNA, 22 bp, Homo sapiens
agatgctctcttgctggttcat

SEQ ID NO: 7331468 - DNA, 22 bp, Homo sapiens
agatgctctctattatgcagaa

SEQ ID NO: 7331469 - DNA, 22 bp, Homo sapiens
aacttgaaactgttccagaaaa

SEQ ID NO: 7331470 - DNA, 22 bp, Homo sapiens
aacatgaagttttctatagtga

SEQ ID NO: 7331471 - DNA, 22 bp, Homo sapiens
aacatgaaagttgctaagtgca

SEQ ID NO: 7331472 - DNA, 22 bp, Homo sapiens
aaatgacactcattcagtgtca

SEQ ID NO: 7331473 - DNA, 22 bp, Homo sapiens
aaatgaacatcaagaatagcct

SEQ ID NO: 7331474 - DNA, 21 bp, Homo sapiens
aaatgaatgtggtagtgcaag

SEQ ID NO: 7331475 - DNA, 22 bp, Homo sapiens
aaagcaatggcacatgatggta

SEQ ID NO: 7331476 - DNA, 22 bp, Homo sapiens
aaaagcaagaggctggattaaa

SEQ ID NO: 7331477 - DNA, 22 bp, Homo sapiens
aaaagcaaggcagtctgtctga

SEQ ID NO: 7331478 - DNA, 22 bp, Homo sapiens
aatgctttagcagtgattagtg

SEQ ID NO: 7331479 - DNA, 22 bp, Homo sapiens
aataagaattgccagatttgaa

SEQ ID NO: 7331480 - DNA, 22 bp, Homo sapiens
aagaatcattgtaaagttctgt

SEQ ID NO: 7331481 - DNA, 22 bp, Homo sapiens
atctgggtaaagtggtatattt

SEQ ID NO: 7331482 - DNA, 22 bp, Homo sapiens
atctgggtccaagttctgagca

SEQ ID NO: 7331483 - DNA, 22 bp, Homo sapiens
atgacaatatagctttgatttt

SEQ ID NO: 7331484 - DNA, 22 bp, Homo sapiens
atgactagaggagggatggcca

SEQ ID NO: 7331485 - DNA, 22 bp, Homo sapiens
atggacagctggcctcaaggga

SEQ ID NO: 7331486 - DNA, 22 bp, Homo sapiens
agaggccggccgagcccatggg

SEQ ID NO: 7331487 - DNA, 22 bp, Homo sapiens
attatttgtgtccacagaatac

SEQ ID NO: 7331488 - DNA, 22 bp, Homo sapiens
attcgcgggcctggagggtggg

SEQ ID NO: 7331489 - DNA, 22 bp, Homo sapiens
agcaataacagaaaactttcct

SEQ ID NO: 7331490 - DNA, 22 bp, Homo sapiens
agcaatcaccacctctatattt

SEQ ID NO: 7331491 - DNA, 22 bp, Homo sapiens
agcaatgactggctatatgatt

SEQ ID NO: 7331492 - DNA, 22 bp, Homo sapiens
agcgctgtgggcgtgcgaggag

SEQ ID NO: 7331493 - DNA, 22 bp, Homo sapiens
cactggggtgggcctggtagag

SEQ ID NO: 7331494 - DNA, 22 bp, Homo sapiens
caattattcagtgacttaagag

SEQ ID NO: 7331495 - DNA, 22 bp, Homo sapiens
agttgcagacgcagagatgttg

SEQ ID NO: 7331496 - DNA, 22 bp, Homo sapiens
agaagccaaaggggccagatat

SEQ ID NO: 7331497 - DNA, 22 bp, Homo sapiens
agtgggaggcggctgacgggcg

SEQ ID NO: 7331498 - DNA, 22 bp, Homo sapiens
agtgggaggaagtggtgatatt

SEQ ID NO: 7331499 - DNA, 22 bp, Homo sapiens
agtgaattagcctatttgtaaa

SEQ ID NO: 7331500 - DNA, 22 bp, Homo sapiens
aggtgcatgatgcagagtgcag

SEQ ID NO: 7331501 - DNA, 22 bp, Homo sapiens
agggtccattctttgccttttc

SEQ ID NO: 7331502 - DNA, 22 bp, Homo sapiens
aggggaggagcttttcttgcct

SEQ ID NO: 7331503 - DNA, 22 bp, Homo sapiens
acatgtgtaaaagtggataaaa

SEQ ID NO: 7331504 - DNA, 22 bp, Homo sapiens
aggacttagaacattatgtact

SEQ ID NO: 7331505 - DNA, 22 bp, Homo sapiens
aggacaggtgtagtgggctctg

SEQ ID NO: 7331506 - DNA, 22 bp, Homo sapiens
cagtaacatttcaaggtagagg

SEQ ID NO: 7331507 - DNA, 20 bp, Homo sapiens
cattggacttggcttcatgg

SEQ ID NO: 7331508 - DNA, 22 bp, Homo sapiens
catgagagatccttcatgagag

SEQ ID NO: 7331509 - DNA, 21 bp, Homo sapiens
cctcagtctccctgctccact

SEQ ID NO: 7331510 - DNA, 22 bp, Homo sapiens
agggggtcgtccggaagacctg

SEQ ID NO: 7331511 - DNA, 22 bp, Homo sapiens
agggggtctcctatcatggaag

SEQ ID NO: 7331512 - DNA, 22 bp, Homo sapiens
aggtccatggcagcgggtactt

SEQ ID NO: 7331513 - DNA, 22 bp, Homo sapiens
agtccgtggccagactcaagag

SEQ ID NO: 7331514 - DNA, 22 bp, Homo sapiens
agtcctctgctgtgcgtctttg

SEQ ID NO: 7331515 - DNA, 22 bp, Homo sapiens
atcaaataaaggtacctagctt

SEQ ID NO: 7331516 - DNA, 22 bp, Homo sapiens
atcaaattatgtgctacaagaa

SEQ ID NO: 7331517 - DNA, 22 bp, Homo sapiens
caaatacaaatacgggcagctt

SEQ ID NO: 7331518 - DNA, 19 bp, Homo sapiens
attcttcagcagtgagacc

SEQ ID NO: 7331519 - DNA, 22 bp, Homo sapiens
attgatttaggcttgttatgac

SEQ ID NO: 7331520 - DNA, 22 bp, Homo sapiens
gcagatgctgtggtgatagaag

SEQ ID NO: 7331521 - DNA, 22 bp, Homo sapiens
gcagatgctgtgtgaatgttgg

SEQ ID NO: 7331522 - DNA, 23 bp, Homo sapiens
gcagatgcttagcaggtcctctc

SEQ ID NO: 7331523 - DNA, 22 bp, Homo sapiens
gcagatgctgctcctctctaga

SEQ ID NO: 7331524 - DNA, 22 bp, Homo sapiens
gcagatgcttggcactgacagt

SEQ ID NO: 7331525 - DNA, 22 bp, Homo sapiens
gcagcctttggaattagagact

SEQ ID NO: 7331526 - DNA, 22 bp, Homo sapiens
attagtagtagttagcagcctc

SEQ ID NO: 7331527 - DNA, 22 bp, Homo sapiens
attagtagcacacagagatcag

SEQ ID NO: 7331528 - DNA, 19 bp, Homo sapiens
attagtagctagtgcctgg

SEQ ID NO: 7331529 - DNA, 22 bp, Homo sapiens
attagtagctgtaataactggg

SEQ ID NO: 7331530 - DNA, 22 bp, Homo sapiens
attagtagagggagaagcttgg

SEQ ID NO: 7331531 - DNA, 22 bp, Homo sapiens
gagacagtgtccatccaggggc

SEQ ID NO: 7331532 - DNA, 22 bp, Homo sapiens
atgggagaaacatcatgaggca

SEQ ID NO: 7331533 - DNA, 21 bp, Homo sapiens
atgtgaaatatcatcagagca

SEQ ID NO: 7331534 - DNA, 22 bp, Homo sapiens
gaacaaagacatggaggaggat

SEQ ID NO: 7331535 - DNA, 22 bp, Homo sapiens
atgacataaagctatgctaggt

SEQ ID NO: 7331536 - DNA, 22 bp, Homo sapiens
atgacagatgctgtggggaggt

SEQ ID NO: 7331537 - DNA, 22 bp, Homo sapiens
atgaacagaggaatagaattct

SEQ ID NO: 7331538 - DNA, 22 bp, Homo sapiens
ggtcattgttcttttctgtgat

SEQ ID NO: 7331539 - DNA, 18 bp, Homo sapiens
ggtcctgggcctggctca

SEQ ID NO: 7331540 - DNA, 22 bp, Homo sapiens
ggtcagtgcctatcatgtgggc

SEQ ID NO: 7331541 - DNA, 22 bp, Homo sapiens
ggtcatctcaggtgtgcttgat

SEQ ID NO: 7331542 - DNA, 22 bp, Homo sapiens
ggtcagtggcagggggtacttc

SEQ ID NO: 7331543 - DNA, 22 bp, Homo sapiens
ggtctggaagcgcagtaggctg

SEQ ID NO: 7331544 - DNA, 22 bp, Homo sapiens
cagacctggggcctgggagccc

SEQ ID NO: 7331545 - DNA, 22 bp, Homo sapiens
cagacctgaggttgagtaccag

SEQ ID NO: 7331546 - DNA, 22 bp, Homo sapiens
cagacctgaggagcactgagcc

SEQ ID NO: 7331547 - DNA, 21 bp, Homo sapiens
ggccgccgccttgtgctctgc

SEQ ID NO: 7331548 - DNA, 22 bp, Homo sapiens
tagaaaatggccaagcaggact

SEQ ID NO: 7331549 - DNA, 22 bp, Homo sapiens
taatcactgtgagtctgttttc

SEQ ID NO: 7331550 - DNA, 22 bp, Homo sapiens
catgaaggaccatttcacggtc

SEQ ID NO: 7331551 - DNA, 22 bp, Homo sapiens
catgaaggctgccagcaggcat

SEQ ID NO: 7331552 - DNA, 23 bp, Homo sapiens
catgaaggtagcacaaagcctct

SEQ ID NO: 7331553 - DNA, 22 bp, Homo sapiens
catgaaggaataattgtttaga

SEQ ID NO: 7331554 - DNA, 22 bp, Homo sapiens
catgaaggaattaaggtaagga

SEQ ID NO: 7331555 - DNA, 22 bp, Homo sapiens
catctgggactgtcaggttagc

SEQ ID NO: 7331556 - DNA, 22 bp, Homo sapiens
tcagatagtgataatagcatgt

SEQ ID NO: 7331557 - DNA, 23 bp, Homo sapiens
tcctttaatgctggaatggctag

SEQ ID NO: 7331558 - DNA, 22 bp, Homo sapiens
tcctttaacttgattattttca

SEQ ID NO: 7331559 - DNA, 23 bp, Homo sapiens
tcctttaagatatcttattcctt

SEQ ID NO: 7331560 - DNA, 22 bp, Homo sapiens
tcctttaactagttaccatgtt

SEQ ID NO: 7331561 - DNA, 22 bp, Homo sapiens
tcctttaaagaactgtgctttt

SEQ ID NO: 7331562 - DNA, 22 bp, Homo sapiens
tcctttaaacaaccagctctca

SEQ ID NO: 7331563 - DNA, 22 bp, Homo sapiens
tcctttaaactcctttcaagtc

SEQ ID NO: 7331564 - DNA, 22 bp, Homo sapiens
catttattcatttgctagggct

SEQ ID NO: 7331565 - DNA, 21 bp, Homo sapiens
ttttcaccaataaaaggactt

SEQ ID NO: 7331566 - DNA, 22 bp, Homo sapiens
ttttcaccagcttgctacaatt

SEQ ID NO: 7331567 - DNA, 22 bp, Homo sapiens
ctccagattccgtttattcagg

SEQ ID NO: 7331568 - DNA, 22 bp, Homo sapiens
tttatttaaagtcgtgtgttaa

SEQ ID NO: 7331569 - DNA, 22 bp, Homo sapiens
tttatttaccttatgtcctcca

SEQ ID NO: 7331570 - DNA, 22 bp, Homo sapiens
tttagacatttgtggtttgcaa

SEQ ID NO: 7331571 - DNA, 22 bp, Homo sapiens
tttagtagaaatatttgggcct

SEQ ID NO: 7331572 - DNA, 22 bp, Homo sapiens
tttagtagaatagtatatcaaa

SEQ ID NO: 7331573 - DNA, 22 bp, Homo sapiens
tttagtagaatgatacagggca

SEQ ID NO: 7331574 - DNA, 22 bp, Homo sapiens
tttagtaggaaattgtcttata

SEQ ID NO: 7331575 - DNA, 22 bp, Homo sapiens
tttagtagatgcagcattattt

SEQ ID NO: 7331576 - DNA, 22 bp, Homo sapiens
tttagtagctacagttagaagg

SEQ ID NO: 7331577 - DNA, 22 bp, Homo sapiens
tttagtaggcactaggagggga

SEQ ID NO: 7331578 - DNA, 22 bp, Homo sapiens
tttagtagtgacagattctggg

SEQ ID NO: 7331579 - DNA, 23 bp, Homo sapiens
tttcaaattactctgcagatgac

SEQ ID NO: 7331580 - DNA, 21 bp, Homo sapiens
tgggggagaattggttgcttt

SEQ ID NO: 7331581 - DNA, 22 bp, Homo sapiens
tgggggactgcactggcgtcag

SEQ ID NO: 7331582 - DNA, 22 bp, Homo sapiens
tggggaggaagtcagatttcag

SEQ ID NO: 7331583 - DNA, 22 bp, Homo sapiens
ctattatttcctcatctataaa

SEQ ID NO: 7331584 - DNA, 22 bp, Homo sapiens
ctattattagataatctacttg

SEQ ID NO: 7331585 - DNA, 22 bp, Homo sapiens
ctgttctgtctcatgttgcaca

SEQ ID NO: 7331586 - DNA, 22 bp, Homo sapiens
cttcagtgaatgttgagtaagg

SEQ ID NO: 7331587 - DNA, 22 bp, Homo sapiens
ctgggtctcttaccatgtgact

SEQ ID NO: 7331588 - DNA, 22 bp, Homo sapiens
ctgggtctctttagggtgccgt

SEQ ID NO: 7331589 - DNA, 22 bp, Homo sapiens
gagatgctttgtgtatagacaa

SEQ ID NO: 7331590 - DNA, 21 bp, Homo sapiens
gagatgctttttattcaaccc

SEQ ID NO: 7331591 - DNA, 22 bp, Homo sapiens
gagatgcttttggtccaagagt

SEQ ID NO: 7331592 - DNA, 22 bp, Homo sapiens
gagaatgggaatgaaagtagca

SEQ ID NO: 7331593 - DNA, 22 bp, Homo sapiens
gagaggctgggttggagatcga

SEQ ID NO: 7331594 - DNA, 22 bp, Homo sapiens
gagatgctttctgcccttggta

SEQ ID NO: 7331595 - DNA, 22 bp, Homo sapiens
gagatgctttatctcctttgtc

SEQ ID NO: 7331596 - DNA, 22 bp, Homo sapiens
gagatgcttgtctgtcttatca

SEQ ID NO: 7331597 - DNA, 22 bp, Homo sapiens
gagatgctgtcaggctatctgt

SEQ ID NO: 7331598 - DNA, 22 bp, Homo sapiens
gagatgctgctcttactgtata

SEQ ID NO: 7331599 - DNA, 22 bp, Homo sapiens
gagatgctgcctgatttattca

SEQ ID NO: 7331600 - DNA, 22 bp, Homo sapiens
gagatgctgaaatctgagtgta

SEQ ID NO: 7331601 - DNA, 17 bp, Homo sapiens
gagatgctaatctgatc

SEQ ID NO: 7331602 - DNA, 22 bp, Homo sapiens
gagatgctatggctattcccct

SEQ ID NO: 7331603 - DNA, 15 bp, Homo sapiens
gagatgctctcaggg

SEQ ID NO: 7331604 - DNA, 22 bp, Homo sapiens
gaatatcccgctatgcaaagta

SEQ ID NO: 7331605 - DNA, 22 bp, Homo sapiens
gggacatctttctagtcagggt

SEQ ID NO: 7331606 - DNA, 19 bp, Homo sapiens
ggcatggggtccggggacc

SEQ ID NO: 7331607 - DNA, 19 bp, Homo sapiens
ggccatctctgccccagca

SEQ ID NO: 7331608 - DNA, 22 bp, Homo sapiens
ggagtccaccaagtatttcagg

SEQ ID NO: 7331609 - DNA, 22 bp, Homo sapiens
ggagtccaaattttttgaatca

SEQ ID NO: 7331610 - DNA, 22 bp, Homo sapiens
ggagtccataggttcttatggg

SEQ ID NO: 7331611 - DNA, 22 bp, Homo sapiens
gtccaagagtcaagaagggggc

SEQ ID NO: 7331612 - DNA, 22 bp, Homo sapiens
gtatttaattccattaagttag

SEQ ID NO: 7331613 - DNA, 22 bp, Homo sapiens
gtatttaattctgtgcttctag

SEQ ID NO: 7331614 - DNA, 22 bp, Homo sapiens
gtgaacaggagaaagtgatgga

SEQ ID NO: 7331615 - DNA, 22 bp, Homo sapiens
gtcctgggcggagggctgctgt

SEQ ID NO: 7331616 - DNA, 22 bp, Homo sapiens
gtcctgggggcagctgtgtcca

SEQ ID NO: 7331617 - DNA, 22 bp, Homo sapiens
gtgcattccaccgtgcaggttg

SEQ ID NO: 7331618 - DNA, 22 bp, Homo sapiens
ggggccgaccgcggttcaggcc

SEQ ID NO: 7331619 - DNA, 22 bp, Homo sapiens
gcctttaaagccccgagagccc

SEQ ID NO: 7331620 - DNA, 22 bp, Homo sapiens
gcctttaaagctggcaggcttt

SEQ ID NO: 7331621 - DNA, 22 bp, Homo sapiens
gctgagggcagcctcctaggtc

SEQ ID NO: 7331622 - DNA, 22 bp, Homo sapiens
tccatctgtcaaatatcatgct

SEQ ID NO: 7331623 - DNA, 22 bp, Homo sapiens
tccatctggtggcttccttttg

SEQ ID NO: 7331624 - DNA, 22 bp, Homo sapiens
tccatctggtaaaattcattga

SEQ ID NO: 7331625 - DNA, 22 bp, Homo sapiens
tccatctggatggtatgtgtaa

SEQ ID NO: 7331626 - DNA, 22 bp, Homo sapiens
tccatctgcatttggtttctgt

SEQ ID NO: 7331627 - DNA, 22 bp, Homo sapiens
tccatctggagacttcctggtc

SEQ ID NO: 7331628 - DNA, 22 bp, Homo sapiens
tcccagtttttctccactaagg

SEQ ID NO: 7331629 - DNA, 19 bp, Homo sapiens
tcacccaggctgctggctc

SEQ ID NO: 7331630 - DNA, 22 bp, Homo sapiens
tcacccaggctggactgcagtg

SEQ ID NO: 7331631 - DNA, 22 bp, Homo sapiens
tcacccaggctggtatgcagtg

SEQ ID NO: 7331632 - DNA, 22 bp, Homo sapiens
tcacccaggctggagtgcagtg

SEQ ID NO: 7331633 - DNA, 23 bp, Homo sapiens
tcactgatgttacagcagccagt

SEQ ID NO: 7331634 - DNA, 22 bp, Homo sapiens
tcatggattaaattattaagtt

SEQ ID NO: 7331635 - DNA, 22 bp, Homo sapiens
tcatagctaagctccagagtgc

SEQ ID NO: 7331636 - DNA, 22 bp, Homo sapiens
tcaggatgtccaaaatccagcc

SEQ ID NO: 7331637 - DNA, 22 bp, Homo sapiens
tagaaaactaatacatgcttga

SEQ ID NO: 7331638 - DNA, 22 bp, Homo sapiens
tagaattttctgctttgatagt

SEQ ID NO: 7331639 - DNA, 22 bp, Homo sapiens
tagaatgacctcctcttagctt

SEQ ID NO: 7331640 - DNA, 22 bp, Homo sapiens
tagaatgagaaagtgtagcagg

SEQ ID NO: 7331641 - DNA, 22 bp, Homo sapiens
tattagcgtcaggaggtgagta

SEQ ID NO: 7331642 - DNA, 21 bp, Homo sapiens
tatttattaatttgtaaggct

SEQ ID NO: 7331643 - DNA, 22 bp, Homo sapiens
tattattttagcactgaggatt

SEQ ID NO: 7331644 - DNA, 22 bp, Homo sapiens
tattattgaatcagttctttga

SEQ ID NO: 7331645 - DNA, 22 bp, Homo sapiens
tattaggcatttgaggataaac

SEQ ID NO: 7331646 - DNA, 22 bp, Homo sapiens
tattctggtttccggatctcta

SEQ ID NO: 7331647 - DNA, 22 bp, Homo sapiens
tataatttggggaaagtggtgt

SEQ ID NO: 7331648 - DNA, 21 bp, Homo sapiens
tacagatgaggagaccaaggc

SEQ ID NO: 7331649 - DNA, 21 bp, Homo sapiens
taagtgcaaagagacagatac

SEQ ID NO: 7331650 - DNA, 22 bp, Homo sapiens
tacaaaggaaacttcttttccc

SEQ ID NO: 7331651 - DNA, 22 bp, Homo sapiens
gtttttattgtgtaaatgtggg

SEQ ID NO: 7331652 - DNA, 22 bp, Homo sapiens
taacctttttatcttacctcca

SEQ ID NO: 7331653 - DNA, 22 bp, Homo sapiens
taacctttgttcaatgtaagat

SEQ ID NO: 7331654 - DNA, 22 bp, Homo sapiens
taacctttggtgaaatattaac

SEQ ID NO: 7331655 - DNA, 22 bp, Homo sapiens
taacctttctcttgtggctgac

SEQ ID NO: 7331656 - DNA, 22 bp, Homo sapiens
taacctttgaccttgcttgtgc

SEQ ID NO: 7331657 - DNA, 22 bp, Homo sapiens
taacctttcaggcatgtaggtt

SEQ ID NO: 7331658 - DNA, 22 bp, Homo sapiens
ttcaatttcataatatctagct

SEQ ID NO: 7331659 - DNA, 22 bp, Homo sapiens
ttcatcatgatgttcccctcta

SEQ ID NO: 7331660 - DNA, 22 bp, Homo sapiens
ttgatttatagaatgttcaagc

SEQ ID NO: 7331661 - DNA, 22 bp, Homo sapiens
ttactttatctcctagattcca

SEQ ID NO: 7331662 - DNA, 22 bp, Homo sapiens
ttaaatgaggctgatgtagatt

SEQ ID NO: 7331663 - DNA, 22 bp, Homo sapiens
ttaattgttggaaatagattat

SEQ ID NO: 7331664 - DNA, 22 bp, Homo sapiens
ttaacactcctaactacagtct

SEQ ID NO: 7331665 - DNA, 22 bp, Homo sapiens
ttaagaaggtactcaaagatct

SEQ ID NO: 7331666 - DNA, 22 bp, Homo sapiens
ttaaggaaagccaaaatgaatt

SEQ ID NO: 7331667 - DNA, 22 bp, Homo sapiens
tcccccaggctggagtgcagtg

SEQ ID NO: 7331668 - DNA, 22 bp, Homo sapiens
tttcatttcatagaattgtgtt

SEQ ID NO: 7331669 - DNA, 22 bp, Homo sapiens
tttctttaattctcacagcaat

SEQ ID NO: 7331670 - DNA, 22 bp, Homo sapiens
tttattattctctggagaatgt

SEQ ID NO: 7331671 - DNA, 22 bp, Homo sapiens
tttattagtgcttgtatcactg

SEQ ID NO: 7331672 - DNA, 22 bp, Homo sapiens
tttattagattatcaaagaggt

SEQ ID NO: 7331673 - DNA, 22 bp, Homo sapiens
tttattagtgcttgtatcactg

SEQ ID NO: 7331674 - DNA, 22 bp, Homo sapiens
tttacaaggcagaactgattaa

SEQ ID NO: 7331675 - DNA, 22 bp, Homo sapiens
tttagttattgcacagaattag

SEQ ID NO: 7331676 - DNA, 22 bp, Homo sapiens
tttaattaggaaatgggcaggg

SEQ ID NO: 7331677 - DNA, 22 bp, Homo sapiens
tttaattatatctgggcagtta

SEQ ID NO: 7331678 - DNA, 22 bp, Homo sapiens
ttgtgtttctggccaagatgga

SEQ ID NO: 7331679 - DNA, 22 bp, Homo sapiens
ttgcaacttctcccatcactct

SEQ ID NO: 7331680 - DNA, 22 bp, Homo sapiens
ggccgctctccggtgtggatct

SEQ ID NO: 7331681 - DNA, 19 bp, Homo sapiens
ggccgcggcccgcagtggg

SEQ ID NO: 7331682 - DNA, 22 bp, Homo sapiens
ggccgctgcgcctccaaccgag

SEQ ID NO: 7331683 - DNA, 20 bp, Homo sapiens
ggccggggagctctccaggg

SEQ ID NO: 7331684 - DNA, 22 bp, Homo sapiens
ggccggggcctgctcgcctgtg

SEQ ID NO: 7331685 - DNA, 22 bp, Homo sapiens
cacgagaacctctcatttgatt

SEQ ID NO: 7331686 - DNA, 22 bp, Homo sapiens
cacgagggcacacgtgggaggg

SEQ ID NO: 7331687 - DNA, 22 bp, Homo sapiens
cacgcacgctgggtggaggcgc

SEQ ID NO: 7331688 - DNA, 23 bp, Homo sapiens
ggccactgaattttctgcatctt

SEQ ID NO: 7331689 - DNA, 22 bp, Homo sapiens
ggccactgacctacatctgggg

SEQ ID NO: 7331690 - DNA, 22 bp, Homo sapiens
ggccactgctctccagcctggg

SEQ ID NO: 7331691 - DNA, 22 bp, Homo sapiens
ggccctgtccctggccgtctgt

SEQ ID NO: 7331692 - DNA, 22 bp, Homo sapiens
ggccctgtccctggccgtctgt

SEQ ID NO: 7331693 - DNA, 22 bp, Homo sapiens
ggccctgtcctggctgtctccg

SEQ ID NO: 7331694 - DNA, 22 bp, Homo sapiens
ggccccagggattaggccaacc

SEQ ID NO: 7331695 - DNA, 21 bp, Homo sapiens
ggccctggttacgcctcctct

SEQ ID NO: 7331696 - DNA, 21 bp, Homo sapiens
ggccctggttacgcctcctct

SEQ ID NO: 7331697 - DNA, 22 bp, Homo sapiens
ggccctgtccccttcagttttg

SEQ ID NO: 7331698 - DNA, 22 bp, Homo sapiens
ggccctgttccacgtggggtgt

SEQ ID NO: 7331699 - DNA, 22 bp, Homo sapiens
ggcccttgcagcaggcgctggc

SEQ ID NO: 7331700 - DNA, 22 bp, Homo sapiens
ggcccttcctgctctcttagct

SEQ ID NO: 7331701 - DNA, 22 bp, Homo sapiens
ggcaggtgatctagagtcaata

SEQ ID NO: 7331702 - DNA, 22 bp, Homo sapiens
ggcaggtgcacctgagccatct

SEQ ID NO: 7331703 - DNA, 22 bp, Homo sapiens
ggcaggtgccagttggcttggg

SEQ ID NO: 7331704 - DNA, 22 bp, Homo sapiens
ggcaggtgcccagagagcacga

SEQ ID NO: 7331705 - DNA, 22 bp, Homo sapiens
ggcagggagtggagactcccta

SEQ ID NO: 7331706 - DNA, 22 bp, Homo sapiens
ggcagggcagcgctgattaggg

SEQ ID NO: 7331707 - DNA, 22 bp, Homo sapiens
ggcagggcaggaaagtcaggaa

SEQ ID NO: 7331708 - DNA, 22 bp, Homo sapiens
ggcagggcaggaaagtcaggaa

SEQ ID NO: 7331709 - DNA, 22 bp, Homo sapiens
cacatttagaggttagcatggt

SEQ ID NO: 7331710 - DNA, 22 bp, Homo sapiens
cacatttacttttatcccttgg

SEQ ID NO: 7331711 - DNA, 22 bp, Homo sapiens
cacatttaggttcctatagcca

SEQ ID NO: 7331712 - DNA, 22 bp, Homo sapiens
cacattcttggtcaccttgtgg

SEQ ID NO: 7331713 - DNA, 22 bp, Homo sapiens
cacattcttggtcaccttgtgg

SEQ ID NO: 7331714 - DNA, 22 bp, Homo sapiens
cacattctttcacagttctgaa

SEQ ID NO: 7331715 - DNA, 22 bp, Homo sapiens
cacatatacctcttcttgagtt

SEQ ID NO: 7331716 - DNA, 23 bp, Homo sapiens
cacatatagcagccactaaggtc

SEQ ID NO: 7331717 - DNA, 22 bp, Homo sapiens
cacattcttgagttacagtcta

SEQ ID NO: 7331718 - DNA, 22 bp, Homo sapiens
cacattctgtgaagctgatttt

SEQ ID NO: 7331719 - DNA, 22 bp, Homo sapiens
cacatataacctagacaaggcc

SEQ ID NO: 7331720 - DNA, 22 bp, Homo sapiens
cacatataccagccgcggtacg

SEQ ID NO: 7331721 - DNA, 20 bp, Homo sapiens
ggcaggcaggaggtttccag

SEQ ID NO: 7331722 - DNA, 22 bp, Homo sapiens
ggcaggcatcatcagttgatca

SEQ ID NO: 7331723 - DNA, 20 bp, Homo sapiens
ggcagggagggatactgagg

SEQ ID NO: 7331724 - DNA, 22 bp, Homo sapiens
ggcaggcatggggtctgccatt

SEQ ID NO: 7331725 - DNA, 22 bp, Homo sapiens
ggcaggcatcatgtggtcatta

SEQ ID NO: 7331726 - DNA, 22 bp, Homo sapiens
cacagggaaccaaggctgggcc

SEQ ID NO: 7331727 - DNA, 19 bp, Homo sapiens
cacagggagaccacatgtc

SEQ ID NO: 7331728 - DNA, 22 bp, Homo sapiens
cacagggaaccaaggctgggcc

SEQ ID NO: 7331729 - DNA, 22 bp, Homo sapiens
cacagtttggttttgctgtaat

SEQ ID NO: 7331730 - DNA, 22 bp, Homo sapiens
cacagttttatcttatactgat

SEQ ID NO: 7331731 - DNA, 22 bp, Homo sapiens
cacagttttgcccagggcttct

SEQ ID NO: 7331732 - DNA, 22 bp, Homo sapiens
cacagttttgtcttggtttcca

SEQ ID NO: 7331733 - DNA, 22 bp, Homo sapiens
cacataaatggtgccatgtttt

SEQ ID NO: 7331734 - DNA, 22 bp, Homo sapiens
cacatacaaggcacactggagg

SEQ ID NO: 7331735 - DNA, 22 bp, Homo sapiens
cacatacaatggtgttatttgg

SEQ ID NO: 7331736 - DNA, 22 bp, Homo sapiens
cacatacaatggtgttatttgg

SEQ ID NO: 7331737 - DNA, 22 bp, Homo sapiens
cacatacttgtgtgtacatatg

SEQ ID NO: 7331738 - DNA, 22 bp, Homo sapiens
cacatacattcatgttactcta

SEQ ID NO: 7331739 - DNA, 22 bp, Homo sapiens
cacatacatgcacacctaaata

SEQ ID NO: 7331740 - DNA, 22 bp, Homo sapiens
cacatacatacgtatgtataca

SEQ ID NO: 7331741 - DNA, 19 bp, Homo sapiens
cacatacagaaaagagtaa

SEQ ID NO: 7331742 - DNA, 22 bp, Homo sapiens
ggctcaggttgggtcacatgac

SEQ ID NO: 7331743 - DNA, 22 bp, Homo sapiens
ggctcaggttaccagtccctcc

SEQ ID NO: 7331744 - DNA, 22 bp, Homo sapiens
ggctcaggttaccagtccctcc

SEQ ID NO: 7331745 - DNA, 22 bp, Homo sapiens
ggctcaggttgggtcacatgac

SEQ ID NO: 7331746 - DNA, 22 bp, Homo sapiens
ggctccagggtacccctggatg

SEQ ID NO: 7331747 - DNA, 22 bp, Homo sapiens
ggctcaggtttaaagtgcttta

SEQ ID NO: 7331748 - DNA, 22 bp, Homo sapiens
ggctccagggtacccctggatg

SEQ ID NO: 7331749 - DNA, 22 bp, Homo sapiens
ggctccagggtctctccttgtg

SEQ ID NO: 7331750 - DNA, 22 bp, Homo sapiens
ggctccaggtgcatgccaggct

SEQ ID NO: 7331751 - DNA, 22 bp, Homo sapiens
ggctccaggtgcatgccaggct

SEQ ID NO: 7331752 - DNA, 20 bp, Homo sapiens
ggctctggaatctggtgggc

SEQ ID NO: 7331753 - DNA, 22 bp, Homo sapiens
ggctctggtcagtgaggggcct

SEQ ID NO: 7331754 - DNA, 22 bp, Homo sapiens
ggctctggtgccctggctccca

SEQ ID NO: 7331755 - DNA, 22 bp, Homo sapiens
ggctgagctcaggggcagcagg

SEQ ID NO: 7331756 - DNA, 22 bp, Homo sapiens
ggctgaggcggcgatgcccttg

SEQ ID NO: 7331757 - DNA, 22 bp, Homo sapiens
ggctgaggcggcgatgcccttg

SEQ ID NO: 7331758 - DNA, 22 bp, Homo sapiens
ggcctgtgggaggacagctggg

SEQ ID NO: 7331759 - DNA, 19 bp, Homo sapiens
ggctcagggcgctgccgcc

SEQ ID NO: 7331760 - DNA, 19 bp, Homo sapiens
ggctcagggcgctgccgcc

SEQ ID NO: 7331761 - DNA, 22 bp, Homo sapiens
ggctcaggggccaggcctgtcc

SEQ ID NO: 7331762 - DNA, 22 bp, Homo sapiens
ggctcaggggccaggcctgtcc

SEQ ID NO: 7331763 - DNA, 19 bp, Homo sapiens
ggctcagggcgctgccgcc

SEQ ID NO: 7331764 - DNA, 22 bp, Homo sapiens
ggctcagggaatgaggaagaat

SEQ ID NO: 7331765 - DNA, 22 bp, Homo sapiens
ggctcaggctggagtgcagtgg

SEQ ID NO: 7331766 - DNA, 22 bp, Homo sapiens
ggctcagggaatgaggaagaat

SEQ ID NO: 7331767 - DNA, 22 bp, Homo sapiens
ggctcaggctggagtgcagtgg

SEQ ID NO: 7331768 - DNA, 18 bp, Homo sapiens
ggctcaggctatcctaac

SEQ ID NO: 7331769 - DNA, 21 bp, Homo sapiens
cactttaatggatatttgttt

SEQ ID NO: 7331770 - DNA, 20 bp, Homo sapiens
ggctgcccactccagagtac

SEQ ID NO: 7331771 - DNA, 22 bp, Homo sapiens
ggctgccccagtgctcatggct

SEQ ID NO: 7331772 - DNA, 22 bp, Homo sapiens
cagaaaataaagtttctacgca

SEQ ID NO: 7331773 - DNA, 22 bp, Homo sapiens
ggctgcctactttcccagagtt

SEQ ID NO: 7331774 - DNA, 22 bp, Homo sapiens
ggctgccctgggaggcaagggt

SEQ ID NO: 7331775 - DNA, 22 bp, Homo sapiens
ggctgccctcgtctactgccca

SEQ ID NO: 7331776 - DNA, 22 bp, Homo sapiens
ggctgccctgggaggcaagggt

SEQ ID NO: 7331777 - DNA, 22 bp, Homo sapiens
ggctgccctcggggtcgcaggc

SEQ ID NO: 7331778 - DNA, 22 bp, Homo sapiens
cagaaagcaaaatggatctctg

SEQ ID NO: 7331779 - DNA, 22 bp, Homo sapiens
cagaaagcaaaatggatctctg

SEQ ID NO: 7331780 - DNA, 22 bp, Homo sapiens
cagaaagccaactccaactgtc

SEQ ID NO: 7331781 - DNA, 22 bp, Homo sapiens
cagaaagccaactccaactgtc

SEQ ID NO: 7331782 - DNA, 22 bp, Homo sapiens
cagaaagccctatgtacagtgg

SEQ ID NO: 7331783 - DNA, 22 bp, Homo sapiens
cagaaagcaagccattcactgt

SEQ ID NO: 7331784 - DNA, 22 bp, Homo sapiens
cagaaagcagagctgagccttt

SEQ ID NO: 7331785 - DNA, 22 bp, Homo sapiens
cagaaagcagttgtcaatgggc

SEQ ID NO: 7331786 - DNA, 20 bp, Homo sapiens
cagaaagcatgttccagggc

SEQ ID NO: 7331787 - DNA, 23 bp, Homo sapiens
cagaaagccctttccccacagta

SEQ ID NO: 7331788 - DNA, 22 bp, Homo sapiens
cagaaagccgacttacaatgga

SEQ ID NO: 7331789 - DNA, 23 bp, Homo sapiens
cagaaagccctttccccacagta

SEQ ID NO: 7331790 - DNA, 22 bp, Homo sapiens
cagaaagcgggatgcagcatgt

SEQ ID NO: 7331791 - DNA, 22 bp, Homo sapiens
cagaaagctctttcaatcttgc

SEQ ID NO: 7331792 - DNA, 22 bp, Homo sapiens
cagaaataaagtggacagagta

SEQ ID NO: 7331793 - DNA, 22 bp, Homo sapiens
cagaaataaacttctcacatcg

SEQ ID NO: 7331794 - DNA, 22 bp, Homo sapiens
cagaaataaacttctcacatcg

SEQ ID NO: 7331795 - DNA, 22 bp, Homo sapiens
cagaaagctctttcaatcttgc

SEQ ID NO: 7331796 - DNA, 22 bp, Homo sapiens
cagaaagcttaggcaagttgga

SEQ ID NO: 7331797 - DNA, 22 bp, Homo sapiens
cagaaagctctttcaatcttgc

SEQ ID NO: 7331798 - DNA, 22 bp, Homo sapiens
cagaaagcttggtacaatatgc

SEQ ID NO: 7331799 - DNA, 18 bp, Homo sapiens
cagaaagttatttactct

SEQ ID NO: 7331800 - DNA, 21 bp, Homo sapiens
ggctggtgtttagctgtgata

SEQ ID NO: 7331801 - DNA, 22 bp, Homo sapiens
ggctgtccacctaccatgccgg

SEQ ID NO: 7331802 - DNA, 20 bp, Homo sapiens
ggctgtcccgcggctgccgg

SEQ ID NO: 7331803 - DNA, 22 bp, Homo sapiens
ggctgtccttggccaaggcact

SEQ ID NO: 7331804 - DNA, 22 bp, Homo sapiens
cacacaggagagtgctggaggt

SEQ ID NO: 7331805 - DNA, 22 bp, Homo sapiens
ggaagggcaataaaatctcagg

SEQ ID NO: 7331806 - DNA, 22 bp, Homo sapiens
cacacagctagtgacaggagaa

SEQ ID NO: 7331807 - DNA, 22 bp, Homo sapiens
cacacagctagtgacaggagaa

SEQ ID NO: 7331808 - DNA, 22 bp, Homo sapiens
cacacagatggtaagggaggga

SEQ ID NO: 7331809 - DNA, 22 bp, Homo sapiens
cacacagacagctctctgaaga

SEQ ID NO: 7331810 - DNA, 22 bp, Homo sapiens
cacacagatggtaagggaggga

SEQ ID NO: 7331811 - DNA, 22 bp, Homo sapiens
cacacagcaacaagaatagcca

SEQ ID NO: 7331812 - DNA, 22 bp, Homo sapiens
cacacagcaacaagaatagcca

SEQ ID NO: 7331813 - DNA, 18 bp, Homo sapiens
caatgttttagatctcta

SEQ ID NO: 7331814 - DNA, 18 bp, Homo sapiens
caatgttttagatctcta

SEQ ID NO: 7331815 - DNA, 22 bp, Homo sapiens
caatgttttcaactgacaagta

SEQ ID NO: 7331816 - DNA, 22 bp, Homo sapiens
caatgtttgttagagctctaga

SEQ ID NO: 7331817 - DNA, 22 bp, Homo sapiens
caatgtttgttagagctctaga

SEQ ID NO: 7331818 - DNA, 22 bp, Homo sapiens
caatgtttgtgatctactgact

SEQ ID NO: 7331819 - DNA, 22 bp, Homo sapiens
cacaattttaatacacagtcaa

SEQ ID NO: 7331820 - DNA, 22 bp, Homo sapiens
caatgtttgagtaggagcataa

SEQ ID NO: 7331821 - DNA, 20 bp, Homo sapiens
ggaaggggcaaagtgtgtga

SEQ ID NO: 7331822 - DNA, 22 bp, Homo sapiens
cacagaagtgtgtataactctt

SEQ ID NO: 7331823 - DNA, 22 bp, Homo sapiens
cacagaactggttaatagcaga

SEQ ID NO: 7331824 - DNA, 22 bp, Homo sapiens
cacagaagaatcatgctgtgtt

SEQ ID NO: 7331825 - DNA, 22 bp, Homo sapiens
cacagaagtgtgtataactctt

SEQ ID NO: 7331826 - DNA, 22 bp, Homo sapiens
cacagaagtttcatagtctcga

SEQ ID NO: 7331827 - DNA, 22 bp, Homo sapiens
ggaagggcctcgggcgtgggac

SEQ ID NO: 7331828 - DNA, 22 bp, Homo sapiens
ggaagggcctcgggcgtgggac

SEQ ID NO: 7331829 - DNA, 21 bp, Homo sapiens
ggaagggctctgaggacggct

SEQ ID NO: 7331830 - DNA, 21 bp, Homo sapiens
ggaagggctctgaggacggct

SEQ ID NO: 7331831 - DNA, 22 bp, Homo sapiens
ggaaggggagctaaatctactg

SEQ ID NO: 7331832 - DNA, 22 bp, Homo sapiens
ggaaggggagctggaaagggta

SEQ ID NO: 7331833 - DNA, 22 bp, Homo sapiens
cacagagctgaacctgggtcat

SEQ ID NO: 7331834 - DNA, 22 bp, Homo sapiens
cacagaggctcaaagccaggtg

SEQ ID NO: 7331835 - DNA, 22 bp, Homo sapiens
cacagaggatgcccaagcgatc

SEQ ID NO: 7331836 - DNA, 22 bp, Homo sapiens
cacagagaaaatgttggtgctt

SEQ ID NO: 7331837 - DNA, 22 bp, Homo sapiens
ggactgggagaatggaggcaag

SEQ ID NO: 7331838 - DNA, 20 bp, Homo sapiens
cacagactgtatgggcacca

SEQ ID NO: 7331839 - DNA, 22 bp, Homo sapiens
cacagaattaagggagaaatat

SEQ ID NO: 7331840 - DNA, 22 bp, Homo sapiens
ggactgggtaggagcccagggc

SEQ ID NO: 7331841 - DNA, 22 bp, Homo sapiens
ggactggggccaacacctccct

SEQ ID NO: 7331842 - DNA, 22 bp, Homo sapiens
cacagagaccccttctggggcc

SEQ ID NO: 7331843 - DNA, 17 bp, Homo sapiens
ggactgggcggggcagg

SEQ ID NO: 7331844 - DNA, 22 bp, Homo sapiens
ggactgggccaggggttggact

SEQ ID NO: 7331845 - DNA, 22 bp, Homo sapiens
ggactgggattctggatctgct

SEQ ID NO: 7331846 - DNA, 22 bp, Homo sapiens
ggactgggcatgggtgctctgc

SEQ ID NO: 7331847 - DNA, 19 bp, Homo sapiens
ggagccgccgcccttcatt

SEQ ID NO: 7331848 - DNA, 20 bp, Homo sapiens
cacagagtcttgcagcgttc

SEQ ID NO: 7331849 - DNA, 22 bp, Homo sapiens
cacagaggtgatagtggtcaag

SEQ ID NO: 7331850 - DNA, 22 bp, Homo sapiens
cacagatacctagtgaaacata

SEQ ID NO: 7331851 - DNA, 19 bp, Homo sapiens
cacagatgattgacacata

SEQ ID NO: 7331852 - DNA, 19 bp, Homo sapiens
cacagatgattgacacata

SEQ ID NO: 7331853 - DNA, 22 bp, Homo sapiens
cacagatgaagtaaacaactct

SEQ ID NO: 7331854 - DNA, 22 bp, Homo sapiens
cacaggcttttctgacataggc

SEQ ID NO: 7331855 - DNA, 22 bp, Homo sapiens
cacaggcttgtcagcatgaggc

SEQ ID NO: 7331856 - DNA, 23 bp, Homo sapiens
cacaggctgcgcataagcttctc

SEQ ID NO: 7331857 - DNA, 20 bp, Homo sapiens
cacaggctatatgagagcca

SEQ ID NO: 7331858 - DNA, 22 bp, Homo sapiens
cacaggcttccagtccccagct

SEQ ID NO: 7331859 - DNA, 22 bp, Homo sapiens
ggaggcattatggggaagactt

SEQ ID NO: 7331860 - DNA, 22 bp, Homo sapiens
ggaggcaggaaagacaggttca

SEQ ID NO: 7331861 - DNA, 20 bp, Homo sapiens
cacaggccttgtgagcagac

SEQ ID NO: 7331862 - DNA, 22 bp, Homo sapiens
ggaggcagaatagagtgtgggt

SEQ ID NO: 7331863 - DNA, 22 bp, Homo sapiens
cacaggaatcgtcacttagcgc

SEQ ID NO: 7331864 - DNA, 22 bp, Homo sapiens
caagggggcaggatcacacttg

SEQ ID NO: 7331865 - DNA, 22 bp, Homo sapiens
caagggggagatttagggtaat

SEQ ID NO: 7331866 - DNA, 22 bp, Homo sapiens
caaggcctgcctctggcagaaa

SEQ ID NO: 7331867 - DNA, 22 bp, Homo sapiens
caaggcagcttaatagaatttg

SEQ ID NO: 7331868 - DNA, 22 bp, Homo sapiens
gctggaggatggactggaagaa

SEQ ID NO: 7331869 - DNA, 22 bp, Homo sapiens
gctggaggcagttcagacacca

SEQ ID NO: 7331870 - DNA, 22 bp, Homo sapiens
caagattatcttcttcttgtta

SEQ ID NO: 7331871 - DNA, 22 bp, Homo sapiens
caaatgtgacttttgggcttct

SEQ ID NO: 7331872 - DNA, 22 bp, Homo sapiens
caaatgtaaattcttttgaagc

SEQ ID NO: 7331873 - DNA, 22 bp, Homo sapiens
caagccagctcctgccacagag

SEQ ID NO: 7331874 - DNA, 22 bp, Homo sapiens
gctggaggatcacttgagccca

SEQ ID NO: 7331875 - DNA, 22 bp, Homo sapiens
gctggaggatggactggaagaa

SEQ ID NO: 7331876 - DNA, 22 bp, Homo sapiens
caagccagtttgtagttctctc

SEQ ID NO: 7331877 - DNA, 22 bp, Homo sapiens
gctggagcttgagaggacaggg

SEQ ID NO: 7331878 - DNA, 22 bp, Homo sapiens
gctggaggaggaagtgtgaggg

SEQ ID NO: 7331879 - DNA, 22 bp, Homo sapiens
gctggaggaggaagtgtgaggg

SEQ ID NO: 7331880 - DNA, 22 bp, Homo sapiens
gctgttcatagaaatggtctca

SEQ ID NO: 7331881 - DNA, 22 bp, Homo sapiens
caagtcaatacctgtggacaaa

SEQ ID NO: 7331882 - DNA, 22 bp, Homo sapiens
caaggtgccatgctgggcgggg

SEQ ID NO: 7331883 - DNA, 22 bp, Homo sapiens
caagtagagattacagtgtgca

SEQ ID NO: 7331884 - DNA, 22 bp, Homo sapiens
caagtagagttcacttgtcttt

SEQ ID NO: 7331885 - DNA, 22 bp, Homo sapiens
caatgtcagaattacagttgat

SEQ ID NO: 7331886 - DNA, 22 bp, Homo sapiens
caatgtcaaggagaccaaaacg

SEQ ID NO: 7331887 - DNA, 22 bp, Homo sapiens
caatgtctagtttcccaaatcc

SEQ ID NO: 7331888 - DNA, 22 bp, Homo sapiens
caatgtcatttcactgggctta

SEQ ID NO: 7331889 - DNA, 22 bp, Homo sapiens
caatgtctgaccgttttgccca

SEQ ID NO: 7331890 - DNA, 22 bp, Homo sapiens
caatgtcagagaagctcatatc

SEQ ID NO: 7331891 - DNA, 22 bp, Homo sapiens
caatgtcagtcaagcagcaaat

SEQ ID NO: 7331892 - DNA, 22 bp, Homo sapiens
caatgtcatgattttccattag

SEQ ID NO: 7331893 - DNA, 21 bp, Homo sapiens
caatgtctgctctctgcctag

SEQ ID NO: 7331894 - DNA, 22 bp, Homo sapiens
caatgtctgggagacctgtgat

SEQ ID NO: 7331895 - DNA, 22 bp, Homo sapiens
caatgtcttctatagttactca

SEQ ID NO: 7331896 - DNA, 22 bp, Homo sapiens
caatgtttcttgtaaccagtga

SEQ ID NO: 7331897 - DNA, 22 bp, Homo sapiens
caatgtttgagtaggagcataa

SEQ ID NO: 7331898 - DNA, 22 bp, Homo sapiens
caatgtttgtgatctactgact

SEQ ID NO: 7331899 - DNA, 22 bp, Homo sapiens
caatgtttcttgtaaccagtga

SEQ ID NO: 7331900 - DNA, 22 bp, Homo sapiens
caatgtttactggggacccaga

SEQ ID NO: 7331901 - DNA, 22 bp, Homo sapiens
caatgtttactggggacccaga

SEQ ID NO: 7331902 - DNA, 17 bp, Homo sapiens
gcttgggctgcctgttg

SEQ ID NO: 7331903 - DNA, 22 bp, Homo sapiens
caagttttagaaatatctggat

SEQ ID NO: 7331904 - DNA, 22 bp, Homo sapiens
cagacctgaggagcactgagcc

SEQ ID NO: 7331905 - DNA, 22 bp, Homo sapiens
cagacctctttttagcactccc

SEQ ID NO: 7331906 - DNA, 19 bp, Homo sapiens
cagacctgtccagcctgtg

SEQ ID NO: 7331907 - DNA, 22 bp, Homo sapiens
cagacgggtggtctgcgaggcc

SEQ ID NO: 7331908 - DNA, 22 bp, Homo sapiens
gggcagagaaatggacagttgg

SEQ ID NO: 7331909 - DNA, 22 bp, Homo sapiens
gggcagagaaatggacagttgg

SEQ ID NO: 7331910 - DNA, 22 bp, Homo sapiens
gggcagagactcagaaacagaa

SEQ ID NO: 7331911 - DNA, 22 bp, Homo sapiens
ggcttagcaactcctgaggctc

SEQ ID NO: 7331912 - DNA, 22 bp, Homo sapiens
cagaccagccatttgcctcttc

SEQ ID NO: 7331913 - DNA, 22 bp, Homo sapiens
cagaccccgagtttgcagagtt

SEQ ID NO: 7331914 - DNA, 22 bp, Homo sapiens
cagaccagtagggctcatccca

SEQ ID NO: 7331915 - DNA, 22 bp, Homo sapiens
cagagacagcctgggagggaca

SEQ ID NO: 7331916 - DNA, 22 bp, Homo sapiens
cagagacagcctgggagggaca

SEQ ID NO: 7331917 - DNA, 22 bp, Homo sapiens
gggcagcatgaggaccctcatc

SEQ ID NO: 7331918 - DNA, 22 bp, Homo sapiens
gggcagcatgtcactagcatgg

SEQ ID NO: 7331919 - DNA, 22 bp, Homo sapiens
gggcagcattctgtgggcaggt

SEQ ID NO: 7331920 - DNA, 22 bp, Homo sapiens
gggcagcagcaggaggtctctg

SEQ ID NO: 7331921 - DNA, 21 bp, Homo sapiens
gggcagcagcagcaacaaggg

SEQ ID NO: 7331922 - DNA, 22 bp, Homo sapiens
gggcagcatcaggaggggcttt

SEQ ID NO: 7331923 - DNA, 22 bp, Homo sapiens
gggcagcatcaggaggggcttt

SEQ ID NO: 7331924 - DNA, 22 bp, Homo sapiens
cagagacaggatctcgaagact

SEQ ID NO: 7331925 - DNA, 19 bp, Homo sapiens
gggcagtggcactagggag

SEQ ID NO: 7331926 - DNA, 22 bp, Homo sapiens
cagagacagggcagggagtgtg

SEQ ID NO: 7331927 - DNA, 22 bp, Homo sapiens
gggcagtggttacacagctgag

SEQ ID NO: 7331928 - DNA, 22 bp, Homo sapiens
gggcagtgggtggctgcagcct

SEQ ID NO: 7331929 - DNA, 22 bp, Homo sapiens
gggcagtggctcacgcctgtaa

SEQ ID NO: 7331930 - DNA, 19 bp, Homo sapiens
gggcagtggcactagggag

SEQ ID NO: 7331931 - DNA, 22 bp, Homo sapiens
gggcagtgggaccaggcaccag

SEQ ID NO: 7331932 - DNA, 22 bp, Homo sapiens
gggctctgtgttctagctctcg

SEQ ID NO: 7331933 - DNA, 22 bp, Homo sapiens
gggccagctctgtgatgtaggg

SEQ ID NO: 7331934 - DNA, 22 bp, Homo sapiens
gggccagcctactgctagaccc

SEQ ID NO: 7331935 - DNA, 22 bp, Homo sapiens
gggccagagcacagaggatgtt

SEQ ID NO: 7331936 - DNA, 22 bp, Homo sapiens
gggccagagcacagaggatgtt

SEQ ID NO: 7331937 - DNA, 22 bp, Homo sapiens
gggccagacctcttctcaggga

SEQ ID NO: 7331938 - DNA, 22 bp, Homo sapiens
gggcagtgtcggggcccaggga

SEQ ID NO: 7331939 - DNA, 22 bp, Homo sapiens
gggcagtgtctggcccccaggc

SEQ ID NO: 7331940 - DNA, 22 bp, Homo sapiens
gggcagtgtctggcccccaggc

SEQ ID NO: 7331941 - DNA, 22 bp, Homo sapiens
gggcagtgtcgaggtctggtcc

SEQ ID NO: 7331942 - DNA, 22 bp, Homo sapiens
gggccactcctggctgctgagt

SEQ ID NO: 7331943 - DNA, 22 bp, Homo sapiens
gggccactgggtcctgctggcc

SEQ ID NO: 7331944 - DNA, 22 bp, Homo sapiens
gggccagacccttggcgatctg

SEQ ID NO: 7331945 - DNA, 22 bp, Homo sapiens
gggccactcagattgtcccctt

SEQ ID NO: 7331946 - DNA, 22 bp, Homo sapiens
gggccactcagattgtcccctt

SEQ ID NO: 7331947 - DNA, 22 bp, Homo sapiens
gggccacattgaagggtgggta

SEQ ID NO: 7331948 - DNA, 22 bp, Homo sapiens
cagagcctcatcatccactcca

SEQ ID NO: 7331949 - DNA, 22 bp, Homo sapiens
gggctgactctgcactgagcca

SEQ ID NO: 7331950 - DNA, 22 bp, Homo sapiens
gggctgacaccacccaggcgca

SEQ ID NO: 7331951 - DNA, 17 bp, Homo sapiens
gggctgacagtggcctc

SEQ ID NO: 7331952 - DNA, 22 bp, Homo sapiens
gggctgacatatttggtgctct

SEQ ID NO: 7331953 - DNA, 22 bp, Homo sapiens
gggctgacatatttggtgctct

SEQ ID NO: 7331954 - DNA, 22 bp, Homo sapiens
gggctctgtttagatcagagat

SEQ ID NO: 7331955 - DNA, 22 bp, Homo sapiens
cagaggatatactatctggaaa

SEQ ID NO: 7331956 - DNA, 22 bp, Homo sapiens
cagaggagttcagtacacagcc

SEQ ID NO: 7331957 - DNA, 22 bp, Homo sapiens
gggctgaggggtatctcatggg

SEQ ID NO: 7331958 - DNA, 22 bp, Homo sapiens
cagagctgggatcccatgggcg

SEQ ID NO: 7331959 - DNA, 22 bp, Homo sapiens
cagagctggggactgttggatg

SEQ ID NO: 7331960 - DNA, 22 bp, Homo sapiens
cagagctgggatcccatgggcg

SEQ ID NO: 7331961 - DNA, 22 bp, Homo sapiens
cagagcctccctcctctgccat

SEQ ID NO: 7331962 - DNA, 22 bp, Homo sapiens
cagagctggctctgcatgtaca

SEQ ID NO: 7331963 - DNA, 22 bp, Homo sapiens
cagagctggctctgcatgtaca

SEQ ID NO: 7331964 - DNA, 23 bp, Homo sapiens
cagagctggctcagagctgcctg

SEQ ID NO: 7331965 - DNA, 22 bp, Homo sapiens
cagagctgcttcccagtttgtg

SEQ ID NO: 7331966 - DNA, 22 bp, Homo sapiens
cagagctggctctgcatgtaca

SEQ ID NO: 7331967 - DNA, 22 bp, Homo sapiens
ggtctggaagcgcagtaggctg

SEQ ID NO: 7331968 - DNA, 22 bp, Homo sapiens
ggtctggaacccctcaagtgac

SEQ ID NO: 7331969 - DNA, 22 bp, Homo sapiens
ggtctggaacgaggtctaagcc

SEQ ID NO: 7331970 - DNA, 22 bp, Homo sapiens
ggtctggaagcgtcccaaaggt

SEQ ID NO: 7331971 - DNA, 22 bp, Homo sapiens
ggtgaccagggtcagtagcttt

SEQ ID NO: 7331972 - DNA, 19 bp, Homo sapiens
ggtgaccacctggtcagtg

SEQ ID NO: 7331973 - DNA, 22 bp, Homo sapiens
ggtctgcgatggcaagggtctt

SEQ ID NO: 7331974 - DNA, 22 bp, Homo sapiens
ggtctgctttccttgccactgt

SEQ ID NO: 7331975 - DNA, 22 bp, Homo sapiens
ggtctgagtgccagggagagaa

SEQ ID NO: 7331976 - DNA, 22 bp, Homo sapiens
ggtctgagtgggcaggggccgg

SEQ ID NO: 7331977 - DNA, 22 bp, Homo sapiens
ggtctgaggtgggacccaggaa

SEQ ID NO: 7331978 - DNA, 22 bp, Homo sapiens
cagcaagacaaggaacaaactg

SEQ ID NO: 7331979 - DNA, 21 bp, Homo sapiens
cagcaaggaagtcgagtaggt

SEQ ID NO: 7331980 - DNA, 21 bp, Homo sapiens
cagcaaggaagtcgagtaggt

SEQ ID NO: 7331981 - DNA, 22 bp, Homo sapiens
ggtgctgatttgttgctgagat

SEQ ID NO: 7331982 - DNA, 22 bp, Homo sapiens
ggtgctgctgctgaacccagct

SEQ ID NO: 7331983 - DNA, 22 bp, Homo sapiens
ggtgctgatgaagatgtagcct

SEQ ID NO: 7331984 - DNA, 23 bp, Homo sapiens
cagcacagtacatttcctgtctc

SEQ ID NO: 7331985 - DNA, 21 bp, Homo sapiens
cagcacagtactgggtcttgc

SEQ ID NO: 7331986 - DNA, 22 bp, Homo sapiens
ggtgctgactctgtcgtgagca

SEQ ID NO: 7331987 - DNA, 22 bp, Homo sapiens
ggtgctgaggccttggcaggga

SEQ ID NO: 7331988 - DNA, 22 bp, Homo sapiens
cagcacagtgcagatgctgact

SEQ ID NO: 7331989 - DNA, 22 bp, Homo sapiens
cagcacagtttgcttggcagag

SEQ ID NO: 7331990 - DNA, 22 bp, Homo sapiens
cagcacagtttctggcccgccg

SEQ ID NO: 7331991 - DNA, 22 bp, Homo sapiens
cagcacagtttcccccatgagc

SEQ ID NO: 7331992 - DNA, 22 bp, Homo sapiens
cagcacatggatggagttagga

SEQ ID NO: 7331993 - DNA, 22 bp, Homo sapiens
cagcacattgatcagagacgct

SEQ ID NO: 7331994 - DNA, 22 bp, Homo sapiens
cagcacatctgattatatgact

SEQ ID NO: 7331995 - DNA, 22 bp, Homo sapiens
cagcacatctccaagaatttct

SEQ ID NO: 7331996 - DNA, 22 bp, Homo sapiens
cagcacatagtaggtattcact

SEQ ID NO: 7331997 - DNA, 22 bp, Homo sapiens
cagcacatagtaggtattcact

SEQ ID NO: 7331998 - DNA, 22 bp, Homo sapiens
cagcacataatcagtgattgtg

SEQ ID NO: 7331999 - DNA, 22 bp, Homo sapiens
ggtcatctcaggtgtgcttgat

SEQ ID NO: 7332000 - DNA, 22 bp, Homo sapiens
ggtcagtgtacacatgtgcagg

SEQ ID NO: 7332001 - DNA, 22 bp, Homo sapiens
ggtcagtgcgtgcccgcgcgtg

SEQ ID NO: 7332002 - DNA, 22 bp, Homo sapiens
cagaggtagaactggccctcac

SEQ ID NO: 7332003 - DNA, 22 bp, Homo sapiens
cagagtctgcgagcagaggggc

SEQ ID NO: 7332004 - DNA, 22 bp, Homo sapiens
cagagtctctgggaggctgggt

SEQ ID NO: 7332005 - DNA, 22 bp, Homo sapiens
ggtcattgttcttttctgtgat

SEQ ID NO: 7332006 - DNA, 22 bp, Homo sapiens
ggtcattgaaatcagaagggtt

SEQ ID NO: 7332007 - DNA, 22 bp, Homo sapiens
ggtcattgtcagagcctgtact

SEQ ID NO: 7332008 - DNA, 22 bp, Homo sapiens
ggtcatgctgtgaatcagtgct

SEQ ID NO: 7332009 - DNA, 22 bp, Homo sapiens
ggtcatcttgaatttccattct

SEQ ID NO: 7332010 - DNA, 22 bp, Homo sapiens
ggtcatctgtaattctgttcct

SEQ ID NO: 7332011 - DNA, 22 bp, Homo sapiens
ggtcatctgtatgtcctcagct

SEQ ID NO: 7332012 - DNA, 20 bp, Homo sapiens
ggtcatcttccaatcccagg

SEQ ID NO: 7332013 - DNA, 22 bp, Homo sapiens
ggtcatctgcctccaaagcact

SEQ ID NO: 7332014 - DNA, 22 bp, Homo sapiens
ggtcatctgtgtatcctcagtg

SEQ ID NO: 7332015 - DNA, 22 bp, Homo sapiens
cagagggaaaaggggagtaata

SEQ ID NO: 7332016 - DNA, 22 bp, Homo sapiens
cagaggctttgccctggaaacc

SEQ ID NO: 7332017 - DNA, 21 bp, Homo sapiens
cagagggccggcatgtggtct

SEQ ID NO: 7332018 - DNA, 22 bp, Homo sapiens
cagagggctcggcggccgctcc

SEQ ID NO: 7332019 - DNA, 22 bp, Homo sapiens
cagagggctcagtcctgctgga

SEQ ID NO: 7332020 - DNA, 22 bp, Homo sapiens
cagagggctcttggctgcctgc

SEQ ID NO: 7332021 - DNA, 22 bp, Homo sapiens
cagagggctgccctgagttcgt

SEQ ID NO: 7332022 - DNA, 22 bp, Homo sapiens
cagagggctgtgtaaggatgtt

SEQ ID NO: 7332023 - DNA, 22 bp, Homo sapiens
cagagggctgtgtaaggatgtt

SEQ ID NO: 7332024 - DNA, 22 bp, Homo sapiens
cagagggcttcaggttcaggat

SEQ ID NO: 7332025 - DNA, 21 bp, Homo sapiens
cagagggcttttctctgttct

SEQ ID NO: 7332026 - DNA, 22 bp, Homo sapiens
ggggagagtcctttccagttcc

SEQ ID NO: 7332027 - DNA, 22 bp, Homo sapiens
ggggagagtattttattcaagt

SEQ ID NO: 7332028 - DNA, 22 bp, Homo sapiens
ggggagagtcctttccagttcc

SEQ ID NO: 7332029 - DNA, 22 bp, Homo sapiens
gtgcccagttgaggccaggact

SEQ ID NO: 7332030 - DNA, 20 bp, Homo sapiens
gtgcccagttggtgacagac

SEQ ID NO: 7332031 - DNA, 20 bp, Homo sapiens
gtgcccagttggtgacagac

SEQ ID NO: 7332032 - DNA, 20 bp, Homo sapiens
gtgcccagttggtgacagac

SEQ ID NO: 7332033 - DNA, 22 bp, Homo sapiens
gtgcccccaaataccaggctac

SEQ ID NO: 7332034 - DNA, 22 bp, Homo sapiens
gtgctgtgcgctttttctgtat

SEQ ID NO: 7332035 - DNA, 22 bp, Homo sapiens
gtgctgtgtgatccatgctggc

SEQ ID NO: 7332036 - DNA, 23 bp, Homo sapiens
cagccctggagatgtgggaggca

SEQ ID NO: 7332037 - DNA, 20 bp, Homo sapiens
cagcctccactcactcagct

SEQ ID NO: 7332038 - DNA, 20 bp, Homo sapiens
cagcctccactcactcagct

SEQ ID NO: 7332039 - DNA, 22 bp, Homo sapiens
cagccctgcttccccgctagtt

SEQ ID NO: 7332040 - DNA, 22 bp, Homo sapiens
cagcctgcaggaggccgtcagc

SEQ ID NO: 7332041 - DNA, 22 bp, Homo sapiens
cagcctgccgtcagccaggtag

SEQ ID NO: 7332042 - DNA, 22 bp, Homo sapiens
cagccctgctggcaatgatgag

SEQ ID NO: 7332043 - DNA, 22 bp, Homo sapiens
cagccctgcagagggcgctcct

SEQ ID NO: 7332044 - DNA, 22 bp, Homo sapiens
cagccctgcagccatggcctgt

SEQ ID NO: 7332045 - DNA, 22 bp, Homo sapiens
cagccctgccatggagcctcct

SEQ ID NO: 7332046 - DNA, 17 bp, Homo sapiens
cagccctgccgttccca

SEQ ID NO: 7332047 - DNA, 22 bp, Homo sapiens
cagctacagttccactgagcat

SEQ ID NO: 7332048 - DNA, 22 bp, Homo sapiens
cagctacagttccactgagcat

SEQ ID NO: 7332049 - DNA, 22 bp, Homo sapiens
cagctagaaagtctgttaggga

SEQ ID NO: 7332050 - DNA, 22 bp, Homo sapiens
cagctacaggacgggcatctgc

SEQ ID NO: 7332051 - DNA, 22 bp, Homo sapiens
cagctacaggacctgatgcacc

SEQ ID NO: 7332052 - DNA, 22 bp, Homo sapiens
cagctacacaccagaactatta

SEQ ID NO: 7332053 - DNA, 22 bp, Homo sapiens
cagctatggtgacaaggtcagg

SEQ ID NO: 7332054 - DNA, 22 bp, Homo sapiens
cagcctggagccacagcccagg

SEQ ID NO: 7332055 - DNA, 22 bp, Homo sapiens
cagcctggacagcgaccagagt

SEQ ID NO: 7332056 - DNA, 21 bp, Homo sapiens
cagcctgctgctccagggcca

SEQ ID NO: 7332057 - DNA, 22 bp, Homo sapiens
cagccttcaaggcttagctcag

SEQ ID NO: 7332058 - DNA, 22 bp, Homo sapiens
cagcctgtagtctggtccaggt

SEQ ID NO: 7332059 - DNA, 22 bp, Homo sapiens
cagcctggcctgggactgctga

SEQ ID NO: 7332060 - DNA, 22 bp, Homo sapiens
cagcctggtccccggctcaccc

SEQ ID NO: 7332061 - DNA, 22 bp, Homo sapiens
cagcctgggctccagagtccct

SEQ ID NO: 7332062 - DNA, 22 bp, Homo sapiens
cagccagggagcaaagagttga

SEQ ID NO: 7332063 - DNA, 22 bp, Homo sapiens
cagccaggcctggtgaccaaag

SEQ ID NO: 7332064 - DNA, 22 bp, Homo sapiens
cagccaggcctggtgaccaaag

SEQ ID NO: 7332065 - DNA, 22 bp, Homo sapiens
gtctggagacttgggtcatcaa

SEQ ID NO: 7332066 - DNA, 22 bp, Homo sapiens
gtctggagagctgagcagagtt

SEQ ID NO: 7332067 - DNA, 22 bp, Homo sapiens
gtctggagccaccctaagcatt

SEQ ID NO: 7332068 - DNA, 22 bp, Homo sapiens
gtctggagccactgctgctgct

SEQ ID NO: 7332069 - DNA, 22 bp, Homo sapiens
gtctggagccccagtcaatgag

SEQ ID NO: 7332070 - DNA, 22 bp, Homo sapiens
gtctggactgtggcagcttgcc

SEQ ID NO: 7332071 - DNA, 22 bp, Homo sapiens
gtctggacagcagcacctcggc

SEQ ID NO: 7332072 - DNA, 22 bp, Homo sapiens
gtctggaagggagtgcattttc

SEQ ID NO: 7332073 - DNA, 22 bp, Homo sapiens
gtctggaagtgtcttgttaagt

SEQ ID NO: 7332074 - DNA, 22 bp, Homo sapiens
gtctggaatatagcaagctctt

SEQ ID NO: 7332075 - DNA, 22 bp, Homo sapiens
gtctggaagaactagggatgtt

SEQ ID NO: 7332076 - DNA, 22 bp, Homo sapiens
gtctggaagagcaggaataaac

SEQ ID NO: 7332077 - DNA, 22 bp, Homo sapiens
gtctggaagctctaggggagaa

SEQ ID NO: 7332078 - DNA, 22 bp, Homo sapiens
gtctggaaggaggagatggagc

SEQ ID NO: 7332079 - DNA, 22 bp, Homo sapiens
gtctggaagaacctgtgccagt

SEQ ID NO: 7332080 - DNA, 22 bp, Homo sapiens
gtctggaaccaatatttgaggg

SEQ ID NO: 7332081 - DNA, 22 bp, Homo sapiens
gtctggaaatttaaggtatgag

SEQ ID NO: 7332082 - DNA, 22 bp, Homo sapiens
gtctggaaccaagacgtgtagc

SEQ ID NO: 7332083 - DNA, 22 bp, Homo sapiens
gtctggaaagagctgaggttca

SEQ ID NO: 7332084 - DNA, 22 bp, Homo sapiens
gtctggaaaggggcttttatct

SEQ ID NO: 7332085 - DNA, 22 bp, Homo sapiens
gtctggaaaggtatttgtctca

SEQ ID NO: 7332086 - DNA, 22 bp, Homo sapiens
gtctggaaatattgacttcaga

SEQ ID NO: 7332087 - DNA, 22 bp, Homo sapiens
gtctggaaattaagaggaggtt

SEQ ID NO: 7332088 - DNA, 22 bp, Homo sapiens
gtctggaaattcaatttaatgc

SEQ ID NO: 7332089 - DNA, 22 bp, Homo sapiens
gtcccaggcttatgtggagctt

SEQ ID NO: 7332090 - DNA, 22 bp, Homo sapiens
gtcccaggctccatggcagcca

SEQ ID NO: 7332091 - DNA, 22 bp, Homo sapiens
gtcccagggaagaaggcagcac

SEQ ID NO: 7332092 - DNA, 22 bp, Homo sapiens
gtcccaggcttatgtggagctt

SEQ ID NO: 7332093 - DNA, 22 bp, Homo sapiens
gtccctggggaatcagctggag

SEQ ID NO: 7332094 - DNA, 22 bp, Homo sapiens
gtccctgggggtttaggactca

SEQ ID NO: 7332095 - DNA, 22 bp, Homo sapiens
gtccctggtctaccgtggcttc

SEQ ID NO: 7332096 - DNA, 22 bp, Homo sapiens
gtctgcttttctgaattgcctg

SEQ ID NO: 7332097 - DNA, 22 bp, Homo sapiens
gtctgtgtgcacagagctttgg

SEQ ID NO: 7332098 - DNA, 22 bp, Homo sapiens
gtctgttacctccaagaccatt

SEQ ID NO: 7332099 - DNA, 19 bp, Homo sapiens
gtctgtgtatttgttgctg

SEQ ID NO: 7332100 - DNA, 22 bp, Homo sapiens
cagccctcatcccgcctgcgtt

SEQ ID NO: 7332101 - DNA, 22 bp, Homo sapiens
gtctgtcactcaggggctggag

SEQ ID NO: 7332102 - DNA, 22 bp, Homo sapiens
gtctgtccacttggaagctccc

SEQ ID NO: 7332103 - DNA, 22 bp, Homo sapiens
gtctgtcccaatagccaacagg

SEQ ID NO: 7332104 - DNA, 19 bp, Homo sapiens
gtctgtccccacgagtggc

SEQ ID NO: 7332105 - DNA, 22 bp, Homo sapiens
cagccagggagggcaaatgaga

SEQ ID NO: 7332106 - DNA, 22 bp, Homo sapiens
cagccagggtcaggcagcttct

SEQ ID NO: 7332107 - DNA, 22 bp, Homo sapiens
cagccaggtatgggcgtgcggg

SEQ ID NO: 7332108 - DNA, 22 bp, Homo sapiens
cagccaggtatgggcgtgcggg

SEQ ID NO: 7332109 - DNA, 22 bp, Homo sapiens
cagcccaggctcagatgttggg

SEQ ID NO: 7332110 - DNA, 22 bp, Homo sapiens
cagccccttcctggcatctgga

SEQ ID NO: 7332111 - DNA, 22 bp, Homo sapiens
cagccccttcctggcatctgga

SEQ ID NO: 7332112 - DNA, 22 bp, Homo sapiens
cagccccatggtgtgctccagc

SEQ ID NO: 7332113 - DNA, 22 bp, Homo sapiens
cagcccccatggggaggtcaag

SEQ ID NO: 7332114 - DNA, 22 bp, Homo sapiens
gtcccaggcagagtcaggaggg

SEQ ID NO: 7332115 - DNA, 22 bp, Homo sapiens
gtcatcatcaggcagatgctgc

SEQ ID NO: 7332116 - DNA, 20 bp, Homo sapiens
gtcatcgccggcagcaaaga

SEQ ID NO: 7332117 - DNA, 22 bp, Homo sapiens
gtcataatataaaaactgactt

SEQ ID NO: 7332118 - DNA, 22 bp, Homo sapiens
gtcagcctgcactcagggagcg

SEQ ID NO: 7332119 - DNA, 22 bp, Homo sapiens
gtcataaagcttgttgcattta

SEQ ID NO: 7332120 - DNA, 22 bp, Homo sapiens
gtcatgaaattctagagcttga

SEQ ID NO: 7332121 - DNA, 22 bp, Homo sapiens
gtcatgcatgggctctgaagaa

SEQ ID NO: 7332122 - DNA, 22 bp, Homo sapiens
gtcatgccagcggagctcggga

SEQ ID NO: 7332123 - DNA, 22 bp, Homo sapiens
gtcatgcagacagggttgtttt

SEQ ID NO: 7332124 - DNA, 22 bp, Homo sapiens
gtcatggaggattgtgagtggt

SEQ ID NO: 7332125 - DNA, 22 bp, Homo sapiens
gtcatgcctggcttcttagaca

SEQ ID NO: 7332126 - DNA, 22 bp, Homo sapiens
cagcaggcggcccgcgggcccg

SEQ ID NO: 7332127 - DNA, 22 bp, Homo sapiens
cagcacctgttagcattaaata

SEQ ID NO: 7332128 - DNA, 22 bp, Homo sapiens
cagcaccattttcctggtcagc

SEQ ID NO: 7332129 - DNA, 22 bp, Homo sapiens
cagcacctacccatcctgagtc

SEQ ID NO: 7332130 - DNA, 22 bp, Homo sapiens
cagcacctacccatcctgagtc

SEQ ID NO: 7332131 - DNA, 22 bp, Homo sapiens
cagcagctgggaaggaggctga

SEQ ID NO: 7332132 - DNA, 22 bp, Homo sapiens
cagcagctggtgagacacagcc

SEQ ID NO: 7332133 - DNA, 22 bp, Homo sapiens
gtcataaagacagaaacattcc

SEQ ID NO: 7332134 - DNA, 22 bp, Homo sapiens
cagcaggacatggaggagtaaa

SEQ ID NO: 7332135 - DNA, 20 bp, Homo sapiens
cagcaggaaaagtgcctcag

SEQ ID NO: 7332136 - DNA, 22 bp, Homo sapiens
cagcagctggtgagacacagcc

SEQ ID NO: 7332137 - DNA, 22 bp, Homo sapiens
atgaacagtacaaagcacagac

SEQ ID NO: 7332138 - DNA, 22 bp, Homo sapiens
atgaacagtatgcaacatgatt

SEQ ID NO: 7332139 - DNA, 22 bp, Homo sapiens
atgaacatcggaaatgagactg

SEQ ID NO: 7332140 - DNA, 22 bp, Homo sapiens
atgaaattcatctgagaatgct

SEQ ID NO: 7332141 - DNA, 22 bp, Homo sapiens
atgaaacagtgtgtatagcaaa

SEQ ID NO: 7332142 - DNA, 22 bp, Homo sapiens
atgaaaattctatgcaggccag

SEQ ID NO: 7332143 - DNA, 22 bp, Homo sapiens
atgaaaatactgtggttgatag

SEQ ID NO: 7332144 - DNA, 22 bp, Homo sapiens
atgaaaatactgtggttgatag

SEQ ID NO: 7332145 - DNA, 22 bp, Homo sapiens
atgaaaatgtacatgtgtataa

SEQ ID NO: 7332146 - DNA, 22 bp, Homo sapiens
atgaaaattgacagcggaagta

SEQ ID NO: 7332147 - DNA, 22 bp, Homo sapiens
atgaaacaagggtattttctct

SEQ ID NO: 7332148 - DNA, 22 bp, Homo sapiens
atgaaacaagggtattttctct

SEQ ID NO: 7332149 - DNA, 22 bp, Homo sapiens
atgaaacaaacctctatggagt

SEQ ID NO: 7332150 - DNA, 22 bp, Homo sapiens
atgaaacaacagacttggtcaa

SEQ ID NO: 7332151 - DNA, 22 bp, Homo sapiens
ctttctgaaagacattttaact

SEQ ID NO: 7332152 - DNA, 22 bp, Homo sapiens
ctttctgaagtttaagttctaa

SEQ ID NO: 7332153 - DNA, 22 bp, Homo sapiens
ctttcttcaacctcattctgca

SEQ ID NO: 7332154 - DNA, 22 bp, Homo sapiens
ctttctgatccctgcaaccctc

SEQ ID NO: 7332155 - DNA, 22 bp, Homo sapiens
ctttctgattttaagctctaat

SEQ ID NO: 7332156 - DNA, 22 bp, Homo sapiens
atgaacatttggtttggcagca

SEQ ID NO: 7332157 - DNA, 22 bp, Homo sapiens
atgaagacaaactgggtagaaa

SEQ ID NO: 7332158 - DNA, 22 bp, Homo sapiens
atgaactgtccaatcttagagg

SEQ ID NO: 7332159 - DNA, 22 bp, Homo sapiens
atgaactgcatgttttctactg

SEQ ID NO: 7332160 - DNA, 22 bp, Homo sapiens
atgaactgcatgtattttagtg

SEQ ID NO: 7332161 - DNA, 22 bp, Homo sapiens
atgaactgcagtataaacttgg

SEQ ID NO: 7332162 - DNA, 22 bp, Homo sapiens
atctggagaataaatgtccaag

SEQ ID NO: 7332163 - DNA, 22 bp, Homo sapiens
atctggagaatgtttgtctccg

SEQ ID NO: 7332164 - DNA, 22 bp, Homo sapiens
atctggagagatcttcacaaaa

SEQ ID NO: 7332165 - DNA, 22 bp, Homo sapiens
atctggagagctggcagcccag

SEQ ID NO: 7332166 - DNA, 22 bp, Homo sapiens
atctggagatcagctggtggca

SEQ ID NO: 7332167 - DNA, 22 bp, Homo sapiens
atctggagatctgaattttgtg

SEQ ID NO: 7332168 - DNA, 22 bp, Homo sapiens
atctggagatgggtctgtcacc

SEQ ID NO: 7332169 - DNA, 22 bp, Homo sapiens
atctggagatttcttttcaata

SEQ ID NO: 7332170 - DNA, 22 bp, Homo sapiens
atctggagcaagattaagagat

SEQ ID NO: 7332171 - DNA, 22 bp, Homo sapiens
atctggagcagggccacaaggc

SEQ ID NO: 7332172 - DNA, 22 bp, Homo sapiens
atctggagctctgcacacctgg

SEQ ID NO: 7332173 - DNA, 22 bp, Homo sapiens
atctggagcttaagcttatata

SEQ ID NO: 7332174 - DNA, 22 bp, Homo sapiens
atctggagcttgttagatgttt

SEQ ID NO: 7332175 - DNA, 22 bp, Homo sapiens
atctggaggattctgggacttg

SEQ ID NO: 7332176 - DNA, 22 bp, Homo sapiens
atctggaggcaaaggggcgtga

SEQ ID NO: 7332177 - DNA, 22 bp, Homo sapiens
atctggaggcattactctgtct

SEQ ID NO: 7332178 - DNA, 22 bp, Homo sapiens
atctggaggcctgtcttatccc

SEQ ID NO: 7332179 - DNA, 22 bp, Homo sapiens
atctggaggctaagtcatttgc

SEQ ID NO: 7332180 - DNA, 22 bp, Homo sapiens
atctggaggtcatcgtttgttc

SEQ ID NO: 7332181 - DNA, 22 bp, Homo sapiens
atctggagtagaaaaatcgctt

SEQ ID NO: 7332182 - DNA, 22 bp, Homo sapiens
atctggagtgggacacagaaat

SEQ ID NO: 7332183 - DNA, 23 bp, Homo sapiens
atctggagtgttgagtaggtact

SEQ ID NO: 7332184 - DNA, 22 bp, Homo sapiens
atctggagtttcagttttctgg

SEQ ID NO: 7332185 - DNA, 22 bp, Homo sapiens
atctggagtagaaaaatcgctt

SEQ ID NO: 7332186 - DNA, 22 bp, Homo sapiens
atctggagtttcagttttctgg

SEQ ID NO: 7332187 - DNA, 22 bp, Homo sapiens
atctggctattgacatgttata

SEQ ID NO: 7332188 - DNA, 22 bp, Homo sapiens
atctggctcacctgggtaaata

SEQ ID NO: 7332189 - DNA, 22 bp, Homo sapiens
atctggctatttctggtcgggg

SEQ ID NO: 7332190 - DNA, 22 bp, Homo sapiens
atctggctcacttagtctagga

SEQ ID NO: 7332191 - DNA, 17 bp, Homo sapiens
atgacagcattaaggta

SEQ ID NO: 7332192 - DNA, 22 bp, Homo sapiens
atgacagcattttcttctaagg

SEQ ID NO: 7332193 - DNA, 22 bp, Homo sapiens
atgacagctctagcacacagta

SEQ ID NO: 7332194 - DNA, 22 bp, Homo sapiens
atgacagctaaggaatgtgtag

SEQ ID NO: 7332195 - DNA, 22 bp, Homo sapiens
gaaacatttgttgagtacttgc

SEQ ID NO: 7332196 - DNA, 21 bp, Homo sapiens
atgacagatgctgcagatcgt

SEQ ID NO: 7332197 - DNA, 22 bp, Homo sapiens
atgacagatgctgtggggaggt

SEQ ID NO: 7332198 - DNA, 22 bp, Homo sapiens
atgacagtgggtcttgcaaaga

SEQ ID NO: 7332199 - DNA, 22 bp, Homo sapiens
atgacagtactggtgacaatac

SEQ ID NO: 7332200 - DNA, 22 bp, Homo sapiens
atgacagtaggtaaatgatagc

SEQ ID NO: 7332201 - DNA, 22 bp, Homo sapiens
gaaagcataactaatatttatt

SEQ ID NO: 7332202 - DNA, 22 bp, Homo sapiens
gaaacattgtgttctacagatt

SEQ ID NO: 7332203 - DNA, 20 bp, Homo sapiens
gaaacattggcagcaactga

SEQ ID NO: 7332204 - DNA, 20 bp, Homo sapiens
gaaacattggcagcaactga

SEQ ID NO: 7332205 - DNA, 22 bp, Homo sapiens
gaaacatgtctgacaatttacc

SEQ ID NO: 7332206 - DNA, 22 bp, Homo sapiens
gaaaatgttagcttcatagtca

SEQ ID NO: 7332207 - DNA, 22 bp, Homo sapiens
gaaaggtttggcttttcagtag

SEQ ID NO: 7332208 - DNA, 22 bp, Homo sapiens
gaaagtcatggatgaacactac

SEQ ID NO: 7332209 - DNA, 19 bp, Homo sapiens
gaaagtcatagagcttgtc

SEQ ID NO: 7332210 - DNA, 22 bp, Homo sapiens
gaaatttattatctacatcatt

SEQ ID NO: 7332211 - DNA, 22 bp, Homo sapiens
atgatgaattttaaaagcacca

SEQ ID NO: 7332212 - DNA, 22 bp, Homo sapiens
atgatgaaattttctatcatgt

SEQ ID NO: 7332213 - DNA, 22 bp, Homo sapiens
atgatcagggcagaagcagaag

SEQ ID NO: 7332214 - DNA, 18 bp, Homo sapiens
atgatcttagcaaatatt

SEQ ID NO: 7332215 - DNA, 22 bp, Homo sapiens
atgatcagcagttttcagtgtt

SEQ ID NO: 7332216 - DNA, 22 bp, Homo sapiens
atgatattttagtaaagtgata

SEQ ID NO: 7332217 - DNA, 19 bp, Homo sapiens
atgatacaggtgaaaattg

SEQ ID NO: 7332218 - DNA, 22 bp, Homo sapiens
gaaggcaagcagcataaatgtc

SEQ ID NO: 7332219 - DNA, 22 bp, Homo sapiens
gaaggcaagctttggatatgag

SEQ ID NO: 7332220 - DNA, 22 bp, Homo sapiens
gaaggcaacaccaggatgcact

SEQ ID NO: 7332221 - DNA, 22 bp, Homo sapiens
gaaggcaagatctcagtggagg

SEQ ID NO: 7332222 - DNA, 22 bp, Homo sapiens
gaaggctgtggctggtctcagt

SEQ ID NO: 7332223 - DNA, 22 bp, Homo sapiens
atgcacagctgaacactctaaa

SEQ ID NO: 7332224 - DNA, 22 bp, Homo sapiens
atgcacagatccccaggaccct

SEQ ID NO: 7332225 - DNA, 22 bp, Homo sapiens
gaatattttcagtacagatggt

SEQ ID NO: 7332226 - DNA, 22 bp, Homo sapiens
gacaatgtaaatcaggatagca

SEQ ID NO: 7332227 - DNA, 22 bp, Homo sapiens
gacaatgtgacagaccaatgat

SEQ ID NO: 7332228 - DNA, 22 bp, Homo sapiens
gacaataagaacagatactgtg

SEQ ID NO: 7332229 - DNA, 22 bp, Homo sapiens
gacaatacagaaagggacatgc

SEQ ID NO: 7332230 - DNA, 22 bp, Homo sapiens
gacaataagaaaagaggaggca

SEQ ID NO: 7332231 - DNA, 22 bp, Homo sapiens
gacaataaagtgatacatggga

SEQ ID NO: 7332232 - DNA, 22 bp, Homo sapiens
gaataatattgactttgcaggc

SEQ ID NO: 7332233 - DNA, 22 bp, Homo sapiens
gaataatattgactttgcaggc

SEQ ID NO: 7332234 - DNA, 22 bp, Homo sapiens
atgcacaggaccacacataatg

SEQ ID NO: 7332235 - DNA, 22 bp, Homo sapiens
atgcacaggtgctgatgcacgc

SEQ ID NO: 7332236 - DNA, 22 bp, Homo sapiens
gacggggcagccagctggtggc

SEQ ID NO: 7332237 - DNA, 22 bp, Homo sapiens
gacgggtgtatgctcccagcca

SEQ ID NO: 7332238 - DNA, 22 bp, Homo sapiens
gacgagagactccatccaccac

SEQ ID NO: 7332239 - DNA, 22 bp, Homo sapiens
gacggagctggttgctgcggct

SEQ ID NO: 7332240 - DNA, 22 bp, Homo sapiens
gactggagtcaatgagcagcac

SEQ ID NO: 7332241 - DNA, 22 bp, Homo sapiens
gactggagcccccaaggacacc

SEQ ID NO: 7332242 - DNA, 22 bp, Homo sapiens
gaccctggagccgtctgaggca

SEQ ID NO: 7332243 - DNA, 22 bp, Homo sapiens
gaccctggagttagtcctgtgt

SEQ ID NO: 7332244 - DNA, 22 bp, Homo sapiens
atgctccagtgtgatgcttcat

SEQ ID NO: 7332245 - DNA, 20 bp, Homo sapiens
atgctcgttgggtttcttcc

SEQ ID NO: 7332246 - DNA, 22 bp, Homo sapiens
gacatttgttcctctaagtgac

SEQ ID NO: 7332247 - DNA, 22 bp, Homo sapiens
gaccaaggccctcagtgggagg

SEQ ID NO: 7332248 - DNA, 22 bp, Homo sapiens
gaccacacgtcccagagagccc

SEQ ID NO: 7332249 - DNA, 22 bp, Homo sapiens
gaccacacgtcccagagagccc

SEQ ID NO: 7332250 - DNA, 22 bp, Homo sapiens
gacataaatgaagtttgactat

SEQ ID NO: 7332251 - DNA, 22 bp, Homo sapiens
gacaatttctcaatatagaaac

SEQ ID NO: 7332252 - DNA, 22 bp, Homo sapiens
gacaatgtgcaattgcagctag

SEQ ID NO: 7332253 - DNA, 22 bp, Homo sapiens
gacaatgtgttgaaagggaaaa

SEQ ID NO: 7332254 - DNA, 22 bp, Homo sapiens
atgtgacagtgtttgacagatg

SEQ ID NO: 7332255 - DNA, 22 bp, Homo sapiens
atgtgaatgcagttatctataa

SEQ ID NO: 7332256 - DNA, 20 bp, Homo sapiens
atgtgaaagatcagttgtct

SEQ ID NO: 7332257 - DNA, 22 bp, Homo sapiens
atgtgaaagaggtgttcagtgg

SEQ ID NO: 7332258 - DNA, 22 bp, Homo sapiens
atgtgaaactgaagcatccata

SEQ ID NO: 7332259 - DNA, 22 bp, Homo sapiens
atgtgagggaaatcagtcagaa

SEQ ID NO: 7332260 - DNA, 22 bp, Homo sapiens
atgtgagaactcaggaaatact

SEQ ID NO: 7332261 - DNA, 22 bp, Homo sapiens
atgtgagctccggcaggtggaa

SEQ ID NO: 7332262 - DNA, 22 bp, Homo sapiens
atgtgagctctcttctgattgg

SEQ ID NO: 7332263 - DNA, 22 bp, Homo sapiens
atgtgagctggggcccggccag

SEQ ID NO: 7332264 - DNA, 22 bp, Homo sapiens
atgtgaggcagcacggagatta

SEQ ID NO: 7332265 - DNA, 22 bp, Homo sapiens
atgtgagcaggtgctggctgct

SEQ ID NO: 7332266 - DNA, 22 bp, Homo sapiens
atgtgagcagggagatgctgcc

SEQ ID NO: 7332267 - DNA, 22 bp, Homo sapiens
atgtgagcatcaccaggaggac

SEQ ID NO: 7332268 - DNA, 22 bp, Homo sapiens
atgtctgcgttatatcaatatc

SEQ ID NO: 7332269 - DNA, 22 bp, Homo sapiens
gagggcagaaaattatgcggtg

SEQ ID NO: 7332270 - DNA, 22 bp, Homo sapiens
gagggcgcttcagagagatgaa

SEQ ID NO: 7332271 - DNA, 22 bp, Homo sapiens
gagggcgcttcagagagatgaa

SEQ ID NO: 7332272 - DNA, 19 bp, Homo sapiens
gagggctcatttgaacaat

SEQ ID NO: 7332273 - DNA, 22 bp, Homo sapiens
gagggctctgaaaggaggtcac

SEQ ID NO: 7332274 - DNA, 22 bp, Homo sapiens
gagggctctgaaaggaggtcac

SEQ ID NO: 7332275 - DNA, 23 bp, Homo sapiens
gagggctctgagtgcttgggcca

SEQ ID NO: 7332276 - DNA, 22 bp, Homo sapiens
atgtccttccattttgatctgt

SEQ ID NO: 7332277 - DNA, 22 bp, Homo sapiens
atgtcctgggctgggttatgtt

SEQ ID NO: 7332278 - DNA, 22 bp, Homo sapiens
atgtcctcttctgcctcaggcc

SEQ ID NO: 7332279 - DNA, 22 bp, Homo sapiens
atgtctatatagtcaataatca

SEQ ID NO: 7332280 - DNA, 22 bp, Homo sapiens
atgtagctgcagatgataatgc

SEQ ID NO: 7332281 - DNA, 22 bp, Homo sapiens
atgtcatttaaatgtttgtata

SEQ ID NO: 7332282 - DNA, 20 bp, Homo sapiens
atgtcctcagccactgccct

SEQ ID NO: 7332283 - DNA, 22 bp, Homo sapiens
gaggtggcactgtgaggagcac

SEQ ID NO: 7332284 - DNA, 22 bp, Homo sapiens
gaggtggccaagcgaggaaggg

SEQ ID NO: 7332285 - DNA, 22 bp, Homo sapiens
atgttctttcagccagtgcatc

SEQ ID NO: 7332286 - DNA, 22 bp, Homo sapiens
atgttgaactaggatctcttga

SEQ ID NO: 7332287 - DNA, 22 bp, Homo sapiens
atgtgtctggttattgacatgc

SEQ ID NO: 7332288 - DNA, 22 bp, Homo sapiens
gataatattagaagatacaaat

SEQ ID NO: 7332289 - DNA, 22 bp, Homo sapiens
atgtttaaatttatagacagtg

SEQ ID NO: 7332290 - DNA, 22 bp, Homo sapiens
atgtttaaatttatagacagtg

SEQ ID NO: 7332291 - DNA, 22 bp, Homo sapiens
atgttggactaggctcttaatt

SEQ ID NO: 7332292 - DNA, 22 bp, Homo sapiens
atgttgtagcatatgaaatata

SEQ ID NO: 7332293 - DNA, 22 bp, Homo sapiens
atgttgtagcatatgaaatata

SEQ ID NO: 7332294 - DNA, 22 bp, Homo sapiens
atgttgtactgagaattaggag

SEQ ID NO: 7332295 - DNA, 22 bp, Homo sapiens
atgttggccaggctggtcttga

SEQ ID NO: 7332296 - DNA, 22 bp, Homo sapiens
atgttgttccctctacacaggt

SEQ ID NO: 7332297 - DNA, 22 bp, Homo sapiens
atgttgtaggtctcatggtaca

SEQ ID NO: 7332298 - DNA, 22 bp, Homo sapiens
atgttgtattatgttattgtct

SEQ ID NO: 7332299 - DNA, 22 bp, Homo sapiens
atgtttaaaggagtcagagact

SEQ ID NO: 7332300 - DNA, 22 bp, Homo sapiens
atgtttaaaggagtcagagact

SEQ ID NO: 7332301 - DNA, 22 bp, Homo sapiens
gataattttggttccaggttgg

SEQ ID NO: 7332302 - DNA, 22 bp, Homo sapiens
gataattttagtctgaaaattg

SEQ ID NO: 7332303 - DNA, 22 bp, Homo sapiens
gataatttaagtcttgggggct

SEQ ID NO: 7332304 - DNA, 22 bp, Homo sapiens
gataatttctccatctcaaggt

SEQ ID NO: 7332305 - DNA, 22 bp, Homo sapiens
gataatttgatacctcaatcag

SEQ ID NO: 7332306 - DNA, 22 bp, Homo sapiens
gatatcagagacttggctacca

SEQ ID NO: 7332307 - DNA, 22 bp, Homo sapiens
gatacacaaaagtctagtgagg

SEQ ID NO: 7332308 - DNA, 22 bp, Homo sapiens
gatacacaagtggaaggagacg

SEQ ID NO: 7332309 - DNA, 22 bp, Homo sapiens
atgggagaaacatcatgaggca

SEQ ID NO: 7332310 - DNA, 22 bp, Homo sapiens
atgggcaggcctctcatttctg

SEQ ID NO: 7332311 - DNA, 22 bp, Homo sapiens
atgggcagggcagtgtataaga

SEQ ID NO: 7332312 - DNA, 18 bp, Homo sapiens
atgggcaggtaagatcca

SEQ ID NO: 7332313 - DNA, 18 bp, Homo sapiens
atgggcaggtaagatcca

SEQ ID NO: 7332314 - DNA, 22 bp, Homo sapiens
atgggctgaggaagctcctgag

SEQ ID NO: 7332315 - DNA, 22 bp, Homo sapiens
atggggaagagccagtgagctg

SEQ ID NO: 7332316 - DNA, 22 bp, Homo sapiens
atggggaagagccagtgagctg

SEQ ID NO: 7332317 - DNA, 22 bp, Homo sapiens
atggggagagaagggctgagct

SEQ ID NO: 7332318 - DNA, 22 bp, Homo sapiens
atgggctgtgaggtccggcagg

SEQ ID NO: 7332319 - DNA, 22 bp, Homo sapiens
atggttatgcaaacatgatgca

SEQ ID NO: 7332320 - DNA, 22 bp, Homo sapiens
atggtggacgggagacaggact

SEQ ID NO: 7332321 - DNA, 22 bp, Homo sapiens
gaggcagcattcgcatagacag

SEQ ID NO: 7332322 - DNA, 22 bp, Homo sapiens
gaggcagcctcagtggacctcg

SEQ ID NO: 7332323 - DNA, 22 bp, Homo sapiens
gaggcagcctcagtggacctcg

SEQ ID NO: 7332324 - DNA, 22 bp, Homo sapiens
gaggagaagctattggaaggac

SEQ ID NO: 7332325 - DNA, 22 bp, Homo sapiens
gaggagaagctattggaaggac

SEQ ID NO: 7332326 - DNA, 22 bp, Homo sapiens
gaggagaagctaagaaacacag

SEQ ID NO: 7332327 - DNA, 22 bp, Homo sapiens
gaggagaaattatccttggtgt

SEQ ID NO: 7332328 - DNA, 22 bp, Homo sapiens
gaggaagggactttattatctg

SEQ ID NO: 7332329 - DNA, 22 bp, Homo sapiens
atggggctagacaaccagtgcc

SEQ ID NO: 7332330 - DNA, 22 bp, Homo sapiens
gaggagaaatttggggacctga

SEQ ID NO: 7332331 - DNA, 22 bp, Homo sapiens
gaggagaagctattggaaggac

SEQ ID NO: 7332332 - DNA, 22 bp, Homo sapiens
gaggagaagggcacggagaaaa

SEQ ID NO: 7332333 - DNA, 22 bp, Homo sapiens
atggtgctcctgcaggaagcag

SEQ ID NO: 7332334 - DNA, 21 bp, Homo sapiens
atggtctgaggatagcaaaaa

SEQ ID NO: 7332335 - DNA, 22 bp, Homo sapiens
gactggggctctagccaggcct

SEQ ID NO: 7332336 - DNA, 22 bp, Homo sapiens
gactggggaaggacccgagacc

SEQ ID NO: 7332337 - DNA, 22 bp, Homo sapiens
gagagagaggtgctgccaggca

SEQ ID NO: 7332338 - DNA, 22 bp, Homo sapiens
gagagagagctaatattaagct

SEQ ID NO: 7332339 - DNA, 22 bp, Homo sapiens
gagagagaaggcctgtgggtgt

SEQ ID NO: 7332340 - DNA, 22 bp, Homo sapiens
gagagagaagtgggtgtcacct

SEQ ID NO: 7332341 - DNA, 22 bp, Homo sapiens
gagagagacatgtaaacgcggt

SEQ ID NO: 7332342 - DNA, 22 bp, Homo sapiens
gagagataggttgcaggaagct

SEQ ID NO: 7332343 - DNA, 22 bp, Homo sapiens
gagagagctctgtgcctgggat

SEQ ID NO: 7332344 - DNA, 22 bp, Homo sapiens
gagagagctctgtgcctgggat

SEQ ID NO: 7332345 - DNA, 23 bp, Homo sapiens
gagagagattgctaaaccactcc

SEQ ID NO: 7332346 - DNA, 22 bp, Homo sapiens
atggaggatgtgcagcatgggc

SEQ ID NO: 7332347 - DNA, 22 bp, Homo sapiens
atggagggaaaagtggagagcc

SEQ ID NO: 7332348 - DNA, 22 bp, Homo sapiens
atggagggtggtaagacagaga

SEQ ID NO: 7332349 - DNA, 21 bp, Homo sapiens
atggagggaccagggaagcag

SEQ ID NO: 7332350 - DNA, 22 bp, Homo sapiens
atggagggaaaagtggagagcc

SEQ ID NO: 7332351 - DNA, 22 bp, Homo sapiens
atggagggtggtaagacagaga

SEQ ID NO: 7332352 - DNA, 22 bp, Homo sapiens
gagatggccagtgccaggacaa

SEQ ID NO: 7332353 - DNA, 20 bp, Homo sapiens
gagatggctaagtgctgaac

SEQ ID NO: 7332354 - DNA, 22 bp, Homo sapiens
gagatggccctggcatgtagct

SEQ ID NO: 7332355 - DNA, 21 bp, Homo sapiens
gagatggcccagtagcgggcc

SEQ ID NO: 7332356 - DNA, 22 bp, Homo sapiens
atggcatttgtcaagataagta

SEQ ID NO: 7332357 - DNA, 22 bp, Homo sapiens
atggccagagagagcacacctg

SEQ ID NO: 7332358 - DNA, 22 bp, Homo sapiens
atggccagagaggccagcctgg

SEQ ID NO: 7332359 - DNA, 22 bp, Homo sapiens
atggctgttttgtgacttctca

SEQ ID NO: 7332360 - DNA, 22 bp, Homo sapiens
atggctgttcctgggagttcta

SEQ ID NO: 7332361 - DNA, 22 bp, Homo sapiens
atggctgtgttgttcctctgaa

SEQ ID NO: 7332362 - DNA, 22 bp, Homo sapiens
atggcttttgatgctaagccaa

SEQ ID NO: 7332363 - DNA, 22 bp, Homo sapiens
atggctttcagatttctatgtt

SEQ ID NO: 7332364 - DNA, 22 bp, Homo sapiens
attaggcagtgccattgtacgg

SEQ ID NO: 7332365 - DNA, 22 bp, Homo sapiens
attaggctctttgtgctagtta

SEQ ID NO: 7332366 - DNA, 22 bp, Homo sapiens
attcaactatgtatagtcttct

SEQ ID NO: 7332367 - DNA, 22 bp, Homo sapiens
attcaacttacaaaggagaaga

SEQ ID NO: 7332368 - DNA, 22 bp, Homo sapiens
attcaacatattctgagtaaaa

SEQ ID NO: 7332369 - DNA, 22 bp, Homo sapiens
attagtgtgtaggctggaaaaa

SEQ ID NO: 7332370 - DNA, 22 bp, Homo sapiens
gatatttaactctcacaggtcc

SEQ ID NO: 7332371 - DNA, 22 bp, Homo sapiens
gatatttaactctcacaggtcc

SEQ ID NO: 7332372 - DNA, 22 bp, Homo sapiens
gatatttaactctcacaggtcc

SEQ ID NO: 7332373 - DNA, 22 bp, Homo sapiens
gatttcctcactaacatccatc

SEQ ID NO: 7332374 - DNA, 22 bp, Homo sapiens
gatttcctagacatggggcaga

SEQ ID NO: 7332375 - DNA, 17 bp, Homo sapiens
gatttcctgaagttctt

SEQ ID NO: 7332376 - DNA, 22 bp, Homo sapiens
gatttccttgcatattggtaat

SEQ ID NO: 7332377 - DNA, 22 bp, Homo sapiens
gatttcccagaaaagtgatctc

SEQ ID NO: 7332378 - DNA, 22 bp, Homo sapiens
gatttcctaatgtggatctctg

SEQ ID NO: 7332379 - DNA, 22 bp, Homo sapiens
gatttctagttcattatctatt

SEQ ID NO: 7332380 - DNA, 22 bp, Homo sapiens
gatttctctgcacccactcagg

SEQ ID NO: 7332381 - DNA, 22 bp, Homo sapiens
gatttctcaatcctagtactat

SEQ ID NO: 7332382 - DNA, 22 bp, Homo sapiens
gatttcagtggctgtctcaaat

SEQ ID NO: 7332383 - DNA, 22 bp, Homo sapiens
gatttcagggtgtcttccagct

SEQ ID NO: 7332384 - DNA, 22 bp, Homo sapiens
gatttcacgggaggtggctgga

SEQ ID NO: 7332385 - DNA, 21 bp, Homo sapiens
gatttcacttaccttcattta

SEQ ID NO: 7332386 - DNA, 22 bp, Homo sapiens
attactgtgactagccatctgg

SEQ ID NO: 7332387 - DNA, 22 bp, Homo sapiens
attactgaggcaaagtagtttt

SEQ ID NO: 7332388 - DNA, 23 bp, Homo sapiens
attagaaaggctttctggtgaaa

SEQ ID NO: 7332389 - DNA, 22 bp, Homo sapiens
attcagttgtaatctttgttag

SEQ ID NO: 7332390 - DNA, 22 bp, Homo sapiens
attcagttctgctggttctgct

SEQ ID NO: 7332391 - DNA, 20 bp, Homo sapiens
gcagcagacagacaggggac

SEQ ID NO: 7332392 - DNA, 22 bp, Homo sapiens
attcacaatagcagcttgcatg

SEQ ID NO: 7332393 - DNA, 22 bp, Homo sapiens
gcacgagtgtctcacggagtca

SEQ ID NO: 7332394 - DNA, 21 bp, Homo sapiens
attcagaaagggaataaactc

SEQ ID NO: 7332395 - DNA, 22 bp, Homo sapiens
attcagaaagttgtcatatttg

SEQ ID NO: 7332396 - DNA, 22 bp, Homo sapiens
attcactggtgtcagggatcag

SEQ ID NO: 7332397 - DNA, 22 bp, Homo sapiens
attcacattttatttcactgga

SEQ ID NO: 7332398 - DNA, 22 bp, Homo sapiens
attcacattttatttcactgga

SEQ ID NO: 7332399 - DNA, 22 bp, Homo sapiens
attcacatgtgcttcttatcac

SEQ ID NO: 7332400 - DNA, 22 bp, Homo sapiens
attcacatgtgcttcttatcac

SEQ ID NO: 7332401 - DNA, 22 bp, Homo sapiens
attcacatgcccaagcagcacc

SEQ ID NO: 7332402 - DNA, 22 bp, Homo sapiens
attcacattgagcttcactgtg

SEQ ID NO: 7332403 - DNA, 22 bp, Homo sapiens
attcacattgagcttcactgtg

SEQ ID NO: 7332404 - DNA, 22 bp, Homo sapiens
attcacattctagggccctact

SEQ ID NO: 7332405 - DNA, 22 bp, Homo sapiens
attgatttgaacaaagatatta

SEQ ID NO: 7332406 - DNA, 22 bp, Homo sapiens
attgcaaagaaatacatgctta

SEQ ID NO: 7332407 - DNA, 22 bp, Homo sapiens
gcagggctgactcagccaccct

SEQ ID NO: 7332408 - DNA, 22 bp, Homo sapiens
gcagggctgagtcatgtgtgcc

SEQ ID NO: 7332409 - DNA, 18 bp, Homo sapiens
gcagggctgcacacgcat

SEQ ID NO: 7332410 - DNA, 22 bp, Homo sapiens
gcagggctgctgaaacttgttt

SEQ ID NO: 7332411 - DNA, 22 bp, Homo sapiens
gcaggcctgcccagcaggatgg

SEQ ID NO: 7332412 - DNA, 22 bp, Homo sapiens
gcaggcctgcccagcaggatgg

SEQ ID NO: 7332413 - DNA, 22 bp, Homo sapiens
gcaggcctgggagtcatcttgt

SEQ ID NO: 7332414 - DNA, 22 bp, Homo sapiens
gcaggcctgtcttgctcgccct

SEQ ID NO: 7332415 - DNA, 22 bp, Homo sapiens
gcaggcctgtaatgaagggaca

SEQ ID NO: 7332416 - DNA, 22 bp, Homo sapiens
attgatatattatttctaactg

SEQ ID NO: 7332417 - DNA, 22 bp, Homo sapiens
attctttagccagcaggtatat

SEQ ID NO: 7332418 - DNA, 22 bp, Homo sapiens
attctttagttggcttcttgcc

SEQ ID NO: 7332419 - DNA, 22 bp, Homo sapiens
attctttacattggcttcttcc

SEQ ID NO: 7332420 - DNA, 22 bp, Homo sapiens
gcagctgcgaagaagtctatct

SEQ ID NO: 7332421 - DNA, 22 bp, Homo sapiens
gcattcctttataggaaaatgg

SEQ ID NO: 7332422 - DNA, 22 bp, Homo sapiens
gcattctgtgctacagccattc

SEQ ID NO: 7332423 - DNA, 23 bp, Homo sapiens
gcattctgatggttctctgtgat

SEQ ID NO: 7332424 - DNA, 22 bp, Homo sapiens
attgtctctttcaataacttgt

SEQ ID NO: 7332425 - DNA, 22 bp, Homo sapiens
attgtctgaatccaaagctctg

SEQ ID NO: 7332426 - DNA, 22 bp, Homo sapiens
gccaagaaatgcccctcacaga

SEQ ID NO: 7332427 - DNA, 23 bp, Homo sapiens
gccaaaggtctgttcagtggtga

SEQ ID NO: 7332428 - DNA, 22 bp, Homo sapiens
gccaaaggacctgtgggtgaca

SEQ ID NO: 7332429 - DNA, 22 bp, Homo sapiens
gccacagggcgagcggaggcca

SEQ ID NO: 7332430 - DNA, 22 bp, Homo sapiens
gccacagggcgagcggaggcca

SEQ ID NO: 7332431 - DNA, 22 bp, Homo sapiens
gccaagaagtatggttggggct

SEQ ID NO: 7332432 - DNA, 22 bp, Homo sapiens
gccaagaagggccatgtggatt

SEQ ID NO: 7332433 - DNA, 22 bp, Homo sapiens
gccaagcctgggaagagcccat

SEQ ID NO: 7332434 - DNA, 22 bp, Homo sapiens
attgtcagctcgaaatgcatca

SEQ ID NO: 7332435 - DNA, 22 bp, Homo sapiens
attgtcgcttatttaggtgctt

SEQ ID NO: 7332436 - DNA, 22 bp, Homo sapiens
attgtcattggcttctatgtct

SEQ ID NO: 7332437 - DNA, 22 bp, Homo sapiens
attgtcattccagtcattgtta

SEQ ID NO: 7332438 - DNA, 22 bp, Homo sapiens
attgtataacagcatgtatttt

SEQ ID NO: 7332439 - DNA, 17 bp, Homo sapiens
gcatcacagataacacg

SEQ ID NO: 7332440 - DNA, 22 bp, Homo sapiens
gcatattttcacaagctcttgg

SEQ ID NO: 7332441 - DNA, 22 bp, Homo sapiens
gcatagaatttagagacaaaag

SEQ ID NO: 7332442 - DNA, 22 bp, Homo sapiens
gcataggcactttcctcctcct

SEQ ID NO: 7332443 - DNA, 22 bp, Homo sapiens
gcatatgatcacgtgtgtcggt

SEQ ID NO: 7332444 - DNA, 22 bp, Homo sapiens
gcagtgttacttggagtactaa

SEQ ID NO: 7332445 - DNA, 22 bp, Homo sapiens
gcagtgttacttggtttgcaga

SEQ ID NO: 7332446 - DNA, 22 bp, Homo sapiens
gcagtgttaaacaactgctgct

SEQ ID NO: 7332447 - DNA, 22 bp, Homo sapiens
gcagtgttaccttgggctggtt

SEQ ID NO: 7332448 - DNA, 22 bp, Homo sapiens
gcagtgttacctcttcagtggg

SEQ ID NO: 7332449 - DNA, 22 bp, Homo sapiens
gcagtgttaatgcgagtgttca

SEQ ID NO: 7332450 - DNA, 23 bp, Homo sapiens
gcagtgcttggcacagctgggtc

SEQ ID NO: 7332451 - DNA, 22 bp, Homo sapiens
gcagtgcttgaagaggtggcca

SEQ ID NO: 7332452 - DNA, 22 bp, Homo sapiens
gcagggctgggacttactggta

SEQ ID NO: 7332453 - DNA, 20 bp, Homo sapiens
gcagtgctggtgcctctgct

SEQ ID NO: 7332454 - DNA, 22 bp, Homo sapiens
caaaggaggtgataggccctct

SEQ ID NO: 7332455 - DNA, 21 bp, Homo sapiens
caaaggactgtagctcactga

SEQ ID NO: 7332456 - DNA, 22 bp, Homo sapiens
caaaggcaacatatacttgttt

SEQ ID NO: 7332457 - DNA, 22 bp, Homo sapiens
caaaggaaatactaatctggaa

SEQ ID NO: 7332458 - DNA, 22 bp, Homo sapiens
caaagcgcagaggagcctccgg

SEQ ID NO: 7332459 - DNA, 22 bp, Homo sapiens
caaatacttactgaacctgtgc

SEQ ID NO: 7332460 - DNA, 22 bp, Homo sapiens
caaatactgtactgaacactgt

SEQ ID NO: 7332461 - DNA, 21 bp, Homo sapiens
caaatacttagaaacttaaga

SEQ ID NO: 7332462 - DNA, 22 bp, Homo sapiens
caaatacttttagcctattgag

SEQ ID NO: 7332463 - DNA, 22 bp, Homo sapiens
caaatagaactcacagacaaga

SEQ ID NO: 7332464 - DNA, 22 bp, Homo sapiens
gctctttctgtccgcagggcct

SEQ ID NO: 7332465 - DNA, 22 bp, Homo sapiens
gctgacaggctctgtgtatgct

SEQ ID NO: 7332466 - DNA, 22 bp, Homo sapiens
caaatggagaattagcagtttg

SEQ ID NO: 7332467 - DNA, 22 bp, Homo sapiens
caaatggatacaggcaaacatt

SEQ ID NO: 7332468 - DNA, 22 bp, Homo sapiens
caaaattagaaatgcagctgtt

SEQ ID NO: 7332469 - DNA, 22 bp, Homo sapiens
caaaatgatgtgattttattgt

SEQ ID NO: 7332470 - DNA, 22 bp, Homo sapiens
caaacaatttgcatttccttag

SEQ ID NO: 7332471 - DNA, 22 bp, Homo sapiens
caaaattagggagtgagctgga

SEQ ID NO: 7332472 - DNA, 21 bp, Homo sapiens
caaagccaggcaactctctcc

SEQ ID NO: 7332473 - DNA, 22 bp, Homo sapiens
caaacattcaagtacaagtctt

SEQ ID NO: 7332474 - DNA, 22 bp, Homo sapiens
attttacttcatttgaaatgcc

SEQ ID NO: 7332475 - DNA, 22 bp, Homo sapiens
attttacttcatttgaaatgcc

SEQ ID NO: 7332476 - DNA, 22 bp, Homo sapiens
attttactttgtgaatattgac

SEQ ID NO: 7332477 - DNA, 22 bp, Homo sapiens
attttgctttatgtaaatatgt

SEQ ID NO: 7332478 - DNA, 22 bp, Homo sapiens
attttgctgtggtacattagga

SEQ ID NO: 7332479 - DNA, 22 bp, Homo sapiens
attttgtttcctttggagtaga

SEQ ID NO: 7332480 - DNA, 22 bp, Homo sapiens
atttttcaactttggaaatggc

SEQ ID NO: 7332481 - DNA, 22 bp, Homo sapiens
atttttcagcttcattgaggca

SEQ ID NO: 7332482 - DNA, 22 bp, Homo sapiens
atttttctctttccactgagat

SEQ ID NO: 7332483 - DNA, 22 bp, Homo sapiens
atttttctctccactccattaa

SEQ ID NO: 7332484 - DNA, 22 bp, Homo sapiens
atttttctctcacacttaccag

SEQ ID NO: 7332485 - DNA, 19 bp, Homo sapiens
atttttcttcctctgtgca

SEQ ID NO: 7332486 - DNA, 19 bp, Homo sapiens
atttttcttcctctgtgca

SEQ ID NO: 7332487 - DNA, 22 bp, Homo sapiens
caaaagcagttctatctgagtt

SEQ ID NO: 7332488 - DNA, 22 bp, Homo sapiens
gcccccaggctctggagaacct

SEQ ID NO: 7332489 - DNA, 22 bp, Homo sapiens
gcccccagctctcaagctcaaa

SEQ ID NO: 7332490 - DNA, 22 bp, Homo sapiens
gcccccaggcactacatgtgaa

SEQ ID NO: 7332491 - DNA, 22 bp, Homo sapiens
gcccccaggcactacatgtgaa

SEQ ID NO: 7332492 - DNA, 22 bp, Homo sapiens
gcccccagaagggccacagatt

SEQ ID NO: 7332493 - DNA, 22 bp, Homo sapiens
gcccccagaagggccacagatt

SEQ ID NO: 7332494 - DNA, 22 bp, Homo sapiens
gcccccagacctcagtgggctg

SEQ ID NO: 7332495 - DNA, 22 bp, Homo sapiens
atttgctagcaagtattctgaa

SEQ ID NO: 7332496 - DNA, 22 bp, Homo sapiens
gccccctctttggagccagcca

SEQ ID NO: 7332497 - DNA, 22 bp, Homo sapiens
gcctcacagactgactgaaagc

SEQ ID NO: 7332498 - DNA, 22 bp, Homo sapiens
gcctcttgtttccttacatgga

SEQ ID NO: 7332499 - DNA, 22 bp, Homo sapiens
gcctcttgtttccttacatgga

SEQ ID NO: 7332500 - DNA, 22 bp, Homo sapiens
gcctggattccttgtttctcag

SEQ ID NO: 7332501 - DNA, 20 bp, Homo sapiens
gcctggaggcaatgggaaga

SEQ ID NO: 7332502 - DNA, 22 bp, Homo sapiens
gcctgagagtctgcatttctaa

SEQ ID NO: 7332503 - DNA, 22 bp, Homo sapiens
gcctgagattctgcatttctaa

SEQ ID NO: 7332504 - DNA, 22 bp, Homo sapiens
atttggaagcatttccaaagca

SEQ ID NO: 7332505 - DNA, 22 bp, Homo sapiens
atttcatgttaactgaacagaa

SEQ ID NO: 7332506 - DNA, 22 bp, Homo sapiens
gccaggtggaggttgcagtgag

SEQ ID NO: 7332507 - DNA, 22 bp, Homo sapiens
atttccagtgcactgaatagaa

SEQ ID NO: 7332508 - DNA, 22 bp, Homo sapiens
atttccaggctgttttgtgaat

SEQ ID NO: 7332509 - DNA, 22 bp, Homo sapiens
atttccagtacccagaacagag

SEQ ID NO: 7332510 - DNA, 22 bp, Homo sapiens
gccaggtgagtgcgcgccgtcc

SEQ ID NO: 7332511 - DNA, 22 bp, Homo sapiens
gcccacagttaatgggggctct

SEQ ID NO: 7332512 - DNA, 23 bp, Homo sapiens
gcccaccctcagcgtcctcacgg

SEQ ID NO: 7332513 - DNA, 22 bp, Homo sapiens
gcccacagtctatcagtttgcg

SEQ ID NO: 7332514 - DNA, 21 bp, Homo sapiens
gcccacagtgaggaggatccc

SEQ ID NO: 7332515 - DNA, 22 bp, Homo sapiens
atttccatacacccatttctga

SEQ ID NO: 7332516 - DNA, 22 bp, Homo sapiens
atttccatagagcgtctcacag

SEQ ID NO: 7332517 - DNA, 22 bp, Homo sapiens
atttccatgaaggcagatttta

SEQ ID NO: 7332518 - DNA, 22 bp, Homo sapiens
atttctcagttcctactgttta

SEQ ID NO: 7332519 - DNA, 22 bp, Homo sapiens
atttctcagttcctactgttta

SEQ ID NO: 7332520 - DNA, 22 bp, Homo sapiens
atttctgtaacttatgaaagtt

SEQ ID NO: 7332521 - DNA, 22 bp, Homo sapiens
atttctgctctgacctgaaagt

SEQ ID NO: 7332522 - DNA, 22 bp, Homo sapiens
atttctgtgcagtaaatggtga

SEQ ID NO: 7332523 - DNA, 22 bp, Homo sapiens
atttctgtatcctgctgtcaga

SEQ ID NO: 7332524 - DNA, 17 bp, Homo sapiens
gcccccagaaatctcag

SEQ ID NO: 7332525 - DNA, 22 bp, Homo sapiens
gcccccacaggcgggctcgggt

SEQ ID NO: 7332526 - DNA, 22 bp, Homo sapiens
atcaaatcattgcattaatgtt

SEQ ID NO: 7332527 - DNA, 22 bp, Homo sapiens
atcaacttttagcatggtacct

SEQ ID NO: 7332528 - DNA, 22 bp, Homo sapiens
atcactttggtaccaattcagc

SEQ ID NO: 7332529 - DNA, 22 bp, Homo sapiens
atcaacatgaatttctctgaag

SEQ ID NO: 7332530 - DNA, 22 bp, Homo sapiens
atcaacttaaagaaaagatact

SEQ ID NO: 7332531 - DNA, 22 bp, Homo sapiens
atcaacttaaagaaaagatact

SEQ ID NO: 7332532 - DNA, 22 bp, Homo sapiens
atcagaaagttcatcatgtttg

SEQ ID NO: 7332533 - DNA, 22 bp, Homo sapiens
atcagaaatagtcatgttactt

SEQ ID NO: 7332534 - DNA, 22 bp, Homo sapiens
atcagaaattgcccagctgttt

SEQ ID NO: 7332535 - DNA, 22 bp, Homo sapiens
atcagaaatctaggattcagaa

SEQ ID NO: 7332536 - DNA, 22 bp, Homo sapiens
atcagaaactcttagagcaggg

SEQ ID NO: 7332537 - DNA, 21 bp, Homo sapiens
atcagaaaatgtaatggagca

SEQ ID NO: 7332538 - DNA, 22 bp, Homo sapiens
atcagaaaatacccagtgttta

SEQ ID NO: 7332539 - DNA, 21 bp, Homo sapiens
atcagaatctctagatttgga

SEQ ID NO: 7332540 - DNA, 22 bp, Homo sapiens
atcagaatactatcaacagtga

SEQ ID NO: 7332541 - DNA, 22 bp, Homo sapiens
atcagaataattagatttcaga

SEQ ID NO: 7332542 - DNA, 22 bp, Homo sapiens
atcagaaattgctaccagtgga

SEQ ID NO: 7332543 - DNA, 22 bp, Homo sapiens
atatttactgctgtggtgaagg

SEQ ID NO: 7332544 - DNA, 22 bp, Homo sapiens
atcaaaatggaagaatttggct

SEQ ID NO: 7332545 - DNA, 22 bp, Homo sapiens
atcaaaatggaagaatttggct

SEQ ID NO: 7332546 - DNA, 22 bp, Homo sapiens
atcaaagtaggcatatgttttt

SEQ ID NO: 7332547 - DNA, 22 bp, Homo sapiens
atattgatggaggtgttagaca

SEQ ID NO: 7332548 - DNA, 22 bp, Homo sapiens
atatgctattgctgtaatttaa

SEQ ID NO: 7332549 - DNA, 22 bp, Homo sapiens
atatgctatgttgaataatttg

SEQ ID NO: 7332550 - DNA, 22 bp, Homo sapiens
atatgctatgtatgtaaatgag

SEQ ID NO: 7332551 - DNA, 22 bp, Homo sapiens
atatgctacaaataaactttta

SEQ ID NO: 7332552 - DNA, 22 bp, Homo sapiens
atatgccattagctagaaataa

SEQ ID NO: 7332553 - DNA, 22 bp, Homo sapiens
atatgcgtactatatactgtgt

SEQ ID NO: 7332554 - DNA, 22 bp, Homo sapiens
atatgctaattagagggcatta

SEQ ID NO: 7332555 - DNA, 22 bp, Homo sapiens
atatgcatttacctggcatata

SEQ ID NO: 7332556 - DNA, 20 bp, Homo sapiens
atatgcatgtgttttcactt

SEQ ID NO: 7332557 - DNA, 21 bp, Homo sapiens
atatgccaaatgccagtaacc

SEQ ID NO: 7332558 - DNA, 22 bp, Homo sapiens
atatgccatactgtacaatact

SEQ ID NO: 7332559 - DNA, 22 bp, Homo sapiens
atatgcatatgtcaaaacttat

SEQ ID NO: 7332560 - DNA, 22 bp, Homo sapiens
atatgcatgtacgtgtgcacaa

SEQ ID NO: 7332561 - DNA, 22 bp, Homo sapiens
atatgcatgcatgcttgtgaga

SEQ ID NO: 7332562 - DNA, 22 bp, Homo sapiens
atattacataaacatgagtgaa

SEQ ID NO: 7332563 - DNA, 22 bp, Homo sapiens
atattacataaacatgagtgaa

SEQ ID NO: 7332564 - DNA, 22 bp, Homo sapiens
atattataagttatttcaagtt

SEQ ID NO: 7332565 - DNA, 22 bp, Homo sapiens
atattatggccccatctaagct

SEQ ID NO: 7332566 - DNA, 22 bp, Homo sapiens
atattatagacagagtcttctg

SEQ ID NO: 7332567 - DNA, 22 bp, Homo sapiens
ctggcttccatgctgtagtggc

SEQ ID NO: 7332568 - DNA, 22 bp, Homo sapiens
ctggctgtttcaggcagtgtcc

SEQ ID NO: 7332569 - DNA, 22 bp, Homo sapiens
ctggctgttttcaatgttgatg

SEQ ID NO: 7332570 - DNA, 22 bp, Homo sapiens
ctggctgtgtccacagagtaag

SEQ ID NO: 7332571 - DNA, 22 bp, Homo sapiens
atatgcacatacatacataggt

SEQ ID NO: 7332572 - DNA, 22 bp, Homo sapiens
ctgggctcagcaggccaaggcc

SEQ ID NO: 7332573 - DNA, 22 bp, Homo sapiens
atatgcatatacacacatgcgt

SEQ ID NO: 7332574 - DNA, 22 bp, Homo sapiens
atatgcataatacaaagagtat

SEQ ID NO: 7332575 - DNA, 22 bp, Homo sapiens
ctgggctcacctgtggctggca

SEQ ID NO: 7332576 - DNA, 22 bp, Homo sapiens
ctgggcctggtgtggcacctgc

SEQ ID NO: 7332577 - DNA, 22 bp, Homo sapiens
ctgtgtgtcctcggacgagttt

SEQ ID NO: 7332578 - DNA, 22 bp, Homo sapiens
ctgtgtgtcctcggacgagttt

SEQ ID NO: 7332579 - DNA, 22 bp, Homo sapiens
ctgtgtgtcctcggacgagttt

SEQ ID NO: 7332580 - DNA, 22 bp, Homo sapiens
ctgtgtgtcatttgtcaatcct

SEQ ID NO: 7332581 - DNA, 22 bp, Homo sapiens
ctgtgtgtcatttgtcaatcct

SEQ ID NO: 7332582 - DNA, 22 bp, Homo sapiens
ctgtgtgtcatttgtcaatcct

SEQ ID NO: 7332583 - DNA, 22 bp, Homo sapiens
ctgtgtgcctagagggtggccg

SEQ ID NO: 7332584 - DNA, 22 bp, Homo sapiens
ctgtgtgctcggatggactcgt

SEQ ID NO: 7332585 - DNA, 22 bp, Homo sapiens
ctgtgtgcatagttgtgctcaa

SEQ ID NO: 7332586 - DNA, 22 bp, Homo sapiens
ctgtgtgcaggtgctgggtacc

SEQ ID NO: 7332587 - DNA, 22 bp, Homo sapiens
atccagtcccacacatgctctg

SEQ ID NO: 7332588 - DNA, 22 bp, Homo sapiens
atccagtctgtctaccttctca

SEQ ID NO: 7332589 - DNA, 22 bp, Homo sapiens
atccagggtgtggagagagctc

SEQ ID NO: 7332590 - DNA, 22 bp, Homo sapiens
ctgtgggagaggtgcctggatt

SEQ ID NO: 7332591 - DNA, 22 bp, Homo sapiens
atccactccctaacaccatgtt

SEQ ID NO: 7332592 - DNA, 22 bp, Homo sapiens
atccactcctggaggtgcccca

SEQ ID NO: 7332593 - DNA, 22 bp, Homo sapiens
atccactcggagggaatgttta

SEQ ID NO: 7332594 - DNA, 22 bp, Homo sapiens
atccaggcgaatgcagaaggcc

SEQ ID NO: 7332595 - DNA, 21 bp, Homo sapiens
ctgtggcctggctagcaccgt

SEQ ID NO: 7332596 - DNA, 22 bp, Homo sapiens
ctgtggccttggaccagcatct

SEQ ID NO: 7332597 - DNA, 22 bp, Homo sapiens
ctgtggccttggaccagcatct

SEQ ID NO: 7332598 - DNA, 23 bp, Homo sapiens
ctgtggccctgcttcatgcagcc

SEQ ID NO: 7332599 - DNA, 19 bp, Homo sapiens
ctgtggcctccaggaggga

SEQ ID NO: 7332600 - DNA, 22 bp, Homo sapiens
atcagaatcttctgaacagtgg

SEQ ID NO: 7332601 - DNA, 22 bp, Homo sapiens
atcagaatgattagtaaccaat

SEQ ID NO: 7332602 - DNA, 22 bp, Homo sapiens
ctgtgggagaagggctttttct

SEQ ID NO: 7332603 - DNA, 22 bp, Homo sapiens
ctgtgggagaagggctttttct

SEQ ID NO: 7332604 - DNA, 22 bp, Homo sapiens
ctgtgggagaagttgctggagt

SEQ ID NO: 7332605 - DNA, 21 bp, Homo sapiens
ctgtgggaccaagcactggga

SEQ ID NO: 7332606 - DNA, 22 bp, Homo sapiens
ctgtgggagaagctagcacagg

SEQ ID NO: 7332607 - DNA, 22 bp, Homo sapiens
ctgtgggactctgaggaaaagc

SEQ ID NO: 7332608 - DNA, 21 bp, Homo sapiens
ctgtgggaccaagcactggga

SEQ ID NO: 7332609 - DNA, 22 bp, Homo sapiens
ctgtgggaacactgaggacttc

SEQ ID NO: 7332610 - DNA, 22 bp, Homo sapiens
ctgtgggaaaggatgagattgc

SEQ ID NO: 7332611 - DNA, 18 bp, Homo sapiens
ctgtgggaagagtttggg

SEQ ID NO: 7332612 - DNA, 22 bp, Homo sapiens
ctgtgggaatactgcgagtgta

SEQ ID NO: 7332613 - DNA, 23 bp, Homo sapiens
ctgtgggaagtcggggagcgcgc

SEQ ID NO: 7332614 - DNA, 18 bp, Homo sapiens
ctgtgggaaggctttcta

SEQ ID NO: 7332615 - DNA, 22 bp, Homo sapiens
ctgtggctaggattattcctga

SEQ ID NO: 7332616 - DNA, 22 bp, Homo sapiens
ctgtggctatggtgtacatact

SEQ ID NO: 7332617 - DNA, 19 bp, Homo sapiens
atctgagattataaacaga

SEQ ID NO: 7332618 - DNA, 22 bp, Homo sapiens
atctgacatctactagaacaga

SEQ ID NO: 7332619 - DNA, 22 bp, Homo sapiens
atctgagtctctgacagcatgt

SEQ ID NO: 7332620 - DNA, 22 bp, Homo sapiens
cttcttcaacctgaaagtttca

SEQ ID NO: 7332621 - DNA, 22 bp, Homo sapiens
atctgaataaatttcttttagt

SEQ ID NO: 7332622 - DNA, 22 bp, Homo sapiens
cttcctctatgttcaggtagaa

SEQ ID NO: 7332623 - DNA, 22 bp, Homo sapiens
atctctgccaacagttaatgtt

SEQ ID NO: 7332624 - DNA, 22 bp, Homo sapiens
cttcctcctccatctcgaaggc

SEQ ID NO: 7332625 - DNA, 22 bp, Homo sapiens
cttcccaagactgtattgcaag

SEQ ID NO: 7332626 - DNA, 22 bp, Homo sapiens
cttagagatgggttttacttag

SEQ ID NO: 7332627 - DNA, 22 bp, Homo sapiens
cttagatacagtagaaagactc

SEQ ID NO: 7332628 - DNA, 22 bp, Homo sapiens
ctggagagaatgttcattgcag

SEQ ID NO: 7332629 - DNA, 22 bp, Homo sapiens
atacagtagggaccatgtctga

SEQ ID NO: 7332630 - DNA, 22 bp, Homo sapiens
ctggagaattctatgaaatatt

SEQ ID NO: 7332631 - DNA, 22 bp, Homo sapiens
ctggagaattctatgaaatatt

SEQ ID NO: 7332632 - DNA, 22 bp, Homo sapiens
ctggagaagtactgagacattt

SEQ ID NO: 7332633 - DNA, 22 bp, Homo sapiens
ctggagaagaggtagtatgtag

SEQ ID NO: 7332634 - DNA, 22 bp, Homo sapiens
ctggagaagaggtagtatgtag

SEQ ID NO: 7332635 - DNA, 22 bp, Homo sapiens
ctgctgcaggatgggcactctg

SEQ ID NO: 7332636 - DNA, 18 bp, Homo sapiens
ctgctgcaggcactcagg

SEQ ID NO: 7332637 - DNA, 22 bp, Homo sapiens
ctgctgcagatgacagacccaa

SEQ ID NO: 7332638 - DNA, 22 bp, Homo sapiens
ctgctgcaggatgggcactctg

SEQ ID NO: 7332639 - DNA, 22 bp, Homo sapiens
ctgctgccaagggtgccacagg

SEQ ID NO: 7332640 - DNA, 22 bp, Homo sapiens
atacatacgtacatacgtatgt

SEQ ID NO: 7332641 - DNA, 22 bp, Homo sapiens
atacatacatgtatgcacatac

SEQ ID NO: 7332642 - DNA, 22 bp, Homo sapiens
atacatacatgtacacataaat

SEQ ID NO: 7332643 - DNA, 17 bp, Homo sapiens
atacagtttattttaca

SEQ ID NO: 7332644 - DNA, 22 bp, Homo sapiens
atacagtttaccacactccttg

SEQ ID NO: 7332645 - DNA, 22 bp, Homo sapiens
atacagtggctgtgagctgggc

SEQ ID NO: 7332646 - DNA, 22 bp, Homo sapiens
atacagtggctgtgagctgggc

SEQ ID NO: 7332647 - DNA, 22 bp, Homo sapiens
atacagtgccccttttcacatg

SEQ ID NO: 7332648 - DNA, 22 bp, Homo sapiens
atacagttagaaaaaaagcctt

SEQ ID NO: 7332649 - DNA, 22 bp, Homo sapiens
atacagtgcacaacctgtgcag

SEQ ID NO: 7332650 - DNA, 22 bp, Homo sapiens
atacagtataactaataaaccc

SEQ ID NO: 7332651 - DNA, 22 bp, Homo sapiens
atacagtattacctgttcagga

SEQ ID NO: 7332652 - DNA, 22 bp, Homo sapiens
atacatagttctgtgaaaagta

SEQ ID NO: 7332653 - DNA, 22 bp, Homo sapiens
atacatgtgtgtgcatacatgt

SEQ ID NO: 7332654 - DNA, 22 bp, Homo sapiens
atacatatatggtacttcctgg

SEQ ID NO: 7332655 - DNA, 22 bp, Homo sapiens
ataccaaagcacatactgtttg

SEQ ID NO: 7332656 - DNA, 22 bp, Homo sapiens
atacgtgctgttttaagataca

SEQ ID NO: 7332657 - DNA, 22 bp, Homo sapiens
atacctgtgtatccacaagcgt

SEQ ID NO: 7332658 - DNA, 22 bp, Homo sapiens
ataccataggaaaggatcagcc

SEQ ID NO: 7332659 - DNA, 22 bp, Homo sapiens
ataccacaacatggctcagagg

SEQ ID NO: 7332660 - DNA, 22 bp, Homo sapiens
ataccctgttctggagtgaatg

SEQ ID NO: 7332661 - DNA, 22 bp, Homo sapiens
ataccctagagttggacagaat

SEQ ID NO: 7332662 - DNA, 22 bp, Homo sapiens
ataccctgttcatctttgtgtt

SEQ ID NO: 7332663 - DNA, 22 bp, Homo sapiens
atagcaaagcctggcacaatga

SEQ ID NO: 7332664 - DNA, 22 bp, Homo sapiens
atagcaaagatgtcaattcccc

SEQ ID NO: 7332665 - DNA, 22 bp, Homo sapiens
ctggcccagttctgcgttttgc

SEQ ID NO: 7332666 - DNA, 22 bp, Homo sapiens
atagcaaaaggcaccagagtga

SEQ ID NO: 7332667 - DNA, 22 bp, Homo sapiens
ctggcccatggtgagctctggg

SEQ ID NO: 7332668 - DNA, 22 bp, Homo sapiens
ctggcccatggtgagctctggg

SEQ ID NO: 7332669 - DNA, 22 bp, Homo sapiens
ctggcccatggtgagctctggg

SEQ ID NO: 7332670 - DNA, 22 bp, Homo sapiens
ctggcccccacacctgtcaggg

SEQ ID NO: 7332671 - DNA, 22 bp, Homo sapiens
ctggcccccacacctgtcaggg

SEQ ID NO: 7332672 - DNA, 22 bp, Homo sapiens
ctggccccaggcagcctgctgg

SEQ ID NO: 7332673 - DNA, 22 bp, Homo sapiens
ctggccccaggcagcctgctgg

SEQ ID NO: 7332674 - DNA, 22 bp, Homo sapiens
ctggccccatctggagtctgag

SEQ ID NO: 7332675 - DNA, 22 bp, Homo sapiens
atactatattaccttctcaact

SEQ ID NO: 7332676 - DNA, 22 bp, Homo sapiens
atagatttgaatttaagacttg

SEQ ID NO: 7332677 - DNA, 22 bp, Homo sapiens
atagatttgaatttaagacttg

SEQ ID NO: 7332678 - DNA, 22 bp, Homo sapiens
atactacaaggtatgtgctaaa

SEQ ID NO: 7332679 - DNA, 22 bp, Homo sapiens
atactaaagtatagaacttagt

SEQ ID NO: 7332680 - DNA, 22 bp, Homo sapiens
atactacaatcataattgtaca

SEQ ID NO: 7332681 - DNA, 22 bp, Homo sapiens
atactacacattgactatattt

SEQ ID NO: 7332682 - DNA, 22 bp, Homo sapiens
ctggctcccatgagctctcacg

SEQ ID NO: 7332683 - DNA, 22 bp, Homo sapiens
ctggctcccgttgtccttgaag

SEQ ID NO: 7332684 - DNA, 22 bp, Homo sapiens
ctggctcacctccgctccagca

SEQ ID NO: 7332685 - DNA, 22 bp, Homo sapiens
ctggctccatcctaggcaaatg

SEQ ID NO: 7332686 - DNA, 22 bp, Homo sapiens
ctggctccatctttgcttcctg

SEQ ID NO: 7332687 - DNA, 22 bp, Homo sapiens
ctggctccatccttgagctctg

SEQ ID NO: 7332688 - DNA, 22 bp, Homo sapiens
atagcaatcagtgtatttgaaa

SEQ ID NO: 7332689 - DNA, 22 bp, Homo sapiens
atagcaatgatcaagacagaca

SEQ ID NO: 7332690 - DNA, 22 bp, Homo sapiens
atagcacatcactccagtgagt

SEQ ID NO: 7332691 - DNA, 22 bp, Homo sapiens
atagcaccatgactaaacaatt

SEQ ID NO: 7332692 - DNA, 19 bp, Homo sapiens
ctggctgcaatgccagggt

SEQ ID NO: 7332693 - DNA, 22 bp, Homo sapiens
ctggctgcagctccgaggaaga

SEQ ID NO: 7332694 - DNA, 22 bp, Homo sapiens
ctgctgaggtatactatgtgac

SEQ ID NO: 7332695 - DNA, 22 bp, Homo sapiens
ctgctgagcctggtgcgggatg

SEQ ID NO: 7332696 - DNA, 22 bp, Homo sapiens
atacaacagaaaatgattattc

SEQ ID NO: 7332697 - DNA, 22 bp, Homo sapiens
atacaaatttatagatgcattt

SEQ ID NO: 7332698 - DNA, 23 bp, Homo sapiens
ataagaaaacagtaggctcagag

SEQ ID NO: 7332699 - DNA, 21 bp, Homo sapiens
ataagcatgctgattacattt

SEQ ID NO: 7332700 - DNA, 22 bp, Homo sapiens
ataaattatgaatggccctttt

SEQ ID NO: 7332701 - DNA, 22 bp, Homo sapiens
ataacagatactctctgtgagg

SEQ ID NO: 7332702 - DNA, 23 bp, Homo sapiens
ataaattactatctccctagagc

SEQ ID NO: 7332703 - DNA, 22 bp, Homo sapiens
ataacagtgacctctcagcacc

SEQ ID NO: 7332704 - DNA, 22 bp, Homo sapiens
ataacagatgtgaagtgctaat

SEQ ID NO: 7332705 - DNA, 22 bp, Homo sapiens
ctgcctctcaggtccctgagat

SEQ ID NO: 7332706 - DNA, 22 bp, Homo sapiens
ctgcctctcaggtccctgagat

SEQ ID NO: 7332707 - DNA, 22 bp, Homo sapiens
ctgcctctcagcctgaccgcca

SEQ ID NO: 7332708 - DNA, 23 bp, Homo sapiens
ctgcattgtctcctgggagcatg

SEQ ID NO: 7332709 - DNA, 22 bp, Homo sapiens
ctgccctgtttggacagcccgg

SEQ ID NO: 7332710 - DNA, 22 bp, Homo sapiens
ctgcctctattcactgaggcag

SEQ ID NO: 7332711 - DNA, 20 bp, Homo sapiens
ctgccgaccacagccatgga

SEQ ID NO: 7332712 - DNA, 22 bp, Homo sapiens
ataaatgcctcagaatcatccc

SEQ ID NO: 7332713 - DNA, 22 bp, Homo sapiens
agttatttactcctttgtctct

SEQ ID NO: 7332714 - DNA, 22 bp, Homo sapiens
agttatttcagtaacataatag

SEQ ID NO: 7332715 - DNA, 22 bp, Homo sapiens
ctgatcattgttgttgctgtaa

SEQ ID NO: 7332716 - DNA, 22 bp, Homo sapiens
ctgcaaatcaagttcttataat

SEQ ID NO: 7332717 - DNA, 22 bp, Homo sapiens
ctgcaagctacccctagcatca

SEQ ID NO: 7332718 - DNA, 22 bp, Homo sapiens
ctgcaagggatcttcaggtagc

SEQ ID NO: 7332719 - DNA, 22 bp, Homo sapiens
ctgcaaggtccacctgctacat

SEQ ID NO: 7332720 - DNA, 22 bp, Homo sapiens
agttatttaaaatgattgtcct

SEQ ID NO: 7332721 - DNA, 22 bp, Homo sapiens
agttatcaagacagtgtggtac

SEQ ID NO: 7332722 - DNA, 22 bp, Homo sapiens
ctgaggagaggtggcctgtgtt

SEQ ID NO: 7332723 - DNA, 22 bp, Homo sapiens
ctgaggagcagctggcccgcta

SEQ ID NO: 7332724 - DNA, 22 bp, Homo sapiens
ctgaggagcagctggcccgcta

SEQ ID NO: 7332725 - DNA, 22 bp, Homo sapiens
ctgcatgtgatgtggttagcta

SEQ ID NO: 7332726 - DNA, 20 bp, Homo sapiens
ctgcagggttagaggctcca

SEQ ID NO: 7332727 - DNA, 22 bp, Homo sapiens
ctgcagggttttaacaatggac

SEQ ID NO: 7332728 - DNA, 23 bp, Homo sapiens
ctgcagagaactgagggacagcc

SEQ ID NO: 7332729 - DNA, 22 bp, Homo sapiens
ctgcagagagtaactgaaatat

SEQ ID NO: 7332730 - DNA, 22 bp, Homo sapiens
ctgcagagagtgccgggcagcc

SEQ ID NO: 7332731 - DNA, 22 bp, Homo sapiens
ctgcagagcaagtaacatcctc

SEQ ID NO: 7332732 - DNA, 22 bp, Homo sapiens
ctgcagagatgaagaaggtggc

SEQ ID NO: 7332733 - DNA, 20 bp, Homo sapiens
ctgcagggtgagtgggcgat

SEQ ID NO: 7332734 - DNA, 22 bp, Homo sapiens
agtcctcccttggggccacctt

SEQ ID NO: 7332735 - DNA, 22 bp, Homo sapiens
agtccggggtctggacacctgg

SEQ ID NO: 7332736 - DNA, 22 bp, Homo sapiens
agtcccccgtcctgcttgtcta

SEQ ID NO: 7332737 - DNA, 22 bp, Homo sapiens
ctcatgcattctttttgtgtgt

SEQ ID NO: 7332738 - DNA, 22 bp, Homo sapiens
agtcctgggtccagcaggtcct

SEQ ID NO: 7332739 - DNA, 22 bp, Homo sapiens
ctcattctttcacagtctgtgg

SEQ ID NO: 7332740 - DNA, 22 bp, Homo sapiens
ctcattgcagctgcattactgt

SEQ ID NO: 7332741 - DNA, 22 bp, Homo sapiens
ctcatgtcaggggtgtcaatgt

SEQ ID NO: 7332742 - DNA, 18 bp, Homo sapiens
ctcatgtgtggtcccagc

SEQ ID NO: 7332743 - DNA, 22 bp, Homo sapiens
ctccagctttttcccagttggc

SEQ ID NO: 7332744 - DNA, 22 bp, Homo sapiens
ctccagggaaaggggcgtccgc

SEQ ID NO: 7332745 - DNA, 22 bp, Homo sapiens
ctccaggctggggtgcaggttg

SEQ ID NO: 7332746 - DNA, 22 bp, Homo sapiens
ctccaggctggatccaagtcaa

SEQ ID NO: 7332747 - DNA, 22 bp, Homo sapiens
ctccaggctcgtccaagatcga

SEQ ID NO: 7332748 - DNA, 22 bp, Homo sapiens
ctccaggctcgtccaagatcga

SEQ ID NO: 7332749 - DNA, 22 bp, Homo sapiens
ctccaggaacagcaccctgctg

SEQ ID NO: 7332750 - DNA, 22 bp, Homo sapiens
ctccagcctcatctcctggctg

SEQ ID NO: 7332751 - DNA, 22 bp, Homo sapiens
ctcctagatgtcttcagagaaa

SEQ ID NO: 7332752 - DNA, 22 bp, Homo sapiens
ctcctcacacccactgcaacca

SEQ ID NO: 7332753 - DNA, 22 bp, Homo sapiens
ctcctcacacccactgcaacca

SEQ ID NO: 7332754 - DNA, 22 bp, Homo sapiens
ctcctcagaacagccttggctg

SEQ ID NO: 7332755 - DNA, 22 bp, Homo sapiens
ctccggaggggcgctcatgctt

SEQ ID NO: 7332756 - DNA, 21 bp, Homo sapiens
ctccggagtgagctgtgggta

SEQ ID NO: 7332757 - DNA, 22 bp, Homo sapiens
ctccggccgcggtgcccagcgc

SEQ ID NO: 7332758 - DNA, 22 bp, Homo sapiens
ctcctacataacccagcgaact

SEQ ID NO: 7332759 - DNA, 22 bp, Homo sapiens
ctcctcagaagagggtaacaca

SEQ ID NO: 7332760 - DNA, 22 bp, Homo sapiens
ctcctcagaagagggtaacaca

SEQ ID NO: 7332761 - DNA, 22 bp, Homo sapiens
ctcctcagaacagccttggctg

SEQ ID NO: 7332762 - DNA, 22 bp, Homo sapiens
ctcctcagactttccttgtccg

SEQ ID NO: 7332763 - DNA, 20 bp, Homo sapiens
ctccagggaacagactggag

SEQ ID NO: 7332764 - DNA, 20 bp, Homo sapiens
ctccagggaacagactggag

SEQ ID NO: 7332765 - DNA, 22 bp, Homo sapiens
ctcctggctttcccagaccagg

SEQ ID NO: 7332766 - DNA, 22 bp, Homo sapiens
ctcctggctttcccagaccagg

SEQ ID NO: 7332767 - DNA, 22 bp, Homo sapiens
ctcctgggaatttagttgtgag

SEQ ID NO: 7332768 - DNA, 22 bp, Homo sapiens
ctcctgggaaatgaaggggcag

SEQ ID NO: 7332769 - DNA, 22 bp, Homo sapiens
ctcctggggcacttagaagcaa

SEQ ID NO: 7332770 - DNA, 22 bp, Homo sapiens
ctcctgggggacagcggcaggg

SEQ ID NO: 7332771 - DNA, 22 bp, Homo sapiens
ctcctgggtcattgccagcaaa

SEQ ID NO: 7332772 - DNA, 22 bp, Homo sapiens
ctcctgggggacagcggcaggg

SEQ ID NO: 7332773 - DNA, 22 bp, Homo sapiens
ctcctgggtcattgccagcaaa

SEQ ID NO: 7332774 - DNA, 22 bp, Homo sapiens
agtggcagaggttgactgcagt

SEQ ID NO: 7332775 - DNA, 22 bp, Homo sapiens
ctctcagatggagtgtgaatgg

SEQ ID NO: 7332776 - DNA, 22 bp, Homo sapiens
ctctcagactgaagggcctgtg

SEQ ID NO: 7332777 - DNA, 22 bp, Homo sapiens
agtggcagagtgcactcaggca

SEQ ID NO: 7332778 - DNA, 17 bp, Homo sapiens
ctctgcagtgcatggct

SEQ ID NO: 7332779 - DNA, 22 bp, Homo sapiens
ctctcagggtccctgcggagga

SEQ ID NO: 7332780 - DNA, 22 bp, Homo sapiens
ctctcatgcaaaatttagttct

SEQ ID NO: 7332781 - DNA, 22 bp, Homo sapiens
ctctcatgtagtatctgtatgg

SEQ ID NO: 7332782 - DNA, 22 bp, Homo sapiens
ctctgctgagccagagtcccca

SEQ ID NO: 7332783 - DNA, 21 bp, Homo sapiens
ctctgctgagctccattttca

SEQ ID NO: 7332784 - DNA, 22 bp, Homo sapiens
ctctgctcaccagccatgtgat

SEQ ID NO: 7332785 - DNA, 22 bp, Homo sapiens
ctctgctcaccagccatgtgat

SEQ ID NO: 7332786 - DNA, 22 bp, Homo sapiens
ctctgcgccaccctcgcctgct

SEQ ID NO: 7332787 - DNA, 22 bp, Homo sapiens
ctctggcttctaccttgcagtt

SEQ ID NO: 7332788 - DNA, 21 bp, Homo sapiens
ctctgctgagtcctaggattc

SEQ ID NO: 7332789 - DNA, 22 bp, Homo sapiens
ctctgcatcaggcattatggat

SEQ ID NO: 7332790 - DNA, 22 bp, Homo sapiens
ctctgcctgccactgttcaggc

SEQ ID NO: 7332791 - DNA, 22 bp, Homo sapiens
ctctgcctgccactgttcaggc

SEQ ID NO: 7332792 - DNA, 22 bp, Homo sapiens
ctctgcctgtgtcgccaccaca

SEQ ID NO: 7332793 - DNA, 22 bp, Homo sapiens
ctctgcctgtctcatcctgcaa

SEQ ID NO: 7332794 - DNA, 22 bp, Homo sapiens
ctctggggtgcttcgacacttc

SEQ ID NO: 7332795 - DNA, 22 bp, Homo sapiens
ctctggggttaagcttccatgg

SEQ ID NO: 7332796 - DNA, 22 bp, Homo sapiens
ctctggggtggaggaggctgac

SEQ ID NO: 7332797 - DNA, 22 bp, Homo sapiens
ctctggggtggaggaggctgac

SEQ ID NO: 7332798 - DNA, 22 bp, Homo sapiens
ctgacaaacttaattttctgaa

SEQ ID NO: 7332799 - DNA, 22 bp, Homo sapiens
ctgaatgatataagatctttct

SEQ ID NO: 7332800 - DNA, 22 bp, Homo sapiens
ctgagaaaagctttcttataca

SEQ ID NO: 7332801 - DNA, 22 bp, Homo sapiens
ctgagaaaagacatttctagat

SEQ ID NO: 7332802 - DNA, 22 bp, Homo sapiens
ctgagaaaagacatttctagat

SEQ ID NO: 7332803 - DNA, 20 bp, Homo sapiens
ctgacagaaaatatttcatc

SEQ ID NO: 7332804 - DNA, 22 bp, Homo sapiens
ctgacagaatcattaagaccat

SEQ ID NO: 7332805 - DNA, 22 bp, Homo sapiens
ctgaatgaatggtttgtcttat

SEQ ID NO: 7332806 - DNA, 22 bp, Homo sapiens
ctgaatgagtggatttttcatt

SEQ ID NO: 7332807 - DNA, 22 bp, Homo sapiens
ctgaaggaagcaggtggcctgt

SEQ ID NO: 7332808 - DNA, 22 bp, Homo sapiens
ctgaaggaagcaggtggcctgt

SEQ ID NO: 7332809 - DNA, 22 bp, Homo sapiens
ctgaaggaagcagaagcgaggt

SEQ ID NO: 7332810 - DNA, 23 bp, Homo sapiens
ctgaaattcagatgctaaagata

SEQ ID NO: 7332811 - DNA, 22 bp, Homo sapiens
agtgtctgctaggttcatcaac

SEQ ID NO: 7332812 - DNA, 22 bp, Homo sapiens
ctgagcagcacagggcgccagg

SEQ ID NO: 7332813 - DNA, 22 bp, Homo sapiens
ctgagcagcaattgctggccca

SEQ ID NO: 7332814 - DNA, 22 bp, Homo sapiens
ctgagcagcaacccagagcctc

SEQ ID NO: 7332815 - DNA, 22 bp, Homo sapiens
ctgagcagcaacccagagcctc

SEQ ID NO: 7332816 - DNA, 22 bp, Homo sapiens
ctgagcagcaacccagagcctc

SEQ ID NO: 7332817 - DNA, 19 bp, Homo sapiens
ctgagcagagggaggaact

SEQ ID NO: 7332818 - DNA, 22 bp, Homo sapiens
ctgagcagaggtcaagatactt

SEQ ID NO: 7332819 - DNA, 22 bp, Homo sapiens
ctgagcagatgaccagccccag

SEQ ID NO: 7332820 - DNA, 22 bp, Homo sapiens
ctgagcagatgaccagccccag

SEQ ID NO: 7332821 - DNA, 22 bp, Homo sapiens
agttaaggcagccaccaggtca

SEQ ID NO: 7332822 - DNA, 22 bp, Homo sapiens
agttaaggagagttggaatcag

SEQ ID NO: 7332823 - DNA, 22 bp, Homo sapiens
agttaaggataccaggccaaaa

SEQ ID NO: 7332824 - DNA, 22 bp, Homo sapiens
agttaaggatggctggaggcgt

SEQ ID NO: 7332825 - DNA, 22 bp, Homo sapiens
agttaagagtgtgaaaatgtta

SEQ ID NO: 7332826 - DNA, 22 bp, Homo sapiens
ctgagaaacaatgaattgtgat

SEQ ID NO: 7332827 - DNA, 22 bp, Homo sapiens
ctgagaaacaatgaattgtgat

SEQ ID NO: 7332828 - DNA, 21 bp, Homo sapiens
aggtcccaggtttgggcagca

SEQ ID NO: 7332829 - DNA, 22 bp, Homo sapiens
cctggctctgcgtgcagctccg

SEQ ID NO: 7332830 - DNA, 22 bp, Homo sapiens
cctggctctgcgtgcagctccg

SEQ ID NO: 7332831 - DNA, 22 bp, Homo sapiens
cctggaggtggaggttgcagtg

SEQ ID NO: 7332832 - DNA, 22 bp, Homo sapiens
cctggaggtggaggttgcagtg

SEQ ID NO: 7332833 - DNA, 23 bp, Homo sapiens
cctggcacacagttgacatggaa

SEQ ID NO: 7332834 - DNA, 22 bp, Homo sapiens
cctggcacagagcggtggtcac

SEQ ID NO: 7332835 - DNA, 22 bp, Homo sapiens
aggtcattaaagttaaatgagg

SEQ ID NO: 7332836 - DNA, 22 bp, Homo sapiens
aggtcattacaattatcatttt

SEQ ID NO: 7332837 - DNA, 22 bp, Homo sapiens
aggtcattccagccattcccct

SEQ ID NO: 7332838 - DNA, 19 bp, Homo sapiens
aggtcattgatagtgcagg

SEQ ID NO: 7332839 - DNA, 22 bp, Homo sapiens
aggtcattgaagttattttctt

SEQ ID NO: 7332840 - DNA, 22 bp, Homo sapiens
aggtcattccttgtcttcttgc

SEQ ID NO: 7332841 - DNA, 22 bp, Homo sapiens
aggtcattggggactatctccg

SEQ ID NO: 7332842 - DNA, 23 bp, Homo sapiens
cctgcagctgctggggctccacc

SEQ ID NO: 7332843 - DNA, 23 bp, Homo sapiens
cctgcagctgccacgccctgctc

SEQ ID NO: 7332844 - DNA, 22 bp, Homo sapiens
cctgcagaccacactcagtcct

SEQ ID NO: 7332845 - DNA, 22 bp, Homo sapiens
aggtagggaagaaggcatgaaa

SEQ ID NO: 7332846 - DNA, 22 bp, Homo sapiens
aggtagggggtttgggaactgc

SEQ ID NO: 7332847 - DNA, 22 bp, Homo sapiens
aggtagggctaggctgcgtctg

SEQ ID NO: 7332848 - DNA, 22 bp, Homo sapiens
aggtagggctaggctgcgtctg

SEQ ID NO: 7332849 - DNA, 22 bp, Homo sapiens
aggtagggttaatggagatata

SEQ ID NO: 7332850 - DNA, 22 bp, Homo sapiens
cctgccagctgtgggccagcct

SEQ ID NO: 7332851 - DNA, 22 bp, Homo sapiens
aggtaggatgggtggagatgat

SEQ ID NO: 7332852 - DNA, 22 bp, Homo sapiens
aggtaggatagataggaagacc

SEQ ID NO: 7332853 - DNA, 22 bp, Homo sapiens
aggtaggatgggtggagatgat

SEQ ID NO: 7332854 - DNA, 22 bp, Homo sapiens
aggtggggaggagtgtctcttt

SEQ ID NO: 7332855 - DNA, 22 bp, Homo sapiens
aggtggggccaaatgctacagt

SEQ ID NO: 7332856 - DNA, 22 bp, Homo sapiens
cctgtgccaaaatctaggcagt

SEQ ID NO: 7332857 - DNA, 22 bp, Homo sapiens
cctgtgccaaaatctaggcagt

SEQ ID NO: 7332858 - DNA, 22 bp, Homo sapiens
aggtgggcaatgaggcctgagt

SEQ ID NO: 7332859 - DNA, 22 bp, Homo sapiens
aggtgggcacacctcccttctc

SEQ ID NO: 7332860 - DNA, 18 bp, Homo sapiens
cctgtgacagaggcatca

SEQ ID NO: 7332861 - DNA, 22 bp, Homo sapiens
cctgtgcatccggtggtcattg

SEQ ID NO: 7332862 - DNA, 22 bp, Homo sapiens
cctgtgaggtcttgcatgtgaa

SEQ ID NO: 7332863 - DNA, 22 bp, Homo sapiens
cctgtctccctggcatggctca

SEQ ID NO: 7332864 - DNA, 22 bp, Homo sapiens
cctgtcatttttatcaatgtct

SEQ ID NO: 7332865 - DNA, 20 bp, Homo sapiens
cctgtccaagctccacccca

SEQ ID NO: 7332866 - DNA, 20 bp, Homo sapiens
cctgtcatcccagcattttg

SEQ ID NO: 7332867 - DNA, 22 bp, Homo sapiens
cctggctctgggatcttcgctt

SEQ ID NO: 7332868 - DNA, 22 bp, Homo sapiens
cctgggctcaggcttgggcagc

SEQ ID NO: 7332869 - DNA, 22 bp, Homo sapiens
cctgggcttgcatctgtgctgg

SEQ ID NO: 7332870 - DNA, 22 bp, Homo sapiens
cctggtgcccccaagccagctg

SEQ ID NO: 7332871 - DNA, 22 bp, Homo sapiens
ctaggggcatgaaatagagaat

SEQ ID NO: 7332872 - DNA, 22 bp, Homo sapiens
agtccagggcttagtcagcggg

SEQ ID NO: 7332873 - DNA, 22 bp, Homo sapiens
ctaccactggctctgtgacttt

SEQ ID NO: 7332874 - DNA, 22 bp, Homo sapiens
ctagaaatgtagattcttagtg

SEQ ID NO: 7332875 - DNA, 22 bp, Homo sapiens
agtatgttgacttattcttgga

SEQ ID NO: 7332876 - DNA, 22 bp, Homo sapiens
agtatttcctggcttatctgct

SEQ ID NO: 7332877 - DNA, 22 bp, Homo sapiens
agtatttcctggcttatctgct

SEQ ID NO: 7332878 - DNA, 23 bp, Homo sapiens
agtatgggggatcacgtggccct

SEQ ID NO: 7332879 - DNA, 20 bp, Homo sapiens
ctaagcactttgataaactg

SEQ ID NO: 7332880 - DNA, 22 bp, Homo sapiens
ctaagcaagaatgagtgcaaca

SEQ ID NO: 7332881 - DNA, 20 bp, Homo sapiens
ctaagaggaggactaggttt

SEQ ID NO: 7332882 - DNA, 22 bp, Homo sapiens
ctaagaggaagtactctgttat

SEQ ID NO: 7332883 - DNA, 22 bp, Homo sapiens
ctaagaggaagtactctgttat

SEQ ID NO: 7332884 - DNA, 22 bp, Homo sapiens
agtacacagaattctacttgtt

SEQ ID NO: 7332885 - DNA, 22 bp, Homo sapiens
agtacacagtagactttctcat

SEQ ID NO: 7332886 - DNA, 22 bp, Homo sapiens
agtacacagaattctacttgtt

SEQ ID NO: 7332887 - DNA, 22 bp, Homo sapiens
agtacagtagatgtaggaatag

SEQ ID NO: 7332888 - DNA, 22 bp, Homo sapiens
agtacacagtatatggtgagat

SEQ ID NO: 7332889 - DNA, 22 bp, Homo sapiens
agtacactggcaaatgtggtgg

SEQ ID NO: 7332890 - DNA, 22 bp, Homo sapiens
agtacagatttagacacgatag

SEQ ID NO: 7332891 - DNA, 22 bp, Homo sapiens
cggctcagctagcttggcccca

SEQ ID NO: 7332892 - DNA, 22 bp, Homo sapiens
cgggcagcggcgtggccatggt

SEQ ID NO: 7332893 - DNA, 22 bp, Homo sapiens
cgggcagatcacacagggcttg

SEQ ID NO: 7332894 - DNA, 22 bp, Homo sapiens
cgggcagattgggaaggttcat

SEQ ID NO: 7332895 - DNA, 22 bp, Homo sapiens
cgggcagattgggaaggttcat

SEQ ID NO: 7332896 - DNA, 17 bp, Homo sapiens
cgggcatggagggcagg

SEQ ID NO: 7332897 - DNA, 22 bp, Homo sapiens
cgggcccgagcacggcacccac

SEQ ID NO: 7332898 - DNA, 17 bp, Homo sapiens
cgggcatggagggcagg

SEQ ID NO: 7332899 - DNA, 22 bp, Homo sapiens
cgggccgttaggaaggtggggc

SEQ ID NO: 7332900 - DNA, 22 bp, Homo sapiens
cgggcagtgtggctccagagtc

SEQ ID NO: 7332901 - DNA, 22 bp, Homo sapiens
cgggcagtgtggctccagagtc

SEQ ID NO: 7332902 - DNA, 22 bp, Homo sapiens
agtacaagtattagagttattc

SEQ ID NO: 7332903 - DNA, 18 bp, Homo sapiens
cgggcgggcgcctggccc

SEQ ID NO: 7332904 - DNA, 22 bp, Homo sapiens
cgggcgcactccgggcagctgt

SEQ ID NO: 7332905 - DNA, 22 bp, Homo sapiens
cgggctgctctggaccgacagc

SEQ ID NO: 7332906 - DNA, 22 bp, Homo sapiens
cgggctgctctggaccgacagc

SEQ ID NO: 7332907 - DNA, 19 bp, Homo sapiens
cctgtgttgggagtgtgag

SEQ ID NO: 7332908 - DNA, 22 bp, Homo sapiens
cctgtgttctaatccatctcag

SEQ ID NO: 7332909 - DNA, 22 bp, Homo sapiens
cctgtgtttagatatgatgctg

SEQ ID NO: 7332910 - DNA, 22 bp, Homo sapiens
cctgtgtttctgttggaattaa

SEQ ID NO: 7332911 - DNA, 17 bp, Homo sapiens
cctgtgtttgctccttc

SEQ ID NO: 7332912 - DNA, 19 bp, Homo sapiens
cgcaggagccgaggtgacc

SEQ ID NO: 7332913 - DNA, 22 bp, Homo sapiens
aggttttcacaggaagtatgtt

SEQ ID NO: 7332914 - DNA, 22 bp, Homo sapiens
aggttttcagctgtatcctgag

SEQ ID NO: 7332915 - DNA, 22 bp, Homo sapiens
aggttttcagctgtatcctgag

SEQ ID NO: 7332916 - DNA, 15 bp, Homo sapiens
aggttttcagagtaa

SEQ ID NO: 7332917 - DNA, 18 bp, Homo sapiens
aggttttcagagtttcca

SEQ ID NO: 7332918 - DNA, 22 bp, Homo sapiens
agtaaaaagttcagaatggttg

SEQ ID NO: 7332919 - DNA, 18 bp, Homo sapiens
aggttttcaggatatgtg

SEQ ID NO: 7332920 - DNA, 20 bp, Homo sapiens
cggctcagcctctccctccc

SEQ ID NO: 7332921 - DNA, 22 bp, Homo sapiens
agtaaaaatatgcttgtggcta

SEQ ID NO: 7332922 - DNA, 19 bp, Homo sapiens
cgcaggcttcgggtcgctc

SEQ ID NO: 7332923 - DNA, 22 bp, Homo sapiens
cgcaggggaggaaggtacacct

SEQ ID NO: 7332924 - DNA, 22 bp, Homo sapiens
cgcaggggaggaaggtacacct

SEQ ID NO: 7332925 - DNA, 22 bp, Homo sapiens
aggtttctgctgtcctccttct

SEQ ID NO: 7332926 - DNA, 22 bp, Homo sapiens
aggggggtggatcacctgaggt

SEQ ID NO: 7332927 - DNA, 22 bp, Homo sapiens
agggggctggagacacctcctc

SEQ ID NO: 7332928 - DNA, 22 bp, Homo sapiens
agggggagacatgtgtgtgttt

SEQ ID NO: 7332929 - DNA, 22 bp, Homo sapiens
cctctgtgtgtgcatgcatgcg

SEQ ID NO: 7332930 - DNA, 22 bp, Homo sapiens
cctctgtgtgatgcgcaaagta

SEQ ID NO: 7332931 - DNA, 22 bp, Homo sapiens
cctctgtgtcttggtttcaaga

SEQ ID NO: 7332932 - DNA, 22 bp, Homo sapiens
cctctgtgtctccaagaggcct

SEQ ID NO: 7332933 - DNA, 20 bp, Homo sapiens
cctctgtgtcctgtgtcata

SEQ ID NO: 7332934 - DNA, 22 bp, Homo sapiens
cctctgtggtctgtctaatgca

SEQ ID NO: 7332935 - DNA, 22 bp, Homo sapiens
cctctgtgggccgggcctgctg

SEQ ID NO: 7332936 - DNA, 22 bp, Homo sapiens
cctctgtgtcctggtcattgaa

SEQ ID NO: 7332937 - DNA, 22 bp, Homo sapiens
cctctgtgtcagggaagagact

SEQ ID NO: 7332938 - DNA, 22 bp, Homo sapiens
agggggtgatcaaggtgcggcg

SEQ ID NO: 7332939 - DNA, 22 bp, Homo sapiens
agggggtgatcaaggtgcggcg

SEQ ID NO: 7332940 - DNA, 22 bp, Homo sapiens
agggggtgcatttgtgaatgaa

SEQ ID NO: 7332941 - DNA, 22 bp, Homo sapiens
agggggtgcccagatgaaggat

SEQ ID NO: 7332942 - DNA, 22 bp, Homo sapiens
aggggtctatcctgagatggtc

SEQ ID NO: 7332943 - DNA, 22 bp, Homo sapiens
aggggtctatcctgagatggtc

SEQ ID NO: 7332944 - DNA, 20 bp, Homo sapiens
aggggtctagcagcagtgct

SEQ ID NO: 7332945 - DNA, 22 bp, Homo sapiens
aggggtagagattgctggtgta

SEQ ID NO: 7332946 - DNA, 22 bp, Homo sapiens
aggggtcttgaggactccagca

SEQ ID NO: 7332947 - DNA, 22 bp, Homo sapiens
aggggtcttgggagtcctggct

SEQ ID NO: 7332948 - DNA, 22 bp, Homo sapiens
aggggtgaaagagggccctcaa

SEQ ID NO: 7332949 - DNA, 22 bp, Homo sapiens
cctcctggtgggcgcttctggc

SEQ ID NO: 7332950 - DNA, 22 bp, Homo sapiens
cctccttcctgggacagagctg

SEQ ID NO: 7332951 - DNA, 22 bp, Homo sapiens
cctcgacctccccaggctcagg

SEQ ID NO: 7332952 - DNA, 22 bp, Homo sapiens
cctcgacctccccaggctcagg

SEQ ID NO: 7332953 - DNA, 22 bp, Homo sapiens
cctccttctggggccttctgct

SEQ ID NO: 7332954 - DNA, 22 bp, Homo sapiens
cctcctggtgacaaggcaaagc

SEQ ID NO: 7332955 - DNA, 22 bp, Homo sapiens
cctcctggtccagcatctcttt

SEQ ID NO: 7332956 - DNA, 22 bp, Homo sapiens
aggggctcctttgtgctgcgtc

SEQ ID NO: 7332957 - DNA, 22 bp, Homo sapiens
aggggctcctggcctggagagc

SEQ ID NO: 7332958 - DNA, 22 bp, Homo sapiens
aggggctcctttgtgctgcgtc

SEQ ID NO: 7332959 - DNA, 22 bp, Homo sapiens
aggggctcctctctgagagtag

SEQ ID NO: 7332960 - DNA, 22 bp, Homo sapiens
aggggctcctggcctggagagc

SEQ ID NO: 7332961 - DNA, 22 bp, Homo sapiens
aggggctgcctggcttggcact

SEQ ID NO: 7332962 - DNA, 22 bp, Homo sapiens
aggggctgactggaaagtgcca

SEQ ID NO: 7332963 - DNA, 22 bp, Homo sapiens
aggggctgactggaaagtgcca

SEQ ID NO: 7332964 - DNA, 22 bp, Homo sapiens
aggggctctgagtgggccagga

SEQ ID NO: 7332965 - DNA, 22 bp, Homo sapiens
aggggctctgagtgggccagga

SEQ ID NO: 7332966 - DNA, 18 bp, Homo sapiens
aggggcagcttgtgtgga

SEQ ID NO: 7332967 - DNA, 18 bp, Homo sapiens
aggggcagcttgtgtgga

SEQ ID NO: 7332968 - DNA, 22 bp, Homo sapiens
aggggcctggttggcctctgtt

SEQ ID NO: 7332969 - DNA, 22 bp, Homo sapiens
aggggcggcctgcctgaagcag

SEQ ID NO: 7332970 - DNA, 22 bp, Homo sapiens
aggggcgggacatgcactgagc

SEQ ID NO: 7332971 - DNA, 22 bp, Homo sapiens
aggggcggcctgcctgaagcag

SEQ ID NO: 7332972 - DNA, 22 bp, Homo sapiens
aggggcgtgctcttccccgacg

SEQ ID NO: 7332973 - DNA, 22 bp, Homo sapiens
aggggcgtgctcttccccgacg

SEQ ID NO: 7332974 - DNA, 22 bp, Homo sapiens
aggggcgtgctcttccccgacg

SEQ ID NO: 7332975 - DNA, 22 bp, Homo sapiens
aggggctcaagcagtgtggtct

SEQ ID NO: 7332976 - DNA, 22 bp, Homo sapiens
aggggctcaagcagtgtggtct

SEQ ID NO: 7332977 - DNA, 22 bp, Homo sapiens
aggggctcaaagtgtgcaggga

SEQ ID NO: 7332978 - DNA, 22 bp, Homo sapiens
aggggctcaaagtgtgcaggga

SEQ ID NO: 7332979 - DNA, 22 bp, Homo sapiens
aggggctcaaagtgtgcaggga

SEQ ID NO: 7332980 - DNA, 22 bp, Homo sapiens
aggggctcagttactttggcag

SEQ ID NO: 7332981 - DNA, 22 bp, Homo sapiens
agggctttgcaatgcacagtgg

SEQ ID NO: 7332982 - DNA, 22 bp, Homo sapiens
agggctttgcaatgcacagtgg

SEQ ID NO: 7332983 - DNA, 22 bp, Homo sapiens
agggctttgatgtccatgagga

SEQ ID NO: 7332984 - DNA, 22 bp, Homo sapiens
agggctttgatgtccatgagga

SEQ ID NO: 7332985 - DNA, 22 bp, Homo sapiens
agggctttgtttaggtgaccac

SEQ ID NO: 7332986 - DNA, 19 bp, Homo sapiens
agggctttgtgtgctgctc

SEQ ID NO: 7332987 - DNA, 19 bp, Homo sapiens
agggctttgtgtgctgctc

SEQ ID NO: 7332988 - DNA, 22 bp, Homo sapiens
agggctttgtggcagtcactat

SEQ ID NO: 7332989 - DNA, 22 bp, Homo sapiens
agggctttgtggcagtcactat

SEQ ID NO: 7332990 - DNA, 22 bp, Homo sapiens
agggctttggccccctgctgca

SEQ ID NO: 7332991 - DNA, 22 bp, Homo sapiens
agggctttggccccctgctgca

SEQ ID NO: 7332992 - DNA, 22 bp, Homo sapiens
agggcttttgcaatccaagtct

SEQ ID NO: 7332993 - DNA, 22 bp, Homo sapiens
agggcttttgcaatccaagtct

SEQ ID NO: 7332994 - DNA, 22 bp, Homo sapiens
agggcttttgagcgcacgtctg

SEQ ID NO: 7332995 - DNA, 22 bp, Homo sapiens
agggctttgtttaggtgaccac

SEQ ID NO: 7332996 - DNA, 22 bp, Homo sapiens
aggggaaaagtgttgtctctag

SEQ ID NO: 7332997 - DNA, 22 bp, Homo sapiens
aggggaaaatgagttagtgtgt

SEQ ID NO: 7332998 - DNA, 22 bp, Homo sapiens
aggggaaagaacagtcttcagg

SEQ ID NO: 7332999 - DNA, 22 bp, Homo sapiens
cctcaggggtgcccacagctgc

SEQ ID NO: 7333000 - DNA, 23 bp, Homo sapiens
cctcagggtctagcagagagaag

SEQ ID NO: 7333001 - DNA, 22 bp, Homo sapiens
cctcagggtggcatcagatctt

SEQ ID NO: 7333002 - DNA, 22 bp, Homo sapiens
cctcagggtctctcacagcacc

SEQ ID NO: 7333003 - DNA, 22 bp, Homo sapiens
cctcagggtctctcacagcacc

SEQ ID NO: 7333004 - DNA, 22 bp, Homo sapiens
cctcagggtctgaggagaccgt

SEQ ID NO: 7333005 - DNA, 22 bp, Homo sapiens
cctcagggaggcctctgtggct

SEQ ID NO: 7333006 - DNA, 22 bp, Homo sapiens
cctcaggggtcactgtgaggag

SEQ ID NO: 7333007 - DNA, 22 bp, Homo sapiens
cctcaggggtcactgtgaggag

SEQ ID NO: 7333008 - DNA, 22 bp, Homo sapiens
agggctgacagtggcgtggcgt

SEQ ID NO: 7333009 - DNA, 22 bp, Homo sapiens
cctactctgtgagccactttgc

SEQ ID NO: 7333010 - DNA, 22 bp, Homo sapiens
cctactgcccttcagtccagca

SEQ ID NO: 7333011 - DNA, 22 bp, Homo sapiens
cctaccacactatggagaagtg

SEQ ID NO: 7333012 - DNA, 22 bp, Homo sapiens
cctacagttatattcttgattg

SEQ ID NO: 7333013 - DNA, 22 bp, Homo sapiens
agggctgagcccaggcatgtag

SEQ ID NO: 7333014 - DNA, 22 bp, Homo sapiens
agggctgagcccaggcatgtag

SEQ ID NO: 7333015 - DNA, 22 bp, Homo sapiens
cctacaggaaattgtatcaaaa

SEQ ID NO: 7333016 - DNA, 22 bp, Homo sapiens
cctacacatgaatgcgagaaat

SEQ ID NO: 7333017 - DNA, 22 bp, Homo sapiens
agggcctgtgctgagtagacga

SEQ ID NO: 7333018 - DNA, 22 bp, Homo sapiens
ccctggccagggcacagggagg

SEQ ID NO: 7333019 - DNA, 22 bp, Homo sapiens
agggcctgtccgctcccgcccg

SEQ ID NO: 7333020 - DNA, 22 bp, Homo sapiens
agggcctgtgaattctccctgc

SEQ ID NO: 7333021 - DNA, 21 bp, Homo sapiens
agggcctgtgctctccaggtc

SEQ ID NO: 7333022 - DNA, 22 bp, Homo sapiens
ccctggccagctcatgtctgag

SEQ ID NO: 7333023 - DNA, 22 bp, Homo sapiens
ccctggccagggcacagggagg

SEQ ID NO: 7333024 - DNA, 22 bp, Homo sapiens
ccctggcagagggggcaggtgc

SEQ ID NO: 7333025 - DNA, 19 bp, Homo sapiens
ccctggcaggcaagcctgg

SEQ ID NO: 7333026 - DNA, 22 bp, Homo sapiens
agggcccaggacagcatcaggg

SEQ ID NO: 7333027 - DNA, 22 bp, Homo sapiens
agggcccagtggagagctgagc

SEQ ID NO: 7333028 - DNA, 22 bp, Homo sapiens
agggcccagtggagagctgagc

SEQ ID NO: 7333029 - DNA, 22 bp, Homo sapiens
agggcccatagatcgtcagctt

SEQ ID NO: 7333030 - DNA, 22 bp, Homo sapiens
ccctggcactagcgacggccat

SEQ ID NO: 7333031 - DNA, 22 bp, Homo sapiens
agggaatggatgatggcaggtt

SEQ ID NO: 7333032 - DNA, 22 bp, Homo sapiens
agggacagttacatcatcagac

SEQ ID NO: 7333033 - DNA, 22 bp, Homo sapiens
cccaggaagttgagactgcagt

SEQ ID NO: 7333034 - DNA, 22 bp, Homo sapiens
agggaaaggtagtgaggtcaca

SEQ ID NO: 7333035 - DNA, 22 bp, Homo sapiens
aggcttggctctcctatgagaa

SEQ ID NO: 7333036 - DNA, 22 bp, Homo sapiens
aggcttggctggcagccctggg

SEQ ID NO: 7333037 - DNA, 20 bp, Homo sapiens
cccagaggttgcggcaggag

SEQ ID NO: 7333038 - DNA, 21 bp, Homo sapiens
agggaaaaggctgagtgaggg

SEQ ID NO: 7333039 - DNA, 22 bp, Homo sapiens
agggaaaggtagtgaggtcaca

SEQ ID NO: 7333040 - DNA, 22 bp, Homo sapiens
cccctgccatagtcaaatctaa

SEQ ID NO: 7333041 - DNA, 22 bp, Homo sapiens
cccctgccagctatccctgaac

SEQ ID NO: 7333042 - DNA, 22 bp, Homo sapiens
cccctgccagctatccctgaac

SEQ ID NO: 7333043 - DNA, 22 bp, Homo sapiens
agggcagactaggatggaagtg

SEQ ID NO: 7333044 - DNA, 22 bp, Homo sapiens
agggcagactaggatggaagtg

SEQ ID NO: 7333045 - DNA, 22 bp, Homo sapiens
agggcagaccacgtgcaaggat

SEQ ID NO: 7333046 - DNA, 22 bp, Homo sapiens
agggcagaagtacagacactta

SEQ ID NO: 7333047 - DNA, 22 bp, Homo sapiens
agggcagaccacgtgcaaggat

SEQ ID NO: 7333048 - DNA, 22 bp, Homo sapiens
agggcagaaatattgatactgt

SEQ ID NO: 7333049 - DNA, 22 bp, Homo sapiens
agggcagaaatattgatactgt

SEQ ID NO: 7333050 - DNA, 22 bp, Homo sapiens
agggcagaaatcgattacacct

SEQ ID NO: 7333051 - DNA, 22 bp, Homo sapiens
agggcagaagtacagacactta

SEQ ID NO: 7333052 - DNA, 22 bp, Homo sapiens
agggatgggtctaacccagaac

SEQ ID NO: 7333053 - DNA, 22 bp, Homo sapiens
agggcagaaaccaccttgatgg

SEQ ID NO: 7333054 - DNA, 19 bp, Homo sapiens
cccaggtgtttgaggctgc

SEQ ID NO: 7333055 - DNA, 23 bp, Homo sapiens
cccaggtgtggaggcggtggcag

SEQ ID NO: 7333056 - DNA, 22 bp, Homo sapiens
cccaggtgggttggcctctgtc

SEQ ID NO: 7333057 - DNA, 20 bp, Homo sapiens
cccaggtgtctgaagctctg

SEQ ID NO: 7333058 - DNA, 22 bp, Homo sapiens
cccaggtgctgcgtgaagcctc

SEQ ID NO: 7333059 - DNA, 22 bp, Homo sapiens
agggcccaccttggtgctgagg

SEQ ID NO: 7333060 - DNA, 20 bp, Homo sapiens
agggcccaggaagagagtta

SEQ ID NO: 7333061 - DNA, 23 bp, Homo sapiens
agggcccaagcctggacagcagg

SEQ ID NO: 7333062 - DNA, 23 bp, Homo sapiens
agggccaggtgcggaaacagctc

SEQ ID NO: 7333063 - DNA, 22 bp, Homo sapiens
ccctgaggcaaaggctagagtt

SEQ ID NO: 7333064 - DNA, 18 bp, Homo sapiens
ccctgaggctagcatgct

SEQ ID NO: 7333065 - DNA, 22 bp, Homo sapiens
agggcatgtgggagaggagcct

SEQ ID NO: 7333066 - DNA, 22 bp, Homo sapiens
agggcatgtgggagaggagcct

SEQ ID NO: 7333067 - DNA, 22 bp, Homo sapiens
agggcatgctggaggagagaca

SEQ ID NO: 7333068 - DNA, 22 bp, Homo sapiens
agggcatgctggaggagagaca

SEQ ID NO: 7333069 - DNA, 22 bp, Homo sapiens
agggcatggggttaacctggga

SEQ ID NO: 7333070 - DNA, 22 bp, Homo sapiens
agggcagcttccatagtctggc

SEQ ID NO: 7333071 - DNA, 22 bp, Homo sapiens
cccctgggtccaggcttctctg

SEQ ID NO: 7333072 - DNA, 21 bp, Homo sapiens
cccctgggagccctgtcagta

SEQ ID NO: 7333073 - DNA, 22 bp, Homo sapiens
cccctggggatcagctggaatt

SEQ ID NO: 7333074 - DNA, 22 bp, Homo sapiens
agggccacagtaatgctgagta

SEQ ID NO: 7333075 - DNA, 22 bp, Homo sapiens
agggccaaagcaagcccaactg

SEQ ID NO: 7333076 - DNA, 22 bp, Homo sapiens
agggccacagtaatgctgagta

SEQ ID NO: 7333077 - DNA, 22 bp, Homo sapiens
ccctgaggatagggcaggaccc

SEQ ID NO: 7333078 - DNA, 22 bp, Homo sapiens
agggccactggctgacggctgc

SEQ ID NO: 7333079 - DNA, 22 bp, Homo sapiens
aggctgtgactacgcagggaag

SEQ ID NO: 7333080 - DNA, 22 bp, Homo sapiens
cccactccctgcacgcctgccg

SEQ ID NO: 7333081 - DNA, 22 bp, Homo sapiens
cccactcctggagctagggctc

SEQ ID NO: 7333082 - DNA, 22 bp, Homo sapiens
cccactcctggagctagggctc

SEQ ID NO: 7333083 - DNA, 22 bp, Homo sapiens
cccactctggctcccttctagt

SEQ ID NO: 7333084 - DNA, 22 bp, Homo sapiens
cccactctggctcccttctagt

SEQ ID NO: 7333085 - DNA, 18 bp, Homo sapiens
cccacggtgctgtagggc

SEQ ID NO: 7333086 - DNA, 22 bp, Homo sapiens
cccacgtcgaacttgctccaga

SEQ ID NO: 7333087 - DNA, 22 bp, Homo sapiens
cccactccctacgacacgctcc

SEQ ID NO: 7333088 - DNA, 22 bp, Homo sapiens
cccaccctgggaagctaggcag

SEQ ID NO: 7333089 - DNA, 22 bp, Homo sapiens
cccacctctcagagagccttgc

SEQ ID NO: 7333090 - DNA, 22 bp, Homo sapiens
cccaccctgggctacacatcca

SEQ ID NO: 7333091 - DNA, 22 bp, Homo sapiens
aggctgtggcatcacatcagga

SEQ ID NO: 7333092 - DNA, 22 bp, Homo sapiens
aggctgtggccctggtctagca

SEQ ID NO: 7333093 - DNA, 22 bp, Homo sapiens
aggctgtgcattttggagggcc

SEQ ID NO: 7333094 - DNA, 22 bp, Homo sapiens
aggctgtgcgaggtctcagagt

SEQ ID NO: 7333095 - DNA, 22 bp, Homo sapiens
aggctgtgggagttgagagtct

SEQ ID NO: 7333096 - DNA, 20 bp, Homo sapiens
cccagaggttgcggcaggag

SEQ ID NO: 7333097 - DNA, 22 bp, Homo sapiens
ccattttctgcagctgccgcgg

SEQ ID NO: 7333098 - DNA, 22 bp, Homo sapiens
ccagtgtatttttgggacctgc

SEQ ID NO: 7333099 - DNA, 20 bp, Homo sapiens
cccacacccttcccacttgg

SEQ ID NO: 7333100 - DNA, 18 bp, Homo sapiens
cccacacagcagtagctc

SEQ ID NO: 7333101 - DNA, 22 bp, Homo sapiens
cccacacacatttatgatagga

SEQ ID NO: 7333102 - DNA, 22 bp, Homo sapiens
ccagtgtagctcaggactgggc

SEQ ID NO: 7333103 - DNA, 22 bp, Homo sapiens
ccagtgggtgctgggctctgcc

SEQ ID NO: 7333104 - DNA, 22 bp, Homo sapiens
ccagtgggtaggccatggtgag

SEQ ID NO: 7333105 - DNA, 22 bp, Homo sapiens
aggctgccatagggaactgcat

SEQ ID NO: 7333106 - DNA, 19 bp, Homo sapiens
aggctgcccagtctctgcc

SEQ ID NO: 7333107 - DNA, 22 bp, Homo sapiens
aggctgccctgccgccagtggg

SEQ ID NO: 7333108 - DNA, 22 bp, Homo sapiens
aggctgccagaagccttcagga

SEQ ID NO: 7333109 - DNA, 22 bp, Homo sapiens
ccagggcagcagaattggggca

SEQ ID NO: 7333110 - DNA, 22 bp, Homo sapiens
ccagggcagcgcccctccacgc

SEQ ID NO: 7333111 - DNA, 22 bp, Homo sapiens
ccaggtggtgaaagtgggccct

SEQ ID NO: 7333112 - DNA, 22 bp, Homo sapiens
ccagggcagaaaaagagggaat

SEQ ID NO: 7333113 - DNA, 22 bp, Homo sapiens
ccagggcagaaaaagagggaat

SEQ ID NO: 7333114 - DNA, 22 bp, Homo sapiens
ccagggcacttaggcccagccc

SEQ ID NO: 7333115 - DNA, 22 bp, Homo sapiens
aggctctgtcaggcggagcagc

SEQ ID NO: 7333116 - DNA, 19 bp, Homo sapiens
aggctctgtaggagagggc

SEQ ID NO: 7333117 - DNA, 19 bp, Homo sapiens
aggctctgtaggagagggc

SEQ ID NO: 7333118 - DNA, 19 bp, Homo sapiens
aggctctgtaggagagggc

SEQ ID NO: 7333119 - DNA, 22 bp, Homo sapiens
ccaggtggtgaaagtgggccct

SEQ ID NO: 7333120 - DNA, 22 bp, Homo sapiens
ccaggtgtttggcctgcatgat

SEQ ID NO: 7333121 - DNA, 22 bp, Homo sapiens
ccaggtggttcaggtcaccata

SEQ ID NO: 7333122 - DNA, 20 bp, Homo sapiens
ccaggtggtgcctggagagg

SEQ ID NO: 7333123 - DNA, 20 bp, Homo sapiens
ccaggcctgggcctgctcta

SEQ ID NO: 7333124 - DNA, 19 bp, Homo sapiens
ccaggcctggcgtctccgc

SEQ ID NO: 7333125 - DNA, 20 bp, Homo sapiens
ccaggcctgggcctgctcta

SEQ ID NO: 7333126 - DNA, 22 bp, Homo sapiens
ccaggccttccagtacgcagaa

SEQ ID NO: 7333127 - DNA, 22 bp, Homo sapiens
ccaggccttctgaggacactct

SEQ ID NO: 7333128 - DNA, 22 bp, Homo sapiens
ccaggccttccagtacgcagaa

SEQ ID NO: 7333129 - DNA, 22 bp, Homo sapiens
aggctcagattcacatttggtt

SEQ ID NO: 7333130 - DNA, 22 bp, Homo sapiens
aggctcagatccttgtgtcctg

SEQ ID NO: 7333131 - DNA, 20 bp, Homo sapiens
aggctcagatacccagggaa

SEQ ID NO: 7333132 - DNA, 21 bp, Homo sapiens
aggctcagcaggtgtataaag

SEQ ID NO: 7333133 - DNA, 22 bp, Homo sapiens
aggctcagcatctgattcatat

SEQ ID NO: 7333134 - DNA, 22 bp, Homo sapiens
aggctcagcccctgggaggaga

SEQ ID NO: 7333135 - DNA, 22 bp, Homo sapiens
aggctcagcccaaggtggagag

SEQ ID NO: 7333136 - DNA, 22 bp, Homo sapiens
aggctcagcccaaggtggagag

SEQ ID NO: 7333137 - DNA, 22 bp, Homo sapiens
aggctcagcccctgggaggaga

SEQ ID NO: 7333138 - DNA, 22 bp, Homo sapiens
aggctctggttggcaagtaaag

SEQ ID NO: 7333139 - DNA, 22 bp, Homo sapiens
aggctctgggaacagacgggtg

SEQ ID NO: 7333140 - DNA, 22 bp, Homo sapiens
aggctctgggaagcagtgagtt

SEQ ID NO: 7333141 - DNA, 22 bp, Homo sapiens
aggctctgggaagcagtgagtt

SEQ ID NO: 7333142 - DNA, 22 bp, Homo sapiens
aggctctgggaacagacgggtg

SEQ ID NO: 7333143 - DNA, 22 bp, Homo sapiens
ccaggaggtctgagtgtggaca

SEQ ID NO: 7333144 - DNA, 22 bp, Homo sapiens
ccaggagggaggagttcctgag

SEQ ID NO: 7333145 - DNA, 22 bp, Homo sapiens
aggcctgggacgggagccgtga

SEQ ID NO: 7333146 - DNA, 22 bp, Homo sapiens
ccaggaggtggcaggacttgcc

SEQ ID NO: 7333147 - DNA, 22 bp, Homo sapiens
ccaggaggtggaggttgcggtg

SEQ ID NO: 7333148 - DNA, 22 bp, Homo sapiens
ccaggaggtgctggaagaaagc

SEQ ID NO: 7333149 - DNA, 22 bp, Homo sapiens
ccaggaggtggagattgcagtg

SEQ ID NO: 7333150 - DNA, 21 bp, Homo sapiens
aggccctggaggtcagagaaa

SEQ ID NO: 7333151 - DNA, 22 bp, Homo sapiens
ccagctccaggtagatgggcag

SEQ ID NO: 7333152 - DNA, 22 bp, Homo sapiens
aggccctgctgaggcctccctc

SEQ ID NO: 7333153 - DNA, 22 bp, Homo sapiens
aggccctggacactcaagccgg

SEQ ID NO: 7333154 - DNA, 22 bp, Homo sapiens
aggccctgctttccagagctca

SEQ ID NO: 7333155 - DNA, 22 bp, Homo sapiens
ccagctcccctcagcaggtaat

SEQ ID NO: 7333156 - DNA, 23 bp, Homo sapiens
ccagctcccaggtctgaggactg

SEQ ID NO: 7333157 - DNA, 22 bp, Homo sapiens
ccagctccctgaagcctggtct

SEQ ID NO: 7333158 - DNA, 22 bp, Homo sapiens
ccagctccctgaagcctggtct

SEQ ID NO: 7333159 - DNA, 22 bp, Homo sapiens
ccaggcactggctgggttcttt

SEQ ID NO: 7333160 - DNA, 20 bp, Homo sapiens
ccaggcactgtcccatgcag

SEQ ID NO: 7333161 - DNA, 22 bp, Homo sapiens
ccaggcactcagagactgggac

SEQ ID NO: 7333162 - DNA, 22 bp, Homo sapiens
ccaggcactgctcgaggtgcta

SEQ ID NO: 7333163 - DNA, 18 bp, Homo sapiens
ccaggcacctttaaatat

SEQ ID NO: 7333164 - DNA, 22 bp, Homo sapiens
ccaggcacggtggctcatgcct

SEQ ID NO: 7333165 - DNA, 22 bp, Homo sapiens
ccaggcaccatgttcttaggac

SEQ ID NO: 7333166 - DNA, 22 bp, Homo sapiens
ccaggcaccaaagtatgcttta

SEQ ID NO: 7333167 - DNA, 22 bp, Homo sapiens
ccaggcactcacggggcactgg

SEQ ID NO: 7333168 - DNA, 20 bp, Homo sapiens
aggctcagagcagtagtaca

SEQ ID NO: 7333169 - DNA, 20 bp, Homo sapiens
aggctcagagcagtagtaca

SEQ ID NO: 7333170 - DNA, 16 bp, Homo sapiens
aggctcagaggctgga

SEQ ID NO: 7333171 - DNA, 22 bp, Homo sapiens
aggctcagaggtgagcatctgc

SEQ ID NO: 7333172 - DNA, 22 bp, Homo sapiens
ccaggcacaggtgggcctcaga

SEQ ID NO: 7333173 - DNA, 22 bp, Homo sapiens
ccaggcacaggtgggcctcaga

SEQ ID NO: 7333174 - DNA, 22 bp, Homo sapiens
aggcctgggtgttcaccagaag

SEQ ID NO: 7333175 - DNA, 21 bp, Homo sapiens
aggctcagagagaaactcttg

SEQ ID NO: 7333176 - DNA, 22 bp, Homo sapiens
aggctcagagagctgtgtccat

SEQ ID NO: 7333177 - DNA, 22 bp, Homo sapiens
aggctcagagatgagtaagcac

SEQ ID NO: 7333178 - DNA, 22 bp, Homo sapiens
aggctcagagatgagtaagcac

SEQ ID NO: 7333179 - DNA, 21 bp, Homo sapiens
aggctcagagatcaaacagta

SEQ ID NO: 7333180 - DNA, 21 bp, Homo sapiens
aggctcagagatcaaacagta

SEQ ID NO: 7333181 - DNA, 22 bp, Homo sapiens
ccagccagcaagctcccagttc

SEQ ID NO: 7333182 - DNA, 22 bp, Homo sapiens
ccagccagaagtccgggcttct

SEQ ID NO: 7333183 - DNA, 22 bp, Homo sapiens
ccagccagatgataagctctat

SEQ ID NO: 7333184 - DNA, 22 bp, Homo sapiens
ccagccagatgataagctctat

SEQ ID NO: 7333185 - DNA, 22 bp, Homo sapiens
ccagccagatgataagctctat

SEQ ID NO: 7333186 - DNA, 22 bp, Homo sapiens
ccagcagggaaaaacccaccaa

SEQ ID NO: 7333187 - DNA, 22 bp, Homo sapiens
ccagcaggcagtcatatccttt

SEQ ID NO: 7333188 - DNA, 22 bp, Homo sapiens
ccagagtctatgagtcctcatt

SEQ ID NO: 7333189 - DNA, 22 bp, Homo sapiens
ccagagtcccttgcagctcagt

SEQ ID NO: 7333190 - DNA, 22 bp, Homo sapiens
ccagagtccctgttctcggcct

SEQ ID NO: 7333191 - DNA, 22 bp, Homo sapiens
ccagccagggaaactttttctt

SEQ ID NO: 7333192 - DNA, 22 bp, Homo sapiens
ccagccagtatattccaaagcc

SEQ ID NO: 7333193 - DNA, 22 bp, Homo sapiens
ccagccaggctggctgtggagg

SEQ ID NO: 7333194 - DNA, 22 bp, Homo sapiens
ccagccagctggttggacgcct

SEQ ID NO: 7333195 - DNA, 22 bp, Homo sapiens
ccagccaggcattgcaaactga

SEQ ID NO: 7333196 - DNA, 22 bp, Homo sapiens
ccagccagctgcccttggggcc

SEQ ID NO: 7333197 - DNA, 22 bp, Homo sapiens
ccagccagccttgatctgagta

SEQ ID NO: 7333198 - DNA, 22 bp, Homo sapiens
ccagccagctggttggacgcct

SEQ ID NO: 7333199 - DNA, 22 bp, Homo sapiens
ccagccagctggttggacgcct

SEQ ID NO: 7333200 - DNA, 22 bp, Homo sapiens
aggccctgacctgggagatcta

SEQ ID NO: 7333201 - DNA, 18 bp, Homo sapiens
ccagccctgcagcacctg

SEQ ID NO: 7333202 - DNA, 18 bp, Homo sapiens
ccagccctgcagcacctg

SEQ ID NO: 7333203 - DNA, 22 bp, Homo sapiens
aggccctgcccagagctcctcg

SEQ ID NO: 7333204 - DNA, 22 bp, Homo sapiens
aggccctgcggaaatgatcatt

SEQ ID NO: 7333205 - DNA, 22 bp, Homo sapiens
aggccctgcccagtgccacaag

SEQ ID NO: 7333206 - DNA, 23 bp, Homo sapiens
aggccctgcctgtccctcttttt

SEQ ID NO: 7333207 - DNA, 23 bp, Homo sapiens
ccagccctccaccagctctaggc

SEQ ID NO: 7333208 - DNA, 23 bp, Homo sapiens
ccagccctccaccagctctaggc

SEQ ID NO: 7333209 - DNA, 22 bp, Homo sapiens
ccagccctcggtagtcccatag

SEQ ID NO: 7333210 - DNA, 22 bp, Homo sapiens
ccagccctcggtagtcccatag

SEQ ID NO: 7333211 - DNA, 19 bp, Homo sapiens
ccagaggtttgctgggcct

SEQ ID NO: 7333212 - DNA, 19 bp, Homo sapiens
ccagagtcatgtctccccc

SEQ ID NO: 7333213 - DNA, 22 bp, Homo sapiens
ccagaggttccaggctagggag

SEQ ID NO: 7333214 - DNA, 22 bp, Homo sapiens
ccagaggcggaggtttgcagtg

SEQ ID NO: 7333215 - DNA, 21 bp, Homo sapiens
ccagaggcctctcttggccac

SEQ ID NO: 7333216 - DNA, 22 bp, Homo sapiens
ccagaggctggcaagggctcct

SEQ ID NO: 7333217 - DNA, 20 bp, Homo sapiens
ccagaggctgacagactttg

SEQ ID NO: 7333218 - DNA, 18 bp, Homo sapiens
ccagaggcccgggcaggc

SEQ ID NO: 7333219 - DNA, 22 bp, Homo sapiens
ccagaggcagacttacactcca

SEQ ID NO: 7333220 - DNA, 22 bp, Homo sapiens
ccagaggatgctggtcagcctc

SEQ ID NO: 7333221 - DNA, 22 bp, Homo sapiens
ccactccccacgtgctgtcaga

SEQ ID NO: 7333222 - DNA, 20 bp, Homo sapiens
ccactccgcccccagagggc

SEQ ID NO: 7333223 - DNA, 22 bp, Homo sapiens
aggcaggtagaaggatctttat

SEQ ID NO: 7333224 - DNA, 22 bp, Homo sapiens
catgagactgccttttcaaacc

SEQ ID NO: 7333225 - DNA, 22 bp, Homo sapiens
catgagaatgaagaagacttaa

SEQ ID NO: 7333226 - DNA, 22 bp, Homo sapiens
catgagggttggggtggagctt

SEQ ID NO: 7333227 - DNA, 22 bp, Homo sapiens
catgaggatccaggtgacaggc

SEQ ID NO: 7333228 - DNA, 22 bp, Homo sapiens
catgagatttgggaggggccag

SEQ ID NO: 7333229 - DNA, 22 bp, Homo sapiens
aggatggggtctgcagcctggt

SEQ ID NO: 7333230 - DNA, 22 bp, Homo sapiens
aggatggggtctgcagcctggt

SEQ ID NO: 7333231 - DNA, 22 bp, Homo sapiens
aggatggggtctgcagcctggt

SEQ ID NO: 7333232 - DNA, 22 bp, Homo sapiens
catctctccacggcagctctcg

SEQ ID NO: 7333233 - DNA, 22 bp, Homo sapiens
catccaaagcaaatatcttaaa

SEQ ID NO: 7333234 - DNA, 20 bp, Homo sapiens
catctcctgcctccatgttc

SEQ ID NO: 7333235 - DNA, 22 bp, Homo sapiens
catctccaggtttagggagcac

SEQ ID NO: 7333236 - DNA, 22 bp, Homo sapiens
catctcctttggtctacttcca

SEQ ID NO: 7333237 - DNA, 22 bp, Homo sapiens
catctcctttggtctacttcca

SEQ ID NO: 7333238 - DNA, 20 bp, Homo sapiens
catctcctgcctccatgttc

SEQ ID NO: 7333239 - DNA, 22 bp, Homo sapiens
catctcctggcagctgttagga

SEQ ID NO: 7333240 - DNA, 22 bp, Homo sapiens
catacagttttccctagatgtg

SEQ ID NO: 7333241 - DNA, 22 bp, Homo sapiens
catacataccactgctgtcttt

SEQ ID NO: 7333242 - DNA, 22 bp, Homo sapiens
catacagtgtggcatgtagtct

SEQ ID NO: 7333243 - DNA, 22 bp, Homo sapiens
catacagtcactgtggtaccac

SEQ ID NO: 7333244 - DNA, 22 bp, Homo sapiens
catacagtcactgtggtaccac

SEQ ID NO: 7333245 - DNA, 22 bp, Homo sapiens
catacagttttccctagatgtg

SEQ ID NO: 7333246 - DNA, 22 bp, Homo sapiens
catacaatcaagttctttatta

SEQ ID NO: 7333247 - DNA, 22 bp, Homo sapiens
catacaatcaagttctttatta

SEQ ID NO: 7333248 - DNA, 22 bp, Homo sapiens
aggaggcctggctggggagatc

SEQ ID NO: 7333249 - DNA, 23 bp, Homo sapiens
aggaggcctgaaactgaggctga

SEQ ID NO: 7333250 - DNA, 22 bp, Homo sapiens
aggaggctctcaggtcctcccc

SEQ ID NO: 7333251 - DNA, 22 bp, Homo sapiens
aggaggctgaactagggtctgg

SEQ ID NO: 7333252 - DNA, 22 bp, Homo sapiens
aggaggcctctatccagagaga

SEQ ID NO: 7333253 - DNA, 22 bp, Homo sapiens
aggaggcctctatccagagaga

SEQ ID NO: 7333254 - DNA, 23 bp, Homo sapiens
aggaggcctgaaactgaggctga

SEQ ID NO: 7333255 - DNA, 22 bp, Homo sapiens
aggaggccgctgatgggctccc

SEQ ID NO: 7333256 - DNA, 22 bp, Homo sapiens
cataactggggacacttctcta

SEQ ID NO: 7333257 - DNA, 19 bp, Homo sapiens
cataatacagtggatctga

SEQ ID NO: 7333258 - DNA, 22 bp, Homo sapiens
cataagaatcttccagggcatg

SEQ ID NO: 7333259 - DNA, 22 bp, Homo sapiens
cataatatactacattgatgaa

SEQ ID NO: 7333260 - DNA, 19 bp, Homo sapiens
cataatacagtggatctga

SEQ ID NO: 7333261 - DNA, 22 bp, Homo sapiens
cataacatgtacatataaatgc

SEQ ID NO: 7333262 - DNA, 22 bp, Homo sapiens
cagtgtggagggagagagcctg

SEQ ID NO: 7333263 - DNA, 22 bp, Homo sapiens
cagtatttgttccctatcaatg

SEQ ID NO: 7333264 - DNA, 22 bp, Homo sapiens
aggagccagcgttcctcaggat

SEQ ID NO: 7333265 - DNA, 22 bp, Homo sapiens
aggagccagcgttcctcaggat

SEQ ID NO: 7333266 - DNA, 22 bp, Homo sapiens
aggagccagcgttcctcaggat

SEQ ID NO: 7333267 - DNA, 21 bp, Homo sapiens
aggagccagcctgtcagtcta

SEQ ID NO: 7333268 - DNA, 22 bp, Homo sapiens
aggagccagattctctcacttt

SEQ ID NO: 7333269 - DNA, 22 bp, Homo sapiens
aggagccaggccccatggggct

SEQ ID NO: 7333270 - DNA, 22 bp, Homo sapiens
cagtgttccaggcggcagtgaa

SEQ ID NO: 7333271 - DNA, 22 bp, Homo sapiens
cagtgtttagcacagtgcttgg

SEQ ID NO: 7333272 - DNA, 22 bp, Homo sapiens
cagtgtgggtttgggaggagta

SEQ ID NO: 7333273 - DNA, 22 bp, Homo sapiens
aggcactgttcccagttatcct

SEQ ID NO: 7333274 - DNA, 22 bp, Homo sapiens
aggcactgtgggtgtggccgga

SEQ ID NO: 7333275 - DNA, 18 bp, Homo sapiens
cattgtacaatgctttat

SEQ ID NO: 7333276 - DNA, 21 bp, Homo sapiens
aggcactgtttgtggtttggg

SEQ ID NO: 7333277 - DNA, 20 bp, Homo sapiens
aggcactgttgtctgtatcc

SEQ ID NO: 7333278 - DNA, 22 bp, Homo sapiens
catttcaatacagtttgtaaat

SEQ ID NO: 7333279 - DNA, 22 bp, Homo sapiens
catttcacagtaaagtgatttc

SEQ ID NO: 7333280 - DNA, 22 bp, Homo sapiens
catttcacagtaaagtgatttc

SEQ ID NO: 7333281 - DNA, 22 bp, Homo sapiens
catttcaaacagttacagctgc

SEQ ID NO: 7333282 - DNA, 21 bp, Homo sapiens
aggcaataaagttttgtctac

SEQ ID NO: 7333283 - DNA, 23 bp, Homo sapiens
aggcaatacaaggcatctctgga

SEQ ID NO: 7333284 - DNA, 22 bp, Homo sapiens
aggcaatacacagcatttcaca

SEQ ID NO: 7333285 - DNA, 22 bp, Homo sapiens
cattgctgtagtccagatgagg

SEQ ID NO: 7333286 - DNA, 22 bp, Homo sapiens
cattgctgttatgcataattcc

SEQ ID NO: 7333287 - DNA, 22 bp, Homo sapiens
cattgcactttgggtccaggac

SEQ ID NO: 7333288 - DNA, 22 bp, Homo sapiens
cattctaaagtgttttatacct

SEQ ID NO: 7333289 - DNA, 22 bp, Homo sapiens
cattgcactctagcctgggtga

SEQ ID NO: 7333290 - DNA, 22 bp, Homo sapiens
cattgcactctagtctgggtga

SEQ ID NO: 7333291 - DNA, 22 bp, Homo sapiens
cattgcactctggctggaacgg

SEQ ID NO: 7333292 - DNA, 22 bp, Homo sapiens
cattgcactctggctggaacgg

SEQ ID NO: 7333293 - DNA, 22 bp, Homo sapiens
cattgcactgcagcccgggcaa

SEQ ID NO: 7333294 - DNA, 22 bp, Homo sapiens
cattgcacttctgcttttcctc

SEQ ID NO: 7333295 - DNA, 22 bp, Homo sapiens
cattgcccagtaggatcaccag

SEQ ID NO: 7333296 - DNA, 22 bp, Homo sapiens
cattgctcaggcccagcaggaa

SEQ ID NO: 7333297 - DNA, 23 bp, Homo sapiens
ccacagttcatcgttcactcacc

SEQ ID NO: 7333298 - DNA, 22 bp, Homo sapiens
ccacagttcatgcactggggct

SEQ ID NO: 7333299 - DNA, 22 bp, Homo sapiens
ccacagttattcatttgtgaca

SEQ ID NO: 7333300 - DNA, 22 bp, Homo sapiens
ccacagtttaggaagtcactct

SEQ ID NO: 7333301 - DNA, 21 bp, Homo sapiens
ccacagttctggcaagggctg

SEQ ID NO: 7333302 - DNA, 22 bp, Homo sapiens
ccacagttgctgaaatcgctta

SEQ ID NO: 7333303 - DNA, 22 bp, Homo sapiens
ccacagtttcttcatctataaa

SEQ ID NO: 7333304 - DNA, 22 bp, Homo sapiens
ccacagtttgccagccaggaat

SEQ ID NO: 7333305 - DNA, 22 bp, Homo sapiens
ccacagtttcttcatctataaa

SEQ ID NO: 7333306 - DNA, 22 bp, Homo sapiens
ccacagtttgccaacacctact

SEQ ID NO: 7333307 - DNA, 22 bp, Homo sapiens
ccacccacaaccagctggctgt

SEQ ID NO: 7333308 - DNA, 22 bp, Homo sapiens
ccacatcatggatacagttatg

SEQ ID NO: 7333309 - DNA, 22 bp, Homo sapiens
ccacatctaagccttcatgata

SEQ ID NO: 7333310 - DNA, 22 bp, Homo sapiens
ccacccagcagaggaggcaaga

SEQ ID NO: 7333311 - DNA, 22 bp, Homo sapiens
ccacccagaccagggatctggg

SEQ ID NO: 7333312 - DNA, 22 bp, Homo sapiens
ccacccagccagatgcaggaag

SEQ ID NO: 7333313 - DNA, 22 bp, Homo sapiens
ccactcagcacagtggatgcag

SEQ ID NO: 7333314 - DNA, 22 bp, Homo sapiens
ccactattactgtgtggcagtc

SEQ ID NO: 7333315 - DNA, 22 bp, Homo sapiens
ccactcagaccaacgacccttc

SEQ ID NO: 7333316 - DNA, 20 bp, Homo sapiens
ccactcagctgtattctcag

SEQ ID NO: 7333317 - DNA, 22 bp, Homo sapiens
ccactcaggcctcctgctctcc

SEQ ID NO: 7333318 - DNA, 22 bp, Homo sapiens
ccactcaggagcttatctatgc

SEQ ID NO: 7333319 - DNA, 17 bp, Homo sapiens
ccactcagtaatttctc

SEQ ID NO: 7333320 - DNA, 22 bp, Homo sapiens
ccactcagttgctctctgtttt

SEQ ID NO: 7333321 - DNA, 22 bp, Homo sapiens
ccacagagacagagcccagggt

SEQ ID NO: 7333322 - DNA, 22 bp, Homo sapiens
ccacagaccttggcttccacct

SEQ ID NO: 7333323 - DNA, 22 bp, Homo sapiens
aggcaggagtgaccctgacagg

SEQ ID NO: 7333324 - DNA, 22 bp, Homo sapiens
cagtaaatgcagatatagatac

SEQ ID NO: 7333325 - DNA, 22 bp, Homo sapiens
cagtaaatgatgatagtgcctt

SEQ ID NO: 7333326 - DNA, 22 bp, Homo sapiens
cagtaaatgagaagctagtaat

SEQ ID NO: 7333327 - DNA, 22 bp, Homo sapiens
cagtaaatcctagagccctcat

SEQ ID NO: 7333328 - DNA, 22 bp, Homo sapiens
cagtaaatctctatctgccatt

SEQ ID NO: 7333329 - DNA, 22 bp, Homo sapiens
cagtaaattatctcatctctgt

SEQ ID NO: 7333330 - DNA, 22 bp, Homo sapiens
cagtaaatggtacgtatatttt

SEQ ID NO: 7333331 - DNA, 22 bp, Homo sapiens
cagtaaatgtcctcgcagggaa

SEQ ID NO: 7333332 - DNA, 22 bp, Homo sapiens
cagtaaatgtgatttttcttgt

SEQ ID NO: 7333333 - DNA, 22 bp, Homo sapiens
cagtaaatttgagggatctaat

SEQ ID NO: 7333334 - DNA, 22 bp, Homo sapiens
cagtaaattttatttgtgggtg

SEQ ID NO: 7333335 - DNA, 22 bp, Homo sapiens
cagtaaatacatatcagagaag

SEQ ID NO: 7333336 - DNA, 22 bp, Homo sapiens
cagtaaatagtggagatgtggg

SEQ ID NO: 7333337 - DNA, 22 bp, Homo sapiens
cagtaaatataggaacgtggaa

SEQ ID NO: 7333338 - DNA, 22 bp, Homo sapiens
aggacagatttttggccaccag

SEQ ID NO: 7333339 - DNA, 22 bp, Homo sapiens
aggacagagcctgtgcagaccg

SEQ ID NO: 7333340 - DNA, 22 bp, Homo sapiens
aggacagagggaccagagccca

SEQ ID NO: 7333341 - DNA, 22 bp, Homo sapiens
cagtatgtttgggagacatgac

SEQ ID NO: 7333342 - DNA, 22 bp, Homo sapiens
cagtatttgttacagcattagc

SEQ ID NO: 7333343 - DNA, 22 bp, Homo sapiens
cagtatttcctcttcttaactt

SEQ ID NO: 7333344 - DNA, 22 bp, Homo sapiens
cagtatttggaatatagctaag

SEQ ID NO: 7333345 - DNA, 22 bp, Homo sapiens
aggacagaatctatattcagtt

SEQ ID NO: 7333346 - DNA, 22 bp, Homo sapiens
aggacacttaggttattcaact

SEQ ID NO: 7333347 - DNA, 22 bp, Homo sapiens
aggacacttgagagtccagtca

SEQ ID NO: 7333348 - DNA, 22 bp, Homo sapiens
aggacacttggctattgttcca

SEQ ID NO: 7333349 - DNA, 22 bp, Homo sapiens
aggacaagctaaaggacttcct

SEQ ID NO: 7333350 - DNA, 22 bp, Homo sapiens
aggacagagccctagtttcata

SEQ ID NO: 7333351 - DNA, 22 bp, Homo sapiens
aggacagagcctgtgcagaccg

SEQ ID NO: 7333352 - DNA, 22 bp, Homo sapiens
aggacagagggaccagagccca

SEQ ID NO: 7333353 - DNA, 22 bp, Homo sapiens
aggacagacctaggactggagc

SEQ ID NO: 7333354 - DNA, 22 bp, Homo sapiens
aggacagacctaggactggagc

SEQ ID NO: 7333355 - DNA, 22 bp, Homo sapiens
aggacaagacaaggaccagaga

SEQ ID NO: 7333356 - DNA, 17 bp, Homo sapiens
aggaatacagatcttca

SEQ ID NO: 7333357 - DNA, 20 bp, Homo sapiens
aggaagtgatgttttatctg

SEQ ID NO: 7333358 - DNA, 21 bp, Homo sapiens
aggaagtggccagattgggaa

SEQ ID NO: 7333359 - DNA, 20 bp, Homo sapiens
caggtgtacagtgagctgag

SEQ ID NO: 7333360 - DNA, 22 bp, Homo sapiens
caggtgggattttgctgcttga

SEQ ID NO: 7333361 - DNA, 22 bp, Homo sapiens
cagggcttctataccaattcat

SEQ ID NO: 7333362 - DNA, 22 bp, Homo sapiens
cagggcagggagcttagaatga

SEQ ID NO: 7333363 - DNA, 22 bp, Homo sapiens
cagggatgtgatgagctgagcc

SEQ ID NO: 7333364 - DNA, 22 bp, Homo sapiens
cagggcaggatgctgtgattat

SEQ ID NO: 7333365 - DNA, 22 bp, Homo sapiens
caggctcttttggtggcaagga

SEQ ID NO: 7333366 - DNA, 22 bp, Homo sapiens
cagggctggatttcatttctag

SEQ ID NO: 7333367 - DNA, 22 bp, Homo sapiens
cagggctctgccttgagggatg

SEQ ID NO: 7333368 - DNA, 22 bp, Homo sapiens
aggaagagctggaccagaggac

SEQ ID NO: 7333369 - DNA, 22 bp, Homo sapiens
aggaagagcattcacatggtag

SEQ ID NO: 7333370 - DNA, 22 bp, Homo sapiens
aggaagagctggaccagaggac

SEQ ID NO: 7333371 - DNA, 22 bp, Homo sapiens
cagggctgttagctgctgctct

SEQ ID NO: 7333372 - DNA, 18 bp, Homo sapiens
cagggctgtggggtcact

SEQ ID NO: 7333373 - DNA, 21 bp, Homo sapiens
aggaaaggccagcacgtaggg

SEQ ID NO: 7333374 - DNA, 21 bp, Homo sapiens
aggaaaggccagcacgtaggg

SEQ ID NO: 7333375 - DNA, 22 bp, Homo sapiens
aggaaaggcctcagcagaaacc

SEQ ID NO: 7333376 - DNA, 21 bp, Homo sapiens
aggaaaggccagcacgtaggg

SEQ ID NO: 7333377 - DNA, 22 bp, Homo sapiens
aggaaaggcctttgcatttggt

SEQ ID NO: 7333378 - DNA, 21 bp, Homo sapiens
aggaaaggaagtccccagggt

SEQ ID NO: 7333379 - DNA, 22 bp, Homo sapiens
cagggctggcttccaagttgtt

SEQ ID NO: 7333380 - DNA, 22 bp, Homo sapiens
cagggctggctgtggcaatctc

SEQ ID NO: 7333381 - DNA, 23 bp, Homo sapiens
cagggctgggcttggtgttaggc

SEQ ID NO: 7333382 - DNA, 22 bp, Homo sapiens
caggcaggtgcagattcctctt

SEQ ID NO: 7333383 - DNA, 22 bp, Homo sapiens
caggcaggtgcagattcctctt

SEQ ID NO: 7333384 - DNA, 22 bp, Homo sapiens
agctggtggagaagcagacctc

SEQ ID NO: 7333385 - DNA, 22 bp, Homo sapiens
agctggtggaagggagcccaaa

SEQ ID NO: 7333386 - DNA, 22 bp, Homo sapiens
agctggtttaggatggtctcca

SEQ ID NO: 7333387 - DNA, 22 bp, Homo sapiens
caggcaggtcagtgaagaagga

SEQ ID NO: 7333388 - DNA, 22 bp, Homo sapiens
caggcagggagctggaaaggat

SEQ ID NO: 7333389 - DNA, 22 bp, Homo sapiens
caggcagcctgcggtctgcaca

SEQ ID NO: 7333390 - DNA, 22 bp, Homo sapiens
caggcagccttctcgtctcaca

SEQ ID NO: 7333391 - DNA, 22 bp, Homo sapiens
caggcagcctgcggtctgcaca

SEQ ID NO: 7333392 - DNA, 22 bp, Homo sapiens
caggcagcgtcctgcttcctgt

SEQ ID NO: 7333393 - DNA, 22 bp, Homo sapiens
caggcagcgtcctgcttcctgt

SEQ ID NO: 7333394 - DNA, 22 bp, Homo sapiens
caggcagcgctcgtggcctggc

SEQ ID NO: 7333395 - DNA, 21 bp, Homo sapiens
caggctctgctagaggagcct

SEQ ID NO: 7333396 - DNA, 21 bp, Homo sapiens
caggctctgctgggtgctggg

SEQ ID NO: 7333397 - DNA, 22 bp, Homo sapiens
caggctcttccatcctgctgag

SEQ ID NO: 7333398 - DNA, 22 bp, Homo sapiens
agcttctagcccatccagcagg

SEQ ID NO: 7333399 - DNA, 22 bp, Homo sapiens
caggcccagtgatcagggctct

SEQ ID NO: 7333400 - DNA, 22 bp, Homo sapiens
caggcccagtgatcagggctct

SEQ ID NO: 7333401 - DNA, 22 bp, Homo sapiens
caggcccaggtgtcgatgttcc

SEQ ID NO: 7333402 - DNA, 22 bp, Homo sapiens
caggcccatttgtagccacttt

SEQ ID NO: 7333403 - DNA, 22 bp, Homo sapiens
caggcccatctgctcccaggct

SEQ ID NO: 7333404 - DNA, 22 bp, Homo sapiens
caggcccattctaggcttgcta

SEQ ID NO: 7333405 - DNA, 22 bp, Homo sapiens
caggagcagagggtggtcagca

SEQ ID NO: 7333406 - DNA, 22 bp, Homo sapiens
caggatggagagtgaggggtca

SEQ ID NO: 7333407 - DNA, 22 bp, Homo sapiens
caggatgggatgtagtgggccc

SEQ ID NO: 7333408 - DNA, 22 bp, Homo sapiens
caggatgggatgtagtgggccc

SEQ ID NO: 7333409 - DNA, 22 bp, Homo sapiens
caggatgggatgtagtgggccc

SEQ ID NO: 7333410 - DNA, 22 bp, Homo sapiens
caggcacacagcacatggcctg

SEQ ID NO: 7333411 - DNA, 22 bp, Homo sapiens
caggatggtcagatgcattgtc

SEQ ID NO: 7333412 - DNA, 22 bp, Homo sapiens
caggagaaacataattttctgg

SEQ ID NO: 7333413 - DNA, 22 bp, Homo sapiens
caggagaaacataattttctgg

SEQ ID NO: 7333414 - DNA, 22 bp, Homo sapiens
caggagaaatgtggctgctacc

SEQ ID NO: 7333415 - DNA, 22 bp, Homo sapiens
caggagaaacataattttctgg

SEQ ID NO: 7333416 - DNA, 22 bp, Homo sapiens
caggagcaaggagcagtgggat

SEQ ID NO: 7333417 - DNA, 22 bp, Homo sapiens
caggactgatgttcctccagcc

SEQ ID NO: 7333418 - DNA, 22 bp, Homo sapiens
cagctgttcttgggacagacag

SEQ ID NO: 7333419 - DNA, 22 bp, Homo sapiens
cagctgttgactggtacatgaa

SEQ ID NO: 7333420 - DNA, 22 bp, Homo sapiens
caggacagagcccagactgtgt

SEQ ID NO: 7333421 - DNA, 22 bp, Homo sapiens
caggacagagcccagactgtgt

SEQ ID NO: 7333422 - DNA, 22 bp, Homo sapiens
cagctgttgtcacctcacatcc

SEQ ID NO: 7333423 - DNA, 22 bp, Homo sapiens
cagctgggtttagtggggtgtg

SEQ ID NO: 7333424 - DNA, 22 bp, Homo sapiens
cagctgggtttagtggggtgtg

SEQ ID NO: 7333425 - DNA, 22 bp, Homo sapiens
cagctggtaggtagcagatttg

SEQ ID NO: 7333426 - DNA, 22 bp, Homo sapiens
cagctggtcaactgaatgaaca

SEQ ID NO: 7333427 - DNA, 22 bp, Homo sapiens
cagctggtggctgatgaccgtc

SEQ ID NO: 7333428 - DNA, 22 bp, Homo sapiens
cagctggtgtcaggcactgcag

SEQ ID NO: 7333429 - DNA, 22 bp, Homo sapiens
cagctggttcagtgtctggtga

SEQ ID NO: 7333430 - DNA, 22 bp, Homo sapiens
cagctggttgaagaggagctgg

SEQ ID NO: 7333431 - DNA, 22 bp, Homo sapiens
cagctggttatcagagaggcct

SEQ ID NO: 7333432 - DNA, 22 bp, Homo sapiens
cagctggttttagcacagttag

SEQ ID NO: 7333433 - DNA, 22 bp, Homo sapiens
cagctgttactctgagtaaatg

SEQ ID NO: 7333434 - DNA, 22 bp, Homo sapiens
cagctgttcctggaaggagacc

SEQ ID NO: 7333435 - DNA, 22 bp, Homo sapiens
cagctgttcattgttgccaccc

SEQ ID NO: 7333436 - DNA, 22 bp, Homo sapiens
cagctgttcagcaactcgcaga

SEQ ID NO: 7333437 - DNA, 22 bp, Homo sapiens
cagctgttatgaggtgtacatg

SEQ ID NO: 7333438 - DNA, 22 bp, Homo sapiens
cagctgttactgaagtaaaatg

SEQ ID NO: 7333439 - DNA, 22 bp, Homo sapiens
aggacaggattgagctgaactg

SEQ ID NO: 7333440 - DNA, 22 bp, Homo sapiens
aggacaggattgagctgaactg

SEQ ID NO: 7333441 - DNA, 22 bp, Homo sapiens
aggacacaggtaagccagtgga

SEQ ID NO: 7333442 - DNA, 22 bp, Homo sapiens
aggacacaggtaagccagtgga

SEQ ID NO: 7333443 - DNA, 22 bp, Homo sapiens
acagggctatattcctcagagt

SEQ ID NO: 7333444 - DNA, 22 bp, Homo sapiens
acagggctatattcctcagagc

SEQ ID NO: 7333445 - DNA, 23 bp, Homo sapiens
acagggctagctgacagtggtat

SEQ ID NO: 7333446 - DNA, 23 bp, Homo sapiens
acagggctagctgacagtggtat

SEQ ID NO: 7333447 - DNA, 22 bp, Homo sapiens
acagggccttatatccagaagg

SEQ ID NO: 7333448 - DNA, 22 bp, Homo sapiens
acagggcctttgatggattata

SEQ ID NO: 7333449 - DNA, 22 bp, Homo sapiens
acagggccaggtgagaggtgct

SEQ ID NO: 7333450 - DNA, 22 bp, Homo sapiens
acagggccattggaggattata

SEQ ID NO: 7333451 - DNA, 22 bp, Homo sapiens
acagggccattatctgttctag

SEQ ID NO: 7333452 - DNA, 22 bp, Homo sapiens
acagggccctgtgggccccact

SEQ ID NO: 7333453 - DNA, 22 bp, Homo sapiens
acagggcctcagccagggcaga

SEQ ID NO: 7333454 - DNA, 22 bp, Homo sapiens
acagggcccttgccagcacaag

SEQ ID NO: 7333455 - DNA, 22 bp, Homo sapiens
acagggcccttagatcctttta

SEQ ID NO: 7333456 - DNA, 22 bp, Homo sapiens
acagggcctcagctgattctgg

SEQ ID NO: 7333457 - DNA, 22 bp, Homo sapiens
acagggcctggctccaaaagat

SEQ ID NO: 7333458 - DNA, 22 bp, Homo sapiens
acagggcctcagccagggcaga

SEQ ID NO: 7333459 - DNA, 22 bp, Homo sapiens
aggactggtgtgtgatcagcat

SEQ ID NO: 7333460 - DNA, 22 bp, Homo sapiens
aggactggcagtgtgaggggtc

SEQ ID NO: 7333461 - DNA, 22 bp, Homo sapiens
aggactggccctgaggggaggc

SEQ ID NO: 7333462 - DNA, 22 bp, Homo sapiens
aggactggccctgaggggaggc

SEQ ID NO: 7333463 - DNA, 22 bp, Homo sapiens
aggacaggtgtagtgggctctg

SEQ ID NO: 7333464 - DNA, 22 bp, Homo sapiens
aggacaggtgtagtgggctctg

SEQ ID NO: 7333465 - DNA, 22 bp, Homo sapiens
aggacagtgtggaagagggtgc

SEQ ID NO: 7333466 - DNA, 22 bp, Homo sapiens
acagggcacctgaggtaggaag

SEQ ID NO: 7333467 - DNA, 22 bp, Homo sapiens
acagggcagtgtcttgaaaaat

SEQ ID NO: 7333468 - DNA, 19 bp, Homo sapiens
acagggcagcaataggata

SEQ ID NO: 7333469 - DNA, 22 bp, Homo sapiens
acaggctcgtgcgcgcacgtgt

SEQ ID NO: 7333470 - DNA, 22 bp, Homo sapiens
acagggccagcctgggacctgg

SEQ ID NO: 7333471 - DNA, 22 bp, Homo sapiens
acagggccacatgtaaacagat

SEQ ID NO: 7333472 - DNA, 22 bp, Homo sapiens
acagggccaatgttagcattga

SEQ ID NO: 7333473 - DNA, 22 bp, Homo sapiens
acagggccaagtaaaccctacc

SEQ ID NO: 7333474 - DNA, 22 bp, Homo sapiens
aggaaaggttcagtgattgaaa

SEQ ID NO: 7333475 - DNA, 22 bp, Homo sapiens
aggaaaggtagcgtgccagcag

SEQ ID NO: 7333476 - DNA, 22 bp, Homo sapiens
aggaaaggtagcgtgccagcag

SEQ ID NO: 7333477 - DNA, 22 bp, Homo sapiens
aggaaataagggacaagacaaa

SEQ ID NO: 7333478 - DNA, 22 bp, Homo sapiens
aggaaagtgaatgttattttgc

SEQ ID NO: 7333479 - DNA, 22 bp, Homo sapiens
aggaaataggaccagacaaagc

SEQ ID NO: 7333480 - DNA, 22 bp, Homo sapiens
acaggcctgtgtgcacacgagg

SEQ ID NO: 7333481 - DNA, 22 bp, Homo sapiens
acaggacaggtaggattcgcag

SEQ ID NO: 7333482 - DNA, 22 bp, Homo sapiens
acaggacatggcttctgtgacg

SEQ ID NO: 7333483 - DNA, 22 bp, Homo sapiens
acaggacatggcttctgtgacg

SEQ ID NO: 7333484 - DNA, 22 bp, Homo sapiens
acaggacatgtaccaggtggtc

SEQ ID NO: 7333485 - DNA, 22 bp, Homo sapiens
aggaaagaagtacattctcatg

SEQ ID NO: 7333486 - DNA, 22 bp, Homo sapiens
acaggcacaccttcctgcaggc

SEQ ID NO: 7333487 - DNA, 22 bp, Homo sapiens
acaggcacaccttcctgcaggc

SEQ ID NO: 7333488 - DNA, 22 bp, Homo sapiens
acaggcacaactgagtagactc

SEQ ID NO: 7333489 - DNA, 22 bp, Homo sapiens
acaggcaatatataaattatga

SEQ ID NO: 7333490 - DNA, 22 bp, Homo sapiens
acagcagtggtgcactgagcca

SEQ ID NO: 7333491 - DNA, 22 bp, Homo sapiens
acagccagaggagccaggctgg

SEQ ID NO: 7333492 - DNA, 22 bp, Homo sapiens
acagccagaggagccaggctgg

SEQ ID NO: 7333493 - DNA, 22 bp, Homo sapiens
acagccactcaaagggccgaag

SEQ ID NO: 7333494 - DNA, 22 bp, Homo sapiens
acagccagaagtcagggtggga

SEQ ID NO: 7333495 - DNA, 22 bp, Homo sapiens
acagcattgagagctaaattta

SEQ ID NO: 7333496 - DNA, 22 bp, Homo sapiens
acaggaagtgggaagaaacagg

SEQ ID NO: 7333497 - DNA, 20 bp, Homo sapiens
acagccagaggaggcagaca

SEQ ID NO: 7333498 - DNA, 20 bp, Homo sapiens
acagccagaggaggcagaca

SEQ ID NO: 7333499 - DNA, 23 bp, Homo sapiens
acaggaatttgtgcaccatgaag

SEQ ID NO: 7333500 - DNA, 22 bp, Homo sapiens
acaggaataaaaggaataagga

SEQ ID NO: 7333501 - DNA, 22 bp, Homo sapiens
acaggacaaaaatctggatggc

SEQ ID NO: 7333502 - DNA, 22 bp, Homo sapiens
acaggacaatttataatgggca

SEQ ID NO: 7333503 - DNA, 22 bp, Homo sapiens
acagtgaaaagaatattagaat

SEQ ID NO: 7333504 - DNA, 22 bp, Homo sapiens
acagtgagcccactccaggaga

SEQ ID NO: 7333505 - DNA, 22 bp, Homo sapiens
acagtgagatccaagggcaggc

SEQ ID NO: 7333506 - DNA, 22 bp, Homo sapiens
acagtgagatccaagggcaggc

SEQ ID NO: 7333507 - DNA, 22 bp, Homo sapiens
acagtgaggaagcagctgtgct

SEQ ID NO: 7333508 - DNA, 22 bp, Homo sapiens
acagtgagcggtagtgattgct

SEQ ID NO: 7333509 - DNA, 21 bp, Homo sapiens
acagtgagaaataaatggaaa

SEQ ID NO: 7333510 - DNA, 21 bp, Homo sapiens
acagtgagaaataaatggaaa

SEQ ID NO: 7333511 - DNA, 22 bp, Homo sapiens
aggaggccatgtactaggttcc

SEQ ID NO: 7333512 - DNA, 22 bp, Homo sapiens
acagtgcttttgttcctctcct

SEQ ID NO: 7333513 - DNA, 22 bp, Homo sapiens
acagtgcttggcacacagtaat

SEQ ID NO: 7333514 - DNA, 22 bp, Homo sapiens
acagtgcttctgatatgatgcc

SEQ ID NO: 7333515 - DNA, 22 bp, Homo sapiens
acagtgcttggcacacagtaat

SEQ ID NO: 7333516 - DNA, 19 bp, Homo sapiens
acagtgcttctgagtgagg

SEQ ID NO: 7333517 - DNA, 22 bp, Homo sapiens
acagtgcttagcacagagtaga

SEQ ID NO: 7333518 - DNA, 22 bp, Homo sapiens
acagtgcttagcacagagtaga

SEQ ID NO: 7333519 - DNA, 22 bp, Homo sapiens
acagtgctgtctatctcactaa

SEQ ID NO: 7333520 - DNA, 22 bp, Homo sapiens
acagtgctgtgcagtctgccct

SEQ ID NO: 7333521 - DNA, 22 bp, Homo sapiens
acagtgctgtgcagtctgccct

SEQ ID NO: 7333522 - DNA, 22 bp, Homo sapiens
aggaggccgatttcagaggtcg

SEQ ID NO: 7333523 - DNA, 17 bp, Homo sapiens
aggaggccctggcgttt

SEQ ID NO: 7333524 - DNA, 22 bp, Homo sapiens
acagtggagaaggcatgaggct

SEQ ID NO: 7333525 - DNA, 22 bp, Homo sapiens
aggcaccgctcctcagtccaga

SEQ ID NO: 7333526 - DNA, 22 bp, Homo sapiens
acagtgttctgaaagttgaggg

SEQ ID NO: 7333527 - DNA, 22 bp, Homo sapiens
aggcactggtccattttctgca

SEQ ID NO: 7333528 - DNA, 22 bp, Homo sapiens
acagtgttacttgatagtgtat

SEQ ID NO: 7333529 - DNA, 22 bp, Homo sapiens
acagtgttacttgatagtgtat

SEQ ID NO: 7333530 - DNA, 22 bp, Homo sapiens
aggcactgaaaggtggccagag

SEQ ID NO: 7333531 - DNA, 22 bp, Homo sapiens
aggcactgaaaggtggccagag

SEQ ID NO: 7333532 - DNA, 22 bp, Homo sapiens
aggcacgagcaatggccgagga

SEQ ID NO: 7333533 - DNA, 22 bp, Homo sapiens
aggcaccttgcggtccagtgaa

SEQ ID NO: 7333534 - DNA, 20 bp, Homo sapiens
aggcacctgtcacaggtgag

SEQ ID NO: 7333535 - DNA, 22 bp, Homo sapiens
aggcacctggatcttggaattc

SEQ ID NO: 7333536 - DNA, 22 bp, Homo sapiens
aggcagtggtgtttgctggtgg

SEQ ID NO: 7333537 - DNA, 22 bp, Homo sapiens
acatctgtaatctagtcaaccc

SEQ ID NO: 7333538 - DNA, 22 bp, Homo sapiens
acatctgttgattgatgttaca

SEQ ID NO: 7333539 - DNA, 22 bp, Homo sapiens
aggcagtgtattgctagcggct

SEQ ID NO: 7333540 - DNA, 22 bp, Homo sapiens
acatatatgtgcacatgtgcag

SEQ ID NO: 7333541 - DNA, 22 bp, Homo sapiens
acatatatgtaaagtactttgt

SEQ ID NO: 7333542 - DNA, 22 bp, Homo sapiens
acatatatgctgggactgtgac

SEQ ID NO: 7333543 - DNA, 22 bp, Homo sapiens
acatatatgcgtgggctcatgg

SEQ ID NO: 7333544 - DNA, 22 bp, Homo sapiens
acatataagggatcagtgacag

SEQ ID NO: 7333545 - DNA, 22 bp, Homo sapiens
acatctgaccattacaagacat

SEQ ID NO: 7333546 - DNA, 20 bp, Homo sapiens
acatctgagaaacacttaaa

SEQ ID NO: 7333547 - DNA, 22 bp, Homo sapiens
acatctgattacatgagaatat

SEQ ID NO: 7333548 - DNA, 22 bp, Homo sapiens
acatctgagcaacagaacacta

SEQ ID NO: 7333549 - DNA, 22 bp, Homo sapiens
aggcagatgggagctggaagtt

SEQ ID NO: 7333550 - DNA, 22 bp, Homo sapiens
aggcaggtgggagtgattcctt

SEQ ID NO: 7333551 - DNA, 22 bp, Homo sapiens
aggcaggtgggtcacttgagtc

SEQ ID NO: 7333552 - DNA, 17 bp, Homo sapiens
acatgtgggtgtttttc

SEQ ID NO: 7333553 - DNA, 22 bp, Homo sapiens
acatgtgcagacagcaagcagg

SEQ ID NO: 7333554 - DNA, 22 bp, Homo sapiens
acatgtcttttaaagtctaata

SEQ ID NO: 7333555 - DNA, 22 bp, Homo sapiens
acatgtcttgtggctttgatct

SEQ ID NO: 7333556 - DNA, 21 bp, Homo sapiens
acatgtctggtcatttttagc

SEQ ID NO: 7333557 - DNA, 22 bp, Homo sapiens
acatgtctgtaattattttagg

SEQ ID NO: 7333558 - DNA, 22 bp, Homo sapiens
acatgtctgtaattattttagg

SEQ ID NO: 7333559 - DNA, 22 bp, Homo sapiens
aggctcagggacggggcccctt

SEQ ID NO: 7333560 - DNA, 22 bp, Homo sapiens
aggctcaggaggagctgccgga

SEQ ID NO: 7333561 - DNA, 22 bp, Homo sapiens
aggctcaggcaggaatggcgga

SEQ ID NO: 7333562 - DNA, 22 bp, Homo sapiens
aggctcaggcaggaatggcgga

SEQ ID NO: 7333563 - DNA, 20 bp, Homo sapiens
aggctcagctgagctcttgg

SEQ ID NO: 7333564 - DNA, 20 bp, Homo sapiens
aggctcagctgagctcttgg

SEQ ID NO: 7333565 - DNA, 22 bp, Homo sapiens
aggctcagctggtggtgatcgc

SEQ ID NO: 7333566 - DNA, 22 bp, Homo sapiens
aggctcagctggtggtgatcgc

SEQ ID NO: 7333567 - DNA, 22 bp, Homo sapiens
acatgtctccacccatcttaaa

SEQ ID NO: 7333568 - DNA, 22 bp, Homo sapiens
acatgtcaatttagtactctta

SEQ ID NO: 7333569 - DNA, 22 bp, Homo sapiens
acatgtctaagtactcaacaaa

SEQ ID NO: 7333570 - DNA, 22 bp, Homo sapiens
acatgtatgtgtgcaaacacat

SEQ ID NO: 7333571 - DNA, 22 bp, Homo sapiens
acatgtatacaatgtgtaatga

SEQ ID NO: 7333572 - DNA, 21 bp, Homo sapiens
acatgtaagagagtttcaaga

SEQ ID NO: 7333573 - DNA, 22 bp, Homo sapiens
acatgtaacatatatgtagcat

SEQ ID NO: 7333574 - DNA, 22 bp, Homo sapiens
acatgtaaacatttacagtatt

SEQ ID NO: 7333575 - DNA, 22 bp, Homo sapiens
acatgtaaaaggaacatgcatg

SEQ ID NO: 7333576 - DNA, 22 bp, Homo sapiens
acatgtaaaagataaattaaca

SEQ ID NO: 7333577 - DNA, 22 bp, Homo sapiens
aggcagtgtgtagctggaagag

SEQ ID NO: 7333578 - DNA, 22 bp, Homo sapiens
aggcagtgttcttctaagggca

SEQ ID NO: 7333579 - DNA, 22 bp, Homo sapiens
aggctctggacagtgaggagtt

SEQ ID NO: 7333580 - DNA, 22 bp, Homo sapiens
aggctctgacgtcacacgtggc

SEQ ID NO: 7333581 - DNA, 22 bp, Homo sapiens
aggctctgacccatgggaccca

SEQ ID NO: 7333582 - DNA, 22 bp, Homo sapiens
aggctctggacagtgaggagtt

SEQ ID NO: 7333583 - DNA, 22 bp, Homo sapiens
aggctctggagttagccaggca

SEQ ID NO: 7333584 - DNA, 22 bp, Homo sapiens
aggctctggagtgtggtgctgg

SEQ ID NO: 7333585 - DNA, 22 bp, Homo sapiens
acattaaatttcatagtgatta

SEQ ID NO: 7333586 - DNA, 22 bp, Homo sapiens
accactggctcaggagctggga

SEQ ID NO: 7333587 - DNA, 22 bp, Homo sapiens
accactgtctacacattgactc

SEQ ID NO: 7333588 - DNA, 22 bp, Homo sapiens
accacttcctttaggaccttgt

SEQ ID NO: 7333589 - DNA, 22 bp, Homo sapiens
accactgtacagcagatatagt

SEQ ID NO: 7333590 - DNA, 22 bp, Homo sapiens
accactgtactatttgagtggc

SEQ ID NO: 7333591 - DNA, 22 bp, Homo sapiens
accactgtatctccagcacatt

SEQ ID NO: 7333592 - DNA, 22 bp, Homo sapiens
accactggttttgcagaggcgc

SEQ ID NO: 7333593 - DNA, 22 bp, Homo sapiens
accactggggcaagtcttcaaa

SEQ ID NO: 7333594 - DNA, 22 bp, Homo sapiens
aggctgtgagaagtccttcagt

SEQ ID NO: 7333595 - DNA, 22 bp, Homo sapiens
aggctgtgatctcatgatttgt

SEQ ID NO: 7333596 - DNA, 22 bp, Homo sapiens
aggctgtgagtagttcttgttg

SEQ ID NO: 7333597 - DNA, 22 bp, Homo sapiens
aggctggctggggatgcgtctt

SEQ ID NO: 7333598 - DNA, 23 bp, Homo sapiens
aggctgctgagatgggtgtgtca

SEQ ID NO: 7333599 - DNA, 21 bp, Homo sapiens
aggctgctctttcttgtggta

SEQ ID NO: 7333600 - DNA, 22 bp, Homo sapiens
aggctctggagttagccaggca

SEQ ID NO: 7333601 - DNA, 22 bp, Homo sapiens
aggctctggcaacagctggtgt

SEQ ID NO: 7333602 - DNA, 22 bp, Homo sapiens
aggctctggcaacagctggtgt

SEQ ID NO: 7333603 - DNA, 22 bp, Homo sapiens
aggctgctggcaggcgtggacg

SEQ ID NO: 7333604 - DNA, 22 bp, Homo sapiens
aggctgctgccttggagagtgt

SEQ ID NO: 7333605 - DNA, 22 bp, Homo sapiens
aggctgcttcaatggataagat

SEQ ID NO: 7333606 - DNA, 22 bp, Homo sapiens
aggctgcttcagctgcagggag

SEQ ID NO: 7333607 - DNA, 22 bp, Homo sapiens
aggggcagttccaagttttgtg

SEQ ID NO: 7333608 - DNA, 22 bp, Homo sapiens
aggggcaggtgctgcacttaga

SEQ ID NO: 7333609 - DNA, 22 bp, Homo sapiens
aggggcaggtgctgcacttaga

SEQ ID NO: 7333610 - DNA, 22 bp, Homo sapiens
agggctttgatggcattctcat

SEQ ID NO: 7333611 - DNA, 22 bp, Homo sapiens
agggctttgatggcattctcat

SEQ ID NO: 7333612 - DNA, 22 bp, Homo sapiens
agggctttgagaatagtggaac

SEQ ID NO: 7333613 - DNA, 22 bp, Homo sapiens
agggctttgagaatagtggaac

SEQ ID NO: 7333614 - DNA, 22 bp, Homo sapiens
agggctttctttgtaaaagaag

SEQ ID NO: 7333615 - DNA, 22 bp, Homo sapiens
agggctgacaaatggcagtgac

SEQ ID NO: 7333616 - DNA, 23 bp, Homo sapiens
agggctgaatgcagagaagcaga

SEQ ID NO: 7333617 - DNA, 22 bp, Homo sapiens
agggctcagtaaacggtggatt

SEQ ID NO: 7333618 - DNA, 22 bp, Homo sapiens
agggctgaagggaggtgctcat

SEQ ID NO: 7333619 - DNA, 22 bp, Homo sapiens
agggctgaagttatggctgagc

SEQ ID NO: 7333620 - DNA, 22 bp, Homo sapiens
acctcatctggtttgtaaggca

SEQ ID NO: 7333621 - DNA, 22 bp, Homo sapiens
acctccagctttttagagacat

SEQ ID NO: 7333622 - DNA, 22 bp, Homo sapiens
acctcagaggccagggatctag

SEQ ID NO: 7333623 - DNA, 22 bp, Homo sapiens
acctcaggatgtggacacagaa

SEQ ID NO: 7333624 - DNA, 22 bp, Homo sapiens
aggggccaccaccaaggaaggt

SEQ ID NO: 7333625 - DNA, 22 bp, Homo sapiens
aggggccaccaccaaggaaggt

SEQ ID NO: 7333626 - DNA, 22 bp, Homo sapiens
aggggccacctgtggcaccctg

SEQ ID NO: 7333627 - DNA, 22 bp, Homo sapiens
aggggccacctgtggcaccctg

SEQ ID NO: 7333628 - DNA, 22 bp, Homo sapiens
aggggccatgtaagtgtatcac

SEQ ID NO: 7333629 - DNA, 22 bp, Homo sapiens
aggggccattgttctgcccgct

SEQ ID NO: 7333630 - DNA, 22 bp, Homo sapiens
aggggccattgttctgcccgct

SEQ ID NO: 7333631 - DNA, 22 bp, Homo sapiens
aggggcctcgcaggaccgctcc

SEQ ID NO: 7333632 - DNA, 20 bp, Homo sapiens
aggggcctggaacaggcctt

SEQ ID NO: 7333633 - DNA, 18 bp, Homo sapiens
accctttccaaactgcag

SEQ ID NO: 7333634 - DNA, 22 bp, Homo sapiens
accctttcttactcacacgctc

SEQ ID NO: 7333635 - DNA, 22 bp, Homo sapiens
aggggtggagagtgttgccagt

SEQ ID NO: 7333636 - DNA, 22 bp, Homo sapiens
aggggtggagagtgttgccagt

SEQ ID NO: 7333637 - DNA, 22 bp, Homo sapiens
aggggtggcctgccttactccc

SEQ ID NO: 7333638 - DNA, 22 bp, Homo sapiens
agggtcagtagtgatgcgtgaa

SEQ ID NO: 7333639 - DNA, 22 bp, Homo sapiens
aggggttggatttggcctagag

SEQ ID NO: 7333640 - DNA, 22 bp, Homo sapiens
aggggtgtgcatcctggaggat

SEQ ID NO: 7333641 - DNA, 23 bp, Homo sapiens
aggggtggtcagtacccgcagtg

SEQ ID NO: 7333642 - DNA, 23 bp, Homo sapiens
aggggtggtcagtacccgcagtg

SEQ ID NO: 7333643 - DNA, 23 bp, Homo sapiens
aggggtggtcagtacccgcagtg

SEQ ID NO: 7333644 - DNA, 22 bp, Homo sapiens
agggaggtctttgaggggctta

SEQ ID NO: 7333645 - DNA, 22 bp, Homo sapiens
agggaggcattagctactgcga

SEQ ID NO: 7333646 - DNA, 22 bp, Homo sapiens
agggcacaagactctgagcccc

SEQ ID NO: 7333647 - DNA, 22 bp, Homo sapiens
agggcacaagactctgagcccc

SEQ ID NO: 7333648 - DNA, 19 bp, Homo sapiens
agggcacagggacagaagg

SEQ ID NO: 7333649 - DNA, 22 bp, Homo sapiens
agggaggatagtagtcagttta

SEQ ID NO: 7333650 - DNA, 22 bp, Homo sapiens
agggaggcaggaaagttgtctg

SEQ ID NO: 7333651 - DNA, 22 bp, Homo sapiens
accagagaaaacacagcaggct

SEQ ID NO: 7333652 - DNA, 22 bp, Homo sapiens
accagagaaaacacagcaggct

SEQ ID NO: 7333653 - DNA, 22 bp, Homo sapiens
accagagaggctgcagtgtgtg

SEQ ID NO: 7333654 - DNA, 20 bp, Homo sapiens
accagagatagcaatagtgc

SEQ ID NO: 7333655 - DNA, 22 bp, Homo sapiens
agggcatgctggaggagagaca

SEQ ID NO: 7333656 - DNA, 22 bp, Homo sapiens
agggccagcactcctggcagga

SEQ ID NO: 7333657 - DNA, 22 bp, Homo sapiens
agggccagatgaagccacaagc

SEQ ID NO: 7333658 - DNA, 22 bp, Homo sapiens
agggccagcactcctggcagga

SEQ ID NO: 7333659 - DNA, 22 bp, Homo sapiens
agggccagcactcctggcagga

SEQ ID NO: 7333660 - DNA, 22 bp, Homo sapiens
agggccagcactcctggcagga

SEQ ID NO: 7333661 - DNA, 22 bp, Homo sapiens
agggccagcccataatgccaaa

SEQ ID NO: 7333662 - DNA, 22 bp, Homo sapiens
agggccagcagcttggccaacc

SEQ ID NO: 7333663 - DNA, 22 bp, Homo sapiens
agggccagcagcttggccaacc

SEQ ID NO: 7333664 - DNA, 22 bp, Homo sapiens
agggccagccaggccctacaaa

SEQ ID NO: 7333665 - DNA, 22 bp, Homo sapiens
agggccagtattaaggtaatta

SEQ ID NO: 7333666 - DNA, 22 bp, Homo sapiens
agggccagtgggttgaaaggca

SEQ ID NO: 7333667 - DNA, 22 bp, Homo sapiens
agggccagtgggttgaaaggca

SEQ ID NO: 7333668 - DNA, 22 bp, Homo sapiens
agggccagttcagaggacatgg

SEQ ID NO: 7333669 - DNA, 22 bp, Homo sapiens
agggccagtaccaggtgggtgg

SEQ ID NO: 7333670 - DNA, 22 bp, Homo sapiens
agggccagtaccaggtgggtgg

SEQ ID NO: 7333671 - DNA, 22 bp, Homo sapiens
agggccagtaaatgtttcctca

SEQ ID NO: 7333672 - DNA, 22 bp, Homo sapiens
agggccagttcagaggacatgg

SEQ ID NO: 7333673 - DNA, 22 bp, Homo sapiens
agggctcaatggtgggcatgta

SEQ ID NO: 7333674 - DNA, 22 bp, Homo sapiens
agggctcaatggtgggcatgta

SEQ ID NO: 7333675 - DNA, 22 bp, Homo sapiens
agggtcagtgatgagggagccc

SEQ ID NO: 7333676 - DNA, 22 bp, Homo sapiens
agggtcagtgatgagggagccc

SEQ ID NO: 7333677 - DNA, 18 bp, Homo sapiens
agggtcagtgtcactggc

SEQ ID NO: 7333678 - DNA, 22 bp, Homo sapiens
agggtcagttctgtgaggtgtt

SEQ ID NO: 7333679 - DNA, 22 bp, Homo sapiens
agggtcagttctgtgaggtgtt

SEQ ID NO: 7333680 - DNA, 22 bp, Homo sapiens
agggtgcagggacaggtgtgca

SEQ ID NO: 7333681 - DNA, 22 bp, Homo sapiens
agggtgcagggacaggtgtgca

SEQ ID NO: 7333682 - DNA, 22 bp, Homo sapiens
aggtgcagtgaaggaaaaggaa

SEQ ID NO: 7333683 - DNA, 22 bp, Homo sapiens
aggtgcttggtaaatattttag

SEQ ID NO: 7333684 - DNA, 22 bp, Homo sapiens
aggtgaggataggtggccaagg

SEQ ID NO: 7333685 - DNA, 19 bp, Homo sapiens
aggtgaggggcaccatgtc

SEQ ID NO: 7333686 - DNA, 22 bp, Homo sapiens
aggtgaggataggtggccaagg

SEQ ID NO: 7333687 - DNA, 22 bp, Homo sapiens
aggtgaggataggtggccaagg

SEQ ID NO: 7333688 - DNA, 22 bp, Homo sapiens
agggtgcatgtttgcaagagtg

SEQ ID NO: 7333689 - DNA, 22 bp, Homo sapiens
aggtgcaggagctgtgcaggga

SEQ ID NO: 7333690 - DNA, 19 bp, Homo sapiens
aggtgcaggtcacagggga

SEQ ID NO: 7333691 - DNA, 19 bp, Homo sapiens
aggtgcaggtcacagggga

SEQ ID NO: 7333692 - DNA, 21 bp, Homo sapiens
aggtgcaggcctcaagcccca

SEQ ID NO: 7333693 - DNA, 22 bp, Homo sapiens
aggtggtcttggcccacccagg

SEQ ID NO: 7333694 - DNA, 22 bp, Homo sapiens
aggtggggttcagtctcagccg

SEQ ID NO: 7333695 - DNA, 22 bp, Homo sapiens
aggtggggaaaccagcgatccc

SEQ ID NO: 7333696 - DNA, 22 bp, Homo sapiens
aggtggagaagagatgggcagt

SEQ ID NO: 7333697 - DNA, 16 bp, Homo sapiens
aggtggagaagttcac

SEQ ID NO: 7333698 - DNA, 22 bp, Homo sapiens
aggtggagaagagatgggcagt

SEQ ID NO: 7333699 - DNA, 22 bp, Homo sapiens
aggtggagaagagatgggcagt

SEQ ID NO: 7333700 - DNA, 22 bp, Homo sapiens
aggtggagaagagatgggcagt

SEQ ID NO: 7333701 - DNA, 22 bp, Homo sapiens
aggtggagacccagagaaggcg

SEQ ID NO: 7333702 - DNA, 20 bp, Homo sapiens
aggtgtccacgtggcagggt

SEQ ID NO: 7333703 - DNA, 22 bp, Homo sapiens
actctgtaattctatatgcagt

SEQ ID NO: 7333704 - DNA, 22 bp, Homo sapiens
agtcctgggtgtgcaaggcaga

SEQ ID NO: 7333705 - DNA, 22 bp, Homo sapiens
actctgctatcttagcaaaagg

SEQ ID NO: 7333706 - DNA, 22 bp, Homo sapiens
actctgctattgcagtgcaaaa

SEQ ID NO: 7333707 - DNA, 21 bp, Homo sapiens
agtccaggagtcacccaagcc

SEQ ID NO: 7333708 - DNA, 21 bp, Homo sapiens
agtccaggaggaggccaggtt

SEQ ID NO: 7333709 - DNA, 22 bp, Homo sapiens
agtccaggcattccagccattc

SEQ ID NO: 7333710 - DNA, 22 bp, Homo sapiens
agtcagtgaatctgaaggctaa

SEQ ID NO: 7333711 - DNA, 22 bp, Homo sapiens
agtcacttgattctcctgagct

SEQ ID NO: 7333712 - DNA, 22 bp, Homo sapiens
agtcaggtactccgagggcatg

SEQ ID NO: 7333713 - DNA, 22 bp, Homo sapiens
agtaagacccagtcacttgaga

SEQ ID NO: 7333714 - DNA, 22 bp, Homo sapiens
actcagagtttgcgttccatac

SEQ ID NO: 7333715 - DNA, 22 bp, Homo sapiens
agtgagagtattaatgtgaact

SEQ ID NO: 7333716 - DNA, 22 bp, Homo sapiens
agtgagagtattaatgtgaact

SEQ ID NO: 7333717 - DNA, 22 bp, Homo sapiens
agtcctttgctgaactgtcaca

SEQ ID NO: 7333718 - DNA, 22 bp, Homo sapiens
agtccttcttttagttgcttgg

SEQ ID NO: 7333719 - DNA, 22 bp, Homo sapiens
agtgaattagcctatttgtaaa

SEQ ID NO: 7333720 - DNA, 22 bp, Homo sapiens
agtgagccataagggctgccac

SEQ ID NO: 7333721 - DNA, 22 bp, Homo sapiens
agtgaggcaaagtgagaggcag

SEQ ID NO: 7333722 - DNA, 20 bp, Homo sapiens
agtgaggcagttcagtgggc

SEQ ID NO: 7333723 - DNA, 20 bp, Homo sapiens
agtgaggcagttcagtgggc

SEQ ID NO: 7333724 - DNA, 22 bp, Homo sapiens
agtgaggcaaagtgagaggcag

SEQ ID NO: 7333725 - DNA, 22 bp, Homo sapiens
agtgaggctaataggcaatggt

SEQ ID NO: 7333726 - DNA, 22 bp, Homo sapiens
agtgagcatccagagaggtggg

SEQ ID NO: 7333727 - DNA, 22 bp, Homo sapiens
agtgagcatcttcaggagccaa

SEQ ID NO: 7333728 - DNA, 21 bp, Homo sapiens
agtgagcatccagagaggtgg

SEQ ID NO: 7333729 - DNA, 22 bp, Homo sapiens
agtgagcaagacttcgttgtcc

SEQ ID NO: 7333730 - DNA, 22 bp, Homo sapiens
agtgagcaacagaagcgtgggt

SEQ ID NO: 7333731 - DNA, 22 bp, Homo sapiens
agtgattttatcaatttactca

SEQ ID NO: 7333732 - DNA, 22 bp, Homo sapiens
agtgcaaattatttacctgatt

SEQ ID NO: 7333733 - DNA, 22 bp, Homo sapiens
agtgggaggcggctgacgggcg

SEQ ID NO: 7333734 - DNA, 22 bp, Homo sapiens
agtggggccgcggtcctgccct

SEQ ID NO: 7333735 - DNA, 22 bp, Homo sapiens
agtggcagagccaagatatgat

SEQ ID NO: 7333736 - DNA, 22 bp, Homo sapiens
agtgctttggatgatgtgggat

SEQ ID NO: 7333737 - DNA, 19 bp, Homo sapiens
agttatttctaaatttacc

SEQ ID NO: 7333738 - DNA, 21 bp, Homo sapiens
agttacaagtttattcagagg

SEQ ID NO: 7333739 - DNA, 21 bp, Homo sapiens
agttacatgtatagataaagt

SEQ ID NO: 7333740 - DNA, 17 bp, Homo sapiens
agttaaggctctttgct

SEQ ID NO: 7333741 - DNA, 22 bp, Homo sapiens
agttacaaacactatcagttct

SEQ ID NO: 7333742 - DNA, 22 bp, Homo sapiens
agttaaggttcaattaaagtta

SEQ ID NO: 7333743 - DNA, 22 bp, Homo sapiens
agttaagggtattcttttaaat

SEQ ID NO: 7333744 - DNA, 22 bp, Homo sapiens
agttaagggggttcatctgtaa

SEQ ID NO: 7333745 - DNA, 22 bp, Homo sapiens
agttaagggctggtgtagactc

SEQ ID NO: 7333746 - DNA, 22 bp, Homo sapiens
actggggattagggactcagtg

SEQ ID NO: 7333747 - DNA, 22 bp, Homo sapiens
actggggattagggactcagtg

SEQ ID NO: 7333748 - DNA, 22 bp, Homo sapiens
actggggcaggaaagtatgctg

SEQ ID NO: 7333749 - DNA, 22 bp, Homo sapiens
actggggcaggaaagtatgctg

SEQ ID NO: 7333750 - DNA, 22 bp, Homo sapiens
actggggcaggaaagtatgctg

SEQ ID NO: 7333751 - DNA, 22 bp, Homo sapiens
actggggcagtgggcagtggtt

SEQ ID NO: 7333752 - DNA, 22 bp, Homo sapiens
actggggcagtgggcagtggtt

SEQ ID NO: 7333753 - DNA, 22 bp, Homo sapiens
actggggctgatgcgttcgtgt

SEQ ID NO: 7333754 - DNA, 22 bp, Homo sapiens
actggggcctcctccatgctct

SEQ ID NO: 7333755 - DNA, 22 bp, Homo sapiens
actggggcctcctccatgctct

SEQ ID NO: 7333756 - DNA, 22 bp, Homo sapiens
agtggggtccatcccttccctc

SEQ ID NO: 7333757 - DNA, 22 bp, Homo sapiens
agtggggccggtgaggccgagg

SEQ ID NO: 7333758 - DNA, 22 bp, Homo sapiens
agtggggcggacaggaccagga

SEQ ID NO: 7333759 - DNA, 22 bp, Homo sapiens
agtggggccggtgaggccgagg

SEQ ID NO: 7333760 - DNA, 22 bp, Homo sapiens
agtggggccggtgaggccgagg

SEQ ID NO: 7333761 - DNA, 22 bp, Homo sapiens
agtggggtctcctccagccccc

SEQ ID NO: 7333762 - DNA, 22 bp, Homo sapiens
agtgtctgtgctttgcagcaaa

SEQ ID NO: 7333763 - DNA, 17 bp, Homo sapiens
agtgtgtaacttgtgta

SEQ ID NO: 7333764 - DNA, 22 bp, Homo sapiens
agtgtgggttttatggagccct

SEQ ID NO: 7333765 - DNA, 22 bp, Homo sapiens
agtgtgtgaccttttaatttaa

SEQ ID NO: 7333766 - DNA, 17 bp, Homo sapiens
agtgtgtgaaatggtgg

SEQ ID NO: 7333767 - DNA, 22 bp, Homo sapiens
agtgtgtagcacatggtaagca

SEQ ID NO: 7333768 - DNA, 22 bp, Homo sapiens
agaagccaaaggggccagatat

SEQ ID NO: 7333769 - DNA, 22 bp, Homo sapiens
agaagccaaatgccagtgacct

SEQ ID NO: 7333770 - DNA, 22 bp, Homo sapiens
agaagcagttattttttgcaca

SEQ ID NO: 7333771 - DNA, 18 bp, Homo sapiens
agaagcaggtaaaattct

SEQ ID NO: 7333772 - DNA, 18 bp, Homo sapiens
agaagcaggtaaaattct

SEQ ID NO: 7333773 - DNA, 18 bp, Homo sapiens
agaagcaggttctcccag

SEQ ID NO: 7333774 - DNA, 22 bp, Homo sapiens
agaagcaggcctcacagatctg

SEQ ID NO: 7333775 - DNA, 22 bp, Homo sapiens
agaagcagggcagggaaaagca

SEQ ID NO: 7333776 - DNA, 22 bp, Homo sapiens
agaagcaggcagatttcagctc

SEQ ID NO: 7333777 - DNA, 22 bp, Homo sapiens
agaagcacctgtcagctacatg

SEQ ID NO: 7333778 - DNA, 22 bp, Homo sapiens
atctgcttgttgcatgtctgtt

SEQ ID NO: 7333779 - DNA, 22 bp, Homo sapiens
agaagctaattcatgtcttatg

SEQ ID NO: 7333780 - DNA, 22 bp, Homo sapiens
agaagccatagtctgggaggca

SEQ ID NO: 7333781 - DNA, 22 bp, Homo sapiens
atcctggcaagcagaggagaac

SEQ ID NO: 7333782 - DNA, 22 bp, Homo sapiens
atcctggcccaggtgtggaggg

SEQ ID NO: 7333783 - DNA, 22 bp, Homo sapiens
atcctggcgccacacggctcta

SEQ ID NO: 7333784 - DNA, 22 bp, Homo sapiens
atcctgaaaattgaatggaagg

SEQ ID NO: 7333785 - DNA, 22 bp, Homo sapiens
agaaagagatgaatgctttaag

SEQ ID NO: 7333786 - DNA, 22 bp, Homo sapiens
agaaagaacgttggttatctta

SEQ ID NO: 7333787 - DNA, 22 bp, Homo sapiens
agaaagaacgttggttatctta

SEQ ID NO: 7333788 - DNA, 22 bp, Homo sapiens
agaaactgtgttactagaatgt

SEQ ID NO: 7333789 - DNA, 22 bp, Homo sapiens
agaaagaacgcacttgtgctgc

SEQ ID NO: 7333790 - DNA, 22 bp, Homo sapiens
agaaagaacgcacttgtgctgc

SEQ ID NO: 7333791 - DNA, 19 bp, Homo sapiens
atatagcattattcaattt

SEQ ID NO: 7333792 - DNA, 19 bp, Homo sapiens
atatagcattattcaattt

SEQ ID NO: 7333793 - DNA, 22 bp, Homo sapiens
atatagaatacacagggaaagt

SEQ ID NO: 7333794 - DNA, 22 bp, Homo sapiens
atatagaaggtgctatttacat

SEQ ID NO: 7333795 - DNA, 22 bp, Homo sapiens
atcaagagtattgacaagacca

SEQ ID NO: 7333796 - DNA, 22 bp, Homo sapiens
agaaatcttggagtctgtggta

SEQ ID NO: 7333797 - DNA, 22 bp, Homo sapiens
agaaagttttgtgctatatatg

SEQ ID NO: 7333798 - DNA, 22 bp, Homo sapiens
atattaattatttacacatgag

SEQ ID NO: 7333799 - DNA, 22 bp, Homo sapiens
agaaatatgctgattagatgaa

SEQ ID NO: 7333800 - DNA, 22 bp, Homo sapiens
agaaatatgctgattagatgaa

SEQ ID NO: 7333801 - DNA, 22 bp, Homo sapiens
agaaatcaatatctatatgttg

SEQ ID NO: 7333802 - DNA, 22 bp, Homo sapiens
agaaatcagaaccctgaagttc

SEQ ID NO: 7333803 - DNA, 20 bp, Homo sapiens
agaaatcagaccacacacta

SEQ ID NO: 7333804 - DNA, 20 bp, Homo sapiens
agaaatcagaccacacacta

SEQ ID NO: 7333805 - DNA, 22 bp, Homo sapiens
agttgcagacgcagagatgttg

SEQ ID NO: 7333806 - DNA, 22 bp, Homo sapiens
ataaatttataattgtttcctg

SEQ ID NO: 7333807 - DNA, 22 bp, Homo sapiens
ataaattttcttgctgtactta

SEQ ID NO: 7333808 - DNA, 22 bp, Homo sapiens
agttgacatccagagacattct

SEQ ID NO: 7333809 - DNA, 22 bp, Homo sapiens
agttgaaattagagtcctggct

SEQ ID NO: 7333810 - DNA, 22 bp, Homo sapiens
agttcacagcaaagtggggacc

SEQ ID NO: 7333811 - DNA, 20 bp, Homo sapiens
agttcacaggccaaatttct

SEQ ID NO: 7333812 - DNA, 22 bp, Homo sapiens
agttcagcaaataaaacatagt

SEQ ID NO: 7333813 - DNA, 22 bp, Homo sapiens
agttcactatagaagacagtgt

SEQ ID NO: 7333814 - DNA, 19 bp, Homo sapiens
atacacgtgtatacataca

SEQ ID NO: 7333815 - DNA, 22 bp, Homo sapiens
atacacgtgccatgttggtgtg

SEQ ID NO: 7333816 - DNA, 22 bp, Homo sapiens
atacactactaagcacagattg

SEQ ID NO: 7333817 - DNA, 22 bp, Homo sapiens
atacacgtgtgtgtacatgcac

SEQ ID NO: 7333818 - DNA, 22 bp, Homo sapiens
atacacacatatgtgagttttg

SEQ ID NO: 7333819 - DNA, 22 bp, Homo sapiens
atacaatagtgtttgttttgag

SEQ ID NO: 7333820 - DNA, 22 bp, Homo sapiens
atacaatgagtgagtgaatggg

SEQ ID NO: 7333821 - DNA, 22 bp, Homo sapiens
ataaggacttgaattagacatt

SEQ ID NO: 7333822 - DNA, 22 bp, Homo sapiens
ataaggacacccttctctttac

SEQ ID NO: 7333823 - DNA, 22 bp, Homo sapiens
ataaggcacacatagatagggt

SEQ ID NO: 7333824 - DNA, 22 bp, Homo sapiens
ataaggcaagctgtcagtttgt

SEQ ID NO: 7333825 - DNA, 19 bp, Homo sapiens
ataaggcaattggatttgg

SEQ ID NO: 7333826 - DNA, 22 bp, Homo sapiens
ataaggcagaaatagggaaagt

SEQ ID NO: 7333827 - DNA, 22 bp, Homo sapiens
ataaggcagaaatgattctagt

SEQ ID NO: 7333828 - DNA, 19 bp, Homo sapiens
ataaggcaggaggaaattt

SEQ ID NO: 7333829 - DNA, 22 bp, Homo sapiens
atacaagttgtgataatgtaaa

SEQ ID NO: 7333830 - DNA, 22 bp, Homo sapiens
atacaagttgtgataatgtaaa

SEQ ID NO: 7333831 - DNA, 22 bp, Homo sapiens
atacaagttgtgataatgtaaa

SEQ ID NO: 7333832 - DNA, 22 bp, Homo sapiens
ataaggtaagggtattgtcaga

SEQ ID NO: 7333833 - DNA, 22 bp, Homo sapiens
ataaggcatctctcagttagca

SEQ ID NO: 7333834 - DNA, 22 bp, Homo sapiens
ataaggcagtcactggaatgtt

SEQ ID NO: 7333835 - DNA, 22 bp, Homo sapiens
ataaggcagtcccttaacaagg

SEQ ID NO: 7333836 - DNA, 22 bp, Homo sapiens
ataaggcagtgacttcatctat

SEQ ID NO: 7333837 - DNA, 22 bp, Homo sapiens
ataaggcatatagtcacttttt

SEQ ID NO: 7333838 - DNA, 22 bp, Homo sapiens
ataaggcatatagtcacttttt

SEQ ID NO: 7333839 - DNA, 23 bp, Homo sapiens
ataaggcataaaggtacattgga

SEQ ID NO: 7333840 - DNA, 19 bp, Homo sapiens
ataaggcagtgactttttt

SEQ ID NO: 7333841 - DNA, 22 bp, Homo sapiens
atagaagaggaaactgaggttg

SEQ ID NO: 7333842 - DNA, 22 bp, Homo sapiens
atacactgctgccacacagctg

SEQ ID NO: 7333843 - DNA, 22 bp, Homo sapiens
atactgtttctcttctacatga

SEQ ID NO: 7333844 - DNA, 22 bp, Homo sapiens
atactgttggctttggtgatgg

SEQ ID NO: 7333845 - DNA, 22 bp, Homo sapiens
atactgttggcagcagaccaga

SEQ ID NO: 7333846 - DNA, 22 bp, Homo sapiens
actttacaggcacttcaagtat

SEQ ID NO: 7333847 - DNA, 22 bp, Homo sapiens
atagaatacatttcatggagat

SEQ ID NO: 7333848 - DNA, 22 bp, Homo sapiens
atagaataaggcacagattctt

SEQ ID NO: 7333849 - DNA, 22 bp, Homo sapiens
atagaatagcatagaaaattga

SEQ ID NO: 7333850 - DNA, 22 bp, Homo sapiens
atagaatagcatagaaaattga

SEQ ID NO: 7333851 - DNA, 22 bp, Homo sapiens
atagctaccatgttggacagta

SEQ ID NO: 7333852 - DNA, 22 bp, Homo sapiens
atagctactgatgacacacaca

SEQ ID NO: 7333853 - DNA, 22 bp, Homo sapiens
atagctgttgccaatttccatg

SEQ ID NO: 7333854 - DNA, 22 bp, Homo sapiens
ataggacaagactgaccctggt

SEQ ID NO: 7333855 - DNA, 22 bp, Homo sapiens
ataggagactgttcttggcttc

SEQ ID NO: 7333856 - DNA, 22 bp, Homo sapiens
ataggaatgtgatttataaatg

SEQ ID NO: 7333857 - DNA, 22 bp, Homo sapiens
ataggcaagcacaaagtcagga

SEQ ID NO: 7333858 - DNA, 22 bp, Homo sapiens
agaaaagaggctttctaagcat

SEQ ID NO: 7333859 - DNA, 17 bp, Homo sapiens
agaaaagagaccagcag

SEQ ID NO: 7333860 - DNA, 20 bp, Homo sapiens
agaaaaagtgtggaaatttc

SEQ ID NO: 7333861 - DNA, 17 bp, Homo sapiens
agaaaagagaccagcag

SEQ ID NO: 7333862 - DNA, 22 bp, Homo sapiens
agaaaacttgtcacagctctca

SEQ ID NO: 7333863 - DNA, 22 bp, Homo sapiens
atagttcacagccatgcagtgg

SEQ ID NO: 7333864 - DNA, 22 bp, Homo sapiens
caatgtttttccttccttaata

SEQ ID NO: 7333865 - DNA, 22 bp, Homo sapiens
caattactggtccacagaaatt

SEQ ID NO: 7333866 - DNA, 22 bp, Homo sapiens
caatgattctgcaactgtgtgc

SEQ ID NO: 7333867 - DNA, 22 bp, Homo sapiens
caatgatggctaggcagctgct

SEQ ID NO: 7333868 - DNA, 22 bp, Homo sapiens
caatgatgtttagataaaatcc

SEQ ID NO: 7333869 - DNA, 22 bp, Homo sapiens
caatgtttttccttccttaata

SEQ ID NO: 7333870 - DNA, 22 bp, Homo sapiens
caatgttttgttgaatgaatag

SEQ ID NO: 7333871 - DNA, 22 bp, Homo sapiens
caagtccatcagataagcaaga

SEQ ID NO: 7333872 - DNA, 22 bp, Homo sapiens
caagggagttgctgcatgcagg

SEQ ID NO: 7333873 - DNA, 22 bp, Homo sapiens
caagggagttactgagggcggg

SEQ ID NO: 7333874 - DNA, 21 bp, Homo sapiens
caagggccagtgagatgggat

SEQ ID NO: 7333875 - DNA, 22 bp, Homo sapiens
caagggcagcagcctcaagcgg

SEQ ID NO: 7333876 - DNA, 22 bp, Homo sapiens
caaggaaaaagcgagctcgggg

SEQ ID NO: 7333877 - DNA, 22 bp, Homo sapiens
caaggaaaacagatgatcaaca

SEQ ID NO: 7333878 - DNA, 22 bp, Homo sapiens
caaggaaacatgaaatgcattg

SEQ ID NO: 7333879 - DNA, 22 bp, Homo sapiens
caaggaaaagaagtatttcaga

SEQ ID NO: 7333880 - DNA, 20 bp, Homo sapiens
agcaattgtgaacttattca

SEQ ID NO: 7333881 - DNA, 22 bp, Homo sapiens
agcaattggaatttagacaaga

SEQ ID NO: 7333882 - DNA, 22 bp, Homo sapiens
agcaattattgtataagaacaa

SEQ ID NO: 7333883 - DNA, 22 bp, Homo sapiens
agcaatgtgacccctgacagca

SEQ ID NO: 7333884 - DNA, 22 bp, Homo sapiens
caagctggctgggagaggcacg

SEQ ID NO: 7333885 - DNA, 22 bp, Homo sapiens
caaggaaggagagatgatgggt

SEQ ID NO: 7333886 - DNA, 22 bp, Homo sapiens
caaggaagttttaggagaggaa

SEQ ID NO: 7333887 - DNA, 22 bp, Homo sapiens
cacaggaaatattaggagggat

SEQ ID NO: 7333888 - DNA, 22 bp, Homo sapiens
cacaggaacaaagaagacaatt

SEQ ID NO: 7333889 - DNA, 22 bp, Homo sapiens
cacaggaagaggtatacaattc

SEQ ID NO: 7333890 - DNA, 22 bp, Homo sapiens
cacagctgccatggctgcactt

SEQ ID NO: 7333891 - DNA, 20 bp, Homo sapiens
cacagaacaaattgcaggac

SEQ ID NO: 7333892 - DNA, 22 bp, Homo sapiens
cacagcagcgttcctccgtgtg

SEQ ID NO: 7333893 - DNA, 22 bp, Homo sapiens
cacagaacatccttagctcatg

SEQ ID NO: 7333894 - DNA, 22 bp, Homo sapiens
cacagaacatccttagctcatg

SEQ ID NO: 7333895 - DNA, 22 bp, Homo sapiens
cacactgttgaggacgagatgt

SEQ ID NO: 7333896 - DNA, 22 bp, Homo sapiens
cacacatgtgagcagagaggcg

SEQ ID NO: 7333897 - DNA, 22 bp, Homo sapiens
cacacatgtgggatccgcaggg

SEQ ID NO: 7333898 - DNA, 22 bp, Homo sapiens
cacacatgtgagcagagaggcg

SEQ ID NO: 7333899 - DNA, 22 bp, Homo sapiens
cacacatgtctctccatgctct

SEQ ID NO: 7333900 - DNA, 22 bp, Homo sapiens
cacacatggctgccagggaggt

SEQ ID NO: 7333901 - DNA, 22 bp, Homo sapiens
caatttttaaactatgaagttg

SEQ ID NO: 7333902 - DNA, 22 bp, Homo sapiens
caatttttgtacttatagtact

SEQ ID NO: 7333903 - DNA, 22 bp, Homo sapiens
caatttctctttatatctcaca

SEQ ID NO: 7333904 - DNA, 22 bp, Homo sapiens
caatttcttgttaattctcagg

SEQ ID NO: 7333905 - DNA, 22 bp, Homo sapiens
cactggggtgggcctggtagag

SEQ ID NO: 7333906 - DNA, 22 bp, Homo sapiens
cactggggaaaacaggcttctt

SEQ ID NO: 7333907 - DNA, 22 bp, Homo sapiens
cactggggtgggcctggtagag

SEQ ID NO: 7333908 - DNA, 22 bp, Homo sapiens
cactggtcagtcggtcagtctc

SEQ ID NO: 7333909 - DNA, 22 bp, Homo sapiens
agcattttctgagagtatagat

SEQ ID NO: 7333910 - DNA, 22 bp, Homo sapiens
cactgggcgtgtcctgggtgag

SEQ ID NO: 7333911 - DNA, 22 bp, Homo sapiens
cactggggaaaacaggcttctt

SEQ ID NO: 7333912 - DNA, 20 bp, Homo sapiens
cactgggctggagtcagggc

SEQ ID NO: 7333913 - DNA, 22 bp, Homo sapiens
cagaaactttctttactgagca

SEQ ID NO: 7333914 - DNA, 22 bp, Homo sapiens
cagaaagacctgattggcagtt

SEQ ID NO: 7333915 - DNA, 22 bp, Homo sapiens
cagaaagacctgggctcaagag

SEQ ID NO: 7333916 - DNA, 22 bp, Homo sapiens
agcatttagtctttattgcagc

SEQ ID NO: 7333917 - DNA, 22 bp, Homo sapiens
agcatttagttagtaaatgttt

SEQ ID NO: 7333918 - DNA, 22 bp, Homo sapiens
agcatttagttagtaaatgttt

SEQ ID NO: 7333919 - DNA, 22 bp, Homo sapiens
agcatttatttcttagaaattg

SEQ ID NO: 7333920 - DNA, 22 bp, Homo sapiens
agcatttatttcttagaaattg

SEQ ID NO: 7333921 - DNA, 22 bp, Homo sapiens
cactgcacttcagcctgggtga

SEQ ID NO: 7333922 - DNA, 22 bp, Homo sapiens
cactgcacttcagcctgggtga

SEQ ID NO: 7333923 - DNA, 22 bp, Homo sapiens
cactgcactccatcctgggaaa

SEQ ID NO: 7333924 - DNA, 22 bp, Homo sapiens
cactgcaacctccagctctcag

SEQ ID NO: 7333925 - DNA, 22 bp, Homo sapiens
cactgcaacctccgcctaccgg

SEQ ID NO: 7333926 - DNA, 22 bp, Homo sapiens
cactgcaacctctgccacctgg

SEQ ID NO: 7333927 - DNA, 22 bp, Homo sapiens
cactgcaacctctgccacctgg

SEQ ID NO: 7333928 - DNA, 22 bp, Homo sapiens
cactgcaagctctgccacctgg

SEQ ID NO: 7333929 - DNA, 22 bp, Homo sapiens
cactgcactccagcactccagc

SEQ ID NO: 7333930 - DNA, 22 bp, Homo sapiens
cactgcactccagcccgggcaa

SEQ ID NO: 7333931 - DNA, 22 bp, Homo sapiens
cactgcactccagcccgggcaa

SEQ ID NO: 7333932 - DNA, 22 bp, Homo sapiens
cactgcaccctcaaactcctgg

SEQ ID NO: 7333933 - DNA, 22 bp, Homo sapiens
cactgcactccagcactccagc

SEQ ID NO: 7333934 - DNA, 22 bp, Homo sapiens
cactgcacaggtgagatgtggg

SEQ ID NO: 7333935 - DNA, 22 bp, Homo sapiens
cactgcaagctctgccacctgg

SEQ ID NO: 7333936 - DNA, 22 bp, Homo sapiens
cactgcaatatctgcatcctgg

SEQ ID NO: 7333937 - DNA, 22 bp, Homo sapiens
cactgcacaatgtagcaaagaa

SEQ ID NO: 7333938 - DNA, 22 bp, Homo sapiens
cactgcactccagcccgggcaa

SEQ ID NO: 7333939 - DNA, 22 bp, Homo sapiens
cactgcactccagcccgggcaa

SEQ ID NO: 7333940 - DNA, 22 bp, Homo sapiens
cactgcactccagcctgcgcaa

SEQ ID NO: 7333941 - DNA, 22 bp, Homo sapiens
cacgttttatgacagaagaagc

SEQ ID NO: 7333942 - DNA, 20 bp, Homo sapiens
cacgtttttccactagcaaa

SEQ ID NO: 7333943 - DNA, 22 bp, Homo sapiens
cacgttttatgacagaagaagc

SEQ ID NO: 7333944 - DNA, 22 bp, Homo sapiens
cacatttaagtgcttgttcaga

SEQ ID NO: 7333945 - DNA, 22 bp, Homo sapiens
cacatttaagcagatgtggacc

SEQ ID NO: 7333946 - DNA, 22 bp, Homo sapiens
cacattgtattgtggaaagtta

SEQ ID NO: 7333947 - DNA, 22 bp, Homo sapiens
cacattgtaggtctcagctctt

SEQ ID NO: 7333948 - DNA, 22 bp, Homo sapiens
cacattgaacttgtctggtggg

SEQ ID NO: 7333949 - DNA, 23 bp, Homo sapiens
cacattgaacactctctttcctg

SEQ ID NO: 7333950 - DNA, 22 bp, Homo sapiens
cacattgataattaaggcctcc

SEQ ID NO: 7333951 - DNA, 22 bp, Homo sapiens
agcaggtggccacgaggaggag

SEQ ID NO: 7333952 - DNA, 22 bp, Homo sapiens
agcaggtggccacgaggaggag

SEQ ID NO: 7333953 - DNA, 22 bp, Homo sapiens
cacatgtcctggcgctgagccc

SEQ ID NO: 7333954 - DNA, 22 bp, Homo sapiens
cacaggctcttctcacttgatt

SEQ ID NO: 7333955 - DNA, 22 bp, Homo sapiens
cacaggctgcccgcagctggga

SEQ ID NO: 7333956 - DNA, 22 bp, Homo sapiens
cacatgaagacctaattggatt

SEQ ID NO: 7333957 - DNA, 23 bp, Homo sapiens
cacatggattaaatgagaccaca

SEQ ID NO: 7333958 - DNA, 23 bp, Homo sapiens
cacatggaggaccgttcttataa

SEQ ID NO: 7333959 - DNA, 22 bp, Homo sapiens
agcaggcctcatgcaccagcta

SEQ ID NO: 7333960 - DNA, 19 bp, Homo sapiens
agcaggccaggcaggtggc

SEQ ID NO: 7333961 - DNA, 22 bp, Homo sapiens
agcaggctactcctgtgttcgt

SEQ ID NO: 7333962 - DNA, 18 bp, Homo sapiens
agcaggcgttgcctggga

SEQ ID NO: 7333963 - DNA, 20 bp, Homo sapiens
agcaggccttggggagagga

SEQ ID NO: 7333964 - DNA, 20 bp, Homo sapiens
agcaggccttggggagagga

SEQ ID NO: 7333965 - DNA, 22 bp, Homo sapiens
cacaggctccggccttgcagcc

SEQ ID NO: 7333966 - DNA, 22 bp, Homo sapiens
agcgccactgcactccagcctg

SEQ ID NO: 7333967 - DNA, 22 bp, Homo sapiens
agcgccactgcactccagcctg

SEQ ID NO: 7333968 - DNA, 22 bp, Homo sapiens
agcgccactgcactccagcctg

SEQ ID NO: 7333969 - DNA, 22 bp, Homo sapiens
agcgagggaggtctgaggacag

SEQ ID NO: 7333970 - DNA, 22 bp, Homo sapiens
agcgagggaggtctgaggacag

SEQ ID NO: 7333971 - DNA, 22 bp, Homo sapiens
cagcatggtgccagtgagtcca

SEQ ID NO: 7333972 - DNA, 22 bp, Homo sapiens
cagcatcaccaacttgagcaat

SEQ ID NO: 7333973 - DNA, 22 bp, Homo sapiens
cagcatcaccaacttgagcaat

SEQ ID NO: 7333974 - DNA, 22 bp, Homo sapiens
cagcagaaaatacctgtaactc

SEQ ID NO: 7333975 - DNA, 22 bp, Homo sapiens
cagcatggacccatcgctgagt

SEQ ID NO: 7333976 - DNA, 22 bp, Homo sapiens
cagcatggggatcactgtaggc

SEQ ID NO: 7333977 - DNA, 22 bp, Homo sapiens
cagcactggggccactggagtt

SEQ ID NO: 7333978 - DNA, 22 bp, Homo sapiens
cagcactgtgataactgagcca

SEQ ID NO: 7333979 - DNA, 22 bp, Homo sapiens
cagcactgggaccactagaaca

SEQ ID NO: 7333980 - DNA, 22 bp, Homo sapiens
cagcactggggccactggagtt

SEQ ID NO: 7333981 - DNA, 22 bp, Homo sapiens
cagcactttagcggaggcatca

SEQ ID NO: 7333982 - DNA, 22 bp, Homo sapiens
cagccccacacggtctagctct

SEQ ID NO: 7333983 - DNA, 22 bp, Homo sapiens
cagccctgggtccctgccctgg

SEQ ID NO: 7333984 - DNA, 22 bp, Homo sapiens
cagcctctaagcacagcctctc

SEQ ID NO: 7333985 - DNA, 22 bp, Homo sapiens
cagcctcctgggacactcaccg

SEQ ID NO: 7333986 - DNA, 22 bp, Homo sapiens
cagcctcctgggacactcaccg

SEQ ID NO: 7333987 - DNA, 22 bp, Homo sapiens
cagcccagtgcacgcccgtttc

SEQ ID NO: 7333988 - DNA, 22 bp, Homo sapiens
cagcccagtaccaagcagttgg

SEQ ID NO: 7333989 - DNA, 22 bp, Homo sapiens
cagcccaggtctctcttccagt

SEQ ID NO: 7333990 - DNA, 22 bp, Homo sapiens
cagcccacttcccagcacctac

SEQ ID NO: 7333991 - DNA, 22 bp, Homo sapiens
cagcccagagaaggggcccgtg

SEQ ID NO: 7333992 - DNA, 21 bp, Homo sapiens
cagcccagagcagtggggcca

SEQ ID NO: 7333993 - DNA, 19 bp, Homo sapiens
cagcccagggtgctaccaa

SEQ ID NO: 7333994 - DNA, 22 bp, Homo sapiens
cagcccagagaaggggcccgtg

SEQ ID NO: 7333995 - DNA, 22 bp, Homo sapiens
cagcccacctggcacgtgtgtt

SEQ ID NO: 7333996 - DNA, 22 bp, Homo sapiens
cagccatgagtctaagcagttt

SEQ ID NO: 7333997 - DNA, 22 bp, Homo sapiens
cagccatcccagcctgtggttc

SEQ ID NO: 7333998 - DNA, 22 bp, Homo sapiens
cagccagtgtgaccgaggagga

SEQ ID NO: 7333999 - DNA, 22 bp, Homo sapiens
cagctgccagcttctctccatc

SEQ ID NO: 7334000 - DNA, 22 bp, Homo sapiens
cagctgccagcttctctccatc

SEQ ID NO: 7334001 - DNA, 18 bp, Homo sapiens
cagctgccagctcatgga

SEQ ID NO: 7334002 - DNA, 22 bp, Homo sapiens
cagctgcccaggccacctggag

SEQ ID NO: 7334003 - DNA, 22 bp, Homo sapiens
agctctggagccggaggatttc

SEQ ID NO: 7334004 - DNA, 22 bp, Homo sapiens
agctctggaagccctggtagtt

SEQ ID NO: 7334005 - DNA, 22 bp, Homo sapiens
cagctgcccctccagggctggg

SEQ ID NO: 7334006 - DNA, 22 bp, Homo sapiens
cagccttcgacagttggagtag

SEQ ID NO: 7334007 - DNA, 22 bp, Homo sapiens
cagcgctggggtaggagcacct

SEQ ID NO: 7334008 - DNA, 22 bp, Homo sapiens
cagcggggcctgtgctggggag

SEQ ID NO: 7334009 - DNA, 22 bp, Homo sapiens
cagcgctggggtaggagcacct

SEQ ID NO: 7334010 - DNA, 22 bp, Homo sapiens
cagcgagagacaaagagctgtg

SEQ ID NO: 7334011 - DNA, 23 bp, Homo sapiens
agctctggcgttggggaggtagt

SEQ ID NO: 7334012 - DNA, 22 bp, Homo sapiens
agctctggagccggaggatttc

SEQ ID NO: 7334013 - DNA, 22 bp, Homo sapiens
agctctggcactggcgcgggat

SEQ ID NO: 7334014 - DNA, 22 bp, Homo sapiens
agctgaagatccagggttgggg

SEQ ID NO: 7334015 - DNA, 20 bp, Homo sapiens
agctgaagatctggatgggg

SEQ ID NO: 7334016 - DNA, 22 bp, Homo sapiens
agctgaggacgtgaagggcggc

SEQ ID NO: 7334017 - DNA, 20 bp, Homo sapiens
agctgaggcacctgaggtta

SEQ ID NO: 7334018 - DNA, 22 bp, Homo sapiens
cagctggcatacctgggcccgg

SEQ ID NO: 7334019 - DNA, 22 bp, Homo sapiens
cagctggcaagtggagcagggt

SEQ ID NO: 7334020 - DNA, 22 bp, Homo sapiens
agccgctgtctcttgggccgcg

SEQ ID NO: 7334021 - DNA, 22 bp, Homo sapiens
agccggcaataggaaaggagag

SEQ ID NO: 7334022 - DNA, 22 bp, Homo sapiens
agcccttagtacatttctcaag

SEQ ID NO: 7334023 - DNA, 22 bp, Homo sapiens
cagatattaggagctcaataat

SEQ ID NO: 7334024 - DNA, 22 bp, Homo sapiens
agcctattccaggatgagctca

SEQ ID NO: 7334025 - DNA, 22 bp, Homo sapiens
cagatcctgccaggctgagttg

SEQ ID NO: 7334026 - DNA, 22 bp, Homo sapiens
agcctgagtgcttaggactgtt

SEQ ID NO: 7334027 - DNA, 22 bp, Homo sapiens
agccctctctttagagatctga

SEQ ID NO: 7334028 - DNA, 22 bp, Homo sapiens
agccctcctggggccacgctgg

SEQ ID NO: 7334029 - DNA, 22 bp, Homo sapiens
cagaggagaattgcgggatcat

SEQ ID NO: 7334030 - DNA, 22 bp, Homo sapiens
cagaggagaattgcgggatcat

SEQ ID NO: 7334031 - DNA, 22 bp, Homo sapiens
cagaggagaattgcgggatcat

SEQ ID NO: 7334032 - DNA, 18 bp, Homo sapiens
cagaggagagacattcag

SEQ ID NO: 7334033 - DNA, 17 bp, Homo sapiens
cagaggagctttggggg

SEQ ID NO: 7334034 - DNA, 22 bp, Homo sapiens
cagaggaggccaccgcataggc

SEQ ID NO: 7334035 - DNA, 22 bp, Homo sapiens
cagaggaggcggtatacactgc

SEQ ID NO: 7334036 - DNA, 20 bp, Homo sapiens
cagaggagtacatatgttca

SEQ ID NO: 7334037 - DNA, 22 bp, Homo sapiens
cagaggagtgggccgttatggt

SEQ ID NO: 7334038 - DNA, 22 bp, Homo sapiens
cagagtgaaaactgagctcaaa

SEQ ID NO: 7334039 - DNA, 22 bp, Homo sapiens
cagagtgataaatatagaaatt

SEQ ID NO: 7334040 - DNA, 22 bp, Homo sapiens
cagagtgattatggaggattgc

SEQ ID NO: 7334041 - DNA, 21 bp, Homo sapiens
cagaggtggcctgacctctga

SEQ ID NO: 7334042 - DNA, 22 bp, Homo sapiens
cagagtgaaataggggatcaag

SEQ ID NO: 7334043 - DNA, 22 bp, Homo sapiens
cagagtgagggcctgcacctgc

SEQ ID NO: 7334044 - DNA, 22 bp, Homo sapiens
agccagggatggcagtgcccag

SEQ ID NO: 7334045 - DNA, 22 bp, Homo sapiens
agccagggctctccttcgcgtg

SEQ ID NO: 7334046 - DNA, 22 bp, Homo sapiens
agccagggctctccttcgcgtg

SEQ ID NO: 7334047 - DNA, 22 bp, Homo sapiens
agccagggaggattacacccca

SEQ ID NO: 7334048 - DNA, 22 bp, Homo sapiens
agccagggaggtggaggttgca

SEQ ID NO: 7334049 - DNA, 22 bp, Homo sapiens
agccagggctgcaggttccttg

SEQ ID NO: 7334050 - DNA, 22 bp, Homo sapiens
agccaagacatttagaaaagct

SEQ ID NO: 7334051 - DNA, 22 bp, Homo sapiens
agccaggccttttctcaaggtt

SEQ ID NO: 7334052 - DNA, 22 bp, Homo sapiens
agccagggaagaggcctacctc

SEQ ID NO: 7334053 - DNA, 22 bp, Homo sapiens
agccaggctgcagttggctggc

SEQ ID NO: 7334054 - DNA, 22 bp, Homo sapiens
agccagggaagaggcctacctc

SEQ ID NO: 7334055 - DNA, 22 bp, Homo sapiens
cagagccagtcagtcagaaact

SEQ ID NO: 7334056 - DNA, 22 bp, Homo sapiens
cagagccaggtctaggagtctc

SEQ ID NO: 7334057 - DNA, 22 bp, Homo sapiens
cagagccagggttgcacccctg

SEQ ID NO: 7334058 - DNA, 22 bp, Homo sapiens
cagagccaggcctgccctcttt

SEQ ID NO: 7334059 - DNA, 22 bp, Homo sapiens
cagagcagtctggagatccagc

SEQ ID NO: 7334060 - DNA, 22 bp, Homo sapiens
cagagcagtaaatctggggcac

SEQ ID NO: 7334061 - DNA, 21 bp, Homo sapiens
cagagctgtccaaaccctgac

SEQ ID NO: 7334062 - DNA, 21 bp, Homo sapiens
cagagctgtccaaaccctgac

SEQ ID NO: 7334063 - DNA, 22 bp, Homo sapiens
cagagctgtccaaaccctgaca

SEQ ID NO: 7334064 - DNA, 22 bp, Homo sapiens
cagagctgtccaaaccctgaca

SEQ ID NO: 7334065 - DNA, 20 bp, Homo sapiens
cagagctgttatggatgatg

SEQ ID NO: 7334066 - DNA, 22 bp, Homo sapiens
cagagctgttgcggggcttggc

SEQ ID NO: 7334067 - DNA, 22 bp, Homo sapiens
cagagctgttgcggggcttggc

SEQ ID NO: 7334068 - DNA, 22 bp, Homo sapiens
caaagttttagtaaacatatat

SEQ ID NO: 7334069 - DNA, 22 bp, Homo sapiens
caaagtttaaagtagatttcag

SEQ ID NO: 7334070 - DNA, 22 bp, Homo sapiens
caaagtgggtgccctgatgctc

SEQ ID NO: 7334071 - DNA, 22 bp, Homo sapiens
caaagtggctggccgggagatc

SEQ ID NO: 7334072 - DNA, 22 bp, Homo sapiens
agcaatatttcagctagcaggt

SEQ ID NO: 7334073 - DNA, 22 bp, Homo sapiens
caaacattgctaccagaggttt

SEQ ID NO: 7334074 - DNA, 22 bp, Homo sapiens
agcaatatttaaaggtttgcaa

SEQ ID NO: 7334075 - DNA, 22 bp, Homo sapiens
agcaatataaatgttgggtaga

SEQ ID NO: 7334076 - DNA, 22 bp, Homo sapiens
agcaatatgacattgctacatc

SEQ ID NO: 7334077 - DNA, 22 bp, Homo sapiens
caaacatttgacttctctcagg

SEQ ID NO: 7334078 - DNA, 23 bp, Homo sapiens
agcaataagaagggatacatgtg

SEQ ID NO: 7334079 - DNA, 19 bp, Homo sapiens
agcaaggtgcctcctcccc

SEQ ID NO: 7334080 - DNA, 22 bp, Homo sapiens
attttgttgatggtggagtagc

SEQ ID NO: 7334081 - DNA, 22 bp, Homo sapiens
attttgttgaggtaattgtcaa

SEQ ID NO: 7334082 - DNA, 22 bp, Homo sapiens
agatgagaatttttagagtgct

SEQ ID NO: 7334083 - DNA, 22 bp, Homo sapiens
agatgacaatgaggttgttatt

SEQ ID NO: 7334084 - DNA, 22 bp, Homo sapiens
atttgaaatctgggttactctg

SEQ ID NO: 7334085 - DNA, 22 bp, Homo sapiens
atttgaaccactcagaactcat

SEQ ID NO: 7334086 - DNA, 22 bp, Homo sapiens
atttgaaatcccttctactgta

SEQ ID NO: 7334087 - DNA, 22 bp, Homo sapiens
atttcttgcccctgctccctga

SEQ ID NO: 7334088 - DNA, 22 bp, Homo sapiens
atttctgataaacgtaagctgc

SEQ ID NO: 7334089 - DNA, 23 bp, Homo sapiens
atttacagctgtgtgagcaagtt

SEQ ID NO: 7334090 - DNA, 22 bp, Homo sapiens
agatgtttgtaaacacactgct

SEQ ID NO: 7334091 - DNA, 22 bp, Homo sapiens
agatgtttgtgttatctccatt

SEQ ID NO: 7334092 - DNA, 22 bp, Homo sapiens
agattctaccagagctagtttg

SEQ ID NO: 7334093 - DNA, 22 bp, Homo sapiens
agatttaaagcagtattcgcaa

SEQ ID NO: 7334094 - DNA, 22 bp, Homo sapiens
agatttaaatttgctacaattc

SEQ ID NO: 7334095 - DNA, 22 bp, Homo sapiens
agatttagtggtggaattttgg

SEQ ID NO: 7334096 - DNA, 22 bp, Homo sapiens
agatttatgtggtcacactcag

SEQ ID NO: 7334097 - DNA, 23 bp, Homo sapiens
agatttaatgttatattctgggc

SEQ ID NO: 7334098 - DNA, 22 bp, Homo sapiens
agatttcaatgtgagcattagt

SEQ ID NO: 7334099 - DNA, 22 bp, Homo sapiens
agatttcaatgtgagcattagt

SEQ ID NO: 7334100 - DNA, 22 bp, Homo sapiens
agatttcaatggatattgcaag

SEQ ID NO: 7334101 - DNA, 22 bp, Homo sapiens
agatttatgtggtcacactcag

SEQ ID NO: 7334102 - DNA, 20 bp, Homo sapiens
attctccctatactcacttt

SEQ ID NO: 7334103 - DNA, 22 bp, Homo sapiens
agaggaagccattgcttactga

SEQ ID NO: 7334104 - DNA, 22 bp, Homo sapiens
agaggccaggtccagagtttgt

SEQ ID NO: 7334105 - DNA, 22 bp, Homo sapiens
agaggaaatggataaagggtga

SEQ ID NO: 7334106 - DNA, 22 bp, Homo sapiens
agagcttgtaattgagtcaggt

SEQ ID NO: 7334107 - DNA, 22 bp, Homo sapiens
attgagaagaaaatctaatata

SEQ ID NO: 7334108 - DNA, 22 bp, Homo sapiens
attgaaagcacaaagaacaagt

SEQ ID NO: 7334109 - DNA, 22 bp, Homo sapiens
attgaaagcatggatttggatt

SEQ ID NO: 7334110 - DNA, 22 bp, Homo sapiens
attgaaagatatactgttctca

SEQ ID NO: 7334111 - DNA, 22 bp, Homo sapiens
attgaaagattttgggctcatg

SEQ ID NO: 7334112 - DNA, 22 bp, Homo sapiens
attgaaagtcctatctaaggga

SEQ ID NO: 7334113 - DNA, 22 bp, Homo sapiens
attgaaaggcaaagtaggaagc

SEQ ID NO: 7334114 - DNA, 22 bp, Homo sapiens
attgaaaggttttgagcagata

SEQ ID NO: 7334115 - DNA, 21 bp, Homo sapiens
attgaaagtcaacaatcagtt

SEQ ID NO: 7334116 - DNA, 22 bp, Homo sapiens
attgaaaatataattctaggag

SEQ ID NO: 7334117 - DNA, 22 bp, Homo sapiens
attgaaagagaatgtagctctt

SEQ ID NO: 7334118 - DNA, 22 bp, Homo sapiens
attgaaagataggctactgtgg

SEQ ID NO: 7334119 - DNA, 22 bp, Homo sapiens
attgaaagagttttctgctgca

SEQ ID NO: 7334120 - DNA, 22 bp, Homo sapiens
attgaaaataaggccagaaaca

SEQ ID NO: 7334121 - DNA, 19 bp, Homo sapiens
attgagcattacaaataga

SEQ ID NO: 7334122 - DNA, 23 bp, Homo sapiens
attgagcaagcttttgcctaagt

SEQ ID NO: 7334123 - DNA, 22 bp, Homo sapiens
attgagcacaaacgttactaga

SEQ ID NO: 7334124 - DNA, 22 bp, Homo sapiens
attgagcacctactttgtgcca

SEQ ID NO: 7334125 - DNA, 22 bp, Homo sapiens
attgagcagcttctctgccatc

SEQ ID NO: 7334126 - DNA, 22 bp, Homo sapiens
attgagagtgtatagctgatct

SEQ ID NO: 7334127 - DNA, 22 bp, Homo sapiens
attgtataacagcatgtatttt

SEQ ID NO: 7334128 - DNA, 22 bp, Homo sapiens
attgtgctgctgctgacgttta

SEQ ID NO: 7334129 - DNA, 22 bp, Homo sapiens
attgtgcttcctgaaatttgat

SEQ ID NO: 7334130 - DNA, 22 bp, Homo sapiens
attgtgtggtgaatgatcagct

SEQ ID NO: 7334131 - DNA, 22 bp, Homo sapiens
attgtgtagtagtattctgttt

SEQ ID NO: 7334132 - DNA, 22 bp, Homo sapiens
attgtgtagtagtattctgttt

SEQ ID NO: 7334133 - DNA, 22 bp, Homo sapiens
attgtgtatgttaattctgtaa

SEQ ID NO: 7334134 - DNA, 22 bp, Homo sapiens
attgtgtatgttaattctgtaa

SEQ ID NO: 7334135 - DNA, 22 bp, Homo sapiens
attgtgtggtgaatgatcagct

SEQ ID NO: 7334136 - DNA, 22 bp, Homo sapiens
agatacacttgttccttccact

SEQ ID NO: 7334137 - DNA, 22 bp, Homo sapiens
agatacagacctcttattaagg

SEQ ID NO: 7334138 - DNA, 22 bp, Homo sapiens
atttacagatgatgctatttga

SEQ ID NO: 7334139 - DNA, 22 bp, Homo sapiens
agatacacagagcatcttcaga

SEQ ID NO: 7334140 - DNA, 22 bp, Homo sapiens
agatacaactgtttaaacatta

SEQ ID NO: 7334141 - DNA, 22 bp, Homo sapiens
agatacaaaggcctacagagca

SEQ ID NO: 7334142 - DNA, 22 bp, Homo sapiens
agataaattcctaagatttcag

SEQ ID NO: 7334143 - DNA, 22 bp, Homo sapiens
atggacaggtactgcagtgggt

SEQ ID NO: 7334144 - DNA, 22 bp, Homo sapiens
atggacaggtggataggtggat

SEQ ID NO: 7334145 - DNA, 22 bp, Homo sapiens
atggacaggtactgcagtgggt

SEQ ID NO: 7334146 - DNA, 16 bp, Homo sapiens
atgggcagtgaggaag

SEQ ID NO: 7334147 - DNA, 22 bp, Homo sapiens
atgggcagtaacagtggcagtc

SEQ ID NO: 7334148 - DNA, 22 bp, Homo sapiens
atgggcagtgtattggaaggaa

SEQ ID NO: 7334149 - DNA, 22 bp, Homo sapiens
atgggcagtgtattggaaggaa

SEQ ID NO: 7334150 - DNA, 22 bp, Homo sapiens
atgggcagttaggaggccagga

SEQ ID NO: 7334151 - DNA, 22 bp, Homo sapiens
atgggcagttaggaggccagga

SEQ ID NO: 7334152 - DNA, 22 bp, Homo sapiens
agagaacagtgttttgaaggag

SEQ ID NO: 7334153 - DNA, 22 bp, Homo sapiens
agagaacagcctcctagagaaa

SEQ ID NO: 7334154 - DNA, 22 bp, Homo sapiens
agagaacatattttgtatgatt

SEQ ID NO: 7334155 - DNA, 22 bp, Homo sapiens
agagaacattagcaaaaacagc

SEQ ID NO: 7334156 - DNA, 22 bp, Homo sapiens
agagaacattagcaaaaacagc

SEQ ID NO: 7334157 - DNA, 22 bp, Homo sapiens
atggacagctgacactcacatt

SEQ ID NO: 7334158 - DNA, 22 bp, Homo sapiens
atggacagagctgagctccacc

SEQ ID NO: 7334159 - DNA, 17 bp, Homo sapiens
agagagaaaagggccat

SEQ ID NO: 7334160 - DNA, 22 bp, Homo sapiens
agagagaagcaatcagtggcca

SEQ ID NO: 7334161 - DNA, 22 bp, Homo sapiens
atgtacatagcatcatctagga

SEQ ID NO: 7334162 - DNA, 19 bp, Homo sapiens
atgtaggggagttgtgaag

SEQ ID NO: 7334163 - DNA, 18 bp, Homo sapiens
agagatgggagttggaaa

SEQ ID NO: 7334164 - DNA, 18 bp, Homo sapiens
agagatgggagttggaaa

SEQ ID NO: 7334165 - DNA, 22 bp, Homo sapiens
atgtatatgaagctagtatttt

SEQ ID NO: 7334166 - DNA, 22 bp, Homo sapiens
atgtatacgtgcaagtcacagg

SEQ ID NO: 7334167 - DNA, 22 bp, Homo sapiens
atgtagttgaagtgctataaag

SEQ ID NO: 7334168 - DNA, 22 bp, Homo sapiens
atgttacagaaagcaaagatga

SEQ ID NO: 7334169 - DNA, 22 bp, Homo sapiens
atgttacagaaagcaaagatga

SEQ ID NO: 7334170 - DNA, 22 bp, Homo sapiens
atgtgcatgtgcacacatgcgt

SEQ ID NO: 7334171 - DNA, 18 bp, Homo sapiens
agagatggtgtagagttt

SEQ ID NO: 7334172 - DNA, 22 bp, Homo sapiens
atgtgcaacttcagcagaaagg

SEQ ID NO: 7334173 - DNA, 22 bp, Homo sapiens
attaaatactgcaggctaagca

SEQ ID NO: 7334174 - DNA, 22 bp, Homo sapiens
attaaggaacaaagccttttga

SEQ ID NO: 7334175 - DNA, 22 bp, Homo sapiens
attaagtgactaaagtaatgct

SEQ ID NO: 7334176 - DNA, 22 bp, Homo sapiens
attaaggaagcctattctctcc

SEQ ID NO: 7334177 - DNA, 18 bp, Homo sapiens
attaaggaattctttaga

SEQ ID NO: 7334178 - DNA, 22 bp, Homo sapiens
attaaggaatgtaggcaagaag

SEQ ID NO: 7334179 - DNA, 18 bp, Homo sapiens
attaaggaattctttaga

SEQ ID NO: 7334180 - DNA, 22 bp, Homo sapiens
attaaggagggctgggcatgat

SEQ ID NO: 7334181 - DNA, 22 bp, Homo sapiens
attaaggaggtaaactatggtt

SEQ ID NO: 7334182 - DNA, 22 bp, Homo sapiens
attaaggattatactctccttt

SEQ ID NO: 7334183 - DNA, 22 bp, Homo sapiens
agagcgagtctggggctcggat

SEQ ID NO: 7334184 - DNA, 21 bp, Homo sapiens
atgttcactgggtcaattaga

SEQ ID NO: 7334185 - DNA, 21 bp, Homo sapiens
atgttcactgggtcaattaga

SEQ ID NO: 7334186 - DNA, 22 bp, Homo sapiens
atgactgttatgggactggaac

SEQ ID NO: 7334187 - DNA, 22 bp, Homo sapiens
atgaccagccgagataaacaga

SEQ ID NO: 7334188 - DNA, 22 bp, Homo sapiens
atcttaaacagaggaatgactt

SEQ ID NO: 7334189 - DNA, 21 bp, Homo sapiens
atcttaaaaggtcttaacttt

SEQ ID NO: 7334190 - DNA, 22 bp, Homo sapiens
atctggctgactttgtgggaca

SEQ ID NO: 7334191 - DNA, 22 bp, Homo sapiens
atctggctgagcgaggcccaca

SEQ ID NO: 7334192 - DNA, 22 bp, Homo sapiens
atctggctgctgtgcttaagct

SEQ ID NO: 7334193 - DNA, 17 bp, Homo sapiens
atctggctgcttctaga

SEQ ID NO: 7334194 - DNA, 22 bp, Homo sapiens
atctggctggattcttagcgtt

SEQ ID NO: 7334195 - DNA, 22 bp, Homo sapiens
atctggcttacctagggtgcct

SEQ ID NO: 7334196 - DNA, 22 bp, Homo sapiens
atctggcttttaccccacggcc

SEQ ID NO: 7334197 - DNA, 22 bp, Homo sapiens
atctggcttttactgaattgct

SEQ ID NO: 7334198 - DNA, 22 bp, Homo sapiens
atctggctttcttaatgactta

SEQ ID NO: 7334199 - DNA, 22 bp, Homo sapiens
atctggcttgggtgtgggtagc

SEQ ID NO: 7334200 - DNA, 22 bp, Homo sapiens
atctggcttgactttgcgactt

SEQ ID NO: 7334201 - DNA, 22 bp, Homo sapiens
atctggcttacgaagcactggt

SEQ ID NO: 7334202 - DNA, 22 bp, Homo sapiens
atgaggagccctcatttaggtt

SEQ ID NO: 7334203 - DNA, 22 bp, Homo sapiens
atgaggagaccaaggcctgatg

SEQ ID NO: 7334204 - DNA, 22 bp, Homo sapiens
atgagaaagagttgtatctaga

SEQ ID NO: 7334205 - DNA, 19 bp, Homo sapiens
atgaggaactgaggctcag

SEQ ID NO: 7334206 - DNA, 22 bp, Homo sapiens
atgaggaggccagtaagagcct

SEQ ID NO: 7334207 - DNA, 22 bp, Homo sapiens
atgaggagctgttttaactgct

SEQ ID NO: 7334208 - DNA, 22 bp, Homo sapiens
atgacttctgcaaggtcatttg

SEQ ID NO: 7334209 - DNA, 22 bp, Homo sapiens
atgacttctgctttacagagtt

SEQ ID NO: 7334210 - DNA, 22 bp, Homo sapiens
atgagaaaattgaggcccatag

SEQ ID NO: 7334211 - DNA, 22 bp, Homo sapiens
atgagaaaattcattccatcca

SEQ ID NO: 7334212 - DNA, 22 bp, Homo sapiens
atgaggcaaggctggccgtgtt

SEQ ID NO: 7334213 - DNA, 22 bp, Homo sapiens
atgaggcaaggctggccgtgtt

SEQ ID NO: 7334214 - DNA, 22 bp, Homo sapiens
atgaggcaaggatcaggtaagg

SEQ ID NO: 7334215 - DNA, 22 bp, Homo sapiens
atgaggcaaaggtggaggtggg

SEQ ID NO: 7334216 - DNA, 22 bp, Homo sapiens
atgaggcaatagaatattgaat

SEQ ID NO: 7334217 - DNA, 22 bp, Homo sapiens
atgaggcaatcatggtccagtt

SEQ ID NO: 7334218 - DNA, 22 bp, Homo sapiens
atgaggcacagagatgttaatg

SEQ ID NO: 7334219 - DNA, 22 bp, Homo sapiens
atgaggcacatcacagccaatg

SEQ ID NO: 7334220 - DNA, 22 bp, Homo sapiens
atgaggcacgtgttactggcct

SEQ ID NO: 7334221 - DNA, 22 bp, Homo sapiens
atgatttaaagtcattgtgaac

SEQ ID NO: 7334222 - DNA, 22 bp, Homo sapiens
atgatttccagttgttgctaag

SEQ ID NO: 7334223 - DNA, 22 bp, Homo sapiens
atgatttccagttgttgctaag

SEQ ID NO: 7334224 - DNA, 22 bp, Homo sapiens
atgcaaatgtcaccacttctaa

SEQ ID NO: 7334225 - DNA, 22 bp, Homo sapiens
atgattttctgataaagaactg

SEQ ID NO: 7334226 - DNA, 22 bp, Homo sapiens
atgcaaattaacatatagtaga

SEQ ID NO: 7334227 - DNA, 22 bp, Homo sapiens
atgattgaaaatgacattgcca

SEQ ID NO: 7334228 - DNA, 22 bp, Homo sapiens
atgattgaccatctgctgggct

SEQ ID NO: 7334229 - DNA, 20 bp, Homo sapiens
atgattcatgatgatgtctc

SEQ ID NO: 7334230 - DNA, 22 bp, Homo sapiens
atgctgaactgagatgtaactt

SEQ ID NO: 7334231 - DNA, 22 bp, Homo sapiens
atgctaaactatgatcattttc

SEQ ID NO: 7334232 - DNA, 22 bp, Homo sapiens
atgctaaactatgatcattttc

SEQ ID NO: 7334233 - DNA, 22 bp, Homo sapiens
atgctgaaatttattggtaagg

SEQ ID NO: 7334234 - DNA, 22 bp, Homo sapiens
atgctaaaaacttgatcattat

SEQ ID NO: 7334235 - DNA, 22 bp, Homo sapiens
atgctgaagtgtgtttgaagta

SEQ ID NO: 7334236 - DNA, 22 bp, Homo sapiens
atgctgaagagttcatgattat

SEQ ID NO: 7334237 - DNA, 22 bp, Homo sapiens
atgctgaatagttcactcttct

SEQ ID NO: 7334238 - DNA, 22 bp, Homo sapiens
atgctgacttctctctgcagtg

SEQ ID NO: 7334239 - DNA, 22 bp, Homo sapiens
agagaacaaattaaaggtggtt

SEQ ID NO: 7334240 - DNA, 22 bp, Homo sapiens
agagaacaaattaaaggtggtt

SEQ ID NO: 7334241 - DNA, 22 bp, Homo sapiens
agagaacagcattgcagctttg

SEQ ID NO: 7334242 - DNA, 22 bp, Homo sapiens
agagaacagacagatgcaatga

SEQ ID NO: 7334243 - DNA, 22 bp, Homo sapiens
agagaaaagccatcccagccaa

SEQ ID NO: 7334244 - DNA, 22 bp, Homo sapiens
atgcttccctttgctccacatg

SEQ ID NO: 7334245 - DNA, 22 bp, Homo sapiens
atgcttcagatttggggtatta

SEQ ID NO: 7334246 - DNA, 22 bp, Homo sapiens
agacagtgtgagttcagggtgg

SEQ ID NO: 7334247 - DNA, 22 bp, Homo sapiens
agacataaacttactgaaatac

SEQ ID NO: 7334248 - DNA, 22 bp, Homo sapiens
agacagttgatatactataaaa

SEQ ID NO: 7334249 - DNA, 22 bp, Homo sapiens
agacataattaattagttctac

SEQ ID NO: 7334250 - DNA, 22 bp, Homo sapiens
atgccatttcaaaataagattt

SEQ ID NO: 7334251 - DNA, 22 bp, Homo sapiens
atgccagaccatccagttggga

SEQ ID NO: 7334252 - DNA, 22 bp, Homo sapiens
atgccacttctctaagtcatgt

SEQ ID NO: 7334253 - DNA, 22 bp, Homo sapiens
atgccacttctctaagtcatgt

SEQ ID NO: 7334254 - DNA, 22 bp, Homo sapiens
atgccacataattacaaataga

SEQ ID NO: 7334255 - DNA, 22 bp, Homo sapiens
aagaatctccatctgattcact

SEQ ID NO: 7334256 - DNA, 23 bp, Homo sapiens
aagaatctcagaattagaaatac

SEQ ID NO: 7334257 - DNA, 22 bp, Homo sapiens
acaaatgactatttggtacagg

SEQ ID NO: 7334258 - DNA, 22 bp, Homo sapiens
acaaatgaatcatacataatgt

SEQ ID NO: 7334259 - DNA, 22 bp, Homo sapiens
acaaaagtgagtgtgtctcaga

SEQ ID NO: 7334260 - DNA, 22 bp, Homo sapiens
aagaatcatagagccactgata

SEQ ID NO: 7334261 - DNA, 17 bp, Homo sapiens
aagaatcattagagaag

SEQ ID NO: 7334262 - DNA, 22 bp, Homo sapiens
aagaatcattgtaaagttctgt

SEQ ID NO: 7334263 - DNA, 22 bp, Homo sapiens
aagaatcatctgaactttgagg

SEQ ID NO: 7334264 - DNA, 22 bp, Homo sapiens
aagaagatggttaactttcagt

SEQ ID NO: 7334265 - DNA, 22 bp, Homo sapiens
acaaaacagtgttcctgcccct

SEQ ID NO: 7334266 - DNA, 22 bp, Homo sapiens
aagaacttttggcaagtgttat

SEQ ID NO: 7334267 - DNA, 22 bp, Homo sapiens
aatgtacaataagacaaagagg

SEQ ID NO: 7334268 - DNA, 22 bp, Homo sapiens
aagaacattgatattgtctatg

SEQ ID NO: 7334269 - DNA, 22 bp, Homo sapiens
aagaacagtgtcctgggactcg

SEQ ID NO: 7334270 - DNA, 22 bp, Homo sapiens
acaaatttcataggcaaatttt

SEQ ID NO: 7334271 - DNA, 22 bp, Homo sapiens
acaaatttcataggcaaatttt

SEQ ID NO: 7334272 - DNA, 22 bp, Homo sapiens
acaaatttgtgtagttatggca

SEQ ID NO: 7334273 - DNA, 22 bp, Homo sapiens
acaaatttgaatcctgacttct

SEQ ID NO: 7334274 - DNA, 22 bp, Homo sapiens
acaaatttggtgagagtaaata

SEQ ID NO: 7334275 - DNA, 21 bp, Homo sapiens
acaatgtcaaggtcagacatt

SEQ ID NO: 7334276 - DNA, 22 bp, Homo sapiens
acaatgtcaaaataggaaacat

SEQ ID NO: 7334277 - DNA, 22 bp, Homo sapiens
acaatgttctacatatacataa

SEQ ID NO: 7334278 - DNA, 23 bp, Homo sapiens
acaatgtctgttcataaaatacc

SEQ ID NO: 7334279 - DNA, 22 bp, Homo sapiens
acaatgtctttgtctccttcag

SEQ ID NO: 7334280 - DNA, 22 bp, Homo sapiens
acaatgtctcatattcgtgttc

SEQ ID NO: 7334281 - DNA, 22 bp, Homo sapiens
acaatgtctgctatttggctct

SEQ ID NO: 7334282 - DNA, 22 bp, Homo sapiens
acaatgtcacctctcatgtttt

SEQ ID NO: 7334283 - DNA, 22 bp, Homo sapiens
acaatatagtccatgagcatgc

SEQ ID NO: 7334284 - DNA, 22 bp, Homo sapiens
acacagcaacttgcagtatgga

SEQ ID NO: 7334285 - DNA, 22 bp, Homo sapiens
acacagcaacttgcagtatgga

SEQ ID NO: 7334286 - DNA, 22 bp, Homo sapiens
acacagcaaggtctgactttgg

SEQ ID NO: 7334287 - DNA, 22 bp, Homo sapiens
acacagcaaggtctgactttgg

SEQ ID NO: 7334288 - DNA, 22 bp, Homo sapiens
acacagagcttctcaactggga

SEQ ID NO: 7334289 - DNA, 22 bp, Homo sapiens
acaatgttctacatatacataa

SEQ ID NO: 7334290 - DNA, 22 bp, Homo sapiens
acaatgttctctgagttgtgtg

SEQ ID NO: 7334291 - DNA, 22 bp, Homo sapiens
acaatgttctgtctgacttgtc

SEQ ID NO: 7334292 - DNA, 22 bp, Homo sapiens
acacacatgcctttcctaagta

SEQ ID NO: 7334293 - DNA, 20 bp, Homo sapiens
acacagactcagcttggatg

SEQ ID NO: 7334294 - DNA, 17 bp, Homo sapiens
acacagacaggcagaca

SEQ ID NO: 7334295 - DNA, 17 bp, Homo sapiens
acacagacaggcagaca

SEQ ID NO: 7334296 - DNA, 20 bp, Homo sapiens
acacagactcagcttggatg

SEQ ID NO: 7334297 - DNA, 22 bp, Homo sapiens
acacagccgtgaatctgcttct

SEQ ID NO: 7334298 - DNA, 22 bp, Homo sapiens
aagataatgttctagctgtcag

SEQ ID NO: 7334299 - DNA, 22 bp, Homo sapiens
aagatacaaatgtcaatattgg

SEQ ID NO: 7334300 - DNA, 22 bp, Homo sapiens
acagacatttaataaatgctga

SEQ ID NO: 7334301 - DNA, 22 bp, Homo sapiens
acagacatttaataaatgctga

SEQ ID NO: 7334302 - DNA, 23 bp, Homo sapiens
acagaaatcatttgtaaggtacc

SEQ ID NO: 7334303 - DNA, 23 bp, Homo sapiens
acagaaatcatttgtaaggtacc

SEQ ID NO: 7334304 - DNA, 18 bp, Homo sapiens
acagaaatagctgtgcct

SEQ ID NO: 7334305 - DNA, 22 bp, Homo sapiens
acagaaatatagaaggtaggaa

SEQ ID NO: 7334306 - DNA, 22 bp, Homo sapiens
acagagcaacttgagtatcctc

SEQ ID NO: 7334307 - DNA, 22 bp, Homo sapiens
acagagatgtggatgagggatt

SEQ ID NO: 7334308 - DNA, 22 bp, Homo sapiens
acagagatggcacagagaaggt

SEQ ID NO: 7334309 - DNA, 22 bp, Homo sapiens
acagagatggcacagagaaggt

SEQ ID NO: 7334310 - DNA, 22 bp, Homo sapiens
acagagatgaattagacagggt

SEQ ID NO: 7334311 - DNA, 22 bp, Homo sapiens
acagacctgggcacagaaagga

SEQ ID NO: 7334312 - DNA, 22 bp, Homo sapiens
acagagatgaataatacaggtg

SEQ ID NO: 7334313 - DNA, 22 bp, Homo sapiens
acacttgttaagaagaggatat

SEQ ID NO: 7334314 - DNA, 22 bp, Homo sapiens
acacttgtgttgaaagctgtta

SEQ ID NO: 7334315 - DNA, 22 bp, Homo sapiens
acacttgtggcctttctagtaa

SEQ ID NO: 7334316 - DNA, 22 bp, Homo sapiens
acactttaagcatttcacactg

SEQ ID NO: 7334317 - DNA, 22 bp, Homo sapiens
acactttaagcatttcacactg

SEQ ID NO: 7334318 - DNA, 22 bp, Homo sapiens
acactttacagaatgttttgat

SEQ ID NO: 7334319 - DNA, 22 bp, Homo sapiens
acacttgtggcctttctagtaa

SEQ ID NO: 7334320 - DNA, 22 bp, Homo sapiens
acacttggagcaacacttatgg

SEQ ID NO: 7334321 - DNA, 22 bp, Homo sapiens
acacttggagcaacacttatgg

SEQ ID NO: 7334322 - DNA, 20 bp, Homo sapiens
acacatatagcagcataaac

SEQ ID NO: 7334323 - DNA, 22 bp, Homo sapiens
acacataagcctaatcatctcc

SEQ ID NO: 7334324 - DNA, 22 bp, Homo sapiens
aagatacataaaggtagagtct

SEQ ID NO: 7334325 - DNA, 22 bp, Homo sapiens
aagatacacgttgtattgaata

SEQ ID NO: 7334326 - DNA, 22 bp, Homo sapiens
aagccaggttccatggaggagc

SEQ ID NO: 7334327 - DNA, 23 bp, Homo sapiens
acagccaggatgggagcagaagc

SEQ ID NO: 7334328 - DNA, 22 bp, Homo sapiens
acagccagggacatacaatggt

SEQ ID NO: 7334329 - DNA, 22 bp, Homo sapiens
aagcccagcatccctgcaccag

SEQ ID NO: 7334330 - DNA, 22 bp, Homo sapiens
aagcccagatgtgagaactgag

SEQ ID NO: 7334331 - DNA, 22 bp, Homo sapiens
acagccaggagccatgggcagg

SEQ ID NO: 7334332 - DNA, 22 bp, Homo sapiens
acagccaggagccatgggcagg

SEQ ID NO: 7334333 - DNA, 22 bp, Homo sapiens
acagccaggagccatgggcagg

SEQ ID NO: 7334334 - DNA, 22 bp, Homo sapiens
acagccaggaggaactcagtga

SEQ ID NO: 7334335 - DNA, 22 bp, Homo sapiens
acagccaggcccagcacgcagg

SEQ ID NO: 7334336 - DNA, 22 bp, Homo sapiens
acagccaggcccagcacgcagg

SEQ ID NO: 7334337 - DNA, 22 bp, Homo sapiens
acagccaggaattctggagaag

SEQ ID NO: 7334338 - DNA, 22 bp, Homo sapiens
acagccaggacttggccctctt

SEQ ID NO: 7334339 - DNA, 22 bp, Homo sapiens
acagccaggacttggccctctt

SEQ ID NO: 7334340 - DNA, 21 bp, Homo sapiens
acagccaggaacatgaggggc

SEQ ID NO: 7334341 - DNA, 22 bp, Homo sapiens
acagccagcttgatgggatccg

SEQ ID NO: 7334342 - DNA, 22 bp, Homo sapiens
acagccagcagagctgtttcct

SEQ ID NO: 7334343 - DNA, 22 bp, Homo sapiens
acagccagatctgagagatctt

SEQ ID NO: 7334344 - DNA, 23 bp, Homo sapiens
aagccccaaggaacttcctggga

SEQ ID NO: 7334345 - DNA, 22 bp, Homo sapiens
aagcccaggtaagtggctcatg

SEQ ID NO: 7334346 - DNA, 22 bp, Homo sapiens
aagcccagtttcacactgagac

SEQ ID NO: 7334347 - DNA, 22 bp, Homo sapiens
aagcagttaatgttttgtcaat

SEQ ID NO: 7334348 - DNA, 22 bp, Homo sapiens
aagcataaaacgttacaacatg

SEQ ID NO: 7334349 - DNA, 22 bp, Homo sapiens
acagcaggaagctggagggaaa

SEQ ID NO: 7334350 - DNA, 22 bp, Homo sapiens
acagcaggaagctggagggaaa

SEQ ID NO: 7334351 - DNA, 22 bp, Homo sapiens
acagcagggggagctgttggac

SEQ ID NO: 7334352 - DNA, 19 bp, Homo sapiens
acagcaggtgtggggataa

SEQ ID NO: 7334353 - DNA, 22 bp, Homo sapiens
acagcagggtcacattccctct

SEQ ID NO: 7334354 - DNA, 22 bp, Homo sapiens
aagcagggagaaatttttcttc

SEQ ID NO: 7334355 - DNA, 22 bp, Homo sapiens
aagcaggcttggtgtggccgct

SEQ ID NO: 7334356 - DNA, 22 bp, Homo sapiens
acagagcacagtcgggatggga

SEQ ID NO: 7334357 - DNA, 22 bp, Homo sapiens
aagcaggctagattgaagggct

SEQ ID NO: 7334358 - DNA, 22 bp, Homo sapiens
aagttacagttatgaaactcac

SEQ ID NO: 7334359 - DNA, 22 bp, Homo sapiens
aacagtttatcaagtttttaca

SEQ ID NO: 7334360 - DNA, 22 bp, Homo sapiens
aacagtttatgagatatgctat

SEQ ID NO: 7334361 - DNA, 22 bp, Homo sapiens
aacagtttatgataaattctta

SEQ ID NO: 7334362 - DNA, 22 bp, Homo sapiens
aataatgtaggatgataaatga

SEQ ID NO: 7334363 - DNA, 22 bp, Homo sapiens
aatacagaggggtcacaattca

SEQ ID NO: 7334364 - DNA, 22 bp, Homo sapiens
aatacagatggcatgtgaagat

SEQ ID NO: 7334365 - DNA, 22 bp, Homo sapiens
aatacagatgagcttctgcctc

SEQ ID NO: 7334366 - DNA, 22 bp, Homo sapiens
aataatcttgactactgaatca

SEQ ID NO: 7334367 - DNA, 22 bp, Homo sapiens
aataatcttgactactgaatca

SEQ ID NO: 7334368 - DNA, 22 bp, Homo sapiens
aataatctccctttttgtatgt

SEQ ID NO: 7334369 - DNA, 22 bp, Homo sapiens
aataatctcactttatgtggaa

SEQ ID NO: 7334370 - DNA, 22 bp, Homo sapiens
aataatgagcttgtctaattgt

SEQ ID NO: 7334371 - DNA, 22 bp, Homo sapiens
aatataattttattcctagagt

SEQ ID NO: 7334372 - DNA, 22 bp, Homo sapiens
aatacagtaattttgatgagtt

SEQ ID NO: 7334373 - DNA, 22 bp, Homo sapiens
aatacagtaattttgatgagtt

SEQ ID NO: 7334374 - DNA, 22 bp, Homo sapiens
aatacagtaggtaatagttcat

SEQ ID NO: 7334375 - DNA, 22 bp, Homo sapiens
aatacagtcttactagaaaatc

SEQ ID NO: 7334376 - DNA, 22 bp, Homo sapiens
aatacagtcttactagaaaatc

SEQ ID NO: 7334377 - DNA, 22 bp, Homo sapiens
aatacagtgaaagtgagcaagg

SEQ ID NO: 7334378 - DNA, 21 bp, Homo sapiens
aatacagtgaagaatttcttt

SEQ ID NO: 7334379 - DNA, 19 bp, Homo sapiens
aatacagtgttatagaatt

SEQ ID NO: 7334380 - DNA, 19 bp, Homo sapiens
aatacagtgttatagaatt

SEQ ID NO: 7334381 - DNA, 22 bp, Homo sapiens
aatccagatgagcaatcatact

SEQ ID NO: 7334382 - DNA, 22 bp, Homo sapiens
aatatttcgttgcgtggctaga

SEQ ID NO: 7334383 - DNA, 22 bp, Homo sapiens
aatatttatgacaggaagtagc

SEQ ID NO: 7334384 - DNA, 22 bp, Homo sapiens
aatatctgtggccatacaattt

SEQ ID NO: 7334385 - DNA, 22 bp, Homo sapiens
aatatctgtctctaatgcatat

SEQ ID NO: 7334386 - DNA, 22 bp, Homo sapiens
aatgcttccaaaataccaagcc

SEQ ID NO: 7334387 - DNA, 22 bp, Homo sapiens
aatgctgtcttttctacttcat

SEQ ID NO: 7334388 - DNA, 22 bp, Homo sapiens
aatgcagtgagccattaaatgg

SEQ ID NO: 7334389 - DNA, 22 bp, Homo sapiens
aatgcttaattcaatactgtgt

SEQ ID NO: 7334390 - DNA, 22 bp, Homo sapiens
aactttaaggctataaattatg

SEQ ID NO: 7334391 - DNA, 22 bp, Homo sapiens
aacttgttagaaatgcagaatc

SEQ ID NO: 7334392 - DNA, 22 bp, Homo sapiens
aatgtacaaaccttctttgtag

SEQ ID NO: 7334393 - DNA, 22 bp, Homo sapiens
aatgtacaaaccttctttgtag

SEQ ID NO: 7334394 - DNA, 22 bp, Homo sapiens
aatgtaaagttgggcacaaatg

SEQ ID NO: 7334395 - DNA, 23 bp, Homo sapiens
aatctggctgatgttttttctct

SEQ ID NO: 7334396 - DNA, 15 bp, Homo sapiens
aatctggcggcaagt

SEQ ID NO: 7334397 - DNA, 22 bp, Homo sapiens
aatctggctcagaagaagatga

SEQ ID NO: 7334398 - DNA, 22 bp, Homo sapiens
aatctggcatgtaagcttagag

SEQ ID NO: 7334399 - DNA, 22 bp, Homo sapiens
aatctggcatttgagagtagga

SEQ ID NO: 7334400 - DNA, 22 bp, Homo sapiens
aatctgtaacattcaataaaga

SEQ ID NO: 7334401 - DNA, 22 bp, Homo sapiens
aatctggagttaatgttttcgc

SEQ ID NO: 7334402 - DNA, 22 bp, Homo sapiens
aatctggagttaatgttttcgc

SEQ ID NO: 7334403 - DNA, 22 bp, Homo sapiens
aatgaaactgtatatagactgt

SEQ ID NO: 7334404 - DNA, 22 bp, Homo sapiens
aatgaaatgaagatatgatcag

SEQ ID NO: 7334405 - DNA, 22 bp, Homo sapiens
aatctcagagatatctgtgtcc

SEQ ID NO: 7334406 - DNA, 22 bp, Homo sapiens
aatctcatgagcttcttgtccc

SEQ ID NO: 7334407 - DNA, 22 bp, Homo sapiens
aatgcacatgttgtaataaata

SEQ ID NO: 7334408 - DNA, 22 bp, Homo sapiens
aatgcagattcttattctgtag

SEQ ID NO: 7334409 - DNA, 22 bp, Homo sapiens
aatgcacatatatgtgtataca

SEQ ID NO: 7334410 - DNA, 22 bp, Homo sapiens
aatgaaatgtagcttatccata

SEQ ID NO: 7334411 - DNA, 18 bp, Homo sapiens
aatgaaatgtacaccttt

SEQ ID NO: 7334412 - DNA, 21 bp, Homo sapiens
aatgatgaaagatgacagagt

SEQ ID NO: 7334413 - DNA, 22 bp, Homo sapiens
aatgaaatgtagcttatccata

SEQ ID NO: 7334414 - DNA, 22 bp, Homo sapiens
aagggaggccagaggttttgca

SEQ ID NO: 7334415 - DNA, 22 bp, Homo sapiens
aaggccctaatagagcacatat

SEQ ID NO: 7334416 - DNA, 22 bp, Homo sapiens
aaggccaggtccctgcagtgca

SEQ ID NO: 7334417 - DNA, 22 bp, Homo sapiens
aaggccattattctgatatatt

SEQ ID NO: 7334418 - DNA, 22 bp, Homo sapiens
aaggccattgtaatgtaaatat

SEQ ID NO: 7334419 - DNA, 22 bp, Homo sapiens
aaggcactgctttgctgcgccc

SEQ ID NO: 7334420 - DNA, 22 bp, Homo sapiens
aaggcactgtactagttagtta

SEQ ID NO: 7334421 - DNA, 22 bp, Homo sapiens
aaggagggaaagcagtgcttct

SEQ ID NO: 7334422 - DNA, 16 bp, Homo sapiens
aaggagggaagagaat

SEQ ID NO: 7334423 - DNA, 21 bp, Homo sapiens
aaatggatagggcaatggaag

SEQ ID NO: 7334424 - DNA, 22 bp, Homo sapiens
aaatggaagctatttatgattc

SEQ ID NO: 7334425 - DNA, 22 bp, Homo sapiens
aaatggaagaagtgcaatactg

SEQ ID NO: 7334426 - DNA, 22 bp, Homo sapiens
aaatggaatgtgtttataattc

SEQ ID NO: 7334427 - DNA, 22 bp, Homo sapiens
aaatggactgtgatatttacat

SEQ ID NO: 7334428 - DNA, 22 bp, Homo sapiens
aaggagggttcccaggtcctgg

SEQ ID NO: 7334429 - DNA, 22 bp, Homo sapiens
aaggagggttcccaggtcctgg

SEQ ID NO: 7334430 - DNA, 22 bp, Homo sapiens
aaggataagaatggaaggaaca

SEQ ID NO: 7334431 - DNA, 22 bp, Homo sapiens
aaggagtgatatatgggtgcta

SEQ ID NO: 7334432 - DNA, 22 bp, Homo sapiens
aaggcactgactgtgcagggga

SEQ ID NO: 7334433 - DNA, 22 bp, Homo sapiens
aaggcactgagccagccgtctc

SEQ ID NO: 7334434 - DNA, 22 bp, Homo sapiens
aaggcactgaaaaattgtgtgt

SEQ ID NO: 7334435 - DNA, 22 bp, Homo sapiens
aaggcactgaacttaaattctg

SEQ ID NO: 7334436 - DNA, 22 bp, Homo sapiens
aaggcactagcaagctgcctgg

SEQ ID NO: 7334437 - DNA, 20 bp, Homo sapiens
aaggcactatgtctgctagc

SEQ ID NO: 7334438 - DNA, 20 bp, Homo sapiens
aaggcactatgtctgctagc

SEQ ID NO: 7334439 - DNA, 22 bp, Homo sapiens
aaggcactagcagaattagtga

SEQ ID NO: 7334440 - DNA, 22 bp, Homo sapiens
aaggcactcagccttgggacag

SEQ ID NO: 7334441 - DNA, 22 bp, Homo sapiens
aaggcactcagccttgggacag

SEQ ID NO: 7334442 - DNA, 22 bp, Homo sapiens
aaggcactcattcaaggagata

SEQ ID NO: 7334443 - DNA, 22 bp, Homo sapiens
aacagtgttttgctctttgccc

SEQ ID NO: 7334444 - DNA, 22 bp, Homo sapiens
aacagtgcttcattcacacatt

SEQ ID NO: 7334445 - DNA, 22 bp, Homo sapiens
aacagttacccttaagatcttt

SEQ ID NO: 7334446 - DNA, 22 bp, Homo sapiens
aagtgctgaatgaagacacaaa

SEQ ID NO: 7334447 - DNA, 22 bp, Homo sapiens
aagtgctcccatatcctgccct

SEQ ID NO: 7334448 - DNA, 23 bp, Homo sapiens
aagtgctcagtggacagcattgc

SEQ ID NO: 7334449 - DNA, 22 bp, Homo sapiens
aagtgctgggattataggcatg

SEQ ID NO: 7334450 - DNA, 22 bp, Homo sapiens
aagtgaaacatgtatctcttta

SEQ ID NO: 7334451 - DNA, 23 bp, Homo sapiens
aaggtgtcattgatgggattcta

SEQ ID NO: 7334452 - DNA, 22 bp, Homo sapiens
aagtaatataattgttgttgtt

SEQ ID NO: 7334453 - DNA, 22 bp, Homo sapiens
aagtaatctggaatttggtttt

SEQ ID NO: 7334454 - DNA, 22 bp, Homo sapiens
aagtacaacgcatacagagaaa

SEQ ID NO: 7334455 - DNA, 22 bp, Homo sapiens
aagtacaacgcatacagagaaa

SEQ ID NO: 7334456 - DNA, 22 bp, Homo sapiens
aaaagcaaggcagtctgtctga

SEQ ID NO: 7334457 - DNA, 22 bp, Homo sapiens
aaaagattgttagggagaatgt

SEQ ID NO: 7334458 - DNA, 22 bp, Homo sapiens
aaaaatgaaacggctggttggc

SEQ ID NO: 7334459 - DNA, 22 bp, Homo sapiens
aaaaatttatggttcttctctg

SEQ ID NO: 7334460 - DNA, 22 bp, Homo sapiens
aaaacattgaattgcacactat

SEQ ID NO: 7334461 - DNA, 22 bp, Homo sapiens
aaaacattgaattgcacactat

SEQ ID NO: 7334462 - DNA, 22 bp, Homo sapiens
aaaacattctgtgaactctcaa

SEQ ID NO: 7334463 - DNA, 22 bp, Homo sapiens
aaaaccaggcgtttcctattat

SEQ ID NO: 7334464 - DNA, 22 bp, Homo sapiens
aaaacagtttaggcatcacagt

SEQ ID NO: 7334465 - DNA, 22 bp, Homo sapiens
aaaacagttataaacagagtca

SEQ ID NO: 7334466 - DNA, 22 bp, Homo sapiens
aaaacacactggaccaatttaa

SEQ ID NO: 7334467 - DNA, 22 bp, Homo sapiens
aaaacactgcaaagctgattgg

SEQ ID NO: 7334468 - DNA, 22 bp, Homo sapiens
aaaacactgcctgcttgactga

SEQ ID NO: 7334469 - DNA, 22 bp, Homo sapiens
aaaagcatctcaaaggagcttc

SEQ ID NO: 7334470 - DNA, 22 bp, Homo sapiens
aaaagcaggtactcagcttggg

SEQ ID NO: 7334471 - DNA, 22 bp, Homo sapiens
aaaagcaattgcagttcttgcc

SEQ ID NO: 7334472 - DNA, 22 bp, Homo sapiens
aaagcagcagaatctctcaggg

SEQ ID NO: 7334473 - DNA, 21 bp, Homo sapiens
aaaatgtgagcgtgatgctta

SEQ ID NO: 7334474 - DNA, 22 bp, Homo sapiens
aaagcagcagcacctgcatttc

SEQ ID NO: 7334475 - DNA, 22 bp, Homo sapiens
aaagcagccactctctctgcct

SEQ ID NO: 7334476 - DNA, 22 bp, Homo sapiens
aaagcagccacagagagagcgt

SEQ ID NO: 7334477 - DNA, 21 bp, Homo sapiens
aaagcagcccatggcacagtc

SEQ ID NO: 7334478 - DNA, 22 bp, Homo sapiens
aaagcagggtccaaggagatgt

SEQ ID NO: 7334479 - DNA, 22 bp, Homo sapiens
aaaattgtaggaactgaatcaa

SEQ ID NO: 7334480 - DNA, 22 bp, Homo sapiens
aaaattgtaggaactgaatcaa

SEQ ID NO: 7334481 - DNA, 22 bp, Homo sapiens
aaagcagcctgctcatcctgga

SEQ ID NO: 7334482 - DNA, 22 bp, Homo sapiens
aaagcagcctgctcatcctgga

SEQ ID NO: 7334483 - DNA, 22 bp, Homo sapiens
aaagcagctttcggccctcggg

SEQ ID NO: 7334484 - DNA, 22 bp, Homo sapiens
aaaatgcatgagaatgtgctcg

SEQ ID NO: 7334485 - DNA, 20 bp, Homo sapiens
aaaatgatgggcagggcagg

SEQ ID NO: 7334486 - DNA, 22 bp, Homo sapiens
aaaatgcaaacctacctacata

SEQ ID NO: 7334487 - DNA, 22 bp, Homo sapiens
aaaatgaggaacggatcatggc

SEQ ID NO: 7334488 - DNA, 22 bp, Homo sapiens
aaaagctcattgataaaaagtc

SEQ ID NO: 7334489 - DNA, 22 bp, Homo sapiens
aaaagttgcaaaattgctcttc

SEQ ID NO: 7334490 - DNA, 22 bp, Homo sapiens
aaaatctggcaacactaagttt

SEQ ID NO: 7334491 - DNA, 22 bp, Homo sapiens
aaaatgagatacagtttgaaag

SEQ ID NO: 7334492 - DNA, 22 bp, Homo sapiens
aaaataacttctactatttgca

SEQ ID NO: 7334493 - DNA, 22 bp, Homo sapiens
aaaataacttctactatttgca

SEQ ID NO: 7334494 - DNA, 22 bp, Homo sapiens
aaaatacacatactaggggaaa

SEQ ID NO: 7334495 - DNA, 22 bp, Homo sapiens
aaaatacacatactaggggaaa

SEQ ID NO: 7334496 - DNA, 22 bp, Homo sapiens
aaaatacacatactaggggaaa

SEQ ID NO: 7334497 - DNA, 22 bp, Homo sapiens
aaatccagtgttcaaagtttga

SEQ ID NO: 7334498 - DNA, 22 bp, Homo sapiens
aaatccagtgttcaaagtttga

SEQ ID NO: 7334499 - DNA, 22 bp, Homo sapiens
aaatccagtttgtcatttccca

SEQ ID NO: 7334500 - DNA, 22 bp, Homo sapiens
aaatgacaataaaagtccatgc

SEQ ID NO: 7334501 - DNA, 22 bp, Homo sapiens
aaatgacactcattcagtgtca

SEQ ID NO: 7334502 - DNA, 22 bp, Homo sapiens
aaatgacactaggctttttgca

SEQ ID NO: 7334503 - DNA, 22 bp, Homo sapiens
aaatgacactcattcagtgtca

SEQ ID NO: 7334504 - DNA, 22 bp, Homo sapiens
aaactgtgagctagtaaatagg

SEQ ID NO: 7334505 - DNA, 22 bp, Homo sapiens
aaactgtgtatgcagagagcat

SEQ ID NO: 7334506 - DNA, 23 bp, Homo sapiens
aaatgacatatggtttctgaagg

SEQ ID NO: 7334507 - DNA, 22 bp, Homo sapiens
aaatgacagttctctctgagta

SEQ ID NO: 7334508 - DNA, 22 bp, Homo sapiens
aaactgttcctttttcagcaac

SEQ ID NO: 7334509 - DNA, 22 bp, Homo sapiens
aaactgtttccctccataacct

SEQ ID NO: 7334510 - DNA, 21 bp, Homo sapiens
aaatacagaaacttgttttca

SEQ ID NO: 7334511 - DNA, 21 bp, Homo sapiens
aaatacagatgcaaatctgtt

SEQ ID NO: 7334512 - DNA, 22 bp, Homo sapiens
aaatacagattccagggtctta

SEQ ID NO: 7334513 - DNA, 21 bp, Homo sapiens
aaatacagatgcaaatctgtt

SEQ ID NO: 7334514 - DNA, 22 bp, Homo sapiens
aaatacagatagatttaaccca

SEQ ID NO: 7334515 - DNA, 22 bp, Homo sapiens
aaatacagagttgcttaaaagc

SEQ ID NO: 7334516 - DNA, 21 bp, Homo sapiens
aaatacagaaacttgttttca

SEQ ID NO: 7334517 - DNA, 21 bp, Homo sapiens
aaatacagaaacttgttttca

SEQ ID NO: 7334518 - DNA, 22 bp, Homo sapiens
aaagacagatggcaaggatgat

SEQ ID NO: 7334519 - DNA, 22 bp, Homo sapiens
aaagacagtggattcaaaatcc

SEQ ID NO: 7334520 - DNA, 22 bp, Homo sapiens
aaagacagatggcaaggatgat

SEQ ID NO: 7334521 - DNA, 22 bp, Homo sapiens
aaatgtctttgagtatttctgc

SEQ ID NO: 7334522 - DNA, 22 bp, Homo sapiens
aaatgtctttgagtttttataa

SEQ ID NO: 7334523 - DNA, 22 bp, Homo sapiens
aaatgtctttcaatagagaaat

SEQ ID NO: 7334524 - DNA, 22 bp, Homo sapiens
aaatgtgagttatagcaataga

SEQ ID NO: 7334525 - DNA, 22 bp, Homo sapiens
aaacttagtagagttcatatta

SEQ ID NO: 7334526 - DNA, 22 bp, Homo sapiens
aaacttattttatcacagttca

SEQ ID NO: 7334527 - DNA, 22 bp, Homo sapiens
aaacttcatggataatataaag

SEQ ID NO: 7334528 - DNA, 22 bp, Homo sapiens
aaatgtctgtatgagaaagaga

SEQ ID NO: 7334529 - DNA, 22 bp, Homo sapiens
aaatggtggctcttttaaattg

SEQ ID NO: 7334530 - DNA, 22 bp, Homo sapiens
aaatggtgctactaggagtcag

SEQ ID NO: 7334531 - DNA, 22 bp, Homo sapiens
aaatggtgttgtatttagtctc

SEQ ID NO: 7334532 - DNA, 22 bp, Homo sapiens
aaatggtgtttctaatgctaga

SEQ ID NO: 7334533 - DNA, 22 bp, Homo sapiens
aaatgtctgagacttctgaact

SEQ ID NO: 7334534 - DNA, 22 bp, Homo sapiens
aaatgtctgtctcatgaggaaa

SEQ ID NO: 7334535 - DNA, 22 bp, Homo sapiens
aaatgtctttatctcatgtaac

SEQ ID NO: 7334536 - DNA, 22 bp, Homo sapiens
aaagctcttactgtactagtga

SEQ ID NO: 7334537 - DNA, 22 bp, Homo sapiens
aaagctctggaagattaggtaa

SEQ ID NO: 7334538 - DNA, 22 bp, Homo sapiens
aaaggagaaaacatacaggact

SEQ ID NO: 7334539 - DNA, 22 bp, Homo sapiens
aaaggagacagtcttacctgga

SEQ ID NO: 7334540 - DNA, 22 bp, Homo sapiens
aaaggagacttcagatctcctt

SEQ ID NO: 7334541 - DNA, 22 bp, Homo sapiens
aaaggagacagtcttacctgga

SEQ ID NO: 7334542 - DNA, 22 bp, Homo sapiens
aaaggagaaaacatacaggact

SEQ ID NO: 7334543 - DNA, 22 bp, Homo sapiens
aaaggagagtgagtcagatgcc

SEQ ID NO: 7334544 - DNA, 22 bp, Homo sapiens
aaaggagagtgagtcagatgcc

SEQ ID NO: 7334545 - DNA, 22 bp, Homo sapiens
aaaggagagtaggttactccat

SEQ ID NO: 7334546 - DNA, 22 bp, Homo sapiens
aaaggagataaagggcccttca

SEQ ID NO: 7334547 - DNA, 22 bp, Homo sapiens
aaagctatagggtcaagcattt

SEQ ID NO: 7334548 - DNA, 22 bp, Homo sapiens
aaagctatgaggcatgcatttc

SEQ ID NO: 7334549 - DNA, 22 bp, Homo sapiens
aaaattgtgaaggtttctgaaa

SEQ ID NO: 7334550 - DNA, 22 bp, Homo sapiens
aaagtacatgtttggccatttg

SEQ ID NO: 7334551 - DNA, 22 bp, Homo sapiens
aaagtacagatggtgaggttgg

SEQ ID NO: 7334552 - DNA, 22 bp, Homo sapiens
aaagtacacacagagccaagaa

SEQ ID NO: 7334553 - DNA, 22 bp, Homo sapiens
aaagtacaatattgagattgat

SEQ ID NO: 7334554 - DNA, 22 bp, Homo sapiens
aaagtacaaggaaaggatctga

SEQ ID NO: 7334555 - DNA, 22 bp, Homo sapiens
aaagttttattcaagcattagt

SEQ ID NO: 7334556 - DNA, 20 bp, Homo sapiens
aaaggcacagcaacagagct

SEQ ID NO: 7334557 - DNA, 22 bp, Homo sapiens
aaaggcaaaattcttagcagga

SEQ ID NO: 7334558 - DNA, 22 bp, Homo sapiens
aaaggcaaaggctggtatggct

SEQ ID NO: 7334559 - DNA, 22 bp, Homo sapiens
aaaggcaagcatttatatagga

SEQ ID NO: 7334560 - DNA, 22 bp, Homo sapiens
aaaggcaatttcttcttcctga

SEQ ID NO: 7334561 - DNA, 22 bp, Homo sapiens
aaaggaagtgccactcttcttc

SEQ ID NO: 7334562 - DNA, 20 bp, Homo sapiens
aaagcatttacttgtgattg

SEQ ID NO: 7334563 - DNA, 22 bp, Homo sapiens
aaagcatgttgggtccctcttt

SEQ ID NO: 7334564 - DNA, 22 bp, Homo sapiens
aaagcattactagactggattt

SEQ ID NO: 7334565 - DNA, 22 bp, Homo sapiens
aaagcatcagatctgacacttc

SEQ ID NO: 7334566 - DNA, 21 bp, Homo sapiens
aaagcatcacgaacatttggg

SEQ ID NO: 7334567 - DNA, 22 bp, Homo sapiens
aaattagatatgtgtgagactc

SEQ ID NO: 7334568 - DNA, 22 bp, Homo sapiens
aaattagatatgtgtgagactc

SEQ ID NO: 7334569 - DNA, 22 bp, Homo sapiens
aaagacatgacacattggagag

SEQ ID NO: 7334570 - DNA, 22 bp, Homo sapiens
aaattcagatggctttcttttc

SEQ ID NO: 7334571 - DNA, 22 bp, Homo sapiens
aaattcagatggctttcttttc

SEQ ID NO: 7334572 - DNA, 22 bp, Homo sapiens
aaattcagttttaataatcact

SEQ ID NO: 7334573 - DNA, 22 bp, Homo sapiens
aaattcagtgttcttcccgtaa

SEQ ID NO: 7334574 - DNA, 22 bp, Homo sapiens
aaattcagcatcctgcactgga

SEQ ID NO: 7334575 - DNA, 22 bp, Homo sapiens
aaattccattatgataatttcg

SEQ ID NO: 7334576 - DNA, 22 bp, Homo sapiens
aaattccattttgtgactattc

SEQ ID NO: 7334577 - DNA, 22 bp, Homo sapiens
aaattccattttgtgactattc

SEQ ID NO: 7334578 - DNA, 22 bp, Homo sapiens
aaattgtcagaattcagaaagt

SEQ ID NO: 7334579 - DNA, 22 bp, Homo sapiens
aaattgtcagaattcagaaagt

SEQ ID NO: 7334580 - DNA, 22 bp, Homo sapiens
aaattgtataatgttccagctg

SEQ ID NO: 7334581 - DNA, 22 bp, Homo sapiens
aaagcaggttgcaattacagtg

SEQ ID NO: 7334582 - DNA, 22 bp, Homo sapiens
aacttctgcagaaaagtgcatg

SEQ ID NO: 7334583 - DNA, 22 bp, Homo sapiens
aacttctgcagaaaagtgcatg

SEQ ID NO: 7334584 - DNA, 22 bp, Homo sapiens
aacttctgacctcaagaactgt

SEQ ID NO: 7334585 - DNA, 22 bp, Homo sapiens
aacttctgccaaacagctgtta

SEQ ID NO: 7334586 - DNA, 22 bp, Homo sapiens
aacttctgcttttacaggcagt

SEQ ID NO: 7334587 - DNA, 22 bp, Homo sapiens
aacttctggatgtttcaaatgt

SEQ ID NO: 7334588 - DNA, 22 bp, Homo sapiens
aacttctgggctgtccaaaact

SEQ ID NO: 7334589 - DNA, 22 bp, Homo sapiens
aaagtcctagcgatccacagaa

SEQ ID NO: 7334590 - DNA, 22 bp, Homo sapiens
aaagtcctttttgccatgcaag

SEQ ID NO: 7334591 - DNA, 22 bp, Homo sapiens
aaagtcctgactgcaggggatg

SEQ ID NO: 7334592 - DNA, 22 bp, Homo sapiens
aaagtctgaaagatgctaacat

SEQ ID NO: 7334593 - DNA, 18 bp, Homo sapiens
aaaggctgaatatagaag

SEQ ID NO: 7334594 - DNA, 22 bp, Homo sapiens
aaaggctgccaggtaaaatatt

SEQ ID NO: 7334595 - DNA, 22 bp, Homo sapiens
aacatgatttagtataatgcag

SEQ ID NO: 7334596 - DNA, 22 bp, Homo sapiens
aacatgcaaagctatgatgtat

SEQ ID NO: 7334597 - DNA, 22 bp, Homo sapiens
aacatgcaaagctatgatgtat

SEQ ID NO: 7334598 - DNA, 22 bp, Homo sapiens
aaaggctatgagatagaagata

SEQ ID NO: 7334599 - DNA, 22 bp, Homo sapiens
aacatgatgacaaaggtatatt

SEQ ID NO: 7334600 - DNA, 22 bp, Homo sapiens
aaaggcttgtacagcagccttc

SEQ ID NO: 7334601 - DNA, 22 bp, Homo sapiens
aaagggaggggcgataagccgg

SEQ ID NO: 7334602 - DNA, 22 bp, Homo sapiens
aaagggagcatggctgcaggga

SEQ ID NO: 7334603 - DNA, 22 bp, Homo sapiens
aaagggaatgtgtaggacatgt

SEQ ID NO: 7334604 - DNA, 22 bp, Homo sapiens
aagaagcaggtcacagacaggg

SEQ ID NO: 7334605 - DNA, 22 bp, Homo sapiens
aagaagcattctttcattggtt

SEQ ID NO: 7334606 - DNA, 22 bp, Homo sapiens
aagaagcatggctgtagattcc

SEQ ID NO: 7334607 - DNA, 22 bp, Homo sapiens
aaatacagattcttgtgtctat

SEQ ID NO: 7334608 - DNA, 22 bp, Homo sapiens
aaatacagattctgactcagag

SEQ ID NO: 7334609 - DNA, 22 bp, Homo sapiens
aaatacagattcttgtgtctat

SEQ ID NO: 7334610 - DNA, 22 bp, Homo sapiens
aaatacagattcttgtgtctat

SEQ ID NO: 7334611 - DNA, 19 bp, Homo sapiens
aaatacagcagctgtttcc

SEQ ID NO: 7334612 - DNA, 19 bp, Homo sapiens
aaatacagcagctgtttcc

SEQ ID NO: 7334613 - DNA, 22 bp, Homo sapiens
aaatacagcagactcctgttgt

SEQ ID NO: 7334614 - DNA, 19 bp, Homo sapiens
aaatacagcagctgtttcc

SEQ ID NO: 7334615 - DNA, 22 bp, Homo sapiens
aaatacaggagtttggacttct

SEQ ID NO: 7334616 - DNA, 22 bp, Homo sapiens
aagaagtggttggaagaagcat

SEQ ID NO: 7334617 - DNA, 22 bp, Homo sapiens
aagagagaagtctctctggttc

SEQ ID NO: 7334618 - DNA, 22 bp, Homo sapiens
aagagagaactcccttcgccag

SEQ ID NO: 7334619 - DNA, 22 bp, Homo sapiens
aaatacagtggcagcagataat

SEQ ID NO: 7334620 - DNA, 22 bp, Homo sapiens
aaatacagtgtgtgttctttga

SEQ ID NO: 7334621 - DNA, 22 bp, Homo sapiens
aaatacataaaggttgtaccag

SEQ ID NO: 7334622 - DNA, 22 bp, Homo sapiens
aagagtttctgggtcaaggatt

SEQ ID NO: 7334623 - DNA, 22 bp, Homo sapiens
aaatatagtgacacttatagtc

SEQ ID NO: 7334624 - DNA, 22 bp, Homo sapiens
aagagagaagtctctctggttc

SEQ ID NO: 7334625 - DNA, 22 bp, Homo sapiens
aagagagacaataggtagcatt

SEQ ID NO: 7334626 - DNA, 22 bp, Homo sapiens
aagagagaccatgggggacagg

SEQ ID NO: 7334627 - DNA, 22 bp, Homo sapiens
aagagagagcattcttctgtta

SEQ ID NO: 7334628 - DNA, 22 bp, Homo sapiens
aagagagaccatgggggacagg

SEQ ID NO: 7334629 - DNA, 22 bp, Homo sapiens
aagagagagtgcgctcacagaa

SEQ ID NO: 7334630 - DNA, 22 bp, Homo sapiens
aagagagagcattcttctgtta

SEQ ID NO: 7334631 - DNA, 22 bp, Homo sapiens
aagagagagtgcgctcacagaa

SEQ ID NO: 7334632 - DNA, 22 bp, Homo sapiens
aaatgcaattgtatgtactcca

SEQ ID NO: 7334633 - DNA, 22 bp, Homo sapiens
aaatgccagcacacgtctgtgg

SEQ ID NO: 7334634 - DNA, 22 bp, Homo sapiens
aaatgctgcagctagtgtgttt

SEQ ID NO: 7334635 - DNA, 20 bp, Homo sapiens
aaatgctgtaatgtttggga

SEQ ID NO: 7334636 - DNA, 22 bp, Homo sapiens
aaatgctgtagatcagtgagtt

SEQ ID NO: 7334637 - DNA, 22 bp, Homo sapiens
aaatgctgtcagtgttattgga

SEQ ID NO: 7334638 - DNA, 22 bp, Homo sapiens
aaatgcttattagtgtcacaaa

SEQ ID NO: 7334639 - DNA, 22 bp, Homo sapiens
aaatggaactgggctactaggt

SEQ ID NO: 7334640 - DNA, 20 bp, Homo sapiens
aaatgcttttgacacatatt

SEQ ID NO: 7334641 - DNA, 22 bp, Homo sapiens
aaatcagacttgaattttcatc

SEQ ID NO: 7334642 - DNA, 22 bp, Homo sapiens
aaatcagagaatatatttagaa

SEQ ID NO: 7334643 - DNA, 22 bp, Homo sapiens
aaatgaaatgagtgcctggagg

SEQ ID NO: 7334644 - DNA, 22 bp, Homo sapiens
aaatcagagtctgattttaagg

SEQ ID NO: 7334645 - DNA, 19 bp, Homo sapiens
aaatcagaatctgcatttt

SEQ ID NO: 7334646 - DNA, 19 bp, Homo sapiens
aaatcagaatctgcatttt

SEQ ID NO: 7334647 - DNA, 21 bp, Homo sapiens
aaatcactgtccaatcttggt

SEQ ID NO: 7334648 - DNA, 22 bp, Homo sapiens
aaatcactgttattgatcttaa

SEQ ID NO: 7334649 - DNA, 22 bp, Homo sapiens
aaatcacagggtctctaagtat

SEQ ID NO: 7334650 - DNA, 22 bp, Homo sapiens
aaatcaaaagacatgtgtttta

SEQ ID NO: 7334651 - DNA, 22 bp, Homo sapiens
acaacagtaggaaaacatgtct

SEQ ID NO: 7334652 - DNA, 22 bp, Homo sapiens
acaaagtgctgacattacaggc

SEQ ID NO: 7334653 - DNA, 22 bp, Homo sapiens
agagtgttatttgctctgtatt

SEQ ID NO: 7334654 - DNA, 22 bp, Homo sapiens
agagtgttatttgctctgtatt

SEQ ID NO: 7334655 - DNA, 22 bp, Homo sapiens
agagtgtttcagtcttcctaga

SEQ ID NO: 7334656 - DNA, 18 bp, Homo sapiens
agagtgttctcagtgaaa

SEQ ID NO: 7334657 - DNA, 22 bp, Homo sapiens
agagtgtttttctgtcaaggac

SEQ ID NO: 7334658 - DNA, 22 bp, Homo sapiens
agagttaagtgaaatgtaataa

SEQ ID NO: 7334659 - DNA, 22 bp, Homo sapiens
agagttaagaggaatgtgaatt

SEQ ID NO: 7334660 - DNA, 22 bp, Homo sapiens
agagtgtaataagggcaagggc

SEQ ID NO: 7334661 - DNA, 22 bp, Homo sapiens
agagtgaagtttttgaaagtga

SEQ ID NO: 7334662 - DNA, 22 bp, Homo sapiens
aatttgtataaaatggtgtttt

SEQ ID NO: 7334663 - DNA, 22 bp, Homo sapiens
agagtgaagtaattgttaggat

SEQ ID NO: 7334664 - DNA, 22 bp, Homo sapiens
agagtgaagtaattgttaggat

SEQ ID NO: 7334665 - DNA, 22 bp, Homo sapiens
agagtgaagttcatcgtgcagc

SEQ ID NO: 7334666 - DNA, 22 bp, Homo sapiens
aatttggcagtgtcttgaagta

SEQ ID NO: 7334667 - DNA, 22 bp, Homo sapiens
aatttgacagcaatagaagatt

SEQ ID NO: 7334668 - DNA, 22 bp, Homo sapiens
aatttgatgagtttgtaagtct

SEQ ID NO: 7334669 - DNA, 18 bp, Homo sapiens
aatttctttgacaactta

SEQ ID NO: 7334670 - DNA, 18 bp, Homo sapiens
aatttctttgacaactta

SEQ ID NO: 7334671 - DNA, 22 bp, Homo sapiens
aatttggacttgggtgctagag

SEQ ID NO: 7334672 - DNA, 22 bp, Homo sapiens
aatttggagagagattaatgtt

SEQ ID NO: 7334673 - DNA, 22 bp, Homo sapiens
aatttggagagaaacaagtagg

SEQ ID NO: 7334674 - DNA, 21 bp, Homo sapiens
aatttgctaagcaaaggagca

SEQ ID NO: 7334675 - DNA, 22 bp, Homo sapiens
aatttctccaagaatgcttaga

SEQ ID NO: 7334676 - DNA, 22 bp, Homo sapiens
aatttctccagacagctgtgca

SEQ ID NO: 7334677 - DNA, 22 bp, Homo sapiens
aatttctcatggattcagttat

SEQ ID NO: 7334678 - DNA, 22 bp, Homo sapiens
aatttctcactctcttgatcac

SEQ ID NO: 7334679 - DNA, 22 bp, Homo sapiens
aatttctctctcatgcttcatg

SEQ ID NO: 7334680 - DNA, 22 bp, Homo sapiens
aatttctgtatgaatagagaaa

SEQ ID NO: 7334681 - DNA, 22 bp, Homo sapiens
aatttcttgggagctcagagaa

SEQ ID NO: 7334682 - DNA, 22 bp, Homo sapiens
agcacacaggacttgattcatg

SEQ ID NO: 7334683 - DNA, 22 bp, Homo sapiens
agcacacaggacttgattcatg

SEQ ID NO: 7334684 - DNA, 22 bp, Homo sapiens
agcacacaggacttgattcatg

SEQ ID NO: 7334685 - DNA, 22 bp, Homo sapiens
agcacacagtattagccattgt

SEQ ID NO: 7334686 - DNA, 22 bp, Homo sapiens
agcacacaggccacctccactt

SEQ ID NO: 7334687 - DNA, 22 bp, Homo sapiens
agcacacagtattagccattgt

SEQ ID NO: 7334688 - DNA, 22 bp, Homo sapiens
agcacacagtattagccattgt

SEQ ID NO: 7334689 - DNA, 22 bp, Homo sapiens
agcacaaaagcagccacagatg

SEQ ID NO: 7334690 - DNA, 23 bp, Homo sapiens
agcacaaagtgttttccttgtag

SEQ ID NO: 7334691 - DNA, 22 bp, Homo sapiens
agcacaaatataaaaatgtctg

SEQ ID NO: 7334692 - DNA, 22 bp, Homo sapiens
agcacaaatataaaaatgtctg

SEQ ID NO: 7334693 - DNA, 22 bp, Homo sapiens
agcacactggcattgggaagct

SEQ ID NO: 7334694 - DNA, 22 bp, Homo sapiens
agcacacatcacttctgctcat

SEQ ID NO: 7334695 - DNA, 22 bp, Homo sapiens
agcacacagtcttccttcctcc

SEQ ID NO: 7334696 - DNA, 22 bp, Homo sapiens
agcacaggaacatggagatggg

SEQ ID NO: 7334697 - DNA, 22 bp, Homo sapiens
agcacagaatgaggtggaagtg

SEQ ID NO: 7334698 - DNA, 21 bp, Homo sapiens
acacaacaggcagtcattttc

SEQ ID NO: 7334699 - DNA, 22 bp, Homo sapiens
agcacagggcccagcctaggcc

SEQ ID NO: 7334700 - DNA, 22 bp, Homo sapiens
agcacagggacaatgccaggtg

SEQ ID NO: 7334701 - DNA, 22 bp, Homo sapiens
agcacaggacgtagagcttgga

SEQ ID NO: 7334702 - DNA, 22 bp, Homo sapiens
acaacagtgtggtggaaggagc

SEQ ID NO: 7334703 - DNA, 22 bp, Homo sapiens
acaacattatacatagaaagct

SEQ ID NO: 7334704 - DNA, 23 bp, Homo sapiens
agcaaataatctgcttgcttttt

SEQ ID NO: 7334705 - DNA, 19 bp, Homo sapiens
acaataactcattgattgc

SEQ ID NO: 7334706 - DNA, 19 bp, Homo sapiens
agcaaatataatagtgttc

SEQ ID NO: 7334707 - DNA, 19 bp, Homo sapiens
agcaaatataatagtgttc

SEQ ID NO: 7334708 - DNA, 19 bp, Homo sapiens
agcaaatataatagtgttc

SEQ ID NO: 7334709 - DNA, 22 bp, Homo sapiens
acaatactcatgctctttttct

SEQ ID NO: 7334710 - DNA, 21 bp, Homo sapiens
acaatactatttgggggaagt

SEQ ID NO: 7334711 - DNA, 22 bp, Homo sapiens
acaatactattttcagtatcct

SEQ ID NO: 7334712 - DNA, 22 bp, Homo sapiens
acaatactagccaaggttatta

SEQ ID NO: 7334713 - DNA, 20 bp, Homo sapiens
acaatacaggttgtgtctga

SEQ ID NO: 7334714 - DNA, 19 bp, Homo sapiens
acaatagaaaagtcttttg

SEQ ID NO: 7334715 - DNA, 22 bp, Homo sapiens
acaatacttaccaatgtttttg

SEQ ID NO: 7334716 - DNA, 22 bp, Homo sapiens
acaatacttaccaatgtttttg

SEQ ID NO: 7334717 - DNA, 21 bp, Homo sapiens
agagaagggactcttccagtc

SEQ ID NO: 7334718 - DNA, 22 bp, Homo sapiens
agagaaggcatagaacttgagt

SEQ ID NO: 7334719 - DNA, 22 bp, Homo sapiens
agagaagggaagggattcaccc

SEQ ID NO: 7334720 - DNA, 22 bp, Homo sapiens
aatgtgtagcatttaatgcagt

SEQ ID NO: 7334721 - DNA, 22 bp, Homo sapiens
agagaagggggaaagatctcac

SEQ ID NO: 7334722 - DNA, 22 bp, Homo sapiens
agagatgaaaagggtactgagg

SEQ ID NO: 7334723 - DNA, 22 bp, Homo sapiens
aatgtatgtgtatatcaaatca

SEQ ID NO: 7334724 - DNA, 22 bp, Homo sapiens
aatgtatggattcatgtctgtg

SEQ ID NO: 7334725 - DNA, 22 bp, Homo sapiens
agacatgtccacaaagcattca

SEQ ID NO: 7334726 - DNA, 22 bp, Homo sapiens
agacatgcattgcaatatccat

SEQ ID NO: 7334727 - DNA, 22 bp, Homo sapiens
agacagggtgatcgcttgagcc

SEQ ID NO: 7334728 - DNA, 20 bp, Homo sapiens
aatgctgcttctttttgcat

SEQ ID NO: 7334729 - DNA, 22 bp, Homo sapiens
agaggaagtaatcaggacctgc

SEQ ID NO: 7334730 - DNA, 21 bp, Homo sapiens
agaggaagtgattggtctggc

SEQ ID NO: 7334731 - DNA, 22 bp, Homo sapiens
agaggagtattttctaagggaa

SEQ ID NO: 7334732 - DNA, 22 bp, Homo sapiens
agaggagtgggaagcagtgcaa

SEQ ID NO: 7334733 - DNA, 22 bp, Homo sapiens
agaggacaaaatgagaagtgct

SEQ ID NO: 7334734 - DNA, 22 bp, Homo sapiens
agaggaggtccttttctgatgt

SEQ ID NO: 7334735 - DNA, 22 bp, Homo sapiens
agaggaggtggtgatgctttaa

SEQ ID NO: 7334736 - DNA, 22 bp, Homo sapiens
agaggaggtggtgatgctttaa

SEQ ID NO: 7334737 - DNA, 22 bp, Homo sapiens
aatttcggttcaaggcccagtt

SEQ ID NO: 7334738 - DNA, 18 bp, Homo sapiens
aatttccatatgaattgc

SEQ ID NO: 7334739 - DNA, 22 bp, Homo sapiens
agaggatgttctaggcactcat

SEQ ID NO: 7334740 - DNA, 22 bp, Homo sapiens
aatttcaattacttttgcacca

SEQ ID NO: 7334741 - DNA, 22 bp, Homo sapiens
aattcattaagaaagagctaaa

SEQ ID NO: 7334742 - DNA, 22 bp, Homo sapiens
aattcatagcaacaaagaccca

SEQ ID NO: 7334743 - DNA, 22 bp, Homo sapiens
agagctgagcaccaagcatggt

SEQ ID NO: 7334744 - DNA, 22 bp, Homo sapiens
agagctgcgtctattcacaatc

SEQ ID NO: 7334745 - DNA, 22 bp, Homo sapiens
agagctgcagggtggacccagg

SEQ ID NO: 7334746 - DNA, 21 bp, Homo sapiens
aattacagatggaattacaga

SEQ ID NO: 7334747 - DNA, 22 bp, Homo sapiens
agagcctggcaaaaggtcctgc

SEQ ID NO: 7334748 - DNA, 21 bp, Homo sapiens
aattacagatggaattacaga

SEQ ID NO: 7334749 - DNA, 22 bp, Homo sapiens
aattaattttgttcattcagtc

SEQ ID NO: 7334750 - DNA, 22 bp, Homo sapiens
acagaggccatgagctgccacc

SEQ ID NO: 7334751 - DNA, 22 bp, Homo sapiens
acagaggccatgagctgccacc

SEQ ID NO: 7334752 - DNA, 17 bp, Homo sapiens
acagaggcaggagtgga

SEQ ID NO: 7334753 - DNA, 20 bp, Homo sapiens
acagaatatgctggttgtgg

SEQ ID NO: 7334754 - DNA, 22 bp, Homo sapiens
acagaatattggttactgttgc

SEQ ID NO: 7334755 - DNA, 22 bp, Homo sapiens
acagaatagtcagctgtaggcc

SEQ ID NO: 7334756 - DNA, 22 bp, Homo sapiens
acagaataggtacagtcagtca

SEQ ID NO: 7334757 - DNA, 22 bp, Homo sapiens
acagaatagtagcttaaagtca

SEQ ID NO: 7334758 - DNA, 22 bp, Homo sapiens
acagaatatttggcatgcgtct

SEQ ID NO: 7334759 - DNA, 22 bp, Homo sapiens
acagaatatttggcatgcgtct

SEQ ID NO: 7334760 - DNA, 22 bp, Homo sapiens
acagaagctcaagagagcagtg

SEQ ID NO: 7334761 - DNA, 22 bp, Homo sapiens
acagaaggacttgagaaagaca

SEQ ID NO: 7334762 - DNA, 22 bp, Homo sapiens
acagaaggcggggacaaggcgg

SEQ ID NO: 7334763 - DNA, 22 bp, Homo sapiens
acagaaggcggggacaaggcgg

SEQ ID NO: 7334764 - DNA, 21 bp, Homo sapiens
acagaagcggcgagtggcccc

SEQ ID NO: 7334765 - DNA, 23 bp, Homo sapiens
acagaagccaggagccgctgggc

SEQ ID NO: 7334766 - DNA, 22 bp, Homo sapiens
acagaacttggaacttttcaca

SEQ ID NO: 7334767 - DNA, 22 bp, Homo sapiens
acagaactttctgatcctgagc

SEQ ID NO: 7334768 - DNA, 22 bp, Homo sapiens
acagaacttccagggaacatac

SEQ ID NO: 7334769 - DNA, 22 bp, Homo sapiens
acagaagtgtctttttcattca

SEQ ID NO: 7334770 - DNA, 22 bp, Homo sapiens
acagaagtgttgaagttttcat

SEQ ID NO: 7334771 - DNA, 22 bp, Homo sapiens
acagaagttggaattagatact

SEQ ID NO: 7334772 - DNA, 22 bp, Homo sapiens
acagaatactcataagaagggg

SEQ ID NO: 7334773 - DNA, 22 bp, Homo sapiens
acagaatactacagactggtta

SEQ ID NO: 7334774 - DNA, 22 bp, Homo sapiens
acagaataactcttgcttgagt

SEQ ID NO: 7334775 - DNA, 22 bp, Homo sapiens
acagaataactcttgcttgagt

SEQ ID NO: 7334776 - DNA, 22 bp, Homo sapiens
acagaataaggtttatctctcc

SEQ ID NO: 7334777 - DNA, 22 bp, Homo sapiens
acagaagtttcaagtaagaagt

SEQ ID NO: 7334778 - DNA, 22 bp, Homo sapiens
agcgggctcaagtggccagcag

SEQ ID NO: 7334779 - DNA, 22 bp, Homo sapiens
agcgggtgctgtgtcagccctc

SEQ ID NO: 7334780 - DNA, 22 bp, Homo sapiens
agcggtggtgtcggcagcggct

SEQ ID NO: 7334781 - DNA, 22 bp, Homo sapiens
agcgggcaccctttgagggttt

SEQ ID NO: 7334782 - DNA, 22 bp, Homo sapiens
agcgggcaccctttgagggttt

SEQ ID NO: 7334783 - DNA, 20 bp, Homo sapiens
agcggctggcggaggacacg

SEQ ID NO: 7334784 - DNA, 22 bp, Homo sapiens
agcggctgctccgcaggctggc

SEQ ID NO: 7334785 - DNA, 22 bp, Homo sapiens
agccttcaacctagctagagca

SEQ ID NO: 7334786 - DNA, 22 bp, Homo sapiens
agccttcactgggaccttggat

SEQ ID NO: 7334787 - DNA, 22 bp, Homo sapiens
acagataattagcataaatgct

SEQ ID NO: 7334788 - DNA, 22 bp, Homo sapiens
agctaaatgtgaaatgtcaacc

SEQ ID NO: 7334789 - DNA, 22 bp, Homo sapiens
agctaaatgttgcttaaaattt

SEQ ID NO: 7334790 - DNA, 22 bp, Homo sapiens
agcgtggactgctgggcaaggt

SEQ ID NO: 7334791 - DNA, 22 bp, Homo sapiens
agcgtgggtccaaggctctggt

SEQ ID NO: 7334792 - DNA, 22 bp, Homo sapiens
agcgtggatgtggggcgcggct

SEQ ID NO: 7334793 - DNA, 22 bp, Homo sapiens
agcgtgggtccaaggctctggt

SEQ ID NO: 7334794 - DNA, 22 bp, Homo sapiens
acagagggtttctaaggatttg

SEQ ID NO: 7334795 - DNA, 22 bp, Homo sapiens
acagagggtctgggcacaggac

SEQ ID NO: 7334796 - DNA, 22 bp, Homo sapiens
acagagggtctgggcacaggac

SEQ ID NO: 7334797 - DNA, 22 bp, Homo sapiens
acagagggtctgggcacaggac

SEQ ID NO: 7334798 - DNA, 22 bp, Homo sapiens
acagagggtgtggaggaagacg

SEQ ID NO: 7334799 - DNA, 19 bp, Homo sapiens
acagagggcaactgagaaa

SEQ ID NO: 7334800 - DNA, 21 bp, Homo sapiens
agctgaggtaaggcaagagag

SEQ ID NO: 7334801 - DNA, 23 bp, Homo sapiens
agctgaggtgcagatccaaagaa

SEQ ID NO: 7334802 - DNA, 22 bp, Homo sapiens
agctgatgtgtccggagcagct

SEQ ID NO: 7334803 - DNA, 21 bp, Homo sapiens
agctgaggtaaggcaagagag

SEQ ID NO: 7334804 - DNA, 22 bp, Homo sapiens
acagcagtcttaacacattgca

SEQ ID NO: 7334805 - DNA, 22 bp, Homo sapiens
acagcaggttattgttatggca

SEQ ID NO: 7334806 - DNA, 22 bp, Homo sapiens
acagcaggttattgttatggca

SEQ ID NO: 7334807 - DNA, 22 bp, Homo sapiens
acagcaggcccatactggaagg

SEQ ID NO: 7334808 - DNA, 22 bp, Homo sapiens
acagcagggaatatgggaattg

SEQ ID NO: 7334809 - DNA, 17 bp, Homo sapiens
acagcaggcccggaggg

SEQ ID NO: 7334810 - DNA, 17 bp, Homo sapiens
acagcagggaagtgttg

SEQ ID NO: 7334811 - DNA, 22 bp, Homo sapiens
acagatagatttgagggaggct

SEQ ID NO: 7334812 - DNA, 22 bp, Homo sapiens
acagcagaccactactagtagg

SEQ ID NO: 7334813 - DNA, 22 bp, Homo sapiens
acagcagagtggagatgagcac

SEQ ID NO: 7334814 - DNA, 22 bp, Homo sapiens
acagcagagtggagatgagcac

SEQ ID NO: 7334815 - DNA, 20 bp, Homo sapiens
acagcagataccacaactat

SEQ ID NO: 7334816 - DNA, 22 bp, Homo sapiens
acagcagagtgtgagatagcca

SEQ ID NO: 7334817 - DNA, 22 bp, Homo sapiens
acagcagagtgtgagatagcca

SEQ ID NO: 7334818 - DNA, 22 bp, Homo sapiens
acagcagatctggctacaggtt

SEQ ID NO: 7334819 - DNA, 22 bp, Homo sapiens
acagcagatctggctacaggtt

SEQ ID NO: 7334820 - DNA, 22 bp, Homo sapiens
acagcagcaatagcagtgacat

SEQ ID NO: 7334821 - DNA, 22 bp, Homo sapiens
acagcagcaatagcagtgacat

SEQ ID NO: 7334822 - DNA, 22 bp, Homo sapiens
acagcagcataaactgactaag

SEQ ID NO: 7334823 - DNA, 22 bp, Homo sapiens
acagcagcagaccagcatatgt

SEQ ID NO: 7334824 - DNA, 22 bp, Homo sapiens
acagcagccagccactgtgagc

SEQ ID NO: 7334825 - DNA, 22 bp, Homo sapiens
acagcagccagccactgtgagc

SEQ ID NO: 7334826 - DNA, 22 bp, Homo sapiens
acagcagcctgcagccctgtgt

SEQ ID NO: 7334827 - DNA, 20 bp, Homo sapiens
acagcagccttgctagaaac

SEQ ID NO: 7334828 - DNA, 21 bp, Homo sapiens
agcaggtgtaaaggaggaaat

SEQ ID NO: 7334829 - DNA, 22 bp, Homo sapiens
agcaggtgagcacagccaggct

SEQ ID NO: 7334830 - DNA, 22 bp, Homo sapiens
agcaggtgtcactttcactcca

SEQ ID NO: 7334831 - DNA, 22 bp, Homo sapiens
acactgtgtgacttctgagact

SEQ ID NO: 7334832 - DNA, 22 bp, Homo sapiens
agccaaggtatcatgagaggca

SEQ ID NO: 7334833 - DNA, 22 bp, Homo sapiens
agccaagggtcagctgcacaga

SEQ ID NO: 7334834 - DNA, 22 bp, Homo sapiens
agccaaggcagctagagctctg

SEQ ID NO: 7334835 - DNA, 22 bp, Homo sapiens
agccaaggacacggagcctcct

SEQ ID NO: 7334836 - DNA, 18 bp, Homo sapiens
agccaaggaggaggagga

SEQ ID NO: 7334837 - DNA, 22 bp, Homo sapiens
agccagctgtgtggtcaggcaa

SEQ ID NO: 7334838 - DNA, 22 bp, Homo sapiens
agccagctgtgggctcaggcgg

SEQ ID NO: 7334839 - DNA, 22 bp, Homo sapiens
agccagctggtgggtcagctgg

SEQ ID NO: 7334840 - DNA, 22 bp, Homo sapiens
agccagaggccagcctgcctca

SEQ ID NO: 7334841 - DNA, 22 bp, Homo sapiens
acactgttttagggaagaaaat

SEQ ID NO: 7334842 - DNA, 22 bp, Homo sapiens
agccagagatccatccctagga

SEQ ID NO: 7334843 - DNA, 22 bp, Homo sapiens
agccagagattgagatgcaggc

SEQ ID NO: 7334844 - DNA, 22 bp, Homo sapiens
agccagaggaagcctggccctc

SEQ ID NO: 7334845 - DNA, 16 bp, Homo sapiens
acacagttttaaggca

SEQ ID NO: 7334846 - DNA, 22 bp, Homo sapiens
acacagtttttcagacagagat

SEQ ID NO: 7334847 - DNA, 22 bp, Homo sapiens
agcaggcttgttatgtctgaga

SEQ ID NO: 7334848 - DNA, 22 bp, Homo sapiens
agcagggaagcctccagaacct

SEQ ID NO: 7334849 - DNA, 22 bp, Homo sapiens
acacagttctttcactgttggt

SEQ ID NO: 7334850 - DNA, 22 bp, Homo sapiens
acacagttgattgtcactcagg

SEQ ID NO: 7334851 - DNA, 22 bp, Homo sapiens
acacagtttatggtattctgtt

SEQ ID NO: 7334852 - DNA, 22 bp, Homo sapiens
acacagtttaaacgattagtac

SEQ ID NO: 7334853 - DNA, 22 bp, Homo sapiens
acacagttggtggctcagtctg

SEQ ID NO: 7334854 - DNA, 22 bp, Homo sapiens
acacagttcttagcaggtgtct

SEQ ID NO: 7334855 - DNA, 22 bp, Homo sapiens
acacagttctcttcttgtaact

SEQ ID NO: 7334856 - DNA, 22 bp, Homo sapiens
acacagttcgttgttttctact

SEQ ID NO: 7334857 - DNA, 22 bp, Homo sapiens
acacagttcgtgcttttctatt

SEQ ID NO: 7334858 - DNA, 22 bp, Homo sapiens
acacagttcatgcatgaggtct

SEQ ID NO: 7334859 - DNA, 22 bp, Homo sapiens
acacatcagaaatatgaatgag

SEQ ID NO: 7334860 - DNA, 22 bp, Homo sapiens
acacatcatgccaagtttcacc

SEQ ID NO: 7334861 - DNA, 22 bp, Homo sapiens
acacatcatgccaagtttcacc

SEQ ID NO: 7334862 - DNA, 22 bp, Homo sapiens
agcagggaagcctccagaacct

SEQ ID NO: 7334863 - DNA, 22 bp, Homo sapiens
acacagtattgtgactataact

SEQ ID NO: 7334864 - DNA, 22 bp, Homo sapiens
acacagtattgtgactataact

SEQ ID NO: 7334865 - DNA, 22 bp, Homo sapiens
acacagtgtcagggcaggggcc

SEQ ID NO: 7334866 - DNA, 22 bp, Homo sapiens
acacagttcaggatcaaatagc

SEQ ID NO: 7334867 - DNA, 22 bp, Homo sapiens
acacagtgtgtgcagtcggacg

SEQ ID NO: 7334868 - DNA, 22 bp, Homo sapiens
acacagggcggaaagcatgaga

SEQ ID NO: 7334869 - DNA, 22 bp, Homo sapiens
acacagggcggaaagcatgaga

SEQ ID NO: 7334870 - DNA, 22 bp, Homo sapiens
acacagtatcaaatttcatctt

SEQ ID NO: 7334871 - DNA, 22 bp, Homo sapiens
acacagtatcaaatttcatctt

SEQ ID NO: 7334872 - DNA, 22 bp, Homo sapiens
acacaatttcctgtccatatgt

SEQ ID NO: 7334873 - DNA, 22 bp, Homo sapiens
acacaatttcctgtccatatgt

SEQ ID NO: 7334874 - DNA, 22 bp, Homo sapiens
acacaatgtcatcataatgtca

SEQ ID NO: 7334875 - DNA, 22 bp, Homo sapiens
acacaatttcataaacaccatg

SEQ ID NO: 7334876 - DNA, 23 bp, Homo sapiens
acacaatagagtactattcagcc

SEQ ID NO: 7334877 - DNA, 22 bp, Homo sapiens
acacaagaataatgatgaaggt

SEQ ID NO: 7334878 - DNA, 22 bp, Homo sapiens
acacaagattgtgtattgaatt

SEQ ID NO: 7334879 - DNA, 22 bp, Homo sapiens
aatagcacacttgtgagcatta

SEQ ID NO: 7334880 - DNA, 22 bp, Homo sapiens
aatagcacacttgtgagcatta

SEQ ID NO: 7334881 - DNA, 22 bp, Homo sapiens
aatagcacacttgtgagcatta

SEQ ID NO: 7334882 - DNA, 22 bp, Homo sapiens
aatagcagtttttcactgatat

SEQ ID NO: 7334883 - DNA, 22 bp, Homo sapiens
aatagcagtttttcactgatat

SEQ ID NO: 7334884 - DNA, 22 bp, Homo sapiens
actgtcctagaacctgcagctc

SEQ ID NO: 7334885 - DNA, 22 bp, Homo sapiens
actgtcctgaatactgcatgac

SEQ ID NO: 7334886 - DNA, 22 bp, Homo sapiens
actgtaatattttaagatgtct

SEQ ID NO: 7334887 - DNA, 22 bp, Homo sapiens
actgtaattatctgaacgtgca

SEQ ID NO: 7334888 - DNA, 22 bp, Homo sapiens
actgtaattggattgtctgact

SEQ ID NO: 7334889 - DNA, 22 bp, Homo sapiens
actgtacacacttctctgtctt

SEQ ID NO: 7334890 - DNA, 22 bp, Homo sapiens
actgtacacagtggtgtactgt

SEQ ID NO: 7334891 - DNA, 22 bp, Homo sapiens
actgtacaactgctgagcagaa

SEQ ID NO: 7334892 - DNA, 22 bp, Homo sapiens
actgtacaacctctgcccctgt

SEQ ID NO: 7334893 - DNA, 22 bp, Homo sapiens
actgtacaaatattgcaaaata

SEQ ID NO: 7334894 - DNA, 22 bp, Homo sapiens
actgtacatatggattctaaga

SEQ ID NO: 7334895 - DNA, 22 bp, Homo sapiens
actgtacacgtgtcatttacag

SEQ ID NO: 7334896 - DNA, 22 bp, Homo sapiens
actgtacacattcgtcaagact

SEQ ID NO: 7334897 - DNA, 22 bp, Homo sapiens
actgtacatgcatcttgtctat

SEQ ID NO: 7334898 - DNA, 22 bp, Homo sapiens
aataaaatggtcagttttctca

SEQ ID NO: 7334899 - DNA, 22 bp, Homo sapiens
actgggaggcatctggagctga

SEQ ID NO: 7334900 - DNA, 20 bp, Homo sapiens
aataaaagaagccttcaccc

SEQ ID NO: 7334901 - DNA, 22 bp, Homo sapiens
actgcatgataataatagcaga

SEQ ID NO: 7334902 - DNA, 22 bp, Homo sapiens
actgcatgtaaggcaatatgtt

SEQ ID NO: 7334903 - DNA, 22 bp, Homo sapiens
actgcagtcatcatctccctgg

SEQ ID NO: 7334904 - DNA, 18 bp, Homo sapiens
actctttctgcccacagg

SEQ ID NO: 7334905 - DNA, 22 bp, Homo sapiens
actcttggtcagaacaattcag

SEQ ID NO: 7334906 - DNA, 22 bp, Homo sapiens
aagtgtttatttataacgatct

SEQ ID NO: 7334907 - DNA, 22 bp, Homo sapiens
aagtgtgggaagtaggtggcga

SEQ ID NO: 7334908 - DNA, 22 bp, Homo sapiens
aagtgggttggacaaatgaccc

SEQ ID NO: 7334909 - DNA, 22 bp, Homo sapiens
aatgaagttctattcattttct

SEQ ID NO: 7334910 - DNA, 22 bp, Homo sapiens
aatgaagattatggtgattaag

SEQ ID NO: 7334911 - DNA, 22 bp, Homo sapiens
agaagccaccagctgaggaaga

SEQ ID NO: 7334912 - DNA, 22 bp, Homo sapiens
agaagcagctttcaaggtgatt

SEQ ID NO: 7334913 - DNA, 20 bp, Homo sapiens
aatgaatgaacgaatggatg

SEQ ID NO: 7334914 - DNA, 22 bp, Homo sapiens
agaagaaactgtcggggatatt

SEQ ID NO: 7334915 - DNA, 22 bp, Homo sapiens
agaacttaattcagtgacttaa

SEQ ID NO: 7334916 - DNA, 22 bp, Homo sapiens
aatgaagaaatggacatcttta

SEQ ID NO: 7334917 - DNA, 22 bp, Homo sapiens
aatgaactgtgttaactgaata

SEQ ID NO: 7334918 - DNA, 22 bp, Homo sapiens
agaactgtcacgagtgacaaag

SEQ ID NO: 7334919 - DNA, 21 bp, Homo sapiens
agaactgattaaataagcagt

SEQ ID NO: 7334920 - DNA, 22 bp, Homo sapiens
agaacacactgggggaaacaag

SEQ ID NO: 7334921 - DNA, 22 bp, Homo sapiens
agaacaattgccccaaagcttg

SEQ ID NO: 7334922 - DNA, 22 bp, Homo sapiens
agaactatacattactcattga

SEQ ID NO: 7334923 - DNA, 22 bp, Homo sapiens
agaaggaaaacctgtcttatgt

SEQ ID NO: 7334924 - DNA, 22 bp, Homo sapiens
agaaggaaacagctgtgctttg

SEQ ID NO: 7334925 - DNA, 22 bp, Homo sapiens
agaagcttcaagatatttggta

SEQ ID NO: 7334926 - DNA, 22 bp, Homo sapiens
agaaggaagccaggagggtgca

SEQ ID NO: 7334927 - DNA, 22 bp, Homo sapiens
agaaggaaggctgagtgctgat

SEQ ID NO: 7334928 - DNA, 22 bp, Homo sapiens
agaaggaaggctgagtgctgat

SEQ ID NO: 7334929 - DNA, 22 bp, Homo sapiens
aatgccatcagagaaaactctt

SEQ ID NO: 7334930 - DNA, 23 bp, Homo sapiens
aatgccatattggatttcttcag

SEQ ID NO: 7334931 - DNA, 22 bp, Homo sapiens
aatgcctggcgattagtgtagc

SEQ ID NO: 7334932 - DNA, 22 bp, Homo sapiens
aatgccattttctataaaaaga

SEQ ID NO: 7334933 - DNA, 22 bp, Homo sapiens
aatgccattttctataaaaaga

SEQ ID NO: 7334934 - DNA, 22 bp, Homo sapiens
aatgcctaagtaattattttga

SEQ ID NO: 7334935 - DNA, 22 bp, Homo sapiens
aatgcataccatgtcatctttg

SEQ ID NO: 7334936 - DNA, 22 bp, Homo sapiens
aatgcatgtttcctctcagcag

SEQ ID NO: 7334937 - DNA, 22 bp, Homo sapiens
aatgcattgattgctggaaata

SEQ ID NO: 7334938 - DNA, 22 bp, Homo sapiens
aataggtagccagatatataaa

SEQ ID NO: 7334939 - DNA, 22 bp, Homo sapiens
aatagctgattaatgtactacc

SEQ ID NO: 7334940 - DNA, 22 bp, Homo sapiens
aatagcatgttcatgataaaat

SEQ ID NO: 7334941 - DNA, 22 bp, Homo sapiens
aatagcatcttctgagacaaag

SEQ ID NO: 7334942 - DNA, 22 bp, Homo sapiens
aatcacagagtccagcagatga

SEQ ID NO: 7334943 - DNA, 22 bp, Homo sapiens
aatcacagccagcttccgctat

SEQ ID NO: 7334944 - DNA, 22 bp, Homo sapiens
agaaagggatgaggtagctgct

SEQ ID NO: 7334945 - DNA, 22 bp, Homo sapiens
agaaagggagagccagcacacg

SEQ ID NO: 7334946 - DNA, 22 bp, Homo sapiens
agaaagggagcgtggatcaatt

SEQ ID NO: 7334947 - DNA, 22 bp, Homo sapiens
agaaagggaccagttcttttga

SEQ ID NO: 7334948 - DNA, 22 bp, Homo sapiens
agaaagggagagccagcacacg

SEQ ID NO: 7334949 - DNA, 22 bp, Homo sapiens
agaaagggaactggcaaagcca

SEQ ID NO: 7334950 - DNA, 22 bp, Homo sapiens
agaaagggatgaggtagctgct

SEQ ID NO: 7334951 - DNA, 22 bp, Homo sapiens
aatctacatgcaatatttttag

SEQ ID NO: 7334952 - DNA, 22 bp, Homo sapiens
aaggggtgggcattagagcagt

SEQ ID NO: 7334953 - DNA, 22 bp, Homo sapiens
aagggtgggcaccgccaggtca

SEQ ID NO: 7334954 - DNA, 22 bp, Homo sapiens
aagggtgggccctggcagccat

SEQ ID NO: 7334955 - DNA, 22 bp, Homo sapiens
aagggtggtgtaggagatcaaa

SEQ ID NO: 7334956 - DNA, 22 bp, Homo sapiens
accagagggcaaaccccagtgt

SEQ ID NO: 7334957 - DNA, 22 bp, Homo sapiens
aaggggggcacctgcatgcccg

SEQ ID NO: 7334958 - DNA, 22 bp, Homo sapiens
aaggggtgagcagaggcttcgc

SEQ ID NO: 7334959 - DNA, 22 bp, Homo sapiens
aaggggtgagcagaggcttcgc

SEQ ID NO: 7334960 - DNA, 22 bp, Homo sapiens
acatttcagtaagtgttaattt

SEQ ID NO: 7334961 - DNA, 22 bp, Homo sapiens
aagggaggggatgtaagcctgg

SEQ ID NO: 7334962 - DNA, 22 bp, Homo sapiens
aagggaggtaaagctatttaaa

SEQ ID NO: 7334963 - DNA, 22 bp, Homo sapiens
aagggcagaaagggacgctttg

SEQ ID NO: 7334964 - DNA, 22 bp, Homo sapiens
acatttcagattcatgaagtga

SEQ ID NO: 7334965 - DNA, 22 bp, Homo sapiens
acatttcagatgtaatgtgatg

SEQ ID NO: 7334966 - DNA, 22 bp, Homo sapiens
acatttcagatgtaatgtgatg

SEQ ID NO: 7334967 - DNA, 22 bp, Homo sapiens
aagtatatttagctgagcttgt

SEQ ID NO: 7334968 - DNA, 22 bp, Homo sapiens
aagtagatgatctttctgcata

SEQ ID NO: 7334969 - DNA, 22 bp, Homo sapiens
aagtcccatctgcctccatgta

SEQ ID NO: 7334970 - DNA, 22 bp, Homo sapiens
acccagggcttaaggcggtgca

SEQ ID NO: 7334971 - DNA, 22 bp, Homo sapiens
acccagggctcaagcgtaggca

SEQ ID NO: 7334972 - DNA, 22 bp, Homo sapiens
acctctcttgtagctgctggtg

SEQ ID NO: 7334973 - DNA, 22 bp, Homo sapiens
acctctcagggccttggtttcc

SEQ ID NO: 7334974 - DNA, 22 bp, Homo sapiens
aaggaagaagggaagttactta

SEQ ID NO: 7334975 - DNA, 22 bp, Homo sapiens
aagcttcaggcccacccatgtc

SEQ ID NO: 7334976 - DNA, 22 bp, Homo sapiens
aagctgttagggagtggtaggt

SEQ ID NO: 7334977 - DNA, 22 bp, Homo sapiens
aaggatttttggaatgagatgg

SEQ ID NO: 7334978 - DNA, 22 bp, Homo sapiens
aaggacacaaaacagcagcagt

SEQ ID NO: 7334979 - DNA, 19 bp, Homo sapiens
aaggacacaacagagatag

SEQ ID NO: 7334980 - DNA, 22 bp, Homo sapiens
aaggacaagtagtatttgcatc

SEQ ID NO: 7334981 - DNA, 22 bp, Homo sapiens
aaggacaatgaagacagccaca

SEQ ID NO: 7334982 - DNA, 22 bp, Homo sapiens
aaggacacggggctggctctgg

SEQ ID NO: 7334983 - DNA, 22 bp, Homo sapiens
aaggacacctgcagagggacca

SEQ ID NO: 7334984 - DNA, 18 bp, Homo sapiens
aaggacacagtccctgct

SEQ ID NO: 7334985 - DNA, 22 bp, Homo sapiens
aaggacagagagccattccaga

SEQ ID NO: 7334986 - DNA, 22 bp, Homo sapiens
aaggacagaaacagattgctgg

SEQ ID NO: 7334987 - DNA, 22 bp, Homo sapiens
aaggaagatgctggcctgggga

SEQ ID NO: 7334988 - DNA, 22 bp, Homo sapiens
aaggaaggaattgatcatgcgc

SEQ ID NO: 7334989 - DNA, 22 bp, Homo sapiens
aaggaagggaaatagtgatgtc

SEQ ID NO: 7334990 - DNA, 22 bp, Homo sapiens
aaggaaggtactcagtgattct

SEQ ID NO: 7334991 - DNA, 22 bp, Homo sapiens
aaggaaggttcatagtcaaaga

SEQ ID NO: 7334992 - DNA, 22 bp, Homo sapiens
aaggaagtgattttcatgtcaa

SEQ ID NO: 7334993 - DNA, 22 bp, Homo sapiens
aaggaattccctttctgacaga

SEQ ID NO: 7334994 - DNA, 22 bp, Homo sapiens
acatgacacaggcctggccaat

SEQ ID NO: 7334995 - DNA, 22 bp, Homo sapiens
acatgcatatacttaaatatgt

SEQ ID NO: 7334996 - DNA, 21 bp, Homo sapiens
acatgcatagagagatttctg

SEQ ID NO: 7334997 - DNA, 22 bp, Homo sapiens
acatgcataggagaagtcttta

SEQ ID NO: 7334998 - DNA, 22 bp, Homo sapiens
acatgcatggacatgtatatat

SEQ ID NO: 7334999 - DNA, 22 bp, Homo sapiens
acatgcatggacatgtatatat

SEQ ID NO: 7335000 - DNA, 22 bp, Homo sapiens
acatgcatggacatgtatatat

SEQ ID NO: 7335001 - DNA, 22 bp, Homo sapiens
acatgcatggctgcttaaatta

SEQ ID NO: 7335002 - DNA, 22 bp, Homo sapiens
acatgcatggggtaatggtatt

SEQ ID NO: 7335003 - DNA, 22 bp, Homo sapiens
acatctcaaattccaggctcca

SEQ ID NO: 7335004 - DNA, 22 bp, Homo sapiens
acatcctcccgatctactggct

SEQ ID NO: 7335005 - DNA, 22 bp, Homo sapiens
acatgaatgaagactttacaat

SEQ ID NO: 7335006 - DNA, 22 bp, Homo sapiens
acatgaagtggtcagatcaaac

SEQ ID NO: 7335007 - DNA, 22 bp, Homo sapiens
acatgaagcaagaaagatgcta

SEQ ID NO: 7335008 - DNA, 22 bp, Homo sapiens
acatctcagaactgagtaaccg

SEQ ID NO: 7335009 - DNA, 22 bp, Homo sapiens
acatgaacactgcttgccacat

SEQ ID NO: 7335010 - DNA, 22 bp, Homo sapiens
aaggcattacctaagtttggga

SEQ ID NO: 7335011 - DNA, 22 bp, Homo sapiens
aaggcattatgatttgagtacc

SEQ ID NO: 7335012 - DNA, 22 bp, Homo sapiens
aaggcattgagcagttacagta

SEQ ID NO: 7335013 - DNA, 22 bp, Homo sapiens
aaggccagagcagactggagtt

SEQ ID NO: 7335014 - DNA, 22 bp, Homo sapiens
aaggcaatagtattaaactgga

SEQ ID NO: 7335015 - DNA, 22 bp, Homo sapiens
aaggcaatatcaagagaattcg

SEQ ID NO: 7335016 - DNA, 22 bp, Homo sapiens
aaggcaatattgagtttccctt

SEQ ID NO: 7335017 - DNA, 22 bp, Homo sapiens
aaggcaatgaatactgtttttg

SEQ ID NO: 7335018 - DNA, 22 bp, Homo sapiens
aaggcaatgactgatttagaat

SEQ ID NO: 7335019 - DNA, 22 bp, Homo sapiens
aaggcaatgagggagatagagt

SEQ ID NO: 7335020 - DNA, 22 bp, Homo sapiens
aaggcaatgctaagaggtttgg

SEQ ID NO: 7335021 - DNA, 22 bp, Homo sapiens
aaggcaatggcaagagaaagca

SEQ ID NO: 7335022 - DNA, 22 bp, Homo sapiens
aaggcaatgggatggatcatgt

SEQ ID NO: 7335023 - DNA, 22 bp, Homo sapiens
aaggcaatggtttctgtgcctt

SEQ ID NO: 7335024 - DNA, 22 bp, Homo sapiens
aaggcaatgtaaattacagctt

SEQ ID NO: 7335025 - DNA, 22 bp, Homo sapiens
aaggcaatgtcatggctcttgc

SEQ ID NO: 7335026 - DNA, 22 bp, Homo sapiens
aaggcaatgttagcaacataat

SEQ ID NO: 7335027 - DNA, 22 bp, Homo sapiens
aaggcaattgagaagaaacaga

SEQ ID NO: 7335028 - DNA, 22 bp, Homo sapiens
aaggcaattgattatttttcct

SEQ ID NO: 7335029 - DNA, 22 bp, Homo sapiens
aaggcaattgcagtttttgcca

SEQ ID NO: 7335030 - DNA, 22 bp, Homo sapiens
aaggcaattggcttgtataaga

SEQ ID NO: 7335031 - DNA, 22 bp, Homo sapiens
aaggcaatttgttgtgaggatt

SEQ ID NO: 7335032 - DNA, 22 bp, Homo sapiens
aaggcaatttcagggctctcta

SEQ ID NO: 7335033 - DNA, 22 bp, Homo sapiens
aaggcaatttggaagaggcaga

SEQ ID NO: 7335034 - DNA, 22 bp, Homo sapiens
taacctggggcggtttcccaat

SEQ ID NO: 7335035 - DNA, 22 bp, Homo sapiens
taacctgggatctgacgggatg

SEQ ID NO: 7335036 - DNA, 20 bp, Homo sapiens
taacggaagctgtaaaatct

SEQ ID NO: 7335037 - DNA, 22 bp, Homo sapiens
taactgaatgtattacaacaga

SEQ ID NO: 7335038 - DNA, 22 bp, Homo sapiens
taaattctacaacttcaaagat

SEQ ID NO: 7335039 - DNA, 22 bp, Homo sapiens
taaattcagtgagtaatttctg

SEQ ID NO: 7335040 - DNA, 22 bp, Homo sapiens
taaattcagtgagtaatttctg

SEQ ID NO: 7335041 - DNA, 22 bp, Homo sapiens
taaatttttgttaacagcctct

SEQ ID NO: 7335042 - DNA, 20 bp, Homo sapiens
taaattagccttgaagatta

SEQ ID NO: 7335043 - DNA, 22 bp, Homo sapiens
taaattagggactttagttaat

SEQ ID NO: 7335044 - DNA, 22 bp, Homo sapiens
taaattatgttccatgtccttt

SEQ ID NO: 7335045 - DNA, 22 bp, Homo sapiens
taaattatgtcacatgactctg

SEQ ID NO: 7335046 - DNA, 22 bp, Homo sapiens
taaattatgtcacatgactctg

SEQ ID NO: 7335047 - DNA, 22 bp, Homo sapiens
taaattatgtcacatgactctg

SEQ ID NO: 7335048 - DNA, 22 bp, Homo sapiens
taaattactcaatgcacataaa

SEQ ID NO: 7335049 - DNA, 20 bp, Homo sapiens
taaattagccttgaagatta

SEQ ID NO: 7335050 - DNA, 22 bp, Homo sapiens
taaattaaagattggagaagga

SEQ ID NO: 7335051 - DNA, 22 bp, Homo sapiens
taaagtgctcataaaaatggat

SEQ ID NO: 7335052 - DNA, 22 bp, Homo sapiens
taaaagttttagttgtacataa

SEQ ID NO: 7335053 - DNA, 22 bp, Homo sapiens
gtttttattgtgtaaatgtggg

SEQ ID NO: 7335054 - DNA, 22 bp, Homo sapiens
gtttttatatcctgtggagtgt

SEQ ID NO: 7335055 - DNA, 22 bp, Homo sapiens
taaaatggtaactttcatttgc

SEQ ID NO: 7335056 - DNA, 22 bp, Homo sapiens
taaaattgcggtgaatatttcc

SEQ ID NO: 7335057 - DNA, 22 bp, Homo sapiens
taaaatttgtccctgagtgttg

SEQ ID NO: 7335058 - DNA, 22 bp, Homo sapiens
taaagggtaggttttactgtaa

SEQ ID NO: 7335059 - DNA, 22 bp, Homo sapiens
taaagggtaggttttactgtaa

SEQ ID NO: 7335060 - DNA, 22 bp, Homo sapiens
taaagggtaggttttactgtaa

SEQ ID NO: 7335061 - DNA, 22 bp, Homo sapiens
taaacagaaagcagatgtactt

SEQ ID NO: 7335062 - DNA, 22 bp, Homo sapiens
taaacactgccttggtgggtca

SEQ ID NO: 7335063 - DNA, 22 bp, Homo sapiens
taaacagaatgcgtaagaagtg

SEQ ID NO: 7335064 - DNA, 22 bp, Homo sapiens
taaacaattcctctctaggcat

SEQ ID NO: 7335065 - DNA, 22 bp, Homo sapiens
taaacaattcctctctaggcat

SEQ ID NO: 7335066 - DNA, 22 bp, Homo sapiens
taaacactcacttcatagccat

SEQ ID NO: 7335067 - DNA, 22 bp, Homo sapiens
taaacaagctgtctgatattct

SEQ ID NO: 7335068 - DNA, 22 bp, Homo sapiens
gtttcccaaattgttcacaggg

SEQ ID NO: 7335069 - DNA, 22 bp, Homo sapiens
gttttctttgaatgcttctaga

SEQ ID NO: 7335070 - DNA, 22 bp, Homo sapiens
gttttgaatactactagaactt

SEQ ID NO: 7335071 - DNA, 21 bp, Homo sapiens
gttttctttgatagagggaag

SEQ ID NO: 7335072 - DNA, 21 bp, Homo sapiens
gttttctttgatagagggaag

SEQ ID NO: 7335073 - DNA, 18 bp, Homo sapiens
gttttgtggctagtagtg

SEQ ID NO: 7335074 - DNA, 22 bp, Homo sapiens
gttttgatatatgcatacatta

SEQ ID NO: 7335075 - DNA, 22 bp, Homo sapiens
gttttgctcatttggtccaagg

SEQ ID NO: 7335076 - DNA, 22 bp, Homo sapiens
gttttgctgactcccacaggaa

SEQ ID NO: 7335077 - DNA, 21 bp, Homo sapiens
gttttgctggtatctggggat

SEQ ID NO: 7335078 - DNA, 22 bp, Homo sapiens
gttttgcttctcatgttaagtg

SEQ ID NO: 7335079 - DNA, 22 bp, Homo sapiens
gtttcattcggcagctcataag

SEQ ID NO: 7335080 - DNA, 22 bp, Homo sapiens
gttgtaaatacagtactgaaac

SEQ ID NO: 7335081 - DNA, 22 bp, Homo sapiens
gttgtacagcattccatatagg

SEQ ID NO: 7335082 - DNA, 22 bp, Homo sapiens
gtttcagatatatttgtactta

SEQ ID NO: 7335083 - DNA, 22 bp, Homo sapiens
gttgcagatgtggaactcgtgc

SEQ ID NO: 7335084 - DNA, 22 bp, Homo sapiens
gttgctcaggcaggagtacagt

SEQ ID NO: 7335085 - DNA, 22 bp, Homo sapiens
gttgggaagtgtagctccacct

SEQ ID NO: 7335086 - DNA, 22 bp, Homo sapiens
gttgggaagtgtagctccacct

SEQ ID NO: 7335087 - DNA, 22 bp, Homo sapiens
gttgggaagtatccccaaagtt

SEQ ID NO: 7335088 - DNA, 22 bp, Homo sapiens
gttgggaaggtgaacatgatgc

SEQ ID NO: 7335089 - DNA, 22 bp, Homo sapiens
gttgggaaggcaagaagtagaa

SEQ ID NO: 7335090 - DNA, 22 bp, Homo sapiens
gttcacatcacttcactgaacc

SEQ ID NO: 7335091 - DNA, 21 bp, Homo sapiens
gttcagagattattgagtcat

SEQ ID NO: 7335092 - DNA, 22 bp, Homo sapiens
gttcagagtgggaatgatcact

SEQ ID NO: 7335093 - DNA, 22 bp, Homo sapiens
gttcagatttgactggtttctc

SEQ ID NO: 7335094 - DNA, 18 bp, Homo sapiens
gttcatctttttctaaag

SEQ ID NO: 7335095 - DNA, 22 bp, Homo sapiens
gttcatctcacagataggcagt

SEQ ID NO: 7335096 - DNA, 22 bp, Homo sapiens
gttgaggaggttcagggtggtt

SEQ ID NO: 7335097 - DNA, 22 bp, Homo sapiens
gttgaggagcaagcatgtgtct

SEQ ID NO: 7335098 - DNA, 22 bp, Homo sapiens
gttgaggaggcactcactgtca

SEQ ID NO: 7335099 - DNA, 22 bp, Homo sapiens
gttcatgctaccctttcctaat

SEQ ID NO: 7335100 - DNA, 22 bp, Homo sapiens
gtgtgggaaggctaggatgctg

SEQ ID NO: 7335101 - DNA, 22 bp, Homo sapiens
gtgtgggaatggcggtcgtgca

SEQ ID NO: 7335102 - DNA, 22 bp, Homo sapiens
gtgtgggacgggtgagtggcca

SEQ ID NO: 7335103 - DNA, 22 bp, Homo sapiens
gtgtgggaaggctaggatgctg

SEQ ID NO: 7335104 - DNA, 22 bp, Homo sapiens
gtgtggcttgggtgaggcgcct

SEQ ID NO: 7335105 - DNA, 22 bp, Homo sapiens
gttaaccatgatgttttaaaag

SEQ ID NO: 7335106 - DNA, 22 bp, Homo sapiens
gttaagaatcaagacttatctt

SEQ ID NO: 7335107 - DNA, 22 bp, Homo sapiens
gttaagaatcaagacttatctt

SEQ ID NO: 7335108 - DNA, 22 bp, Homo sapiens
gttaagaagctagagatgaaca

SEQ ID NO: 7335109 - DNA, 22 bp, Homo sapiens
gttaagaatgcattatgcatat

SEQ ID NO: 7335110 - DNA, 22 bp, Homo sapiens
gttaagaattcgttctcatgtt

SEQ ID NO: 7335111 - DNA, 22 bp, Homo sapiens
gttaagaattcgttctcatgtt

SEQ ID NO: 7335112 - DNA, 22 bp, Homo sapiens
gttaatgaggacaagttttgag

SEQ ID NO: 7335113 - DNA, 22 bp, Homo sapiens
gttaatgagtgggctgtggaga

SEQ ID NO: 7335114 - DNA, 22 bp, Homo sapiens
gttaagtaccagattgtctgaa

SEQ ID NO: 7335115 - DNA, 22 bp, Homo sapiens
gttaagtaccagattgtctgaa

SEQ ID NO: 7335116 - DNA, 22 bp, Homo sapiens
gttaagtgggaccagtgtcctt

SEQ ID NO: 7335117 - DNA, 22 bp, Homo sapiens
gttaagtaaactatgatttatc

SEQ ID NO: 7335118 - DNA, 22 bp, Homo sapiens
gttaagtaaactatgatttatc

SEQ ID NO: 7335119 - DNA, 22 bp, Homo sapiens
gttaaggatgcagagcatggaa

SEQ ID NO: 7335120 - DNA, 22 bp, Homo sapiens
gttaaggatcttgagatgagga

SEQ ID NO: 7335121 - DNA, 22 bp, Homo sapiens
gtgtgcatgcatagacaccaca

SEQ ID NO: 7335122 - DNA, 22 bp, Homo sapiens
gtgctcaggggcaatcctggga

SEQ ID NO: 7335123 - DNA, 22 bp, Homo sapiens
gtgctcaggttcccatgagtgc

SEQ ID NO: 7335124 - DNA, 22 bp, Homo sapiens
gtgctcaggaagctgttcctgc

SEQ ID NO: 7335125 - DNA, 22 bp, Homo sapiens
gtgctcagggcctggctgggga

SEQ ID NO: 7335126 - DNA, 22 bp, Homo sapiens
gtgctcagcccggatgagatca

SEQ ID NO: 7335127 - DNA, 22 bp, Homo sapiens
gtgctccaacattagtgtgctt

SEQ ID NO: 7335128 - DNA, 22 bp, Homo sapiens
gtgctccaggataggctgacct

SEQ ID NO: 7335129 - DNA, 22 bp, Homo sapiens
gtgctccaggataggctgacct

SEQ ID NO: 7335130 - DNA, 22 bp, Homo sapiens
gtgctccaacattagtgtgctt

SEQ ID NO: 7335131 - DNA, 19 bp, Homo sapiens
gtgctccagggcaaggagt

SEQ ID NO: 7335132 - DNA, 22 bp, Homo sapiens
gtgctctgagtttgcatgtcag

SEQ ID NO: 7335133 - DNA, 22 bp, Homo sapiens
gtgctctgatctgtctgacatc

SEQ ID NO: 7335134 - DNA, 22 bp, Homo sapiens
gtgctctcctggctgccctgac

SEQ ID NO: 7335135 - DNA, 22 bp, Homo sapiens
gtgctctccagccccacgtgga

SEQ ID NO: 7335136 - DNA, 22 bp, Homo sapiens
gtgctccctccttcctcaagga

SEQ ID NO: 7335137 - DNA, 22 bp, Homo sapiens
gtgctcctcacagtgtggccct

SEQ ID NO: 7335138 - DNA, 22 bp, Homo sapiens
gtgctcctggccacatgaagct

SEQ ID NO: 7335139 - DNA, 22 bp, Homo sapiens
tacaaaggcggtttttctgggc

SEQ ID NO: 7335140 - DNA, 22 bp, Homo sapiens
tacaaaggcttaaagagatttc

SEQ ID NO: 7335141 - DNA, 22 bp, Homo sapiens
taattatagccgctattttgct

SEQ ID NO: 7335142 - DNA, 22 bp, Homo sapiens
taattattatgacaacaattgc

SEQ ID NO: 7335143 - DNA, 21 bp, Homo sapiens
taatggtgatggttatgttct

SEQ ID NO: 7335144 - DNA, 22 bp, Homo sapiens
taatggtgcagtgggtgtaact

SEQ ID NO: 7335145 - DNA, 22 bp, Homo sapiens
taatggtgcttctgtgagataa

SEQ ID NO: 7335146 - DNA, 22 bp, Homo sapiens
taatggtgtttttctgtaattt

SEQ ID NO: 7335147 - DNA, 22 bp, Homo sapiens
taatgtttccagtctatgatgg

SEQ ID NO: 7335148 - DNA, 22 bp, Homo sapiens
taatgtttagaagcagacagct

SEQ ID NO: 7335149 - DNA, 22 bp, Homo sapiens
taatagcattatcatcaaaact

SEQ ID NO: 7335150 - DNA, 22 bp, Homo sapiens
taatagaatagtggaaacattg

SEQ ID NO: 7335151 - DNA, 22 bp, Homo sapiens
taatagctgttattgttataac

SEQ ID NO: 7335152 - DNA, 22 bp, Homo sapiens
taatactgtatactgcaaattt

SEQ ID NO: 7335153 - DNA, 22 bp, Homo sapiens
taatactgtgcttcattttcct

SEQ ID NO: 7335154 - DNA, 22 bp, Homo sapiens
taatactgtgcttcattttcct

SEQ ID NO: 7335155 - DNA, 22 bp, Homo sapiens
taatactgtaacttggtgggtc

SEQ ID NO: 7335156 - DNA, 22 bp, Homo sapiens
taatactgtatactgcaaattt

SEQ ID NO: 7335157 - DNA, 22 bp, Homo sapiens
taatactgggaaatacttgggt

SEQ ID NO: 7335158 - DNA, 22 bp, Homo sapiens
taatactgtaacttggtgggtc

SEQ ID NO: 7335159 - DNA, 19 bp, Homo sapiens
taatactggctgtagctgg

SEQ ID NO: 7335160 - DNA, 22 bp, Homo sapiens
taatactgggaaatacttgggt

SEQ ID NO: 7335161 - DNA, 19 bp, Homo sapiens
taatactggctgtagctgg

SEQ ID NO: 7335162 - DNA, 23 bp, Homo sapiens
taatactgcttcagaggcttaga

SEQ ID NO: 7335163 - DNA, 23 bp, Homo sapiens
taatactgcttcagaggcttaga

SEQ ID NO: 7335164 - DNA, 22 bp, Homo sapiens
taatactgctgtgcttgagttg

SEQ ID NO: 7335165 - DNA, 22 bp, Homo sapiens
taatactgctgtgcttgagttg

SEQ ID NO: 7335166 - DNA, 22 bp, Homo sapiens
taatactgagccaccaggtagg

SEQ ID NO: 7335167 - DNA, 22 bp, Homo sapiens
taatactgatgtctgagcccca

SEQ ID NO: 7335168 - DNA, 22 bp, Homo sapiens
taatactgatgtctgagcccca

SEQ ID NO: 7335169 - DNA, 22 bp, Homo sapiens
taattatagccgctattttgct

SEQ ID NO: 7335170 - DNA, 22 bp, Homo sapiens
taattatacaaaaaggcatgca

SEQ ID NO: 7335171 - DNA, 22 bp, Homo sapiens
taattataacagttacatctta

SEQ ID NO: 7335172 - DNA, 22 bp, Homo sapiens
taatgtttttctcaacattgct

SEQ ID NO: 7335173 - DNA, 22 bp, Homo sapiens
taatgtttgagatgttggattt

SEQ ID NO: 7335174 - DNA, 22 bp, Homo sapiens
taatgtttgagatgttggattt

SEQ ID NO: 7335175 - DNA, 22 bp, Homo sapiens
taatgtttccagtctatgatgg

SEQ ID NO: 7335176 - DNA, 22 bp, Homo sapiens
taatgtttgggaaggtgctttg

SEQ ID NO: 7335177 - DNA, 22 bp, Homo sapiens
taatgtttgggaaggtgctttg

SEQ ID NO: 7335178 - DNA, 22 bp, Homo sapiens
taatgtttttctcaacattgct

SEQ ID NO: 7335179 - DNA, 22 bp, Homo sapiens
taattagagtcacaagtaacca

SEQ ID NO: 7335180 - DNA, 22 bp, Homo sapiens
taattagagtttggtaaacaat

SEQ ID NO: 7335181 - DNA, 22 bp, Homo sapiens
taagtgcaatgttttacttaaa

SEQ ID NO: 7335182 - DNA, 17 bp, Homo sapiens
taagtgattatctcata

SEQ ID NO: 7335183 - DNA, 22 bp, Homo sapiens
taagtgagatctgaaatgaaat

SEQ ID NO: 7335184 - DNA, 22 bp, Homo sapiens
taagtgagaactaaaccttctg

SEQ ID NO: 7335185 - DNA, 22 bp, Homo sapiens
taagtgagaaagacattaactg

SEQ ID NO: 7335186 - DNA, 22 bp, Homo sapiens
taagtaaatttataatgtgatt

SEQ ID NO: 7335187 - DNA, 22 bp, Homo sapiens
taatacagtttccaagccagct

SEQ ID NO: 7335188 - DNA, 22 bp, Homo sapiens
taatacatcattcatctaagga

SEQ ID NO: 7335189 - DNA, 22 bp, Homo sapiens
taatacatcattcatctaagga

SEQ ID NO: 7335190 - DNA, 22 bp, Homo sapiens
taatacagtagcttttacacag

SEQ ID NO: 7335191 - DNA, 22 bp, Homo sapiens
taatacagggcactttgagtga

SEQ ID NO: 7335192 - DNA, 22 bp, Homo sapiens
taatacagatacaaaggaggac

SEQ ID NO: 7335193 - DNA, 22 bp, Homo sapiens
taataagtctgttgtttaattg

SEQ ID NO: 7335194 - DNA, 22 bp, Homo sapiens
taagtgggcgccttgaattact

SEQ ID NO: 7335195 - DNA, 22 bp, Homo sapiens
taatactgaaaggagtatcagc

SEQ ID NO: 7335196 - DNA, 22 bp, Homo sapiens
taatactgaaagggaaatgtcc

SEQ ID NO: 7335197 - DNA, 22 bp, Homo sapiens
taatactgaaagggaaatgtcc

SEQ ID NO: 7335198 - DNA, 22 bp, Homo sapiens
taatactgaaaggagtatcagc

SEQ ID NO: 7335199 - DNA, 22 bp, Homo sapiens
taatactgactaaagatatcaa

SEQ ID NO: 7335200 - DNA, 22 bp, Homo sapiens
taatactgactaaagatatcaa

SEQ ID NO: 7335201 - DNA, 22 bp, Homo sapiens
taatactgagccaccaggtagg

SEQ ID NO: 7335202 - DNA, 22 bp, Homo sapiens
taatactgaaggtaaaatttct

SEQ ID NO: 7335203 - DNA, 22 bp, Homo sapiens
taatactgaaggtaaaatttct

SEQ ID NO: 7335204 - DNA, 21 bp, Homo sapiens
taatactgaaagtgacatctg

SEQ ID NO: 7335205 - DNA, 21 bp, Homo sapiens
taatactgaaagtgacatctg

SEQ ID NO: 7335206 - DNA, 22 bp, Homo sapiens
taaggcagtagtgtctgtaggg

SEQ ID NO: 7335207 - DNA, 22 bp, Homo sapiens
taaggcagtagtgtctgtaggg

SEQ ID NO: 7335208 - DNA, 22 bp, Homo sapiens
taaggcaatggcattcttgaca

SEQ ID NO: 7335209 - DNA, 22 bp, Homo sapiens
taaggcaagagcagggtctttg

SEQ ID NO: 7335210 - DNA, 22 bp, Homo sapiens
taaggcaagtttttagtggaca

SEQ ID NO: 7335211 - DNA, 22 bp, Homo sapiens
taaggcaaagaaccatagtaat

SEQ ID NO: 7335212 - DNA, 22 bp, Homo sapiens
taaggcaaaggggaagttatca

SEQ ID NO: 7335213 - DNA, 22 bp, Homo sapiens
taaggcaaacaggaaagcaggc

SEQ ID NO: 7335214 - DNA, 22 bp, Homo sapiens
taaggcaaaggggaagttatca

SEQ ID NO: 7335215 - DNA, 22 bp, Homo sapiens
taaggcaaagtgatttcttaaa

SEQ ID NO: 7335216 - DNA, 22 bp, Homo sapiens
taaggcaagaaactcctgtgta

SEQ ID NO: 7335217 - DNA, 22 bp, Homo sapiens
taagggggaactcagttcagaa

SEQ ID NO: 7335218 - DNA, 22 bp, Homo sapiens
taagggggaagatcatatttta

SEQ ID NO: 7335219 - DNA, 22 bp, Homo sapiens
taagggggcacttactctcagg

SEQ ID NO: 7335220 - DNA, 22 bp, Homo sapiens
taagggctgacttggaactgtc

SEQ ID NO: 7335221 - DNA, 17 bp, Homo sapiens
taagggggaaacggagc

SEQ ID NO: 7335222 - DNA, 22 bp, Homo sapiens
taaggtgagctgtataacaggg

SEQ ID NO: 7335223 - DNA, 22 bp, Homo sapiens
taaggtagccctaatgtgggtt

SEQ ID NO: 7335224 - DNA, 22 bp, Homo sapiens
taaggtcatggtgaataataag

SEQ ID NO: 7335225 - DNA, 22 bp, Homo sapiens
taaggtagccctaatgtgggtt

SEQ ID NO: 7335226 - DNA, 22 bp, Homo sapiens
taaggtagattacttgtttgga

SEQ ID NO: 7335227 - DNA, 22 bp, Homo sapiens
tacagatgaggaaactgaggca

SEQ ID NO: 7335228 - DNA, 22 bp, Homo sapiens
tacagatatttctcttcaacaa

SEQ ID NO: 7335229 - DNA, 22 bp, Homo sapiens
tacagatatagagatttataga

SEQ ID NO: 7335230 - DNA, 22 bp, Homo sapiens
tacagatatagagatttataga

SEQ ID NO: 7335231 - DNA, 22 bp, Homo sapiens
tacagcaatgcctgaaatagta

SEQ ID NO: 7335232 - DNA, 22 bp, Homo sapiens
tacagagtgttattacagaatc

SEQ ID NO: 7335233 - DNA, 22 bp, Homo sapiens
tacagagttttcctgccaagaa

SEQ ID NO: 7335234 - DNA, 22 bp, Homo sapiens
tacagataaaaatgctgttctt

SEQ ID NO: 7335235 - DNA, 22 bp, Homo sapiens
tacagatacagatctagataca

SEQ ID NO: 7335236 - DNA, 22 bp, Homo sapiens
tacagaaatactggggggttct

SEQ ID NO: 7335237 - DNA, 22 bp, Homo sapiens
tacagaagctgagacactgaga

SEQ ID NO: 7335238 - DNA, 22 bp, Homo sapiens
tacactgagcaggaagaagtgg

SEQ ID NO: 7335239 - DNA, 22 bp, Homo sapiens
tacagaaaaactggcattgaag

SEQ ID NO: 7335240 - DNA, 22 bp, Homo sapiens
tacaacaatttccacattagaa

SEQ ID NO: 7335241 - DNA, 22 bp, Homo sapiens
tacaacaatttccacattagaa

SEQ ID NO: 7335242 - DNA, 22 bp, Homo sapiens
tacattgactgtgtgcatcaca

SEQ ID NO: 7335243 - DNA, 22 bp, Homo sapiens
tacattgagcacgtactatgtg

SEQ ID NO: 7335244 - DNA, 22 bp, Homo sapiens
tacattgagaaccactgcttag

SEQ ID NO: 7335245 - DNA, 22 bp, Homo sapiens
tacattgactctctgtccctaa

SEQ ID NO: 7335246 - DNA, 21 bp, Homo sapiens
tacattgactacaaataaagc

SEQ ID NO: 7335247 - DNA, 22 bp, Homo sapiens
tacattgacctttgttaggttg

SEQ ID NO: 7335248 - DNA, 21 bp, Homo sapiens
tacattgactacaaataaagc

SEQ ID NO: 7335249 - DNA, 22 bp, Homo sapiens
tacattgaattttttagcatgt

SEQ ID NO: 7335250 - DNA, 22 bp, Homo sapiens
tacatttgcctccaccaaaggt

SEQ ID NO: 7335251 - DNA, 22 bp, Homo sapiens
tacattgatggagtacctagct

SEQ ID NO: 7335252 - DNA, 22 bp, Homo sapiens
tacattgagtattatttagcca

SEQ ID NO: 7335253 - DNA, 22 bp, Homo sapiens
tacattgaggcagtagctggag

SEQ ID NO: 7335254 - DNA, 22 bp, Homo sapiens
tacattgaactatgagttcagt

SEQ ID NO: 7335255 - DNA, 22 bp, Homo sapiens
tacattgaaatcaatggatgtg

SEQ ID NO: 7335256 - DNA, 22 bp, Homo sapiens
tacattgaaagtcatttaatcc

SEQ ID NO: 7335257 - DNA, 22 bp, Homo sapiens
tacattctggaaaggcacagac

SEQ ID NO: 7335258 - DNA, 22 bp, Homo sapiens
tacattctgaaataaatggttt

SEQ ID NO: 7335259 - DNA, 22 bp, Homo sapiens
tacatatagacagttactctag

SEQ ID NO: 7335260 - DNA, 22 bp, Homo sapiens
tacatagctcctagtgatgcat

SEQ ID NO: 7335261 - DNA, 22 bp, Homo sapiens
tacatatactgagtgatttgct

SEQ ID NO: 7335262 - DNA, 22 bp, Homo sapiens
tacatagtgttttgaagaatta

SEQ ID NO: 7335263 - DNA, 22 bp, Homo sapiens
tacatagcaaggaaatgacaga

SEQ ID NO: 7335264 - DNA, 21 bp, Homo sapiens
tacatagaggtgatatctgtt

SEQ ID NO: 7335265 - DNA, 22 bp, Homo sapiens
tacatagagggtaatagcatca

SEQ ID NO: 7335266 - DNA, 22 bp, Homo sapiens
tacatactttttcttgcaagca

SEQ ID NO: 7335267 - DNA, 22 bp, Homo sapiens
tacatacatgtatgtgtgtatt

SEQ ID NO: 7335268 - DNA, 22 bp, Homo sapiens
tacatacattacctcatttagt

SEQ ID NO: 7335269 - DNA, 22 bp, Homo sapiens
tacatacattacctcatttagt

SEQ ID NO: 7335270 - DNA, 22 bp, Homo sapiens
tacatactccataatgacagca

SEQ ID NO: 7335271 - DNA, 22 bp, Homo sapiens
tacagtagctgaggttctcagg

SEQ ID NO: 7335272 - DNA, 22 bp, Homo sapiens
tacagtacctgccacgttgttg

SEQ ID NO: 7335273 - DNA, 22 bp, Homo sapiens
tacagtaccctgatgaactaaa

SEQ ID NO: 7335274 - DNA, 22 bp, Homo sapiens
tacagtaccctgatgaactaaa

SEQ ID NO: 7335275 - DNA, 22 bp, Homo sapiens
tacagtaccagaaatgctaaga

SEQ ID NO: 7335276 - DNA, 22 bp, Homo sapiens
tacagtaatctggacatgattt

SEQ ID NO: 7335277 - DNA, 22 bp, Homo sapiens
tacagtaagatgaaatagcaat

SEQ ID NO: 7335278 - DNA, 22 bp, Homo sapiens
tacagtaagatgaaatagcaat

SEQ ID NO: 7335279 - DNA, 22 bp, Homo sapiens
tataatttggggaaagtggtgt

SEQ ID NO: 7335280 - DNA, 22 bp, Homo sapiens
tataatttggggaaagtggtgt

SEQ ID NO: 7335281 - DNA, 22 bp, Homo sapiens
tataattttaagtggtaaatta

SEQ ID NO: 7335282 - DNA, 22 bp, Homo sapiens
tatacaatgagtacattctggg

SEQ ID NO: 7335283 - DNA, 22 bp, Homo sapiens
tataatttttctgtggccagtt

SEQ ID NO: 7335284 - DNA, 22 bp, Homo sapiens
tataattttagaagagatggaa

SEQ ID NO: 7335285 - DNA, 22 bp, Homo sapiens
tatacacacctccaaagcagga

SEQ ID NO: 7335286 - DNA, 22 bp, Homo sapiens
tatacacacatgctccggcctt

SEQ ID NO: 7335287 - DNA, 22 bp, Homo sapiens
tatacacaaggtgtgcatttgt

SEQ ID NO: 7335288 - DNA, 22 bp, Homo sapiens
tatacacaaacaaggggttaag

SEQ ID NO: 7335289 - DNA, 22 bp, Homo sapiens
tatacaatggctgaatcatcca

SEQ ID NO: 7335290 - DNA, 22 bp, Homo sapiens
tatacaatggctgaatcatcca

SEQ ID NO: 7335291 - DNA, 22 bp, Homo sapiens
tatacacatatcttctaggcct

SEQ ID NO: 7335292 - DNA, 22 bp, Homo sapiens
tatacacatcctccaaagatag

SEQ ID NO: 7335293 - DNA, 23 bp, Homo sapiens
tatacacatgtggcagtatagtg

SEQ ID NO: 7335294 - DNA, 22 bp, Homo sapiens
tatacacatatacgtttgtgtg

SEQ ID NO: 7335295 - DNA, 22 bp, Homo sapiens
tatacacaggaatctgtgaaaa

SEQ ID NO: 7335296 - DNA, 17 bp, Homo sapiens
tatacacagacagactg

SEQ ID NO: 7335297 - DNA, 22 bp, Homo sapiens
tatacacatgtgtgtattcata

SEQ ID NO: 7335298 - DNA, 22 bp, Homo sapiens
tatacacattacagtttcagga

SEQ ID NO: 7335299 - DNA, 22 bp, Homo sapiens
tatacacatttttacctatagt

SEQ ID NO: 7335300 - DNA, 22 bp, Homo sapiens
tataatttatcatgtcacagtt

SEQ ID NO: 7335301 - DNA, 22 bp, Homo sapiens
tataaatgccaggactttagat

SEQ ID NO: 7335302 - DNA, 22 bp, Homo sapiens
tataaattaatgtgcccatgag

SEQ ID NO: 7335303 - DNA, 22 bp, Homo sapiens
taggtgagtttggggaagatag

SEQ ID NO: 7335304 - DNA, 22 bp, Homo sapiens
taggggtggagctaagagtccc

SEQ ID NO: 7335305 - DNA, 22 bp, Homo sapiens
taggggtgggatccaggaatta

SEQ ID NO: 7335306 - DNA, 22 bp, Homo sapiens
taggggtgtttcgagagaggtt

SEQ ID NO: 7335307 - DNA, 22 bp, Homo sapiens
taggtgagggagcattgtgaga

SEQ ID NO: 7335308 - DNA, 20 bp, Homo sapiens
taggtgagggcagatagagg

SEQ ID NO: 7335309 - DNA, 22 bp, Homo sapiens
taggtgaggttacaagagttca

SEQ ID NO: 7335310 - DNA, 22 bp, Homo sapiens
tatagtatacttaaagtctatt

SEQ ID NO: 7335311 - DNA, 22 bp, Homo sapiens
tatagtgtctctagatcaaaga

SEQ ID NO: 7335312 - DNA, 22 bp, Homo sapiens
tatagtgtgtgagagagtgaaa

SEQ ID NO: 7335313 - DNA, 22 bp, Homo sapiens
tataggtacttggaaaataagg

SEQ ID NO: 7335314 - DNA, 22 bp, Homo sapiens
tatatctaagtgtatgtaagag

SEQ ID NO: 7335315 - DNA, 22 bp, Homo sapiens
tatatattcttaagtagtgtag

SEQ ID NO: 7335316 - DNA, 22 bp, Homo sapiens
tatatattcttaagtagtgtag

SEQ ID NO: 7335317 - DNA, 22 bp, Homo sapiens
tatccacactcaaggggagggg

SEQ ID NO: 7335318 - DNA, 22 bp, Homo sapiens
tatccaggaggaactcattttg

SEQ ID NO: 7335319 - DNA, 22 bp, Homo sapiens
tatccacactgggatgttttga

SEQ ID NO: 7335320 - DNA, 23 bp, Homo sapiens
tatccagtagggcccagagctga

SEQ ID NO: 7335321 - DNA, 22 bp, Homo sapiens
tatgacattttgccagcattgc

SEQ ID NO: 7335322 - DNA, 21 bp, Homo sapiens
tatgagaaaactgaggtgcat

SEQ ID NO: 7335323 - DNA, 22 bp, Homo sapiens
tatgagaaaataaatatctgtt

SEQ ID NO: 7335324 - DNA, 22 bp, Homo sapiens
tatgagaaagtcgtatgtctcc

SEQ ID NO: 7335325 - DNA, 22 bp, Homo sapiens
tatgagaacaagaacaatctcc

SEQ ID NO: 7335326 - DNA, 18 bp, Homo sapiens
tatgagaagattagcaat

SEQ ID NO: 7335327 - DNA, 22 bp, Homo sapiens
tatgagaactgacagagtgcca

SEQ ID NO: 7335328 - DNA, 22 bp, Homo sapiens
tatgagaataatctggtaaata

SEQ ID NO: 7335329 - DNA, 21 bp, Homo sapiens
tatctacagtgtccattcagt

SEQ ID NO: 7335330 - DNA, 22 bp, Homo sapiens
tatctacagttaatatgtcatc

SEQ ID NO: 7335331 - DNA, 18 bp, Homo sapiens
tattctgtcctatgaagc

SEQ ID NO: 7335332 - DNA, 22 bp, Homo sapiens
tattctgatttcaagtgagagt

SEQ ID NO: 7335333 - DNA, 22 bp, Homo sapiens
tattctcagtgctataagtaga

SEQ ID NO: 7335334 - DNA, 22 bp, Homo sapiens
tattgaaattcttcatgtcctc

SEQ ID NO: 7335335 - DNA, 22 bp, Homo sapiens
tattgaaatgaatgacagtgat

SEQ ID NO: 7335336 - DNA, 22 bp, Homo sapiens
tattgaaatccattacgttctt

SEQ ID NO: 7335337 - DNA, 22 bp, Homo sapiens
tattattatgcatagcatgaaa

SEQ ID NO: 7335338 - DNA, 22 bp, Homo sapiens
tattccttggcaaaaaatatat

SEQ ID NO: 7335339 - DNA, 22 bp, Homo sapiens
tatttatcgagtgtctactatg

SEQ ID NO: 7335340 - DNA, 21 bp, Homo sapiens
tatttatctcaggctatcttt

SEQ ID NO: 7335341 - DNA, 22 bp, Homo sapiens
tatttatattctgccttctgct

SEQ ID NO: 7335342 - DNA, 22 bp, Homo sapiens
tatttataatctgccaaagaga

SEQ ID NO: 7335343 - DNA, 22 bp, Homo sapiens
tatttataccaggtgatcggag

SEQ ID NO: 7335344 - DNA, 22 bp, Homo sapiens
tattgacatttttatagcttga

SEQ ID NO: 7335345 - DNA, 22 bp, Homo sapiens
tatttaatttgctcattgtgat

SEQ ID NO: 7335346 - DNA, 22 bp, Homo sapiens
tatttaatttgctcattgtgat

SEQ ID NO: 7335347 - DNA, 22 bp, Homo sapiens
tatttataatctgccaaagaga

SEQ ID NO: 7335348 - DNA, 22 bp, Homo sapiens
tatttctcttcaaaattgatgt

SEQ ID NO: 7335349 - DNA, 22 bp, Homo sapiens
tatttctcttcaaaattgatgt

SEQ ID NO: 7335350 - DNA, 22 bp, Homo sapiens
tatttctctcacggttgcctgg

SEQ ID NO: 7335351 - DNA, 22 bp, Homo sapiens
tatttctctttgtagggatata

SEQ ID NO: 7335352 - DNA, 22 bp, Homo sapiens
tatttctcagcattttacatcc

SEQ ID NO: 7335353 - DNA, 22 bp, Homo sapiens
tatttctcagcattttacatcc

SEQ ID NO: 7335354 - DNA, 22 bp, Homo sapiens
tatttattctttgtactgcctt

SEQ ID NO: 7335355 - DNA, 22 bp, Homo sapiens
tatttattggacagtgttgctg

SEQ ID NO: 7335356 - DNA, 22 bp, Homo sapiens
tatttattcattcagcaagcat

SEQ ID NO: 7335357 - DNA, 22 bp, Homo sapiens
tattagaaagcttaatatcgtg

SEQ ID NO: 7335358 - DNA, 19 bp, Homo sapiens
tatgtgtgcatttgtgcat

SEQ ID NO: 7335359 - DNA, 22 bp, Homo sapiens
tatgtgtgctttttccatgcat

SEQ ID NO: 7335360 - DNA, 20 bp, Homo sapiens
tattacacacaatgagcagt

SEQ ID NO: 7335361 - DNA, 22 bp, Homo sapiens
tattacatccacttttattgca

SEQ ID NO: 7335362 - DNA, 22 bp, Homo sapiens
tattacagggctagttatgagt

SEQ ID NO: 7335363 - DNA, 22 bp, Homo sapiens
tatgtctggaccactgcagccc

SEQ ID NO: 7335364 - DNA, 22 bp, Homo sapiens
tatgtgaagagattaaaaaata

SEQ ID NO: 7335365 - DNA, 22 bp, Homo sapiens
tatgtgtgcatgtatacattaa

SEQ ID NO: 7335366 - DNA, 21 bp, Homo sapiens
tatgtgtctgtggaaaactag

SEQ ID NO: 7335367 - DNA, 22 bp, Homo sapiens
tatgagatattcccagcgtcta

SEQ ID NO: 7335368 - DNA, 22 bp, Homo sapiens
tatgagaatttgctaattggct

SEQ ID NO: 7335369 - DNA, 23 bp, Homo sapiens
tatgagaattaagtgcgagtgcc

SEQ ID NO: 7335370 - DNA, 22 bp, Homo sapiens
tatgagtactgtgaacgagaat

SEQ ID NO: 7335371 - DNA, 22 bp, Homo sapiens
tatgtacaagcacacatgtgac

SEQ ID NO: 7335372 - DNA, 22 bp, Homo sapiens
tatgtacacatacacttgtaat

SEQ ID NO: 7335373 - DNA, 22 bp, Homo sapiens
tatgtctggaagtgtacttgtc

SEQ ID NO: 7335374 - DNA, 22 bp, Homo sapiens
tatgtctggaatttgaggttca

SEQ ID NO: 7335375 - DNA, 22 bp, Homo sapiens
tatgtctgaatcttatttaaat

SEQ ID NO: 7335376 - DNA, 22 bp, Homo sapiens
tatgtctgcttggttttggaat

SEQ ID NO: 7335377 - DNA, 22 bp, Homo sapiens
tatgtcctgctactctctcatg

SEQ ID NO: 7335378 - DNA, 22 bp, Homo sapiens
tatgtacagtccttaacttaaa

SEQ ID NO: 7335379 - DNA, 22 bp, Homo sapiens
tagaattgggcctaacttccat

SEQ ID NO: 7335380 - DNA, 22 bp, Homo sapiens
tagacaatatttgaaagtagtg

SEQ ID NO: 7335381 - DNA, 22 bp, Homo sapiens
tagacaatgccatcttgtggtt

SEQ ID NO: 7335382 - DNA, 22 bp, Homo sapiens
tagacaatctcagcaaacacac

SEQ ID NO: 7335383 - DNA, 22 bp, Homo sapiens
tagaggccgaatgctgagctgg

SEQ ID NO: 7335384 - DNA, 22 bp, Homo sapiens
tagacacatcttcatccacaat

SEQ ID NO: 7335385 - DNA, 22 bp, Homo sapiens
tagacactgtatgagctgggtg

SEQ ID NO: 7335386 - DNA, 21 bp, Homo sapiens
tagaggcaggagggactgcag

SEQ ID NO: 7335387 - DNA, 22 bp, Homo sapiens
tagaaagtactaaatttaactg

SEQ ID NO: 7335388 - DNA, 22 bp, Homo sapiens
tagaaaggaagctacttagggg

SEQ ID NO: 7335389 - DNA, 22 bp, Homo sapiens
tagaaagcttggggtgtttaaa

SEQ ID NO: 7335390 - DNA, 22 bp, Homo sapiens
tagaaagctggaggaattcttt

SEQ ID NO: 7335391 - DNA, 22 bp, Homo sapiens
tagaaagcgttaaatctacaga

SEQ ID NO: 7335392 - DNA, 22 bp, Homo sapiens
tagaaagctgagtaatacattt

SEQ ID NO: 7335393 - DNA, 19 bp, Homo sapiens
tagaaagccagaaaacaga

SEQ ID NO: 7335394 - DNA, 22 bp, Homo sapiens
tagaaagccctgtgttcactgc

SEQ ID NO: 7335395 - DNA, 20 bp, Homo sapiens
tagaaatcttataaaagact

SEQ ID NO: 7335396 - DNA, 22 bp, Homo sapiens
tactttggttgaatatgtaatg

SEQ ID NO: 7335397 - DNA, 22 bp, Homo sapiens
tactttggttaatgaaatgtga

SEQ ID NO: 7335398 - DNA, 22 bp, Homo sapiens
tagaaacattcagttgcagtcc

SEQ ID NO: 7335399 - DNA, 22 bp, Homo sapiens
tagaaacatgttctgttctgtt

SEQ ID NO: 7335400 - DNA, 22 bp, Homo sapiens
tagaaacatgttctgttctgtt

SEQ ID NO: 7335401 - DNA, 22 bp, Homo sapiens
tagaaacagagcaggtggccca

SEQ ID NO: 7335402 - DNA, 22 bp, Homo sapiens
tagaaacagatgtttttgaaga

SEQ ID NO: 7335403 - DNA, 22 bp, Homo sapiens
tagaaacatataggatggcagg

SEQ ID NO: 7335404 - DNA, 22 bp, Homo sapiens
tagaaacatataggatggcagg

SEQ ID NO: 7335405 - DNA, 22 bp, Homo sapiens
tagaaaagccccagctggaggg

SEQ ID NO: 7335406 - DNA, 22 bp, Homo sapiens
tagaaacaatgacatgcttgta

SEQ ID NO: 7335407 - DNA, 22 bp, Homo sapiens
tagaaacagaaaactgtaatag

SEQ ID NO: 7335408 - DNA, 22 bp, Homo sapiens
tagaaacacagatctggtgtca

SEQ ID NO: 7335409 - DNA, 22 bp, Homo sapiens
tagaaacacagatctggtgtca

SEQ ID NO: 7335410 - DNA, 22 bp, Homo sapiens
tagaaacagaatatgagtgaga

SEQ ID NO: 7335411 - DNA, 22 bp, Homo sapiens
tagcccaggctggagggcagtg

SEQ ID NO: 7335412 - DNA, 22 bp, Homo sapiens
tagccccagctactcggaagct

SEQ ID NO: 7335413 - DNA, 22 bp, Homo sapiens
tagctgaataatgcgtctgcag

SEQ ID NO: 7335414 - DNA, 22 bp, Homo sapiens
tagagggttattaggacagaag

SEQ ID NO: 7335415 - DNA, 18 bp, Homo sapiens
tagaggggaagaccttta

SEQ ID NO: 7335416 - DNA, 22 bp, Homo sapiens
tagcagaagttgcaaactaggg

SEQ ID NO: 7335417 - DNA, 22 bp, Homo sapiens
tagagtaaatagtatgagaaag

SEQ ID NO: 7335418 - DNA, 22 bp, Homo sapiens
taggacagtagctggtgcacag

SEQ ID NO: 7335419 - DNA, 22 bp, Homo sapiens
taggacagtagctggtgcacag

SEQ ID NO: 7335420 - DNA, 22 bp, Homo sapiens
taggacaggtgaggggctgtgg

SEQ ID NO: 7335421 - DNA, 22 bp, Homo sapiens
taggacagtggagataaccaga

SEQ ID NO: 7335422 - DNA, 22 bp, Homo sapiens
taggagggttagagggaaatat

SEQ ID NO: 7335423 - DNA, 22 bp, Homo sapiens
taggagggggaacaaggcatac

SEQ ID NO: 7335424 - DNA, 22 bp, Homo sapiens
taggagggccctgaaaatggca

SEQ ID NO: 7335425 - DNA, 22 bp, Homo sapiens
taggacagtttactttggttac

SEQ ID NO: 7335426 - DNA, 22 bp, Homo sapiens
taggatggtcacagagatggac

SEQ ID NO: 7335427 - DNA, 22 bp, Homo sapiens
taggagggttagagggaaatat

SEQ ID NO: 7335428 - DNA, 22 bp, Homo sapiens
taggaaaaagaggctggcaagg

SEQ ID NO: 7335429 - DNA, 22 bp, Homo sapiens
taggaaaacgtgattttctcac

SEQ ID NO: 7335430 - DNA, 22 bp, Homo sapiens
tagggaggagggttttcaaatc

SEQ ID NO: 7335431 - DNA, 22 bp, Homo sapiens
tagggaggctacttcttgtagg

SEQ ID NO: 7335432 - DNA, 22 bp, Homo sapiens
taggcaatgggtggccctagaa

SEQ ID NO: 7335433 - DNA, 22 bp, Homo sapiens
taggcaatattagactttgtct

SEQ ID NO: 7335434 - DNA, 20 bp, Homo sapiens
taggcaattagtagataaca

SEQ ID NO: 7335435 - DNA, 22 bp, Homo sapiens
taggcaatgttctaaggaatga

SEQ ID NO: 7335436 - DNA, 22 bp, Homo sapiens
taggcaattagtaacgcagaaa

SEQ ID NO: 7335437 - DNA, 20 bp, Homo sapiens
taggcaattagtagataaca

SEQ ID NO: 7335438 - DNA, 21 bp, Homo sapiens
taggcaatttgttgtcatagc

SEQ ID NO: 7335439 - DNA, 22 bp, Homo sapiens
tcaggatcggcctttttttaag

SEQ ID NO: 7335440 - DNA, 17 bp, Homo sapiens
tcaggatccagggttct

SEQ ID NO: 7335441 - DNA, 22 bp, Homo sapiens
tcaggatcaggggcctttcctt

SEQ ID NO: 7335442 - DNA, 22 bp, Homo sapiens
tcaggatccatagactcccaaa

SEQ ID NO: 7335443 - DNA, 22 bp, Homo sapiens
tcaggcctgctgtatgatggat

SEQ ID NO: 7335444 - DNA, 22 bp, Homo sapiens
tcaggcctgcaaggagagtccc

SEQ ID NO: 7335445 - DNA, 22 bp, Homo sapiens
tcaggccacttcacaggtgatt

SEQ ID NO: 7335446 - DNA, 22 bp, Homo sapiens
tcaggccacggctcactgagac

SEQ ID NO: 7335447 - DNA, 22 bp, Homo sapiens
tcaggcatggctcttcctcagg

SEQ ID NO: 7335448 - DNA, 22 bp, Homo sapiens
tcaggcattcccatgcataaga

SEQ ID NO: 7335449 - DNA, 22 bp, Homo sapiens
tcaggccaaagaaacagcatga

SEQ ID NO: 7335450 - DNA, 22 bp, Homo sapiens
tcaggccaaggtagacatgact

SEQ ID NO: 7335451 - DNA, 19 bp, Homo sapiens
tcaggcagttattcacaaa

SEQ ID NO: 7335452 - DNA, 18 bp, Homo sapiens
tcaggctgggcctccttc

SEQ ID NO: 7335453 - DNA, 22 bp, Homo sapiens
tcaggctgggagacaatcactg

SEQ ID NO: 7335454 - DNA, 22 bp, Homo sapiens
tcaggctgggctcctctcccca

SEQ ID NO: 7335455 - DNA, 22 bp, Homo sapiens
tcaggctggggtgctaaggtgt

SEQ ID NO: 7335456 - DNA, 22 bp, Homo sapiens
tcaggcctgtgctggaggagat

SEQ ID NO: 7335457 - DNA, 22 bp, Homo sapiens
tcaggctgataggaggaactga

SEQ ID NO: 7335458 - DNA, 22 bp, Homo sapiens
tcaggctgctgtactgtgaatg

SEQ ID NO: 7335459 - DNA, 22 bp, Homo sapiens
tcaggctgctggccagcaggct

SEQ ID NO: 7335460 - DNA, 21 bp, Homo sapiens
tcaggctgatgtcgatgttag

SEQ ID NO: 7335461 - DNA, 22 bp, Homo sapiens
tcaggctggaatgcagtggggc

SEQ ID NO: 7335462 - DNA, 22 bp, Homo sapiens
tcaggctggaatgcagtggggc

SEQ ID NO: 7335463 - DNA, 18 bp, Homo sapiens
tcaggctggaagtttgcc

SEQ ID NO: 7335464 - DNA, 22 bp, Homo sapiens
tcaggctgctgtactgtgaatg

SEQ ID NO: 7335465 - DNA, 22 bp, Homo sapiens
tcaggctgctttcatgcttaga

SEQ ID NO: 7335466 - DNA, 22 bp, Homo sapiens
tcaggctggagtgcagtggcgc

SEQ ID NO: 7335467 - DNA, 22 bp, Homo sapiens
tcaggctggagtgcagtggcgc

SEQ ID NO: 7335468 - DNA, 22 bp, Homo sapiens
tcaggagtctgtgcagttccac

SEQ ID NO: 7335469 - DNA, 17 bp, Homo sapiens
tcaggaggtgtttctag

SEQ ID NO: 7335470 - DNA, 22 bp, Homo sapiens
tcaggaggttgaccacggggca

SEQ ID NO: 7335471 - DNA, 22 bp, Homo sapiens
tcaggaaggagctggcctgcca

SEQ ID NO: 7335472 - DNA, 22 bp, Homo sapiens
tcaggaaggcgccccatcagga

SEQ ID NO: 7335473 - DNA, 22 bp, Homo sapiens
tcaggaagaagacggggcagga

SEQ ID NO: 7335474 - DNA, 22 bp, Homo sapiens
tcaggaagctactgccagcagc

SEQ ID NO: 7335475 - DNA, 22 bp, Homo sapiens
tcagcactttgaagcagaagga

SEQ ID NO: 7335476 - DNA, 22 bp, Homo sapiens
tcagcagaaaggcactagatga

SEQ ID NO: 7335477 - DNA, 21 bp, Homo sapiens
tcagcagcttttgcagtccct

SEQ ID NO: 7335478 - DNA, 21 bp, Homo sapiens
tcagcagcttttgcagtccct

SEQ ID NO: 7335479 - DNA, 22 bp, Homo sapiens
tcagcctgctccaagtgctgcc

SEQ ID NO: 7335480 - DNA, 22 bp, Homo sapiens
tcagcaggcacggacaggctgc

SEQ ID NO: 7335481 - DNA, 22 bp, Homo sapiens
tcagcaggcacaccaaaaactg

SEQ ID NO: 7335482 - DNA, 22 bp, Homo sapiens
tcagctcggcctaggcccacgg

SEQ ID NO: 7335483 - DNA, 22 bp, Homo sapiens
tcagctcctcatgcaggggata

SEQ ID NO: 7335484 - DNA, 22 bp, Homo sapiens
tcagctcctcagagcctcagtt

SEQ ID NO: 7335485 - DNA, 22 bp, Homo sapiens
tcagctctcacagatctcaacc

SEQ ID NO: 7335486 - DNA, 22 bp, Homo sapiens
tcagctctaagttttatgcaaa

SEQ ID NO: 7335487 - DNA, 22 bp, Homo sapiens
tcagctccacagctcctctgcc

SEQ ID NO: 7335488 - DNA, 22 bp, Homo sapiens
tcagctccagagttgcacagtg

SEQ ID NO: 7335489 - DNA, 22 bp, Homo sapiens
tcagtgttattagatgaggttt

SEQ ID NO: 7335490 - DNA, 22 bp, Homo sapiens
tcatatacctgcatgtgcatgt

SEQ ID NO: 7335491 - DNA, 22 bp, Homo sapiens
tcatataccagagagtttatat

SEQ ID NO: 7335492 - DNA, 22 bp, Homo sapiens
tcatatactgccttgtagatta

SEQ ID NO: 7335493 - DNA, 22 bp, Homo sapiens
tcatatatctgcaaagcagtat

SEQ ID NO: 7335494 - DNA, 22 bp, Homo sapiens
tcatatgcatatgaaatttttg

SEQ ID NO: 7335495 - DNA, 22 bp, Homo sapiens
tcatatgcatatgaaatttttg

SEQ ID NO: 7335496 - DNA, 22 bp, Homo sapiens
tcatatattttggcagtgatca

SEQ ID NO: 7335497 - DNA, 21 bp, Homo sapiens
tcatatattccagctgcagct

SEQ ID NO: 7335498 - DNA, 22 bp, Homo sapiens
tcatgctctggtttagctgttt

SEQ ID NO: 7335499 - DNA, 22 bp, Homo sapiens
tcatgctatttcgaatgtaata

SEQ ID NO: 7335500 - DNA, 23 bp, Homo sapiens
tcatgcccaggctccagatgtca

SEQ ID NO: 7335501 - DNA, 17 bp, Homo sapiens
tcatgcccaactattac

SEQ ID NO: 7335502 - DNA, 22 bp, Homo sapiens
tcatgcccagagcagtaaatta

SEQ ID NO: 7335503 - DNA, 21 bp, Homo sapiens
tcatgcatgagtttatatata

SEQ ID NO: 7335504 - DNA, 21 bp, Homo sapiens
tcatatttctcttgctattgt

SEQ ID NO: 7335505 - DNA, 22 bp, Homo sapiens
tcatgccaatttctgcatggct

SEQ ID NO: 7335506 - DNA, 22 bp, Homo sapiens
tcatatttaggcctttaattca

SEQ ID NO: 7335507 - DNA, 22 bp, Homo sapiens
tcatatttaggcctttaattca

SEQ ID NO: 7335508 - DNA, 22 bp, Homo sapiens
tcatattagggtaatgataaga

SEQ ID NO: 7335509 - DNA, 21 bp, Homo sapiens
tcatatttctcttgctattgt

SEQ ID NO: 7335510 - DNA, 22 bp, Homo sapiens
tcatggcagtttaataagtggt

SEQ ID NO: 7335511 - DNA, 22 bp, Homo sapiens
tcatggaaacagcaatgctaat

SEQ ID NO: 7335512 - DNA, 22 bp, Homo sapiens
tcatggaagaggtattttttgt

SEQ ID NO: 7335513 - DNA, 19 bp, Homo sapiens
tcatggaagaaatgtgata

SEQ ID NO: 7335514 - DNA, 22 bp, Homo sapiens
tcatggaagaaaggtttgtttc

SEQ ID NO: 7335515 - DNA, 20 bp, Homo sapiens
tcatggaatctcactctagt

SEQ ID NO: 7335516 - DNA, 22 bp, Homo sapiens
tcatggaatagagcagtggcaa

SEQ ID NO: 7335517 - DNA, 22 bp, Homo sapiens
tcattgaacgaagagctccatt

SEQ ID NO: 7335518 - DNA, 22 bp, Homo sapiens
tcattatttgctttagttatgt

SEQ ID NO: 7335519 - DNA, 22 bp, Homo sapiens
tcattatagagttgtattttag

SEQ ID NO: 7335520 - DNA, 22 bp, Homo sapiens
tcattactttttttgtgtctac

SEQ ID NO: 7335521 - DNA, 20 bp, Homo sapiens
tcattacagtgctaagatgt

SEQ ID NO: 7335522 - DNA, 22 bp, Homo sapiens
tcagtgtaagttatgtagatgt

SEQ ID NO: 7335523 - DNA, 21 bp, Homo sapiens
tcagtgtatttaagaatgttg

SEQ ID NO: 7335524 - DNA, 23 bp, Homo sapiens
tcagtgatgttgaacctagcagt

SEQ ID NO: 7335525 - DNA, 20 bp, Homo sapiens
tcagtgattatctctgagtg

SEQ ID NO: 7335526 - DNA, 23 bp, Homo sapiens
tcagtcttggcttctgattttcc

SEQ ID NO: 7335527 - DNA, 17 bp, Homo sapiens
tcagtctctgtcctgga

SEQ ID NO: 7335528 - DNA, 21 bp, Homo sapiens
tcagtaaaaaaactacctaga

SEQ ID NO: 7335529 - DNA, 22 bp, Homo sapiens
tcagtctctggctgtgtctgac

SEQ ID NO: 7335530 - DNA, 22 bp, Homo sapiens
tcaggtgtctgcctctttgagt

SEQ ID NO: 7335531 - DNA, 22 bp, Homo sapiens
tcagggacccctctgagtggag

SEQ ID NO: 7335532 - DNA, 22 bp, Homo sapiens
tcaggtggccaaatgggagcgc

SEQ ID NO: 7335533 - DNA, 22 bp, Homo sapiens
tcagggaatgatgcacacagtt

SEQ ID NO: 7335534 - DNA, 22 bp, Homo sapiens
tcagggaataagtagatgagtg

SEQ ID NO: 7335535 - DNA, 21 bp, Homo sapiens
tcagggaagtgtgcagaaggg

SEQ ID NO: 7335536 - DNA, 19 bp, Homo sapiens
tcactgaggctttgttggc

SEQ ID NO: 7335537 - DNA, 22 bp, Homo sapiens
tcactgtgcacatatgataggt

SEQ ID NO: 7335538 - DNA, 23 bp, Homo sapiens
tcactgtgcccattgaggtagag

SEQ ID NO: 7335539 - DNA, 22 bp, Homo sapiens
tcactctgtggcccaggcagtg

SEQ ID NO: 7335540 - DNA, 22 bp, Homo sapiens
tcactctgttttactcactgtt

SEQ ID NO: 7335541 - DNA, 22 bp, Homo sapiens
tcactctttatcttttatgtct

SEQ ID NO: 7335542 - DNA, 22 bp, Homo sapiens
tcactctgttttactcactgtt

SEQ ID NO: 7335543 - DNA, 22 bp, Homo sapiens
tcacttcttcccttgcacatat

SEQ ID NO: 7335544 - DNA, 22 bp, Homo sapiens
tcactgttaataaatagcaaag

SEQ ID NO: 7335545 - DNA, 19 bp, Homo sapiens
tcacttgaagttcagaaat

SEQ ID NO: 7335546 - DNA, 22 bp, Homo sapiens
tcactttgacagagaaatgaat

SEQ ID NO: 7335547 - DNA, 22 bp, Homo sapiens
tcactttggaagatagcacatc

SEQ ID NO: 7335548 - DNA, 22 bp, Homo sapiens
tcactttaatgatttgtagaat

SEQ ID NO: 7335549 - DNA, 22 bp, Homo sapiens
tcacccaggctggagtgcagtg

SEQ ID NO: 7335550 - DNA, 22 bp, Homo sapiens
tcacccaggctggagtgtagtg

SEQ ID NO: 7335551 - DNA, 19 bp, Homo sapiens
tcacccaggctgctggctc

SEQ ID NO: 7335552 - DNA, 22 bp, Homo sapiens
tcacccaggatattgaagtcag

SEQ ID NO: 7335553 - DNA, 22 bp, Homo sapiens
tcactctgacttggcctccaac

SEQ ID NO: 7335554 - DNA, 20 bp, Homo sapiens
tcactctgatgctagggtgg

SEQ ID NO: 7335555 - DNA, 22 bp, Homo sapiens
tcactctgacttggcctccaac

SEQ ID NO: 7335556 - DNA, 22 bp, Homo sapiens
tcactagtcatcatatattttt

SEQ ID NO: 7335557 - DNA, 22 bp, Homo sapiens
tcaccagatgatttttcttcag

SEQ ID NO: 7335558 - DNA, 23 bp, Homo sapiens
tcaccagaaggggtcaataaaga

SEQ ID NO: 7335559 - DNA, 22 bp, Homo sapiens
tcaccagatctctctgtaatgg

SEQ ID NO: 7335560 - DNA, 22 bp, Homo sapiens
tcacattttcatattctctgag

SEQ ID NO: 7335561 - DNA, 22 bp, Homo sapiens
tcacagtagccatttcatgagt

SEQ ID NO: 7335562 - DNA, 22 bp, Homo sapiens
tcagacatcgtaattacacaat

SEQ ID NO: 7335563 - DNA, 22 bp, Homo sapiens
tcagaccttgtcgtcacttaga

SEQ ID NO: 7335564 - DNA, 20 bp, Homo sapiens
tcagagaagggactgagatt

SEQ ID NO: 7335565 - DNA, 22 bp, Homo sapiens
tcagaaaataactgttagtttg

SEQ ID NO: 7335566 - DNA, 22 bp, Homo sapiens
tcagaaaagactcaggggctga

SEQ ID NO: 7335567 - DNA, 22 bp, Homo sapiens
tcacttttgatccctatgcagt

SEQ ID NO: 7335568 - DNA, 22 bp, Homo sapiens
tcagaaaagaccacattattct

SEQ ID NO: 7335569 - DNA, 22 bp, Homo sapiens
tcagaaaagaccacattattct

SEQ ID NO: 7335570 - DNA, 22 bp, Homo sapiens
tcagaggaaaggtcagatggct

SEQ ID NO: 7335571 - DNA, 22 bp, Homo sapiens
tcagcaagtggaccatcctggg

SEQ ID NO: 7335572 - DNA, 22 bp, Homo sapiens
tcagcaagtattttctgaatgc

SEQ ID NO: 7335573 - DNA, 22 bp, Homo sapiens
tcagcaatcctcccacaggtgg

SEQ ID NO: 7335574 - DNA, 22 bp, Homo sapiens
tcagcaatatgataggctttgt

SEQ ID NO: 7335575 - DNA, 22 bp, Homo sapiens
tcagcaatgagaactggcattt

SEQ ID NO: 7335576 - DNA, 22 bp, Homo sapiens
tcagcaatgtgatactgtgcaa

SEQ ID NO: 7335577 - DNA, 22 bp, Homo sapiens
tcagcaccagttatcctcaggg

SEQ ID NO: 7335578 - DNA, 22 bp, Homo sapiens
tcagcactgtcttttatttgaa

SEQ ID NO: 7335579 - DNA, 22 bp, Homo sapiens
tcagagctcctaagggctgatt

SEQ ID NO: 7335580 - DNA, 22 bp, Homo sapiens
tcagagctcatgagcagagcca

SEQ ID NO: 7335581 - DNA, 22 bp, Homo sapiens
tcagagctaaggggagagcaaa

SEQ ID NO: 7335582 - DNA, 22 bp, Homo sapiens
tcagagctgcccatgcaagggg

SEQ ID NO: 7335583 - DNA, 22 bp, Homo sapiens
tcagagctgggtgcttcttcct

SEQ ID NO: 7335584 - DNA, 22 bp, Homo sapiens
tcagagcttatctcttgctgga

SEQ ID NO: 7335585 - DNA, 23 bp, Homo sapiens
tcagagaggccccctgcagagat

SEQ ID NO: 7335586 - DNA, 23 bp, Homo sapiens
tcagagaggccccctgcagagat

SEQ ID NO: 7335587 - DNA, 22 bp, Homo sapiens
tcagagaggcaatactgtttaa

SEQ ID NO: 7335588 - DNA, 22 bp, Homo sapiens
tcagagaggttggtgataagaa

SEQ ID NO: 7335589 - DNA, 22 bp, Homo sapiens
tcagagaggttaaatatcttgt

SEQ ID NO: 7335590 - DNA, 22 bp, Homo sapiens
tatttcttcgggattcaagcta

SEQ ID NO: 7335591 - DNA, 20 bp, Homo sapiens
tatttctgggcaaccattta

SEQ ID NO: 7335592 - DNA, 22 bp, Homo sapiens
tatttcttcgggattcaagcta

SEQ ID NO: 7335593 - DNA, 22 bp, Homo sapiens
tatttcttcgggattcaagcta

SEQ ID NO: 7335594 - DNA, 22 bp, Homo sapiens
tatttcttgagactcgtcttcc

SEQ ID NO: 7335595 - DNA, 22 bp, Homo sapiens
tatttcttgagtggtcagtttc

SEQ ID NO: 7335596 - DNA, 22 bp, Homo sapiens
tcaagaatttttaatgtgactg

SEQ ID NO: 7335597 - DNA, 20 bp, Homo sapiens
tcaagacagacatggagttt

SEQ ID NO: 7335598 - DNA, 22 bp, Homo sapiens
tcaagagaaggggaaatagact

SEQ ID NO: 7335599 - DNA, 22 bp, Homo sapiens
tcaagctgcatcagtgcagtga

SEQ ID NO: 7335600 - DNA, 22 bp, Homo sapiens
tcaagataccaccattatatgt

SEQ ID NO: 7335601 - DNA, 22 bp, Homo sapiens
tcaaggaggtgcttggcttcac

SEQ ID NO: 7335602 - DNA, 22 bp, Homo sapiens
tcaaggcatacatttagaagag

SEQ ID NO: 7335603 - DNA, 22 bp, Homo sapiens
tcaatttcccctattgatagac

SEQ ID NO: 7335604 - DNA, 22 bp, Homo sapiens
tcaatttcttggtttgataata

SEQ ID NO: 7335605 - DNA, 22 bp, Homo sapiens
tcaagtttctctcagattatgg

SEQ ID NO: 7335606 - DNA, 22 bp, Homo sapiens
tcaagtcttcacgtgatatctc

SEQ ID NO: 7335607 - DNA, 22 bp, Homo sapiens
tcaataaaattgttttcctatc

SEQ ID NO: 7335608 - DNA, 22 bp, Homo sapiens
tcacagaataaattgagaagac

SEQ ID NO: 7335609 - DNA, 22 bp, Homo sapiens
tcacagaagttgaatttgcatg

SEQ ID NO: 7335610 - DNA, 22 bp, Homo sapiens
tcacagaagttgaatttgcatg

SEQ ID NO: 7335611 - DNA, 20 bp, Homo sapiens
tcacaggggaccaggagcag

SEQ ID NO: 7335612 - DNA, 22 bp, Homo sapiens
tcacagggtatctgggatggat

SEQ ID NO: 7335613 - DNA, 22 bp, Homo sapiens
tcacagtaaatccagaagaaat

SEQ ID NO: 7335614 - DNA, 22 bp, Homo sapiens
tcacaggctctagggattaaga

SEQ ID NO: 7335615 - DNA, 22 bp, Homo sapiens
tcacaggcctggggcagagggc

SEQ ID NO: 7335616 - DNA, 22 bp, Homo sapiens
tcacaggcttgtgaacattgca

SEQ ID NO: 7335617 - DNA, 22 bp, Homo sapiens
tcacaggctggtctccgaggac

SEQ ID NO: 7335618 - DNA, 22 bp, Homo sapiens
tcacaggctctccaccatgagg

SEQ ID NO: 7335619 - DNA, 22 bp, Homo sapiens
tcacaaatagctatattaagga

SEQ ID NO: 7335620 - DNA, 22 bp, Homo sapiens
tcacaagtttctcttgcatgcg

SEQ ID NO: 7335621 - DNA, 22 bp, Homo sapiens
tcacaagatggctgctgcagcc

SEQ ID NO: 7335622 - DNA, 22 bp, Homo sapiens
tcacaaaaggccatgtggcttc

SEQ ID NO: 7335623 - DNA, 20 bp, Homo sapiens
tcacacatggtaagctatga

SEQ ID NO: 7335624 - DNA, 22 bp, Homo sapiens
tcccatatatgtttatattgga

SEQ ID NO: 7335625 - DNA, 22 bp, Homo sapiens
tcccattctgccaaggacattg

SEQ ID NO: 7335626 - DNA, 22 bp, Homo sapiens
tcccagggatcctccgggtcgc

SEQ ID NO: 7335627 - DNA, 22 bp, Homo sapiens
tccatgagtttgaggaaaagag

SEQ ID NO: 7335628 - DNA, 20 bp, Homo sapiens
tccatgagttagagactata

SEQ ID NO: 7335629 - DNA, 22 bp, Homo sapiens
tccatgaggcagggaggctggc

SEQ ID NO: 7335630 - DNA, 22 bp, Homo sapiens
tccatgagggacactggatgct

SEQ ID NO: 7335631 - DNA, 22 bp, Homo sapiens
tccatgagctagggattcatca

SEQ ID NO: 7335632 - DNA, 22 bp, Homo sapiens
tccatgaggaccaaattcgtag

SEQ ID NO: 7335633 - DNA, 22 bp, Homo sapiens
tccatgagctagctttccaaag

SEQ ID NO: 7335634 - DNA, 23 bp, Homo sapiens
tccatgagatgtgggcttctagt

SEQ ID NO: 7335635 - DNA, 22 bp, Homo sapiens
tccatgagaacccttggagata

SEQ ID NO: 7335636 - DNA, 22 bp, Homo sapiens
tccatgagacagatactgtaag

SEQ ID NO: 7335637 - DNA, 17 bp, Homo sapiens
tccatgagacatgaaga

SEQ ID NO: 7335638 - DNA, 22 bp, Homo sapiens
tccatgagaggtaactttacaa

SEQ ID NO: 7335639 - DNA, 22 bp, Homo sapiens
tcccaaggccaggcatctagaa

SEQ ID NO: 7335640 - DNA, 22 bp, Homo sapiens
tcccacacttgaaacaaggctg

SEQ ID NO: 7335641 - DNA, 22 bp, Homo sapiens
tccagggcgtgtgtgaaggaaa

SEQ ID NO: 7335642 - DNA, 22 bp, Homo sapiens
tccagggccttacctcttcaga

SEQ ID NO: 7335643 - DNA, 20 bp, Homo sapiens
tccagggctagggagctcat

SEQ ID NO: 7335644 - DNA, 22 bp, Homo sapiens
tccagggctacaaggcaccaga

SEQ ID NO: 7335645 - DNA, 22 bp, Homo sapiens
tccagttgtttgtattaactct

SEQ ID NO: 7335646 - DNA, 22 bp, Homo sapiens
tccagttgcctgtctctgatta

SEQ ID NO: 7335647 - DNA, 22 bp, Homo sapiens
tccagggctcattccctctgca

SEQ ID NO: 7335648 - DNA, 22 bp, Homo sapiens
tccatcagattccctcctgaga

SEQ ID NO: 7335649 - DNA, 22 bp, Homo sapiens
tccaggctgcagtcttgccctc

SEQ ID NO: 7335650 - DNA, 19 bp, Homo sapiens
tccagggcaggaacatgta

SEQ ID NO: 7335651 - DNA, 22 bp, Homo sapiens
tccagggcagggtgcgcatggg

SEQ ID NO: 7335652 - DNA, 22 bp, Homo sapiens
tccagggccacagaggatgcta

SEQ ID NO: 7335653 - DNA, 22 bp, Homo sapiens
tccagggccacagaggatgcta

SEQ ID NO: 7335654 - DNA, 22 bp, Homo sapiens
tccagggccagtccttgtctgt

SEQ ID NO: 7335655 - DNA, 22 bp, Homo sapiens
tccagggccccccagttgcacg

SEQ ID NO: 7335656 - DNA, 22 bp, Homo sapiens
tccagggccatgaagttgcaca

SEQ ID NO: 7335657 - DNA, 22 bp, Homo sapiens
tccaggctctaggctgctctcc

SEQ ID NO: 7335658 - DNA, 22 bp, Homo sapiens
tccaggctctaggctgctctcc

SEQ ID NO: 7335659 - DNA, 22 bp, Homo sapiens
tccaggccaatgtagcaggccc

SEQ ID NO: 7335660 - DNA, 15 bp, Homo sapiens
tccaggcattcattc

SEQ ID NO: 7335661 - DNA, 22 bp, Homo sapiens
tccaggcatgttgggaagatga

SEQ ID NO: 7335662 - DNA, 22 bp, Homo sapiens
tccaggccaatgtagcaggccc

SEQ ID NO: 7335663 - DNA, 22 bp, Homo sapiens
tccaggccacatggatggcgat

SEQ ID NO: 7335664 - DNA, 22 bp, Homo sapiens
tccaggccacgacctcctggat

SEQ ID NO: 7335665 - DNA, 17 bp, Homo sapiens
tccaggcatatctccta

SEQ ID NO: 7335666 - DNA, 22 bp, Homo sapiens
tccaggcatcccccaggacaga

SEQ ID NO: 7335667 - DNA, 23 bp, Homo sapiens
tccaggcatgagctctggatgga

SEQ ID NO: 7335668 - DNA, 19 bp, Homo sapiens
tccaggcatccttcaggct

SEQ ID NO: 7335669 - DNA, 19 bp, Homo sapiens
tccaggcatccttcaggct

SEQ ID NO: 7335670 - DNA, 23 bp, Homo sapiens
tccaggcatgagctctggatgga

SEQ ID NO: 7335671 - DNA, 22 bp, Homo sapiens
tccaggcatgtcccaagccgga

SEQ ID NO: 7335672 - DNA, 22 bp, Homo sapiens
tccaggcatgtctgagtccttc

SEQ ID NO: 7335673 - DNA, 22 bp, Homo sapiens
tccaggcatgtctgagtccttc

SEQ ID NO: 7335674 - DNA, 22 bp, Homo sapiens
tccaggcatgtggccagtactc

SEQ ID NO: 7335675 - DNA, 21 bp, Homo sapiens
tccaggagtggctgggcaggg

SEQ ID NO: 7335676 - DNA, 22 bp, Homo sapiens
tccaggagtctagcctcaggcc

SEQ ID NO: 7335677 - DNA, 22 bp, Homo sapiens
tccaggagtgataaggccactg

SEQ ID NO: 7335678 - DNA, 22 bp, Homo sapiens
tccaggagtttgagactgcagt

SEQ ID NO: 7335679 - DNA, 22 bp, Homo sapiens
tccaggcagggcagccatcaag

SEQ ID NO: 7335680 - DNA, 22 bp, Homo sapiens
tccaggagtttgagactgcagt

SEQ ID NO: 7335681 - DNA, 22 bp, Homo sapiens
tccaggcagttttccaggttgt

SEQ ID NO: 7335682 - DNA, 22 bp, Homo sapiens
tccaggcagggttaagggtcct

SEQ ID NO: 7335683 - DNA, 22 bp, Homo sapiens
tccaggcatagaaggcacgcac

SEQ ID NO: 7335684 - DNA, 22 bp, Homo sapiens
tccaggcataatgcccagtggt

SEQ ID NO: 7335685 - DNA, 22 bp, Homo sapiens
tccaggcataagccttgagtgt

SEQ ID NO: 7335686 - DNA, 22 bp, Homo sapiens
tccaggagggggagccgtgccg

SEQ ID NO: 7335687 - DNA, 22 bp, Homo sapiens
tccaggaggttgagactgcagt

SEQ ID NO: 7335688 - DNA, 22 bp, Homo sapiens
tccaggaggttgagactgcagt

SEQ ID NO: 7335689 - DNA, 22 bp, Homo sapiens
tccaggagtctagcctcaggcc

SEQ ID NO: 7335690 - DNA, 22 bp, Homo sapiens
tccaggagtctagcctcaggcc

SEQ ID NO: 7335691 - DNA, 22 bp, Homo sapiens
tccaggagtcctgggtggcccc

SEQ ID NO: 7335692 - DNA, 22 bp, Homo sapiens
tccagaggcagctgcggtcagg

SEQ ID NO: 7335693 - DNA, 22 bp, Homo sapiens
tccagaggcagctgcggtcagg

SEQ ID NO: 7335694 - DNA, 23 bp, Homo sapiens
tccagagctcatgctctcaacca

SEQ ID NO: 7335695 - DNA, 22 bp, Homo sapiens
tccagagctgggtctgtgctca

SEQ ID NO: 7335696 - DNA, 21 bp, Homo sapiens
tccagaggaggacagactcag

SEQ ID NO: 7335697 - DNA, 22 bp, Homo sapiens
tccagagctgggtctgtgctca

SEQ ID NO: 7335698 - DNA, 22 bp, Homo sapiens
tcattgcactccagcctgggca

SEQ ID NO: 7335699 - DNA, 22 bp, Homo sapiens
tcattgcaccccagtcccagct

SEQ ID NO: 7335700 - DNA, 22 bp, Homo sapiens
tcattgcagaaataaaggtgaa

SEQ ID NO: 7335701 - DNA, 22 bp, Homo sapiens
tcattgcagactaacaatctca

SEQ ID NO: 7335702 - DNA, 22 bp, Homo sapiens
tcattgcagactaacaatctca

SEQ ID NO: 7335703 - DNA, 22 bp, Homo sapiens
tcattgcagcttcaggtgttca

SEQ ID NO: 7335704 - DNA, 22 bp, Homo sapiens
tcattgcaggcattcccctgcc

SEQ ID NO: 7335705 - DNA, 22 bp, Homo sapiens
tcattgcagtagggagagaccc

SEQ ID NO: 7335706 - DNA, 22 bp, Homo sapiens
tcattgcagtgatgttgtatgt

SEQ ID NO: 7335707 - DNA, 19 bp, Homo sapiens
tccagaactgccctggcct

SEQ ID NO: 7335708 - DNA, 22 bp, Homo sapiens
tcattgcatttattcactggca

SEQ ID NO: 7335709 - DNA, 22 bp, Homo sapiens
tcattgcagttgagttgtgtta

SEQ ID NO: 7335710 - DNA, 22 bp, Homo sapiens
tccagaatactctgaaatcatt

SEQ ID NO: 7335711 - DNA, 22 bp, Homo sapiens
tccagagaggtttctccatgct

SEQ ID NO: 7335712 - DNA, 22 bp, Homo sapiens
tcattgcaagctcatttatctg

SEQ ID NO: 7335713 - DNA, 20 bp, Homo sapiens
tcattgcacataatggaagc

SEQ ID NO: 7335714 - DNA, 22 bp, Homo sapiens
tcattgaagacttactggcttc

SEQ ID NO: 7335715 - DNA, 22 bp, Homo sapiens
tcattgaagtgactgaaagatt

SEQ ID NO: 7335716 - DNA, 22 bp, Homo sapiens
tcattgaatgagatgcaataga

SEQ ID NO: 7335717 - DNA, 22 bp, Homo sapiens
tcattgaatgctctgcaggttg

SEQ ID NO: 7335718 - DNA, 22 bp, Homo sapiens
tcattgaatgctctgcaggttg

SEQ ID NO: 7335719 - DNA, 22 bp, Homo sapiens
tcattgaatttcacagctttat

SEQ ID NO: 7335720 - DNA, 17 bp, Homo sapiens
tccagagcacagagctc

SEQ ID NO: 7335721 - DNA, 22 bp, Homo sapiens
tccagagatcacactgggcagg

SEQ ID NO: 7335722 - DNA, 22 bp, Homo sapiens
tccagagcaggtgtctacacag

SEQ ID NO: 7335723 - DNA, 22 bp, Homo sapiens
tccagagccccagtctagtggg

SEQ ID NO: 7335724 - DNA, 22 bp, Homo sapiens
tccagagctaattcagcagctg

SEQ ID NO: 7335725 - DNA, 22 bp, Homo sapiens
tccagagcctttccacccactt

SEQ ID NO: 7335726 - DNA, 22 bp, Homo sapiens
tccagagcctttctgcttgaca

SEQ ID NO: 7335727 - DNA, 22 bp, Homo sapiens
tccagagcctgcgcactggctg

SEQ ID NO: 7335728 - DNA, 22 bp, Homo sapiens
tccagctgtactttgtcctggc

SEQ ID NO: 7335729 - DNA, 22 bp, Homo sapiens
tccagctggggccgaagtggat

SEQ ID NO: 7335730 - DNA, 21 bp, Homo sapiens
tccagctcctgccactcctta

SEQ ID NO: 7335731 - DNA, 22 bp, Homo sapiens
tccagctcctgagttcactgct

SEQ ID NO: 7335732 - DNA, 22 bp, Homo sapiens
tccagcctttctactcactgag

SEQ ID NO: 7335733 - DNA, 22 bp, Homo sapiens
tccagccaccaccttgattgcc

SEQ ID NO: 7335734 - DNA, 22 bp, Homo sapiens
tccagccaatcagagctgaggc

SEQ ID NO: 7335735 - DNA, 22 bp, Homo sapiens
tccagccaagggaggttactag

SEQ ID NO: 7335736 - DNA, 22 bp, Homo sapiens
tccagccaatcaactattgttt

SEQ ID NO: 7335737 - DNA, 22 bp, Homo sapiens
tccagccaagccttggtagctg

SEQ ID NO: 7335738 - DNA, 23 bp, Homo sapiens
tccagccaaatctggctgacagt

SEQ ID NO: 7335739 - DNA, 22 bp, Homo sapiens
tccagccaactgcctagggagc

SEQ ID NO: 7335740 - DNA, 22 bp, Homo sapiens
tccagctcccactctcactgct

SEQ ID NO: 7335741 - DNA, 22 bp, Homo sapiens
tccagctccacagcctccctgt

SEQ ID NO: 7335742 - DNA, 22 bp, Homo sapiens
tccagctcatctgtctccatta

SEQ ID NO: 7335743 - DNA, 22 bp, Homo sapiens
gctgagggcagcctcctaggtc

SEQ ID NO: 7335744 - DNA, 22 bp, Homo sapiens
gctgagggcatgtgtggcgact

SEQ ID NO: 7335745 - DNA, 22 bp, Homo sapiens
gctgagggcatgtgtggcgact

SEQ ID NO: 7335746 - DNA, 22 bp, Homo sapiens
gctgagggcatgtgtggcgact

SEQ ID NO: 7335747 - DNA, 19 bp, Homo sapiens
gctgagggccacccagccc

SEQ ID NO: 7335748 - DNA, 22 bp, Homo sapiens
gctgcccaattacagggccgtg

SEQ ID NO: 7335749 - DNA, 22 bp, Homo sapiens
gctgagggccgcatagggtcat

SEQ ID NO: 7335750 - DNA, 22 bp, Homo sapiens
gctgagggctggtcacatttgt

SEQ ID NO: 7335751 - DNA, 22 bp, Homo sapiens
gctgagggctgtaacagcagag

SEQ ID NO: 7335752 - DNA, 22 bp, Homo sapiens
gctgagggccgcatagggtcat

SEQ ID NO: 7335753 - DNA, 22 bp, Homo sapiens
gctgagggccgcatagggtcat

SEQ ID NO: 7335754 - DNA, 22 bp, Homo sapiens
gctgcccaggagaggtggggct

SEQ ID NO: 7335755 - DNA, 22 bp, Homo sapiens
gctgcccagcaggccccagggg

SEQ ID NO: 7335756 - DNA, 22 bp, Homo sapiens
gctgcccagttctgctgctgcc

SEQ ID NO: 7335757 - DNA, 22 bp, Homo sapiens
gctgcccagtgtgctcatgcag

SEQ ID NO: 7335758 - DNA, 22 bp, Homo sapiens
gctgccctacccgaggcactct

SEQ ID NO: 7335759 - DNA, 22 bp, Homo sapiens
gctgccctgtctgcagcaggac

SEQ ID NO: 7335760 - DNA, 22 bp, Homo sapiens
gctgccccagctgggggctgga

SEQ ID NO: 7335761 - DNA, 22 bp, Homo sapiens
gctgccccagctgggggctgga

SEQ ID NO: 7335762 - DNA, 22 bp, Homo sapiens
gctgccccccggactcggcggg

SEQ ID NO: 7335763 - DNA, 22 bp, Homo sapiens
gctgcctgtcctgaggagtccg

SEQ ID NO: 7335764 - DNA, 22 bp, Homo sapiens
gctgccctgtggtccagcaggt

SEQ ID NO: 7335765 - DNA, 22 bp, Homo sapiens
gctgcttcctttcctgctgacc

SEQ ID NO: 7335766 - DNA, 22 bp, Homo sapiens
gctgcttcagggacgtgccagc

SEQ ID NO: 7335767 - DNA, 22 bp, Homo sapiens
gctgctccagtgttctgtctag

SEQ ID NO: 7335768 - DNA, 22 bp, Homo sapiens
gctgctccagctgtgctgcaga

SEQ ID NO: 7335769 - DNA, 22 bp, Homo sapiens
gctgctccgtctgagctctggt

SEQ ID NO: 7335770 - DNA, 22 bp, Homo sapiens
gctgctcctgagtcccgcgcgc

SEQ ID NO: 7335771 - DNA, 19 bp, Homo sapiens
gctgctcctggctgaccac

SEQ ID NO: 7335772 - DNA, 22 bp, Homo sapiens
gctgctccgcagagtgtgtgtg

SEQ ID NO: 7335773 - DNA, 21 bp, Homo sapiens
gctgctcgagatccagtgctt

SEQ ID NO: 7335774 - DNA, 19 bp, Homo sapiens
gctgctcctggctgaccac

SEQ ID NO: 7335775 - DNA, 22 bp, Homo sapiens
gctgctacaacagaataccata

SEQ ID NO: 7335776 - DNA, 22 bp, Homo sapiens
gctgcctgttgaagggtctgtg

SEQ ID NO: 7335777 - DNA, 22 bp, Homo sapiens
gctgcctgtggcccttctgggt

SEQ ID NO: 7335778 - DNA, 22 bp, Homo sapiens
gctccggcttggtgtgcagggt

SEQ ID NO: 7335779 - DNA, 22 bp, Homo sapiens
gctccgggggttccagatcatc

SEQ ID NO: 7335780 - DNA, 22 bp, Homo sapiens
gctccctgttctcagccatgat

SEQ ID NO: 7335781 - DNA, 22 bp, Homo sapiens
gctccctgtgggatgaggcgcc

SEQ ID NO: 7335782 - DNA, 22 bp, Homo sapiens
gctccctgtgctctgagtgata

SEQ ID NO: 7335783 - DNA, 22 bp, Homo sapiens
gctcctccaatatggactcctc

SEQ ID NO: 7335784 - DNA, 22 bp, Homo sapiens
gctcctccctgtgcagacccag

SEQ ID NO: 7335785 - DNA, 22 bp, Homo sapiens
gctcctctcccagagctgcagg

SEQ ID NO: 7335786 - DNA, 22 bp, Homo sapiens
gctctgggaactgactgccttc

SEQ ID NO: 7335787 - DNA, 22 bp, Homo sapiens
gctctggcttggggcactcgtc

SEQ ID NO: 7335788 - DNA, 22 bp, Homo sapiens
gctctgggctgccctctggaca

SEQ ID NO: 7335789 - DNA, 22 bp, Homo sapiens
gctctggggatgcttctgccgt

SEQ ID NO: 7335790 - DNA, 22 bp, Homo sapiens
gctctgggccatcctggccggg

SEQ ID NO: 7335791 - DNA, 22 bp, Homo sapiens
gctgagaatcaagatggagagg

SEQ ID NO: 7335792 - DNA, 22 bp, Homo sapiens
gctgagaatcaagatggagagg

SEQ ID NO: 7335793 - DNA, 17 bp, Homo sapiens
gctgagaaggggaagag

SEQ ID NO: 7335794 - DNA, 22 bp, Homo sapiens
gctgagaatgttcctactggta

SEQ ID NO: 7335795 - DNA, 22 bp, Homo sapiens
gctgagaggcagccagaccctc

SEQ ID NO: 7335796 - DNA, 22 bp, Homo sapiens
gctgagggaccatgtttcagga

SEQ ID NO: 7335797 - DNA, 22 bp, Homo sapiens
gctgagggaggctgaactgagt

SEQ ID NO: 7335798 - DNA, 22 bp, Homo sapiens
gctgagggaggctgaactgagt

SEQ ID NO: 7335799 - DNA, 22 bp, Homo sapiens
gctgagggatagctgctcactg

SEQ ID NO: 7335800 - DNA, 22 bp, Homo sapiens
gctgaggctgggagcagcctgt

SEQ ID NO: 7335801 - DNA, 22 bp, Homo sapiens
gctgaggctcaagtcatgggtc

SEQ ID NO: 7335802 - DNA, 22 bp, Homo sapiens
gcctttgctgtgacaatgctgg

SEQ ID NO: 7335803 - DNA, 22 bp, Homo sapiens
gcggggggcagcagtcgctcag

SEQ ID NO: 7335804 - DNA, 22 bp, Homo sapiens
gcgggtggaacggctccacgtg

SEQ ID NO: 7335805 - DNA, 22 bp, Homo sapiens
gcgggggtggccagcaagacct

SEQ ID NO: 7335806 - DNA, 22 bp, Homo sapiens
gcgggtggatcatgaggtcagg

SEQ ID NO: 7335807 - DNA, 22 bp, Homo sapiens
gcgggtggtgtccctgctcctc

SEQ ID NO: 7335808 - DNA, 22 bp, Homo sapiens
gcgggtggtgtccctgctcctc

SEQ ID NO: 7335809 - DNA, 22 bp, Homo sapiens
gcgggttgaagggcgcatcgaa

SEQ ID NO: 7335810 - DNA, 22 bp, Homo sapiens
gctacaggtgacagcctctgca

SEQ ID NO: 7335811 - DNA, 22 bp, Homo sapiens
gctacaggagataaaggcctct

SEQ ID NO: 7335812 - DNA, 22 bp, Homo sapiens
gcgtggggcagcccagggcttc

SEQ ID NO: 7335813 - DNA, 22 bp, Homo sapiens
gcgtgggctggactgggatgaa

SEQ ID NO: 7335814 - DNA, 22 bp, Homo sapiens
gcgtggggcagcccagggcttc

SEQ ID NO: 7335815 - DNA, 22 bp, Homo sapiens
gcgtggggcagcccagggcttc

SEQ ID NO: 7335816 - DNA, 18 bp, Homo sapiens
gcgtggagcgggctcggt

SEQ ID NO: 7335817 - DNA, 23 bp, Homo sapiens
gcgtccggcctctctcgctcccg

SEQ ID NO: 7335818 - DNA, 23 bp, Homo sapiens
gcgtccggcctctctcgctcccg

SEQ ID NO: 7335819 - DNA, 22 bp, Homo sapiens
gcgtattttagtctatgtgcat

SEQ ID NO: 7335820 - DNA, 22 bp, Homo sapiens
gcggtgggggaaaggagcggtt

SEQ ID NO: 7335821 - DNA, 22 bp, Homo sapiens
gcgtctcaaggcccccaggcca

SEQ ID NO: 7335822 - DNA, 22 bp, Homo sapiens
gcggtggggaaaggaggtgctg

SEQ ID NO: 7335823 - DNA, 22 bp, Homo sapiens
gcggtggggaaaggaggtgctg

SEQ ID NO: 7335824 - DNA, 22 bp, Homo sapiens
gcctctgtaggagtgagagcat

SEQ ID NO: 7335825 - DNA, 22 bp, Homo sapiens
gcctctgtaggagtgagagcat

SEQ ID NO: 7335826 - DNA, 22 bp, Homo sapiens
gcctctggtccctcatgctgtg

SEQ ID NO: 7335827 - DNA, 23 bp, Homo sapiens
gctcagaggtttttctctggatg

SEQ ID NO: 7335828 - DNA, 19 bp, Homo sapiens
gctcagagtccccctgcgg

SEQ ID NO: 7335829 - DNA, 19 bp, Homo sapiens
gctactgaggcccaggacc

SEQ ID NO: 7335830 - DNA, 22 bp, Homo sapiens
gctactgtgaaggagtctttct

SEQ ID NO: 7335831 - DNA, 22 bp, Homo sapiens
gctactgattgaccttggagag

SEQ ID NO: 7335832 - DNA, 22 bp, Homo sapiens
gctactgattgaccttggagag

SEQ ID NO: 7335833 - DNA, 22 bp, Homo sapiens
gctcagagggaacaaggggctg

SEQ ID NO: 7335834 - DNA, 19 bp, Homo sapiens
gctcagagggccctgtgct

SEQ ID NO: 7335835 - DNA, 22 bp, Homo sapiens
gctcagagcttgaagttccact

SEQ ID NO: 7335836 - DNA, 22 bp, Homo sapiens
gctcagaggagcatcataagga

SEQ ID NO: 7335837 - DNA, 22 bp, Homo sapiens
gctcagaggaggcctttaccta

SEQ ID NO: 7335838 - DNA, 22 bp, Homo sapiens
gctcagaggatgctcctttatg

SEQ ID NO: 7335839 - DNA, 22 bp, Homo sapiens
gctcagaggatgctcctttatg

SEQ ID NO: 7335840 - DNA, 22 bp, Homo sapiens
gctcagaggcacgacctcttgg

SEQ ID NO: 7335841 - DNA, 23 bp, Homo sapiens
gctcagatgccctaggaggtggc

SEQ ID NO: 7335842 - DNA, 22 bp, Homo sapiens
gctcagccgaacttcagagcag

SEQ ID NO: 7335843 - DNA, 23 bp, Homo sapiens
gctcagcctcagcaggcccagga

SEQ ID NO: 7335844 - DNA, 22 bp, Homo sapiens
gctcagcgtggacctggagctt

SEQ ID NO: 7335845 - DNA, 22 bp, Homo sapiens
gctcagcgtggacctggagctt

SEQ ID NO: 7335846 - DNA, 22 bp, Homo sapiens
gctccagggtggatgacaattc

SEQ ID NO: 7335847 - DNA, 22 bp, Homo sapiens
gctccaggataataaagttgtt

SEQ ID NO: 7335848 - DNA, 22 bp, Homo sapiens
gctccaggtgaatcctctcacc

SEQ ID NO: 7335849 - DNA, 22 bp, Homo sapiens
gctcccaactcaggcctcctcc

SEQ ID NO: 7335850 - DNA, 22 bp, Homo sapiens
gctccaggtgtcccaggtaaaa

SEQ ID NO: 7335851 - DNA, 22 bp, Homo sapiens
gctccctgcactctgcagccct

SEQ ID NO: 7335852 - DNA, 22 bp, Homo sapiens
gctccctgaagagatttggtct

SEQ ID NO: 7335853 - DNA, 22 bp, Homo sapiens
gctccctgactcagttcctgag

SEQ ID NO: 7335854 - DNA, 17 bp, Homo sapiens
gctccctgaggacagct

SEQ ID NO: 7335855 - DNA, 21 bp, Homo sapiens
gctccctgctcagctcctggg

SEQ ID NO: 7335856 - DNA, 22 bp, Homo sapiens
gctccctgcctacacggacctt

SEQ ID NO: 7335857 - DNA, 22 bp, Homo sapiens
gctccctgcatttcccaccctt

SEQ ID NO: 7335858 - DNA, 22 bp, Homo sapiens
gctccctgcagctgagagttcc

SEQ ID NO: 7335859 - DNA, 22 bp, Homo sapiens
gctccctgtctctggggtccat

SEQ ID NO: 7335860 - DNA, 23 bp, Homo sapiens
gctccctgtccctgcacttaggc

SEQ ID NO: 7335861 - DNA, 23 bp, Homo sapiens
gctccctgtgctccaggagatgc

SEQ ID NO: 7335862 - DNA, 22 bp, Homo sapiens
gctccctggtattgctgccact

SEQ ID NO: 7335863 - DNA, 22 bp, Homo sapiens
gctccctggaatgttggctgcc

SEQ ID NO: 7335864 - DNA, 22 bp, Homo sapiens
gctccctgctccttcaccgacc

SEQ ID NO: 7335865 - DNA, 22 bp, Homo sapiens
gctccctggaggatgtgaactt

SEQ ID NO: 7335866 - DNA, 18 bp, Homo sapiens
gctccctggatgttactc

SEQ ID NO: 7335867 - DNA, 21 bp, Homo sapiens
gctccctggctgtgtgacctg

SEQ ID NO: 7335868 - DNA, 20 bp, Homo sapiens
gctccctggtagaaatgttt

SEQ ID NO: 7335869 - DNA, 22 bp, Homo sapiens
gctccctggtagccatgctctc

SEQ ID NO: 7335870 - DNA, 22 bp, Homo sapiens
gctccctggcttttacagtgta

SEQ ID NO: 7335871 - DNA, 22 bp, Homo sapiens
ggagacagtgacttagagactg

SEQ ID NO: 7335872 - DNA, 22 bp, Homo sapiens
ggagacagtgacttagagactg

SEQ ID NO: 7335873 - DNA, 22 bp, Homo sapiens
ggagagaattcagcttaagatt

SEQ ID NO: 7335874 - DNA, 22 bp, Homo sapiens
ggagagaattccatggacatgt

SEQ ID NO: 7335875 - DNA, 22 bp, Homo sapiens
ggagagaaattgaggtagcaag

SEQ ID NO: 7335876 - DNA, 22 bp, Homo sapiens
ggagagaaattgaggtagcaag

SEQ ID NO: 7335877 - DNA, 22 bp, Homo sapiens
ggagagaaattgaggtagcaag

SEQ ID NO: 7335878 - DNA, 22 bp, Homo sapiens
ggagagaactgacctgaaagga

SEQ ID NO: 7335879 - DNA, 22 bp, Homo sapiens
ggagagaactgacctgaaagga

SEQ ID NO: 7335880 - DNA, 22 bp, Homo sapiens
ggagagaaattgaggtagcaag

SEQ ID NO: 7335881 - DNA, 22 bp, Homo sapiens
ggagcagggaattacagcgcag

SEQ ID NO: 7335882 - DNA, 22 bp, Homo sapiens
ggagagagagctcattagctgc

SEQ ID NO: 7335883 - DNA, 22 bp, Homo sapiens
ggagagagacctccatgcccag

SEQ ID NO: 7335884 - DNA, 22 bp, Homo sapiens
ggagagagacctccatgcccag

SEQ ID NO: 7335885 - DNA, 22 bp, Homo sapiens
ggagagagagattgtgtttatt

SEQ ID NO: 7335886 - DNA, 22 bp, Homo sapiens
ggagagagacctccatgcccag

SEQ ID NO: 7335887 - DNA, 22 bp, Homo sapiens
ggagcaggcagggccgtgtctg

SEQ ID NO: 7335888 - DNA, 22 bp, Homo sapiens
ggagcagcactgccacacagag

SEQ ID NO: 7335889 - DNA, 22 bp, Homo sapiens
ggacagtgcgagacacagtaac

SEQ ID NO: 7335890 - DNA, 22 bp, Homo sapiens
ggacagtgtgggccatctcact

SEQ ID NO: 7335891 - DNA, 22 bp, Homo sapiens
ggacaggtgcaaagggcacatg

SEQ ID NO: 7335892 - DNA, 22 bp, Homo sapiens
ggacaggtgactgcccagagtg

SEQ ID NO: 7335893 - DNA, 22 bp, Homo sapiens
ggacaggtgtgaggctggcaca

SEQ ID NO: 7335894 - DNA, 22 bp, Homo sapiens
ggacagggtaagtactagtgtg

SEQ ID NO: 7335895 - DNA, 22 bp, Homo sapiens
ggacagggtaagtactagtgtg

SEQ ID NO: 7335896 - DNA, 22 bp, Homo sapiens
ggacagggttggggcatataaa

SEQ ID NO: 7335897 - DNA, 22 bp, Homo sapiens
ggacatgatatttcaggaagac

SEQ ID NO: 7335898 - DNA, 22 bp, Homo sapiens
gctttcagccactgtgtttctg

SEQ ID NO: 7335899 - DNA, 21 bp, Homo sapiens
gctttcagaagtctcatagtt

SEQ ID NO: 7335900 - DNA, 22 bp, Homo sapiens
gctttcctggccctgtccctgc

SEQ ID NO: 7335901 - DNA, 22 bp, Homo sapiens
ggaagaggctctcattgagggc

SEQ ID NO: 7335902 - DNA, 22 bp, Homo sapiens
ggaagaggaggagccaggcttt

SEQ ID NO: 7335903 - DNA, 22 bp, Homo sapiens
ggaagaggctctcattgagggc

SEQ ID NO: 7335904 - DNA, 22 bp, Homo sapiens
ggaagaggctggtagtgcccgt

SEQ ID NO: 7335905 - DNA, 22 bp, Homo sapiens
ggaagagggaaccacgactgta

SEQ ID NO: 7335906 - DNA, 22 bp, Homo sapiens
ggaagagggaaccacgactgta

SEQ ID NO: 7335907 - DNA, 22 bp, Homo sapiens
ggaagagggaaccacgactgta

SEQ ID NO: 7335908 - DNA, 22 bp, Homo sapiens
ggaagagtgcaggtttgtttca

SEQ ID NO: 7335909 - DNA, 22 bp, Homo sapiens
ggaagagtaacaggaggtggaa

SEQ ID NO: 7335910 - DNA, 22 bp, Homo sapiens
ggaatctcagtggagctgttag

SEQ ID NO: 7335911 - DNA, 20 bp, Homo sapiens
ggaagcagagaactgttttc

SEQ ID NO: 7335912 - DNA, 22 bp, Homo sapiens
ggaagcagcctgaagccaaggg

SEQ ID NO: 7335913 - DNA, 22 bp, Homo sapiens
ggacaaaacttcttgcatttct

SEQ ID NO: 7335914 - DNA, 22 bp, Homo sapiens
ggacaaaatccaaacttcttag

SEQ ID NO: 7335915 - DNA, 22 bp, Homo sapiens
ggacaaaaatcagccatctcta

SEQ ID NO: 7335916 - DNA, 22 bp, Homo sapiens
ggacacagctgcagccacaccc

SEQ ID NO: 7335917 - DNA, 18 bp, Homo sapiens
ggaatgtggacaggctgg

SEQ ID NO: 7335918 - DNA, 22 bp, Homo sapiens
gctgtgtcctcacacagccttt

SEQ ID NO: 7335919 - DNA, 22 bp, Homo sapiens
gctgtgtatcagatgccacggg

SEQ ID NO: 7335920 - DNA, 22 bp, Homo sapiens
gcttctgtggtgcatctttgct

SEQ ID NO: 7335921 - DNA, 22 bp, Homo sapiens
gctttatgtgagtagcactgtc

SEQ ID NO: 7335922 - DNA, 22 bp, Homo sapiens
gctggggaggcagcagagaaca

SEQ ID NO: 7335923 - DNA, 22 bp, Homo sapiens
gctggggcctctgtgaggttaa

SEQ ID NO: 7335924 - DNA, 22 bp, Homo sapiens
gctggggcctctgtgaggttaa

SEQ ID NO: 7335925 - DNA, 22 bp, Homo sapiens
gctggggcctgaacagtcagct

SEQ ID NO: 7335926 - DNA, 22 bp, Homo sapiens
gctggggcctgaacagtcagct

SEQ ID NO: 7335927 - DNA, 19 bp, Homo sapiens
gctggggcctgaccagaca

SEQ ID NO: 7335928 - DNA, 22 bp, Homo sapiens
gctgtgctcaacgtgccttcct

SEQ ID NO: 7335929 - DNA, 22 bp, Homo sapiens
gctgtgctatatctctgagtgt

SEQ ID NO: 7335930 - DNA, 22 bp, Homo sapiens
gctgtggcggcagcagctggtg

SEQ ID NO: 7335931 - DNA, 22 bp, Homo sapiens
gctgtggctgtacagagaccat

SEQ ID NO: 7335932 - DNA, 22 bp, Homo sapiens
gctgtgggccacacggctgagt

SEQ ID NO: 7335933 - DNA, 22 bp, Homo sapiens
gctgtgggccacacggctgagt

SEQ ID NO: 7335934 - DNA, 22 bp, Homo sapiens
gctgtggtctgtgagctccaaa

SEQ ID NO: 7335935 - DNA, 22 bp, Homo sapiens
gctgtggtccctctgtcctcat

SEQ ID NO: 7335936 - DNA, 22 bp, Homo sapiens
gctgtgggtaaacgctgagggt

SEQ ID NO: 7335937 - DNA, 22 bp, Homo sapiens
gctgtgggtgctggctccaccc

SEQ ID NO: 7335938 - DNA, 22 bp, Homo sapiens
gctggctggcgggtgcgtcctc

SEQ ID NO: 7335939 - DNA, 23 bp, Homo sapiens
gctgggcttactctttcagtgag

SEQ ID NO: 7335940 - DNA, 22 bp, Homo sapiens
gcaaagacccaggtgtctatcc

SEQ ID NO: 7335941 - DNA, 22 bp, Homo sapiens
gcaaagaaatgtcagtgagagg

SEQ ID NO: 7335942 - DNA, 22 bp, Homo sapiens
gcaaatacatgttgagcaccta

SEQ ID NO: 7335943 - DNA, 22 bp, Homo sapiens
gcaaagggaaagtggcagggtc

SEQ ID NO: 7335944 - DNA, 22 bp, Homo sapiens
gcaaaggccactggggcgatgg

SEQ ID NO: 7335945 - DNA, 22 bp, Homo sapiens
gcacaccctctcaccagcactg

SEQ ID NO: 7335946 - DNA, 22 bp, Homo sapiens
gcacagaacactggtgagtccc

SEQ ID NO: 7335947 - DNA, 22 bp, Homo sapiens
gcacagaacagagaaatagcca

SEQ ID NO: 7335948 - DNA, 22 bp, Homo sapiens
gcacaggccatgggaggacagc

SEQ ID NO: 7335949 - DNA, 22 bp, Homo sapiens
gcacagggctgccaggcggctt

SEQ ID NO: 7335950 - DNA, 22 bp, Homo sapiens
gcacagggctgccaggcggctt

SEQ ID NO: 7335951 - DNA, 22 bp, Homo sapiens
gcaaatatttctaattcctgaa

SEQ ID NO: 7335952 - DNA, 22 bp, Homo sapiens
gcacacagaacatttggatcct

SEQ ID NO: 7335953 - DNA, 22 bp, Homo sapiens
gcacacagtagggattcaatga

SEQ ID NO: 7335954 - DNA, 22 bp, Homo sapiens
gcacacatgcatgcacaggagt

SEQ ID NO: 7335955 - DNA, 22 bp, Homo sapiens
gcacacatgcatgtgtgcatcc

SEQ ID NO: 7335956 - DNA, 20 bp, Homo sapiens
gcacacatagaaatgcatat

SEQ ID NO: 7335957 - DNA, 20 bp, Homo sapiens
gcacacatagaaatgcatat

SEQ ID NO: 7335958 - DNA, 22 bp, Homo sapiens
gcacacatatatatgagcatgt

SEQ ID NO: 7335959 - DNA, 22 bp, Homo sapiens
gcagaggaggacccaggaatta

SEQ ID NO: 7335960 - DNA, 22 bp, Homo sapiens
gcagaggagtgattatgccgtg

SEQ ID NO: 7335961 - DNA, 22 bp, Homo sapiens
gcagaggaggacccaggaatta

SEQ ID NO: 7335962 - DNA, 22 bp, Homo sapiens
gcagaggcacagccccagatga

SEQ ID NO: 7335963 - DNA, 22 bp, Homo sapiens
gcagaggatcaggctctggaaa

SEQ ID NO: 7335964 - DNA, 22 bp, Homo sapiens
gcagaggatcaggctctggaaa

SEQ ID NO: 7335965 - DNA, 22 bp, Homo sapiens
gcagaggatagcatatgaacct

SEQ ID NO: 7335966 - DNA, 22 bp, Homo sapiens
gcagaggcagggccctcctcca

SEQ ID NO: 7335967 - DNA, 22 bp, Homo sapiens
gcagaggcagggccctcctcca

SEQ ID NO: 7335968 - DNA, 22 bp, Homo sapiens
gcagaggcatttctgacgctgc

SEQ ID NO: 7335969 - DNA, 21 bp, Homo sapiens
gcagaggcacggcaccaaggg

SEQ ID NO: 7335970 - DNA, 22 bp, Homo sapiens
gcagaggcacagccccagatga

SEQ ID NO: 7335971 - DNA, 22 bp, Homo sapiens
gcagagggggtacttcggccct

SEQ ID NO: 7335972 - DNA, 22 bp, Homo sapiens
gcagaggtcctagccaggagtc

SEQ ID NO: 7335973 - DNA, 22 bp, Homo sapiens
gcagagggtcctgtgccagcag

SEQ ID NO: 7335974 - DNA, 22 bp, Homo sapiens
gcagaggccaggccaccagcaa

SEQ ID NO: 7335975 - DNA, 22 bp, Homo sapiens
gcagaggggaagctgaggaatt

SEQ ID NO: 7335976 - DNA, 22 bp, Homo sapiens
gcagaggccaggccaccagcaa

SEQ ID NO: 7335977 - DNA, 22 bp, Homo sapiens
gcagaggccatcaactttgcca

SEQ ID NO: 7335978 - DNA, 19 bp, Homo sapiens
gcagagtggggtggagggt

SEQ ID NO: 7335979 - DNA, 22 bp, Homo sapiens
gcagaggtgaccagcagcaggg

SEQ ID NO: 7335980 - DNA, 22 bp, Homo sapiens
gcagaggtcctagccaggagtc

SEQ ID NO: 7335981 - DNA, 22 bp, Homo sapiens
gcacagttaaagggtcatgtga

SEQ ID NO: 7335982 - DNA, 22 bp, Homo sapiens
gcacagttgacaatgattaaga

SEQ ID NO: 7335983 - DNA, 22 bp, Homo sapiens
gcacagttgagacttcacagct

SEQ ID NO: 7335984 - DNA, 22 bp, Homo sapiens
gcacagttctctcagtctccag

SEQ ID NO: 7335985 - DNA, 22 bp, Homo sapiens
gcacagttgatttatgctggtg

SEQ ID NO: 7335986 - DNA, 22 bp, Homo sapiens
gcacagttgccattagccacat

SEQ ID NO: 7335987 - DNA, 22 bp, Homo sapiens
gcacagttgtgacaaccatcgc

SEQ ID NO: 7335988 - DNA, 20 bp, Homo sapiens
gcacagtttgggaaccatgg

SEQ ID NO: 7335989 - DNA, 21 bp, Homo sapiens
gcacagtgccaggcacacagt

SEQ ID NO: 7335990 - DNA, 22 bp, Homo sapiens
gcacatgagctgctgggatggg

SEQ ID NO: 7335991 - DNA, 22 bp, Homo sapiens
gcagactgtacactggactttg

SEQ ID NO: 7335992 - DNA, 22 bp, Homo sapiens
gcaggacaaaatttccagggtg

SEQ ID NO: 7335993 - DNA, 22 bp, Homo sapiens
gcaggaatctaacccaaggaga

SEQ ID NO: 7335994 - DNA, 22 bp, Homo sapiens
gcaggaagccttaccaagccca

SEQ ID NO: 7335995 - DNA, 22 bp, Homo sapiens
gcaggaacccggccgccctggc

SEQ ID NO: 7335996 - DNA, 22 bp, Homo sapiens
gcaggaagaggctcgaagcccc

SEQ ID NO: 7335997 - DNA, 22 bp, Homo sapiens
gcaggaacccagacaaccaggg

SEQ ID NO: 7335998 - DNA, 22 bp, Homo sapiens
gcaggaaccccgggaggctggc

SEQ ID NO: 7335999 - DNA, 22 bp, Homo sapiens
gcagcctctgatgatggccgta

SEQ ID NO: 7336000 - DNA, 20 bp, Homo sapiens
gcagcctcaacaggcacagc

SEQ ID NO: 7336001 - DNA, 22 bp, Homo sapiens
gcagcctcaaactccccagctc

SEQ ID NO: 7336002 - DNA, 22 bp, Homo sapiens
gcagccctttctgggcagggga

SEQ ID NO: 7336003 - DNA, 22 bp, Homo sapiens
gcagcccttcaggtgaggggca

SEQ ID NO: 7336004 - DNA, 22 bp, Homo sapiens
gcagccctgcaggcagctccag

SEQ ID NO: 7336005 - DNA, 22 bp, Homo sapiens
gcagccctcgctagctctcccc

SEQ ID NO: 7336006 - DNA, 22 bp, Homo sapiens
gcagccctcgctagctctcccc

SEQ ID NO: 7336007 - DNA, 22 bp, Homo sapiens
gcagcccagagcgcaggacccc

SEQ ID NO: 7336008 - DNA, 22 bp, Homo sapiens
gcagcccagagcgcaggacccc

SEQ ID NO: 7336009 - DNA, 22 bp, Homo sapiens
gcagcccagagcgcaggacccc

SEQ ID NO: 7336010 - DNA, 22 bp, Homo sapiens
gcagcccaggaccctggacaga

SEQ ID NO: 7336011 - DNA, 22 bp, Homo sapiens
gcagcccagcagggcccggagc

SEQ ID NO: 7336012 - DNA, 22 bp, Homo sapiens
gcagcccagcagggcccggagc

SEQ ID NO: 7336013 - DNA, 22 bp, Homo sapiens
gcagcccaggaccctggacaga

SEQ ID NO: 7336014 - DNA, 22 bp, Homo sapiens
gcagatgttcgcgttaatgcat

SEQ ID NO: 7336015 - DNA, 22 bp, Homo sapiens
gcagcccaggaccctggacaga

SEQ ID NO: 7336016 - DNA, 22 bp, Homo sapiens
gcagcccaggaggcgggagccc

SEQ ID NO: 7336017 - DNA, 22 bp, Homo sapiens
gcagcccaggaggcgggagccc

SEQ ID NO: 7336018 - DNA, 22 bp, Homo sapiens
gcagatggatgtggacggcgcc

SEQ ID NO: 7336019 - DNA, 22 bp, Homo sapiens
gcagatggatcacctgaggtcg

SEQ ID NO: 7336020 - DNA, 23 bp, Homo sapiens
gcagatggccccagagtgctgcc

SEQ ID NO: 7336021 - DNA, 22 bp, Homo sapiens
gcagatgggagccccaggggag

SEQ ID NO: 7336022 - DNA, 22 bp, Homo sapiens
gcagggaccaaaagaggcagta

SEQ ID NO: 7336023 - DNA, 22 bp, Homo sapiens
gcagggaccaaaagaggcagta

SEQ ID NO: 7336024 - DNA, 22 bp, Homo sapiens
gcagggaccaaaagaggcagta

SEQ ID NO: 7336025 - DNA, 22 bp, Homo sapiens
gcagggacctatgacgatggaa

SEQ ID NO: 7336026 - DNA, 18 bp, Homo sapiens
gcagggacacagggtcac

SEQ ID NO: 7336027 - DNA, 22 bp, Homo sapiens
gcagggacaactgtgcacctga

SEQ ID NO: 7336028 - DNA, 22 bp, Homo sapiens
gcagggacatcttcagatcact

SEQ ID NO: 7336029 - DNA, 22 bp, Homo sapiens
gcagggcttagaaatggtggct

SEQ ID NO: 7336030 - DNA, 22 bp, Homo sapiens
gcagggcttagaaatggtggct

SEQ ID NO: 7336031 - DNA, 22 bp, Homo sapiens
gcagggctttttgaaacatggt

SEQ ID NO: 7336032 - DNA, 22 bp, Homo sapiens
gcagggcttgcagcagctagac

SEQ ID NO: 7336033 - DNA, 22 bp, Homo sapiens
gcagggcttgcagcagctagac

SEQ ID NO: 7336034 - DNA, 22 bp, Homo sapiens
gcagggctgggtgggagacaga

SEQ ID NO: 7336035 - DNA, 22 bp, Homo sapiens
gcagggctggggctgctcctga

SEQ ID NO: 7336036 - DNA, 22 bp, Homo sapiens
gcagggctgaaggtcccaggcc

SEQ ID NO: 7336037 - DNA, 22 bp, Homo sapiens
gcagggctgggtcctgtctcat

SEQ ID NO: 7336038 - DNA, 22 bp, Homo sapiens
gcaggcagccacgattcccttg

SEQ ID NO: 7336039 - DNA, 22 bp, Homo sapiens
gcaggcagatcacctgtcagga

SEQ ID NO: 7336040 - DNA, 22 bp, Homo sapiens
gcaggcagatcacctgtcagga

SEQ ID NO: 7336041 - DNA, 22 bp, Homo sapiens
gcaggcagatcacctgtcagga

SEQ ID NO: 7336042 - DNA, 22 bp, Homo sapiens
gcaggacagacccaagcagtct

SEQ ID NO: 7336043 - DNA, 22 bp, Homo sapiens
gcaggcagaggtggaggagaca

SEQ ID NO: 7336044 - DNA, 22 bp, Homo sapiens
gcaggcagagtcaatttgatcc

SEQ ID NO: 7336045 - DNA, 21 bp, Homo sapiens
gcagggacaaagcttcaggag

SEQ ID NO: 7336046 - DNA, 22 bp, Homo sapiens
gcagggaagacccggagcagcg

SEQ ID NO: 7336047 - DNA, 22 bp, Homo sapiens
gcaggcagttatttagtagaat

SEQ ID NO: 7336048 - DNA, 19 bp, Homo sapiens
gcaggcagtggcattcgga

SEQ ID NO: 7336049 - DNA, 22 bp, Homo sapiens
gcaggcaggtggcatcttgtga

SEQ ID NO: 7336050 - DNA, 22 bp, Homo sapiens
gccccacagcctgcggtctcag

SEQ ID NO: 7336051 - DNA, 22 bp, Homo sapiens
gccccacagcctgcggtctcag

SEQ ID NO: 7336052 - DNA, 22 bp, Homo sapiens
gccccactgtggaacctaagtc

SEQ ID NO: 7336053 - DNA, 22 bp, Homo sapiens
gccccactttcctaggcagtat

SEQ ID NO: 7336054 - DNA, 22 bp, Homo sapiens
gcccagcctccaagctccaagg

SEQ ID NO: 7336055 - DNA, 22 bp, Homo sapiens
gcccagcacctctctcagggtt

SEQ ID NO: 7336056 - DNA, 22 bp, Homo sapiens
gcccagcactaaaagctttgct

SEQ ID NO: 7336057 - DNA, 22 bp, Homo sapiens
gcccagcactcctctctgacat

SEQ ID NO: 7336058 - DNA, 22 bp, Homo sapiens
gcccagcagatctcagtgtctc

SEQ ID NO: 7336059 - DNA, 22 bp, Homo sapiens
gcccagccctgaggtcacagct

SEQ ID NO: 7336060 - DNA, 22 bp, Homo sapiens
gcccagcccctgggtggacgtg

SEQ ID NO: 7336061 - DNA, 22 bp, Homo sapiens
gcccagcagctggtggagaagg

SEQ ID NO: 7336062 - DNA, 22 bp, Homo sapiens
gcccagcagctccacttggctt

SEQ ID NO: 7336063 - DNA, 22 bp, Homo sapiens
gccaggggtgcccacccaagga

SEQ ID NO: 7336064 - DNA, 22 bp, Homo sapiens
gccagggtgtgcagggacagga

SEQ ID NO: 7336065 - DNA, 22 bp, Homo sapiens
gccaggggacgcggagcgacga

SEQ ID NO: 7336066 - DNA, 22 bp, Homo sapiens
gccagggggtcagcaggcactt

SEQ ID NO: 7336067 - DNA, 22 bp, Homo sapiens
gccagggggtcagcaggcactt

SEQ ID NO: 7336068 - DNA, 21 bp, Homo sapiens
gcccagcaaggtgagaaggcc

SEQ ID NO: 7336069 - DNA, 22 bp, Homo sapiens
gcccagcacagctggaagagtc

SEQ ID NO: 7336070 - DNA, 22 bp, Homo sapiens
gcccagcacattgctgaggacc

SEQ ID NO: 7336071 - DNA, 22 bp, Homo sapiens
gcccagcacatctggccttgaa

SEQ ID NO: 7336072 - DNA, 22 bp, Homo sapiens
gccccagcgtggctgtgttagg

SEQ ID NO: 7336073 - DNA, 22 bp, Homo sapiens
gccccagctctgccacaactag

SEQ ID NO: 7336074 - DNA, 22 bp, Homo sapiens
gccctggagagggatatggcat

SEQ ID NO: 7336075 - DNA, 22 bp, Homo sapiens
gccccagcctgggaactggagg

SEQ ID NO: 7336076 - DNA, 22 bp, Homo sapiens
gccccagccctgtggaccatgg

SEQ ID NO: 7336077 - DNA, 22 bp, Homo sapiens
gccccagcctagttttctttca

SEQ ID NO: 7336078 - DNA, 22 bp, Homo sapiens
gccccagcctcccgagtagctg

SEQ ID NO: 7336079 - DNA, 22 bp, Homo sapiens
gccccagacataagtagggggt

SEQ ID NO: 7336080 - DNA, 22 bp, Homo sapiens
gccccagcagcaatgcggttga

SEQ ID NO: 7336081 - DNA, 22 bp, Homo sapiens
gccccagccaaggtgacacgaa

SEQ ID NO: 7336082 - DNA, 22 bp, Homo sapiens
gccccagccaaggtgacacgaa

SEQ ID NO: 7336083 - DNA, 22 bp, Homo sapiens
gccctgggcaaggttctggcca

SEQ ID NO: 7336084 - DNA, 22 bp, Homo sapiens
gccctgggattgggtggaggct

SEQ ID NO: 7336085 - DNA, 22 bp, Homo sapiens
gccctggatgtacaggcatgtt

SEQ ID NO: 7336086 - DNA, 22 bp, Homo sapiens
gccctggatgctcatggcatca

SEQ ID NO: 7336087 - DNA, 22 bp, Homo sapiens
gccctggccttcatctcagaca

SEQ ID NO: 7336088 - DNA, 22 bp, Homo sapiens
gccctgtgtgtttgcactgatt

SEQ ID NO: 7336089 - DNA, 22 bp, Homo sapiens
gcctcctcttgagggtcaggga

SEQ ID NO: 7336090 - DNA, 22 bp, Homo sapiens
gcctcctcacaatgtacccacg

SEQ ID NO: 7336091 - DNA, 22 bp, Homo sapiens
gcctcctccttcccgagggtct

SEQ ID NO: 7336092 - DNA, 22 bp, Homo sapiens
gcctcctcacaatgtacccacg

SEQ ID NO: 7336093 - DNA, 22 bp, Homo sapiens
gcctcctatcatttccttgctt

SEQ ID NO: 7336094 - DNA, 22 bp, Homo sapiens
gcctcctatggggccatcgcag

SEQ ID NO: 7336095 - DNA, 22 bp, Homo sapiens
gcctcctaccacaccctcagtc

SEQ ID NO: 7336096 - DNA, 22 bp, Homo sapiens
gcctcctagagctccagggact

SEQ ID NO: 7336097 - DNA, 22 bp, Homo sapiens
gcctcctaattgccactctgga

SEQ ID NO: 7336098 - DNA, 22 bp, Homo sapiens
gcctcctgacttacactgagct

SEQ ID NO: 7336099 - DNA, 22 bp, Homo sapiens
gcctcctgcccagatgagtgat

SEQ ID NO: 7336100 - DNA, 22 bp, Homo sapiens
gcctcctggttgcttctccaac

SEQ ID NO: 7336101 - DNA, 22 bp, Homo sapiens
gccagggctcgcggtccctcgt

SEQ ID NO: 7336102 - DNA, 22 bp, Homo sapiens
gccagggctcgcggtccctcgt

SEQ ID NO: 7336103 - DNA, 22 bp, Homo sapiens
gccagggctgtgcaggtttgtt

SEQ ID NO: 7336104 - DNA, 22 bp, Homo sapiens
gccagggctcgcggtccctcgt

SEQ ID NO: 7336105 - DNA, 22 bp, Homo sapiens
gccagggcaggggagcatctgc

SEQ ID NO: 7336106 - DNA, 22 bp, Homo sapiens
gccagggcaggggagcatctgc

SEQ ID NO: 7336107 - DNA, 22 bp, Homo sapiens
gccaggcatgtcctctgcagaa

SEQ ID NO: 7336108 - DNA, 22 bp, Homo sapiens
gccaggcatgggcttctgggcg

SEQ ID NO: 7336109 - DNA, 22 bp, Homo sapiens
gccaggcagcaggaagccagtg

SEQ ID NO: 7336110 - DNA, 22 bp, Homo sapiens
gccaggcagcagcgaggatggt

SEQ ID NO: 7336111 - DNA, 22 bp, Homo sapiens
gccaggcagatatgtgagctta

SEQ ID NO: 7336112 - DNA, 22 bp, Homo sapiens
gccaggcagcagcgaggatggt

SEQ ID NO: 7336113 - DNA, 22 bp, Homo sapiens
gccaggcaggtgtcggagccct

SEQ ID NO: 7336114 - DNA, 22 bp, Homo sapiens
gccaggcagttcaagtacacca

SEQ ID NO: 7336115 - DNA, 22 bp, Homo sapiens
gccaggcaggtgtcggagccct

SEQ ID NO: 7336116 - DNA, 22 bp, Homo sapiens
gccagctcccaagtgagcccct

SEQ ID NO: 7336117 - DNA, 22 bp, Homo sapiens
gccagctctgtggctgtacttg

SEQ ID NO: 7336118 - DNA, 22 bp, Homo sapiens
gccagctcagtgccaggcccct

SEQ ID NO: 7336119 - DNA, 21 bp, Homo sapiens
gccagcggccgccctccagga

SEQ ID NO: 7336120 - DNA, 22 bp, Homo sapiens
gccagctgaaatttcagttctg

SEQ ID NO: 7336121 - DNA, 22 bp, Homo sapiens
gccaccatgtattgacttggcc

SEQ ID NO: 7336122 - DNA, 22 bp, Homo sapiens
gccaccatgtctggctgagttt

SEQ ID NO: 7336123 - DNA, 22 bp, Homo sapiens
gccaccatcttcccatgccaac

SEQ ID NO: 7336124 - DNA, 22 bp, Homo sapiens
gccagcctgtgcttggccaggc

SEQ ID NO: 7336125 - DNA, 22 bp, Homo sapiens
gccagcctgtgcttggccaggc

SEQ ID NO: 7336126 - DNA, 20 bp, Homo sapiens
gccagccctgacacaggagc

SEQ ID NO: 7336127 - DNA, 23 bp, Homo sapiens
gccagccttgctctcctgcagcc

SEQ ID NO: 7336128 - DNA, 22 bp, Homo sapiens
gccagccttctgtggcctgcaa

SEQ ID NO: 7336129 - DNA, 22 bp, Homo sapiens
gccagcctgtgggggctctgtg

SEQ ID NO: 7336130 - DNA, 21 bp, Homo sapiens
gccagcctgtttacctgtggt

SEQ ID NO: 7336131 - DNA, 22 bp, Homo sapiens
gcatgcagtaaaattcagcaac

SEQ ID NO: 7336132 - DNA, 22 bp, Homo sapiens
gcatgcagtgcaattcaatgta

SEQ ID NO: 7336133 - DNA, 22 bp, Homo sapiens
gccacaggcttaggagggaggt

SEQ ID NO: 7336134 - DNA, 22 bp, Homo sapiens
gcagtggatggccagcaggggc

SEQ ID NO: 7336135 - DNA, 22 bp, Homo sapiens
gcagtgctttagtctgtccttt

SEQ ID NO: 7336136 - DNA, 22 bp, Homo sapiens
gcagtgaatctggcaagaattt

SEQ ID NO: 7336137 - DNA, 22 bp, Homo sapiens
gcaggggagtggatgatggatt

SEQ ID NO: 7336138 - DNA, 22 bp, Homo sapiens
gcaggggagtggatgatggatt

SEQ ID NO: 7336139 - DNA, 22 bp, Homo sapiens
gcaggggagtggcaggcccgga

SEQ ID NO: 7336140 - DNA, 22 bp, Homo sapiens
gcatgcagagaatacctgtgat

SEQ ID NO: 7336141 - DNA, 22 bp, Homo sapiens
gcatgcagagtccctctgcatt

SEQ ID NO: 7336142 - DNA, 22 bp, Homo sapiens
gcatgcacagtttttcacctca

SEQ ID NO: 7336143 - DNA, 22 bp, Homo sapiens
gcatgcacacactttctcacta

SEQ ID NO: 7336144 - DNA, 22 bp, Homo sapiens
gcagtgggagcttaggcagtgc

SEQ ID NO: 7336145 - DNA, 22 bp, Homo sapiens
gcagtgggagcttaggcagtgc

SEQ ID NO: 7336146 - DNA, 22 bp, Homo sapiens
ggggcctccagcactaggcagc

SEQ ID NO: 7336147 - DNA, 22 bp, Homo sapiens
ggggcggggctctgagaagcat

SEQ ID NO: 7336148 - DNA, 22 bp, Homo sapiens
ggggaagaggcgtgatggatcc

SEQ ID NO: 7336149 - DNA, 22 bp, Homo sapiens
ggggaagaggcgtgatggatcc

SEQ ID NO: 7336150 - DNA, 22 bp, Homo sapiens
ggggctgacgggcatgtggctt

SEQ ID NO: 7336151 - DNA, 22 bp, Homo sapiens
ggggctgaacctggaggtggtc

SEQ ID NO: 7336152 - DNA, 22 bp, Homo sapiens
ggggctgaacctggaggtggtc

SEQ ID NO: 7336153 - DNA, 22 bp, Homo sapiens
ggggctctgctctgagccgtgt

SEQ ID NO: 7336154 - DNA, 22 bp, Homo sapiens
ggggctctggagaaaggccagt

SEQ ID NO: 7336155 - DNA, 22 bp, Homo sapiens
ggggctctgcctctcccacgcc

SEQ ID NO: 7336156 - DNA, 22 bp, Homo sapiens
ggggctctcaggtctccccaaa

SEQ ID NO: 7336157 - DNA, 22 bp, Homo sapiens
ggggctcagttcggacagcctg

SEQ ID NO: 7336158 - DNA, 22 bp, Homo sapiens
ggggctcagttcggacagcctg

SEQ ID NO: 7336159 - DNA, 22 bp, Homo sapiens
ggggctgcttcacctttttacg

SEQ ID NO: 7336160 - DNA, 22 bp, Homo sapiens
ggggctgcttcacctttttacg

SEQ ID NO: 7336161 - DNA, 22 bp, Homo sapiens
ggggctgctcccacccctgagg

SEQ ID NO: 7336162 - DNA, 22 bp, Homo sapiens
ggggctgctcgccgcgcgtttc

SEQ ID NO: 7336163 - DNA, 22 bp, Homo sapiens
ggggctgctcgccgcgcgtttc

SEQ ID NO: 7336164 - DNA, 22 bp, Homo sapiens
ggggctgctggtatttccagtt

SEQ ID NO: 7336165 - DNA, 22 bp, Homo sapiens
ggggctgctggtatttccagtt

SEQ ID NO: 7336166 - DNA, 22 bp, Homo sapiens
ggggctggctcactaagagact

SEQ ID NO: 7336167 - DNA, 22 bp, Homo sapiens
ggggctgctcccacccctgagg

SEQ ID NO: 7336168 - DNA, 20 bp, Homo sapiens
ggggctgcatgcagagaaga

SEQ ID NO: 7336169 - DNA, 20 bp, Homo sapiens
ggggctgcatgcagagaaga

SEQ ID NO: 7336170 - DNA, 22 bp, Homo sapiens
gggtaggatggtagaagggacc

SEQ ID NO: 7336171 - DNA, 22 bp, Homo sapiens
gggtaggccagaagggcctgga

SEQ ID NO: 7336172 - DNA, 22 bp, Homo sapiens
gggtaggcagtgcgtcctgcct

SEQ ID NO: 7336173 - DNA, 22 bp, Homo sapiens
gggtaggctctgcaggctgggt

SEQ ID NO: 7336174 - DNA, 22 bp, Homo sapiens
gggtaggctgctcctggggccc

SEQ ID NO: 7336175 - DNA, 22 bp, Homo sapiens
gggtggagtgtgaaatctggct

SEQ ID NO: 7336176 - DNA, 22 bp, Homo sapiens
gggtggagtagaaagatgaatt

SEQ ID NO: 7336177 - DNA, 22 bp, Homo sapiens
gggtggagtagaaagatgaatt

SEQ ID NO: 7336178 - DNA, 22 bp, Homo sapiens
gggtggaggagaacaggcccca

SEQ ID NO: 7336179 - DNA, 22 bp, Homo sapiens
gggtggaggtgggttttgagat

SEQ ID NO: 7336180 - DNA, 22 bp, Homo sapiens
gggtggaggagaacaggcccca

SEQ ID NO: 7336181 - DNA, 22 bp, Homo sapiens
gggtggagcttggacaccagta

SEQ ID NO: 7336182 - DNA, 22 bp, Homo sapiens
gggtggagccagttgactctgt

SEQ ID NO: 7336183 - DNA, 22 bp, Homo sapiens
gggtggagcctgagaatttgca

SEQ ID NO: 7336184 - DNA, 22 bp, Homo sapiens
ggggtgggcgtgcagggacacc

SEQ ID NO: 7336185 - DNA, 22 bp, Homo sapiens
ggggtgggcgtgcagggacacc

SEQ ID NO: 7336186 - DNA, 22 bp, Homo sapiens
ggggtggggttactcattgtgc

SEQ ID NO: 7336187 - DNA, 22 bp, Homo sapiens
ggggtgtgagtagagctgggga

SEQ ID NO: 7336188 - DNA, 22 bp, Homo sapiens
ggggtgtgtctgacaatggtat

SEQ ID NO: 7336189 - DNA, 22 bp, Homo sapiens
ggggctgggatttgaacccagg

SEQ ID NO: 7336190 - DNA, 22 bp, Homo sapiens
ggggtgggcgtgcagggacacc

SEQ ID NO: 7336191 - DNA, 22 bp, Homo sapiens
gggctgaggctaccactggtct

SEQ ID NO: 7336192 - DNA, 22 bp, Homo sapiens
gggctgagtgtcccaggccgaa

SEQ ID NO: 7336193 - DNA, 22 bp, Homo sapiens
gggctgcacgtattctgctcac

SEQ ID NO: 7336194 - DNA, 22 bp, Homo sapiens
gggctgcatcagcaggacccgg

SEQ ID NO: 7336195 - DNA, 22 bp, Homo sapiens
gggctgcacgtattctgctcac

SEQ ID NO: 7336196 - DNA, 22 bp, Homo sapiens
gggctgccaagcctgcctgcct

SEQ ID NO: 7336197 - DNA, 22 bp, Homo sapiens
gggctgccaagcctgcctgcct

SEQ ID NO: 7336198 - DNA, 22 bp, Homo sapiens
gggctgcctgagcatctcctcc

SEQ ID NO: 7336199 - DNA, 22 bp, Homo sapiens
gggctgcctttcttctgggagc

SEQ ID NO: 7336200 - DNA, 22 bp, Homo sapiens
gggctgccttttaattcttccc

SEQ ID NO: 7336201 - DNA, 22 bp, Homo sapiens
gggcttgctaagaagagcgcat

SEQ ID NO: 7336202 - DNA, 22 bp, Homo sapiens
gggctgctgccaccaggtggat

SEQ ID NO: 7336203 - DNA, 22 bp, Homo sapiens
gggctgctgcccaggaggcacc

SEQ ID NO: 7336204 - DNA, 22 bp, Homo sapiens
gggctgctgctgccagcgacac

SEQ ID NO: 7336205 - DNA, 22 bp, Homo sapiens
gggcttggctggggccaccaga

SEQ ID NO: 7336206 - DNA, 19 bp, Homo sapiens
gggcttggggctgaagcct

SEQ ID NO: 7336207 - DNA, 22 bp, Homo sapiens
gggcttggcacatgggctcagc

SEQ ID NO: 7336208 - DNA, 22 bp, Homo sapiens
gggcttggcacatgggctcagc

SEQ ID NO: 7336209 - DNA, 20 bp, Homo sapiens
gggcttggaggactcgaggg

SEQ ID NO: 7336210 - DNA, 22 bp, Homo sapiens
gggcttggagtaggctgatgaa

SEQ ID NO: 7336211 - DNA, 22 bp, Homo sapiens
gggcatggtggcaggcacctgt

SEQ ID NO: 7336212 - DNA, 22 bp, Homo sapiens
gggcatggtgctggtgttcatg

SEQ ID NO: 7336213 - DNA, 18 bp, Homo sapiens
gggcatggatgcagcatc

SEQ ID NO: 7336214 - DNA, 18 bp, Homo sapiens
gggcatggatgcagcatc

SEQ ID NO: 7336215 - DNA, 22 bp, Homo sapiens
gggcatggccaggtgaggggtc

SEQ ID NO: 7336216 - DNA, 22 bp, Homo sapiens
gggcatgtaggaatccatggag

SEQ ID NO: 7336217 - DNA, 22 bp, Homo sapiens
gggcatggtggtgcacacctgt

SEQ ID NO: 7336218 - DNA, 22 bp, Homo sapiens
gggcatgtctctaggctggcta

SEQ ID NO: 7336219 - DNA, 22 bp, Homo sapiens
gggcatgtcccgctgtgcaccg

SEQ ID NO: 7336220 - DNA, 22 bp, Homo sapiens
gggctgagagctggaatctgag

SEQ ID NO: 7336221 - DNA, 22 bp, Homo sapiens
gggctgagctaagctgggttga

SEQ ID NO: 7336222 - DNA, 22 bp, Homo sapiens
gggctgagctgttctgagttta

SEQ ID NO: 7336223 - DNA, 22 bp, Homo sapiens
ggtggctcaaagagagcacaga

SEQ ID NO: 7336224 - DNA, 19 bp, Homo sapiens
ggtggctcagggcccagcc

SEQ ID NO: 7336225 - DNA, 22 bp, Homo sapiens
ggtggctcagggctccaagcat

SEQ ID NO: 7336226 - DNA, 19 bp, Homo sapiens
ggtggctcagggcccagcc

SEQ ID NO: 7336227 - DNA, 22 bp, Homo sapiens
ggtggctcagtgtcaggccctg

SEQ ID NO: 7336228 - DNA, 22 bp, Homo sapiens
ggtggctcagtgtcaggccctg

SEQ ID NO: 7336229 - DNA, 22 bp, Homo sapiens
ggtggcctcgccgcggctctgc

SEQ ID NO: 7336230 - DNA, 22 bp, Homo sapiens
ggtggcctgaattagctcaggg

SEQ ID NO: 7336231 - DNA, 22 bp, Homo sapiens
ggtctggagtaggatgatggct

SEQ ID NO: 7336232 - DNA, 22 bp, Homo sapiens
ggtctggagcttggctaaggga

SEQ ID NO: 7336233 - DNA, 16 bp, Homo sapiens
ggtctggaggatgtct

SEQ ID NO: 7336234 - DNA, 22 bp, Homo sapiens
ggtctggagtagatgagtcatg

SEQ ID NO: 7336235 - DNA, 22 bp, Homo sapiens
ggtctggatattcaccagggcc

SEQ ID NO: 7336236 - DNA, 22 bp, Homo sapiens
ggtctggatgctgaggttccca

SEQ ID NO: 7336237 - DNA, 22 bp, Homo sapiens
ggtctggataattccagtacct

SEQ ID NO: 7336238 - DNA, 22 bp, Homo sapiens
ggtctggatttctgcttctttc

SEQ ID NO: 7336239 - DNA, 22 bp, Homo sapiens
ggtctggattttatctactgta

SEQ ID NO: 7336240 - DNA, 22 bp, Homo sapiens
ggtggccctaaccgcagcctcc

SEQ ID NO: 7336241 - DNA, 20 bp, Homo sapiens
ggtggccgtagcgggcggcg

SEQ ID NO: 7336242 - DNA, 20 bp, Homo sapiens
ggtggccgtagcgggcggcg

SEQ ID NO: 7336243 - DNA, 22 bp, Homo sapiens
ggtctggattttgaacaaaatt

SEQ ID NO: 7336244 - DNA, 22 bp, Homo sapiens
ggtctctttgcttcagctacag

SEQ ID NO: 7336245 - DNA, 22 bp, Homo sapiens
ggtctcttcaggagcttgagcg

SEQ ID NO: 7336246 - DNA, 22 bp, Homo sapiens
ggtctctgtttggggctggcaa

SEQ ID NO: 7336247 - DNA, 22 bp, Homo sapiens
ggtctggacagaatgtgacact

SEQ ID NO: 7336248 - DNA, 22 bp, Homo sapiens
ggtctggacagaatgtgacact

SEQ ID NO: 7336249 - DNA, 22 bp, Homo sapiens
ggtctggaccatggacgccggg

SEQ ID NO: 7336250 - DNA, 22 bp, Homo sapiens
ggtctggaccctcctggagtgg

SEQ ID NO: 7336251 - DNA, 22 bp, Homo sapiens
ggtctggagctaatcttgttgg

SEQ ID NO: 7336252 - DNA, 22 bp, Homo sapiens
ggtctggaataaggtccaggaa

SEQ ID NO: 7336253 - DNA, 22 bp, Homo sapiens
ggtctggaatggagtaggggtg

SEQ ID NO: 7336254 - DNA, 23 bp, Homo sapiens
ggtctggaattcgcggagttaac

SEQ ID NO: 7336255 - DNA, 19 bp, Homo sapiens
ggtggctctccctcaggga

SEQ ID NO: 7336256 - DNA, 17 bp, Homo sapiens
ggtggctcgggcgcggc

SEQ ID NO: 7336257 - DNA, 19 bp, Homo sapiens
ggtggctctccctcaggga

SEQ ID NO: 7336258 - DNA, 22 bp, Homo sapiens
ggtgtccttcgtccgctggcat

SEQ ID NO: 7336259 - DNA, 22 bp, Homo sapiens
ggtggctctcttaagggcagcg

SEQ ID NO: 7336260 - DNA, 22 bp, Homo sapiens
ggtgtggatcatctgaggtcag

SEQ ID NO: 7336261 - DNA, 22 bp, Homo sapiens
ggtgtgggaactacaggttttt

SEQ ID NO: 7336262 - DNA, 22 bp, Homo sapiens
ggtgtgggtccttgtgcttgct

SEQ ID NO: 7336263 - DNA, 22 bp, Homo sapiens
ggtttaattggtccaggatggg

SEQ ID NO: 7336264 - DNA, 22 bp, Homo sapiens
ggtttaattacctgcatctcaa

SEQ ID NO: 7336265 - DNA, 22 bp, Homo sapiens
ggtgttgtacattctgtggatt

SEQ ID NO: 7336266 - DNA, 22 bp, Homo sapiens
ggtttaatgggtgaaggcatga

SEQ ID NO: 7336267 - DNA, 18 bp, Homo sapiens
ggtgtgtaacgtgttttc

SEQ ID NO: 7336268 - DNA, 22 bp, Homo sapiens
ggtgtgtggttttgatacagtc

SEQ ID NO: 7336269 - DNA, 20 bp, Homo sapiens
ggtgtgttggttcagcatgg

SEQ ID NO: 7336270 - DNA, 20 bp, Homo sapiens
gggtggagttgcggtctgtg

SEQ ID NO: 7336271 - DNA, 20 bp, Homo sapiens
gggtggagttgcggtctgtg

SEQ ID NO: 7336272 - DNA, 21 bp, Homo sapiens
gggtggccgcatgggtgcgtg

SEQ ID NO: 7336273 - DNA, 22 bp, Homo sapiens
gggtggccttcatagctcaggg

SEQ ID NO: 7336274 - DNA, 22 bp, Homo sapiens
gggtggctaggtatcccccatt

SEQ ID NO: 7336275 - DNA, 22 bp, Homo sapiens
gggtggctaggtatcccccatt

SEQ ID NO: 7336276 - DNA, 22 bp, Homo sapiens
ggtagggcaaagtagggcacct

SEQ ID NO: 7336277 - DNA, 22 bp, Homo sapiens
ggtagggcaaagtagggcacct

SEQ ID NO: 7336278 - DNA, 22 bp, Homo sapiens
ggtcacccatgatcacatcacc

SEQ ID NO: 7336279 - DNA, 22 bp, Homo sapiens
ggtaggggcagggccaagctgt

SEQ ID NO: 7336280 - DNA, 22 bp, Homo sapiens
ggtcactgtctgaggtactgga

SEQ ID NO: 7336281 - DNA, 22 bp, Homo sapiens
ggtcactgctctaaacaaaagt

SEQ ID NO: 7336282 - DNA, 22 bp, Homo sapiens
ggtcactgctctaaacaaaagt

SEQ ID NO: 7336283 - DNA, 23 bp, Homo sapiens
ggtcactggcaagcagtgcagag

SEQ ID NO: 7336284 - DNA, 22 bp, Homo sapiens
ggtcactggtctctgcttccat

SEQ ID NO: 7336285 - DNA, 20 bp, Homo sapiens
ggtcactgtggctgcaggat

SEQ ID NO: 7336286 - DNA, 22 bp, Homo sapiens
ggtcactgtcttctgggctctg

SEQ ID NO: 7336287 - DNA, 22 bp, Homo sapiens
ggtcactgcaggtttaacagag

SEQ ID NO: 7336288 - DNA, 22 bp, Homo sapiens
ggtcactgccctcccttttgca

SEQ ID NO: 7336289 - DNA, 22 bp, Homo sapiens
ggtcactgatgtgttccctggg

SEQ ID NO: 7336290 - DNA, 18 bp, Homo sapiens
ggtcactgagatgctact

SEQ ID NO: 7336291 - DNA, 22 bp, Homo sapiens
ggtcactgagctgtaattctgt

SEQ ID NO: 7336292 - DNA, 22 bp, Homo sapiens
ggtcagaagtgcaaaatcagtt

SEQ ID NO: 7336293 - DNA, 22 bp, Homo sapiens
ggtcagagaaaagtagggtgtt

SEQ ID NO: 7336294 - DNA, 22 bp, Homo sapiens
ggtcagagccgttagcattcag

SEQ ID NO: 7336295 - DNA, 22 bp, Homo sapiens
ggtcagagctggagagataggg

SEQ ID NO: 7336296 - DNA, 22 bp, Homo sapiens
ggtctcagctggagtccttggt

SEQ ID NO: 7336297 - DNA, 22 bp, Homo sapiens
ggtctcaggagactggagagca

SEQ ID NO: 7336298 - DNA, 22 bp, Homo sapiens
ggtctcagccctcgccagcagc

SEQ ID NO: 7336299 - DNA, 22 bp, Homo sapiens
ggtctcagatctttattaaggc

SEQ ID NO: 7336300 - DNA, 22 bp, Homo sapiens
ggtctcagcagttgctttgact

SEQ ID NO: 7336301 - DNA, 19 bp, Homo sapiens
ggtctcagtgcagctgcag

SEQ ID NO: 7336302 - DNA, 22 bp, Homo sapiens
ggtctctgcagctcccggcccc

SEQ ID NO: 7336303 - DNA, 22 bp, Homo sapiens
ggtctctgagtgaggacctggg

SEQ ID NO: 7336304 - DNA, 22 bp, Homo sapiens
ggtctctgtcactgagtggccc

SEQ ID NO: 7336305 - DNA, 22 bp, Homo sapiens
ggtctctgtcactgagtggccc

SEQ ID NO: 7336306 - DNA, 22 bp, Homo sapiens
ggtctcctgggttgaccagctg

SEQ ID NO: 7336307 - DNA, 22 bp, Homo sapiens
ggtcgctgtgtaggttcagcta

SEQ ID NO: 7336308 - DNA, 22 bp, Homo sapiens
ggtcgggcactctccagggctg

SEQ ID NO: 7336309 - DNA, 22 bp, Homo sapiens
ggtcgctgagctagcatctgca

SEQ ID NO: 7336310 - DNA, 22 bp, Homo sapiens
ggtctcagactggcaggcagtg

SEQ ID NO: 7336311 - DNA, 22 bp, Homo sapiens
gtgcattgcgatgcagacgacc

SEQ ID NO: 7336312 - DNA, 22 bp, Homo sapiens
gtgcattggtgcgccacttcac

SEQ ID NO: 7336313 - DNA, 22 bp, Homo sapiens
gtgcattctctgattttcacaa

SEQ ID NO: 7336314 - DNA, 22 bp, Homo sapiens
gtgcattgtaggatgttatgca

SEQ ID NO: 7336315 - DNA, 22 bp, Homo sapiens
gtgccacatggtccatgtatca

SEQ ID NO: 7336316 - DNA, 22 bp, Homo sapiens
gtgcaggtttaggaagcagctc

SEQ ID NO: 7336317 - DNA, 22 bp, Homo sapiens
gtgcagggtagcgacggcagga

SEQ ID NO: 7336318 - DNA, 22 bp, Homo sapiens
gtgcagtggcagatcctagctc

SEQ ID NO: 7336319 - DNA, 22 bp, Homo sapiens
gtgcagagcaagggctgagggc

SEQ ID NO: 7336320 - DNA, 22 bp, Homo sapiens
gtgcagagaggtggagggactt

SEQ ID NO: 7336321 - DNA, 22 bp, Homo sapiens
gtgcagagcaagggctgagggc

SEQ ID NO: 7336322 - DNA, 22 bp, Homo sapiens
gtgcagagcaagggctgagggc

SEQ ID NO: 7336323 - DNA, 22 bp, Homo sapiens
gtgcagaggacgtggcggcctc

SEQ ID NO: 7336324 - DNA, 20 bp, Homo sapiens
gtgcagaggcagcctgtggg

SEQ ID NO: 7336325 - DNA, 22 bp, Homo sapiens
gtgcagagtgtctgtggactga

SEQ ID NO: 7336326 - DNA, 22 bp, Homo sapiens
gtgcagagtgtctgtggactga

SEQ ID NO: 7336327 - DNA, 22 bp, Homo sapiens
gtgagacacccaagagtcagat

SEQ ID NO: 7336328 - DNA, 22 bp, Homo sapiens
gtgagcagctcagggtggtctc

SEQ ID NO: 7336329 - DNA, 22 bp, Homo sapiens
gtgactgtgaactgtttctgat

SEQ ID NO: 7336330 - DNA, 22 bp, Homo sapiens
gtgactgtgagtcgctgtgaca

SEQ ID NO: 7336331 - DNA, 22 bp, Homo sapiens
gtgactctcaaaagtgcagtct

SEQ ID NO: 7336332 - DNA, 22 bp, Homo sapiens
gtgagaaatggaacttcatacg

SEQ ID NO: 7336333 - DNA, 22 bp, Homo sapiens
gtgcagagaaggagcagtagtt

SEQ ID NO: 7336334 - DNA, 22 bp, Homo sapiens
gtgcagagaggtggagggactt

SEQ ID NO: 7336335 - DNA, 21 bp, Homo sapiens
gtgcacagtcctgcacacagg

SEQ ID NO: 7336336 - DNA, 21 bp, Homo sapiens
gtgcacagtcctgcacacagg

SEQ ID NO: 7336337 - DNA, 23 bp, Homo sapiens
gtgcacagtcaagcccagcttag

SEQ ID NO: 7336338 - DNA, 22 bp, Homo sapiens
gtgcacagagcccagggccgcg

SEQ ID NO: 7336339 - DNA, 22 bp, Homo sapiens
gtgcacagattcagaggttttg

SEQ ID NO: 7336340 - DNA, 22 bp, Homo sapiens
gtgagcagggcaggactgggga

SEQ ID NO: 7336341 - DNA, 22 bp, Homo sapiens
gtgagcaggatttcatggtgta

SEQ ID NO: 7336342 - DNA, 22 bp, Homo sapiens
gtcctgggggcagctgtgtcca

SEQ ID NO: 7336343 - DNA, 22 bp, Homo sapiens
gtctgcccatctccgggcgggg

SEQ ID NO: 7336344 - DNA, 22 bp, Homo sapiens
gtcctgggcctgctgaggctga

SEQ ID NO: 7336345 - DNA, 22 bp, Homo sapiens
gtcctgggcggagggctgctgt

SEQ ID NO: 7336346 - DNA, 22 bp, Homo sapiens
gtctggaggaaaaggttaaatg

SEQ ID NO: 7336347 - DNA, 22 bp, Homo sapiens
gtctggagcctgggtccctgct

SEQ ID NO: 7336348 - DNA, 22 bp, Homo sapiens
gtctggaggaggaagaaggcac

SEQ ID NO: 7336349 - DNA, 22 bp, Homo sapiens
gtctggaggagggctctgcggc

SEQ ID NO: 7336350 - DNA, 22 bp, Homo sapiens
gtctggaggcactttctcatga

SEQ ID NO: 7336351 - DNA, 22 bp, Homo sapiens
gtctgctgcttctgttgaagca

SEQ ID NO: 7336352 - DNA, 22 bp, Homo sapiens
gtctgctggcacgtcacagata

SEQ ID NO: 7336353 - DNA, 22 bp, Homo sapiens
gtctgctggcacgtcacagata

SEQ ID NO: 7336354 - DNA, 22 bp, Homo sapiens
gtctgctgtgggtccccaggag

SEQ ID NO: 7336355 - DNA, 22 bp, Homo sapiens
gtctgctgttcagagatgttgc

SEQ ID NO: 7336356 - DNA, 22 bp, Homo sapiens
gtctgctgtaggtaggacagca

SEQ ID NO: 7336357 - DNA, 22 bp, Homo sapiens
gtctgctcatgctaccgcgggc

SEQ ID NO: 7336358 - DNA, 22 bp, Homo sapiens
gtctgctgcagagcatggcttt

SEQ ID NO: 7336359 - DNA, 22 bp, Homo sapiens
gtctgctgcagagcatggcttt

SEQ ID NO: 7336360 - DNA, 22 bp, Homo sapiens
gtgaacaggagaaagtgatgga

SEQ ID NO: 7336361 - DNA, 22 bp, Homo sapiens
gtgaaatatttaacgtccaggt

SEQ ID NO: 7336362 - DNA, 22 bp, Homo sapiens
gtgaaattgtatttggcattga

SEQ ID NO: 7336363 - DNA, 22 bp, Homo sapiens
gtgaaatctgaggcccatgatg

SEQ ID NO: 7336364 - DNA, 22 bp, Homo sapiens
gtctggagggtgggtagagacc

SEQ ID NO: 7336365 - DNA, 22 bp, Homo sapiens
gtctggaggggagatttgggtt

SEQ ID NO: 7336366 - DNA, 22 bp, Homo sapiens
gtctggaggcccgtcagcccta

SEQ ID NO: 7336367 - DNA, 22 bp, Homo sapiens
gtctgctgtgccttggggaaaa

SEQ ID NO: 7336368 - DNA, 22 bp, Homo sapiens
gtctggagggaagagatgtcag

SEQ ID NO: 7336369 - DNA, 18 bp, Homo sapiens
gtctggaggtcaggagct

SEQ ID NO: 7336370 - DNA, 22 bp, Homo sapiens
gtctggagtaccataaaaagga

SEQ ID NO: 7336371 - DNA, 17 bp, Homo sapiens
gtctggagtggccttca

SEQ ID NO: 7336372 - DNA, 22 bp, Homo sapiens
gtctggagtggggcctgagaat

SEQ ID NO: 7336373 - DNA, 22 bp, Homo sapiens
gtgaaaataaggctggttcttg

SEQ ID NO: 7336374 - DNA, 22 bp, Homo sapiens
gtgaaaataaggctggttcttg

SEQ ID NO: 7336375 - DNA, 22 bp, Homo sapiens
gtgaaggactgaatgaaaatgt

SEQ ID NO: 7336376 - DNA, 22 bp, Homo sapiens
gtgaaggagttatcagtggtta

SEQ ID NO: 7336377 - DNA, 22 bp, Homo sapiens
gtatttaattccattaagttag

SEQ ID NO: 7336378 - DNA, 22 bp, Homo sapiens
gtattgtattgggatgagctct

SEQ ID NO: 7336379 - DNA, 22 bp, Homo sapiens
gtattgtatttatttatgtgac

SEQ ID NO: 7336380 - DNA, 21 bp, Homo sapiens
gtattgcagagttatgtgctc

SEQ ID NO: 7336381 - DNA, 22 bp, Homo sapiens
gtagacaagcacaggactcaga

SEQ ID NO: 7336382 - DNA, 22 bp, Homo sapiens
gtagaattacctctctatgtcc

SEQ ID NO: 7336383 - DNA, 22 bp, Homo sapiens
gtaaaacaagctttatggttcc

SEQ ID NO: 7336384 - DNA, 22 bp, Homo sapiens
ggttttccaaccggctatcatc

SEQ ID NO: 7336385 - DNA, 22 bp, Homo sapiens
ggtttgcatgtgatgttgggca

SEQ ID NO: 7336386 - DNA, 22 bp, Homo sapiens
ggtttgcatgtgatgttgggca

SEQ ID NO: 7336387 - DNA, 22 bp, Homo sapiens
ggtttgcattctgaaaggctca

SEQ ID NO: 7336388 - DNA, 22 bp, Homo sapiens
ggtttgcacgatatttccatgg

SEQ ID NO: 7336389 - DNA, 22 bp, Homo sapiens
gtacattttgaggttaaaacaa

SEQ ID NO: 7336390 - DNA, 22 bp, Homo sapiens
gtaccatgagcatcatgttttt

SEQ ID NO: 7336391 - DNA, 22 bp, Homo sapiens
gtacatttctcccaacactaaa

SEQ ID NO: 7336392 - DNA, 22 bp, Homo sapiens
gtacatttcatttaaatgatgt

SEQ ID NO: 7336393 - DNA, 22 bp, Homo sapiens
gtacatttatttttgcagcata

SEQ ID NO: 7336394 - DNA, 22 bp, Homo sapiens
gtccaagagtcaagaagggggc

SEQ ID NO: 7336395 - DNA, 22 bp, Homo sapiens
gtccaagagggagctacagagc

SEQ ID NO: 7336396 - DNA, 22 bp, Homo sapiens
gtccacaaaattactatcttac

SEQ ID NO: 7336397 - DNA, 22 bp, Homo sapiens
gtccaaggtctttggagataga

SEQ ID NO: 7336398 - DNA, 22 bp, Homo sapiens
gtccacaacatcagactaactg

SEQ ID NO: 7336399 - DNA, 22 bp, Homo sapiens
gtccacaagcaggaagtgagcc

SEQ ID NO: 7336400 - DNA, 22 bp, Homo sapiens
gtccaaggcaagtgtgcagagt

SEQ ID NO: 7336401 - DNA, 22 bp, Homo sapiens
gtccaagggtgcacaactagta

SEQ ID NO: 7336402 - DNA, 22 bp, Homo sapiens
gtccaagggtgcacaactagta

SEQ ID NO: 7336403 - DNA, 22 bp, Homo sapiens
gtccaaggatgcaggatgctgt

SEQ ID NO: 7336404 - DNA, 22 bp, Homo sapiens
gtccaaggatggggtctcccag

SEQ ID NO: 7336405 - DNA, 22 bp, Homo sapiens
gtcattttgctgcatatttaga

SEQ ID NO: 7336406 - DNA, 22 bp, Homo sapiens
gtatttcatcttgaaaaccagt

SEQ ID NO: 7336407 - DNA, 23 bp, Homo sapiens
gtatttcagcattctcagttaaa

SEQ ID NO: 7336408 - DNA, 23 bp, Homo sapiens
gtatttcagcattctcagttaaa

SEQ ID NO: 7336409 - DNA, 22 bp, Homo sapiens
gtccacttcaggactggccgct

SEQ ID NO: 7336410 - DNA, 22 bp, Homo sapiens
gtccactctctgccgtgcctgt

SEQ ID NO: 7336411 - DNA, 22 bp, Homo sapiens
gtccactctagggcagctctcg

SEQ ID NO: 7336412 - DNA, 22 bp, Homo sapiens
gtccactcactcttagtcactc

SEQ ID NO: 7336413 - DNA, 19 bp, Homo sapiens
gtccactccactcggtctc

SEQ ID NO: 7336414 - DNA, 22 bp, Homo sapiens
gtccactcccagtgcctgaggc

SEQ ID NO: 7336415 - DNA, 22 bp, Homo sapiens
gtccactcccagtgcctgaggc

SEQ ID NO: 7336416 - DNA, 22 bp, Homo sapiens
gtccccgacgtttggcttgatg

SEQ ID NO: 7336417 - DNA, 22 bp, Homo sapiens
gtccccttggtaaccttcagct

SEQ ID NO: 7336418 - DNA, 22 bp, Homo sapiens
gtcctgggcatgcagggctttc

SEQ ID NO: 7336419 - DNA, 22 bp, Homo sapiens
gtcctgggaggggctggtcctg

SEQ ID NO: 7336420 - DNA, 22 bp, Homo sapiens
gtcctgggcccaggggctgcct

SEQ ID NO: 7336421 - DNA, 22 bp, Homo sapiens
gtccctggaaaagagctggtga

SEQ ID NO: 7336422 - DNA, 22 bp, Homo sapiens
gtccctgccctcctgggactca

SEQ ID NO: 7336423 - DNA, 22 bp, Homo sapiens
gtccctgcatctgcaggccatg

SEQ ID NO: 7336424 - DNA, 22 bp, Homo sapiens
gtcctgggaaggaagccaggga

SEQ ID NO: 7336425 - DNA, 22 bp, Homo sapiens
gtcctgggaaggaagccaggga

SEQ ID NO: 7336426 - DNA, 22 bp, Homo sapiens
ggagtgagtactggagtagctg

SEQ ID NO: 7336427 - DNA, 22 bp, Homo sapiens
ggagtctgagcttgtgtcctgg

SEQ ID NO: 7336428 - DNA, 22 bp, Homo sapiens
ggagtcagactttgattagtag

SEQ ID NO: 7336429 - DNA, 22 bp, Homo sapiens
ggagccagaggctgctgctgtg

SEQ ID NO: 7336430 - DNA, 22 bp, Homo sapiens
ggagccagagtctgcagtgtaa

SEQ ID NO: 7336431 - DNA, 22 bp, Homo sapiens
ggagccagagcactggggagcc

SEQ ID NO: 7336432 - DNA, 23 bp, Homo sapiens
ggagccagcctgtggggagcggg

SEQ ID NO: 7336433 - DNA, 22 bp, Homo sapiens
ggagtaggccccgggagagagt

SEQ ID NO: 7336434 - DNA, 19 bp, Homo sapiens
ggagccagctgtggaaggc

SEQ ID NO: 7336435 - DNA, 22 bp, Homo sapiens
ggcaaaaacagcaatgactttt

SEQ ID NO: 7336436 - DNA, 22 bp, Homo sapiens
ggcaaaaaccacaattactttt

SEQ ID NO: 7336437 - DNA, 22 bp, Homo sapiens
ggcaaaaaccataattactttt

SEQ ID NO: 7336438 - DNA, 22 bp, Homo sapiens
ggcaaaaaccgcaataacttct

SEQ ID NO: 7336439 - DNA, 22 bp, Homo sapiens
ggcaaaaagttcccatcagtgt

SEQ ID NO: 7336440 - DNA, 22 bp, Homo sapiens
ggagtgcagtggcgtgagctcg

SEQ ID NO: 7336441 - DNA, 22 bp, Homo sapiens
ggagtgcagtggtgggatctca

SEQ ID NO: 7336442 - DNA, 22 bp, Homo sapiens
ggcaacattctccagatccttt

SEQ ID NO: 7336443 - DNA, 22 bp, Homo sapiens
ggcaaaggaaccaggccacact

SEQ ID NO: 7336444 - DNA, 22 bp, Homo sapiens
ggcaggcaccagctcagcaata

SEQ ID NO: 7336445 - DNA, 22 bp, Homo sapiens
ggcaggcactgtgctaggcgct

SEQ ID NO: 7336446 - DNA, 22 bp, Homo sapiens
ggcaggcactgtgctaggcgct

SEQ ID NO: 7336447 - DNA, 22 bp, Homo sapiens
ggcaggaggtgagtggcgggtg

SEQ ID NO: 7336448 - DNA, 22 bp, Homo sapiens
ggcaggaggtgagtggcgggtg

SEQ ID NO: 7336449 - DNA, 22 bp, Homo sapiens
ggcaggcaacggaccactagtc

SEQ ID NO: 7336450 - DNA, 22 bp, Homo sapiens
ggcaggcaacggaccactagtc

SEQ ID NO: 7336451 - DNA, 22 bp, Homo sapiens
ggcaggaggtgagtggcgggtg

SEQ ID NO: 7336452 - DNA, 22 bp, Homo sapiens
ggcagaggtagctggaaccagg

SEQ ID NO: 7336453 - DNA, 22 bp, Homo sapiens
ggcagaggtagctggaaccagg

SEQ ID NO: 7336454 - DNA, 22 bp, Homo sapiens
ggcagaggtagctggaaccagg

SEQ ID NO: 7336455 - DNA, 20 bp, Homo sapiens
ggcagagggcctgggagaag

SEQ ID NO: 7336456 - DNA, 20 bp, Homo sapiens
ggcagagggcctgggagaag

SEQ ID NO: 7336457 - DNA, 20 bp, Homo sapiens
ggcagagggcctgggagaag

SEQ ID NO: 7336458 - DNA, 20 bp, Homo sapiens
ggcagagggcctgggagaag

SEQ ID NO: 7336459 - DNA, 22 bp, Homo sapiens
ggcagaggaggggtgaatttgc

SEQ ID NO: 7336460 - DNA, 22 bp, Homo sapiens
ggcagaggagctggaaacatgg

SEQ ID NO: 7336461 - DNA, 22 bp, Homo sapiens
ggcagaggagctggaaacatgg

SEQ ID NO: 7336462 - DNA, 22 bp, Homo sapiens
ggcagaggagctggaaacatgg

SEQ ID NO: 7336463 - DNA, 22 bp, Homo sapiens
ggcagaggaaggatgaattcac

SEQ ID NO: 7336464 - DNA, 22 bp, Homo sapiens
ggcagaggaagctggaagtggg

SEQ ID NO: 7336465 - DNA, 22 bp, Homo sapiens
ggcagaggaagctggaagtggg

SEQ ID NO: 7336466 - DNA, 22 bp, Homo sapiens
ggcagaggaaggatgaattcac

SEQ ID NO: 7336467 - DNA, 22 bp, Homo sapiens
ggcagaggaagctggaagtggg

SEQ ID NO: 7336468 - DNA, 22 bp, Homo sapiens
ggcacatttataagtggacata

SEQ ID NO: 7336469 - DNA, 22 bp, Homo sapiens
ggcacaggaatctgtgaagtgc

SEQ ID NO: 7336470 - DNA, 22 bp, Homo sapiens
ggcacagccctctctgtggaca

SEQ ID NO: 7336471 - DNA, 22 bp, Homo sapiens
ggccatgccaggctgcctggga

SEQ ID NO: 7336472 - DNA, 22 bp, Homo sapiens
ggccatgcctggtctggcacca

SEQ ID NO: 7336473 - DNA, 22 bp, Homo sapiens
ggccagtggctctgtgcttggg

SEQ ID NO: 7336474 - DNA, 22 bp, Homo sapiens
ggccagtctgggccacggtcgg

SEQ ID NO: 7336475 - DNA, 22 bp, Homo sapiens
ggccaggtgcggtggctcacac

SEQ ID NO: 7336476 - DNA, 22 bp, Homo sapiens
ggccaggtccagtggaaggccc

SEQ ID NO: 7336477 - DNA, 22 bp, Homo sapiens
ggccagggcctggggactgtcc

SEQ ID NO: 7336478 - DNA, 22 bp, Homo sapiens
ggccagggggcttcagactcca

SEQ ID NO: 7336479 - DNA, 22 bp, Homo sapiens
ggccagggcctggggactgtcc

SEQ ID NO: 7336480 - DNA, 19 bp, Homo sapiens
ggccaggctgactgtggtc

SEQ ID NO: 7336481 - DNA, 20 bp, Homo sapiens
ggcatgggtggggctcccag

SEQ ID NO: 7336482 - DNA, 20 bp, Homo sapiens
ggcatgggtggggctcccag

SEQ ID NO: 7336483 - DNA, 22 bp, Homo sapiens
ggccacactctggtagaggtga

SEQ ID NO: 7336484 - DNA, 22 bp, Homo sapiens
ggccacactctggtagaggtga

SEQ ID NO: 7336485 - DNA, 22 bp, Homo sapiens
ggccacagaacagctacaggac

SEQ ID NO: 7336486 - DNA, 19 bp, Homo sapiens
ggccaggctgactgtggtc

SEQ ID NO: 7336487 - DNA, 22 bp, Homo sapiens
ggccacacagatgactgctttc

SEQ ID NO: 7336488 - DNA, 22 bp, Homo sapiens
ggccacacggagaggctggtct

SEQ ID NO: 7336489 - DNA, 22 bp, Homo sapiens
ggccacacggagaggctggtct

SEQ ID NO: 7336490 - DNA, 19 bp, Homo sapiens
ggcatggggtccggggacc

SEQ ID NO: 7336491 - DNA, 22 bp, Homo sapiens
ggcatggggtgtatgtggcacg

SEQ ID NO: 7336492 - DNA, 22 bp, Homo sapiens
ggcatgggccgaggtgcctcct

SEQ ID NO: 7336493 - DNA, 22 bp, Homo sapiens
ggcatgggccgaggtgcctcct

SEQ ID NO: 7336494 - DNA, 22 bp, Homo sapiens
ggcatgggagtgagcaacctta

SEQ ID NO: 7336495 - DNA, 22 bp, Homo sapiens
ggcagtgaatgaaacagaggct

SEQ ID NO: 7336496 - DNA, 22 bp, Homo sapiens
ggcagtgaacagaaatgcagaa

SEQ ID NO: 7336497 - DNA, 22 bp, Homo sapiens
ggcagtgaacagaaatgcagaa

SEQ ID NO: 7336498 - DNA, 22 bp, Homo sapiens
ggcagtcatcccacttggaacc

SEQ ID NO: 7336499 - DNA, 22 bp, Homo sapiens
ggcagtcagtttggagatggat

SEQ ID NO: 7336500 - DNA, 22 bp, Homo sapiens
ggcaggtggcactgctgctccc

SEQ ID NO: 7336501 - DNA, 22 bp, Homo sapiens
ggcaggtgggaaccctccccac

SEQ ID NO: 7336502 - DNA, 22 bp, Homo sapiens
ggcaggtggacgtgctaaagct

SEQ ID NO: 7336503 - DNA, 22 bp, Homo sapiens
ggcaggtggattttctactcta

SEQ ID NO: 7336504 - DNA, 19 bp, Homo sapiens
ggccatggcgggggtcaca

SEQ ID NO: 7336505 - DNA, 22 bp, Homo sapiens
ggccatgctcgtggctggactg

SEQ ID NO: 7336506 - DNA, 22 bp, Homo sapiens
ggccatgctgttgcctgctggt

SEQ ID NO: 7336507 - DNA, 23 bp, Homo sapiens
ggccatggagacttagaatgggc

SEQ ID NO: 7336508 - DNA, 22 bp, Homo sapiens
ggcctcagaggaggtgtgagtc

SEQ ID NO: 7336509 - DNA, 22 bp, Homo sapiens
ggcctcagagaaggctgtgcgg

SEQ ID NO: 7336510 - DNA, 21 bp, Homo sapiens
ggcctcagccacctggctctg

SEQ ID NO: 7336511 - DNA, 18 bp, Homo sapiens
ggcctcagcctggccgga

SEQ ID NO: 7336512 - DNA, 22 bp, Homo sapiens
ggcctcagggtcactctgtaga

SEQ ID NO: 7336513 - DNA, 22 bp, Homo sapiens
ggcctcagtgggccgctgcagg

SEQ ID NO: 7336514 - DNA, 22 bp, Homo sapiens
ggcctctgtttggagccaggat

SEQ ID NO: 7336515 - DNA, 22 bp, Homo sapiens
ggcctctggttcgtggtgacct

SEQ ID NO: 7336516 - DNA, 22 bp, Homo sapiens
ggcctctggttcacagggagga

SEQ ID NO: 7336517 - DNA, 22 bp, Homo sapiens
ggccttttgtgtccttgcccgt

SEQ ID NO: 7336518 - DNA, 22 bp, Homo sapiens
ggcctttgcgtccacgccgctt

SEQ ID NO: 7336519 - DNA, 22 bp, Homo sapiens
ggcgctggccacggtggctctg

SEQ ID NO: 7336520 - DNA, 22 bp, Homo sapiens
ggcgagcagagcactgccagga

SEQ ID NO: 7336521 - DNA, 22 bp, Homo sapiens
ggccttgggcgagtccctcagt

SEQ ID NO: 7336522 - DNA, 22 bp, Homo sapiens
ggccttgggcagacacgtcaca

SEQ ID NO: 7336523 - DNA, 22 bp, Homo sapiens
gggacatctttctagtcagggt

SEQ ID NO: 7336524 - DNA, 22 bp, Homo sapiens
gggacatctttctagtcagggt

SEQ ID NO: 7336525 - DNA, 22 bp, Homo sapiens
gggacaggctgagacttgagct

SEQ ID NO: 7336526 - DNA, 22 bp, Homo sapiens
gggacaggcccctcgctagctt

SEQ ID NO: 7336527 - DNA, 22 bp, Homo sapiens
gggacaggctgagacttgagct

SEQ ID NO: 7336528 - DNA, 22 bp, Homo sapiens
gggacaggctgagacttgagct

SEQ ID NO: 7336529 - DNA, 22 bp, Homo sapiens
gggacaggcccctcgctagctt

SEQ ID NO: 7336530 - DNA, 22 bp, Homo sapiens
gggacaggcccctcgctagctt

SEQ ID NO: 7336531 - DNA, 22 bp, Homo sapiens
gggacaggcaaaggtatgcttc

SEQ ID NO: 7336532 - DNA, 22 bp, Homo sapiens
gggagaagtggaaatctcatta

SEQ ID NO: 7336533 - DNA, 22 bp, Homo sapiens
gggacattgtcaatggtggtag

SEQ ID NO: 7336534 - DNA, 22 bp, Homo sapiens
ggcttggcttgggctcagaggc

SEQ ID NO: 7336535 - DNA, 22 bp, Homo sapiens
ggcttggctgtctcccagccca

SEQ ID NO: 7336536 - DNA, 22 bp, Homo sapiens
gggagagaattattgccagacc

SEQ ID NO: 7336537 - DNA, 22 bp, Homo sapiens
gggagagagaaaacgtggcgca

SEQ ID NO: 7336538 - DNA, 22 bp, Homo sapiens
gggagagcgcgctagggccgag

SEQ ID NO: 7336539 - DNA, 19 bp, Homo sapiens
gggagagccaggctcaccc

SEQ ID NO: 7336540 - DNA, 22 bp, Homo sapiens
gggagagcgcgctagggccgag

SEQ ID NO: 7336541 - DNA, 19 bp, Homo sapiens
gggagagccaggctcaccc

SEQ ID NO: 7336542 - DNA, 22 bp, Homo sapiens
gggagagcgggaggtgccacag

SEQ ID NO: 7336543 - DNA, 22 bp, Homo sapiens
gggagagcgggaggtgccacag

SEQ ID NO: 7336544 - DNA, 22 bp, Homo sapiens
gggagagcgcgctagggccgag

SEQ ID NO: 7336545 - DNA, 22 bp, Homo sapiens
gggagagcgggaggtgccacag

SEQ ID NO: 7336546 - DNA, 22 bp, Homo sapiens
gggagaggttacccgagcaact

SEQ ID NO: 7336547 - DNA, 22 bp, Homo sapiens
gggagaggttacccgagcaact

SEQ ID NO: 7336548 - DNA, 22 bp, Homo sapiens
gggagatgaatcagaagtgatc

SEQ ID NO: 7336549 - DNA, 22 bp, Homo sapiens
gggagctgtaagggacaggtag

SEQ ID NO: 7336550 - DNA, 22 bp, Homo sapiens
gggcaggagagaacagtcatgg

SEQ ID NO: 7336551 - DNA, 22 bp, Homo sapiens
gggcaggagagaacagtcatgg

SEQ ID NO: 7336552 - DNA, 22 bp, Homo sapiens
gggcaggagagggccacctgga

SEQ ID NO: 7336553 - DNA, 22 bp, Homo sapiens
gggcaggagagaacagtcatgg

SEQ ID NO: 7336554 - DNA, 16 bp, Homo sapiens
gggcaggaatcagggt

SEQ ID NO: 7336555 - DNA, 22 bp, Homo sapiens
gggcaggaacaaatcaaatgat

SEQ ID NO: 7336556 - DNA, 16 bp, Homo sapiens
gggcaggaatcagggt

SEQ ID NO: 7336557 - DNA, 22 bp, Homo sapiens
gggcaggaggctaattctgcat

SEQ ID NO: 7336558 - DNA, 19 bp, Homo sapiens
gggcatggatgagcttacc

SEQ ID NO: 7336559 - DNA, 23 bp, Homo sapiens
gggcatggagtgtaggtggaagg

SEQ ID NO: 7336560 - DNA, 19 bp, Homo sapiens
gggcatgctggctctagag

SEQ ID NO: 7336561 - DNA, 22 bp, Homo sapiens
gggcacaggaatttgggatgtg

SEQ ID NO: 7336562 - DNA, 22 bp, Homo sapiens
gggaggagctgagtgtgtgtgc

SEQ ID NO: 7336563 - DNA, 22 bp, Homo sapiens
gggaggagctgagtgtgtgtgc

SEQ ID NO: 7336564 - DNA, 22 bp, Homo sapiens
gggatggggagctggaaagggg

SEQ ID NO: 7336565 - DNA, 22 bp, Homo sapiens
gggatggggggaagcgtccatg

SEQ ID NO: 7336566 - DNA, 22 bp, Homo sapiens
gggatggggagctggaaagggg

SEQ ID NO: 7336567 - DNA, 22 bp, Homo sapiens
gggatggggagctggaaagggg

SEQ ID NO: 7336568 - DNA, 22 bp, Homo sapiens
gggaggaaggcttgggtgagta

SEQ ID NO: 7336569 - DNA, 22 bp, Homo sapiens
gggcacagcctaactatggaga

SEQ ID NO: 7336570 - DNA, 22 bp, Homo sapiens
gggcacagcccagtggggtccc

SEQ ID NO: 7336571 - DNA, 22 bp, Homo sapiens
gggcacagcctaactatggaga

SEQ ID NO: 7336572 - DNA, 22 bp, Homo sapiens
gggattgaattgggggatcaca

SEQ ID NO: 7336573 - DNA, 22 bp, Homo sapiens
gggatggggtcgggaccctgct

SEQ ID NO: 7336574 - DNA, 22 bp, Homo sapiens
ggctctgggaaatggtcttcct

SEQ ID NO: 7336575 - DNA, 22 bp, Homo sapiens
ggctctgggcatagaaggaagc

SEQ ID NO: 7336576 - DNA, 22 bp, Homo sapiens
ggctctggcaaggggaggctac

SEQ ID NO: 7336577 - DNA, 22 bp, Homo sapiens
ggctctggagatgtccgacctg

SEQ ID NO: 7336578 - DNA, 22 bp, Homo sapiens
ggctctggagacatgtggagag

SEQ ID NO: 7336579 - DNA, 22 bp, Homo sapiens
ggctctgctggattgaggccag

SEQ ID NO: 7336580 - DNA, 22 bp, Homo sapiens
ggctcttctgtttcacaggcca

SEQ ID NO: 7336581 - DNA, 22 bp, Homo sapiens
ggctcttctggttgtcacattt

SEQ ID NO: 7336582 - DNA, 22 bp, Homo sapiens
ggctccagatgtctcctggcaa

SEQ ID NO: 7336583 - DNA, 22 bp, Homo sapiens
ggctccagatgtcccctggcaa

SEQ ID NO: 7336584 - DNA, 22 bp, Homo sapiens
ggctccagatgtcccctggcaa

SEQ ID NO: 7336585 - DNA, 22 bp, Homo sapiens
ggctccagaaacttcagtccat

SEQ ID NO: 7336586 - DNA, 22 bp, Homo sapiens
ggctccagaaacttcagtccat

SEQ ID NO: 7336587 - DNA, 22 bp, Homo sapiens
ggctccagaaatcatagagcag

SEQ ID NO: 7336588 - DNA, 22 bp, Homo sapiens
ggctccagaaatcatagagcag

SEQ ID NO: 7336589 - DNA, 22 bp, Homo sapiens
ggcgggaggctgaggagttggt

SEQ ID NO: 7336590 - DNA, 22 bp, Homo sapiens
ggcgggcagatgcggacacgcg

SEQ ID NO: 7336591 - DNA, 22 bp, Homo sapiens
ggcggggcctcgcgaacggcct

SEQ ID NO: 7336592 - DNA, 22 bp, Homo sapiens
ggcggccgccttcggccacggc

SEQ ID NO: 7336593 - DNA, 21 bp, Homo sapiens
ggcggcgcagagctgcggctc

SEQ ID NO: 7336594 - DNA, 22 bp, Homo sapiens
ggcgggacggggcgtgcacaga

SEQ ID NO: 7336595 - DNA, 22 bp, Homo sapiens
ggctctgctgcacccttggctc

SEQ ID NO: 7336596 - DNA, 22 bp, Homo sapiens
ggctctgctgcaagtcttcctc

SEQ ID NO: 7336597 - DNA, 22 bp, Homo sapiens
ggctctgctcacagcccgcagc

SEQ ID NO: 7336598 - DNA, 22 bp, Homo sapiens
ggctctgctcctggtgccagtg

SEQ ID NO: 7336599 - DNA, 22 bp, Homo sapiens
ggctctgctgcaagtcttcctc

SEQ ID NO: 7336600 - DNA, 22 bp, Homo sapiens
ggctccaggagatgctgggcag

SEQ ID NO: 7336601 - DNA, 22 bp, Homo sapiens
ggctccaggagggccttggcca

SEQ ID NO: 7336602 - DNA, 22 bp, Homo sapiens
ggctccaggaacctcctctcct

SEQ ID NO: 7336603 - DNA, 18 bp, Homo sapiens
ggctccaggacctaccca

SEQ ID NO: 7336604 - DNA, 22 bp, Homo sapiens
ggctccagccctggctcttcac

SEQ ID NO: 7336605 - DNA, 22 bp, Homo sapiens
ggctccagctaatggtttctat

SEQ ID NO: 7336606 - DNA, 22 bp, Homo sapiens
ggctccagccctggctcttcac

SEQ ID NO: 7336607 - DNA, 22 bp, Homo sapiens
ggctgggaggccgtgctgacct

SEQ ID NO: 7336608 - DNA, 22 bp, Homo sapiens
ggctgggcaaacaagactcttc

SEQ ID NO: 7336609 - DNA, 21 bp, Homo sapiens
ggctgggcaggacccacccct

SEQ ID NO: 7336610 - DNA, 21 bp, Homo sapiens
ggctgctgggagagctgcgtg

SEQ ID NO: 7336611 - DNA, 21 bp, Homo sapiens
ggctgctgggagagctgcgtg

SEQ ID NO: 7336612 - DNA, 21 bp, Homo sapiens
ggctgctgggagagctgcgtg

SEQ ID NO: 7336613 - DNA, 21 bp, Homo sapiens
ggctgctgggagagctgcgtg

SEQ ID NO: 7336614 - DNA, 22 bp, Homo sapiens
ggctgctggagttgggtctctc

SEQ ID NO: 7336615 - DNA, 22 bp, Homo sapiens
ggctgctggcagatgtagttta

SEQ ID NO: 7336616 - DNA, 22 bp, Homo sapiens
ggctgctggagttgggtctctc

SEQ ID NO: 7336617 - DNA, 22 bp, Homo sapiens
ggctgctggcattgaggtaggt

SEQ ID NO: 7336618 - DNA, 22 bp, Homo sapiens
ggctgctggcattgaggtaggt

SEQ ID NO: 7336619 - DNA, 22 bp, Homo sapiens
ggctgctggccagcctaggagt

SEQ ID NO: 7336620 - DNA, 22 bp, Homo sapiens
ggctgctggcattgaggtaggt

SEQ ID NO: 7336621 - DNA, 22 bp, Homo sapiens
ggctgctggccagcctaggagt

SEQ ID NO: 7336622 - DNA, 22 bp, Homo sapiens
ggctgctggccagcctaggagt

SEQ ID NO: 7336623 - DNA, 22 bp, Homo sapiens
ggctgctgggaatatgccagct

SEQ ID NO: 7336624 - DNA, 22 bp, Homo sapiens
ggctgctgggaatatgccagct

SEQ ID NO: 7336625 - DNA, 22 bp, Homo sapiens
ggctgctgagttggccaggaga

SEQ ID NO: 7336626 - DNA, 22 bp, Homo sapiens
ggctgctgagttggccaggaga

SEQ ID NO: 7336627 - DNA, 22 bp, Homo sapiens
ggctgctgagttggccaggaga

SEQ ID NO: 7336628 - DNA, 22 bp, Homo sapiens
ggctgctgagtcacgacagtga

SEQ ID NO: 7336629 - DNA, 22 bp, Homo sapiens
ggctgctgagtcacgacagtga

SEQ ID NO: 7336630 - DNA, 22 bp, Homo sapiens
ggctgctgctgtgtaggcctgt

SEQ ID NO: 7336631 - DNA, 22 bp, Homo sapiens
ggctgctgccctcctaagtgca

SEQ ID NO: 7336632 - DNA, 22 bp, Homo sapiens
ggctgctgccctcctaagtgca

SEQ ID NO: 7336633 - DNA, 22 bp, Homo sapiens
ggctgctgcccacccctgcatg

SEQ ID NO: 7336634 - DNA, 22 bp, Homo sapiens
ggctgagcaattttgatgacat

SEQ ID NO: 7336635 - DNA, 22 bp, Homo sapiens
ggctgctgaagtgtggcaatct

SEQ ID NO: 7336636 - DNA, 22 bp, Homo sapiens
ggctgggctgcggctgtacctg

SEQ ID NO: 7336637 - DNA, 22 bp, Homo sapiens
ggctgggctgcggctgtacctg

SEQ ID NO: 7336638 - DNA, 22 bp, Homo sapiens
ggctgggctccgggagcatgcg

SEQ ID NO: 7336639 - DNA, 22 bp, Homo sapiens
ggctgggctccgggagcatgcg

SEQ ID NO: 7336640 - DNA, 22 bp, Homo sapiens
ggctgggcctctccctcagctg

SEQ ID NO: 7336641 - DNA, 22 bp, Homo sapiens
ggctgggccgcggctacccaga

SEQ ID NO: 7336642 - DNA, 22 bp, Homo sapiens
ggctgggccgcggctacccaga

SEQ ID NO: 7336643 - DNA, 22 bp, Homo sapiens
ggctgggccgcggctacccaga

SEQ ID NO: 7336644 - DNA, 22 bp, Homo sapiens
ggctgggcctctccctcagctg

SEQ ID NO: 7336645 - DNA, 22 bp, Homo sapiens
ggctgggcctctccctcagctg

SEQ ID NO: 7336646 - DNA, 22 bp, Homo sapiens
ggctgggcatccatccatgaga

SEQ ID NO: 7336647 - DNA, 22 bp, Homo sapiens
ggctgggccagggcctgtggac

SEQ ID NO: 7336648 - DNA, 22 bp, Homo sapiens
ggctgggcaggtctgcacaggg

SEQ ID NO: 7336649 - DNA, 22 bp, Homo sapiens
ggctgggccagggcctgtggac

SEQ ID NO: 7336650 - DNA, 22 bp, Homo sapiens
ggctgggccagggcctgtggac

SEQ ID NO: 7336651 - DNA, 22 bp, Homo sapiens
ggctgggcaggtctgcacaggg

SEQ ID NO: 7336652 - DNA, 21 bp, Homo sapiens
ggctgggcaggacccacccct

SEQ ID NO: 7336653 - DNA, 20 bp, Homo sapiens
gacaacatgcagaaagtata

SEQ ID NO: 7336654 - DNA, 20 bp, Homo sapiens
gacaacatgcagaaagtata

SEQ ID NO: 7336655 - DNA, 22 bp, Homo sapiens
gaatactgacactcaggtggga

SEQ ID NO: 7336656 - DNA, 22 bp, Homo sapiens
gaatactgacactcaggtggga

SEQ ID NO: 7336657 - DNA, 22 bp, Homo sapiens
gaatactggaaaactcatttta

SEQ ID NO: 7336658 - DNA, 22 bp, Homo sapiens
gaatactggaaaactcatttta

SEQ ID NO: 7336659 - DNA, 22 bp, Homo sapiens
gaatactgatgctcagccccct

SEQ ID NO: 7336660 - DNA, 22 bp, Homo sapiens
gaatactgatgctcagccccct

SEQ ID NO: 7336661 - DNA, 18 bp, Homo sapiens
gaatactgagagcacaaa

SEQ ID NO: 7336662 - DNA, 18 bp, Homo sapiens
gaatactgagagcacaaa

SEQ ID NO: 7336663 - DNA, 22 bp, Homo sapiens
gaatacatgtgtgtatagaggt

SEQ ID NO: 7336664 - DNA, 21 bp, Homo sapiens
gaataggaacctgatcatggg

SEQ ID NO: 7336665 - DNA, 22 bp, Homo sapiens
gaaggaaaggtctcatgccttt

SEQ ID NO: 7336666 - DNA, 22 bp, Homo sapiens
gaaggaaatctgtgatttatgc

SEQ ID NO: 7336667 - DNA, 22 bp, Homo sapiens
gaaggaagattctgttggaatc

SEQ ID NO: 7336668 - DNA, 22 bp, Homo sapiens
gaagttgatagagtacatgatt

SEQ ID NO: 7336669 - DNA, 22 bp, Homo sapiens
gaaggaaaaatactctgtaagg

SEQ ID NO: 7336670 - DNA, 22 bp, Homo sapiens
gaaggaaaacagatctgcctga

SEQ ID NO: 7336671 - DNA, 22 bp, Homo sapiens
gaagcctcaacatctctgcgtc

SEQ ID NO: 7336672 - DNA, 22 bp, Homo sapiens
gaagcctcaacatctctgcgtc

SEQ ID NO: 7336673 - DNA, 23 bp, Homo sapiens
gaatacagagataaatagaacac

SEQ ID NO: 7336674 - DNA, 23 bp, Homo sapiens
gaatacagagataaatagaacac

SEQ ID NO: 7336675 - DNA, 19 bp, Homo sapiens
gaatacagataataagcag

SEQ ID NO: 7336676 - DNA, 19 bp, Homo sapiens
gaatacagataataagcag

SEQ ID NO: 7336677 - DNA, 19 bp, Homo sapiens
gaatacagataataagcag

SEQ ID NO: 7336678 - DNA, 22 bp, Homo sapiens
gaatacaggcaggtggctgtgc

SEQ ID NO: 7336679 - DNA, 22 bp, Homo sapiens
gaatacaggcaggtggctgtgc

SEQ ID NO: 7336680 - DNA, 22 bp, Homo sapiens
gaatacaggcaggtggctgtgc

SEQ ID NO: 7336681 - DNA, 18 bp, Homo sapiens
gacacacttgcagtagtc

SEQ ID NO: 7336682 - DNA, 22 bp, Homo sapiens
gacaataaaatgatcttacagt

SEQ ID NO: 7336683 - DNA, 22 bp, Homo sapiens
gacacactgtttggactagggt

SEQ ID NO: 7336684 - DNA, 22 bp, Homo sapiens
gacaggctaggttgctgtcctc

SEQ ID NO: 7336685 - DNA, 22 bp, Homo sapiens
gacaggctaggttgctgtcctc

SEQ ID NO: 7336686 - DNA, 22 bp, Homo sapiens
gacacagagacttgcagttgta

SEQ ID NO: 7336687 - DNA, 22 bp, Homo sapiens
gacacagacagttagaggtaat

SEQ ID NO: 7336688 - DNA, 22 bp, Homo sapiens
gacaggctttctcaggatgagc

SEQ ID NO: 7336689 - DNA, 22 bp, Homo sapiens
gacaggctttgagtcccagaac

SEQ ID NO: 7336690 - DNA, 22 bp, Homo sapiens
gacaggctttctcaggatgagc

SEQ ID NO: 7336691 - DNA, 22 bp, Homo sapiens
gacaggcttcatcctcagagtt

SEQ ID NO: 7336692 - DNA, 22 bp, Homo sapiens
gacaggcttcatcctcagagtt

SEQ ID NO: 7336693 - DNA, 22 bp, Homo sapiens
gacaggcttcatcctcagagtt

SEQ ID NO: 7336694 - DNA, 17 bp, Homo sapiens
gacaggctcagtgacga

SEQ ID NO: 7336695 - DNA, 22 bp, Homo sapiens
gacagggctgtgggaggagcag

SEQ ID NO: 7336696 - DNA, 22 bp, Homo sapiens
gacagggctgtgggaggagcag

SEQ ID NO: 7336697 - DNA, 22 bp, Homo sapiens
gacagggctgtgggaggagcag

SEQ ID NO: 7336698 - DNA, 21 bp, Homo sapiens
gacaggggaagaagcaaggag

SEQ ID NO: 7336699 - DNA, 21 bp, Homo sapiens
gacaggggaagaagcaaggag

SEQ ID NO: 7336700 - DNA, 21 bp, Homo sapiens
gacaggggccatgggtttcta

SEQ ID NO: 7336701 - DNA, 22 bp, Homo sapiens
gacaggggtccctctgggctgt

SEQ ID NO: 7336702 - DNA, 22 bp, Homo sapiens
gacaggggtccctctgggctgt

SEQ ID NO: 7336703 - DNA, 22 bp, Homo sapiens
gacaggggctttgcatgcttta

SEQ ID NO: 7336704 - DNA, 22 bp, Homo sapiens
gaccctggtgtccaggtcctgc

SEQ ID NO: 7336705 - DNA, 22 bp, Homo sapiens
gaccctggctgccgcggtctgg

SEQ ID NO: 7336706 - DNA, 22 bp, Homo sapiens
gacagtcacttccaggagagga

SEQ ID NO: 7336707 - DNA, 22 bp, Homo sapiens
gacaggtgaaacagcaaggtaa

SEQ ID NO: 7336708 - DNA, 21 bp, Homo sapiens
gacaggtgattcagagcaggg

SEQ ID NO: 7336709 - DNA, 21 bp, Homo sapiens
gacaggtgattcagagcaggg

SEQ ID NO: 7336710 - DNA, 20 bp, Homo sapiens
gacaggtgctaaagaggggc

SEQ ID NO: 7336711 - DNA, 22 bp, Homo sapiens
gacaggtgagatgaggaacacc

SEQ ID NO: 7336712 - DNA, 22 bp, Homo sapiens
gacaggtgagatgaggaacacc

SEQ ID NO: 7336713 - DNA, 22 bp, Homo sapiens
gacaggtaaagatggtggcagg

SEQ ID NO: 7336714 - DNA, 22 bp, Homo sapiens
gacaggtaaagatggtggcagg

SEQ ID NO: 7336715 - DNA, 23 bp, Homo sapiens
gacaggtaagggttgggagaatc

SEQ ID NO: 7336716 - DNA, 22 bp, Homo sapiens
gacagggtggctgatagggctc

SEQ ID NO: 7336717 - DNA, 22 bp, Homo sapiens
gacaggtgtgtgtatattaggg

SEQ ID NO: 7336718 - DNA, 22 bp, Homo sapiens
gacaggtgtgatgatttaggct

SEQ ID NO: 7336719 - DNA, 20 bp, Homo sapiens
gacaggtgctaaagaggggc

SEQ ID NO: 7336720 - DNA, 22 bp, Homo sapiens
gacaggtggggaaactaaggta

SEQ ID NO: 7336721 - DNA, 18 bp, Homo sapiens
gacaggtgggtgagacca

SEQ ID NO: 7336722 - DNA, 22 bp, Homo sapiens
gaagagaagcatcaataggtaa

SEQ ID NO: 7336723 - DNA, 22 bp, Homo sapiens
gaagaggatgacaggagccggt

SEQ ID NO: 7336724 - DNA, 22 bp, Homo sapiens
gaagaggctttcctagggcaag

SEQ ID NO: 7336725 - DNA, 22 bp, Homo sapiens
gaagaggactgtggcatcctag

SEQ ID NO: 7336726 - DNA, 21 bp, Homo sapiens
gaacccagcagcagtgctctg

SEQ ID NO: 7336727 - DNA, 21 bp, Homo sapiens
gaacccagcagcagtgctctg

SEQ ID NO: 7336728 - DNA, 22 bp, Homo sapiens
gaagacatcgtgtggactaaca

SEQ ID NO: 7336729 - DNA, 22 bp, Homo sapiens
gaagacactaaactggggcttc

SEQ ID NO: 7336730 - DNA, 22 bp, Homo sapiens
gaagaggctttcctagggcaag

SEQ ID NO: 7336731 - DNA, 22 bp, Homo sapiens
gaagcccatttgtacagcacat

SEQ ID NO: 7336732 - DNA, 22 bp, Homo sapiens
gaagcccagtgtcttcttttct

SEQ ID NO: 7336733 - DNA, 22 bp, Homo sapiens
gaagcctcaacatctctgcgtc

SEQ ID NO: 7336734 - DNA, 22 bp, Homo sapiens
gaaatcattagcaaagatatgt

SEQ ID NO: 7336735 - DNA, 22 bp, Homo sapiens
gaaatgcagattctgattctgt

SEQ ID NO: 7336736 - DNA, 22 bp, Homo sapiens
gaaatggtaaacattttaatgg

SEQ ID NO: 7336737 - DNA, 20 bp, Homo sapiens
gaaatgtacacattaccaca

SEQ ID NO: 7336738 - DNA, 22 bp, Homo sapiens
gaacagtgccagcacacaataa

SEQ ID NO: 7336739 - DNA, 22 bp, Homo sapiens
gaacatttggcatgagaatttg

SEQ ID NO: 7336740 - DNA, 22 bp, Homo sapiens
gaacagggttgggtgagagagg

SEQ ID NO: 7336741 - DNA, 22 bp, Homo sapiens
gaacagggttgggtgagagagg

SEQ ID NO: 7336742 - DNA, 22 bp, Homo sapiens
gaacagggtttgagaggcttag

SEQ ID NO: 7336743 - DNA, 22 bp, Homo sapiens
gaacagcttcttgggagctggg

SEQ ID NO: 7336744 - DNA, 22 bp, Homo sapiens
gaacagggagtacggcacattt

SEQ ID NO: 7336745 - DNA, 22 bp, Homo sapiens
gaacagcatgtaagaagctact

SEQ ID NO: 7336746 - DNA, 22 bp, Homo sapiens
gaacagctataatcatctgtcc

SEQ ID NO: 7336747 - DNA, 22 bp, Homo sapiens
gaacagctctgaagcagtaaat

SEQ ID NO: 7336748 - DNA, 22 bp, Homo sapiens
ctttcatagttaaaatagtttg

SEQ ID NO: 7336749 - DNA, 22 bp, Homo sapiens
ctttcatgcacttctttagatc

SEQ ID NO: 7336750 - DNA, 22 bp, Homo sapiens
gaaatcacttttttcatagttg

SEQ ID NO: 7336751 - DNA, 22 bp, Homo sapiens
gaaatcaggatgatgttccaga

SEQ ID NO: 7336752 - DNA, 22 bp, Homo sapiens
gaaatcaaacccttttctgata

SEQ ID NO: 7336753 - DNA, 22 bp, Homo sapiens
ctttcaggttctataggaagcc

SEQ ID NO: 7336754 - DNA, 22 bp, Homo sapiens
ctttcaggtcacataacgccaa

SEQ ID NO: 7336755 - DNA, 22 bp, Homo sapiens
ctttcagggcaacacttctttt

SEQ ID NO: 7336756 - DNA, 22 bp, Homo sapiens
ctttcagatagtctgagatata

SEQ ID NO: 7336757 - DNA, 22 bp, Homo sapiens
ctttcacagcttgaaaagtatt

SEQ ID NO: 7336758 - DNA, 22 bp, Homo sapiens
ctttcacagcacaagcctgcct

SEQ ID NO: 7336759 - DNA, 22 bp, Homo sapiens
ctttcacagtcctgactgagcg

SEQ ID NO: 7336760 - DNA, 22 bp, Homo sapiens
ctttcaatgtgcctgccttggg

SEQ ID NO: 7336761 - DNA, 22 bp, Homo sapiens
ctttcaatgtcatctgtgaatg

SEQ ID NO: 7336762 - DNA, 22 bp, Homo sapiens
ctttcaatgtgcctgccttggg

SEQ ID NO: 7336763 - DNA, 22 bp, Homo sapiens
ctttcaatgtcatctgtgaatg

SEQ ID NO: 7336764 - DNA, 22 bp, Homo sapiens
ctttcacaagatttgagatgct

SEQ ID NO: 7336765 - DNA, 22 bp, Homo sapiens
ctttcacacacatacatttgga

SEQ ID NO: 7336766 - DNA, 22 bp, Homo sapiens
gagatgacatgcctgttgtagg

SEQ ID NO: 7336767 - DNA, 22 bp, Homo sapiens
gagaggctcagggacttgctga

SEQ ID NO: 7336768 - DNA, 22 bp, Homo sapiens
gagagggatactgagttttggt

SEQ ID NO: 7336769 - DNA, 22 bp, Homo sapiens
gagacacaaacacatttagagg

SEQ ID NO: 7336770 - DNA, 22 bp, Homo sapiens
gagacaatttctaagatgcttc

SEQ ID NO: 7336771 - DNA, 22 bp, Homo sapiens
gagacaaagcttcctgtgggta

SEQ ID NO: 7336772 - DNA, 22 bp, Homo sapiens
gagaggccatggggtgggatgc

SEQ ID NO: 7336773 - DNA, 22 bp, Homo sapiens
gagaggccatggctgtgcagtg

SEQ ID NO: 7336774 - DNA, 22 bp, Homo sapiens
gagaggcctgggcccgtgagct

SEQ ID NO: 7336775 - DNA, 22 bp, Homo sapiens
gagaggcctgggcccgtgagct

SEQ ID NO: 7336776 - DNA, 22 bp, Homo sapiens
gagaattagggcgtaattcaga

SEQ ID NO: 7336777 - DNA, 22 bp, Homo sapiens
gagacaaaagttggagtgcaag

SEQ ID NO: 7336778 - DNA, 22 bp, Homo sapiens
gagaaggactacggaaaacaga

SEQ ID NO: 7336779 - DNA, 22 bp, Homo sapiens
gagatggaaaactgctggtagt

SEQ ID NO: 7336780 - DNA, 22 bp, Homo sapiens
gagatggaatctgtgtggaggg

SEQ ID NO: 7336781 - DNA, 18 bp, Homo sapiens
gagcagcaggatcaagaa

SEQ ID NO: 7336782 - DNA, 22 bp, Homo sapiens
gagcagcaaagggagggtaaat

SEQ ID NO: 7336783 - DNA, 22 bp, Homo sapiens
gagccacagtggtggcccacgt

SEQ ID NO: 7336784 - DNA, 22 bp, Homo sapiens
gagccacagtggattgattcca

SEQ ID NO: 7336785 - DNA, 22 bp, Homo sapiens
gagccacagcaacctcaaagga

SEQ ID NO: 7336786 - DNA, 22 bp, Homo sapiens
gagccacagcaacctcaaagga

SEQ ID NO: 7336787 - DNA, 22 bp, Homo sapiens
gagccacagaaggaaattgggg

SEQ ID NO: 7336788 - DNA, 22 bp, Homo sapiens
gagccaagattgtgtccctgca

SEQ ID NO: 7336789 - DNA, 22 bp, Homo sapiens
gagccaggtcgggccgcggcga

SEQ ID NO: 7336790 - DNA, 22 bp, Homo sapiens
gagccagattttatgcaagaca

SEQ ID NO: 7336791 - DNA, 22 bp, Homo sapiens
gagccagccgcaagagctgtga

SEQ ID NO: 7336792 - DNA, 22 bp, Homo sapiens
gagccagcagccggcaccacca

SEQ ID NO: 7336793 - DNA, 22 bp, Homo sapiens
gaggcagaagttgcagtgagca

SEQ ID NO: 7336794 - DNA, 22 bp, Homo sapiens
gaggcactctcgacaagggtgg

SEQ ID NO: 7336795 - DNA, 22 bp, Homo sapiens
gaggcaatgggctatagcattg

SEQ ID NO: 7336796 - DNA, 22 bp, Homo sapiens
gaggcaatgggctatagcattg

SEQ ID NO: 7336797 - DNA, 22 bp, Homo sapiens
gaggcaccagacatggcctcat

SEQ ID NO: 7336798 - DNA, 22 bp, Homo sapiens
gaggcaccagccccgctagcct

SEQ ID NO: 7336799 - DNA, 22 bp, Homo sapiens
gaggccagctagtccaggaagt

SEQ ID NO: 7336800 - DNA, 22 bp, Homo sapiens
gaggccaggaagcccaagatca

SEQ ID NO: 7336801 - DNA, 22 bp, Homo sapiens
gaggaggctaagtgggctctgg

SEQ ID NO: 7336802 - DNA, 22 bp, Homo sapiens
gaggaggccagtggaaggaagc

SEQ ID NO: 7336803 - DNA, 22 bp, Homo sapiens
gaggaggcagcctatcccttag

SEQ ID NO: 7336804 - DNA, 22 bp, Homo sapiens
gaggaggaagttctctgtaggc

SEQ ID NO: 7336805 - DNA, 19 bp, Homo sapiens
gaggaggaaaactagtgta

SEQ ID NO: 7336806 - DNA, 19 bp, Homo sapiens
gaggaggaaaactagtgta

SEQ ID NO: 7336807 - DNA, 19 bp, Homo sapiens
gaggaggaaaactagtgta

SEQ ID NO: 7336808 - DNA, 19 bp, Homo sapiens
gaggagctatcggagacag

SEQ ID NO: 7336809 - DNA, 22 bp, Homo sapiens
gaggagcttcagaggaatctta

SEQ ID NO: 7336810 - DNA, 22 bp, Homo sapiens
gaggagcttgtgagaagatgtc

SEQ ID NO: 7336811 - DNA, 22 bp, Homo sapiens
gaggagcttgtgagaagatgtc

SEQ ID NO: 7336812 - DNA, 22 bp, Homo sapiens
gagctctgtgtagcctgagggt

SEQ ID NO: 7336813 - DNA, 22 bp, Homo sapiens
gagctctgttctcgtcctgctg

SEQ ID NO: 7336814 - DNA, 22 bp, Homo sapiens
gagcgggggctgccgggatttg

SEQ ID NO: 7336815 - DNA, 22 bp, Homo sapiens
gagcctggagctggaacgaagc

SEQ ID NO: 7336816 - DNA, 22 bp, Homo sapiens
gagcggaggcttggaggccagc

SEQ ID NO: 7336817 - DNA, 22 bp, Homo sapiens
gagcctggacatctcaggccca

SEQ ID NO: 7336818 - DNA, 22 bp, Homo sapiens
gagcctggagctggaacgaagc

SEQ ID NO: 7336819 - DNA, 22 bp, Homo sapiens
gagcctgagcaatgtgatgttt

SEQ ID NO: 7336820 - DNA, 22 bp, Homo sapiens
gagcctcctcctggtgtgccga

SEQ ID NO: 7336821 - DNA, 22 bp, Homo sapiens
gagccctgttcaggcctcctca

SEQ ID NO: 7336822 - DNA, 22 bp, Homo sapiens
gagccctttccactgccctctg

SEQ ID NO: 7336823 - DNA, 22 bp, Homo sapiens
gagccctttccactgccctctg

SEQ ID NO: 7336824 - DNA, 22 bp, Homo sapiens
gagctgaattgctgccatttgc

SEQ ID NO: 7336825 - DNA, 22 bp, Homo sapiens
gagctgagacacactttggcaa

SEQ ID NO: 7336826 - DNA, 22 bp, Homo sapiens
gagcttgcctagttttttaaac

SEQ ID NO: 7336827 - DNA, 23 bp, Homo sapiens
gagcttttgtagtagtcactgtg

SEQ ID NO: 7336828 - DNA, 21 bp, Homo sapiens
gagcttgcaagcattatggga

SEQ ID NO: 7336829 - DNA, 22 bp, Homo sapiens
ctggggtgtgctcagagcaggg

SEQ ID NO: 7336830 - DNA, 22 bp, Homo sapiens
ctggggctgcggacgggagccc

SEQ ID NO: 7336831 - DNA, 22 bp, Homo sapiens
ctggggctgcagcgatcttcat

SEQ ID NO: 7336832 - DNA, 22 bp, Homo sapiens
ctggggcccatcgagggctgag

SEQ ID NO: 7336833 - DNA, 22 bp, Homo sapiens
ctggggcccatcgagggctgag

SEQ ID NO: 7336834 - DNA, 22 bp, Homo sapiens
ctggggccagtgaggaggcttt

SEQ ID NO: 7336835 - DNA, 22 bp, Homo sapiens
ctggggccagtgaggaggcttt

SEQ ID NO: 7336836 - DNA, 22 bp, Homo sapiens
ctggggcccatcgagggctgag

SEQ ID NO: 7336837 - DNA, 22 bp, Homo sapiens
ctggggcccatcgagggctgag

SEQ ID NO: 7336838 - DNA, 22 bp, Homo sapiens
ctggggcattgggagaggcctg

SEQ ID NO: 7336839 - DNA, 22 bp, Homo sapiens
ctggggccacaacggcgcacgc

SEQ ID NO: 7336840 - DNA, 22 bp, Homo sapiens
ctggggccagtgaggaggcttt

SEQ ID NO: 7336841 - DNA, 22 bp, Homo sapiens
ctggggccacaacggcgcacgc

SEQ ID NO: 7336842 - DNA, 22 bp, Homo sapiens
ctggggcattgggagaggcctg

SEQ ID NO: 7336843 - DNA, 22 bp, Homo sapiens
ctggggccacaacggcgcacgc

SEQ ID NO: 7336844 - DNA, 22 bp, Homo sapiens
ctggggctcactccagccctgg

SEQ ID NO: 7336845 - DNA, 22 bp, Homo sapiens
ctggggccctgggtctgccctc

SEQ ID NO: 7336846 - DNA, 22 bp, Homo sapiens
ctggggcccgagccttgggcca

SEQ ID NO: 7336847 - DNA, 22 bp, Homo sapiens
ctggggctcactttggtcaggc

SEQ ID NO: 7336848 - DNA, 23 bp, Homo sapiens
ctggggctcattgcagtagccat

SEQ ID NO: 7336849 - DNA, 23 bp, Homo sapiens
ctggggctcattgcagtagccat

SEQ ID NO: 7336850 - DNA, 19 bp, Homo sapiens
ctgggccagagctgtcctc

SEQ ID NO: 7336851 - DNA, 22 bp, Homo sapiens
ctgggccagaccttgtggtctt

SEQ ID NO: 7336852 - DNA, 22 bp, Homo sapiens
ctgggccagatccagcctcaca

SEQ ID NO: 7336853 - DNA, 22 bp, Homo sapiens
ctgggccagatccagcctcaca

SEQ ID NO: 7336854 - DNA, 22 bp, Homo sapiens
ctgggaagaaattgtgggaggc

SEQ ID NO: 7336855 - DNA, 22 bp, Homo sapiens
ctgggaggcaccgcgtcgtgct

SEQ ID NO: 7336856 - DNA, 22 bp, Homo sapiens
ctgggaggattcattgaggtga

SEQ ID NO: 7336857 - DNA, 22 bp, Homo sapiens
ctggctgtgctgactgagaggg

SEQ ID NO: 7336858 - DNA, 22 bp, Homo sapiens
ctggctgtgctgcaggctttgg

SEQ ID NO: 7336859 - DNA, 22 bp, Homo sapiens
ctggctgtgctggagttgagga

SEQ ID NO: 7336860 - DNA, 22 bp, Homo sapiens
ctgggaggcccacgttgggaag

SEQ ID NO: 7336861 - DNA, 22 bp, Homo sapiens
ctgggaggcccacgttgggaag

SEQ ID NO: 7336862 - DNA, 22 bp, Homo sapiens
ctgggcagctgtgcaaacaata

SEQ ID NO: 7336863 - DNA, 22 bp, Homo sapiens
ctgggaggcagaggttgcagtg

SEQ ID NO: 7336864 - DNA, 22 bp, Homo sapiens
ctgggaggcactattcaggagg

SEQ ID NO: 7336865 - DNA, 22 bp, Homo sapiens
ctgggaggcagaggttgcagtg

SEQ ID NO: 7336866 - DNA, 22 bp, Homo sapiens
ctgggaggcagaggttgtagtg

SEQ ID NO: 7336867 - DNA, 22 bp, Homo sapiens
ctgggcagttttacatcattgc

SEQ ID NO: 7336868 - DNA, 22 bp, Homo sapiens
ctgggcagttttacatcattgc

SEQ ID NO: 7336869 - DNA, 22 bp, Homo sapiens
ctgggcagtttattcagttctg

SEQ ID NO: 7336870 - DNA, 22 bp, Homo sapiens
ctgggcagtttattcagttctg

SEQ ID NO: 7336871 - DNA, 22 bp, Homo sapiens
ctgggcaggagggctctatgga

SEQ ID NO: 7336872 - DNA, 22 bp, Homo sapiens
ctgggcaggagaggtggttgga

SEQ ID NO: 7336873 - DNA, 22 bp, Homo sapiens
ctgggccacaagcctgtgtgat

SEQ ID NO: 7336874 - DNA, 22 bp, Homo sapiens
ctgggccacagactcaaggcag

SEQ ID NO: 7336875 - DNA, 22 bp, Homo sapiens
ctgggccacatcagatgaagac

SEQ ID NO: 7336876 - DNA, 22 bp, Homo sapiens
ctgggccactccagatgcccac

SEQ ID NO: 7336877 - DNA, 22 bp, Homo sapiens
ctgggccacttcctcaggggaa

SEQ ID NO: 7336878 - DNA, 22 bp, Homo sapiens
ctgccagcaagctaccctggca

SEQ ID NO: 7336879 - DNA, 22 bp, Homo sapiens
ctgccagaaggttcctgctgca

SEQ ID NO: 7336880 - DNA, 22 bp, Homo sapiens
ctgcatccatgttgctgcaaag

SEQ ID NO: 7336881 - DNA, 22 bp, Homo sapiens
ctgccacaagctggccctgtgt

SEQ ID NO: 7336882 - DNA, 22 bp, Homo sapiens
ctgccaatctgaagagcttctt

SEQ ID NO: 7336883 - DNA, 22 bp, Homo sapiens
ctgccacaggggagcaggcaga

SEQ ID NO: 7336884 - DNA, 22 bp, Homo sapiens
ctgccacaggggagcaggcaga

SEQ ID NO: 7336885 - DNA, 22 bp, Homo sapiens
ctgccagcagaggccagcgctg

SEQ ID NO: 7336886 - DNA, 22 bp, Homo sapiens
ctgccagcactgcctcctgagg

SEQ ID NO: 7336887 - DNA, 22 bp, Homo sapiens
ctgccagccaggccaggtaggc

SEQ ID NO: 7336888 - DNA, 22 bp, Homo sapiens
ctgccagctcaaagcgcagcta

SEQ ID NO: 7336889 - DNA, 22 bp, Homo sapiens
ctgccagctcaaagcgcagcta

SEQ ID NO: 7336890 - DNA, 22 bp, Homo sapiens
ctgccagctcaccggctcagac

SEQ ID NO: 7336891 - DNA, 22 bp, Homo sapiens
ctgccagctcaccggctcagac

SEQ ID NO: 7336892 - DNA, 22 bp, Homo sapiens
ctgccagctcaccggctcagac

SEQ ID NO: 7336893 - DNA, 22 bp, Homo sapiens
ctgccagctctctggaggctct

SEQ ID NO: 7336894 - DNA, 22 bp, Homo sapiens
ctggccagcatggctgaagtac

SEQ ID NO: 7336895 - DNA, 22 bp, Homo sapiens
ctggccagagttggagggtgtg

SEQ ID NO: 7336896 - DNA, 22 bp, Homo sapiens
ctggccagctgacagcagggct

SEQ ID NO: 7336897 - DNA, 22 bp, Homo sapiens
ctggccagcctgtcgatgccct

SEQ ID NO: 7336898 - DNA, 22 bp, Homo sapiens
ctggccagcctcccaggtaccc

SEQ ID NO: 7336899 - DNA, 22 bp, Homo sapiens
ctggcaggcggcagagcccagg

SEQ ID NO: 7336900 - DNA, 22 bp, Homo sapiens
ctggcaggcggaggttgcagtg

SEQ ID NO: 7336901 - DNA, 22 bp, Homo sapiens
ctggcaggctctctggtcggtt

SEQ ID NO: 7336902 - DNA, 22 bp, Homo sapiens
ctggcaggcggcagagcccagg

SEQ ID NO: 7336903 - DNA, 22 bp, Homo sapiens
ctggcaggatctaaccagggaa

SEQ ID NO: 7336904 - DNA, 22 bp, Homo sapiens
ctggcaggatctaaccagggaa

SEQ ID NO: 7336905 - DNA, 22 bp, Homo sapiens
ctggccctcggagtccagctgc

SEQ ID NO: 7336906 - DNA, 22 bp, Homo sapiens
ctggcccagtctcagagtgtca

SEQ ID NO: 7336907 - DNA, 19 bp, Homo sapiens
ctggccaggccaggggccc

SEQ ID NO: 7336908 - DNA, 22 bp, Homo sapiens
ctggccctggctggagcccagg

SEQ ID NO: 7336909 - DNA, 22 bp, Homo sapiens
ctggctcagacagctgtgcagt

SEQ ID NO: 7336910 - DNA, 22 bp, Homo sapiens
ctggctcaggaaagttgctgct

SEQ ID NO: 7336911 - DNA, 22 bp, Homo sapiens
ctggctcagggtggtctgggtc

SEQ ID NO: 7336912 - DNA, 22 bp, Homo sapiens
ctggctcacctccgctccagca

SEQ ID NO: 7336913 - DNA, 22 bp, Homo sapiens
ctggctcacctccgctccagca

SEQ ID NO: 7336914 - DNA, 22 bp, Homo sapiens
ctggctcactagccctgccctg

SEQ ID NO: 7336915 - DNA, 22 bp, Homo sapiens
ctggcctgtcctgacccagcct

SEQ ID NO: 7336916 - DNA, 22 bp, Homo sapiens
ctggctcattttagcatcaggt

SEQ ID NO: 7336917 - DNA, 22 bp, Homo sapiens
ctggctcattttagcatcaggt

SEQ ID NO: 7336918 - DNA, 23 bp, Homo sapiens
ctggctcatcctggttgcagtgg

SEQ ID NO: 7336919 - DNA, 22 bp, Homo sapiens
ctggctcatgtgatgagggcaa

SEQ ID NO: 7336920 - DNA, 22 bp, Homo sapiens
ctggctcatagagcagctccaa

SEQ ID NO: 7336921 - DNA, 22 bp, Homo sapiens
ctggctcatagagcagctccaa

SEQ ID NO: 7336922 - DNA, 22 bp, Homo sapiens
ctggctcatccaggtgttgctc

SEQ ID NO: 7336923 - DNA, 22 bp, Homo sapiens
ctggctcagtgccttcagaagt

SEQ ID NO: 7336924 - DNA, 22 bp, Homo sapiens
ctggctcagtgccttcagaagt

SEQ ID NO: 7336925 - DNA, 22 bp, Homo sapiens
ctggctcagttcttggttttca

SEQ ID NO: 7336926 - DNA, 22 bp, Homo sapiens
ctggctcatagagcagctccaa

SEQ ID NO: 7336927 - DNA, 22 bp, Homo sapiens
ctggctgcaggaaggagtgggc

SEQ ID NO: 7336928 - DNA, 22 bp, Homo sapiens
ctggctgcaggatgaggctgcc

SEQ ID NO: 7336929 - DNA, 22 bp, Homo sapiens
ctggctccaaggaagaggtttt

SEQ ID NO: 7336930 - DNA, 22 bp, Homo sapiens
ctggctgtgaaatggcagtgtc

SEQ ID NO: 7336931 - DNA, 22 bp, Homo sapiens
ctggctgtgcagtcttccagaa

SEQ ID NO: 7336932 - DNA, 22 bp, Homo sapiens
ctggctgcagtagcaagagact

SEQ ID NO: 7336933 - DNA, 22 bp, Homo sapiens
ctggctgcctggagtgagggag

SEQ ID NO: 7336934 - DNA, 22 bp, Homo sapiens
cttcagctacctctgatgcaag

SEQ ID NO: 7336935 - DNA, 22 bp, Homo sapiens
cttcagctgcagttatgtttag

SEQ ID NO: 7336936 - DNA, 22 bp, Homo sapiens
cttcctctgaggcttctgagtc

SEQ ID NO: 7336937 - DNA, 22 bp, Homo sapiens
cttcctctcttgcccataagag

SEQ ID NO: 7336938 - DNA, 22 bp, Homo sapiens
cttccctttttatgtcttcagc

SEQ ID NO: 7336939 - DNA, 22 bp, Homo sapiens
cttcctgaacaatgccatcaat

SEQ ID NO: 7336940 - DNA, 22 bp, Homo sapiens
cttcctgaaggatggcagcctc

SEQ ID NO: 7336941 - DNA, 22 bp, Homo sapiens
cttcctctgtggccagagtgta

SEQ ID NO: 7336942 - DNA, 22 bp, Homo sapiens
cttcctctgtgtcctgggcttc

SEQ ID NO: 7336943 - DNA, 22 bp, Homo sapiens
cttcctctgtgtcctgggcttg

SEQ ID NO: 7336944 - DNA, 22 bp, Homo sapiens
cttcctctgtgtcctgggcttc

SEQ ID NO: 7336945 - DNA, 22 bp, Homo sapiens
cttcctctgtgtcctgggcttg

SEQ ID NO: 7336946 - DNA, 22 bp, Homo sapiens
cttcagaaccagccagaagagg

SEQ ID NO: 7336947 - DNA, 19 bp, Homo sapiens
cttatttctggttttgggt

SEQ ID NO: 7336948 - DNA, 22 bp, Homo sapiens
cttatttgtactaataaatctg

SEQ ID NO: 7336949 - DNA, 22 bp, Homo sapiens
ctgttgtctatataagtttttc

SEQ ID NO: 7336950 - DNA, 22 bp, Homo sapiens
cttgacagaaggttttatccta

SEQ ID NO: 7336951 - DNA, 22 bp, Homo sapiens
cttgacagtcccaggaaaatag

SEQ ID NO: 7336952 - DNA, 22 bp, Homo sapiens
cttgaccgaatatgatcacttc

SEQ ID NO: 7336953 - DNA, 22 bp, Homo sapiens
cttgaccgattctagtggacat

SEQ ID NO: 7336954 - DNA, 22 bp, Homo sapiens
cttcctgggccctgcttaagca

SEQ ID NO: 7336955 - DNA, 22 bp, Homo sapiens
cttgcaaagtagctgagaggtt

SEQ ID NO: 7336956 - DNA, 22 bp, Homo sapiens
cttgatctacatagtgaaaccc

SEQ ID NO: 7336957 - DNA, 22 bp, Homo sapiens
cttgcacatttcacacaatagg

SEQ ID NO: 7336958 - DNA, 20 bp, Homo sapiens
cttgcccagggtctcctgcc

SEQ ID NO: 7336959 - DNA, 20 bp, Homo sapiens
cttgcccagggtctcctgcc

SEQ ID NO: 7336960 - DNA, 22 bp, Homo sapiens
cttgcccgcgaagaagctagga

SEQ ID NO: 7336961 - DNA, 22 bp, Homo sapiens
cttgcctacttgtcaaccagca

SEQ ID NO: 7336962 - DNA, 22 bp, Homo sapiens
cttgtagaattgaaatggtctc

SEQ ID NO: 7336963 - DNA, 22 bp, Homo sapiens
cttgtacattgatttctgcatt

SEQ ID NO: 7336964 - DNA, 21 bp, Homo sapiens
cttgtcttgcttagaatagac

SEQ ID NO: 7336965 - DNA, 22 bp, Homo sapiens
ctgttctgaccagtgcagggat

SEQ ID NO: 7336966 - DNA, 22 bp, Homo sapiens
ctgttctttagttccactgcaa

SEQ ID NO: 7336967 - DNA, 18 bp, Homo sapiens
ctgttgagatgtggctga

SEQ ID NO: 7336968 - DNA, 22 bp, Homo sapiens
ctgttgcatcatggctcttaat

SEQ ID NO: 7336969 - DNA, 22 bp, Homo sapiens
ctgttgagtaatttatatcagg

SEQ ID NO: 7336970 - DNA, 22 bp, Homo sapiens
ctgttctgaactgcctgcatgc

SEQ ID NO: 7336971 - DNA, 22 bp, Homo sapiens
ctgttattttcctctgaactct

SEQ ID NO: 7336972 - DNA, 22 bp, Homo sapiens
ctgttcatgctgattctgtatg

SEQ ID NO: 7336973 - DNA, 22 bp, Homo sapiens
ctgttcatggaaaaatagttgg

SEQ ID NO: 7336974 - DNA, 22 bp, Homo sapiens
ctgtgtcttcctctgcccaggc

SEQ ID NO: 7336975 - DNA, 22 bp, Homo sapiens
ctgttacatagcttttcttaac

SEQ ID NO: 7336976 - DNA, 22 bp, Homo sapiens
ctgttaatggaggactacagga

SEQ ID NO: 7336977 - DNA, 23 bp, Homo sapiens
ctgttaaattccttaagagcagg

SEQ ID NO: 7336978 - DNA, 22 bp, Homo sapiens
ctgtgtctctccttacaagact

SEQ ID NO: 7336979 - DNA, 22 bp, Homo sapiens
ctgtgtctctccttacaagact

SEQ ID NO: 7336980 - DNA, 22 bp, Homo sapiens
ctgtgtctcgttaaagcattgg

SEQ ID NO: 7336981 - DNA, 22 bp, Homo sapiens
ctgtgtctcgttaaagcattgg

SEQ ID NO: 7336982 - DNA, 22 bp, Homo sapiens
ctgtggctggccttattgctgc

SEQ ID NO: 7336983 - DNA, 22 bp, Homo sapiens
ctgtggctggcctgtctgacat

SEQ ID NO: 7336984 - DNA, 22 bp, Homo sapiens
ctgtggctgcgtaggtctggca

SEQ ID NO: 7336985 - DNA, 22 bp, Homo sapiens
ctgtggctgtctctttcccatg

SEQ ID NO: 7336986 - DNA, 22 bp, Homo sapiens
ctgtgtctaatcttatacatca

SEQ ID NO: 7336987 - DNA, 22 bp, Homo sapiens
ctgtgtctaatcttatacatca

SEQ ID NO: 7336988 - DNA, 22 bp, Homo sapiens
ctgtgtctaatcttatacatca

SEQ ID NO: 7336989 - DNA, 22 bp, Homo sapiens
ctgtgtctaatcttatacatca

SEQ ID NO: 7336990 - DNA, 22 bp, Homo sapiens
ctgtggctctcagaggctgctg

SEQ ID NO: 7336991 - DNA, 22 bp, Homo sapiens
ctgtggctgagttccttatgtt

SEQ ID NO: 7336992 - DNA, 22 bp, Homo sapiens
ctgtggccagatggtgccagtt

SEQ ID NO: 7336993 - DNA, 22 bp, Homo sapiens
ctgtggccagtcccacacctcc

SEQ ID NO: 7336994 - DNA, 22 bp, Homo sapiens
ctgtgccctctttgctggcctt

SEQ ID NO: 7336995 - DNA, 22 bp, Homo sapiens
ctgtgcccggcccagggccctg

SEQ ID NO: 7336996 - DNA, 22 bp, Homo sapiens
ctgtgcccaggcccctggggat

SEQ ID NO: 7336997 - DNA, 22 bp, Homo sapiens
ctgtgcccaggctggagtgcag

SEQ ID NO: 7336998 - DNA, 22 bp, Homo sapiens
ctgtgcatggccatcagtgccc

SEQ ID NO: 7336999 - DNA, 22 bp, Homo sapiens
ctgtgcattgtcttgtctgtag

SEQ ID NO: 7337000 - DNA, 22 bp, Homo sapiens
ctgtgcattgttgagtgtttag

SEQ ID NO: 7337001 - DNA, 22 bp, Homo sapiens
ctgtgcagtggcagcgtgtggg

SEQ ID NO: 7337002 - DNA, 22 bp, Homo sapiens
ctgtgcagtggggctctgggtt

SEQ ID NO: 7337003 - DNA, 22 bp, Homo sapiens
ctgtgcagtaggtcagggctgg

SEQ ID NO: 7337004 - DNA, 22 bp, Homo sapiens
ctgtgcagtaggtcagggctgg

SEQ ID NO: 7337005 - DNA, 22 bp, Homo sapiens
ctgtgagtcttcagcaagtgtt

SEQ ID NO: 7337006 - DNA, 22 bp, Homo sapiens
ctgtgagggtcacagccatgcc

SEQ ID NO: 7337007 - DNA, 22 bp, Homo sapiens
ctgtgagggccagagtcagggc

SEQ ID NO: 7337008 - DNA, 22 bp, Homo sapiens
ctgtcctgcagttgggggcagg

SEQ ID NO: 7337009 - DNA, 22 bp, Homo sapiens
ctgtcctctgtcctcagcagga

SEQ ID NO: 7337010 - DNA, 22 bp, Homo sapiens
ctgggtgccacgggcaccctgg

SEQ ID NO: 7337011 - DNA, 22 bp, Homo sapiens
ctgtccctgagcaactcctgtt

SEQ ID NO: 7337012 - DNA, 22 bp, Homo sapiens
ctgggtgattcctgtccaggca

SEQ ID NO: 7337013 - DNA, 22 bp, Homo sapiens
ctgggtgagttgatgaaggaga

SEQ ID NO: 7337014 - DNA, 22 bp, Homo sapiens
ctgggtgagttgatgaaggaga

SEQ ID NO: 7337015 - DNA, 22 bp, Homo sapiens
ctgggtgacagagtgagatggt

SEQ ID NO: 7337016 - DNA, 22 bp, Homo sapiens
ctgggtgacagagtgagatggt

SEQ ID NO: 7337017 - DNA, 22 bp, Homo sapiens
ctattatttcctcatctataaa

SEQ ID NO: 7337018 - DNA, 22 bp, Homo sapiens
ctattattatcctaatttctgt

SEQ ID NO: 7337019 - DNA, 22 bp, Homo sapiens
ctcaaaatccataaaatcaggt

SEQ ID NO: 7337020 - DNA, 22 bp, Homo sapiens
ctatttttctgtaccctaattt

SEQ ID NO: 7337021 - DNA, 22 bp, Homo sapiens
ctcaagtttcatatttgtctag

SEQ ID NO: 7337022 - DNA, 22 bp, Homo sapiens
ctcaaaatggttaattttaata

SEQ ID NO: 7337023 - DNA, 22 bp, Homo sapiens
ctcaaggacttattcatgcctg

SEQ ID NO: 7337024 - DNA, 22 bp, Homo sapiens
ctcaaggaaagtctggagaaga

SEQ ID NO: 7337025 - DNA, 22 bp, Homo sapiens
ctcacagctgcttcaggatcca

SEQ ID NO: 7337026 - DNA, 22 bp, Homo sapiens
ctcacaggcatctcatcaggct

SEQ ID NO: 7337027 - DNA, 22 bp, Homo sapiens
ctcacaggcatctcatcaggct

SEQ ID NO: 7337028 - DNA, 22 bp, Homo sapiens
ctcacagatgttctcctttagg

SEQ ID NO: 7337029 - DNA, 22 bp, Homo sapiens
ctcacagatgtcctggcacttc

SEQ ID NO: 7337030 - DNA, 22 bp, Homo sapiens
ctcacagatgtcctggcacttc

SEQ ID NO: 7337031 - DNA, 22 bp, Homo sapiens
ctcacagatatttgcttcaggt

SEQ ID NO: 7337032 - DNA, 22 bp, Homo sapiens
ctcacagatatttgcttcaggt

SEQ ID NO: 7337033 - DNA, 22 bp, Homo sapiens
ctcacagatctgtgcctgaacc

SEQ ID NO: 7337034 - DNA, 22 bp, Homo sapiens
ctcacagatgatgtctatgtgg

SEQ ID NO: 7337035 - DNA, 22 bp, Homo sapiens
ctcacagagctcatactgggag

SEQ ID NO: 7337036 - DNA, 22 bp, Homo sapiens
ctcacagagcctctgtgtcttc

SEQ ID NO: 7337037 - DNA, 22 bp, Homo sapiens
ctcacactgtgccaaatccttt

SEQ ID NO: 7337038 - DNA, 22 bp, Homo sapiens
ctcacaccagcttacaagactt

SEQ ID NO: 7337039 - DNA, 22 bp, Homo sapiens
ctatgtttatctgtatttctgt

SEQ ID NO: 7337040 - DNA, 22 bp, Homo sapiens
ctatgtgtcttgaaacaagact

SEQ ID NO: 7337041 - DNA, 19 bp, Homo sapiens
ctatgtttatatatccagt

SEQ ID NO: 7337042 - DNA, 22 bp, Homo sapiens
ctattacaatctgctactatga

SEQ ID NO: 7337043 - DNA, 22 bp, Homo sapiens
ctattacagggaagccttggga

SEQ ID NO: 7337044 - DNA, 22 bp, Homo sapiens
ctatgctttagtaatattctca

SEQ ID NO: 7337045 - DNA, 16 bp, Homo sapiens
ctatggctagaaacat

SEQ ID NO: 7337046 - DNA, 22 bp, Homo sapiens
ctatggtctggaccgaggtcct

SEQ ID NO: 7337047 - DNA, 22 bp, Homo sapiens
ctatggctagatgtatcaggtg

SEQ ID NO: 7337048 - DNA, 22 bp, Homo sapiens
ctatggctcaattctagtggtt

SEQ ID NO: 7337049 - DNA, 22 bp, Homo sapiens
ctatggctccttctctactggg

SEQ ID NO: 7337050 - DNA, 22 bp, Homo sapiens
ctatggctctggttatggctgt

SEQ ID NO: 7337051 - DNA, 22 bp, Homo sapiens
ctatggctctgtcttttaagtt

SEQ ID NO: 7337052 - DNA, 22 bp, Homo sapiens
ctatggctgatttcatttgttt

SEQ ID NO: 7337053 - DNA, 22 bp, Homo sapiens
ctatggctgcacttatctgagg

SEQ ID NO: 7337054 - DNA, 22 bp, Homo sapiens
ctatggctgccactcaagccaa

SEQ ID NO: 7337055 - DNA, 22 bp, Homo sapiens
ctatggctgtgttcatgctaca

SEQ ID NO: 7337056 - DNA, 22 bp, Homo sapiens
ctatggcttaagattgacatga

SEQ ID NO: 7337057 - DNA, 22 bp, Homo sapiens
ctatggcttgcaatattcttgg

SEQ ID NO: 7337058 - DNA, 22 bp, Homo sapiens
ctatatacttttcacagatgtt

SEQ ID NO: 7337059 - DNA, 22 bp, Homo sapiens
ctatatatatcatcttccagtt

SEQ ID NO: 7337060 - DNA, 22 bp, Homo sapiens
ctagcaggtcaaaccagctgat

SEQ ID NO: 7337061 - DNA, 22 bp, Homo sapiens
ctagatttctagttcattatcc

SEQ ID NO: 7337062 - DNA, 22 bp, Homo sapiens
ctacagagtatctaaagaggta

SEQ ID NO: 7337063 - DNA, 22 bp, Homo sapiens
ctacaggctcagggagccctct

SEQ ID NO: 7337064 - DNA, 21 bp, Homo sapiens
ctactgtgagacacaaagtgc

SEQ ID NO: 7337065 - DNA, 22 bp, Homo sapiens
ctacttctaagtacatggtgat

SEQ ID NO: 7337066 - DNA, 22 bp, Homo sapiens
ctacttcttgatctgtcgacct

SEQ ID NO: 7337067 - DNA, 22 bp, Homo sapiens
ctacttctgtggctctaagaga

SEQ ID NO: 7337068 - DNA, 17 bp, Homo sapiens
ctacttcttctattctt

SEQ ID NO: 7337069 - DNA, 22 bp, Homo sapiens
ctacttctgtggctctaagaga

SEQ ID NO: 7337070 - DNA, 19 bp, Homo sapiens
ctactttataatatgcctc

SEQ ID NO: 7337071 - DNA, 22 bp, Homo sapiens
ttctctggagagtatcttctta

SEQ ID NO: 7337072 - DNA, 22 bp, Homo sapiens
ttctctaagagatgcagaagtt

SEQ ID NO: 7337073 - DNA, 22 bp, Homo sapiens
ctaaatactagccttcagattt

SEQ ID NO: 7337074 - DNA, 22 bp, Homo sapiens
ttcatgaaagtgtatcttgtgg

SEQ ID NO: 7337075 - DNA, 22 bp, Homo sapiens
ttcatgaacgaacatatgtata

SEQ ID NO: 7337076 - DNA, 22 bp, Homo sapiens
ttcatgaatgttccatgtgagt

SEQ ID NO: 7337077 - DNA, 22 bp, Homo sapiens
ttcatgaatggaatcaatgctc

SEQ ID NO: 7337078 - DNA, 22 bp, Homo sapiens
cgtcagggttgagcaggtagat

SEQ ID NO: 7337079 - DNA, 22 bp, Homo sapiens
ttcatctagtgtgctcgtaacg

SEQ ID NO: 7337080 - DNA, 22 bp, Homo sapiens
cgtcactggcgtgaagtgagga

SEQ ID NO: 7337081 - DNA, 22 bp, Homo sapiens
cgtatgaaatttttgacatttg

SEQ ID NO: 7337082 - DNA, 22 bp, Homo sapiens
cggtggagtgctcagctgaacc

SEQ ID NO: 7337083 - DNA, 22 bp, Homo sapiens
cggtgcccggtgccaggcgcgg

SEQ ID NO: 7337084 - DNA, 22 bp, Homo sapiens
cggtctcccgtgtgtgtgcgct

SEQ ID NO: 7337085 - DNA, 22 bp, Homo sapiens
cggtggtcataagtggctggcg

SEQ ID NO: 7337086 - DNA, 22 bp, Homo sapiens
cggtggccaacaagaggccggg

SEQ ID NO: 7337087 - DNA, 22 bp, Homo sapiens
ttcacagaattgtcttgactgg

SEQ ID NO: 7337088 - DNA, 22 bp, Homo sapiens
ttcagaggtttccgggccatgc

SEQ ID NO: 7337089 - DNA, 22 bp, Homo sapiens
ttcagggcagagagttcaggga

SEQ ID NO: 7337090 - DNA, 22 bp, Homo sapiens
ttcagggagagcgggacgggtg

SEQ ID NO: 7337091 - DNA, 22 bp, Homo sapiens
cggggctggcacaggtgaccac

SEQ ID NO: 7337092 - DNA, 22 bp, Homo sapiens
cggggctgtagcacagctgagc

SEQ ID NO: 7337093 - DNA, 22 bp, Homo sapiens
cggggctgtagcacagctgagc

SEQ ID NO: 7337094 - DNA, 22 bp, Homo sapiens
ttcagggacttagtgtcagttt

SEQ ID NO: 7337095 - DNA, 22 bp, Homo sapiens
ttcaggattatactctcttccc

SEQ ID NO: 7337096 - DNA, 20 bp, Homo sapiens
ttcaggattctagaccacac

SEQ ID NO: 7337097 - DNA, 22 bp, Homo sapiens
ttcagcaaacacgatgcttgtt

SEQ ID NO: 7337098 - DNA, 22 bp, Homo sapiens
ttcaggagtgtcaggagtgcct

SEQ ID NO: 7337099 - DNA, 22 bp, Homo sapiens
ttcagcaaaatatctcagatag

SEQ ID NO: 7337100 - DNA, 18 bp, Homo sapiens
cgccctgctataaatgac

SEQ ID NO: 7337101 - DNA, 22 bp, Homo sapiens
ttcaaatttggtatgcaagcca

SEQ ID NO: 7337102 - DNA, 22 bp, Homo sapiens
cgcccagggcaggaggccgctc

SEQ ID NO: 7337103 - DNA, 22 bp, Homo sapiens
ttcacacagcaactgtatgaat

SEQ ID NO: 7337104 - DNA, 19 bp, Homo sapiens
ttcacaattatgaaattag

SEQ ID NO: 7337105 - DNA, 19 bp, Homo sapiens
ttcacaattatgaaattag

SEQ ID NO: 7337106 - DNA, 20 bp, Homo sapiens
ttcaagttgggtctctggct

SEQ ID NO: 7337107 - DNA, 22 bp, Homo sapiens
ttcaagttctgtggagagctgt

SEQ ID NO: 7337108 - DNA, 22 bp, Homo sapiens
ttcaagttctagtgttcacttc

SEQ ID NO: 7337109 - DNA, 22 bp, Homo sapiens
ttcaagttaatgattctggttt

SEQ ID NO: 7337110 - DNA, 22 bp, Homo sapiens
ttcaagttagagatatatttag

SEQ ID NO: 7337111 - DNA, 22 bp, Homo sapiens
ttcaagttttatattgaagcaa

SEQ ID NO: 7337112 - DNA, 22 bp, Homo sapiens
ttcaagtttactttgaagttta

SEQ ID NO: 7337113 - DNA, 22 bp, Homo sapiens
ttcaagtttgtatttctgtatt

SEQ ID NO: 7337114 - DNA, 23 bp, Homo sapiens
cgcccagcctcagtgacctgggc

SEQ ID NO: 7337115 - DNA, 23 bp, Homo sapiens
cgcccagcctcagtgacctgggc

SEQ ID NO: 7337116 - DNA, 22 bp, Homo sapiens
ttaggacatggacagctttggt

SEQ ID NO: 7337117 - DNA, 22 bp, Homo sapiens
ttaggaagtttcagaaaatgca

SEQ ID NO: 7337118 - DNA, 22 bp, Homo sapiens
cctttctacagatgcctcttgc

SEQ ID NO: 7337119 - DNA, 22 bp, Homo sapiens
cctttctaagatactgcaactt

SEQ ID NO: 7337120 - DNA, 22 bp, Homo sapiens
tggggcagcagacctttcttgg

SEQ ID NO: 7337121 - DNA, 22 bp, Homo sapiens
tggggcagcagacctttcttgg

SEQ ID NO: 7337122 - DNA, 22 bp, Homo sapiens
tggggcagccacatagacaaca

SEQ ID NO: 7337123 - DNA, 22 bp, Homo sapiens
tggggcagccacatagacaaca

SEQ ID NO: 7337124 - DNA, 22 bp, Homo sapiens
tggggcagctccatctattcca

SEQ ID NO: 7337125 - DNA, 22 bp, Homo sapiens
tggggcagctccatctattcca

SEQ ID NO: 7337126 - DNA, 22 bp, Homo sapiens
tggggcagctccatctattcca

SEQ ID NO: 7337127 - DNA, 22 bp, Homo sapiens
tggggcagggatgggaaactat

SEQ ID NO: 7337128 - DNA, 22 bp, Homo sapiens
tggggcagggatgggaaactat

SEQ ID NO: 7337129 - DNA, 22 bp, Homo sapiens
tggggcagctccatctattcca

SEQ ID NO: 7337130 - DNA, 22 bp, Homo sapiens
tggggcagtggcttttcaccct

SEQ ID NO: 7337131 - DNA, 22 bp, Homo sapiens
tggggcagtggcttttcaccct

SEQ ID NO: 7337132 - DNA, 22 bp, Homo sapiens
tggggctgtggattctcacgaa

SEQ ID NO: 7337133 - DNA, 22 bp, Homo sapiens
tggggctgtgagactacaggat

SEQ ID NO: 7337134 - DNA, 22 bp, Homo sapiens
tggggctgtgagactacaggat

SEQ ID NO: 7337135 - DNA, 22 bp, Homo sapiens
tggggccacacatctctttcta

SEQ ID NO: 7337136 - DNA, 23 bp, Homo sapiens
tggggccaagtgaggaagggtct

SEQ ID NO: 7337137 - DNA, 22 bp, Homo sapiens
tggggcagttaataaacattct

SEQ ID NO: 7337138 - DNA, 22 bp, Homo sapiens
tggggccaagaaggtctcatgt

SEQ ID NO: 7337139 - DNA, 22 bp, Homo sapiens
tgggggaaattcagccagatat

SEQ ID NO: 7337140 - DNA, 22 bp, Homo sapiens
cctgggaggtggaggttgcagt

SEQ ID NO: 7337141 - DNA, 19 bp, Homo sapiens
cctgggagtcagctgaagg

SEQ ID NO: 7337142 - DNA, 22 bp, Homo sapiens
cctgggaggtggatgttgcggt

SEQ ID NO: 7337143 - DNA, 22 bp, Homo sapiens
tgtgtatgtaagcatgtgcata

SEQ ID NO: 7337144 - DNA, 23 bp, Homo sapiens
tgtgtatgtatctatgcataggt

SEQ ID NO: 7337145 - DNA, 23 bp, Homo sapiens
tgtgtatgtatctatgcataggt

SEQ ID NO: 7337146 - DNA, 21 bp, Homo sapiens
tgtgtatgtccaatgccctac

SEQ ID NO: 7337147 - DNA, 22 bp, Homo sapiens
tgtgtatgcatacacacataga

SEQ ID NO: 7337148 - DNA, 22 bp, Homo sapiens
tgtgtatatgtaaatatagttg

SEQ ID NO: 7337149 - DNA, 22 bp, Homo sapiens
tgtgtatgtgtatacactatat

SEQ ID NO: 7337150 - DNA, 22 bp, Homo sapiens
tgtgtatgtgtatacactatat

SEQ ID NO: 7337151 - DNA, 20 bp, Homo sapiens
tgtgtatgtgcacatgcgaa

SEQ ID NO: 7337152 - DNA, 22 bp, Homo sapiens
tgtgtatgttttgaggttgcta

SEQ ID NO: 7337153 - DNA, 22 bp, Homo sapiens
tgtgtatgtctgtatgcacaca

SEQ ID NO: 7337154 - DNA, 22 bp, Homo sapiens
tgtgtattaatgtttgtatatg

SEQ ID NO: 7337155 - DNA, 23 bp, Homo sapiens
tgtgtctgaggatatatgtgcat

SEQ ID NO: 7337156 - DNA, 22 bp, Homo sapiens
tgtgtctcttggggtttaaagc

SEQ ID NO: 7337157 - DNA, 22 bp, Homo sapiens
tgtgtctgaacatgctttgtaa

SEQ ID NO: 7337158 - DNA, 22 bp, Homo sapiens
tgtgtctctcctggaagcacgt

SEQ ID NO: 7337159 - DNA, 22 bp, Homo sapiens
tgtgtatagatgcatgcatata

SEQ ID NO: 7337160 - DNA, 22 bp, Homo sapiens
tgtgtatagaaagtaggaaagg

SEQ ID NO: 7337161 - DNA, 22 bp, Homo sapiens
tgtgtatagatgcatgcatata

SEQ ID NO: 7337162 - DNA, 22 bp, Homo sapiens
tgtgtataggttgtgctaatag

SEQ ID NO: 7337163 - DNA, 22 bp, Homo sapiens
tgtgtatagcagtttccagtct

SEQ ID NO: 7337164 - DNA, 22 bp, Homo sapiens
tgtgtatatatgtttaagtcat

SEQ ID NO: 7337165 - DNA, 22 bp, Homo sapiens
tgtgtatatatgtgcacatgta

SEQ ID NO: 7337166 - DNA, 22 bp, Homo sapiens
tgtgtatacatacatacacacg

SEQ ID NO: 7337167 - DNA, 20 bp, Homo sapiens
tgtgtataaatatatgtttc

SEQ ID NO: 7337168 - DNA, 22 bp, Homo sapiens
tgtgtataaacaagagtctgtg

SEQ ID NO: 7337169 - DNA, 20 bp, Homo sapiens
tgtgtataaatatatgtttc

SEQ ID NO: 7337170 - DNA, 22 bp, Homo sapiens
tgttccatcagtttttggttga

SEQ ID NO: 7337171 - DNA, 22 bp, Homo sapiens
cctggtgtggctgtcacagagg

SEQ ID NO: 7337172 - DNA, 22 bp, Homo sapiens
cctggtgtggccctgtgacatg

SEQ ID NO: 7337173 - DNA, 18 bp, Homo sapiens
tgttccaaggaaggaatc

SEQ ID NO: 7337174 - DNA, 22 bp, Homo sapiens
tgttccataagtggtgctttgt

SEQ ID NO: 7337175 - DNA, 22 bp, Homo sapiens
tgttcattctgtatatgctgta

SEQ ID NO: 7337176 - DNA, 22 bp, Homo sapiens
tgttacaatattatcaactgag

SEQ ID NO: 7337177 - DNA, 22 bp, Homo sapiens
tgttacaggaaatagaattacc

SEQ ID NO: 7337178 - DNA, 22 bp, Homo sapiens
cctgggctgtacctgtgcgcgg

SEQ ID NO: 7337179 - DNA, 22 bp, Homo sapiens
tgttacaaactgttgtttctat

SEQ ID NO: 7337180 - DNA, 22 bp, Homo sapiens
tgttaaggttatttgttatgtc

SEQ ID NO: 7337181 - DNA, 18 bp, Homo sapiens
tgttaaggatccagtagt

SEQ ID NO: 7337182 - DNA, 22 bp, Homo sapiens
tgttaaggcagattgcctggcc

SEQ ID NO: 7337183 - DNA, 22 bp, Homo sapiens
tgttaaggcagcaacggatgaa

SEQ ID NO: 7337184 - DNA, 22 bp, Homo sapiens
tgttaaggctcttgtttatgtc

SEQ ID NO: 7337185 - DNA, 22 bp, Homo sapiens
tgttaaggtcctgacttctgca

SEQ ID NO: 7337186 - DNA, 22 bp, Homo sapiens
tgttaaggggatatagcagggc

SEQ ID NO: 7337187 - DNA, 22 bp, Homo sapiens
tgttaagggtaaacagcagtaa

SEQ ID NO: 7337188 - DNA, 22 bp, Homo sapiens
cctgtgtccttggcagatatcc

SEQ ID NO: 7337189 - DNA, 22 bp, Homo sapiens
ccttccctaaagcgtcgcttag

SEQ ID NO: 7337190 - DNA, 17 bp, Homo sapiens
ccttcctcatctccttc

SEQ ID NO: 7337191 - DNA, 19 bp, Homo sapiens
ccttcctccccagggccat

SEQ ID NO: 7337192 - DNA, 19 bp, Homo sapiens
ccttcctccccagggccat

SEQ ID NO: 7337193 - DNA, 22 bp, Homo sapiens
ccttcctggagcccatgcagat

SEQ ID NO: 7337194 - DNA, 19 bp, Homo sapiens
ccttccccttcagcctctg

SEQ ID NO: 7337195 - DNA, 22 bp, Homo sapiens
ccttcattattcctgaactgtt

SEQ ID NO: 7337196 - DNA, 22 bp, Homo sapiens
ttagaatttctgctcactttga

SEQ ID NO: 7337197 - DNA, 22 bp, Homo sapiens
ttagaatttctgctcactttga

SEQ ID NO: 7337198 - DNA, 22 bp, Homo sapiens
ttagaatctttagagtctcact

SEQ ID NO: 7337199 - DNA, 22 bp, Homo sapiens
ttagaattattgtttccttcta

SEQ ID NO: 7337200 - DNA, 22 bp, Homo sapiens
ttagaaaatggaggtgggaggg

SEQ ID NO: 7337201 - DNA, 22 bp, Homo sapiens
ttagaaaatggaggtgggaggg

SEQ ID NO: 7337202 - DNA, 22 bp, Homo sapiens
ttagaaaatttgcttctttgga

SEQ ID NO: 7337203 - DNA, 22 bp, Homo sapiens
ttagaaaatttgcttctttgga

SEQ ID NO: 7337204 - DNA, 22 bp, Homo sapiens
ttagaaaacataagtggtaaag

SEQ ID NO: 7337205 - DNA, 22 bp, Homo sapiens
ttagaaaacataagtggtaaag

SEQ ID NO: 7337206 - DNA, 22 bp, Homo sapiens
ttagaaaaaggctgtggtctta

SEQ ID NO: 7337207 - DNA, 22 bp, Homo sapiens
ttagaaaaaacgtcttctagtg

SEQ ID NO: 7337208 - DNA, 22 bp, Homo sapiens
ttagaaaaaacgtcttctagtg

SEQ ID NO: 7337209 - DNA, 22 bp, Homo sapiens
ttagaaaaaggctgtggtctta

SEQ ID NO: 7337210 - DNA, 22 bp, Homo sapiens
ttacttttgcaccaaactaata

SEQ ID NO: 7337211 - DNA, 21 bp, Homo sapiens
ccttctccacagggtctccgg

SEQ ID NO: 7337212 - DNA, 22 bp, Homo sapiens
ccttctcagccccagctcccgc

SEQ ID NO: 7337213 - DNA, 22 bp, Homo sapiens
ccttcctttcagggctatgcct

SEQ ID NO: 7337214 - DNA, 22 bp, Homo sapiens
cctgtgccttccttaggcacct

SEQ ID NO: 7337215 - DNA, 22 bp, Homo sapiens
cctgtgccttaaccctttaggc

SEQ ID NO: 7337216 - DNA, 22 bp, Homo sapiens
cctgtgccctgccaggctggtg

SEQ ID NO: 7337217 - DNA, 22 bp, Homo sapiens
cctgtgccctgccaggctggtg

SEQ ID NO: 7337218 - DNA, 22 bp, Homo sapiens
cctgtgccctggaaggagagag

SEQ ID NO: 7337219 - DNA, 22 bp, Homo sapiens
cctgtgccctcagcctggctct

SEQ ID NO: 7337220 - DNA, 22 bp, Homo sapiens
cctgtgctcccatagcttctgt

SEQ ID NO: 7337221 - DNA, 21 bp, Homo sapiens
cctgtgctccacacagggtcc

SEQ ID NO: 7337222 - DNA, 21 bp, Homo sapiens
cctgtgctccacacagggtcc

SEQ ID NO: 7337223 - DNA, 19 bp, Homo sapiens
cctgtgctaggagctgacc

SEQ ID NO: 7337224 - DNA, 22 bp, Homo sapiens
ttaaaggaattgagtttcttgt

SEQ ID NO: 7337225 - DNA, 22 bp, Homo sapiens
ttaaaggaattgagtttcttgt

SEQ ID NO: 7337226 - DNA, 22 bp, Homo sapiens
ttaaaggatctttgtcattaat

SEQ ID NO: 7337227 - DNA, 17 bp, Homo sapiens
ttaaaggatgctctctc

SEQ ID NO: 7337228 - DNA, 22 bp, Homo sapiens
ttaaagtaatctgtgtgaattt

SEQ ID NO: 7337229 - DNA, 22 bp, Homo sapiens
ttaaagtatagaggacaaaaac

SEQ ID NO: 7337230 - DNA, 22 bp, Homo sapiens
cctgtgccatcctgagcatccc

SEQ ID NO: 7337231 - DNA, 22 bp, Homo sapiens
cctgtctctgcagggccctgcc

SEQ ID NO: 7337232 - DNA, 22 bp, Homo sapiens
tttcaatgtaacatttccaggc

SEQ ID NO: 7337233 - DNA, 22 bp, Homo sapiens
tttcaatgtatgtctttctgag

SEQ ID NO: 7337234 - DNA, 21 bp, Homo sapiens
tttcaatgtgttctttgtagt

SEQ ID NO: 7337235 - DNA, 21 bp, Homo sapiens
tttcaatttgccttgagtcat

SEQ ID NO: 7337236 - DNA, 21 bp, Homo sapiens
tttcacaaaagtatgtgacaa

SEQ ID NO: 7337237 - DNA, 22 bp, Homo sapiens
tttcaatttccaggctagaatt

SEQ ID NO: 7337238 - DNA, 22 bp, Homo sapiens
tttcaattgactttggaagaaa

SEQ ID NO: 7337239 - DNA, 22 bp, Homo sapiens
tttcaattgactttggaagaaa

SEQ ID NO: 7337240 - DNA, 22 bp, Homo sapiens
tttcacaaatgtctttaacttg

SEQ ID NO: 7337241 - DNA, 22 bp, Homo sapiens
tttcacaaagcatagcacttta

SEQ ID NO: 7337242 - DNA, 22 bp, Homo sapiens
tttcacaaagcatagcacttta

SEQ ID NO: 7337243 - DNA, 22 bp, Homo sapiens
tttcacaaactgaggagacaat

SEQ ID NO: 7337244 - DNA, 22 bp, Homo sapiens
tttcacaaactcagggtgtgtg

SEQ ID NO: 7337245 - DNA, 22 bp, Homo sapiens
tttcacaaactgaggagacaat

SEQ ID NO: 7337246 - DNA, 21 bp, Homo sapiens
tttcacaaaagtatgtgacaa

SEQ ID NO: 7337247 - DNA, 22 bp, Homo sapiens
tttcacagtcaatttggagtca

SEQ ID NO: 7337248 - DNA, 22 bp, Homo sapiens
tttcacagttagcatgaggact

SEQ ID NO: 7337249 - DNA, 22 bp, Homo sapiens
tttcacataaatggagtaaaga

SEQ ID NO: 7337250 - DNA, 22 bp, Homo sapiens
tttcacataaatattatgccta

SEQ ID NO: 7337251 - DNA, 22 bp, Homo sapiens
tttcacatagaaagtgatttac

SEQ ID NO: 7337252 - DNA, 22 bp, Homo sapiens
tttcacatacagtgtatagtag

SEQ ID NO: 7337253 - DNA, 22 bp, Homo sapiens
tttcacatagaaagtgatttac

SEQ ID NO: 7337254 - DNA, 22 bp, Homo sapiens
tttcctaaggtagtgataattt

SEQ ID NO: 7337255 - DNA, 22 bp, Homo sapiens
tttcctaggctctagagttcta

SEQ ID NO: 7337256 - DNA, 22 bp, Homo sapiens
ctctctgaggaaggagcatctg

SEQ ID NO: 7337257 - DNA, 22 bp, Homo sapiens
ctctctgaaactggagagtctc

SEQ ID NO: 7337258 - DNA, 20 bp, Homo sapiens
ctctctctccattcccaggg

SEQ ID NO: 7337259 - DNA, 20 bp, Homo sapiens
ctctctctccattcccaggg

SEQ ID NO: 7337260 - DNA, 21 bp, Homo sapiens
ctctccaggtaggataaatgt

SEQ ID NO: 7337261 - DNA, 22 bp, Homo sapiens
ctctcctggtgtggaggacagg

SEQ ID NO: 7337262 - DNA, 22 bp, Homo sapiens
ctctcctggggagcacacacac

SEQ ID NO: 7337263 - DNA, 22 bp, Homo sapiens
tttcctcacttcatgagagttt

SEQ ID NO: 7337264 - DNA, 22 bp, Homo sapiens
tttcctatgatattctatgtgt

SEQ ID NO: 7337265 - DNA, 22 bp, Homo sapiens
tttcctcaactgtcaaatgggg

SEQ ID NO: 7337266 - DNA, 22 bp, Homo sapiens
tttagtagtgacagattctggg

SEQ ID NO: 7337267 - DNA, 22 bp, Homo sapiens
tttaggtgtgtttggattgaga

SEQ ID NO: 7337268 - DNA, 22 bp, Homo sapiens
tttaggcattgggtgctcaagt

SEQ ID NO: 7337269 - DNA, 22 bp, Homo sapiens
tttagggaatagaagatctgaa

SEQ ID NO: 7337270 - DNA, 18 bp, Homo sapiens
ctcctccacagcccctgc

SEQ ID NO: 7337271 - DNA, 22 bp, Homo sapiens
ctcctccacagacctactgaat

SEQ ID NO: 7337272 - DNA, 22 bp, Homo sapiens
ctcccgtgccactggctcctgc

SEQ ID NO: 7337273 - DNA, 22 bp, Homo sapiens
ctccccttccgccagctcttga

SEQ ID NO: 7337274 - DNA, 22 bp, Homo sapiens
ctcccctccttaggtcttctag

SEQ ID NO: 7337275 - DNA, 22 bp, Homo sapiens
ctccccttcttgccagatcctt

SEQ ID NO: 7337276 - DNA, 22 bp, Homo sapiens
ctccccttccgccagctcttga

SEQ ID NO: 7337277 - DNA, 22 bp, Homo sapiens
tttaatcataagaaggaaaata

SEQ ID NO: 7337278 - DNA, 22 bp, Homo sapiens
tttaatcaggcaaagcataata

SEQ ID NO: 7337279 - DNA, 22 bp, Homo sapiens
tttaatctattccctaaacacc

SEQ ID NO: 7337280 - DNA, 22 bp, Homo sapiens
tttatttaaagtcgtgtgttaa

SEQ ID NO: 7337281 - DNA, 22 bp, Homo sapiens
tttattgttgggtcttaagctg

SEQ ID NO: 7337282 - DNA, 22 bp, Homo sapiens
tttattgtgttgaaactgaatt

SEQ ID NO: 7337283 - DNA, 22 bp, Homo sapiens
ctcctccagtgggtccctcagg

SEQ ID NO: 7337284 - DNA, 22 bp, Homo sapiens
ctcctccagcttccagtggctc

SEQ ID NO: 7337285 - DNA, 18 bp, Homo sapiens
ctcctccacagcccctgc

SEQ ID NO: 7337286 - DNA, 22 bp, Homo sapiens
ctcctccacccgctggggccca

SEQ ID NO: 7337287 - DNA, 22 bp, Homo sapiens
ctcctccagacttactgaatcc

SEQ ID NO: 7337288 - DNA, 22 bp, Homo sapiens
ttgtacaacgttttaaatttga

SEQ ID NO: 7337289 - DNA, 22 bp, Homo sapiens
ttgtacaacacatattctacag

SEQ ID NO: 7337290 - DNA, 22 bp, Homo sapiens
ttgtaattaatggcagcaatta

SEQ ID NO: 7337291 - DNA, 22 bp, Homo sapiens
ctccacagcccctccagtggca

SEQ ID NO: 7337292 - DNA, 22 bp, Homo sapiens
ctccaaggttttccctgtcctt

SEQ ID NO: 7337293 - DNA, 22 bp, Homo sapiens
ctccaagtccgagggctctcaa

SEQ ID NO: 7337294 - DNA, 22 bp, Homo sapiens
ctccaagtcggctgcagctgga

SEQ ID NO: 7337295 - DNA, 19 bp, Homo sapiens
ctccaagtgccaaggacag

SEQ ID NO: 7337296 - DNA, 22 bp, Homo sapiens
ctccacaggtgtactgtacctt

SEQ ID NO: 7337297 - DNA, 20 bp, Homo sapiens
ctccaaattcctgaggataa

SEQ ID NO: 7337298 - DNA, 22 bp, Homo sapiens
ctccaacgaggctggggtacaa

SEQ ID NO: 7337299 - DNA, 22 bp, Homo sapiens
ctccaaggaagccccaagggat

SEQ ID NO: 7337300 - DNA, 22 bp, Homo sapiens
ctccaaggagaaatgggcaaca

SEQ ID NO: 7337301 - DNA, 22 bp, Homo sapiens
ctccaaggattctggacccttg

SEQ ID NO: 7337302 - DNA, 23 bp, Homo sapiens
ctccaaggcccaactgtctaggc

SEQ ID NO: 7337303 - DNA, 22 bp, Homo sapiens
ctccaaggctaggagcatgttc

SEQ ID NO: 7337304 - DNA, 22 bp, Homo sapiens
ctccaagggtcttccaccagga

SEQ ID NO: 7337305 - DNA, 22 bp, Homo sapiens
ctccaagggttgtgggtggtca

SEQ ID NO: 7337306 - DNA, 18 bp, Homo sapiens
ctccaaggtctctggctt

SEQ ID NO: 7337307 - DNA, 22 bp, Homo sapiens
ctccaaggtggttatttgagat

SEQ ID NO: 7337308 - DNA, 22 bp, Homo sapiens
ctccaaggtttcagaacaaatg

SEQ ID NO: 7337309 - DNA, 20 bp, Homo sapiens
ctccaaggcttgcaggaggc

SEQ ID NO: 7337310 - DNA, 20 bp, Homo sapiens
ctccaaggcttgcaggaggc

SEQ ID NO: 7337311 - DNA, 22 bp, Homo sapiens
ctccaaggctctggtgctgagg

SEQ ID NO: 7337312 - DNA, 23 bp, Homo sapiens
ctccaagggagggcaaacaacag

SEQ ID NO: 7337313 - DNA, 22 bp, Homo sapiens
ctccaagggctcccagacgtct

SEQ ID NO: 7337314 - DNA, 22 bp, Homo sapiens
ttgaaagggttaaagtggtaaa

SEQ ID NO: 7337315 - DNA, 22 bp, Homo sapiens
ttgaaaggtgctgtgtgctgat

SEQ ID NO: 7337316 - DNA, 23 bp, Homo sapiens
ttgaaaggtagctggcagctaga

SEQ ID NO: 7337317 - DNA, 22 bp, Homo sapiens
ttgaaaggtgaacatgatgcac

SEQ ID NO: 7337318 - DNA, 22 bp, Homo sapiens
ttgaaaggtgacattgttagag

SEQ ID NO: 7337319 - DNA, 22 bp, Homo sapiens
ttcttttacattaagatttcag

SEQ ID NO: 7337320 - DNA, 22 bp, Homo sapiens
ttcttttaatttctgtctgcag

SEQ ID NO: 7337321 - DNA, 22 bp, Homo sapiens
ttgaaagtctctgcatgtagga

SEQ ID NO: 7337322 - DNA, 22 bp, Homo sapiens
ctccaaatacagtcatcttggg

SEQ ID NO: 7337323 - DNA, 19 bp, Homo sapiens
ctccaaatacttttccctt

SEQ ID NO: 7337324 - DNA, 22 bp, Homo sapiens
ctccaaatataatcacattgga

SEQ ID NO: 7337325 - DNA, 19 bp, Homo sapiens
ttgtcttagctgcataaga

SEQ ID NO: 7337326 - DNA, 22 bp, Homo sapiens
ttgtcttaaatggatggacaat

SEQ ID NO: 7337327 - DNA, 22 bp, Homo sapiens
ttgtcttaaatggatggacaat

SEQ ID NO: 7337328 - DNA, 22 bp, Homo sapiens
ttgtcttaccaaatatgatgca

SEQ ID NO: 7337329 - DNA, 22 bp, Homo sapiens
ttgtcttattttatcataagca

SEQ ID NO: 7337330 - DNA, 22 bp, Homo sapiens
ctccagccagagtgcctctgtt

SEQ ID NO: 7337331 - DNA, 23 bp, Homo sapiens
ttgtatttttagtagagacaggg

SEQ ID NO: 7337332 - DNA, 22 bp, Homo sapiens
ctccagcctcatctcctggctg

SEQ ID NO: 7337333 - DNA, 20 bp, Homo sapiens
ctccagcccctgccctggtc

SEQ ID NO: 7337334 - DNA, 22 bp, Homo sapiens
ttgtgtaaaacctgtgatcttt

SEQ ID NO: 7337335 - DNA, 22 bp, Homo sapiens
ttgtgtaaaacctgtgatcttt

SEQ ID NO: 7337336 - DNA, 22 bp, Homo sapiens
ttgtggttaaccgcacattttt

SEQ ID NO: 7337337 - DNA, 22 bp, Homo sapiens
ctccagtgcgtcttagtaaacc

SEQ ID NO: 7337338 - DNA, 22 bp, Homo sapiens
ttgtgtaattagcaaacaaatc

SEQ ID NO: 7337339 - DNA, 22 bp, Homo sapiens
tttaatatccagtggatacaaa

SEQ ID NO: 7337340 - DNA, 22 bp, Homo sapiens
ctcccaggcagggctgcccact

SEQ ID NO: 7337341 - DNA, 22 bp, Homo sapiens
ctcccaggcacagggaggagcc

SEQ ID NO: 7337342 - DNA, 22 bp, Homo sapiens
tttaacagatgctatgtctacc

SEQ ID NO: 7337343 - DNA, 22 bp, Homo sapiens
ctcccagaaaattctcagacaa

SEQ ID NO: 7337344 - DNA, 22 bp, Homo sapiens
ctcccactcctggctcaccaca

SEQ ID NO: 7337345 - DNA, 22 bp, Homo sapiens
ctcccaagctgtgctgaactgt

SEQ ID NO: 7337346 - DNA, 22 bp, Homo sapiens
ctccattgaacatcctctcaga

SEQ ID NO: 7337347 - DNA, 22 bp, Homo sapiens
ctcccagacatgtgcctccttg

SEQ ID NO: 7337348 - DNA, 22 bp, Homo sapiens
ctcccaggactcagaggagaag

SEQ ID NO: 7337349 - DNA, 22 bp, Homo sapiens
ctcccagccttcgccagtctga

SEQ ID NO: 7337350 - DNA, 22 bp, Homo sapiens
ctctttagtggtgatgatgcta

SEQ ID NO: 7337351 - DNA, 20 bp, Homo sapiens
ctcttcaaatattttattct

SEQ ID NO: 7337352 - DNA, 22 bp, Homo sapiens
ttttagttactgcagtagcaaa

SEQ ID NO: 7337353 - DNA, 22 bp, Homo sapiens
ctcttccatattactcagggta

SEQ ID NO: 7337354 - DNA, 22 bp, Homo sapiens
ctcttccacctccttcaggaga

SEQ ID NO: 7337355 - DNA, 22 bp, Homo sapiens
ttttagatagtttaactgcact

SEQ ID NO: 7337356 - DNA, 22 bp, Homo sapiens
ttttagattataagtctaattc

SEQ ID NO: 7337357 - DNA, 22 bp, Homo sapiens
ttttagatagtttaactgcact

SEQ ID NO: 7337358 - DNA, 20 bp, Homo sapiens
ttttagcacttgttatggtg

SEQ ID NO: 7337359 - DNA, 22 bp, Homo sapiens
ttttagattgggaaatgtaaag

SEQ ID NO: 7337360 - DNA, 22 bp, Homo sapiens
ttttagattgggaaatgtaaag

SEQ ID NO: 7337361 - DNA, 22 bp, Homo sapiens
ttttaatactgctattgtagga

SEQ ID NO: 7337362 - DNA, 22 bp, Homo sapiens
ttttaatactgctattgtagga

SEQ ID NO: 7337363 - DNA, 22 bp, Homo sapiens
ttttaatactgctattgtagga

SEQ ID NO: 7337364 - DNA, 22 bp, Homo sapiens
ttttaagttggattgctaagta

SEQ ID NO: 7337365 - DNA, 22 bp, Homo sapiens
ttttaagtgcaatctgaatgcg

SEQ ID NO: 7337366 - DNA, 19 bp, Homo sapiens
ttttaagtcctctctattc

SEQ ID NO: 7337367 - DNA, 19 bp, Homo sapiens
ttttaagtgccctttcttc

SEQ ID NO: 7337368 - DNA, 19 bp, Homo sapiens
ttttaagtgccctttcttc

SEQ ID NO: 7337369 - DNA, 22 bp, Homo sapiens
tttgtacactgtctactatgaa

SEQ ID NO: 7337370 - DNA, 22 bp, Homo sapiens
ctctgccagtttctggcctcag

SEQ ID NO: 7337371 - DNA, 22 bp, Homo sapiens
tttcctttatgacatcaccact

SEQ ID NO: 7337372 - DNA, 22 bp, Homo sapiens
tttcctttatgacatcaccact

SEQ ID NO: 7337373 - DNA, 22 bp, Homo sapiens
tttgcattttgataagatcact

SEQ ID NO: 7337374 - DNA, 22 bp, Homo sapiens
tttgcattttagatttaggcct

SEQ ID NO: 7337375 - DNA, 21 bp, Homo sapiens
ctctgcccagggcctcctgcc

SEQ ID NO: 7337376 - DNA, 21 bp, Homo sapiens
ctctgcccagggcctcctgcc

SEQ ID NO: 7337377 - DNA, 22 bp, Homo sapiens
ctctgcccagtgcccacaggag

SEQ ID NO: 7337378 - DNA, 22 bp, Homo sapiens
ctctgctttttaaaaggagtcc

SEQ ID NO: 7337379 - DNA, 22 bp, Homo sapiens
ctctggaaaaccactagcagga

SEQ ID NO: 7337380 - DNA, 22 bp, Homo sapiens
ctctggaaatggccatagtcat

SEQ ID NO: 7337381 - DNA, 22 bp, Homo sapiens
ctctggaaaattgtgtgggggt

SEQ ID NO: 7337382 - DNA, 22 bp, Homo sapiens
tttgctcttgctgcttggggca

SEQ ID NO: 7337383 - DNA, 22 bp, Homo sapiens
tttgctataaaagggtcacacg

SEQ ID NO: 7337384 - DNA, 22 bp, Homo sapiens
tttgctatttttctgtgcagct

SEQ ID NO: 7337385 - DNA, 22 bp, Homo sapiens
tttgcctgattctaagagctca

SEQ ID NO: 7337386 - DNA, 19 bp, Homo sapiens
tttgccttgcagctgtgtg

SEQ ID NO: 7337387 - DNA, 22 bp, Homo sapiens
tttgggaactctatcatggaaa

SEQ ID NO: 7337388 - DNA, 22 bp, Homo sapiens
tttgggaacttggttcagggaa

SEQ ID NO: 7337389 - DNA, 19 bp, Homo sapiens
tttgggaagcccagagtgt

SEQ ID NO: 7337390 - DNA, 23 bp, Homo sapiens
tttgggaagggagagagtaagca

SEQ ID NO: 7337391 - DNA, 22 bp, Homo sapiens
tttgggaagtgggagcaaggtg

SEQ ID NO: 7337392 - DNA, 22 bp, Homo sapiens
tttgggaatagcagggactgag

SEQ ID NO: 7337393 - DNA, 22 bp, Homo sapiens
tttgggaagtttaaaataagta

SEQ ID NO: 7337394 - DNA, 22 bp, Homo sapiens
tttgggaataattgcacagatt

SEQ ID NO: 7337395 - DNA, 22 bp, Homo sapiens
tttgggaaataaacctagagga

SEQ ID NO: 7337396 - DNA, 22 bp, Homo sapiens
ctctggaatgtttacatgccct

SEQ ID NO: 7337397 - DNA, 22 bp, Homo sapiens
ctctggaatgggtgtttctaac

SEQ ID NO: 7337398 - DNA, 22 bp, Homo sapiens
ctctggaagaatacacttagaa

SEQ ID NO: 7337399 - DNA, 20 bp, Homo sapiens
ctctggaagagtttaaatgg

SEQ ID NO: 7337400 - DNA, 22 bp, Homo sapiens
ctctggaagatgacctgggtaa

SEQ ID NO: 7337401 - DNA, 22 bp, Homo sapiens
ctctggaagtgatggcaggtca

SEQ ID NO: 7337402 - DNA, 22 bp, Homo sapiens
ctgacagatgctgctggcagta

SEQ ID NO: 7337403 - DNA, 22 bp, Homo sapiens
ctgacagattagatgtgcatat

SEQ ID NO: 7337404 - DNA, 22 bp, Homo sapiens
ctgacagatacttatgacataa

SEQ ID NO: 7337405 - DNA, 22 bp, Homo sapiens
ctgacagatctggatctgaact

SEQ ID NO: 7337406 - DNA, 22 bp, Homo sapiens
ctgaccactgttctcctggggt

SEQ ID NO: 7337407 - DNA, 21 bp, Homo sapiens
ctctttatatagtaaagatat

SEQ ID NO: 7337408 - DNA, 17 bp, Homo sapiens
ctctttataaagagtta

SEQ ID NO: 7337409 - DNA, 22 bp, Homo sapiens
ctctttcctcgatgggctcctg

SEQ ID NO: 7337410 - DNA, 22 bp, Homo sapiens
ctgagcccctctgacctcagag

SEQ ID NO: 7337411 - DNA, 17 bp, Homo sapiens
ctgagccccgggcagct

SEQ ID NO: 7337412 - DNA, 17 bp, Homo sapiens
ctgagccccgggcagct

SEQ ID NO: 7337413 - DNA, 22 bp, Homo sapiens
ctgagccctcctgcttgctgag

SEQ ID NO: 7337414 - DNA, 20 bp, Homo sapiens
ctgagcccccagcctgcagg

SEQ ID NO: 7337415 - DNA, 22 bp, Homo sapiens
ctgagccccatctgaggtgccc

SEQ ID NO: 7337416 - DNA, 22 bp, Homo sapiens
ctgagcccattgggtgctgtta

SEQ ID NO: 7337417 - DNA, 20 bp, Homo sapiens
ctgagcccagatcccaggtc

SEQ ID NO: 7337418 - DNA, 22 bp, Homo sapiens
ctgagcccaggcgggagctgag

SEQ ID NO: 7337419 - DNA, 22 bp, Homo sapiens
ctgaggcagagggcagaccaga

SEQ ID NO: 7337420 - DNA, 21 bp, Homo sapiens
ctgaggcagcacagctagtca

SEQ ID NO: 7337421 - DNA, 22 bp, Homo sapiens
ctgaggcagagggcagaccaga

SEQ ID NO: 7337422 - DNA, 22 bp, Homo sapiens
ctgagcccttgtcttcctggtc

SEQ ID NO: 7337423 - DNA, 22 bp, Homo sapiens
ctgagccctggctcgcctggag

SEQ ID NO: 7337424 - DNA, 22 bp, Homo sapiens
ctgagccctgcctcttgtcact

SEQ ID NO: 7337425 - DNA, 22 bp, Homo sapiens
ctgagccctctgttttccctct

SEQ ID NO: 7337426 - DNA, 20 bp, Homo sapiens
ctgagcccttcctgtgaacc

SEQ ID NO: 7337427 - DNA, 22 bp, Homo sapiens
ctgagccataagggaggctggg

SEQ ID NO: 7337428 - DNA, 22 bp, Homo sapiens
ctgaggccggagcactgaagag

SEQ ID NO: 7337429 - DNA, 17 bp, Homo sapiens
ctgaggcccagggccca

SEQ ID NO: 7337430 - DNA, 22 bp, Homo sapiens
ctgaggccagagtgggcctctt

SEQ ID NO: 7337431 - DNA, 22 bp, Homo sapiens
ctgaggccagaacccgaccctg

SEQ ID NO: 7337432 - DNA, 22 bp, Homo sapiens
ctgaggccagctgcagagctct

SEQ ID NO: 7337433 - DNA, 22 bp, Homo sapiens
ctgaggcatgttacaggacata

SEQ ID NO: 7337434 - DNA, 22 bp, Homo sapiens
ctgaggcatgggaagttgggtg

SEQ ID NO: 7337435 - DNA, 22 bp, Homo sapiens
ctgcacagggatatggggagct

SEQ ID NO: 7337436 - DNA, 22 bp, Homo sapiens
ctgcacagcctgtctgggggcc

SEQ ID NO: 7337437 - DNA, 22 bp, Homo sapiens
ctgcacagctggccagggagag

SEQ ID NO: 7337438 - DNA, 22 bp, Homo sapiens
ctgcacagtggacagtgaagat

SEQ ID NO: 7337439 - DNA, 22 bp, Homo sapiens
ctgcacagtggacagtgaagat

SEQ ID NO: 7337440 - DNA, 22 bp, Homo sapiens
ctgcacagtgttggaagctgcc

SEQ ID NO: 7337441 - DNA, 22 bp, Homo sapiens
ctgcacagtgttggaagctgcc

SEQ ID NO: 7337442 - DNA, 22 bp, Homo sapiens
ctgcacagtaagcttcagagat

SEQ ID NO: 7337443 - DNA, 22 bp, Homo sapiens
ctgcaaaattgttctttgctcc

SEQ ID NO: 7337444 - DNA, 22 bp, Homo sapiens
ctgcacagaggtcggtctgcca

SEQ ID NO: 7337445 - DNA, 22 bp, Homo sapiens
ctgcacagagcggcagttctta

SEQ ID NO: 7337446 - DNA, 22 bp, Homo sapiens
ctgcacatgttcatcatgacaa

SEQ ID NO: 7337447 - DNA, 22 bp, Homo sapiens
ctgcaccatctggagcacctcc

SEQ ID NO: 7337448 - DNA, 22 bp, Homo sapiens
ctgcaccctcaaactcctgggc

SEQ ID NO: 7337449 - DNA, 22 bp, Homo sapiens
ctgcactgaagaaaggagctct

SEQ ID NO: 7337450 - DNA, 18 bp, Homo sapiens
ctgcacttcagcttgggc

SEQ ID NO: 7337451 - DNA, 18 bp, Homo sapiens
ctgcactgtgggtagctc

SEQ ID NO: 7337452 - DNA, 22 bp, Homo sapiens
ctgcaggccgagctccttctcg

SEQ ID NO: 7337453 - DNA, 22 bp, Homo sapiens
ctgcagggagaggggacagcct

SEQ ID NO: 7337454 - DNA, 22 bp, Homo sapiens
ctgcagggcttaccttgctctg

SEQ ID NO: 7337455 - DNA, 22 bp, Homo sapiens
ctgcagggcccgcctgagccct

SEQ ID NO: 7337456 - DNA, 22 bp, Homo sapiens
ctgcagggatgtgaggcccgtt

SEQ ID NO: 7337457 - DNA, 19 bp, Homo sapiens
ctgcagggatgtgcagagt

SEQ ID NO: 7337458 - DNA, 22 bp, Homo sapiens
ctgcagggcagaagggcataga

SEQ ID NO: 7337459 - DNA, 22 bp, Homo sapiens
tccctctctagcctgttcagta

SEQ ID NO: 7337460 - DNA, 22 bp, Homo sapiens
tccctgggtcctgcttgctctc

SEQ ID NO: 7337461 - DNA, 22 bp, Homo sapiens
tccctggggttcctccagccac

SEQ ID NO: 7337462 - DNA, 22 bp, Homo sapiens
tccctgggtcattctctggcac

SEQ ID NO: 7337463 - DNA, 22 bp, Homo sapiens
tccctgggttcccgtggaagtg

SEQ ID NO: 7337464 - DNA, 22 bp, Homo sapiens
tccctgggttacctttcaaggt

SEQ ID NO: 7337465 - DNA, 16 bp, Homo sapiens
tcctaacgtgcagcca

SEQ ID NO: 7337466 - DNA, 18 bp, Homo sapiens
tccctggggctgccaccc

SEQ ID NO: 7337467 - DNA, 20 bp, Homo sapiens
tccctggggccctacttcct

SEQ ID NO: 7337468 - DNA, 22 bp, Homo sapiens
tccctggggtatcgctgaggca

SEQ ID NO: 7337469 - DNA, 22 bp, Homo sapiens
tccctggggtaacattagaggg

SEQ ID NO: 7337470 - DNA, 22 bp, Homo sapiens
catttaaaggttgtgggtaaaa

SEQ ID NO: 7337471 - DNA, 22 bp, Homo sapiens
cattgttgttaaacatagtaat

SEQ ID NO: 7337472 - DNA, 22 bp, Homo sapiens
cattgttggtcattgtcggttg

SEQ ID NO: 7337473 - DNA, 22 bp, Homo sapiens
cattgttgtgagatcaagcagt

SEQ ID NO: 7337474 - DNA, 22 bp, Homo sapiens
cattgttaattggtatcttaca

SEQ ID NO: 7337475 - DNA, 22 bp, Homo sapiens
cattgttgaacacctgctggat

SEQ ID NO: 7337476 - DNA, 22 bp, Homo sapiens
cattgttgctgcttcaagatat

SEQ ID NO: 7337477 - DNA, 22 bp, Homo sapiens
cattgttggcagagggacagag

SEQ ID NO: 7337478 - DNA, 22 bp, Homo sapiens
cattgttggtaatgctcagagg

SEQ ID NO: 7337479 - DNA, 22 bp, Homo sapiens
cattgtcacccaaagctcatag

SEQ ID NO: 7337480 - DNA, 22 bp, Homo sapiens
cattgtcctttggctttgcaaa

SEQ ID NO: 7337481 - DNA, 21 bp, Homo sapiens
cattgtcgacattttcccctc

SEQ ID NO: 7337482 - DNA, 22 bp, Homo sapiens
cattgtccctcaatgtctatga

SEQ ID NO: 7337483 - DNA, 16 bp, Homo sapiens
cattgcactctagcct

SEQ ID NO: 7337484 - DNA, 22 bp, Homo sapiens
tcccactcactgtctctgacac

SEQ ID NO: 7337485 - DNA, 22 bp, Homo sapiens
tcccactcccaggcaggcctct

SEQ ID NO: 7337486 - DNA, 22 bp, Homo sapiens
cattgcactccaccctaggcaa

SEQ ID NO: 7337487 - DNA, 22 bp, Homo sapiens
cattgcactccagcctaggcaa

SEQ ID NO: 7337488 - DNA, 22 bp, Homo sapiens
cattgcactccagcctgggcaa

SEQ ID NO: 7337489 - DNA, 22 bp, Homo sapiens
cattgcactccagcctgggcca

SEQ ID NO: 7337490 - DNA, 22 bp, Homo sapiens
cattgcactccagcctgggtaa

SEQ ID NO: 7337491 - DNA, 22 bp, Homo sapiens
cattgcactccagcctgggtga

SEQ ID NO: 7337492 - DNA, 22 bp, Homo sapiens
cattgcactccagccttggcaa

SEQ ID NO: 7337493 - DNA, 22 bp, Homo sapiens
cattgcactccagctctgggcg

SEQ ID NO: 7337494 - DNA, 22 bp, Homo sapiens
cattgcactccagcttgggcaa

SEQ ID NO: 7337495 - DNA, 22 bp, Homo sapiens
cattgcactccagtctgggcca

SEQ ID NO: 7337496 - DNA, 22 bp, Homo sapiens
cattgcactccatcttgggcaa

SEQ ID NO: 7337497 - DNA, 22 bp, Homo sapiens
cattgcactcctgcctgggcaa

SEQ ID NO: 7337498 - DNA, 22 bp, Homo sapiens
catgggccagagctcctctggg

SEQ ID NO: 7337499 - DNA, 22 bp, Homo sapiens
catgggcccgtgagaggcaggg

SEQ ID NO: 7337500 - DNA, 19 bp, Homo sapiens
tccaggagcaaagccagtt

SEQ ID NO: 7337501 - DNA, 22 bp, Homo sapiens
catgggaggtctgcaaggtgct

SEQ ID NO: 7337502 - DNA, 17 bp, Homo sapiens
tccaggagaggcaatgg

SEQ ID NO: 7337503 - DNA, 22 bp, Homo sapiens
tccaggagacacaaggtacata

SEQ ID NO: 7337504 - DNA, 23 bp, Homo sapiens
tccaggagaattccagggcccgg

SEQ ID NO: 7337505 - DNA, 22 bp, Homo sapiens
tccaggagatacactgcaccag

SEQ ID NO: 7337506 - DNA, 22 bp, Homo sapiens
cattcttacacaatattttaat

SEQ ID NO: 7337507 - DNA, 22 bp, Homo sapiens
cattctctgatcttcacatacc

SEQ ID NO: 7337508 - DNA, 22 bp, Homo sapiens
cattctgaccctatgatttaag

SEQ ID NO: 7337509 - DNA, 22 bp, Homo sapiens
tcccacccatcctgcatctctt

SEQ ID NO: 7337510 - DNA, 22 bp, Homo sapiens
tcccaccaggtgaccatttcat

SEQ ID NO: 7337511 - DNA, 22 bp, Homo sapiens
cattcttctggatagttagttg

SEQ ID NO: 7337512 - DNA, 22 bp, Homo sapiens
tcccaccccttgactctttaag

SEQ ID NO: 7337513 - DNA, 22 bp, Homo sapiens
cattagcaatcataaaccttta

SEQ ID NO: 7337514 - DNA, 22 bp, Homo sapiens
cattacatttcaaaatgtttcc

SEQ ID NO: 7337515 - DNA, 22 bp, Homo sapiens
cattacatctttgatgcagtat

SEQ ID NO: 7337516 - DNA, 22 bp, Homo sapiens
tcccaaacatttttggccttga

SEQ ID NO: 7337517 - DNA, 22 bp, Homo sapiens
cattagaagaacagttatatta

SEQ ID NO: 7337518 - DNA, 22 bp, Homo sapiens
cattagaagaacagttatatta

SEQ ID NO: 7337519 - DNA, 22 bp, Homo sapiens
cattagaacctataaaaagcat

SEQ ID NO: 7337520 - DNA, 22 bp, Homo sapiens
cattagaaggttttaaaggaat

SEQ ID NO: 7337521 - DNA, 22 bp, Homo sapiens
cattagacacagatgtataaat

SEQ ID NO: 7337522 - DNA, 22 bp, Homo sapiens
tcctttaacttgattattttca

SEQ ID NO: 7337523 - DNA, 22 bp, Homo sapiens
tcctgggcttagtggctaggtc

SEQ ID NO: 7337524 - DNA, 19 bp, Homo sapiens
tcctggggaggggcatggc

SEQ ID NO: 7337525 - DNA, 19 bp, Homo sapiens
tcctggggaggggcatggc

SEQ ID NO: 7337526 - DNA, 17 bp, Homo sapiens
tccttcagtgcctctgc

SEQ ID NO: 7337527 - DNA, 22 bp, Homo sapiens
tctaagcctcagaccacgctgc

SEQ ID NO: 7337528 - DNA, 22 bp, Homo sapiens
tctaagctagtggctcatgtga

SEQ ID NO: 7337529 - DNA, 22 bp, Homo sapiens
ccactgtaagtttgaaaataac

SEQ ID NO: 7337530 - DNA, 22 bp, Homo sapiens
ccactgtcttttccaggctgaa

SEQ ID NO: 7337531 - DNA, 22 bp, Homo sapiens
ccactgtcagaggggctgtgcc

SEQ ID NO: 7337532 - DNA, 22 bp, Homo sapiens
ccactgtctgcaggcctcagca

SEQ ID NO: 7337533 - DNA, 22 bp, Homo sapiens
ccactgtctgcaggcctcagca

SEQ ID NO: 7337534 - DNA, 22 bp, Homo sapiens
tctaagccgcaagcctatctgt

SEQ ID NO: 7337535 - DNA, 22 bp, Homo sapiens
ccacttaagagaacagctatag

SEQ ID NO: 7337536 - DNA, 22 bp, Homo sapiens
ccacttcatcagtgctccattt

SEQ ID NO: 7337537 - DNA, 22 bp, Homo sapiens
ccactgtttcctttctgctggc

SEQ ID NO: 7337538 - DNA, 22 bp, Homo sapiens
ccactgtgtccaccaggaatgc

SEQ ID NO: 7337539 - DNA, 22 bp, Homo sapiens
ccactgtgtccaccaggaatgc

SEQ ID NO: 7337540 - DNA, 22 bp, Homo sapiens
ccactgtgagcatgaacaggac

SEQ ID NO: 7337541 - DNA, 22 bp, Homo sapiens
ccaaggctgtggggctgtgcag

SEQ ID NO: 7337542 - DNA, 22 bp, Homo sapiens
ccaaggccacaaacagcctggc

SEQ ID NO: 7337543 - DNA, 22 bp, Homo sapiens
ccaaggcttcctgacctacatg

SEQ ID NO: 7337544 - DNA, 22 bp, Homo sapiens
ccaaggcacactctgcaaggtt

SEQ ID NO: 7337545 - DNA, 22 bp, Homo sapiens
ccaaggagtagagcaggaagct

SEQ ID NO: 7337546 - DNA, 22 bp, Homo sapiens
ccaaggaggccccaggtcagct

SEQ ID NO: 7337547 - DNA, 22 bp, Homo sapiens
ccaaggagcaaggctcaacaag

SEQ ID NO: 7337548 - DNA, 22 bp, Homo sapiens
ccaaggagcaagtttacacctg

SEQ ID NO: 7337549 - DNA, 22 bp, Homo sapiens
ccaaggagctcatattcttgtt

SEQ ID NO: 7337550 - DNA, 22 bp, Homo sapiens
ccaaggagctgcaggcacttgt

SEQ ID NO: 7337551 - DNA, 22 bp, Homo sapiens
tcctacagaaccaggctaggtg

SEQ ID NO: 7337552 - DNA, 22 bp, Homo sapiens
tcctgggcttaagtgatcctcc

SEQ ID NO: 7337553 - DNA, 22 bp, Homo sapiens
ccacagaaaataaagcacgatt

SEQ ID NO: 7337554 - DNA, 22 bp, Homo sapiens
ccacactttgagatgactagga

SEQ ID NO: 7337555 - DNA, 22 bp, Homo sapiens
ccacactgaacctcagtgtctt

SEQ ID NO: 7337556 - DNA, 22 bp, Homo sapiens
ccacactgaccagctgtgagac

SEQ ID NO: 7337557 - DNA, 17 bp, Homo sapiens
ccacaccctttccttcc

SEQ ID NO: 7337558 - DNA, 19 bp, Homo sapiens
ccacacagtgtgcaattta

SEQ ID NO: 7337559 - DNA, 22 bp, Homo sapiens
tcctggcagggtggcagcgggt

SEQ ID NO: 7337560 - DNA, 22 bp, Homo sapiens
tcctggcaggtcagcaggagca

SEQ ID NO: 7337561 - DNA, 22 bp, Homo sapiens
tcagatatgaattcatatctct

SEQ ID NO: 7337562 - DNA, 22 bp, Homo sapiens
tcagatatagtcatttaaataa

SEQ ID NO: 7337563 - DNA, 22 bp, Homo sapiens
tcagatatgaattcatatctct

SEQ ID NO: 7337564 - DNA, 22 bp, Homo sapiens
tcagagttgagctgttttgtgg

SEQ ID NO: 7337565 - DNA, 22 bp, Homo sapiens
tcagagttggcctttctgtatt

SEQ ID NO: 7337566 - DNA, 22 bp, Homo sapiens
tcagagttttattttattccgg

SEQ ID NO: 7337567 - DNA, 22 bp, Homo sapiens
tcagagtttgaaataattttta

SEQ ID NO: 7337568 - DNA, 22 bp, Homo sapiens
tcagaggagcaaaagaggggat

SEQ ID NO: 7337569 - DNA, 22 bp, Homo sapiens
tcagaggatcatgtccctactc

SEQ ID NO: 7337570 - DNA, 22 bp, Homo sapiens
tcagatgagtgctttcagctgc

SEQ ID NO: 7337571 - DNA, 22 bp, Homo sapiens
tcagatcatcagctgctttata

SEQ ID NO: 7337572 - DNA, 22 bp, Homo sapiens
cagttttctaaagtctctttaa

SEQ ID NO: 7337573 - DNA, 22 bp, Homo sapiens
cagtttgtgctaggcactattt

SEQ ID NO: 7337574 - DNA, 18 bp, Homo sapiens
cagtttttatatctggca

SEQ ID NO: 7337575 - DNA, 22 bp, Homo sapiens
cagtttttagattagttggtgg

SEQ ID NO: 7337576 - DNA, 23 bp, Homo sapiens
cataaaatattagtatggtagca

SEQ ID NO: 7337577 - DNA, 22 bp, Homo sapiens
cagtttttcaaaattacatgat

SEQ ID NO: 7337578 - DNA, 22 bp, Homo sapiens
cagtttttgccattaagagtaa

SEQ ID NO: 7337579 - DNA, 22 bp, Homo sapiens
cagtttttcaaaattacatgat

SEQ ID NO: 7337580 - DNA, 22 bp, Homo sapiens
cagttactgtatgtcaaagact

SEQ ID NO: 7337581 - DNA, 22 bp, Homo sapiens
tcagagagttttcactagggtg

SEQ ID NO: 7337582 - DNA, 22 bp, Homo sapiens
tcagagagttggaaagaattaa

SEQ ID NO: 7337583 - DNA, 22 bp, Homo sapiens
tcagagagttagtgtcttagct

SEQ ID NO: 7337584 - DNA, 22 bp, Homo sapiens
tcagagagttagtgtcttagct

SEQ ID NO: 7337585 - DNA, 22 bp, Homo sapiens
tcagagagttacacaaattgtt

SEQ ID NO: 7337586 - DNA, 22 bp, Homo sapiens
tcagagagtgcaaaatatagct

SEQ ID NO: 7337587 - DNA, 22 bp, Homo sapiens
tcagagatgcagtgccacctac

SEQ ID NO: 7337588 - DNA, 22 bp, Homo sapiens
cagttgcctactacatggcagg

SEQ ID NO: 7337589 - DNA, 22 bp, Homo sapiens
cagttgcagctgtgacattgcg

SEQ ID NO: 7337590 - DNA, 22 bp, Homo sapiens
cagttgcactagccacatttca

SEQ ID NO: 7337591 - DNA, 22 bp, Homo sapiens
cagttgctggatgtgcagctct

SEQ ID NO: 7337592 - DNA, 21 bp, Homo sapiens
tcagagagtcacagtgaactg

SEQ ID NO: 7337593 - DNA, 21 bp, Homo sapiens
tcagagagtcacagtgaactg

SEQ ID NO: 7337594 - DNA, 22 bp, Homo sapiens
tcagagagtcctggtcatttgc

SEQ ID NO: 7337595 - DNA, 22 bp, Homo sapiens
tcagagaggttggtgataagaa

SEQ ID NO: 7337596 - DNA, 22 bp, Homo sapiens
cataatatctccgattacttgc

SEQ ID NO: 7337597 - DNA, 22 bp, Homo sapiens
tcagcagtcacatgttgtccca

SEQ ID NO: 7337598 - DNA, 22 bp, Homo sapiens
cataatttctaccagggccata

SEQ ID NO: 7337599 - DNA, 22 bp, Homo sapiens
cataatttcactgtcgtatggc

SEQ ID NO: 7337600 - DNA, 22 bp, Homo sapiens
cataatttcccaagagattgaa

SEQ ID NO: 7337601 - DNA, 22 bp, Homo sapiens
tcaggcagagttaatttgctcc

SEQ ID NO: 7337602 - DNA, 18 bp, Homo sapiens
cataattttctttcttta

SEQ ID NO: 7337603 - DNA, 18 bp, Homo sapiens
cataattttctttcttta

SEQ ID NO: 7337604 - DNA, 22 bp, Homo sapiens
tcaggcagagtggaagctgcaa

SEQ ID NO: 7337605 - DNA, 22 bp, Homo sapiens
cataattttccatggtttgcta

SEQ ID NO: 7337606 - DNA, 22 bp, Homo sapiens
cataatttgtggtagtggggga

SEQ ID NO: 7337607 - DNA, 22 bp, Homo sapiens
cataatttctgtatcagcacca

SEQ ID NO: 7337608 - DNA, 22 bp, Homo sapiens
cataatttgatatgcttgatgg

SEQ ID NO: 7337609 - DNA, 22 bp, Homo sapiens
catagaaacttgcagcaagcac

SEQ ID NO: 7337610 - DNA, 22 bp, Homo sapiens
catagaaactgagacaaggatt

SEQ ID NO: 7337611 - DNA, 22 bp, Homo sapiens
catagaaagtattatggaattt

SEQ ID NO: 7337612 - DNA, 22 bp, Homo sapiens
catagaaatcaggtgagaatct

SEQ ID NO: 7337613 - DNA, 22 bp, Homo sapiens
tcaggcctagaacacagcagat

SEQ ID NO: 7337614 - DNA, 17 bp, Homo sapiens
tcaggctgtgcctggta

SEQ ID NO: 7337615 - DNA, 17 bp, Homo sapiens
tcaggctgtgcctggta

SEQ ID NO: 7337616 - DNA, 21 bp, Homo sapiens
tcaggctgtctgctggttcca

SEQ ID NO: 7337617 - DNA, 22 bp, Homo sapiens
catagaacagctcctagcacat

SEQ ID NO: 7337618 - DNA, 22 bp, Homo sapiens
tcaggctgtgggcactggccat

SEQ ID NO: 7337619 - DNA, 22 bp, Homo sapiens
tcaggctgtgggcactggccat

SEQ ID NO: 7337620 - DNA, 22 bp, Homo sapiens
tcaggctgtggctttgaccgca

SEQ ID NO: 7337621 - DNA, 22 bp, Homo sapiens
tcaggctgtggcttcagttctt

SEQ ID NO: 7337622 - DNA, 22 bp, Homo sapiens
tcaggctgttagccacctcctc

SEQ ID NO: 7337623 - DNA, 22 bp, Homo sapiens
tcaggctgtgtctttaaacaat

SEQ ID NO: 7337624 - DNA, 19 bp, Homo sapiens
catctgtaaggacagaaac

SEQ ID NO: 7337625 - DNA, 19 bp, Homo sapiens
catctggatgattctcctg

SEQ ID NO: 7337626 - DNA, 22 bp, Homo sapiens
catctggctagctatcattgtg

SEQ ID NO: 7337627 - DNA, 19 bp, Homo sapiens
catctggatgattctcctg

SEQ ID NO: 7337628 - DNA, 22 bp, Homo sapiens
catctgaatatcccaggcatat

SEQ ID NO: 7337629 - DNA, 22 bp, Homo sapiens
catctgatgggaatataagagc

SEQ ID NO: 7337630 - DNA, 22 bp, Homo sapiens
catctgaataaagacttgcaga

SEQ ID NO: 7337631 - DNA, 22 bp, Homo sapiens
catctgaagagctttgcaagag

SEQ ID NO: 7337632 - DNA, 22 bp, Homo sapiens
catcttaaaatgtgtcataact

SEQ ID NO: 7337633 - DNA, 22 bp, Homo sapiens
catgaaattgtattggcctcaa

SEQ ID NO: 7337634 - DNA, 22 bp, Homo sapiens
catgaaattgctcctttggtgc

SEQ ID NO: 7337635 - DNA, 22 bp, Homo sapiens
catgaacatttgtttacatctg

SEQ ID NO: 7337636 - DNA, 22 bp, Homo sapiens
catgaagatcctgtatgttttt

SEQ ID NO: 7337637 - DNA, 22 bp, Homo sapiens
tcagtccccagatgtgtgctgt

SEQ ID NO: 7337638 - DNA, 22 bp, Homo sapiens
tcagtccagctcctcatttccc

SEQ ID NO: 7337639 - DNA, 21 bp, Homo sapiens
catctcagtgggttggtggat

SEQ ID NO: 7337640 - DNA, 22 bp, Homo sapiens
catctcactgaggggtttacaa

SEQ ID NO: 7337641 - DNA, 22 bp, Homo sapiens
catctcacttccctgcagcatc

SEQ ID NO: 7337642 - DNA, 22 bp, Homo sapiens
tcagtgctgagtagcgtgcacc

SEQ ID NO: 7337643 - DNA, 22 bp, Homo sapiens
tcagtgctgagtagcgtgcacc

SEQ ID NO: 7337644 - DNA, 20 bp, Homo sapiens
tcagtgctcaggcaccaggt

SEQ ID NO: 7337645 - DNA, 22 bp, Homo sapiens
tcagtgctaaaagagctggtgt

SEQ ID NO: 7337646 - DNA, 22 bp, Homo sapiens
tcagtgctaaaagagctggtgt

SEQ ID NO: 7337647 - DNA, 22 bp, Homo sapiens
tcagggagatttggggactcaa

SEQ ID NO: 7337648 - DNA, 18 bp, Homo sapiens
tcagtcagtcctgtgaag

SEQ ID NO: 7337649 - DNA, 22 bp, Homo sapiens
tcagggattgcaaaattcatcc

SEQ ID NO: 7337650 - DNA, 22 bp, Homo sapiens
catgaaggaattaaggtaagga

SEQ ID NO: 7337651 - DNA, 22 bp, Homo sapiens
catgaaggctgccagcaggcat

SEQ ID NO: 7337652 - DNA, 22 bp, Homo sapiens
catgaaggctgccagcaggcat

SEQ ID NO: 7337653 - DNA, 22 bp, Homo sapiens
catgaattagcaatggtgtgca

SEQ ID NO: 7337654 - DNA, 22 bp, Homo sapiens
catgaatttatattattagtga

SEQ ID NO: 7337655 - DNA, 22 bp, Homo sapiens
catgaattttaagactgttttt

SEQ ID NO: 7337656 - DNA, 22 bp, Homo sapiens
catgcacactgcaacaaggact

SEQ ID NO: 7337657 - DNA, 22 bp, Homo sapiens
catgcaggcctatggagcagtg

SEQ ID NO: 7337658 - DNA, 20 bp, Homo sapiens
catgacactgttcctctgcc

SEQ ID NO: 7337659 - DNA, 22 bp, Homo sapiens
catgcaggcctatggagcagtg

SEQ ID NO: 7337660 - DNA, 22 bp, Homo sapiens
catgcaggtctggagcttgggg

SEQ ID NO: 7337661 - DNA, 22 bp, Homo sapiens
catgcagggacttgtgctccat

SEQ ID NO: 7337662 - DNA, 22 bp, Homo sapiens
catgcagtttctctatgcgtag

SEQ ID NO: 7337663 - DNA, 22 bp, Homo sapiens
catgcatgccgggctgacagag

SEQ ID NO: 7337664 - DNA, 22 bp, Homo sapiens
catgcatatatgctacatgcaa

SEQ ID NO: 7337665 - DNA, 22 bp, Homo sapiens
catgcatgtttactacagtgac

SEQ ID NO: 7337666 - DNA, 22 bp, Homo sapiens
catgcattcagaatctctcaca

SEQ ID NO: 7337667 - DNA, 22 bp, Homo sapiens
catggaaggcaaaagacacaga

SEQ ID NO: 7337668 - DNA, 22 bp, Homo sapiens
catggcaggaaggacatgcact

SEQ ID NO: 7337669 - DNA, 22 bp, Homo sapiens
catggcagtgattcagcctttg

SEQ ID NO: 7337670 - DNA, 22 bp, Homo sapiens
catggccacatctagctgcaag

SEQ ID NO: 7337671 - DNA, 22 bp, Homo sapiens
taatcatggcctcaaattttat

SEQ ID NO: 7337672 - DNA, 22 bp, Homo sapiens
taatcagaagttacattagggt

SEQ ID NO: 7337673 - DNA, 22 bp, Homo sapiens
taatccaaaactgaatctgtgg

SEQ ID NO: 7337674 - DNA, 20 bp, Homo sapiens
taatgtcaaagtcacaaggt

SEQ ID NO: 7337675 - DNA, 22 bp, Homo sapiens
taatgtcaaggtcattctagag

SEQ ID NO: 7337676 - DNA, 22 bp, Homo sapiens
taatatttctaccctgctgcct

SEQ ID NO: 7337677 - DNA, 22 bp, Homo sapiens
caggcatggagaggcagagact

SEQ ID NO: 7337678 - DNA, 22 bp, Homo sapiens
caggcatgcttctgtctgggca

SEQ ID NO: 7337679 - DNA, 22 bp, Homo sapiens
caggcatgatgggaagtgcctg

SEQ ID NO: 7337680 - DNA, 22 bp, Homo sapiens
caggcatggaaaagcccagagg

SEQ ID NO: 7337681 - DNA, 22 bp, Homo sapiens
caggcatggaaaagcccagagg

SEQ ID NO: 7337682 - DNA, 22 bp, Homo sapiens
taatgtcagtgacctggtttaa

SEQ ID NO: 7337683 - DNA, 22 bp, Homo sapiens
taatgtctatgggccagataat

SEQ ID NO: 7337684 - DNA, 22 bp, Homo sapiens
taatgtcagcatagtttatttt

SEQ ID NO: 7337685 - DNA, 22 bp, Homo sapiens
taatgtcaaggtgatagatttg

SEQ ID NO: 7337686 - DNA, 22 bp, Homo sapiens
taatgtctccagggttgaccta

SEQ ID NO: 7337687 - DNA, 22 bp, Homo sapiens
taatgtcttagtaccttaattt

SEQ ID NO: 7337688 - DNA, 22 bp, Homo sapiens
taatgtcttcttttaatttggc

SEQ ID NO: 7337689 - DNA, 22 bp, Homo sapiens
taatgtgaagacataaatcaga

SEQ ID NO: 7337690 - DNA, 22 bp, Homo sapiens
caggccagtgggaaatagggat

SEQ ID NO: 7337691 - DNA, 19 bp, Homo sapiens
caggccagtgtcagggggc

SEQ ID NO: 7337692 - DNA, 22 bp, Homo sapiens
caggccaggtggcaggcaaaac

SEQ ID NO: 7337693 - DNA, 22 bp, Homo sapiens
caggccaggtgctctagaatca

SEQ ID NO: 7337694 - DNA, 22 bp, Homo sapiens
caggccagggttgagaagagaa

SEQ ID NO: 7337695 - DNA, 22 bp, Homo sapiens
caggcccaagactgatgagtct

SEQ ID NO: 7337696 - DNA, 22 bp, Homo sapiens
caggcccactgcttgtctagtc

SEQ ID NO: 7337697 - DNA, 19 bp, Homo sapiens
caggccagtgtcagggggc

SEQ ID NO: 7337698 - DNA, 22 bp, Homo sapiens
caggccagttttgatttaagcc

SEQ ID NO: 7337699 - DNA, 22 bp, Homo sapiens
caggccattaccgctgagaccc

SEQ ID NO: 7337700 - DNA, 22 bp, Homo sapiens
caggccagtgtgcttcccaggc

SEQ ID NO: 7337701 - DNA, 22 bp, Homo sapiens
caggcatgggccatgggaagtg

SEQ ID NO: 7337702 - DNA, 22 bp, Homo sapiens
caggccagagcgcgtggttggg

SEQ ID NO: 7337703 - DNA, 22 bp, Homo sapiens
caggccagggagaatatgaagc

SEQ ID NO: 7337704 - DNA, 22 bp, Homo sapiens
tacaaaccaaggaacagtgatc

SEQ ID NO: 7337705 - DNA, 22 bp, Homo sapiens
tacaaaccagcagaataggtcc

SEQ ID NO: 7337706 - DNA, 22 bp, Homo sapiens
caggcagatatgttcgctttaa

SEQ ID NO: 7337707 - DNA, 22 bp, Homo sapiens
caggcagagttagagcaactgg

SEQ ID NO: 7337708 - DNA, 22 bp, Homo sapiens
caggcagagccaatcgtggggt

SEQ ID NO: 7337709 - DNA, 22 bp, Homo sapiens
caggcacctttgtgcatgggca

SEQ ID NO: 7337710 - DNA, 22 bp, Homo sapiens
caggcacccagcccagtcgcac

SEQ ID NO: 7337711 - DNA, 22 bp, Homo sapiens
caggcacctgtgtgtctcaggg

SEQ ID NO: 7337712 - DNA, 22 bp, Homo sapiens
caggcaccccaggtgagcactg

SEQ ID NO: 7337713 - DNA, 22 bp, Homo sapiens
caggcagatttgctgccctcca

SEQ ID NO: 7337714 - DNA, 22 bp, Homo sapiens
caggcagcagaggagtgtggga

SEQ ID NO: 7337715 - DNA, 22 bp, Homo sapiens
taatacagaagtgtattaaaat

SEQ ID NO: 7337716 - DNA, 22 bp, Homo sapiens
taatacagaagtgtattaaaat

SEQ ID NO: 7337717 - DNA, 22 bp, Homo sapiens
taatacagaagtgtattaaaat

SEQ ID NO: 7337718 - DNA, 19 bp, Homo sapiens
gtgcttaacattttattgt

SEQ ID NO: 7337719 - DNA, 22 bp, Homo sapiens
gtgcttaaaacagaaaacattg

SEQ ID NO: 7337720 - DNA, 22 bp, Homo sapiens
gtgcttaagcttctgctttatg

SEQ ID NO: 7337721 - DNA, 22 bp, Homo sapiens
gtgcttctccgttctgcagcac

SEQ ID NO: 7337722 - DNA, 22 bp, Homo sapiens
cagctcagacgcaggtcgagca

SEQ ID NO: 7337723 - DNA, 22 bp, Homo sapiens
cagctatttatctttcatgata

SEQ ID NO: 7337724 - DNA, 22 bp, Homo sapiens
cagctattgttctgtataatga

SEQ ID NO: 7337725 - DNA, 22 bp, Homo sapiens
cagctattggcaagaagtggtg

SEQ ID NO: 7337726 - DNA, 19 bp, Homo sapiens
taagtatgtactatcttgc

SEQ ID NO: 7337727 - DNA, 22 bp, Homo sapiens
taaggcaggaactggctgtttt

SEQ ID NO: 7337728 - DNA, 23 bp, Homo sapiens
cagctcagcacataggaggtact

SEQ ID NO: 7337729 - DNA, 23 bp, Homo sapiens
cagctcagcacataggaggtact

SEQ ID NO: 7337730 - DNA, 22 bp, Homo sapiens
taagtattggcctatagctaga

SEQ ID NO: 7337731 - DNA, 22 bp, Homo sapiens
taagtcaaggtggcatttgaga

SEQ ID NO: 7337732 - DNA, 22 bp, Homo sapiens
tagaaaatgttccactgccatt

SEQ ID NO: 7337733 - DNA, 22 bp, Homo sapiens
tagaaacaaagacctgggtgct

SEQ ID NO: 7337734 - DNA, 22 bp, Homo sapiens
tagaaaagctctaaggcctctc

SEQ ID NO: 7337735 - DNA, 22 bp, Homo sapiens
tagaaaagctctaaggcctctc

SEQ ID NO: 7337736 - DNA, 22 bp, Homo sapiens
caggctgggcagcctccccggc

SEQ ID NO: 7337737 - DNA, 22 bp, Homo sapiens
caggctgggactgacccctgct

SEQ ID NO: 7337738 - DNA, 22 bp, Homo sapiens
caggctgggactgacccctgct

SEQ ID NO: 7337739 - DNA, 22 bp, Homo sapiens
caggctgggactgacccctgct

SEQ ID NO: 7337740 - DNA, 22 bp, Homo sapiens
caggctgggaacgccacccgct

SEQ ID NO: 7337741 - DNA, 22 bp, Homo sapiens
caggctgggaacgccacccgct

SEQ ID NO: 7337742 - DNA, 22 bp, Homo sapiens
caggctggcaatgcgtcaagca

SEQ ID NO: 7337743 - DNA, 22 bp, Homo sapiens
caggctgccgtgaagcaggcct

SEQ ID NO: 7337744 - DNA, 22 bp, Homo sapiens
caggctgccgaggctgcagaat

SEQ ID NO: 7337745 - DNA, 22 bp, Homo sapiens
caggctgccctagcttggacat

SEQ ID NO: 7337746 - DNA, 22 bp, Homo sapiens
caggctgcagtgcagtggctat

SEQ ID NO: 7337747 - DNA, 22 bp, Homo sapiens
caggctggagttcagtggtgtg

SEQ ID NO: 7337748 - DNA, 22 bp, Homo sapiens
caggctggagttcagtggtgtg

SEQ ID NO: 7337749 - DNA, 22 bp, Homo sapiens
caggctggagttcagtggtgtg

SEQ ID NO: 7337750 - DNA, 22 bp, Homo sapiens
caggctggagttcagtggtgtg

SEQ ID NO: 7337751 - DNA, 22 bp, Homo sapiens
caggctggagtgcagtggtgcc

SEQ ID NO: 7337752 - DNA, 22 bp, Homo sapiens
caggctggagtgcagtggtgcc

SEQ ID NO: 7337753 - DNA, 22 bp, Homo sapiens
caggctggagtgcagtggtgcc

SEQ ID NO: 7337754 - DNA, 22 bp, Homo sapiens
caggctgccgtgaagcaggcct

SEQ ID NO: 7337755 - DNA, 22 bp, Homo sapiens
caggctgccgtggggtccaggc

SEQ ID NO: 7337756 - DNA, 22 bp, Homo sapiens
cagggacaaacaaggttgggga

SEQ ID NO: 7337757 - DNA, 22 bp, Homo sapiens
cagggacaatggcagagcctga

SEQ ID NO: 7337758 - DNA, 20 bp, Homo sapiens
cagggacagcagtgggtttt

SEQ ID NO: 7337759 - DNA, 20 bp, Homo sapiens
cagggacagcagtgggtttt

SEQ ID NO: 7337760 - DNA, 22 bp, Homo sapiens
cagggacagagactgcaccttg

SEQ ID NO: 7337761 - DNA, 22 bp, Homo sapiens
cagggaagagccgatgctgcag

SEQ ID NO: 7337762 - DNA, 22 bp, Homo sapiens
cagggaaattaagtgacgatga

SEQ ID NO: 7337763 - DNA, 22 bp, Homo sapiens
cagggaaagttcttgtccactc

SEQ ID NO: 7337764 - DNA, 22 bp, Homo sapiens
caggcttttatgaatttcagtg

SEQ ID NO: 7337765 - DNA, 22 bp, Homo sapiens
cagggaaagtcccaccccacac

SEQ ID NO: 7337766 - DNA, 22 bp, Homo sapiens
cagggaaactaggaaataagct

SEQ ID NO: 7337767 - DNA, 22 bp, Homo sapiens
caggctgtctgaatggaggccc

SEQ ID NO: 7337768 - DNA, 22 bp, Homo sapiens
tagaaacaagggagaggattct

SEQ ID NO: 7337769 - DNA, 22 bp, Homo sapiens
caggcttggcagggaggctggt

SEQ ID NO: 7337770 - DNA, 22 bp, Homo sapiens
caggcttggttggggcgaggga

SEQ ID NO: 7337771 - DNA, 22 bp, Homo sapiens
tacattgattcaggatataggc

SEQ ID NO: 7337772 - DNA, 22 bp, Homo sapiens
tacattgctagaaatgtatttt

SEQ ID NO: 7337773 - DNA, 22 bp, Homo sapiens
tacatgttcaaatttgtctttc

SEQ ID NO: 7337774 - DNA, 22 bp, Homo sapiens
tacattgtacttacaaatagtg

SEQ ID NO: 7337775 - DNA, 22 bp, Homo sapiens
tacattgctcattatattgctt

SEQ ID NO: 7337776 - DNA, 22 bp, Homo sapiens
tacattgctttctaatacatct

SEQ ID NO: 7337777 - DNA, 22 bp, Homo sapiens
caggcctgatacactgaactct

SEQ ID NO: 7337778 - DNA, 22 bp, Homo sapiens
caggcctgagtgtggaagtctt

SEQ ID NO: 7337779 - DNA, 22 bp, Homo sapiens
caggcctgcttcttacccttca

SEQ ID NO: 7337780 - DNA, 22 bp, Homo sapiens
caggcctcttccatgcagcagc

SEQ ID NO: 7337781 - DNA, 19 bp, Homo sapiens
caggcctcttaccctctct

SEQ ID NO: 7337782 - DNA, 22 bp, Homo sapiens
caggcctgagacatctgagata

SEQ ID NO: 7337783 - DNA, 22 bp, Homo sapiens
caggcctgaccctgagcttcac

SEQ ID NO: 7337784 - DNA, 22 bp, Homo sapiens
caggcctgaccctgagcttcac

SEQ ID NO: 7337785 - DNA, 22 bp, Homo sapiens
caggcccaggccagtggttccc

SEQ ID NO: 7337786 - DNA, 22 bp, Homo sapiens
caggcccagcccagcccttcga

SEQ ID NO: 7337787 - DNA, 22 bp, Homo sapiens
caggcccagcccttagccaggt

SEQ ID NO: 7337788 - DNA, 22 bp, Homo sapiens
caggcccagcccagcccttcga

SEQ ID NO: 7337789 - DNA, 22 bp, Homo sapiens
caggcccagaggcctcttccca

SEQ ID NO: 7337790 - DNA, 22 bp, Homo sapiens
caggcctcctatgagcactagc

SEQ ID NO: 7337791 - DNA, 22 bp, Homo sapiens
caggcctctatggtcagctgag

SEQ ID NO: 7337792 - DNA, 22 bp, Homo sapiens
caggcctctccttagtctggca

SEQ ID NO: 7337793 - DNA, 22 bp, Homo sapiens
caggcctctccttagtctggca

SEQ ID NO: 7337794 - DNA, 22 bp, Homo sapiens
caggcctctatggtcagctgag

SEQ ID NO: 7337795 - DNA, 22 bp, Homo sapiens
caggctgcagcagcagtggccc

SEQ ID NO: 7337796 - DNA, 22 bp, Homo sapiens
tactttattgtaaatgctgatg

SEQ ID NO: 7337797 - DNA, 22 bp, Homo sapiens
tactgtggtaacattttaaatt

SEQ ID NO: 7337798 - DNA, 22 bp, Homo sapiens
tactgtggttactgctattaga

SEQ ID NO: 7337799 - DNA, 22 bp, Homo sapiens
caggcgctgtggctcccacctg

SEQ ID NO: 7337800 - DNA, 22 bp, Homo sapiens
caggcgggcaggtgcggcccct

SEQ ID NO: 7337801 - DNA, 22 bp, Homo sapiens
caggcgtcactgccacgggtat

SEQ ID NO: 7337802 - DNA, 18 bp, Homo sapiens
caggcctttgagacagaa

SEQ ID NO: 7337803 - DNA, 22 bp, Homo sapiens
tacattgtgatgtttcaataca

SEQ ID NO: 7337804 - DNA, 22 bp, Homo sapiens
tacattgtgttaaaacagaaga

SEQ ID NO: 7337805 - DNA, 22 bp, Homo sapiens
tacatttataaggcttctctgt

SEQ ID NO: 7337806 - DNA, 22 bp, Homo sapiens
tacattgttttttcttgccatc

SEQ ID NO: 7337807 - DNA, 22 bp, Homo sapiens
cagtcaccttgaggactcagac

SEQ ID NO: 7337808 - DNA, 22 bp, Homo sapiens
cagtcaccaccaggtggcagta

SEQ ID NO: 7337809 - DNA, 22 bp, Homo sapiens
cagtatattctgcagagcctta

SEQ ID NO: 7337810 - DNA, 22 bp, Homo sapiens
cagtatttttaagctgctttgt

SEQ ID NO: 7337811 - DNA, 21 bp, Homo sapiens
cagtattttaagcagtgagtt

SEQ ID NO: 7337812 - DNA, 22 bp, Homo sapiens
cagtcaggggtgggatcaaggc

SEQ ID NO: 7337813 - DNA, 22 bp, Homo sapiens
cagtcaggggtgggatcaaggc

SEQ ID NO: 7337814 - DNA, 22 bp, Homo sapiens
cagtcagggacaccagctagga

SEQ ID NO: 7337815 - DNA, 22 bp, Homo sapiens
cagtcagagtcacagtaatttg

SEQ ID NO: 7337816 - DNA, 22 bp, Homo sapiens
cagtcaggctgcgcttctctga

SEQ ID NO: 7337817 - DNA, 22 bp, Homo sapiens
cagtcacttacaaaaatataat

SEQ ID NO: 7337818 - DNA, 22 bp, Homo sapiens
cagtcagaaggaagatgcttaa

SEQ ID NO: 7337819 - DNA, 22 bp, Homo sapiens
tattttaaagtgaagggtcttg

SEQ ID NO: 7337820 - DNA, 22 bp, Homo sapiens
tattttaaagtgaagggtcttg

SEQ ID NO: 7337821 - DNA, 22 bp, Homo sapiens
tattttaaagactgccagccta

SEQ ID NO: 7337822 - DNA, 22 bp, Homo sapiens
tatttgaagattcttctgatgt

SEQ ID NO: 7337823 - DNA, 22 bp, Homo sapiens
tcaaaacaatcattggatgtgc

SEQ ID NO: 7337824 - DNA, 22 bp, Homo sapiens
tcaaaacaacactcaggtgtaa

SEQ ID NO: 7337825 - DNA, 22 bp, Homo sapiens
tcaaaacactattacctttaat

SEQ ID NO: 7337826 - DNA, 22 bp, Homo sapiens
tcaaaacactattacctttaat

SEQ ID NO: 7337827 - DNA, 19 bp, Homo sapiens
tcaaaacacaaatggttga

SEQ ID NO: 7337828 - DNA, 22 bp, Homo sapiens
tcaagcaagttgcatattgcta

SEQ ID NO: 7337829 - DNA, 23 bp, Homo sapiens
tcaagcaataattggtaatagtg

SEQ ID NO: 7337830 - DNA, 22 bp, Homo sapiens
tcaatagataaagctacataaa

SEQ ID NO: 7337831 - DNA, 18 bp, Homo sapiens
tcaagccattctcctgcc

SEQ ID NO: 7337832 - DNA, 22 bp, Homo sapiens
tcaagcaagtgtttggtgtaaa

SEQ ID NO: 7337833 - DNA, 18 bp, Homo sapiens
caggtgggtctcctgccc

SEQ ID NO: 7337834 - DNA, 22 bp, Homo sapiens
caggtgggtacatcacagagac

SEQ ID NO: 7337835 - DNA, 22 bp, Homo sapiens
caggtgggtacatcacagagac

SEQ ID NO: 7337836 - DNA, 22 bp, Homo sapiens
caggtgggtacatcacagagac

SEQ ID NO: 7337837 - DNA, 22 bp, Homo sapiens
caggtggggggcttccgagcct

SEQ ID NO: 7337838 - DNA, 19 bp, Homo sapiens
caggtggcgctctacaggg

SEQ ID NO: 7337839 - DNA, 22 bp, Homo sapiens
caggtggcattgtcccgccagc

SEQ ID NO: 7337840 - DNA, 22 bp, Homo sapiens
caggtggcatgactgcctacaa

SEQ ID NO: 7337841 - DNA, 22 bp, Homo sapiens
caggtaggatggaagggctcaa

SEQ ID NO: 7337842 - DNA, 22 bp, Homo sapiens
caggtaagaccgtttaggcagt

SEQ ID NO: 7337843 - DNA, 22 bp, Homo sapiens
caggtaggggagagctccaaca

SEQ ID NO: 7337844 - DNA, 22 bp, Homo sapiens
caggtcagaggtagatgagatg

SEQ ID NO: 7337845 - DNA, 22 bp, Homo sapiens
caggtcagcacttggaggtgca

SEQ ID NO: 7337846 - DNA, 22 bp, Homo sapiens
caggtcagctggtgccccaggt

SEQ ID NO: 7337847 - DNA, 22 bp, Homo sapiens
caggtgacaagacaggtaatat

SEQ ID NO: 7337848 - DNA, 22 bp, Homo sapiens
caggtgctctgctgcaggtaag

SEQ ID NO: 7337849 - DNA, 22 bp, Homo sapiens
caggtgctctgctgcaggtaag

SEQ ID NO: 7337850 - DNA, 22 bp, Homo sapiens
caggtgctgcgtggcggagctg

SEQ ID NO: 7337851 - DNA, 22 bp, Homo sapiens
caggtgctgtcctgcacatgtc

SEQ ID NO: 7337852 - DNA, 22 bp, Homo sapiens
tagcttgcctctggctgcacgg

SEQ ID NO: 7337853 - DNA, 22 bp, Homo sapiens
taggaggccatccagcctgcct

SEQ ID NO: 7337854 - DNA, 22 bp, Homo sapiens
taggagggccctgaaaatggca

SEQ ID NO: 7337855 - DNA, 22 bp, Homo sapiens
taggcagtagcaggatctgcca

SEQ ID NO: 7337856 - DNA, 22 bp, Homo sapiens
taggcatgcaaataaatgtgca

SEQ ID NO: 7337857 - DNA, 22 bp, Homo sapiens
taggcatgtggcatacctatgg

SEQ ID NO: 7337858 - DNA, 22 bp, Homo sapiens
taggcatttaagatggataagg

SEQ ID NO: 7337859 - DNA, 22 bp, Homo sapiens
cagggcccagtccctgctgtca

SEQ ID NO: 7337860 - DNA, 20 bp, Homo sapiens
cagggcctatgattgagctt

SEQ ID NO: 7337861 - DNA, 22 bp, Homo sapiens
cagggcctcatcctcagagatt

SEQ ID NO: 7337862 - DNA, 22 bp, Homo sapiens
cagggcctcatggccggggtgc

SEQ ID NO: 7337863 - DNA, 22 bp, Homo sapiens
cagggccactgtagatgaggag

SEQ ID NO: 7337864 - DNA, 22 bp, Homo sapiens
cagggccactgcatgaggttca

SEQ ID NO: 7337865 - DNA, 22 bp, Homo sapiens
cagggccagttctcgcagcagt

SEQ ID NO: 7337866 - DNA, 22 bp, Homo sapiens
cagggccagggctccatttcct

SEQ ID NO: 7337867 - DNA, 22 bp, Homo sapiens
cagggccaggctgatggcctgg

SEQ ID NO: 7337868 - DNA, 22 bp, Homo sapiens
cagggccagggacacgctgtca

SEQ ID NO: 7337869 - DNA, 22 bp, Homo sapiens
cagggccagggctatggtgaag

SEQ ID NO: 7337870 - DNA, 22 bp, Homo sapiens
cagggccagttctcgcagcagt

SEQ ID NO: 7337871 - DNA, 22 bp, Homo sapiens
cagggccatatcttgtgcacca

SEQ ID NO: 7337872 - DNA, 22 bp, Homo sapiens
cagggccatgaggcacagggtc

SEQ ID NO: 7337873 - DNA, 22 bp, Homo sapiens
cagggccattggcgtggctgtc

SEQ ID NO: 7337874 - DNA, 22 bp, Homo sapiens
cagggccattggaacaaagagg

SEQ ID NO: 7337875 - DNA, 22 bp, Homo sapiens
tagatttctcattcatagattg

SEQ ID NO: 7337876 - DNA, 22 bp, Homo sapiens
tagatttctcattcatagattg

SEQ ID NO: 7337877 - DNA, 22 bp, Homo sapiens
tagatttgaatgatgtaaagag

SEQ ID NO: 7337878 - DNA, 22 bp, Homo sapiens
tagatttaagaccctgaatttg

SEQ ID NO: 7337879 - DNA, 20 bp, Homo sapiens
tagatttcatacttctcttt

SEQ ID NO: 7337880 - DNA, 22 bp, Homo sapiens
tagatttcctcttcctcattcc

SEQ ID NO: 7337881 - DNA, 22 bp, Homo sapiens
tagatttcgctgcatctcaatc

SEQ ID NO: 7337882 - DNA, 22 bp, Homo sapiens
tagatttcaggctggcttgcgg

SEQ ID NO: 7337883 - DNA, 22 bp, Homo sapiens
cagggagcactgcgagcggcag

SEQ ID NO: 7337884 - DNA, 22 bp, Homo sapiens
cagggagcactgcgagcggcag

SEQ ID NO: 7337885 - DNA, 22 bp, Homo sapiens
cagggagcagcgctggggcctc

SEQ ID NO: 7337886 - DNA, 22 bp, Homo sapiens
cagggagcagcccctagaagta

SEQ ID NO: 7337887 - DNA, 22 bp, Homo sapiens
cagggtggggctggctatcaaa

SEQ ID NO: 7337888 - DNA, 22 bp, Homo sapiens
cagggtccggctgcctggctgt

SEQ ID NO: 7337889 - DNA, 22 bp, Homo sapiens
cagggtcatggcacctgcacgg

SEQ ID NO: 7337890 - DNA, 22 bp, Homo sapiens
caggggtgtttttggccaggag

SEQ ID NO: 7337891 - DNA, 22 bp, Homo sapiens
caggggtgtttttggccaggag

SEQ ID NO: 7337892 - DNA, 22 bp, Homo sapiens
cagggtagacagtaggtgtctg

SEQ ID NO: 7337893 - DNA, 22 bp, Homo sapiens
cagggtagggcaagggaacctg

SEQ ID NO: 7337894 - DNA, 22 bp, Homo sapiens
caggggtggctgcagcagaggt

SEQ ID NO: 7337895 - DNA, 22 bp, Homo sapiens
caggggtggctgcagcagaggt

SEQ ID NO: 7337896 - DNA, 22 bp, Homo sapiens
caggggtggctgcagcagaggt

SEQ ID NO: 7337897 - DNA, 22 bp, Homo sapiens
cagggggtggtccaggctgcgc

SEQ ID NO: 7337898 - DNA, 22 bp, Homo sapiens
cagggctgtggctttgtgctgt

SEQ ID NO: 7337899 - DNA, 22 bp, Homo sapiens
caggggcttaagtgacagaagg

SEQ ID NO: 7337900 - DNA, 22 bp, Homo sapiens
caggggctgtttgcctcaggcc

SEQ ID NO: 7337901 - DNA, 22 bp, Homo sapiens
caggggctgtttgcctcaggcc

SEQ ID NO: 7337902 - DNA, 22 bp, Homo sapiens
caggggcgggtaaaaggcctcc

SEQ ID NO: 7337903 - DNA, 22 bp, Homo sapiens
caggggcctgtcctggcttctg

SEQ ID NO: 7337904 - DNA, 22 bp, Homo sapiens
caggggggcaggagtcattgat

SEQ ID NO: 7337905 - DNA, 22 bp, Homo sapiens
caggggggcaggagtcattgat

SEQ ID NO: 7337906 - DNA, 22 bp, Homo sapiens
cagggggctgtggctgtccagt

SEQ ID NO: 7337907 - DNA, 22 bp, Homo sapiens
cagggggctcaaaggagagtgc

SEQ ID NO: 7337908 - DNA, 23 bp, Homo sapiens
cagggctggtagggaagagcgtg

SEQ ID NO: 7337909 - DNA, 22 bp, Homo sapiens
cagggctgtctccaaaggcccc

SEQ ID NO: 7337910 - DNA, 22 bp, Homo sapiens
cagggctgtaaattagtgctga

SEQ ID NO: 7337911 - DNA, 22 bp, Homo sapiens
tagggaaatatagatttagggc

SEQ ID NO: 7337912 - DNA, 22 bp, Homo sapiens
tagggaagctcctgattcccct

SEQ ID NO: 7337913 - DNA, 22 bp, Homo sapiens
tagggaaaagacttcactgttt

SEQ ID NO: 7337914 - DNA, 22 bp, Homo sapiens
cagggctgaaatcaaggtgtag

SEQ ID NO: 7337915 - DNA, 22 bp, Homo sapiens
cagggctcttccggagcaggga

SEQ ID NO: 7337916 - DNA, 22 bp, Homo sapiens
cagggctgaaatcaaggtgtag

SEQ ID NO: 7337917 - DNA, 20 bp, Homo sapiens
cagggctctgggcctggcct

SEQ ID NO: 7337918 - DNA, 21 bp, Homo sapiens
cctcatcaaactttcacttgc

SEQ ID NO: 7337919 - DNA, 22 bp, Homo sapiens
cctcagttttctcatctgtaaa

SEQ ID NO: 7337920 - DNA, 22 bp, Homo sapiens
cctcagtgtgcagcagcatctg

SEQ ID NO: 7337921 - DNA, 18 bp, Homo sapiens
cctcagggagagagacgc

SEQ ID NO: 7337922 - DNA, 22 bp, Homo sapiens
cctcagtgagtgtttccttctt

SEQ ID NO: 7337923 - DNA, 22 bp, Homo sapiens
cctcatgctgcatctctgaggt

SEQ ID NO: 7337924 - DNA, 22 bp, Homo sapiens
tggctctgaccaggtagaggag

SEQ ID NO: 7337925 - DNA, 22 bp, Homo sapiens
tggctctgagacacaggctctc

SEQ ID NO: 7337926 - DNA, 22 bp, Homo sapiens
tggctctggtgcgggctcctgc

SEQ ID NO: 7337927 - DNA, 22 bp, Homo sapiens
tggctctgtcaaactgcacaca

SEQ ID NO: 7337928 - DNA, 22 bp, Homo sapiens
tggctctggtgcgggctcctgc

SEQ ID NO: 7337929 - DNA, 22 bp, Homo sapiens
cctcagagttggaatcacattt

SEQ ID NO: 7337930 - DNA, 22 bp, Homo sapiens
cctcagaggttttcattctgta

SEQ ID NO: 7337931 - DNA, 22 bp, Homo sapiens
cctcagaggttttcattctgta

SEQ ID NO: 7337932 - DNA, 22 bp, Homo sapiens
cctcagagtaggtctcagctgt

SEQ ID NO: 7337933 - DNA, 22 bp, Homo sapiens
cctcagcagacacgcttctcac

SEQ ID NO: 7337934 - DNA, 22 bp, Homo sapiens
tggcccagcactccaagtaggg

SEQ ID NO: 7337935 - DNA, 20 bp, Homo sapiens
tggcccagcacgacgaggac

SEQ ID NO: 7337936 - DNA, 20 bp, Homo sapiens
tggcccagcacgacgaggac

SEQ ID NO: 7337937 - DNA, 22 bp, Homo sapiens
tggcccagagcactgctgggca

SEQ ID NO: 7337938 - DNA, 19 bp, Homo sapiens
tggcccagatggtcctggg

SEQ ID NO: 7337939 - DNA, 22 bp, Homo sapiens
cctcaggctagctactgtccct

SEQ ID NO: 7337940 - DNA, 22 bp, Homo sapiens
cctcaggcctgccagagcccca

SEQ ID NO: 7337941 - DNA, 22 bp, Homo sapiens
cctcaggctgggctgcccctgg

SEQ ID NO: 7337942 - DNA, 22 bp, Homo sapiens
cctcaggcttcgtcttccaccc

SEQ ID NO: 7337943 - DNA, 22 bp, Homo sapiens
cctcaggcttgtgagccttcag

SEQ ID NO: 7337944 - DNA, 22 bp, Homo sapiens
cctcaggcttgtgagccttcag

SEQ ID NO: 7337945 - DNA, 22 bp, Homo sapiens
cctcagggaatgggaggctggg

SEQ ID NO: 7337946 - DNA, 22 bp, Homo sapiens
cctcagggaatgggaggctggg

SEQ ID NO: 7337947 - DNA, 22 bp, Homo sapiens
cctcagggaatgggaggctggg

SEQ ID NO: 7337948 - DNA, 22 bp, Homo sapiens
tggcagaggctctgtgatgttg

SEQ ID NO: 7337949 - DNA, 19 bp, Homo sapiens
tggcagaggcagtttgtac

SEQ ID NO: 7337950 - DNA, 22 bp, Homo sapiens
tggcagaggaggctcagattga

SEQ ID NO: 7337951 - DNA, 22 bp, Homo sapiens
cctagccttcggcctacccatc

SEQ ID NO: 7337952 - DNA, 22 bp, Homo sapiens
tggcagggtgggcttcagcccc

SEQ ID NO: 7337953 - DNA, 23 bp, Homo sapiens
cctcagaggcctcatagtctggc

SEQ ID NO: 7337954 - DNA, 22 bp, Homo sapiens
cctcagaggtgtggcatctctg

SEQ ID NO: 7337955 - DNA, 19 bp, Homo sapiens
tggcagaggacaaggactt

SEQ ID NO: 7337956 - DNA, 22 bp, Homo sapiens
cccttctctttcactcactatt

SEQ ID NO: 7337957 - DNA, 22 bp, Homo sapiens
cccttcctcccaggcttctgtg

SEQ ID NO: 7337958 - DNA, 22 bp, Homo sapiens
cccttcctggagtaccctctgt

SEQ ID NO: 7337959 - DNA, 22 bp, Homo sapiens
tgggaagctgcattttaacaag

SEQ ID NO: 7337960 - DNA, 22 bp, Homo sapiens
cctctgctgctgttgagcaccg

SEQ ID NO: 7337961 - DNA, 22 bp, Homo sapiens
tgggaaggaactgcctttagct

SEQ ID NO: 7337962 - DNA, 22 bp, Homo sapiens
tgggaaggaactgcctttagct

SEQ ID NO: 7337963 - DNA, 22 bp, Homo sapiens
tgggaaggacagaacataattg

SEQ ID NO: 7337964 - DNA, 22 bp, Homo sapiens
tgggaaggacgtgtcagtggca

SEQ ID NO: 7337965 - DNA, 22 bp, Homo sapiens
tgggaaggacgtgtcagtggca

SEQ ID NO: 7337966 - DNA, 22 bp, Homo sapiens
tgggaaggataccttggaacat

SEQ ID NO: 7337967 - DNA, 22 bp, Homo sapiens
cctctgtggccttggaccagct

SEQ ID NO: 7337968 - DNA, 22 bp, Homo sapiens
cctctgtggccctgactctctt

SEQ ID NO: 7337969 - DNA, 22 bp, Homo sapiens
cctcttcctcaccatctacaac

SEQ ID NO: 7337970 - DNA, 19 bp, Homo sapiens
cctctgtgggagtcagtga

SEQ ID NO: 7337971 - DNA, 19 bp, Homo sapiens
cctctgtgggagtcagtga

SEQ ID NO: 7337972 - DNA, 21 bp, Homo sapiens
cctctgctcgggcatgcgttt

SEQ ID NO: 7337973 - DNA, 19 bp, Homo sapiens
cctctgcgctgtcctgctc

SEQ ID NO: 7337974 - DNA, 22 bp, Homo sapiens
cctctgctctggtccatgtgct

SEQ ID NO: 7337975 - DNA, 22 bp, Homo sapiens
cctctgcctgcacatcatcctg

SEQ ID NO: 7337976 - DNA, 20 bp, Homo sapiens
cctctgcctttctagtctga

SEQ ID NO: 7337977 - DNA, 20 bp, Homo sapiens
cctctgcctttctagtctga

SEQ ID NO: 7337978 - DNA, 18 bp, Homo sapiens
cctctgcctttgtagagc

SEQ ID NO: 7337979 - DNA, 22 bp, Homo sapiens
cctctgagtacagtgatggatt

SEQ ID NO: 7337980 - DNA, 18 bp, Homo sapiens
cctctgccatagccagca

SEQ ID NO: 7337981 - DNA, 18 bp, Homo sapiens
cctctgccatagccagca

SEQ ID NO: 7337982 - DNA, 22 bp, Homo sapiens
cctctgcccttttcctgtatca

SEQ ID NO: 7337983 - DNA, 20 bp, Homo sapiens
cctctgccccggggctgcta

SEQ ID NO: 7337984 - DNA, 17 bp, Homo sapiens
tggcttcaggctgagca

SEQ ID NO: 7337985 - DNA, 22 bp, Homo sapiens
tggcttcagtctcatcttggaa

SEQ ID NO: 7337986 - DNA, 22 bp, Homo sapiens
tggcttcagtttcccagtctgg

SEQ ID NO: 7337987 - DNA, 22 bp, Homo sapiens
tggcttcatcactcgggctgcc

SEQ ID NO: 7337988 - DNA, 22 bp, Homo sapiens
tggcttcatctgcagcactgcc

SEQ ID NO: 7337989 - DNA, 22 bp, Homo sapiens
tggctggcttgttcactgactg

SEQ ID NO: 7337990 - DNA, 22 bp, Homo sapiens
tggctggctgtcagtaggctgt

SEQ ID NO: 7337991 - DNA, 22 bp, Homo sapiens
tggctggctgtccagctgggca

SEQ ID NO: 7337992 - DNA, 19 bp, Homo sapiens
tggctctgtcgaaggcaca

SEQ ID NO: 7337993 - DNA, 17 bp, Homo sapiens
tggctctgtcctcagct

SEQ ID NO: 7337994 - DNA, 22 bp, Homo sapiens
tggctctgtcactgtgagctat

SEQ ID NO: 7337995 - DNA, 22 bp, Homo sapiens
tggctggctagtgggcaggatt

SEQ ID NO: 7337996 - DNA, 22 bp, Homo sapiens
tggctgctagccagagcttcag

SEQ ID NO: 7337997 - DNA, 22 bp, Homo sapiens
tggctggctggaccacacctgc

SEQ ID NO: 7337998 - DNA, 22 bp, Homo sapiens
cctgagctgcggggcagtgctc

SEQ ID NO: 7337999 - DNA, 22 bp, Homo sapiens
cctgagctccagtagcagccag

SEQ ID NO: 7338000 - DNA, 22 bp, Homo sapiens
tgggctgcttctcaaatgtctc

SEQ ID NO: 7338001 - DNA, 22 bp, Homo sapiens
tgggctgctgttacaggggctg

SEQ ID NO: 7338002 - DNA, 22 bp, Homo sapiens
tgggctgcttcctcagctgaga

SEQ ID NO: 7338003 - DNA, 22 bp, Homo sapiens
tgggctgcttctattggtggtc

SEQ ID NO: 7338004 - DNA, 22 bp, Homo sapiens
tgggcccaagagagtctccaac

SEQ ID NO: 7338005 - DNA, 22 bp, Homo sapiens
tgggcccaggtcctgggagaag

SEQ ID NO: 7338006 - DNA, 21 bp, Homo sapiens
tgggcccagttcccgctgggc

SEQ ID NO: 7338007 - DNA, 22 bp, Homo sapiens
tgggcccgcagctgctgctcca

SEQ ID NO: 7338008 - DNA, 23 bp, Homo sapiens
tgggccctggagtcgccagtctg

SEQ ID NO: 7338009 - DNA, 22 bp, Homo sapiens
tgggctgctgtctgcacatgct

SEQ ID NO: 7338010 - DNA, 22 bp, Homo sapiens
tgggctgctgcggtgctcttgg

SEQ ID NO: 7338011 - DNA, 22 bp, Homo sapiens
tgggctgctgagaatgagagag

SEQ ID NO: 7338012 - DNA, 22 bp, Homo sapiens
tgggctgctgtctgcacatgct

SEQ ID NO: 7338013 - DNA, 22 bp, Homo sapiens
tgggctgctgtctgcacatgct

SEQ ID NO: 7338014 - DNA, 18 bp, Homo sapiens
tgggctgcctggcctctg

SEQ ID NO: 7338015 - DNA, 18 bp, Homo sapiens
tgggctgcctggcctctg

SEQ ID NO: 7338016 - DNA, 22 bp, Homo sapiens
tgggctgcggataggcctcgga

SEQ ID NO: 7338017 - DNA, 22 bp, Homo sapiens
tgggctgcggataggcctcgga

SEQ ID NO: 7338018 - DNA, 22 bp, Homo sapiens
tgggcccttatgaagctcaaga

SEQ ID NO: 7338019 - DNA, 22 bp, Homo sapiens
tgggccctggtggccatgcctc

SEQ ID NO: 7338020 - DNA, 22 bp, Homo sapiens
tgggcccttatgaagctcaaga

SEQ ID NO: 7338021 - DNA, 23 bp, Homo sapiens
tgggagtgttgggatctctgctc

SEQ ID NO: 7338022 - DNA, 22 bp, Homo sapiens
cctgagcctgagtggtgcaggg

SEQ ID NO: 7338023 - DNA, 22 bp, Homo sapiens
cctgagccgagcgctctttctc

SEQ ID NO: 7338024 - DNA, 22 bp, Homo sapiens
cctcttctcaactccagccaga

SEQ ID NO: 7338025 - DNA, 19 bp, Homo sapiens
tgggagtggggaaggtcct

SEQ ID NO: 7338026 - DNA, 22 bp, Homo sapiens
cctcttctaggacgtccttgtg

SEQ ID NO: 7338027 - DNA, 22 bp, Homo sapiens
cctcttctaggtttcagcctgc

SEQ ID NO: 7338028 - DNA, 17 bp, Homo sapiens
cctcttcctctcagctg

SEQ ID NO: 7338029 - DNA, 17 bp, Homo sapiens
cctcttcctctcagctg

SEQ ID NO: 7338030 - DNA, 17 bp, Homo sapiens
cctcttcctctcagctg

SEQ ID NO: 7338031 - DNA, 22 bp, Homo sapiens
cccaggcatcccattaaggagc

SEQ ID NO: 7338032 - DNA, 22 bp, Homo sapiens
tgcccagcttcttacttttaaa

SEQ ID NO: 7338033 - DNA, 22 bp, Homo sapiens
tgcccagcctaaacttggcaag

SEQ ID NO: 7338034 - DNA, 22 bp, Homo sapiens
tgcccagccagtttatggtaat

SEQ ID NO: 7338035 - DNA, 22 bp, Homo sapiens
tgccagtgtgagtggagttctt

SEQ ID NO: 7338036 - DNA, 22 bp, Homo sapiens
tgccagtgtctgctatctgaga

SEQ ID NO: 7338037 - DNA, 22 bp, Homo sapiens
tgccagtgggtgtgcagagact

SEQ ID NO: 7338038 - DNA, 22 bp, Homo sapiens
tgccagtgtagtagctggttta

SEQ ID NO: 7338039 - DNA, 20 bp, Homo sapiens
tgccagtgtgtcaatttata

SEQ ID NO: 7338040 - DNA, 22 bp, Homo sapiens
tgccctggggagcccagccagg

SEQ ID NO: 7338041 - DNA, 21 bp, Homo sapiens
tgccctggggctcttccctca

SEQ ID NO: 7338042 - DNA, 22 bp, Homo sapiens
cccaggctagaaaggccaacaa

SEQ ID NO: 7338043 - DNA, 22 bp, Homo sapiens
cccaggagagaggccagttggc

SEQ ID NO: 7338044 - DNA, 22 bp, Homo sapiens
tgccagtgcttgtgtctgagca

SEQ ID NO: 7338045 - DNA, 22 bp, Homo sapiens
cccaggagataacgttcccaag

SEQ ID NO: 7338046 - DNA, 22 bp, Homo sapiens
tgccaggagtgtagagtggttt

SEQ ID NO: 7338047 - DNA, 22 bp, Homo sapiens
tgccaggagtcaggccaggcag

SEQ ID NO: 7338048 - DNA, 22 bp, Homo sapiens
tgcacagagcaggcaccagcgg

SEQ ID NO: 7338049 - DNA, 22 bp, Homo sapiens
tgcacagagcaggcaccagcgg

SEQ ID NO: 7338050 - DNA, 22 bp, Homo sapiens
tgcacagagagatgagacacgt

SEQ ID NO: 7338051 - DNA, 22 bp, Homo sapiens
tgcacagacatacacatatatg

SEQ ID NO: 7338052 - DNA, 20 bp, Homo sapiens
tgcacagacaatgagcccag

SEQ ID NO: 7338053 - DNA, 22 bp, Homo sapiens
tgccaggaggcggcttgggaaa

SEQ ID NO: 7338054 - DNA, 22 bp, Homo sapiens
tgccaggacaaggaccacatgg

SEQ ID NO: 7338055 - DNA, 22 bp, Homo sapiens
cccagggaaggcagatggagga

SEQ ID NO: 7338056 - DNA, 22 bp, Homo sapiens
tgccctggtgaagtgctctcct

SEQ ID NO: 7338057 - DNA, 22 bp, Homo sapiens
tgcctgtgtggggtctgccgcc

SEQ ID NO: 7338058 - DNA, 22 bp, Homo sapiens
tgcctgtgtggtctgcgcatta

SEQ ID NO: 7338059 - DNA, 22 bp, Homo sapiens
tgcctgtgtgaccacgggcaag

SEQ ID NO: 7338060 - DNA, 22 bp, Homo sapiens
cccagggacagctaggtggggc

SEQ ID NO: 7338061 - DNA, 22 bp, Homo sapiens
cccagggattataaaggtgaaa

SEQ ID NO: 7338062 - DNA, 22 bp, Homo sapiens
tgcctgttaagggtgtagatat

SEQ ID NO: 7338063 - DNA, 22 bp, Homo sapiens
tgcctgtgttgattactttgtc

SEQ ID NO: 7338064 - DNA, 22 bp, Homo sapiens
tgcctgttgcccacctgataaa

SEQ ID NO: 7338065 - DNA, 22 bp, Homo sapiens
cccaggggttcaaggctgcagt

SEQ ID NO: 7338066 - DNA, 22 bp, Homo sapiens
cccagggccctggacagctaca

SEQ ID NO: 7338067 - DNA, 22 bp, Homo sapiens
cccaggggttctagaccagctt

SEQ ID NO: 7338068 - DNA, 22 bp, Homo sapiens
cccaggggttcaaggctgcagt

SEQ ID NO: 7338069 - DNA, 22 bp, Homo sapiens
cccaggggttctagaccagctt

SEQ ID NO: 7338070 - DNA, 20 bp, Homo sapiens
cccaggggttgtggtgagga

SEQ ID NO: 7338071 - DNA, 22 bp, Homo sapiens
cccaggggttctgagcagcagc

SEQ ID NO: 7338072 - DNA, 20 bp, Homo sapiens
cccaggggttgtggtgagga

SEQ ID NO: 7338073 - DNA, 22 bp, Homo sapiens
cccaggggttctgagcagcagc

SEQ ID NO: 7338074 - DNA, 22 bp, Homo sapiens
cccagggtccctgctctctgtg

SEQ ID NO: 7338075 - DNA, 22 bp, Homo sapiens
cccagggttgcctgcctctgct

SEQ ID NO: 7338076 - DNA, 22 bp, Homo sapiens
cccatttaagtaatgataaact

SEQ ID NO: 7338077 - DNA, 22 bp, Homo sapiens
cccattccctttactgttgcat

SEQ ID NO: 7338078 - DNA, 22 bp, Homo sapiens
ccccacaactcatgttgaaact

SEQ ID NO: 7338079 - DNA, 22 bp, Homo sapiens
ccccacagtccgtgaggagcca

SEQ ID NO: 7338080 - DNA, 22 bp, Homo sapiens
ccccaccaccaaggctcagttt

SEQ ID NO: 7338081 - DNA, 22 bp, Homo sapiens
ccccacagtccgtgaggagcca

SEQ ID NO: 7338082 - DNA, 22 bp, Homo sapiens
ccccacagccgccagcagggag

SEQ ID NO: 7338083 - DNA, 22 bp, Homo sapiens
ccccacagcttgtggagagaat

SEQ ID NO: 7338084 - DNA, 22 bp, Homo sapiens
tgctggagcccaggcggccttt

SEQ ID NO: 7338085 - DNA, 22 bp, Homo sapiens
tgctggagcccaggcggccttt

SEQ ID NO: 7338086 - DNA, 22 bp, Homo sapiens
ccccaccaccaaggctcagttt

SEQ ID NO: 7338087 - DNA, 22 bp, Homo sapiens
ccccaccagcaccctctctatc

SEQ ID NO: 7338088 - DNA, 22 bp, Homo sapiens
cccgagcgggccctggggtgac

SEQ ID NO: 7338089 - DNA, 22 bp, Homo sapiens
ccccttctctgcaagcctgctc

SEQ ID NO: 7338090 - DNA, 22 bp, Homo sapiens
ccccttctggtcttcaatggtg

SEQ ID NO: 7338091 - DNA, 22 bp, Homo sapiens
cccctttctcccgcgactggcc

SEQ ID NO: 7338092 - DNA, 22 bp, Homo sapiens
ccccttctgtgtcctgtcagcc

SEQ ID NO: 7338093 - DNA, 22 bp, Homo sapiens
tgctggctttgcgagatgcatt

SEQ ID NO: 7338094 - DNA, 22 bp, Homo sapiens
tgctgtgtctttctgtgaaaag

SEQ ID NO: 7338095 - DNA, 22 bp, Homo sapiens
tgctgtgtggatgtgaagaatc

SEQ ID NO: 7338096 - DNA, 22 bp, Homo sapiens
tgctgtgttctcctgactcacc

SEQ ID NO: 7338097 - DNA, 22 bp, Homo sapiens
tgctgtgttctcctgactcacc

SEQ ID NO: 7338098 - DNA, 22 bp, Homo sapiens
tgctgtgttcaccaatatgtgt

SEQ ID NO: 7338099 - DNA, 22 bp, Homo sapiens
tgctgtgttcaccaatatgtgt

SEQ ID NO: 7338100 - DNA, 22 bp, Homo sapiens
tgctgtgttactgagatccggc

SEQ ID NO: 7338101 - DNA, 22 bp, Homo sapiens
tggaagggagctggaatttgga

SEQ ID NO: 7338102 - DNA, 22 bp, Homo sapiens
tggaagggagctggaatttgga

SEQ ID NO: 7338103 - DNA, 22 bp, Homo sapiens
tgctgtggttcccagagtggat

SEQ ID NO: 7338104 - DNA, 22 bp, Homo sapiens
tgctgtgtaaaaggtgattgaa

SEQ ID NO: 7338105 - DNA, 22 bp, Homo sapiens
tgctgtgtaaaaggtgattgaa

SEQ ID NO: 7338106 - DNA, 22 bp, Homo sapiens
tgctgtgctggcggcagaggcc

SEQ ID NO: 7338107 - DNA, 22 bp, Homo sapiens
ccctcctctccctaagagtcac

SEQ ID NO: 7338108 - DNA, 22 bp, Homo sapiens
tggaatgtgttctattttacag

SEQ ID NO: 7338109 - DNA, 22 bp, Homo sapiens
ccctcctctccctaagagtcac

SEQ ID NO: 7338110 - DNA, 22 bp, Homo sapiens
ccctcctttctaggcttccagc

SEQ ID NO: 7338111 - DNA, 22 bp, Homo sapiens
tggaatgtcagctacaagaggg

SEQ ID NO: 7338112 - DNA, 22 bp, Homo sapiens
tggaatgtgaacatacaaggta

SEQ ID NO: 7338113 - DNA, 22 bp, Homo sapiens
ccctctcctggctgcatggagc

SEQ ID NO: 7338114 - DNA, 22 bp, Homo sapiens
ccctctcctggctgcatggagc

SEQ ID NO: 7338115 - DNA, 22 bp, Homo sapiens
ccctctcctggctgcatggagc

SEQ ID NO: 7338116 - DNA, 18 bp, Homo sapiens
ccctctcctgctagtggg

SEQ ID NO: 7338117 - DNA, 22 bp, Homo sapiens
ccctctccctgcagaatgtggc

SEQ ID NO: 7338118 - DNA, 22 bp, Homo sapiens
ccctgaccatcccgcactgact

SEQ ID NO: 7338119 - DNA, 22 bp, Homo sapiens
ccctgacccaaaactgtcagaa

SEQ ID NO: 7338120 - DNA, 23 bp, Homo sapiens
ccctgagctggtccaggctcaac

SEQ ID NO: 7338121 - DNA, 16 bp, Homo sapiens
tggagcaggcaggatg

SEQ ID NO: 7338122 - DNA, 22 bp, Homo sapiens
tggagcaggacggggagtggta

SEQ ID NO: 7338123 - DNA, 22 bp, Homo sapiens
ccctgagcattcatgtgagctt

SEQ ID NO: 7338124 - DNA, 22 bp, Homo sapiens
cccagacataacagcagagagg

SEQ ID NO: 7338125 - DNA, 21 bp, Homo sapiens
cccagaagttccatggggggc

SEQ ID NO: 7338126 - DNA, 20 bp, Homo sapiens
cccagaagcttaacagagca

SEQ ID NO: 7338127 - DNA, 22 bp, Homo sapiens
tgcacacatgtttacaagcatc

SEQ ID NO: 7338128 - DNA, 23 bp, Homo sapiens
cccagaccttgtgctgcccttgg

SEQ ID NO: 7338129 - DNA, 22 bp, Homo sapiens
tgcacacatatgagcatgtgtg

SEQ ID NO: 7338130 - DNA, 22 bp, Homo sapiens
tgcacacatgtatgtatatgtg

SEQ ID NO: 7338131 - DNA, 22 bp, Homo sapiens
tgcacacattctatggggctga

SEQ ID NO: 7338132 - DNA, 22 bp, Homo sapiens
tgcacagaataatatatgttct

SEQ ID NO: 7338133 - DNA, 22 bp, Homo sapiens
tgcacagaatcattttcagctg

SEQ ID NO: 7338134 - DNA, 22 bp, Homo sapiens
tgcacacattaaggatacacag

SEQ ID NO: 7338135 - DNA, 22 bp, Homo sapiens
tgcacacattctatggggctga

SEQ ID NO: 7338136 - DNA, 22 bp, Homo sapiens
cccactgtggaagaaaggggag

SEQ ID NO: 7338137 - DNA, 18 bp, Homo sapiens
cccaccctggctcttagt

SEQ ID NO: 7338138 - DNA, 22 bp, Homo sapiens
cccactgttgcctcaaatatca

SEQ ID NO: 7338139 - DNA, 22 bp, Homo sapiens
cccactgtgttgctgttaatct

SEQ ID NO: 7338140 - DNA, 22 bp, Homo sapiens
cccactgtgttgcagtctagtg

SEQ ID NO: 7338141 - DNA, 22 bp, Homo sapiens
cccactgtttccctgaggctct

SEQ ID NO: 7338142 - DNA, 22 bp, Homo sapiens
cccacttcatgggcaggaagga

SEQ ID NO: 7338143 - DNA, 22 bp, Homo sapiens
tgcaaatagcctgatgaaagaa

SEQ ID NO: 7338144 - DNA, 22 bp, Homo sapiens
tgcaaatattccatgctgttca

SEQ ID NO: 7338145 - DNA, 21 bp, Homo sapiens
tgatttctgccaagttcacta

SEQ ID NO: 7338146 - DNA, 22 bp, Homo sapiens
tgatttcttccttgtcattaga

SEQ ID NO: 7338147 - DNA, 22 bp, Homo sapiens
tgatttctcttggcaatatgtt

SEQ ID NO: 7338148 - DNA, 22 bp, Homo sapiens
tgatttctcttggcaatatgtt

SEQ ID NO: 7338149 - DNA, 22 bp, Homo sapiens
tgatttctctccgttatttcag

SEQ ID NO: 7338150 - DNA, 22 bp, Homo sapiens
ccattgtaaagagtatactttg

SEQ ID NO: 7338151 - DNA, 22 bp, Homo sapiens
tgatttctcatattgttcaaaa

SEQ ID NO: 7338152 - DNA, 22 bp, Homo sapiens
tgatttctcatattgttcaaaa

SEQ ID NO: 7338153 - DNA, 22 bp, Homo sapiens
tgatttcttctaatttccatca

SEQ ID NO: 7338154 - DNA, 23 bp, Homo sapiens
tgattttaaaaagtaagttatca

SEQ ID NO: 7338155 - DNA, 23 bp, Homo sapiens
tgattttaaaaagtaagttatca

SEQ ID NO: 7338156 - DNA, 22 bp, Homo sapiens
ccattcacctcttcacgtgctc

SEQ ID NO: 7338157 - DNA, 21 bp, Homo sapiens
ccattgagaccatggaggagt

SEQ ID NO: 7338158 - DNA, 22 bp, Homo sapiens
ccattctgtccagaggaggaag

SEQ ID NO: 7338159 - DNA, 20 bp, Homo sapiens
ccattctgggtgcagtctgg

SEQ ID NO: 7338160 - DNA, 22 bp, Homo sapiens
ccattctgagtcttatgtcttt

SEQ ID NO: 7338161 - DNA, 22 bp, Homo sapiens
ccattctgacttcattgcctca

SEQ ID NO: 7338162 - DNA, 22 bp, Homo sapiens
ccattctgacacctaattctgt

SEQ ID NO: 7338163 - DNA, 19 bp, Homo sapiens
ccattcctctagaatttgg

SEQ ID NO: 7338164 - DNA, 22 bp, Homo sapiens
ccattccttcatcaaaaggcct

SEQ ID NO: 7338165 - DNA, 22 bp, Homo sapiens
ccattctgaacaattcttgtct

SEQ ID NO: 7338166 - DNA, 22 bp, Homo sapiens
ccattctgaagtgcaggctaag

SEQ ID NO: 7338167 - DNA, 22 bp, Homo sapiens
tgaggcagcctgcattaaagag

SEQ ID NO: 7338168 - DNA, 22 bp, Homo sapiens
tgaggcagcccactttccttag

SEQ ID NO: 7338169 - DNA, 22 bp, Homo sapiens
tgaggcagcattcttcaagaca

SEQ ID NO: 7338170 - DNA, 22 bp, Homo sapiens
ccagtcccgcatggtccagaat

SEQ ID NO: 7338171 - DNA, 22 bp, Homo sapiens
ccagtctcttccctcctgccag

SEQ ID NO: 7338172 - DNA, 22 bp, Homo sapiens
tgagggctgcttccagagctag

SEQ ID NO: 7338173 - DNA, 22 bp, Homo sapiens
tgagggctgtggaaggctaacc

SEQ ID NO: 7338174 - DNA, 22 bp, Homo sapiens
tgagggctgtggaaggctaacc

SEQ ID NO: 7338175 - DNA, 22 bp, Homo sapiens
tgagggctgcttccagagctag

SEQ ID NO: 7338176 - DNA, 22 bp, Homo sapiens
tgagggctgacaggaggacagc

SEQ ID NO: 7338177 - DNA, 22 bp, Homo sapiens
tgagggctccccgctgctgtgt

SEQ ID NO: 7338178 - DNA, 20 bp, Homo sapiens
tgagggctaaccagactctg

SEQ ID NO: 7338179 - DNA, 22 bp, Homo sapiens
tgagggctgacaggaggacagc

SEQ ID NO: 7338180 - DNA, 22 bp, Homo sapiens
tgagggcaaagtggtgctgagg

SEQ ID NO: 7338181 - DNA, 22 bp, Homo sapiens
tgagggcagagcactggggagc

SEQ ID NO: 7338182 - DNA, 20 bp, Homo sapiens
tgagggctaaccagactctg

SEQ ID NO: 7338183 - DNA, 22 bp, Homo sapiens
tgagggctaaattgtggcaggt

SEQ ID NO: 7338184 - DNA, 22 bp, Homo sapiens
tgagggctaaattgtggcaggt

SEQ ID NO: 7338185 - DNA, 22 bp, Homo sapiens
ccatggcctcgctctacgtggg

SEQ ID NO: 7338186 - DNA, 22 bp, Homo sapiens
tgaggtatgctgaactctgttt

SEQ ID NO: 7338187 - DNA, 22 bp, Homo sapiens
ccatgtggtctgtgtagcaact

SEQ ID NO: 7338188 - DNA, 22 bp, Homo sapiens
ccatgctgaccctgtgcaggca

SEQ ID NO: 7338189 - DNA, 22 bp, Homo sapiens
ccatgctccttaccactcactt

SEQ ID NO: 7338190 - DNA, 22 bp, Homo sapiens
ccatgctggagtccctagctgt

SEQ ID NO: 7338191 - DNA, 22 bp, Homo sapiens
ccatgctgggatgctccaagtg

SEQ ID NO: 7338192 - DNA, 22 bp, Homo sapiens
ccatgctggagtccctagctgt

SEQ ID NO: 7338193 - DNA, 22 bp, Homo sapiens
ccatgcctggactccactctca

SEQ ID NO: 7338194 - DNA, 19 bp, Homo sapiens
ccaggtggaactgaggtag

SEQ ID NO: 7338195 - DNA, 17 bp, Homo sapiens
ccaggtggaatcgtgga

SEQ ID NO: 7338196 - DNA, 22 bp, Homo sapiens
ccaggtggaaggtctgtgctct

SEQ ID NO: 7338197 - DNA, 22 bp, Homo sapiens
ccaggggctggtgctgagctgg

SEQ ID NO: 7338198 - DNA, 22 bp, Homo sapiens
ccaggggctggtgctgagctgg

SEQ ID NO: 7338199 - DNA, 22 bp, Homo sapiens
ccagggggcttggtgaggccat

SEQ ID NO: 7338200 - DNA, 22 bp, Homo sapiens
ccaggggctctcagggtgtgtg

SEQ ID NO: 7338201 - DNA, 22 bp, Homo sapiens
ccaggggctctcagggtgtgtg

SEQ ID NO: 7338202 - DNA, 22 bp, Homo sapiens
ccaggggcctgtgaaggtgccc

SEQ ID NO: 7338203 - DNA, 22 bp, Homo sapiens
ccaggggctctcagggtgtgtg

SEQ ID NO: 7338204 - DNA, 22 bp, Homo sapiens
ccaggggctggtgctgagctgg

SEQ ID NO: 7338205 - DNA, 22 bp, Homo sapiens
ccaggggctgcagatccatggt

SEQ ID NO: 7338206 - DNA, 22 bp, Homo sapiens
tgagaaggcctgtgtgacaggg

SEQ ID NO: 7338207 - DNA, 22 bp, Homo sapiens
tgagaaggcctgtgtgacaggg

SEQ ID NO: 7338208 - DNA, 19 bp, Homo sapiens
tgagaaggcagtggggagc

SEQ ID NO: 7338209 - DNA, 22 bp, Homo sapiens
tgagaataacagcctgtgttcc

SEQ ID NO: 7338210 - DNA, 22 bp, Homo sapiens
tgaggcagatatttattgggtt

SEQ ID NO: 7338211 - DNA, 22 bp, Homo sapiens
tgaggcagcaattgtattgtat

SEQ ID NO: 7338212 - DNA, 22 bp, Homo sapiens
tgaggcagcaattgattattca

SEQ ID NO: 7338213 - DNA, 22 bp, Homo sapiens
tgaggcagagtaagatacatga

SEQ ID NO: 7338214 - DNA, 22 bp, Homo sapiens
tgaggcagaaattcctgttttc

SEQ ID NO: 7338215 - DNA, 22 bp, Homo sapiens
tgaggactacctggggtgggag

SEQ ID NO: 7338216 - DNA, 22 bp, Homo sapiens
ccaggtgtgccagcagggactg

SEQ ID NO: 7338217 - DNA, 22 bp, Homo sapiens
ccaggtgtgctctgcagtggat

SEQ ID NO: 7338218 - DNA, 22 bp, Homo sapiens
tgaggacatttatcttggcgca

SEQ ID NO: 7338219 - DNA, 20 bp, Homo sapiens
tgagacccgctgacaagttc

SEQ ID NO: 7338220 - DNA, 22 bp, Homo sapiens
ccaggtgtaggacaccaaggga

SEQ ID NO: 7338221 - DNA, 22 bp, Homo sapiens
tgaatgcaagtcacacatttct

SEQ ID NO: 7338222 - DNA, 22 bp, Homo sapiens
tgaatgcaagaaggaacatgaa

SEQ ID NO: 7338223 - DNA, 22 bp, Homo sapiens
ccaggctggagtgcagtagtgt

SEQ ID NO: 7338224 - DNA, 22 bp, Homo sapiens
ccaggctggagtgcagtagtgt

SEQ ID NO: 7338225 - DNA, 22 bp, Homo sapiens
ccaggctggagtgcagtagtgt

SEQ ID NO: 7338226 - DNA, 22 bp, Homo sapiens
ccaggctggagtgcagtggcac

SEQ ID NO: 7338227 - DNA, 22 bp, Homo sapiens
ccaggctggagtgcagtggcac

SEQ ID NO: 7338228 - DNA, 22 bp, Homo sapiens
ccaggctggagtgcagtggcac

SEQ ID NO: 7338229 - DNA, 20 bp, Homo sapiens
ccaggctggcaaatgggggc

SEQ ID NO: 7338230 - DNA, 22 bp, Homo sapiens
ccaggctggattttgcagttca

SEQ ID NO: 7338231 - DNA, 20 bp, Homo sapiens
ccaggctggcaaatgggggc

SEQ ID NO: 7338232 - DNA, 21 bp, Homo sapiens
ccaggctggccatggtattga

SEQ ID NO: 7338233 - DNA, 21 bp, Homo sapiens
ccaggctggccatggtattga

SEQ ID NO: 7338234 - DNA, 22 bp, Homo sapiens
ccaggctggagtgtagtcgcat

SEQ ID NO: 7338235 - DNA, 22 bp, Homo sapiens
ccaggctggagtgtagtcgcat

SEQ ID NO: 7338236 - DNA, 22 bp, Homo sapiens
ccaggctggattttgcagttca

SEQ ID NO: 7338237 - DNA, 22 bp, Homo sapiens
ccaggctggagtgtagtcgcat

SEQ ID NO: 7338238 - DNA, 22 bp, Homo sapiens
ccaggctggattttgcagttca

SEQ ID NO: 7338239 - DNA, 22 bp, Homo sapiens
tgagaaaaggttgagatgataa

SEQ ID NO: 7338240 - DNA, 22 bp, Homo sapiens
tgagaaaagtacatggagaagc

SEQ ID NO: 7338241 - DNA, 22 bp, Homo sapiens
tgacagttaaggtatacattca

SEQ ID NO: 7338242 - DNA, 22 bp, Homo sapiens
tgacagtgtcagtttcctaata

SEQ ID NO: 7338243 - DNA, 22 bp, Homo sapiens
ccaggggaaacagggagcactc

SEQ ID NO: 7338244 - DNA, 21 bp, Homo sapiens
ccaggggcaaattgtcgtttc

SEQ ID NO: 7338245 - DNA, 21 bp, Homo sapiens
ccaggggcaaattgtcgtttc

SEQ ID NO: 7338246 - DNA, 22 bp, Homo sapiens
tgacaatagcgatttatcttgc

SEQ ID NO: 7338247 - DNA, 19 bp, Homo sapiens
tgacaatgggcacctgtgt

SEQ ID NO: 7338248 - DNA, 22 bp, Homo sapiens
tgacaatggggcacatggaaag

SEQ ID NO: 7338249 - DNA, 22 bp, Homo sapiens
ccaggggaaacagggagcactc

SEQ ID NO: 7338250 - DNA, 22 bp, Homo sapiens
ccagggcttcccacgtgccctg

SEQ ID NO: 7338251 - DNA, 18 bp, Homo sapiens
tctggaacaacttcatgt

SEQ ID NO: 7338252 - DNA, 22 bp, Homo sapiens
tctgctcaatactgctcatgaa

SEQ ID NO: 7338253 - DNA, 22 bp, Homo sapiens
tctgctcacatggctccatgca

SEQ ID NO: 7338254 - DNA, 22 bp, Homo sapiens
tctgcttctcctacttcatggg

SEQ ID NO: 7338255 - DNA, 22 bp, Homo sapiens
tctgcttctgtgaaggcagtct

SEQ ID NO: 7338256 - DNA, 23 bp, Homo sapiens
tctgcttctgtattttttcccat

SEQ ID NO: 7338257 - DNA, 22 bp, Homo sapiens
tctgctttatggctcagagact

SEQ ID NO: 7338258 - DNA, 22 bp, Homo sapiens
tctgctttcaaattcacttagt

SEQ ID NO: 7338259 - DNA, 22 bp, Homo sapiens
ccagagagaaaatggagggcca

SEQ ID NO: 7338260 - DNA, 22 bp, Homo sapiens
ccagagagaaaatggagggcca

SEQ ID NO: 7338261 - DNA, 22 bp, Homo sapiens
ccagagagaaatggatttgagt

SEQ ID NO: 7338262 - DNA, 22 bp, Homo sapiens
tctgctacaaatacgctgggag

SEQ ID NO: 7338263 - DNA, 22 bp, Homo sapiens
tctgctacagggaaggacccct

SEQ ID NO: 7338264 - DNA, 22 bp, Homo sapiens
tctcagagaagtgatgagcaat

SEQ ID NO: 7338265 - DNA, 22 bp, Homo sapiens
tctcagagaacagttggtgctt

SEQ ID NO: 7338266 - DNA, 23 bp, Homo sapiens
tctcagacccgaagccagaggaa

SEQ ID NO: 7338267 - DNA, 22 bp, Homo sapiens
tctcagagaaatgtgtcaccat

SEQ ID NO: 7338268 - DNA, 19 bp, Homo sapiens
tctcagactgtgcttctgt

SEQ ID NO: 7338269 - DNA, 22 bp, Homo sapiens
tctcagacatgtaatctctacc

SEQ ID NO: 7338270 - DNA, 22 bp, Homo sapiens
ccagctgctatcatgccatttc

SEQ ID NO: 7338271 - DNA, 22 bp, Homo sapiens
ccagctgctgtgaggaccacag

SEQ ID NO: 7338272 - DNA, 22 bp, Homo sapiens
tctggaggcaggctgccaggat

SEQ ID NO: 7338273 - DNA, 22 bp, Homo sapiens
tctggctcaggtcagacaggga

SEQ ID NO: 7338274 - DNA, 22 bp, Homo sapiens
tctggctcagggctctgaggga

SEQ ID NO: 7338275 - DNA, 18 bp, Homo sapiens
tctggctcaggactgaac

SEQ ID NO: 7338276 - DNA, 22 bp, Homo sapiens
tctggctcaggagctgtgttca

SEQ ID NO: 7338277 - DNA, 22 bp, Homo sapiens
tctggctcacttcaggcttcac

SEQ ID NO: 7338278 - DNA, 22 bp, Homo sapiens
tctggctcaaaatacgtactct

SEQ ID NO: 7338279 - DNA, 22 bp, Homo sapiens
ccaggacagggagacgggagcc

SEQ ID NO: 7338280 - DNA, 22 bp, Homo sapiens
ccaggaccacacgacaggagag

SEQ ID NO: 7338281 - DNA, 22 bp, Homo sapiens
ccaggaccctgcaaaccctgtt

SEQ ID NO: 7338282 - DNA, 22 bp, Homo sapiens
ccaggactgcagggggcgagga

SEQ ID NO: 7338283 - DNA, 22 bp, Homo sapiens
ccaggctgagcatgattggagc

SEQ ID NO: 7338284 - DNA, 22 bp, Homo sapiens
ccaggctgagcatgattggagc

SEQ ID NO: 7338285 - DNA, 22 bp, Homo sapiens
ccaggctgaatatgttccaggg

SEQ ID NO: 7338286 - DNA, 22 bp, Homo sapiens
tctttggctatgatttactgtt

SEQ ID NO: 7338287 - DNA, 22 bp, Homo sapiens
ccaggctgctgttggtgtccgc

SEQ ID NO: 7338288 - DNA, 22 bp, Homo sapiens
ccaggctgctgttggtgtccgc

SEQ ID NO: 7338289 - DNA, 22 bp, Homo sapiens
ccaggctggagtgcaatggtgc

SEQ ID NO: 7338290 - DNA, 22 bp, Homo sapiens
ccaggctggagtgcaatggtgc

SEQ ID NO: 7338291 - DNA, 22 bp, Homo sapiens
ccaggctggagtgcaatggcgt

SEQ ID NO: 7338292 - DNA, 22 bp, Homo sapiens
ccaggctggagtgcaatggcgt

SEQ ID NO: 7338293 - DNA, 22 bp, Homo sapiens
ccaggctctgtgtgggctagag

SEQ ID NO: 7338294 - DNA, 23 bp, Homo sapiens
ccaggctctttcacctgctattc

SEQ ID NO: 7338295 - DNA, 23 bp, Homo sapiens
ccaggctctttcacctgctattc

SEQ ID NO: 7338296 - DNA, 22 bp, Homo sapiens
ccaggctgaatatgttccaggg

SEQ ID NO: 7338297 - DNA, 22 bp, Homo sapiens
ccaggctgaatatgttccaggg

SEQ ID NO: 7338298 - DNA, 22 bp, Homo sapiens
ccaggcctggaccatgccaggg

SEQ ID NO: 7338299 - DNA, 22 bp, Homo sapiens
ccaggcctggaccatgccaggg

SEQ ID NO: 7338300 - DNA, 22 bp, Homo sapiens
tctttcttcagccctgtaagat

SEQ ID NO: 7338301 - DNA, 22 bp, Homo sapiens
ccaggcctgcattccctctcag

SEQ ID NO: 7338302 - DNA, 22 bp, Homo sapiens
ccaggcctgcatctgctgcgca

SEQ ID NO: 7338303 - DNA, 22 bp, Homo sapiens
ccaggcctgcattccctctcag

SEQ ID NO: 7338304 - DNA, 22 bp, Homo sapiens
tctttgaaacaccctaaccttt

SEQ ID NO: 7338305 - DNA, 22 bp, Homo sapiens
tctttctttatcacctgatatg

SEQ ID NO: 7338306 - DNA, 22 bp, Homo sapiens
tctttcaatccattcatatgtc

SEQ ID NO: 7338307 - DNA, 22 bp, Homo sapiens
tctttcaatgagcattctttcc

SEQ ID NO: 7338308 - DNA, 22 bp, Homo sapiens
ccaggcccagggtactgaccaa

SEQ ID NO: 7338309 - DNA, 22 bp, Homo sapiens
ccaggcccaccttggccactta

SEQ ID NO: 7338310 - DNA, 22 bp, Homo sapiens
ccaggccattcccagagttgct

SEQ ID NO: 7338311 - DNA, 18 bp, Homo sapiens
ccaggccatgaacctctg

SEQ ID NO: 7338312 - DNA, 18 bp, Homo sapiens
ccaggccatgaacctctg

SEQ ID NO: 7338313 - DNA, 22 bp, Homo sapiens
ccaggccagtgtttggtccagg

SEQ ID NO: 7338314 - DNA, 19 bp, Homo sapiens
ccaggccatcccagttccc

SEQ ID NO: 7338315 - DNA, 21 bp, Homo sapiens
ccaggccaggcctacggggat

SEQ ID NO: 7338316 - DNA, 22 bp, Homo sapiens
ccaggccaggagagcgaggttt

SEQ ID NO: 7338317 - DNA, 22 bp, Homo sapiens
ccaggccagggctgcagcgagc

SEQ ID NO: 7338318 - DNA, 22 bp, Homo sapiens
ccaggaggttgaggctgcagtg

SEQ ID NO: 7338319 - DNA, 22 bp, Homo sapiens
ccaggaggttgaggctgcagtg

SEQ ID NO: 7338320 - DNA, 22 bp, Homo sapiens
ccaggaggttgaggctgcagtg

SEQ ID NO: 7338321 - DNA, 22 bp, Homo sapiens
ccaggagggaccgcggcatccc

SEQ ID NO: 7338322 - DNA, 22 bp, Homo sapiens
ccaggcaaaacagatttgtatg

SEQ ID NO: 7338323 - DNA, 22 bp, Homo sapiens
ccaggcaacggagcccactgcc

SEQ ID NO: 7338324 - DNA, 22 bp, Homo sapiens
tcttcagagatgtaacatatgg

SEQ ID NO: 7338325 - DNA, 22 bp, Homo sapiens
tcttcagacttccggaaacgtg

SEQ ID NO: 7338326 - DNA, 22 bp, Homo sapiens
tcttcagaggagctgaatatat

SEQ ID NO: 7338327 - DNA, 22 bp, Homo sapiens
tcttcagaaaattatcacttgt

SEQ ID NO: 7338328 - DNA, 22 bp, Homo sapiens
tcttcagaagatcacatcagtg

SEQ ID NO: 7338329 - DNA, 22 bp, Homo sapiens
tcttcagagtgagcagtgtcat

SEQ ID NO: 7338330 - DNA, 22 bp, Homo sapiens
ccaggccagcaggcacacctgc

SEQ ID NO: 7338331 - DNA, 22 bp, Homo sapiens
ccaggccagagtgcagtggcac

SEQ ID NO: 7338332 - DNA, 22 bp, Homo sapiens
ccaggccagagtgcagtggcac

SEQ ID NO: 7338333 - DNA, 22 bp, Homo sapiens
ccaggccagagtgcagtggcac

SEQ ID NO: 7338334 - DNA, 22 bp, Homo sapiens
ccaggccagcctggagcatggc

SEQ ID NO: 7338335 - DNA, 22 bp, Homo sapiens
ccaggccagcctggagcatggc

SEQ ID NO: 7338336 - DNA, 22 bp, Homo sapiens
ccaggccagcgctggctggagg

SEQ ID NO: 7338337 - DNA, 21 bp, Homo sapiens
tcttcccattatgttccaatt

SEQ ID NO: 7338338 - DNA, 22 bp, Homo sapiens
ttgcaagaaataatcgaataga

SEQ ID NO: 7338339 - DNA, 23 bp, Homo sapiens
ttgcaaatttcagttagttcatg

SEQ ID NO: 7338340 - DNA, 22 bp, Homo sapiens
ttgcaaattcgtcactgttaaa

SEQ ID NO: 7338341 - DNA, 22 bp, Homo sapiens
ttggggtgttcagggtacttct

SEQ ID NO: 7338342 - DNA, 22 bp, Homo sapiens
ttgtctggtcaaatcacttgta

SEQ ID NO: 7338343 - DNA, 22 bp, Homo sapiens
ttgtctgcttgatgccaagcat

SEQ ID NO: 7338344 - DNA, 22 bp, Homo sapiens
ttgtgaatagtgccgctataaa

SEQ ID NO: 7338345 - DNA, 22 bp, Homo sapiens
ttggtttagtacctgccagcgt

SEQ ID NO: 7338346 - DNA, 22 bp, Homo sapiens
ttggttcagtaggcatgcctgg

SEQ ID NO: 7338347 - DNA, 23 bp, Homo sapiens
ttggtttacaggaataagcaggg

SEQ ID NO: 7338348 - DNA, 22 bp, Homo sapiens
ttgtctaaggaggtagaggact

SEQ ID NO: 7338349 - DNA, 22 bp, Homo sapiens
ttgtctaatgagctccacttca

SEQ ID NO: 7338350 - DNA, 22 bp, Homo sapiens
ttgtcgggcttacgcagggcca

SEQ ID NO: 7338351 - DNA, 22 bp, Homo sapiens
ttgtccttggatgaagctggga

SEQ ID NO: 7338352 - DNA, 22 bp, Homo sapiens
ttgtccttgtgatagtttgctg

SEQ ID NO: 7338353 - DNA, 23 bp, Homo sapiens
ttgtaaaacagtgtgacggttcc

SEQ ID NO: 7338354 - DNA, 22 bp, Homo sapiens
ttgtgtttctggccaagatgga

SEQ ID NO: 7338355 - DNA, 22 bp, Homo sapiens
ttgtgtttctgtgatatgtaaa

SEQ ID NO: 7338356 - DNA, 22 bp, Homo sapiens
ttgtgtttgatgctgacacgca

SEQ ID NO: 7338357 - DNA, 22 bp, Homo sapiens
ttgtgtttctggccaagatgga

SEQ ID NO: 7338358 - DNA, 22 bp, Homo sapiens
ttgtgtttctgtgatatgtaaa

SEQ ID NO: 7338359 - DNA, 22 bp, Homo sapiens
ttgtgtgtttgtagaaaatcca

SEQ ID NO: 7338360 - DNA, 22 bp, Homo sapiens
ttgtgtgtttgtagaaaatcca

SEQ ID NO: 7338361 - DNA, 22 bp, Homo sapiens
ttgtgtgtttgtagaaaatcca

SEQ ID NO: 7338362 - DNA, 22 bp, Homo sapiens
ttgtgttaaggtgcatctagtg

SEQ ID NO: 7338363 - DNA, 22 bp, Homo sapiens
ttgtgtgtgtaactttatgaga

SEQ ID NO: 7338364 - DNA, 22 bp, Homo sapiens
ttgtgtgtgtaactttatgaga

SEQ ID NO: 7338365 - DNA, 19 bp, Homo sapiens
ttgtgactggctctgcata

SEQ ID NO: 7338366 - DNA, 19 bp, Homo sapiens
ttgtgtgtcagtcagagtt

SEQ ID NO: 7338367 - DNA, 19 bp, Homo sapiens
ttgtgtgtcagtcagagtt

SEQ ID NO: 7338368 - DNA, 19 bp, Homo sapiens
ttgtgtgtcagtcagagtt

SEQ ID NO: 7338369 - DNA, 22 bp, Homo sapiens
ttgtgtgtcttcttcactgccc

SEQ ID NO: 7338370 - DNA, 22 bp, Homo sapiens
ttgtgtgtcttcttcactgccc

SEQ ID NO: 7338371 - DNA, 22 bp, Homo sapiens
ttgtgtgtcttcttcactgccc

SEQ ID NO: 7338372 - DNA, 22 bp, Homo sapiens
ttgtgtgtgagccttcaccaca

SEQ ID NO: 7338373 - DNA, 22 bp, Homo sapiens
ttgtgtgtgagccttcaccaca

SEQ ID NO: 7338374 - DNA, 22 bp, Homo sapiens
ttgtttaaagaacttctgactt

SEQ ID NO: 7338375 - DNA, 22 bp, Homo sapiens
ttgtttaaagaacttctgactt

SEQ ID NO: 7338376 - DNA, 22 bp, Homo sapiens
ttgttagtttcagacacttgcc

SEQ ID NO: 7338377 - DNA, 22 bp, Homo sapiens
ttgtttcattttggctaaactg

SEQ ID NO: 7338378 - DNA, 20 bp, Homo sapiens
ttgtttaaaggtgaagaggc

SEQ ID NO: 7338379 - DNA, 20 bp, Homo sapiens
ttgtttaaaggtgaagaggc

SEQ ID NO: 7338380 - DNA, 22 bp, Homo sapiens
ttgtttcattttggctaaactg

SEQ ID NO: 7338381 - DNA, 22 bp, Homo sapiens
ttgttaaaaatagatttccagg

SEQ ID NO: 7338382 - DNA, 22 bp, Homo sapiens
ttgttttattctgcaatttccc

SEQ ID NO: 7338383 - DNA, 22 bp, Homo sapiens
ttgttttattctgcaatttccc

SEQ ID NO: 7338384 - DNA, 22 bp, Homo sapiens
ttgttttagtaggtacactgag

SEQ ID NO: 7338385 - DNA, 22 bp, Homo sapiens
ttgttttatctttctacagact

SEQ ID NO: 7338386 - DNA, 22 bp, Homo sapiens
ttgttttaagccagtctgccta

SEQ ID NO: 7338387 - DNA, 22 bp, Homo sapiens
ttgtttgtgctatttaatgtag

SEQ ID NO: 7338388 - DNA, 22 bp, Homo sapiens
ttgtttgtgctatttaatgtag

SEQ ID NO: 7338389 - DNA, 22 bp, Homo sapiens
ttgtttgtgctatttaatgtag

SEQ ID NO: 7338390 - DNA, 17 bp, Homo sapiens
ttgtttgttcttgcccc

SEQ ID NO: 7338391 - DNA, 17 bp, Homo sapiens
ttgtttgttcttgcccc

SEQ ID NO: 7338392 - DNA, 22 bp, Homo sapiens
ttgttttaacgactcagcttgt

SEQ ID NO: 7338393 - DNA, 22 bp, Homo sapiens
ttgttttaacctagtgtttatg

SEQ ID NO: 7338394 - DNA, 22 bp, Homo sapiens
ttgtttcttcaggcttttagga

SEQ ID NO: 7338395 - DNA, 20 bp, Homo sapiens
ttgtttctgctattttctaa

SEQ ID NO: 7338396 - DNA, 22 bp, Homo sapiens
ttgtttcttcaggcttttagga

SEQ ID NO: 7338397 - DNA, 23 bp, Homo sapiens
ttgtttctttgtattgtctctat

SEQ ID NO: 7338398 - DNA, 22 bp, Homo sapiens
ttgtttgaataacagacaaatt

SEQ ID NO: 7338399 - DNA, 22 bp, Homo sapiens
ttgtttgcccacaactattaag

SEQ ID NO: 7338400 - DNA, 22 bp, Homo sapiens
ttgtttgtcataatatcattac

SEQ ID NO: 7338401 - DNA, 22 bp, Homo sapiens
ttgtttgtcataatatcattac

SEQ ID NO: 7338402 - DNA, 22 bp, Homo sapiens
ttgtttgtatgctgagaagaat

SEQ ID NO: 7338403 - DNA, 22 bp, Homo sapiens
ttgtttgtaaggctcttagaat

SEQ ID NO: 7338404 - DNA, 22 bp, Homo sapiens
tttaattctggcataatagctc

SEQ ID NO: 7338405 - DNA, 22 bp, Homo sapiens
tttaattttcctcttcctggag

SEQ ID NO: 7338406 - DNA, 22 bp, Homo sapiens
tttaaacatatctgttgaggga

SEQ ID NO: 7338407 - DNA, 22 bp, Homo sapiens
tttaaacaaataggattgccta

SEQ ID NO: 7338408 - DNA, 22 bp, Homo sapiens
tttaaaatcagatgggagttgg

SEQ ID NO: 7338409 - DNA, 22 bp, Homo sapiens
tttactttctcaagtatatagg

SEQ ID NO: 7338410 - DNA, 22 bp, Homo sapiens
tttactgtttacagctaatgca

SEQ ID NO: 7338411 - DNA, 22 bp, Homo sapiens
tttactgtttacagctaatgca

SEQ ID NO: 7338412 - DNA, 22 bp, Homo sapiens
tttactgtctcagagagacaaa

SEQ ID NO: 7338413 - DNA, 22 bp, Homo sapiens
tttactgtgtaaggggaatgtt

SEQ ID NO: 7338414 - DNA, 22 bp, Homo sapiens
tttacaactttctgttctgtat

SEQ ID NO: 7338415 - DNA, 22 bp, Homo sapiens
tttacaacgttcctggtgctaa

SEQ ID NO: 7338416 - DNA, 22 bp, Homo sapiens
tttacaagtacacctaacagct

SEQ ID NO: 7338417 - DNA, 22 bp, Homo sapiens
tttacaaggcagaactgattaa

SEQ ID NO: 7338418 - DNA, 22 bp, Homo sapiens
tttactaacaccatacatgctg

SEQ ID NO: 7338419 - DNA, 22 bp, Homo sapiens
tttacgtgaaggtgttatgtgt

SEQ ID NO: 7338420 - DNA, 22 bp, Homo sapiens
tttattaattagtgacccaatg

SEQ ID NO: 7338421 - DNA, 22 bp, Homo sapiens
tttatttgtcttgccatttagt

SEQ ID NO: 7338422 - DNA, 22 bp, Homo sapiens
tttatttgaatcaggggagaat

SEQ ID NO: 7338423 - DNA, 22 bp, Homo sapiens
tttattaaaactgttggctctg

SEQ ID NO: 7338424 - DNA, 21 bp, Homo sapiens
tttattaacaactgtggacgt

SEQ ID NO: 7338425 - DNA, 22 bp, Homo sapiens
tttattaagatgcgaatgctga

SEQ ID NO: 7338426 - DNA, 22 bp, Homo sapiens
tttattaagatgcgaatgctga

SEQ ID NO: 7338427 - DNA, 22 bp, Homo sapiens
tttattaatgtagcatccatgg

SEQ ID NO: 7338428 - DNA, 22 bp, Homo sapiens
tttatagtcgtctcagtaataa

SEQ ID NO: 7338429 - DNA, 22 bp, Homo sapiens
tttatagtcgtctcagtaataa

SEQ ID NO: 7338430 - DNA, 23 bp, Homo sapiens
tttatagcagcatgatttatagt

SEQ ID NO: 7338431 - DNA, 23 bp, Homo sapiens
tttatagcagcatgatttataat

SEQ ID NO: 7338432 - DNA, 22 bp, Homo sapiens
tttatataacagagactgctat

SEQ ID NO: 7338433 - DNA, 22 bp, Homo sapiens
tttatataacagagactgctat

SEQ ID NO: 7338434 - DNA, 22 bp, Homo sapiens
tttagtttgatgttctactcct

SEQ ID NO: 7338435 - DNA, 22 bp, Homo sapiens
tttagttttgatgaaaatgcca

SEQ ID NO: 7338436 - DNA, 22 bp, Homo sapiens
tttatacttcataatgtctatt

SEQ ID NO: 7338437 - DNA, 22 bp, Homo sapiens
tttatagatgtctgtattataa

SEQ ID NO: 7338438 - DNA, 22 bp, Homo sapiens
tttcttgtttcatggtgtctca

SEQ ID NO: 7338439 - DNA, 22 bp, Homo sapiens
tttctttatcatagcatctttg

SEQ ID NO: 7338440 - DNA, 22 bp, Homo sapiens
tttcttctctgattaaggctca

SEQ ID NO: 7338441 - DNA, 22 bp, Homo sapiens
tttcttgtctttagtatctggc

SEQ ID NO: 7338442 - DNA, 22 bp, Homo sapiens
tttcttctaagatttcaaacta

SEQ ID NO: 7338443 - DNA, 22 bp, Homo sapiens
tttcttcctggattcctacttc

SEQ ID NO: 7338444 - DNA, 22 bp, Homo sapiens
tttcttctcgacaccttatccc

SEQ ID NO: 7338445 - DNA, 22 bp, Homo sapiens
tttcttatgagcaagactctat

SEQ ID NO: 7338446 - DNA, 21 bp, Homo sapiens
tttcttcactttgccccatgt

SEQ ID NO: 7338447 - DNA, 22 bp, Homo sapiens
tttcttcagagagagctttccc

SEQ ID NO: 7338448 - DNA, 22 bp, Homo sapiens
tttcttccccaagtgaatttta

SEQ ID NO: 7338449 - DNA, 22 bp, Homo sapiens
tttcttcccaagcagtttcaga

SEQ ID NO: 7338450 - DNA, 22 bp, Homo sapiens
tttcttcatagaccttgtcttg

SEQ ID NO: 7338451 - DNA, 23 bp, Homo sapiens
tttctgttgggtatatatccaag

SEQ ID NO: 7338452 - DNA, 23 bp, Homo sapiens
tttctgttgggtatatatccaag

SEQ ID NO: 7338453 - DNA, 21 bp, Homo sapiens
tttcttatctgtaaagtggga

SEQ ID NO: 7338454 - DNA, 22 bp, Homo sapiens
tttctgttgtacttaaactagg

SEQ ID NO: 7338455 - DNA, 22 bp, Homo sapiens
tttctgtattttgtcataacct

SEQ ID NO: 7338456 - DNA, 22 bp, Homo sapiens
tttctgtaggggatatctttga

SEQ ID NO: 7338457 - DNA, 22 bp, Homo sapiens
tttctgtatttaaaagatctgg

SEQ ID NO: 7338458 - DNA, 22 bp, Homo sapiens
tttctccttgtgtctcctttga

SEQ ID NO: 7338459 - DNA, 22 bp, Homo sapiens
tttctctagctattcattaaat

SEQ ID NO: 7338460 - DNA, 22 bp, Homo sapiens
tttctctttcaatctgcagtac

SEQ ID NO: 7338461 - DNA, 22 bp, Homo sapiens
tttctcttgcgatatgctacac

SEQ ID NO: 7338462 - DNA, 22 bp, Homo sapiens
tttctcttgcgatatgctacac

SEQ ID NO: 7338463 - DNA, 22 bp, Homo sapiens
tttctcttcactgtgtgcctca

SEQ ID NO: 7338464 - DNA, 22 bp, Homo sapiens
tttctctttggaggggctgaat

SEQ ID NO: 7338465 - DNA, 22 bp, Homo sapiens
tttctctttgacaggaatcaga

SEQ ID NO: 7338466 - DNA, 22 bp, Homo sapiens
tttctgaagggcagcagactct

SEQ ID NO: 7338467 - DNA, 21 bp, Homo sapiens
tttctgaaggcaacatctatc

SEQ ID NO: 7338468 - DNA, 22 bp, Homo sapiens
tttctgaaaactgaagtagtgc

SEQ ID NO: 7338469 - DNA, 22 bp, Homo sapiens
tttctgctttctatccttgtca

SEQ ID NO: 7338470 - DNA, 22 bp, Homo sapiens
tttctgtagggatttcacagtt

SEQ ID NO: 7338471 - DNA, 20 bp, Homo sapiens
tttctgtagctcagtattca

SEQ ID NO: 7338472 - DNA, 22 bp, Homo sapiens
tttctgtacacccactattcat

SEQ ID NO: 7338473 - DNA, 22 bp, Homo sapiens
tttctgtaagtggcaaataatg

SEQ ID NO: 7338474 - DNA, 22 bp, Homo sapiens
tttctgctcgctctcaatcagg

SEQ ID NO: 7338475 - DNA, 23 bp, Homo sapiens
tttctgaagttgagatggacttt

SEQ ID NO: 7338476 - DNA, 22 bp, Homo sapiens
tttcattgtcatctatcttaga

SEQ ID NO: 7338477 - DNA, 22 bp, Homo sapiens
tttcagtgcttctgtttaccgg

SEQ ID NO: 7338478 - DNA, 22 bp, Homo sapiens
tttcattggctccctgatgaat

SEQ ID NO: 7338479 - DNA, 22 bp, Homo sapiens
tttcattttggttatgccataa

SEQ ID NO: 7338480 - DNA, 22 bp, Homo sapiens
tttcctcttccgagggggaggc

SEQ ID NO: 7338481 - DNA, 22 bp, Homo sapiens
tttcctcttccgagggggaggc

SEQ ID NO: 7338482 - DNA, 22 bp, Homo sapiens
tttcctcttcgattaagtttgg

SEQ ID NO: 7338483 - DNA, 22 bp, Homo sapiens
tttcctcttcgattaagtttgg

SEQ ID NO: 7338484 - DNA, 22 bp, Homo sapiens
tttcctcttccgagggggaggc

SEQ ID NO: 7338485 - DNA, 22 bp, Homo sapiens
tttcctcttctggcaggcaggg

SEQ ID NO: 7338486 - DNA, 22 bp, Homo sapiens
tttcctcttctggcaggcaggg

SEQ ID NO: 7338487 - DNA, 22 bp, Homo sapiens
tttcctcttcttcccatgtcat

SEQ ID NO: 7338488 - DNA, 22 bp, Homo sapiens
tttcctcttcttcccatgtcat

SEQ ID NO: 7338489 - DNA, 22 bp, Homo sapiens
tttcctcttcttcccatgtcat

SEQ ID NO: 7338490 - DNA, 22 bp, Homo sapiens
tttcctcttatacagtgtttat

SEQ ID NO: 7338491 - DNA, 22 bp, Homo sapiens
tttcctctgtcatgacagctga

SEQ ID NO: 7338492 - DNA, 22 bp, Homo sapiens
tttcctcttatacagtgtttat

SEQ ID NO: 7338493 - DNA, 22 bp, Homo sapiens
tttcctcttatacagtgtttat

SEQ ID NO: 7338494 - DNA, 22 bp, Homo sapiens
tttcctctgtcatgacagctga

SEQ ID NO: 7338495 - DNA, 22 bp, Homo sapiens
tttcctctgggccctgccaccc

SEQ ID NO: 7338496 - DNA, 22 bp, Homo sapiens
tttcctctgggccctgccaccc

SEQ ID NO: 7338497 - DNA, 22 bp, Homo sapiens
tttcctctgctgccattgcccc

SEQ ID NO: 7338498 - DNA, 22 bp, Homo sapiens
tttcagagttgtcttcttgacc

SEQ ID NO: 7338499 - DNA, 22 bp, Homo sapiens
tttcagatcattttttaagtac

SEQ ID NO: 7338500 - DNA, 22 bp, Homo sapiens
tttcagatcattttttaagtac

SEQ ID NO: 7338501 - DNA, 22 bp, Homo sapiens
tttcagatggtatatacagtag

SEQ ID NO: 7338502 - DNA, 22 bp, Homo sapiens
tttcagatgtgtgtctctgaag

SEQ ID NO: 7338503 - DNA, 22 bp, Homo sapiens
tttcaaagagttgtaaattact

SEQ ID NO: 7338504 - DNA, 22 bp, Homo sapiens
tttcaaagaccattaactatca

SEQ ID NO: 7338505 - DNA, 22 bp, Homo sapiens
tttcaaagacagccatatttgt

SEQ ID NO: 7338506 - DNA, 22 bp, Homo sapiens
tttctcagggaggagtcaagcc

SEQ ID NO: 7338507 - DNA, 21 bp, Homo sapiens
tttctcataaaatactcatta

SEQ ID NO: 7338508 - DNA, 21 bp, Homo sapiens
tttctcataaaatactcatta

SEQ ID NO: 7338509 - DNA, 22 bp, Homo sapiens
tttctcagtgtagcttttcaag

SEQ ID NO: 7338510 - DNA, 18 bp, Homo sapiens
tttctcagactctctttc

SEQ ID NO: 7338511 - DNA, 22 bp, Homo sapiens
tttctagaaaccaagatattgt

SEQ ID NO: 7338512 - DNA, 22 bp, Homo sapiens
tttctagaaacattatctctat

SEQ ID NO: 7338513 - DNA, 22 bp, Homo sapiens
tttctactttggaatgcactga

SEQ ID NO: 7338514 - DNA, 22 bp, Homo sapiens
tttctcatggacccttcatgat

SEQ ID NO: 7338515 - DNA, 22 bp, Homo sapiens
tttctcatggacccttcatgat

SEQ ID NO: 7338516 - DNA, 16 bp, Homo sapiens
tttctcattgtcatca

SEQ ID NO: 7338517 - DNA, 22 bp, Homo sapiens
tttctcatggaacatagctcct

SEQ ID NO: 7338518 - DNA, 22 bp, Homo sapiens
tttctcatggaacatcgtttag

SEQ ID NO: 7338519 - DNA, 22 bp, Homo sapiens
tttctcatagtcatgcctctta

SEQ ID NO: 7338520 - DNA, 23 bp, Homo sapiens
tttctcatccagagagtcagtcc

SEQ ID NO: 7338521 - DNA, 22 bp, Homo sapiens
tttcctctttgtaccttgacta

SEQ ID NO: 7338522 - DNA, 22 bp, Homo sapiens
tttcctctttgtaccttgacta

SEQ ID NO: 7338523 - DNA, 22 bp, Homo sapiens
tttcctctttgtgacacagctg

SEQ ID NO: 7338524 - DNA, 22 bp, Homo sapiens
tttcctctttgtgacacagctg

SEQ ID NO: 7338525 - DNA, 22 bp, Homo sapiens
tttcctgagtcagagacaccag

SEQ ID NO: 7338526 - DNA, 22 bp, Homo sapiens
tttctactcatcctttggagaa

SEQ ID NO: 7338527 - DNA, 22 bp, Homo sapiens
tttctaagtaagattaacttct

SEQ ID NO: 7338528 - DNA, 22 bp, Homo sapiens
tttctaagtaaacacagcatac

SEQ ID NO: 7338529 - DNA, 22 bp, Homo sapiens
tttctaagtgaacattcaagtt

SEQ ID NO: 7338530 - DNA, 22 bp, Homo sapiens
tttctaagtgtgtttcatagga

SEQ ID NO: 7338531 - DNA, 22 bp, Homo sapiens
tttctaagtgtattgagcttgg

SEQ ID NO: 7338532 - DNA, 22 bp, Homo sapiens
tttctaagtgtgattttagatt

SEQ ID NO: 7338533 - DNA, 22 bp, Homo sapiens
tttgttttgaactagctcagaa

SEQ ID NO: 7338534 - DNA, 22 bp, Homo sapiens
tttgttttgaactagctcagaa

SEQ ID NO: 7338535 - DNA, 22 bp, Homo sapiens
tttgttttcaatgtgtcattca

SEQ ID NO: 7338536 - DNA, 22 bp, Homo sapiens
tttgtttctgcaatacctatag

SEQ ID NO: 7338537 - DNA, 22 bp, Homo sapiens
tttgtttggcaacttggtaaag

SEQ ID NO: 7338538 - DNA, 22 bp, Homo sapiens
tttgtttagatggtaaatcagt

SEQ ID NO: 7338539 - DNA, 22 bp, Homo sapiens
ttttatagctgaatagtattcc

SEQ ID NO: 7338540 - DNA, 22 bp, Homo sapiens
ttttataaagagagtcagttgg

SEQ ID NO: 7338541 - DNA, 22 bp, Homo sapiens
ttttagtttggatttctaaagc

SEQ ID NO: 7338542 - DNA, 22 bp, Homo sapiens
tttgttgtcatcagtgatgagt

SEQ ID NO: 7338543 - DNA, 22 bp, Homo sapiens
tttgttgttagagtatgtgaaa

SEQ ID NO: 7338544 - DNA, 22 bp, Homo sapiens
tttgttgtgataatggtctgca

SEQ ID NO: 7338545 - DNA, 22 bp, Homo sapiens
tttgttctgaagcaagtaggga

SEQ ID NO: 7338546 - DNA, 22 bp, Homo sapiens
tttgtactagtcagtaaatagt

SEQ ID NO: 7338547 - DNA, 22 bp, Homo sapiens
tttgtactggaagaacatgcaa

SEQ ID NO: 7338548 - DNA, 22 bp, Homo sapiens
tttgtagagaatgttaagcact

SEQ ID NO: 7338549 - DNA, 22 bp, Homo sapiens
tttgtagactaccagtaattgt

SEQ ID NO: 7338550 - DNA, 22 bp, Homo sapiens
tttgtagagggtaattgacaga

SEQ ID NO: 7338551 - DNA, 22 bp, Homo sapiens
tttgtagagggtaattgacaga

SEQ ID NO: 7338552 - DNA, 22 bp, Homo sapiens
tttgtagatagaaaaatgatta

SEQ ID NO: 7338553 - DNA, 22 bp, Homo sapiens
tttgtagaactatacttacatt

SEQ ID NO: 7338554 - DNA, 22 bp, Homo sapiens
tttgtagaaagggttgtatgaa

SEQ ID NO: 7338555 - DNA, 22 bp, Homo sapiens
tttgtagaactatacttacatt

SEQ ID NO: 7338556 - DNA, 22 bp, Homo sapiens
tttgtagaaagggttgtatgaa

SEQ ID NO: 7338557 - DNA, 22 bp, Homo sapiens
tttgtagacgtcagaagttact

SEQ ID NO: 7338558 - DNA, 22 bp, Homo sapiens
tttgtagattcattgaactttt

SEQ ID NO: 7338559 - DNA, 22 bp, Homo sapiens
tttgtagattttctctccagta

SEQ ID NO: 7338560 - DNA, 22 bp, Homo sapiens
tttgtataaatgaagatgctgg

SEQ ID NO: 7338561 - DNA, 22 bp, Homo sapiens
tttgtattacaaagtcacagta

SEQ ID NO: 7338562 - DNA, 22 bp, Homo sapiens
tttgcacagatgggatacagca

SEQ ID NO: 7338563 - DNA, 22 bp, Homo sapiens
tttgcagaagaaaacatgaaca

SEQ ID NO: 7338564 - DNA, 22 bp, Homo sapiens
tttgcagaagaaaacatgaaca

SEQ ID NO: 7338565 - DNA, 22 bp, Homo sapiens
tttgcagtcaaatttgctaaat

SEQ ID NO: 7338566 - DNA, 22 bp, Homo sapiens
tttgcagagtacctgaagagga

SEQ ID NO: 7338567 - DNA, 22 bp, Homo sapiens
tttgcagatgagaaaactgtgg

SEQ ID NO: 7338568 - DNA, 22 bp, Homo sapiens
tttgattttcagcaatagtggc

SEQ ID NO: 7338569 - DNA, 22 bp, Homo sapiens
tttgtaatgataatgttaaatt

SEQ ID NO: 7338570 - DNA, 22 bp, Homo sapiens
tttgtacacaggatgttataat

SEQ ID NO: 7338571 - DNA, 22 bp, Homo sapiens
tttggcacagcttcccagactt

SEQ ID NO: 7338572 - DNA, 22 bp, Homo sapiens
tttggcacagtactttttggct

SEQ ID NO: 7338573 - DNA, 22 bp, Homo sapiens
tttggcacattctgtcacattc

SEQ ID NO: 7338574 - DNA, 22 bp, Homo sapiens
tttggcaccaaaggagaagatc

SEQ ID NO: 7338575 - DNA, 22 bp, Homo sapiens
tttggcactcacttatcattgg

SEQ ID NO: 7338576 - DNA, 22 bp, Homo sapiens
tttggcactataggtaaatttg

SEQ ID NO: 7338577 - DNA, 22 bp, Homo sapiens
tttggcacctccaaggactcgc

SEQ ID NO: 7338578 - DNA, 22 bp, Homo sapiens
tttggcaccatttttattctct

SEQ ID NO: 7338579 - DNA, 22 bp, Homo sapiens
tttggcaccaaaggagaagatc

SEQ ID NO: 7338580 - DNA, 22 bp, Homo sapiens
tttggcacttggcagttgagtt

SEQ ID NO: 7338581 - DNA, 22 bp, Homo sapiens
tttggcacttggcagttgagtt

SEQ ID NO: 7338582 - DNA, 19 bp, Homo sapiens
tttggcactctgaagtgtt

SEQ ID NO: 7338583 - DNA, 20 bp, Homo sapiens
tttggcactgagtggtataa

SEQ ID NO: 7338584 - DNA, 22 bp, Homo sapiens
tttggcactgttctaggtgcaa

SEQ ID NO: 7338585 - DNA, 22 bp, Homo sapiens
tttggactgcatgatgatctgg

SEQ ID NO: 7338586 - DNA, 22 bp, Homo sapiens
tttggactactgggaccttgtg

SEQ ID NO: 7338587 - DNA, 22 bp, Homo sapiens
tttggactatctgtgtggcttt

SEQ ID NO: 7338588 - DNA, 22 bp, Homo sapiens
tttggactcaatggtttgctgc

SEQ ID NO: 7338589 - DNA, 22 bp, Homo sapiens
tttggaacccagcccatcggaa

SEQ ID NO: 7338590 - DNA, 22 bp, Homo sapiens
tttggaagggaaagaaagtact

SEQ ID NO: 7338591 - DNA, 20 bp, Homo sapiens
tttggagagaaagaagtagt

SEQ ID NO: 7338592 - DNA, 23 bp, Homo sapiens
tttggacttgtgactcttctcct

SEQ ID NO: 7338593 - DNA, 22 bp, Homo sapiens
tttggagatggagagagggcat

SEQ ID NO: 7338594 - DNA, 22 bp, Homo sapiens
tttttccttggatgtgtctctc

SEQ ID NO: 7338595 - DNA, 22 bp, Homo sapiens
tttttgatctgagcagttggag

SEQ ID NO: 7338596 - DNA, 22 bp, Homo sapiens
tttttgctgataagcagaattc

SEQ ID NO: 7338597 - DNA, 22 bp, Homo sapiens
tttttgctccacaactttgaag

SEQ ID NO: 7338598 - DNA, 22 bp, Homo sapiens
tttttgctaatccccagccact

SEQ ID NO: 7338599 - DNA, 22 bp, Homo sapiens
ttttttgtcttgaagaaatggt

SEQ ID NO: 7338600 - DNA, 22 bp, Homo sapiens
ttttttgtcttgaagaaatggt

SEQ ID NO: 7338601 - DNA, 23 bp, Homo sapiens
ttttttgtcttgctaggctgccc

SEQ ID NO: 7338602 - DNA, 23 bp, Homo sapiens
ttttttgtcttgctaggctgccc

SEQ ID NO: 7338603 - DNA, 22 bp, Homo sapiens
ttttctaacatctagtaatttg

SEQ ID NO: 7338604 - DNA, 22 bp, Homo sapiens
ttttctaaaagaagtcactgat

SEQ ID NO: 7338605 - DNA, 22 bp, Homo sapiens
ttttggcactttgtctgattct

SEQ ID NO: 7338606 - DNA, 22 bp, Homo sapiens
tttttcctaagcagtggagctg

SEQ ID NO: 7338607 - DNA, 22 bp, Homo sapiens
tttttccttaggggttactcac

SEQ ID NO: 7338608 - DNA, 20 bp, Homo sapiens
tttttccttctctacaggca

SEQ ID NO: 7338609 - DNA, 22 bp, Homo sapiens
tttttcctagtgctttctggta

SEQ ID NO: 7338610 - DNA, 22 bp, Homo sapiens
tttttcctagcgatttgtcagc

SEQ ID NO: 7338611 - DNA, 22 bp, Homo sapiens
ttttggcaaaggcattctcttt

SEQ ID NO: 7338612 - DNA, 22 bp, Homo sapiens
ttttggcaaagagatagcatga

SEQ ID NO: 7338613 - DNA, 21 bp, Homo sapiens
ttttggcaaggtgcatgtttc

SEQ ID NO: 7338614 - DNA, 22 bp, Homo sapiens
ttttgatatcatgatgaacaga

SEQ ID NO: 7338615 - DNA, 22 bp, Homo sapiens
ttttgaagaagatgggaattta

SEQ ID NO: 7338616 - DNA, 22 bp, Homo sapiens
ttttgaataattcagaaacagc

SEQ ID NO: 7338617 - DNA, 22 bp, Homo sapiens
ttttgaataattcagaaacagc

SEQ ID NO: 7338618 - DNA, 22 bp, Homo sapiens
tcccccaggctggagtgcagtg

SEQ ID NO: 7338619 - DNA, 17 bp, Homo sapiens
tcccccagggctctctc

SEQ ID NO: 7338620 - DNA, 22 bp, Homo sapiens
tcccctcctctcctgatatggg

SEQ ID NO: 7338621 - DNA, 22 bp, Homo sapiens
tccccccagcctttcacatgag

SEQ ID NO: 7338622 - DNA, 22 bp, Homo sapiens
tgtggacagagccctggtttgg

SEQ ID NO: 7338623 - DNA, 22 bp, Homo sapiens
tgtggacagagcagaaggtcat

SEQ ID NO: 7338624 - DNA, 22 bp, Homo sapiens
tgtggacagctctttgagtgct

SEQ ID NO: 7338625 - DNA, 22 bp, Homo sapiens
tgtggacagctcttcccatatg

SEQ ID NO: 7338626 - DNA, 22 bp, Homo sapiens
tgtggacagctcttcccatatg

SEQ ID NO: 7338627 - DNA, 22 bp, Homo sapiens
tgtggacagagcagaaggtcat

SEQ ID NO: 7338628 - DNA, 22 bp, Homo sapiens
tgtggacaccactgggaggtct

SEQ ID NO: 7338629 - DNA, 22 bp, Homo sapiens
tgtggacactagcagatacggt

SEQ ID NO: 7338630 - DNA, 22 bp, Homo sapiens
tgtggacactacgataggggaa

SEQ ID NO: 7338631 - DNA, 22 bp, Homo sapiens
tgtggacactacgataggggaa

SEQ ID NO: 7338632 - DNA, 22 bp, Homo sapiens
tgtggacacctattaccagtga

SEQ ID NO: 7338633 - DNA, 22 bp, Homo sapiens
tgtggacacctattaccagtga

SEQ ID NO: 7338634 - DNA, 22 bp, Homo sapiens
tcccctctggttgacccaggag

SEQ ID NO: 7338635 - DNA, 22 bp, Homo sapiens
tcccctctttctggaaacacaa

SEQ ID NO: 7338636 - DNA, 22 bp, Homo sapiens
tcccctctggaggctgcagggg

SEQ ID NO: 7338637 - DNA, 22 bp, Homo sapiens
tcccctctctgcgctcccaggt

SEQ ID NO: 7338638 - DNA, 22 bp, Homo sapiens
tgtggacattttttgtcagtag

SEQ ID NO: 7338639 - DNA, 22 bp, Homo sapiens
tgtggacatagaagcatgtgga

SEQ ID NO: 7338640 - DNA, 18 bp, Homo sapiens
tgtggacatggctcttca

SEQ ID NO: 7338641 - DNA, 22 bp, Homo sapiens
tgtggacatagaagcatgtgga

SEQ ID NO: 7338642 - DNA, 22 bp, Homo sapiens
tgtggacatactaggcctaggc

SEQ ID NO: 7338643 - DNA, 22 bp, Homo sapiens
tgtggacagtgatccctagtca

SEQ ID NO: 7338644 - DNA, 22 bp, Homo sapiens
tgtggacaggcagttggtggga

SEQ ID NO: 7338645 - DNA, 22 bp, Homo sapiens
tgtggactgaaagaaccggcag

SEQ ID NO: 7338646 - DNA, 22 bp, Homo sapiens
tgtggactggcgggacgcaatg

SEQ ID NO: 7338647 - DNA, 22 bp, Homo sapiens
tgtggactctgagatccggaga

SEQ ID NO: 7338648 - DNA, 22 bp, Homo sapiens
tgtggactctggagtcagacag

SEQ ID NO: 7338649 - DNA, 22 bp, Homo sapiens
tgtggagctggcaatatgggca

SEQ ID NO: 7338650 - DNA, 22 bp, Homo sapiens
tgtggagcctcaaggccatctc

SEQ ID NO: 7338651 - DNA, 22 bp, Homo sapiens
tgtggagatgtgagcaagggga

SEQ ID NO: 7338652 - DNA, 22 bp, Homo sapiens
tgtggactgtgctgccacagtg

SEQ ID NO: 7338653 - DNA, 21 bp, Homo sapiens
tgtggcagatgttgggaggca

SEQ ID NO: 7338654 - DNA, 22 bp, Homo sapiens
tgtggcagaggaggcagcgtcc

SEQ ID NO: 7338655 - DNA, 22 bp, Homo sapiens
tgtggcagaggaggcagcgtcc

SEQ ID NO: 7338656 - DNA, 22 bp, Homo sapiens
tgtggcagtctcactggagggc

SEQ ID NO: 7338657 - DNA, 22 bp, Homo sapiens
tgtggcagtataagagctagaa

SEQ ID NO: 7338658 - DNA, 22 bp, Homo sapiens
tgtggcagtataagagctagaa

SEQ ID NO: 7338659 - DNA, 18 bp, Homo sapiens
tgtggcaggggtgggaga

SEQ ID NO: 7338660 - DNA, 22 bp, Homo sapiens
tgtggcagtaaaattgggcaac

SEQ ID NO: 7338661 - DNA, 22 bp, Homo sapiens
tgtggcagctgctgcaggagct

SEQ ID NO: 7338662 - DNA, 22 bp, Homo sapiens
tgtggcccgatcttgggagaca

SEQ ID NO: 7338663 - DNA, 22 bp, Homo sapiens
tgtgtgaagcactctgggtgat

SEQ ID NO: 7338664 - DNA, 22 bp, Homo sapiens
tgtgtgaaggaatatatactca

SEQ ID NO: 7338665 - DNA, 22 bp, Homo sapiens
tgtgtgaaggaatatatactca

SEQ ID NO: 7338666 - DNA, 20 bp, Homo sapiens
tgtgtgaacacggactctgt

SEQ ID NO: 7338667 - DNA, 22 bp, Homo sapiens
tgtgtgaactctctgatgtaca

SEQ ID NO: 7338668 - DNA, 22 bp, Homo sapiens
tgtgtgaagcacatgttcaagg

SEQ ID NO: 7338669 - DNA, 22 bp, Homo sapiens
tgtgtgaagcacatgttcaagg

SEQ ID NO: 7338670 - DNA, 22 bp, Homo sapiens
tgtgtgaatggattattctatt

SEQ ID NO: 7338671 - DNA, 22 bp, Homo sapiens
tgtgtgaatggattattctatt

SEQ ID NO: 7338672 - DNA, 22 bp, Homo sapiens
tgtgtgaatagcagtggctggt

SEQ ID NO: 7338673 - DNA, 22 bp, Homo sapiens
tgtgtgaatctattgaatatat

SEQ ID NO: 7338674 - DNA, 22 bp, Homo sapiens
tgtgtgaatctattgaatatat

SEQ ID NO: 7338675 - DNA, 22 bp, Homo sapiens
tgtgtgaaggagccactgttca

SEQ ID NO: 7338676 - DNA, 22 bp, Homo sapiens
tgtgtgaagggaagatagaggt

SEQ ID NO: 7338677 - DNA, 22 bp, Homo sapiens
tgtgtgaagtgattttaagtct

SEQ ID NO: 7338678 - DNA, 22 bp, Homo sapiens
tgtgtctttggcgatgtctgga

SEQ ID NO: 7338679 - DNA, 22 bp, Homo sapiens
tgtgtctttgttccaggtacga

SEQ ID NO: 7338680 - DNA, 22 bp, Homo sapiens
tgtgtgaacatgttttcatttc

SEQ ID NO: 7338681 - DNA, 22 bp, Homo sapiens
tgtgtgaacatgttttcatttc

SEQ ID NO: 7338682 - DNA, 22 bp, Homo sapiens
tgtgtcttggccaccttgggaa

SEQ ID NO: 7338683 - DNA, 22 bp, Homo sapiens
tgtgtcttacataattacatgt

SEQ ID NO: 7338684 - DNA, 22 bp, Homo sapiens
tgtgtgcaagtgacattagaaa

SEQ ID NO: 7338685 - DNA, 19 bp, Homo sapiens
tgtgtgcaaatggaagcca

SEQ ID NO: 7338686 - DNA, 22 bp, Homo sapiens
tgtgtgagtaaggctgagagag

SEQ ID NO: 7338687 - DNA, 20 bp, Homo sapiens
tgtgtgaatttcagagccgc

SEQ ID NO: 7338688 - DNA, 22 bp, Homo sapiens
tgtgtgaattacgcgtgtcctg

SEQ ID NO: 7338689 - DNA, 20 bp, Homo sapiens
tgtgtgaattagggcatgtt

SEQ ID NO: 7338690 - DNA, 22 bp, Homo sapiens
tgtgtgaattctgagcagttta

SEQ ID NO: 7338691 - DNA, 22 bp, Homo sapiens
tgtgtgaggactcagtgaaaca

SEQ ID NO: 7338692 - DNA, 22 bp, Homo sapiens
tgtgtgagacaattggctgtgg

SEQ ID NO: 7338693 - DNA, 22 bp, Homo sapiens
tgtgtgaggattcctggttctt

SEQ ID NO: 7338694 - DNA, 22 bp, Homo sapiens
tgtgtgaggtggttctgagaag

SEQ ID NO: 7338695 - DNA, 22 bp, Homo sapiens
tgtgtcattgccatgaaaaggc

SEQ ID NO: 7338696 - DNA, 23 bp, Homo sapiens
tgtgtcataaaattaaaacttca

SEQ ID NO: 7338697 - DNA, 22 bp, Homo sapiens
tgtgtcatagagagcacaaatc

SEQ ID NO: 7338698 - DNA, 22 bp, Homo sapiens
tgtgtccattcaggcactgacc

SEQ ID NO: 7338699 - DNA, 23 bp, Homo sapiens
tgtgtccttaactgtatatacta

SEQ ID NO: 7338700 - DNA, 18 bp, Homo sapiens
tgtgggttgggcagacca

SEQ ID NO: 7338701 - DNA, 22 bp, Homo sapiens
tgtgggtttaagaggcagcatg

SEQ ID NO: 7338702 - DNA, 22 bp, Homo sapiens
tgtggtatcaccatccactagt

SEQ ID NO: 7338703 - DNA, 22 bp, Homo sapiens
tgtggggactttcaaagccaat

SEQ ID NO: 7338704 - DNA, 22 bp, Homo sapiens
tgtgtacaaactaacaacatat

SEQ ID NO: 7338705 - DNA, 22 bp, Homo sapiens
tgtgtacaaactaacaacatat

SEQ ID NO: 7338706 - DNA, 22 bp, Homo sapiens
tgtgtaaattatttttaatgat

SEQ ID NO: 7338707 - DNA, 22 bp, Homo sapiens
tgtgtaaatttatttacataaa

SEQ ID NO: 7338708 - DNA, 17 bp, Homo sapiens
tgtgtaagttgcataga

SEQ ID NO: 7338709 - DNA, 22 bp, Homo sapiens
tgtgtaaatggactgtgaatta

SEQ ID NO: 7338710 - DNA, 21 bp, Homo sapiens
tgtgtaaagttgaaatcctgt

SEQ ID NO: 7338711 - DNA, 22 bp, Homo sapiens
tgtgtaaaagattagtttacta

SEQ ID NO: 7338712 - DNA, 22 bp, Homo sapiens
tgtttaataattctatgatagt

SEQ ID NO: 7338713 - DNA, 22 bp, Homo sapiens
tgtttaagtgctggtagggttg

SEQ ID NO: 7338714 - DNA, 22 bp, Homo sapiens
tgtttaatttttcatgagccaa

SEQ ID NO: 7338715 - DNA, 21 bp, Homo sapiens
tgtttaatacatatttgtgga

SEQ ID NO: 7338716 - DNA, 22 bp, Homo sapiens
tgtttaataattctatgatagt

SEQ ID NO: 7338717 - DNA, 22 bp, Homo sapiens
tgtttaatcttcaggacagtct

SEQ ID NO: 7338718 - DNA, 22 bp, Homo sapiens
tgtttaatcttcaggacagtct

SEQ ID NO: 7338719 - DNA, 22 bp, Homo sapiens
tgtttaatctataaaatggaga

SEQ ID NO: 7338720 - DNA, 22 bp, Homo sapiens
tgtttaatctataaaatggaga

SEQ ID NO: 7338721 - DNA, 22 bp, Homo sapiens
tgtttaattgggccaacagcgg

SEQ ID NO: 7338722 - DNA, 22 bp, Homo sapiens
tgtttaatttcacaaagttgac

SEQ ID NO: 7338723 - DNA, 22 bp, Homo sapiens
tgtttaatgaagatggtttttc

SEQ ID NO: 7338724 - DNA, 22 bp, Homo sapiens
tgtttaatgcattgaccttggg

SEQ ID NO: 7338725 - DNA, 22 bp, Homo sapiens
tgtttaattcaccatcatgttc

SEQ ID NO: 7338726 - DNA, 22 bp, Homo sapiens
tgtttcatgaaacatgtttagg

SEQ ID NO: 7338727 - DNA, 22 bp, Homo sapiens
tgtttcatgtggacatagttgt

SEQ ID NO: 7338728 - DNA, 22 bp, Homo sapiens
tgtttccaaagtcttttcttaa

SEQ ID NO: 7338729 - DNA, 22 bp, Homo sapiens
tgtttccccaaccccacaagta

SEQ ID NO: 7338730 - DNA, 22 bp, Homo sapiens
tgtttactagccaacatggaga

SEQ ID NO: 7338731 - DNA, 22 bp, Homo sapiens
tgtttctttgtagatattcttt

SEQ ID NO: 7338732 - DNA, 22 bp, Homo sapiens
tgtttctttgtagatattcttt

SEQ ID NO: 7338733 - DNA, 23 bp, Homo sapiens
tgtttctagaatcattgatgtct

SEQ ID NO: 7338734 - DNA, 22 bp, Homo sapiens
tgtttcctaagtgtctctgaag

SEQ ID NO: 7338735 - DNA, 22 bp, Homo sapiens
tgtttccttctgtctctttgga

SEQ ID NO: 7338736 - DNA, 22 bp, Homo sapiens
tgtttgcaaccccttgtgagaa

SEQ ID NO: 7338737 - DNA, 22 bp, Homo sapiens
tgtttgaaactttgatcactaa

SEQ ID NO: 7338738 - DNA, 22 bp, Homo sapiens
tgtttgaaagcacctacatttt

SEQ ID NO: 7338739 - DNA, 22 bp, Homo sapiens
tgttttcaagtcaaggccaaat

SEQ ID NO: 7338740 - DNA, 22 bp, Homo sapiens
tgttcctaaatatgaatggaga

SEQ ID NO: 7338741 - DNA, 22 bp, Homo sapiens
tgttcagaacaaaggtaaatga

SEQ ID NO: 7338742 - DNA, 22 bp, Homo sapiens
tgttcctaaatatgaatggaga

SEQ ID NO: 7338743 - DNA, 22 bp, Homo sapiens
tgttcaaatcttttgcttattt

SEQ ID NO: 7338744 - DNA, 22 bp, Homo sapiens
tgttcaaatgatcttcttaaat

SEQ ID NO: 7338745 - DNA, 22 bp, Homo sapiens
tgttcaaatcttttgcttattt

SEQ ID NO: 7338746 - DNA, 22 bp, Homo sapiens
tgttcaatccccaggtcctgaa

SEQ ID NO: 7338747 - DNA, 22 bp, Homo sapiens
tgttatatctaaatagccacat

SEQ ID NO: 7338748 - DNA, 22 bp, Homo sapiens
tgttatagttaggagtgggttt

SEQ ID NO: 7338749 - DNA, 21 bp, Homo sapiens
tgttatgtgcttcaagaagtg

SEQ ID NO: 7338750 - DNA, 22 bp, Homo sapiens
tgttattgatatctaatgctct

SEQ ID NO: 7338751 - DNA, 22 bp, Homo sapiens
tgttattatgtttccagagcct

SEQ ID NO: 7338752 - DNA, 22 bp, Homo sapiens
tgtgtgcacatgatttgaaatg

SEQ ID NO: 7338753 - DNA, 20 bp, Homo sapiens
tgtgtgcatctgtatgtatt

SEQ ID NO: 7338754 - DNA, 22 bp, Homo sapiens
tgtgtgcaggcactgtgccaga

SEQ ID NO: 7338755 - DNA, 22 bp, Homo sapiens
tgtgtgcaggcactgtgccaga

SEQ ID NO: 7338756 - DNA, 22 bp, Homo sapiens
tgtgtgcatacacacggtaaca

SEQ ID NO: 7338757 - DNA, 22 bp, Homo sapiens
tgtgtgcagacagatattactt

SEQ ID NO: 7338758 - DNA, 22 bp, Homo sapiens
tgtgtgcacttaatgcaatcat

SEQ ID NO: 7338759 - DNA, 22 bp, Homo sapiens
tgtgtgcagcggcaggtgaagt

SEQ ID NO: 7338760 - DNA, 22 bp, Homo sapiens
tgtgttaattttccctttctct

SEQ ID NO: 7338761 - DNA, 22 bp, Homo sapiens
tgtgttatctatctcgatgctt

SEQ ID NO: 7338762 - DNA, 22 bp, Homo sapiens
tgtgttgtgacattcttggatg

SEQ ID NO: 7338763 - DNA, 22 bp, Homo sapiens
tgtgttcttaaaagcagtgata

SEQ ID NO: 7338764 - DNA, 22 bp, Homo sapiens
tgtgtttcagaaccttctttca

SEQ ID NO: 7338765 - DNA, 22 bp, Homo sapiens
tgtgtttgaggcatgttgcaga

SEQ ID NO: 7338766 - DNA, 22 bp, Homo sapiens
tgtgtttgaggcatgttgcaga

SEQ ID NO: 7338767 - DNA, 21 bp, Homo sapiens
tgtgtttgagactatgtttcc

SEQ ID NO: 7338768 - DNA, 22 bp, Homo sapiens
tgtgtttagagagcacattcag

SEQ ID NO: 7338769 - DNA, 22 bp, Homo sapiens
tgtgtttagagagcacattcag

SEQ ID NO: 7338770 - DNA, 22 bp, Homo sapiens
tgtgtttacttctatgcagttt

SEQ ID NO: 7338771 - DNA, 22 bp, Homo sapiens
tgtgttgtgacattcttggatg

SEQ ID NO: 7338772 - DNA, 22 bp, Homo sapiens
tgtgttgttttaagctgctgca

SEQ ID NO: 7338773 - DNA, 22 bp, Homo sapiens
tgtgtttaaagaggaagtgaga

SEQ ID NO: 7338774 - DNA, 21 bp, Homo sapiens
tgtgttttaatgatattctgt

SEQ ID NO: 7338775 - DNA, 22 bp, Homo sapiens
tgtgttttacaaattctcttaa

SEQ ID NO: 7338776 - DNA, 22 bp, Homo sapiens
tgtgtttgttagactaatgtta

SEQ ID NO: 7338777 - DNA, 22 bp, Homo sapiens
tgtgtttgttagactaatgtta

SEQ ID NO: 7338778 - DNA, 22 bp, Homo sapiens
tgtgttttccagaatggtgttt

SEQ ID NO: 7338779 - DNA, 22 bp, Homo sapiens
tgtgttttgaactcatctactg

SEQ ID NO: 7338780 - DNA, 22 bp, Homo sapiens
ttaaggaaagattagcatttgt

SEQ ID NO: 7338781 - DNA, 22 bp, Homo sapiens
ttaaggaaatcttggtgtcaca

SEQ ID NO: 7338782 - DNA, 22 bp, Homo sapiens
ttaaggaacaattctacacacc

SEQ ID NO: 7338783 - DNA, 22 bp, Homo sapiens
ttaaggaaccacagcatgttag

SEQ ID NO: 7338784 - DNA, 22 bp, Homo sapiens
ttaaggaagaattgcaatggca

SEQ ID NO: 7338785 - DNA, 22 bp, Homo sapiens
ttaaggaagacagggcaaggtg

SEQ ID NO: 7338786 - DNA, 22 bp, Homo sapiens
ttaaggaagagacttttgcgtt

SEQ ID NO: 7338787 - DNA, 22 bp, Homo sapiens
ttaaggaagcctatgggaatag

SEQ ID NO: 7338788 - DNA, 22 bp, Homo sapiens
ttaaggaaggagtcttaaatgg

SEQ ID NO: 7338789 - DNA, 22 bp, Homo sapiens
ttaaggaaggcacagcagttga

SEQ ID NO: 7338790 - DNA, 22 bp, Homo sapiens
ttaaggaatattcatgaagttt

SEQ ID NO: 7338791 - DNA, 22 bp, Homo sapiens
ttaaggaatggttggaatggat

SEQ ID NO: 7338792 - DNA, 22 bp, Homo sapiens
ttaagaagtgagtagaagtaat

SEQ ID NO: 7338793 - DNA, 22 bp, Homo sapiens
ttaagaatgtgccttttggttg

SEQ ID NO: 7338794 - DNA, 22 bp, Homo sapiens
ttaacttgtcagaaaatacagt

SEQ ID NO: 7338795 - DNA, 22 bp, Homo sapiens
ttaacttttatttctgctcgcc

SEQ ID NO: 7338796 - DNA, 22 bp, Homo sapiens
ttaagaaggcaactggcaacta

SEQ ID NO: 7338797 - DNA, 22 bp, Homo sapiens
ttaacacttgaactctacatgt

SEQ ID NO: 7338798 - DNA, 22 bp, Homo sapiens
ttaacatacatcatgaacaatg

SEQ ID NO: 7338799 - DNA, 22 bp, Homo sapiens
ttaacattaaaagcagcatttt

SEQ ID NO: 7338800 - DNA, 22 bp, Homo sapiens
ttaacatgtcttgacttcatct

SEQ ID NO: 7338801 - DNA, 22 bp, Homo sapiens
ttaaccaggtcctttgaaaaca

SEQ ID NO: 7338802 - DNA, 22 bp, Homo sapiens
ttaatttatacataatcacagg

SEQ ID NO: 7338803 - DNA, 22 bp, Homo sapiens
ttaataaagtatgaattggaaa

SEQ ID NO: 7338804 - DNA, 22 bp, Homo sapiens
ttaattcagtcaaagaaaccat

SEQ ID NO: 7338805 - DNA, 22 bp, Homo sapiens
ttaaggagcacagtgtattaat

SEQ ID NO: 7338806 - DNA, 22 bp, Homo sapiens
ttaaggaatttatagttgtact

SEQ ID NO: 7338807 - DNA, 22 bp, Homo sapiens
ttaaggagcacagtgtattaat

SEQ ID NO: 7338808 - DNA, 22 bp, Homo sapiens
ttaaggagcagaatgcttggac

SEQ ID NO: 7338809 - DNA, 23 bp, Homo sapiens
ttaaggagcttgcactctgggtg

SEQ ID NO: 7338810 - DNA, 22 bp, Homo sapiens
ttaaggaggacgttcctggtgg

SEQ ID NO: 7338811 - DNA, 22 bp, Homo sapiens
ttaaggaatgtgcagtttatat

SEQ ID NO: 7338812 - DNA, 22 bp, Homo sapiens
ttaaggcaactgggtccaagat

SEQ ID NO: 7338813 - DNA, 22 bp, Homo sapiens
ttaaggattactttgtgtaccc

SEQ ID NO: 7338814 - DNA, 22 bp, Homo sapiens
ttaaggatgttgtgatttatta

SEQ ID NO: 7338815 - DNA, 22 bp, Homo sapiens
ttaaggcatagcttgtgttgac

SEQ ID NO: 7338816 - DNA, 22 bp, Homo sapiens
ttaaggcattgatatggtgcta

SEQ ID NO: 7338817 - DNA, 22 bp, Homo sapiens
ttaagttttaaagctagagtct

SEQ ID NO: 7338818 - DNA, 22 bp, Homo sapiens
ttaagtcacttatctaaagaca

SEQ ID NO: 7338819 - DNA, 22 bp, Homo sapiens
ttaagtcacttatctaaagaca

SEQ ID NO: 7338820 - DNA, 22 bp, Homo sapiens
ttaagtagattcagtgttaagg

SEQ ID NO: 7338821 - DNA, 22 bp, Homo sapiens
ttaagtaagaccttatgtcttg

SEQ ID NO: 7338822 - DNA, 22 bp, Homo sapiens
ttaagtaagaccttatgtcttg

SEQ ID NO: 7338823 - DNA, 22 bp, Homo sapiens
ttaaatgaggctgatgtagatt

SEQ ID NO: 7338824 - DNA, 22 bp, Homo sapiens
ttaaatggggatgagtagatgg

SEQ ID NO: 7338825 - DNA, 22 bp, Homo sapiens
ttaaatgatgcatatcatttag

SEQ ID NO: 7338826 - DNA, 22 bp, Homo sapiens
ttaaatgaacgagatatgcaac

SEQ ID NO: 7338827 - DNA, 22 bp, Homo sapiens
ttaaatcaggcatcatttcagt

SEQ ID NO: 7338828 - DNA, 22 bp, Homo sapiens
ttaaatgtttaatctaacttga

SEQ ID NO: 7338829 - DNA, 22 bp, Homo sapiens
ttaaattagtcaagcttctctg

SEQ ID NO: 7338830 - DNA, 22 bp, Homo sapiens
ttaaattaggactctagttctg

SEQ ID NO: 7338831 - DNA, 22 bp, Homo sapiens
ttaaattaggactctagttctg

SEQ ID NO: 7338832 - DNA, 22 bp, Homo sapiens
ttaacaaagtaacgggaaaaga

SEQ ID NO: 7338833 - DNA, 22 bp, Homo sapiens
tgttttgtagctaatagctatt

SEQ ID NO: 7338834 - DNA, 22 bp, Homo sapiens
tgttttgttcactgcattgtcc

SEQ ID NO: 7338835 - DNA, 22 bp, Homo sapiens
tgttttgtgcacttctatagca

SEQ ID NO: 7338836 - DNA, 22 bp, Homo sapiens
tgttttcttcctaattgctcat

SEQ ID NO: 7338837 - DNA, 22 bp, Homo sapiens
ttaaatattatgttgtctgcaa

SEQ ID NO: 7338838 - DNA, 22 bp, Homo sapiens
tgtttttaaataatgatagaaa

SEQ ID NO: 7338839 - DNA, 22 bp, Homo sapiens
ttaaagcatcctgtcagtctgt

SEQ ID NO: 7338840 - DNA, 21 bp, Homo sapiens
ttagaaagctcactacagtta

SEQ ID NO: 7338841 - DNA, 20 bp, Homo sapiens
ttagaaagagcgtgataaga

SEQ ID NO: 7338842 - DNA, 22 bp, Homo sapiens
ttagaaagaatagcctggctgc

SEQ ID NO: 7338843 - DNA, 22 bp, Homo sapiens
ttagaaagaactttagatatca

SEQ ID NO: 7338844 - DNA, 22 bp, Homo sapiens
ttagaaacaaaatagttatttg

SEQ ID NO: 7338845 - DNA, 22 bp, Homo sapiens
ttagaaagctttccatagtcaa

SEQ ID NO: 7338846 - DNA, 20 bp, Homo sapiens
ttagaagggccagatgaagg

SEQ ID NO: 7338847 - DNA, 22 bp, Homo sapiens
ttagagaaattctggtaatgta

SEQ ID NO: 7338848 - DNA, 22 bp, Homo sapiens
ttagagagaaccatcaggatct

SEQ ID NO: 7338849 - DNA, 19 bp, Homo sapiens
ttacttcaggagtgaaatt

SEQ ID NO: 7338850 - DNA, 22 bp, Homo sapiens
ttacttattaccaccaatgccg

SEQ ID NO: 7338851 - DNA, 22 bp, Homo sapiens
ttactgttggttggtaagagtt

SEQ ID NO: 7338852 - DNA, 22 bp, Homo sapiens
ttacttaaacagaaatgcagaa

SEQ ID NO: 7338853 - DNA, 22 bp, Homo sapiens
ttactgatggaacagagataga

SEQ ID NO: 7338854 - DNA, 22 bp, Homo sapiens
ttactgatcccccaggtgaccc

SEQ ID NO: 7338855 - DNA, 22 bp, Homo sapiens
ttactgtagcttgacatatgtc

SEQ ID NO: 7338856 - DNA, 22 bp, Homo sapiens
ttaccaaatcccgtgcacattc

SEQ ID NO: 7338857 - DNA, 22 bp, Homo sapiens
ttacatcagaaggaaacagcgt

SEQ ID NO: 7338858 - DNA, 22 bp, Homo sapiens
ttacatcagcaagagtgtatgt

SEQ ID NO: 7338859 - DNA, 22 bp, Homo sapiens
ttacatcattgagacatacata

SEQ ID NO: 7338860 - DNA, 22 bp, Homo sapiens
ttacaggattctttggatatgc

SEQ ID NO: 7338861 - DNA, 22 bp, Homo sapiens
ttacaggattctttggatatgc

SEQ ID NO: 7338862 - DNA, 22 bp, Homo sapiens
ttacaggaggtgctaggtgttt

SEQ ID NO: 7338863 - DNA, 22 bp, Homo sapiens
ttacactaagctacttctatat

SEQ ID NO: 7338864 - DNA, 22 bp, Homo sapiens
ttacacatgaaggtccaatgtt

SEQ ID NO: 7338865 - DNA, 22 bp, Homo sapiens
ttacacattgcagatcaaaatg

SEQ ID NO: 7338866 - DNA, 22 bp, Homo sapiens
ttacacattgcagatcaaaatg

SEQ ID NO: 7338867 - DNA, 22 bp, Homo sapiens
ttacacatgaaggtccaatgtt

SEQ ID NO: 7338868 - DNA, 22 bp, Homo sapiens
ttaatttttatgtatagtgtgt

SEQ ID NO: 7338869 - DNA, 22 bp, Homo sapiens
ttaatttttatgtatagtgtgt

SEQ ID NO: 7338870 - DNA, 22 bp, Homo sapiens
ttaattttctcatctgtgaaat

SEQ ID NO: 7338871 - DNA, 21 bp, Homo sapiens
ttgatttagcagatctagctg

SEQ ID NO: 7338872 - DNA, 22 bp, Homo sapiens
ttgatttcaacatcatcccttt

SEQ ID NO: 7338873 - DNA, 23 bp, Homo sapiens
ttgatttcaaatgcagagaacac

SEQ ID NO: 7338874 - DNA, 22 bp, Homo sapiens
ttgatttctattcagatgtaga

SEQ ID NO: 7338875 - DNA, 22 bp, Homo sapiens
ttgatttcactctctgtccaat

SEQ ID NO: 7338876 - DNA, 22 bp, Homo sapiens
ttgatttctattgagttcctgt

SEQ ID NO: 7338877 - DNA, 22 bp, Homo sapiens
ttgatttcttattaccctagtt

SEQ ID NO: 7338878 - DNA, 22 bp, Homo sapiens
ttgcaaagtgtcatgcaaagta

SEQ ID NO: 7338879 - DNA, 22 bp, Homo sapiens
ttgcaaataaacaagtatacat

SEQ ID NO: 7338880 - DNA, 22 bp, Homo sapiens
ttgattttaaaatagtgacact

SEQ ID NO: 7338881 - DNA, 22 bp, Homo sapiens
ttgattttaaaatagtgacact

SEQ ID NO: 7338882 - DNA, 21 bp, Homo sapiens
ttgattttaggaagtttgtca

SEQ ID NO: 7338883 - DNA, 20 bp, Homo sapiens
ttgcaaatatctattgattg

SEQ ID NO: 7338884 - DNA, 22 bp, Homo sapiens
ttgcaaatgtgaataattacac

SEQ ID NO: 7338885 - DNA, 22 bp, Homo sapiens
ttgattaaaatgagacatcatt

SEQ ID NO: 7338886 - DNA, 22 bp, Homo sapiens
ttgattaaacaggcatattcaa

SEQ ID NO: 7338887 - DNA, 22 bp, Homo sapiens
ttgattaaaatgagacatcatt

SEQ ID NO: 7338888 - DNA, 22 bp, Homo sapiens
ttgattctacttaaaacatatg

SEQ ID NO: 7338889 - DNA, 22 bp, Homo sapiens
ttgatgaatctgaagggaacca

SEQ ID NO: 7338890 - DNA, 22 bp, Homo sapiens
ttgaggcattactgtaatgaga

SEQ ID NO: 7338891 - DNA, 22 bp, Homo sapiens
ttgaggcagggcatggtggccc

SEQ ID NO: 7338892 - DNA, 22 bp, Homo sapiens
ttgaggcagcccttaattggga

SEQ ID NO: 7338893 - DNA, 20 bp, Homo sapiens
ttgaggcatgtctagaagta

SEQ ID NO: 7338894 - DNA, 22 bp, Homo sapiens
ttgaggcaggtccgggtccttc

SEQ ID NO: 7338895 - DNA, 22 bp, Homo sapiens
ttctttctcaacatgaatgttt

SEQ ID NO: 7338896 - DNA, 22 bp, Homo sapiens
ttctttctcaacatgaatgttt

SEQ ID NO: 7338897 - DNA, 22 bp, Homo sapiens
ttgaagagtttgatagagttga

SEQ ID NO: 7338898 - DNA, 22 bp, Homo sapiens
ttgaagagcaccagcattttga

SEQ ID NO: 7338899 - DNA, 22 bp, Homo sapiens
ttgaagagacgatttttccacc

SEQ ID NO: 7338900 - DNA, 22 bp, Homo sapiens
ttgaagagaatcagaaggttga

SEQ ID NO: 7338901 - DNA, 22 bp, Homo sapiens
ttctttatgcttctgtttaggc

SEQ ID NO: 7338902 - DNA, 22 bp, Homo sapiens
ttctttattgagacttcattgt

SEQ ID NO: 7338903 - DNA, 22 bp, Homo sapiens
ttctttccaaccagatattggt

SEQ ID NO: 7338904 - DNA, 22 bp, Homo sapiens
ttgagatttggaggtaattccc

SEQ ID NO: 7338905 - DNA, 22 bp, Homo sapiens
ttgagcatatgcatttccaatt

SEQ ID NO: 7338906 - DNA, 22 bp, Homo sapiens
ttgagcatcaattaagtgagtt

SEQ ID NO: 7338907 - DNA, 22 bp, Homo sapiens
ttgagcatctgaggattttcct

SEQ ID NO: 7338908 - DNA, 22 bp, Homo sapiens
ttgagcatcttatagaaagagc

SEQ ID NO: 7338909 - DNA, 22 bp, Homo sapiens
ttgaggagtgtttagggtgagg

SEQ ID NO: 7338910 - DNA, 22 bp, Homo sapiens
ttgaggcaaaatcaacgggaag

SEQ ID NO: 7338911 - DNA, 22 bp, Homo sapiens
ttgaggcacacacaggttgcat

SEQ ID NO: 7338912 - DNA, 22 bp, Homo sapiens
ttgaggcacagattttagtggc

SEQ ID NO: 7338913 - DNA, 23 bp, Homo sapiens
ttgaggcaaacatgtaagtagga

SEQ ID NO: 7338914 - DNA, 23 bp, Homo sapiens
ttgaggcaaactcttttctgaaa

SEQ ID NO: 7338915 - DNA, 22 bp, Homo sapiens
ttgagccctacctcagactttc

SEQ ID NO: 7338916 - DNA, 22 bp, Homo sapiens
ttgagcccaggaggcctgggtg

SEQ ID NO: 7338917 - DNA, 22 bp, Homo sapiens
ttgagcatgtaactacacaggg

SEQ ID NO: 7338918 - DNA, 21 bp, Homo sapiens
ttgagcatgtaccctttgcct

SEQ ID NO: 7338919 - DNA, 21 bp, Homo sapiens
ttgagcatgtactttgtgctt

SEQ ID NO: 7338920 - DNA, 23 bp, Homo sapiens
ttgagcatttgtggatactgaaa

SEQ ID NO: 7338921 - DNA, 22 bp, Homo sapiens
ttgagcatttgttttgaaagag

SEQ ID NO: 7338922 - DNA, 22 bp, Homo sapiens
ttgagcccaggaggcctgggtg

SEQ ID NO: 7338923 - DNA, 22 bp, Homo sapiens
ttgaaggacatcctatttctag

SEQ ID NO: 7338924 - DNA, 22 bp, Homo sapiens
ttgaagcagagaaatacttgaa

SEQ ID NO: 7338925 - DNA, 22 bp, Homo sapiens
ttgaagcacaatgtcttttatc

SEQ ID NO: 7338926 - DNA, 22 bp, Homo sapiens
ttgaagcacaatgtcttttatc

SEQ ID NO: 7338927 - DNA, 22 bp, Homo sapiens
ttgaagcacaatgtcttttatc

SEQ ID NO: 7338928 - DNA, 22 bp, Homo sapiens
ttgaagcaaattctgtgcagta

SEQ ID NO: 7338929 - DNA, 22 bp, Homo sapiens
ttgaagcaaggcgaatcttgtg

SEQ ID NO: 7338930 - DNA, 21 bp, Homo sapiens
ttgaagcaagggtggctctga

SEQ ID NO: 7338931 - DNA, 22 bp, Homo sapiens
ttgaagcagctcaggaggctta

SEQ ID NO: 7338932 - DNA, 22 bp, Homo sapiens
ttgaagcaggaaaatttctatt

SEQ ID NO: 7338933 - DNA, 22 bp, Homo sapiens
ttgaagcaggaaaatttctatt

SEQ ID NO: 7338934 - DNA, 22 bp, Homo sapiens
ttgaagcatggtacttgttcaa

SEQ ID NO: 7338935 - DNA, 22 bp, Homo sapiens
ttgaagcatggtacttgttcaa

SEQ ID NO: 7338936 - DNA, 22 bp, Homo sapiens
ttgaagcatttctttgagcttc

SEQ ID NO: 7338937 - DNA, 22 bp, Homo sapiens
ttgaagcattgtggcttgtatt

SEQ ID NO: 7338938 - DNA, 22 bp, Homo sapiens
ttgaagcatttgctatagcatt

SEQ ID NO: 7338939 - DNA, 22 bp, Homo sapiens
ttgagatattcagttccattga

SEQ ID NO: 7338940 - DNA, 22 bp, Homo sapiens
ttgagatgacttaaatttggga

SEQ ID NO: 7338941 - DNA, 22 bp, Homo sapiens
ttgaatgaccatgatgcaaggg

SEQ ID NO: 7338942 - DNA, 22 bp, Homo sapiens
ttgaatgaatttgagcagagat

SEQ ID NO: 7338943 - DNA, 22 bp, Homo sapiens
ttgaatgagtgttttactcatg

SEQ ID NO: 7338944 - DNA, 22 bp, Homo sapiens
ttctggtcaatggcctgtaagt

SEQ ID NO: 7338945 - DNA, 22 bp, Homo sapiens
ttctgggtggccagtatttaga

SEQ ID NO: 7338946 - DNA, 18 bp, Homo sapiens
ttctgggtgttatgttta

SEQ ID NO: 7338947 - DNA, 21 bp, Homo sapiens
ttctgggttgttaatctgaac

SEQ ID NO: 7338948 - DNA, 22 bp, Homo sapiens
ttcttacagagtttacagagcc

SEQ ID NO: 7338949 - DNA, 22 bp, Homo sapiens
ttctgttatcattaagcattat

SEQ ID NO: 7338950 - DNA, 22 bp, Homo sapiens
ttctgttagaattttgaaaata

SEQ ID NO: 7338951 - DNA, 22 bp, Homo sapiens
ttctgttacatggggcacagtg

SEQ ID NO: 7338952 - DNA, 18 bp, Homo sapiens
ttctttaattcagtttga

SEQ ID NO: 7338953 - DNA, 22 bp, Homo sapiens
ttctttaaatgaattctctgta

SEQ ID NO: 7338954 - DNA, 22 bp, Homo sapiens
ttcttgatttcatgcagttaag

SEQ ID NO: 7338955 - DNA, 22 bp, Homo sapiens
ttcttgattcttccttgaagga

SEQ ID NO: 7338956 - DNA, 22 bp, Homo sapiens
ttcttgatgaatgctaagaact

SEQ ID NO: 7338957 - DNA, 22 bp, Homo sapiens
ttcttgaatagggattgataaa

SEQ ID NO: 7338958 - DNA, 22 bp, Homo sapiens
ttcttcttgtctgccctcacat

SEQ ID NO: 7338959 - DNA, 20 bp, Homo sapiens
ttctgcttgcaaatatcaag

SEQ ID NO: 7338960 - DNA, 22 bp, Homo sapiens
ttctgcttctgtgtgtcccagg

SEQ ID NO: 7338961 - DNA, 22 bp, Homo sapiens
ttctgcttttctctgtctgagt

SEQ ID NO: 7338962 - DNA, 22 bp, Homo sapiens
ttctgctttcagttcttctggg

SEQ ID NO: 7338963 - DNA, 22 bp, Homo sapiens
ttctgctttggttccatggatg

SEQ ID NO: 7338964 - DNA, 19 bp, Homo sapiens
ttctggaaacccaggtaat

SEQ ID NO: 7338965 - DNA, 22 bp, Homo sapiens
ttctggaaaccctcagccagtg

SEQ ID NO: 7338966 - DNA, 22 bp, Homo sapiens
ttctggaaagaaggctaaggtc

SEQ ID NO: 7338967 - DNA, 22 bp, Homo sapiens
ttctggaaaagaaagttaagat

SEQ ID NO: 7338968 - DNA, 22 bp, Homo sapiens
ttctggaaagatttgcgtgtaa

SEQ ID NO: 7338969 - DNA, 22 bp, Homo sapiens
ttctggaaagcatttgaggccc

SEQ ID NO: 7338970 - DNA, 22 bp, Homo sapiens
ttctgctgaagtcactgggagc

SEQ ID NO: 7338971 - DNA, 22 bp, Homo sapiens
ttctgctgaaaacagccatgta

SEQ ID NO: 7338972 - DNA, 22 bp, Homo sapiens
ttctgctgaagccagggagcaa

SEQ ID NO: 7338973 - DNA, 22 bp, Homo sapiens
ttctgctctaatgtacaccagc

SEQ ID NO: 7338974 - DNA, 22 bp, Homo sapiens
ttctgctctaatgtacaccagc

SEQ ID NO: 7338975 - DNA, 22 bp, Homo sapiens
ttctgctgcgacccaggagtta

SEQ ID NO: 7338976 - DNA, 22 bp, Homo sapiens
ttctgctggtaactatgtttca

SEQ ID NO: 7338977 - DNA, 22 bp, Homo sapiens
ttctgctgctgctgcacccaat

SEQ ID NO: 7338978 - DNA, 17 bp, Homo sapiens
ttctgctgtcgtcctct

SEQ ID NO: 7338979 - DNA, 22 bp, Homo sapiens
ttctgctggtgttttgtgaggc

SEQ ID NO: 7338980 - DNA, 22 bp, Homo sapiens
ttctgctgtagttgcatctgtt

SEQ ID NO: 7338981 - DNA, 22 bp, Homo sapiens
ttctgctgttgtgacgttagtt

SEQ ID NO: 7338982 - DNA, 17 bp, Homo sapiens
ttctgctgtttcccctt

SEQ ID NO: 7338983 - DNA, 22 bp, Homo sapiens
ttctgctgtttgtagtaatgta

SEQ ID NO: 7338984 - DNA, 21 bp, Homo sapiens
ttctgctgttcaccaccaccc

SEQ ID NO: 7338985 - DNA, 18 bp, Homo sapiens
ttctgcggtgacagatat

SEQ ID NO: 7338986 - DNA, 22 bp, Homo sapiens
ttctgagaaggctgtggacaca

SEQ ID NO: 7338987 - DNA, 22 bp, Homo sapiens
ttctgagaaatgggttcacata

SEQ ID NO: 7338988 - DNA, 22 bp, Homo sapiens
ttctagttttgccacaggatac

SEQ ID NO: 7338989 - DNA, 22 bp, Homo sapiens
ttctataagactcatatttctt

SEQ ID NO: 7338990 - DNA, 22 bp, Homo sapiens
ttctataaatgaatgtgtatat

SEQ ID NO: 7338991 - DNA, 20 bp, Homo sapiens
ttctatacatatcactgaaa

SEQ ID NO: 7338992 - DNA, 20 bp, Homo sapiens
ttctatacatatcactgaaa

SEQ ID NO: 7338993 - DNA, 22 bp, Homo sapiens
ttctataatgcaagccactgca

SEQ ID NO: 7338994 - DNA, 22 bp, Homo sapiens
ttctagttaatgtagcatcttg

SEQ ID NO: 7338995 - DNA, 22 bp, Homo sapiens
ttctagttactcttaaatgctg

SEQ ID NO: 7338996 - DNA, 18 bp, Homo sapiens
ttcatcatgactctgtgg

SEQ ID NO: 7338997 - DNA, 22 bp, Homo sapiens
ttcatggagttgagaaggctaa

SEQ ID NO: 7338998 - DNA, 22 bp, Homo sapiens
ttcatcatcagaactgttcact

SEQ ID NO: 7338999 - DNA, 22 bp, Homo sapiens
ttcatgtaataggatgtgttaa

SEQ ID NO: 7339000 - DNA, 22 bp, Homo sapiens
ttcatgtagtgtaatgtcttca

SEQ ID NO: 7339001 - DNA, 22 bp, Homo sapiens
ttcatgtagtgtaatgtcttca

SEQ ID NO: 7339002 - DNA, 22 bp, Homo sapiens
ttccaatttgtggtgagttaat

SEQ ID NO: 7339003 - DNA, 18 bp, Homo sapiens
ttcatgttggcttaggga

SEQ ID NO: 7339004 - DNA, 22 bp, Homo sapiens
ttcatgtgccagagctgaaaat

SEQ ID NO: 7339005 - DNA, 22 bp, Homo sapiens
ttcatgttcatgcttaggaaaa

SEQ ID NO: 7339006 - DNA, 22 bp, Homo sapiens
ttcaggagctggctgcgaagga

SEQ ID NO: 7339007 - DNA, 22 bp, Homo sapiens
ttcaggagctagggatgtgaaa

SEQ ID NO: 7339008 - DNA, 22 bp, Homo sapiens
ttcacattccgcggctattttc

SEQ ID NO: 7339009 - DNA, 22 bp, Homo sapiens
ttcacattataatcagttctgc

SEQ ID NO: 7339010 - DNA, 22 bp, Homo sapiens
ttcacattatcaggattgtttc

SEQ ID NO: 7339011 - DNA, 22 bp, Homo sapiens
ttcacattccgcggctattttc

SEQ ID NO: 7339012 - DNA, 22 bp, Homo sapiens
ttcacagtggctgacaggctgg

SEQ ID NO: 7339013 - DNA, 22 bp, Homo sapiens
ttcacagtggctgtgccatttg

SEQ ID NO: 7339014 - DNA, 22 bp, Homo sapiens
ttcacagtggccctctctgagt

SEQ ID NO: 7339015 - DNA, 22 bp, Homo sapiens
ttcacagtggccctctctgagt

SEQ ID NO: 7339016 - DNA, 22 bp, Homo sapiens
ttcacagtgctgcacctggctt

SEQ ID NO: 7339017 - DNA, 21 bp, Homo sapiens
ttcacagtggataactttctg

SEQ ID NO: 7339018 - DNA, 22 bp, Homo sapiens
ttcacagtggctaagttctgca

SEQ ID NO: 7339019 - DNA, 22 bp, Homo sapiens
ttcacaaaaatgctgaacagtt

SEQ ID NO: 7339020 - DNA, 22 bp, Homo sapiens
ttcacaaaacactattttctgg

SEQ ID NO: 7339021 - DNA, 22 bp, Homo sapiens
ttcacaaaatggtttgttgatg

SEQ ID NO: 7339022 - DNA, 22 bp, Homo sapiens
ttcacaaacttcatgatggcac

SEQ ID NO: 7339023 - DNA, 22 bp, Homo sapiens
ttcacaaacaccagaatggcta

SEQ ID NO: 7339024 - DNA, 22 bp, Homo sapiens
ttcacaaagctggagcatttcc

SEQ ID NO: 7339025 - DNA, 22 bp, Homo sapiens
ttcacaaagctggttccttctg

SEQ ID NO: 7339026 - DNA, 22 bp, Homo sapiens
ttcacaatagctggcatcatct

SEQ ID NO: 7339027 - DNA, 22 bp, Homo sapiens
ttcacaagtcattagctgcata

SEQ ID NO: 7339028 - DNA, 22 bp, Homo sapiens
ttcacagtgccagggggcaggc

SEQ ID NO: 7339029 - DNA, 22 bp, Homo sapiens
ttcacagtctatcttggttttt

SEQ ID NO: 7339030 - DNA, 22 bp, Homo sapiens
ttcacagtgagctatgtcttgt

SEQ ID NO: 7339031 - DNA, 22 bp, Homo sapiens
ttcacagtgctcacagttcagt

SEQ ID NO: 7339032 - DNA, 22 bp, Homo sapiens
ttcacagtgctcacagttcagt

SEQ ID NO: 7339033 - DNA, 22 bp, Homo sapiens
ttcacagtgctcacagttcagt

SEQ ID NO: 7339034 - DNA, 22 bp, Homo sapiens
ttcacagtataggtttccagcg

SEQ ID NO: 7339035 - DNA, 22 bp, Homo sapiens
ttcacagtcacccttctccatg

SEQ ID NO: 7339036 - DNA, 22 bp, Homo sapiens
ttcacagtcacccttctccatg

SEQ ID NO: 7339037 - DNA, 22 bp, Homo sapiens
ttcacagtaagtaggatagttg

SEQ ID NO: 7339038 - DNA, 22 bp, Homo sapiens
ttcacagtaagtaggatagttg

SEQ ID NO: 7339039 - DNA, 22 bp, Homo sapiens
ttcacagtaatgtgcccaggta

SEQ ID NO: 7339040 - DNA, 22 bp, Homo sapiens
ttcacagtaacagggggatatg

SEQ ID NO: 7339041 - DNA, 22 bp, Homo sapiens
ttcacaggttctttttaaggct

SEQ ID NO: 7339042 - DNA, 22 bp, Homo sapiens
ttcaacaattaagtatcagcct

SEQ ID NO: 7339043 - DNA, 22 bp, Homo sapiens
ttcaacatgcaaacatgtttgt

SEQ ID NO: 7339044 - DNA, 22 bp, Homo sapiens
ttcaacatcaagaatgcatgga

SEQ ID NO: 7339045 - DNA, 22 bp, Homo sapiens
ttcaacatgctttatttctaaa

SEQ ID NO: 7339046 - DNA, 22 bp, Homo sapiens
ttcaacatttatcagtttatca

SEQ ID NO: 7339047 - DNA, 22 bp, Homo sapiens
ttcaactaatgtttattttatg

SEQ ID NO: 7339048 - DNA, 22 bp, Homo sapiens
ttcaactttaggcaaagaaaac

SEQ ID NO: 7339049 - DNA, 22 bp, Homo sapiens
ttcaactttatgcatatgtatt

SEQ ID NO: 7339050 - DNA, 22 bp, Homo sapiens
ttcaactttggagatttaataa

SEQ ID NO: 7339051 - DNA, 22 bp, Homo sapiens
ttcaacaagtcttttttcactg

SEQ ID NO: 7339052 - DNA, 22 bp, Homo sapiens
ttagagtttttgtaagtacaat

SEQ ID NO: 7339053 - DNA, 22 bp, Homo sapiens
ttagagttgagtttctatgaga

SEQ ID NO: 7339054 - DNA, 22 bp, Homo sapiens
ttagagttttctgttcctctaa

SEQ ID NO: 7339055 - DNA, 22 bp, Homo sapiens
ttctaatagctgcctatgtatt

SEQ ID NO: 7339056 - DNA, 22 bp, Homo sapiens
ttctaatacacggtatgacttt

SEQ ID NO: 7339057 - DNA, 22 bp, Homo sapiens
ttctagaaactggagcaaacag

SEQ ID NO: 7339058 - DNA, 22 bp, Homo sapiens
ttctagaaacacatgcaaacag

SEQ ID NO: 7339059 - DNA, 22 bp, Homo sapiens
ttctacaatatgaataatgaag

SEQ ID NO: 7339060 - DNA, 20 bp, Homo sapiens
ttctacaaaactgattctga

SEQ ID NO: 7339061 - DNA, 20 bp, Homo sapiens
ttctagggggagccacaaag

SEQ ID NO: 7339062 - DNA, 22 bp, Homo sapiens
ttctagaaccatgacttcaggg

SEQ ID NO: 7339063 - DNA, 22 bp, Homo sapiens
ttctagaatgttttgaaaggga

SEQ ID NO: 7339064 - DNA, 22 bp, Homo sapiens
ttctagaagtgtctatgtctgt

SEQ ID NO: 7339065 - DNA, 22 bp, Homo sapiens
ttcctgaatataaagacactag

SEQ ID NO: 7339066 - DNA, 22 bp, Homo sapiens
ttcctgtccgcaatggcctggg

SEQ ID NO: 7339067 - DNA, 22 bp, Homo sapiens
ttcctctttgcatcctcaactc

SEQ ID NO: 7339068 - DNA, 22 bp, Homo sapiens
ttcctgaaaatacagggagacc

SEQ ID NO: 7339069 - DNA, 22 bp, Homo sapiens
ttcctgaaaatacagggagaga

SEQ ID NO: 7339070 - DNA, 22 bp, Homo sapiens
ttcctctttagggctggccagg

SEQ ID NO: 7339071 - DNA, 23 bp, Homo sapiens
ttccttaactgttaagattgtct

SEQ ID NO: 7339072 - DNA, 22 bp, Homo sapiens
ttctaagaggctaatgaagaat

SEQ ID NO: 7339073 - DNA, 22 bp, Homo sapiens
ttccttctattcagctccaaga

SEQ ID NO: 7339074 - DNA, 22 bp, Homo sapiens
ttcctaacaaggggtattcatc

SEQ ID NO: 7339075 - DNA, 22 bp, Homo sapiens
ttcctaactggcctttatggat

SEQ ID NO: 7339076 - DNA, 22 bp, Homo sapiens
ttcctaactggcctttatggat

SEQ ID NO: 7339077 - DNA, 22 bp, Homo sapiens
ttcctaacacagtgtaagcaag

SEQ ID NO: 7339078 - DNA, 22 bp, Homo sapiens
ttcctaacaagtctatctttga

SEQ ID NO: 7339079 - DNA, 22 bp, Homo sapiens
ttcctaacgccagtattttcat

SEQ ID NO: 7339080 - DNA, 22 bp, Homo sapiens
ttcctaacctctagctgcatat

SEQ ID NO: 7339081 - DNA, 22 bp, Homo sapiens
ttcctaactctggcacctagtc

SEQ ID NO: 7339082 - DNA, 20 bp, Homo sapiens
ttccagagatctgcatttta

SEQ ID NO: 7339083 - DNA, 22 bp, Homo sapiens
ttccagaattttgttctgcttg

SEQ ID NO: 7339084 - DNA, 22 bp, Homo sapiens
ttccacaaatacactccacatt

SEQ ID NO: 7339085 - DNA, 22 bp, Homo sapiens
ttccacaaacacatcctgagca

SEQ ID NO: 7339086 - DNA, 22 bp, Homo sapiens
ttccacaaatcaattctgctga

SEQ ID NO: 7339087 - DNA, 22 bp, Homo sapiens
ttccacaacaaccaagcatata

SEQ ID NO: 7339088 - DNA, 22 bp, Homo sapiens
ttccacaagacttgggttaaga

SEQ ID NO: 7339089 - DNA, 22 bp, Homo sapiens
ttccacaagatgtttcttagaa

SEQ ID NO: 7339090 - DNA, 22 bp, Homo sapiens
ttccacaaggccttgtcctgct

SEQ ID NO: 7339091 - DNA, 22 bp, Homo sapiens
ttccacaagtgatatctagctg

SEQ ID NO: 7339092 - DNA, 22 bp, Homo sapiens
ttccacaagtgatatctagctg

SEQ ID NO: 7339093 - DNA, 17 bp, Homo sapiens
ttccacaatagtttgtc

SEQ ID NO: 7339094 - DNA, 23 bp, Homo sapiens
ttccacaatgaaaataaagcagg

SEQ ID NO: 7339095 - DNA, 22 bp, Homo sapiens
ttccacaatggttaagctcgtt

SEQ ID NO: 7339096 - DNA, 22 bp, Homo sapiens
ttccacaatgccaggggcatca

SEQ ID NO: 7339097 - DNA, 22 bp, Homo sapiens
ttccacaatgtatgaataagat

SEQ ID NO: 7339098 - DNA, 22 bp, Homo sapiens
ttccacaattcagattgttgcc

SEQ ID NO: 7339099 - DNA, 22 bp, Homo sapiens
ttccacacttaaggaatatgat

SEQ ID NO: 7339100 - DNA, 22 bp, Homo sapiens
ttccacactttcacacgaggtc

SEQ ID NO: 7339101 - DNA, 20 bp, Homo sapiens
ttccacatctttgcacatgc

SEQ ID NO: 7339102 - DNA, 22 bp, Homo sapiens
ttccagaactcaagaaatgccc

SEQ ID NO: 7339103 - DNA, 22 bp, Homo sapiens
ttcctcttattttcccagtgat

SEQ ID NO: 7339104 - DNA, 22 bp, Homo sapiens
ttcctctggggccaggccaaca

SEQ ID NO: 7339105 - DNA, 22 bp, Homo sapiens
ttcctcatggggttccttcaga

SEQ ID NO: 7339106 - DNA, 22 bp, Homo sapiens
ttcctcagctgtgtcctggcga

SEQ ID NO: 7339107 - DNA, 22 bp, Homo sapiens
ttcctcagctttagactatgaa

SEQ ID NO: 7339108 - DNA, 22 bp, Homo sapiens
ttcctcagctgtttgggctcat

SEQ ID NO: 7339109 - DNA, 20 bp, Homo sapiens
ttcctcaggagaggatgtta

SEQ ID NO: 7339110 - DNA, 22 bp, Homo sapiens
ttcctcaggactgttgacttcc

SEQ ID NO: 7339111 - DNA, 22 bp, Homo sapiens
ttcctcaggcttccctttgtcc

SEQ ID NO: 7339112 - DNA, 22 bp, Homo sapiens
ttcctcaggctgctttcacata

SEQ ID NO: 7339113 - DNA, 22 bp, Homo sapiens
ttcctcagttagtgcctgaggc

SEQ ID NO: 7339114 - DNA, 22 bp, Homo sapiens
ttcctcagtgcccccatacggt

SEQ ID NO: 7339115 - DNA, 22 bp, Homo sapiens
ttcctcagtgatggattcaacg

SEQ ID NO: 7339116 - DNA, 22 bp, Homo sapiens
ttcctcaggtgctacaaagcag

SEQ ID NO: 7339117 - DNA, 22 bp, Homo sapiens
ttcctcagggaggctagcagta

SEQ ID NO: 7339118 - DNA, 22 bp, Homo sapiens
ttcctcagggcggatgggcagg

SEQ ID NO: 7339119 - DNA, 22 bp, Homo sapiens
ttcctatttccatgaaacacaa

SEQ ID NO: 7339120 - DNA, 22 bp, Homo sapiens
ttcctataagtcacactgttgt

SEQ ID NO: 7339121 - DNA, 22 bp, Homo sapiens
ttcctcagaaaatactgtccaa

SEQ ID NO: 7339122 - DNA, 22 bp, Homo sapiens
ttcctcagaccctcattgtgag

SEQ ID NO: 7339123 - DNA, 22 bp, Homo sapiens
ttcctcagagagacagaaacta

SEQ ID NO: 7339124 - DNA, 22 bp, Homo sapiens
ttcctcagagggcgctggggaa

SEQ ID NO: 7339125 - DNA, 22 bp, Homo sapiens
ttcctcagcacaaagccaagat

SEQ ID NO: 7339126 - DNA, 22 bp, Homo sapiens
ttcctcagccaaggctgggatc

SEQ ID NO: 7339127 - DNA, 22 bp, Homo sapiens
ttcctcagctggcctgattggg

SEQ ID NO: 7339128 - DNA, 22 bp, Homo sapiens
ttcctcagctcagcgagagaga

SEQ ID NO: 7339129 - DNA, 22 bp, Homo sapiens
ttcctcagccagcacttagggg

SEQ ID NO: 7339130 - DNA, 22 bp, Homo sapiens
gtagaaaaagcagtaagtctca

SEQ ID NO: 7339131 - DNA, 22 bp, Homo sapiens
gtactgctgtaaatattcttca

SEQ ID NO: 7339132 - DNA, 23 bp, Homo sapiens
gtacacatagtgtagttatattt

SEQ ID NO: 7339133 - DNA, 22 bp, Homo sapiens
gtacacatatattaaaaattgt

SEQ ID NO: 7339134 - DNA, 22 bp, Homo sapiens
gtacacatatttccaagggtaa

SEQ ID NO: 7339135 - DNA, 22 bp, Homo sapiens
gtacactccccctgtgaagttg

SEQ ID NO: 7339136 - DNA, 18 bp, Homo sapiens
gtacactacatgtctaac

SEQ ID NO: 7339137 - DNA, 22 bp, Homo sapiens
cagcagcctagaagctctacca

SEQ ID NO: 7339138 - DNA, 22 bp, Homo sapiens
cagcagcctagaagctctacca

SEQ ID NO: 7339139 - DNA, 22 bp, Homo sapiens
gtacacataggttactgattaa

SEQ ID NO: 7339140 - DNA, 22 bp, Homo sapiens
gtacacaggcagcccagtgctg

SEQ ID NO: 7339141 - DNA, 21 bp, Homo sapiens
gtacacagtggttctgaggga

SEQ ID NO: 7339142 - DNA, 22 bp, Homo sapiens
cagcagccactagagggctcac

SEQ ID NO: 7339143 - DNA, 22 bp, Homo sapiens
cagcaaaatttgaggattgcct

SEQ ID NO: 7339144 - DNA, 22 bp, Homo sapiens
cagcaaaggtagaagcacagga

SEQ ID NO: 7339145 - DNA, 22 bp, Homo sapiens
cagcagccactagagggctcac

SEQ ID NO: 7339146 - DNA, 22 bp, Homo sapiens
cagcagccagacaagatacatc

SEQ ID NO: 7339147 - DNA, 19 bp, Homo sapiens
cagcagccagggggcccct

SEQ ID NO: 7339148 - DNA, 19 bp, Homo sapiens
cagcagccagggggcccct

SEQ ID NO: 7339149 - DNA, 22 bp, Homo sapiens
cagcagcctacaatgcacagaa

SEQ ID NO: 7339150 - DNA, 22 bp, Homo sapiens
cagcagcctacaatgcacagaa

SEQ ID NO: 7339151 - DNA, 22 bp, Homo sapiens
cagcagccgagagggggctctg

SEQ ID NO: 7339152 - DNA, 20 bp, Homo sapiens
cagcagccattctagtagta

SEQ ID NO: 7339153 - DNA, 22 bp, Homo sapiens
cagcagccctttggctgaactg

SEQ ID NO: 7339154 - DNA, 22 bp, Homo sapiens
cagcagccctttggctgaactg

SEQ ID NO: 7339155 - DNA, 22 bp, Homo sapiens
cagatttaagatatttgtattg

SEQ ID NO: 7339156 - DNA, 22 bp, Homo sapiens
cagcaaaacagccgttgcctgg

SEQ ID NO: 7339157 - DNA, 22 bp, Homo sapiens
cagcaaaagccagcataagctc

SEQ ID NO: 7339158 - DNA, 22 bp, Homo sapiens
cagcaaaagccagcataagctc

SEQ ID NO: 7339159 - DNA, 22 bp, Homo sapiens
cagattaagtgctcaacagtgt

SEQ ID NO: 7339160 - DNA, 22 bp, Homo sapiens
cagattactttgtagcagtcag

SEQ ID NO: 7339161 - DNA, 22 bp, Homo sapiens
cagatttaagagataaacagtg

SEQ ID NO: 7339162 - DNA, 22 bp, Homo sapiens
cagccaggagcctctgcaacta

SEQ ID NO: 7339163 - DNA, 22 bp, Homo sapiens
cagccaggagctccccctgctc

SEQ ID NO: 7339164 - DNA, 22 bp, Homo sapiens
cagccaggacagggaaactagt

SEQ ID NO: 7339165 - DNA, 22 bp, Homo sapiens
cagccagctggtgcggcagagc

SEQ ID NO: 7339166 - DNA, 22 bp, Homo sapiens
cagccagctgtcccaagtgcct

SEQ ID NO: 7339167 - DNA, 22 bp, Homo sapiens
gtcagcaaaaaatttatgtgag

SEQ ID NO: 7339168 - DNA, 22 bp, Homo sapiens
gtcagcaagatgaatcagcagg

SEQ ID NO: 7339169 - DNA, 22 bp, Homo sapiens
gtcagcaaggaaaatgtgtcac

SEQ ID NO: 7339170 - DNA, 22 bp, Homo sapiens
gtcagcaaggtgcaagcggctg

SEQ ID NO: 7339171 - DNA, 22 bp, Homo sapiens
gtcagcaatagttagtttacaa

SEQ ID NO: 7339172 - DNA, 22 bp, Homo sapiens
gtcagcaattcaagagctctta

SEQ ID NO: 7339173 - DNA, 22 bp, Homo sapiens
gtcagcaattcaagagctctta

SEQ ID NO: 7339174 - DNA, 22 bp, Homo sapiens
gtcacagaggctgccagggttg

SEQ ID NO: 7339175 - DNA, 22 bp, Homo sapiens
gtcagagttccaaattaatcaa

SEQ ID NO: 7339176 - DNA, 21 bp, Homo sapiens
gtcacacaggcctggagctga

SEQ ID NO: 7339177 - DNA, 22 bp, Homo sapiens
gtcctgtgcaccgtgggatgtt

SEQ ID NO: 7339178 - DNA, 22 bp, Homo sapiens
cagccctcctaccctgccaggc

SEQ ID NO: 7339179 - DNA, 20 bp, Homo sapiens
cagccctccagtggaggcag

SEQ ID NO: 7339180 - DNA, 19 bp, Homo sapiens
cagccctcttaccactgtg

SEQ ID NO: 7339181 - DNA, 22 bp, Homo sapiens
cagccctcatctcagcttcttt

SEQ ID NO: 7339182 - DNA, 23 bp, Homo sapiens
gtgagcagcccactaggaatgcc

SEQ ID NO: 7339183 - DNA, 22 bp, Homo sapiens
cagccctggccccaggtggtct

SEQ ID NO: 7339184 - DNA, 22 bp, Homo sapiens
cagccctggcccaggtgcctta

SEQ ID NO: 7339185 - DNA, 22 bp, Homo sapiens
cagccctgtccaatgtctgctc

SEQ ID NO: 7339186 - DNA, 22 bp, Homo sapiens
ggtagtttaagaaataattgtt

SEQ ID NO: 7339187 - DNA, 22 bp, Homo sapiens
ggtatacaagagcaatttaggg

SEQ ID NO: 7339188 - DNA, 22 bp, Homo sapiens
gggttcctggctcctgtgtggt

SEQ ID NO: 7339189 - DNA, 22 bp, Homo sapiens
gggttcagtccctcttgctact

SEQ ID NO: 7339190 - DNA, 22 bp, Homo sapiens
gggtccagtagttggtggccgt

SEQ ID NO: 7339191 - DNA, 22 bp, Homo sapiens
gggtccagggccagtggctgag

SEQ ID NO: 7339192 - DNA, 22 bp, Homo sapiens
gggtccctggaattacttgaca

SEQ ID NO: 7339193 - DNA, 20 bp, Homo sapiens
gggtcctgacttggtctcct

SEQ ID NO: 7339194 - DNA, 22 bp, Homo sapiens
gggtcctgcgtgggcccaggac

SEQ ID NO: 7339195 - DNA, 18 bp, Homo sapiens
gggtcctgtgggagacag

SEQ ID NO: 7339196 - DNA, 22 bp, Homo sapiens
cagatgagggctggaggtgagc

SEQ ID NO: 7339197 - DNA, 22 bp, Homo sapiens
cagatgaccgtcttccagccag

SEQ ID NO: 7339198 - DNA, 22 bp, Homo sapiens
cagatgaagtaggtgacgagca

SEQ ID NO: 7339199 - DNA, 22 bp, Homo sapiens
ggtatttatagtggtgcttagt

SEQ ID NO: 7339200 - DNA, 22 bp, Homo sapiens
ggtcctgcgtctggctcgcccg

SEQ ID NO: 7339201 - DNA, 22 bp, Homo sapiens
ggtcctgctggctcagctgagc

SEQ ID NO: 7339202 - DNA, 22 bp, Homo sapiens
cagatgtggttaacatgtacat

SEQ ID NO: 7339203 - DNA, 22 bp, Homo sapiens
ggtccctggttccctctgagct

SEQ ID NO: 7339204 - DNA, 22 bp, Homo sapiens
cagatgcagcaaaatgacaggc

SEQ ID NO: 7339205 - DNA, 23 bp, Homo sapiens
cagatgaggttggcagcatggtc

SEQ ID NO: 7339206 - DNA, 22 bp, Homo sapiens
ggtcctgcattgccagcaagct

SEQ ID NO: 7339207 - DNA, 22 bp, Homo sapiens
ggggcagagtctggactgttgt

SEQ ID NO: 7339208 - DNA, 22 bp, Homo sapiens
ggggcagagtctggactgttgt

SEQ ID NO: 7339209 - DNA, 22 bp, Homo sapiens
ggggcagatggaacagagcaca

SEQ ID NO: 7339210 - DNA, 22 bp, Homo sapiens
ggggcagatggaacagagcaca

SEQ ID NO: 7339211 - DNA, 22 bp, Homo sapiens
ggggcagcctccaggaaagctg

SEQ ID NO: 7339212 - DNA, 21 bp, Homo sapiens
ggggcctctccacacagccgg

SEQ ID NO: 7339213 - DNA, 22 bp, Homo sapiens
ggggcctcgccgccgcctctgc

SEQ ID NO: 7339214 - DNA, 21 bp, Homo sapiens
ggggcctctccacacagccgg

SEQ ID NO: 7339215 - DNA, 21 bp, Homo sapiens
ggggcctctccacacagccgg

SEQ ID NO: 7339216 - DNA, 22 bp, Homo sapiens
ggggcctctgcagtcacgctgg

SEQ ID NO: 7339217 - DNA, 23 bp, Homo sapiens
ggggcctgcaccggtctgcgcgg

SEQ ID NO: 7339218 - DNA, 23 bp, Homo sapiens
ggggcctgcaccggtctgcgcgg

SEQ ID NO: 7339219 - DNA, 22 bp, Homo sapiens
ggggcctctgggaacccctgtg

SEQ ID NO: 7339220 - DNA, 22 bp, Homo sapiens
ggggcagagcatagctccaatt

SEQ ID NO: 7339221 - DNA, 21 bp, Homo sapiens
ggggcagagctaggccctgca

SEQ ID NO: 7339222 - DNA, 22 bp, Homo sapiens
ggggcagagcatagctccaatt

SEQ ID NO: 7339223 - DNA, 22 bp, Homo sapiens
ggggcagagcatagctccaatt

SEQ ID NO: 7339224 - DNA, 22 bp, Homo sapiens
ggggcagagtagctggggtgtg

SEQ ID NO: 7339225 - DNA, 22 bp, Homo sapiens
ggggcagagtagctggggtgtg

SEQ ID NO: 7339226 - DNA, 21 bp, Homo sapiens
ggggcagagctaggccctgca

SEQ ID NO: 7339227 - DNA, 21 bp, Homo sapiens
ggggcagagctaggccctgca

SEQ ID NO: 7339228 - DNA, 21 bp, Homo sapiens
ggggcagagctaggccctgca

SEQ ID NO: 7339229 - DNA, 22 bp, Homo sapiens
ggggcagagtagctggggtgtg

SEQ ID NO: 7339230 - DNA, 22 bp, Homo sapiens
ggggcagaagtagtgcccctga

SEQ ID NO: 7339231 - DNA, 22 bp, Homo sapiens
ggggcagaagtagtgcccctga

SEQ ID NO: 7339232 - DNA, 22 bp, Homo sapiens
ggggcagagaataaaaacctaa

SEQ ID NO: 7339233 - DNA, 22 bp, Homo sapiens
ggggcagagaataaaaacctaa

SEQ ID NO: 7339234 - DNA, 22 bp, Homo sapiens
ggggcagagagaaggaagcttg

SEQ ID NO: 7339235 - DNA, 22 bp, Homo sapiens
ggggcagagagaaggaagcttg

SEQ ID NO: 7339236 - DNA, 22 bp, Homo sapiens
ggggtgagctgggcctgtgcct

SEQ ID NO: 7339237 - DNA, 22 bp, Homo sapiens
ggggcgactgtatcttggggca

SEQ ID NO: 7339238 - DNA, 22 bp, Homo sapiens
ggggcgactgtatcttggggca

SEQ ID NO: 7339239 - DNA, 22 bp, Homo sapiens
ggggccttggatctgtgccccg

SEQ ID NO: 7339240 - DNA, 22 bp, Homo sapiens
ggggccttttctgaatgtggaa

SEQ ID NO: 7339241 - DNA, 22 bp, Homo sapiens
ggggcctgtagagcttcaggga

SEQ ID NO: 7339242 - DNA, 22 bp, Homo sapiens
ggggccttggatctgtgccccg

SEQ ID NO: 7339243 - DNA, 22 bp, Homo sapiens
gggtaaatctcttttcatggct

SEQ ID NO: 7339244 - DNA, 21 bp, Homo sapiens
ggggttggcaagagcagagac

SEQ ID NO: 7339245 - DNA, 22 bp, Homo sapiens
gggctgtgagagtggggctgct

SEQ ID NO: 7339246 - DNA, 22 bp, Homo sapiens
gggctgtgagagtggggctgct

SEQ ID NO: 7339247 - DNA, 22 bp, Homo sapiens
gggctgtgtaatgtgctctttt

SEQ ID NO: 7339248 - DNA, 22 bp, Homo sapiens
gggctgtgggacccggcacttt

SEQ ID NO: 7339249 - DNA, 22 bp, Homo sapiens
gggctgtggagccgcgagggct

SEQ ID NO: 7339250 - DNA, 22 bp, Homo sapiens
gggctgtgcctcaggtggggtc

SEQ ID NO: 7339251 - DNA, 22 bp, Homo sapiens
gggctgtgcctcaggtggggtc

SEQ ID NO: 7339252 - DNA, 22 bp, Homo sapiens
gggctgtgaggtgagaacttac

SEQ ID NO: 7339253 - DNA, 20 bp, Homo sapiens
gggctgtgcctcctcgtggt

SEQ ID NO: 7339254 - DNA, 22 bp, Homo sapiens
gggctggaggaccggcctcgga

SEQ ID NO: 7339255 - DNA, 21 bp, Homo sapiens
gggctggaggatgggaagccc

SEQ ID NO: 7339256 - DNA, 19 bp, Homo sapiens
gggctggagggatagagcc

SEQ ID NO: 7339257 - DNA, 22 bp, Homo sapiens
gggctggaggtgagcaggacag

SEQ ID NO: 7339258 - DNA, 22 bp, Homo sapiens
cagagcagaagcggtcctcaca

SEQ ID NO: 7339259 - DNA, 22 bp, Homo sapiens
cagagcagaaacctgggtgatt

SEQ ID NO: 7339260 - DNA, 22 bp, Homo sapiens
gggatgagagctgggacagaag

SEQ ID NO: 7339261 - DNA, 22 bp, Homo sapiens
cagagcacctgctcattgccag

SEQ ID NO: 7339262 - DNA, 22 bp, Homo sapiens
gggatgaattgagtcagaaggg

SEQ ID NO: 7339263 - DNA, 22 bp, Homo sapiens
cagacttgaaagagactcagtt

SEQ ID NO: 7339264 - DNA, 22 bp, Homo sapiens
cagagacagaaaatggatctag

SEQ ID NO: 7339265 - DNA, 22 bp, Homo sapiens
cagagacacttaacaggaatgg

SEQ ID NO: 7339266 - DNA, 22 bp, Homo sapiens
cagagacacttaacaggaatgg

SEQ ID NO: 7339267 - DNA, 22 bp, Homo sapiens
cagagacaccccagaaaataag

SEQ ID NO: 7339268 - DNA, 22 bp, Homo sapiens
cagagacaacctggtagagaaa

SEQ ID NO: 7339269 - DNA, 22 bp, Homo sapiens
gggcaggtacaagatgcttctt

SEQ ID NO: 7339270 - DNA, 22 bp, Homo sapiens
gggcaggggtcagtggccccaa

SEQ ID NO: 7339271 - DNA, 22 bp, Homo sapiens
gggcaggggtcagtggccccaa

SEQ ID NO: 7339272 - DNA, 22 bp, Homo sapiens
gggcaggtacaagatgcttctt

SEQ ID NO: 7339273 - DNA, 22 bp, Homo sapiens
gggcaggtactgggtggtgagc

SEQ ID NO: 7339274 - DNA, 22 bp, Homo sapiens
gggcaggtactgggtggtgagc

SEQ ID NO: 7339275 - DNA, 22 bp, Homo sapiens
gggcaggggtagcattccaagt

SEQ ID NO: 7339276 - DNA, 17 bp, Homo sapiens
gggcagggactcctggg

SEQ ID NO: 7339277 - DNA, 17 bp, Homo sapiens
gggcagggactcctggg

SEQ ID NO: 7339278 - DNA, 22 bp, Homo sapiens
cagagcagaagcggtcctcaca

SEQ ID NO: 7339279 - DNA, 20 bp, Homo sapiens
cagagccaagagcagcatct

SEQ ID NO: 7339280 - DNA, 20 bp, Homo sapiens
cagagcagtgcccaggcggc

SEQ ID NO: 7339281 - DNA, 22 bp, Homo sapiens
cagagcagtggagagtaggtct

SEQ ID NO: 7339282 - DNA, 22 bp, Homo sapiens
cagacagaaggaaggccaacat

SEQ ID NO: 7339283 - DNA, 22 bp, Homo sapiens
cagacacacaagcaatctaagt

SEQ ID NO: 7339284 - DNA, 22 bp, Homo sapiens
cagacacacaccctggcctagc

SEQ ID NO: 7339285 - DNA, 22 bp, Homo sapiens
cagacacacaccctggcctagc

SEQ ID NO: 7339286 - DNA, 22 bp, Homo sapiens
cagacacagatatgcatatggc

SEQ ID NO: 7339287 - DNA, 22 bp, Homo sapiens
gggaggcagtgctggaggctgg

SEQ ID NO: 7339288 - DNA, 22 bp, Homo sapiens
gggaggcacgaggcgcgcagtg

SEQ ID NO: 7339289 - DNA, 22 bp, Homo sapiens
gggaggcacgaggcgcgcagtg

SEQ ID NO: 7339290 - DNA, 22 bp, Homo sapiens
gggaggagtgaagattcacctg

SEQ ID NO: 7339291 - DNA, 21 bp, Homo sapiens
gggagctggaaactgggtgac

SEQ ID NO: 7339292 - DNA, 22 bp, Homo sapiens
cagaataaaggtacaattgagt

SEQ ID NO: 7339293 - DNA, 22 bp, Homo sapiens
cagacaattaagtaattgaggt

SEQ ID NO: 7339294 - DNA, 22 bp, Homo sapiens
cagacaaagcggaaactgttta

SEQ ID NO: 7339295 - DNA, 22 bp, Homo sapiens
cagaatttgaagtaatattcca

SEQ ID NO: 7339296 - DNA, 22 bp, Homo sapiens
cagaaacacttgtagagaagtt

SEQ ID NO: 7339297 - DNA, 22 bp, Homo sapiens
cagaaacacttgtagagaagtt

SEQ ID NO: 7339298 - DNA, 22 bp, Homo sapiens
ggctggcactgaggagagctct

SEQ ID NO: 7339299 - DNA, 22 bp, Homo sapiens
cagaaaatagagtttctctgag

SEQ ID NO: 7339300 - DNA, 22 bp, Homo sapiens
cagaaaatagagtttctctgag

SEQ ID NO: 7339301 - DNA, 22 bp, Homo sapiens
caatttcattaatagatataga

SEQ ID NO: 7339302 - DNA, 22 bp, Homo sapiens
caatttcattaatagatataga

SEQ ID NO: 7339303 - DNA, 21 bp, Homo sapiens
caatttcatgggaagatggga

SEQ ID NO: 7339304 - DNA, 22 bp, Homo sapiens
caatttcatcttgtgcttcaat

SEQ ID NO: 7339305 - DNA, 20 bp, Homo sapiens
caatttcatcatttcctgtg

SEQ ID NO: 7339306 - DNA, 20 bp, Homo sapiens
caatttcatcatttcctgtg

SEQ ID NO: 7339307 - DNA, 18 bp, Homo sapiens
caatttcatccttaagcc

SEQ ID NO: 7339308 - DNA, 18 bp, Homo sapiens
caatttcaatggtctgaa

SEQ ID NO: 7339309 - DNA, 22 bp, Homo sapiens
caatttcactaataatatttac

SEQ ID NO: 7339310 - DNA, 22 bp, Homo sapiens
caatttcactaataatatttac

SEQ ID NO: 7339311 - DNA, 22 bp, Homo sapiens
caatttcagacctttccttgga

SEQ ID NO: 7339312 - DNA, 22 bp, Homo sapiens
caatttcagacctttccttgga

SEQ ID NO: 7339313 - DNA, 23 bp, Homo sapiens
caatttcatatgattctacctaa

SEQ ID NO: 7339314 - DNA, 22 bp, Homo sapiens
caatttcagtctcagagagttc

SEQ ID NO: 7339315 - DNA, 22 bp, Homo sapiens
caatttcagtgctgtggagagg

SEQ ID NO: 7339316 - DNA, 22 bp, Homo sapiens
caatgttttcaactgacaagta

SEQ ID NO: 7339317 - DNA, 22 bp, Homo sapiens
caatgttttgttgaatgaatag

SEQ ID NO: 7339318 - DNA, 22 bp, Homo sapiens
caatgttttgttgaatgaatag

SEQ ID NO: 7339319 - DNA, 22 bp, Homo sapiens
caatcactgacctgcagatgca

SEQ ID NO: 7339320 - DNA, 22 bp, Homo sapiens
caatcactgggatattggtgtg

SEQ ID NO: 7339321 - DNA, 22 bp, Homo sapiens
caatattcagtggaaaagccat

SEQ ID NO: 7339322 - DNA, 22 bp, Homo sapiens
caatttcaatacaaaatacatt

SEQ ID NO: 7339323 - DNA, 19 bp, Homo sapiens
caattctattatcattcca

SEQ ID NO: 7339324 - DNA, 22 bp, Homo sapiens
caattctgaggcctgctttgtt

SEQ ID NO: 7339325 - DNA, 19 bp, Homo sapiens
caattctgcaacactgtcc

SEQ ID NO: 7339326 - DNA, 22 bp, Homo sapiens
caattctgaggcctgctttgtt

SEQ ID NO: 7339327 - DNA, 22 bp, Homo sapiens
caattctgcaagtgactgacct

SEQ ID NO: 7339328 - DNA, 19 bp, Homo sapiens
caattctgcaacactgtcc

SEQ ID NO: 7339329 - DNA, 22 bp, Homo sapiens
caatatataggaacaacttagg

SEQ ID NO: 7339330 - DNA, 22 bp, Homo sapiens
caatagaaggcacagataggta

SEQ ID NO: 7339331 - DNA, 22 bp, Homo sapiens
caatagaaaactcaatacttaa

SEQ ID NO: 7339332 - DNA, 22 bp, Homo sapiens
caatactgggcaggagagtaca

SEQ ID NO: 7339333 - DNA, 22 bp, Homo sapiens
caatactgggcaggagagtaca

SEQ ID NO: 7339334 - DNA, 22 bp, Homo sapiens
caatactgcatctttgcccttt

SEQ ID NO: 7339335 - DNA, 22 bp, Homo sapiens
caatactgcatctttgcccttt

SEQ ID NO: 7339336 - DNA, 22 bp, Homo sapiens
caaggctgtctccagcttccaa

SEQ ID NO: 7339337 - DNA, 22 bp, Homo sapiens
caaggctgcactgttgccatag

SEQ ID NO: 7339338 - DNA, 22 bp, Homo sapiens
cacaaatgactgaaacgactgt

SEQ ID NO: 7339339 - DNA, 22 bp, Homo sapiens
ggaagctgggatctctctcccg

SEQ ID NO: 7339340 - DNA, 22 bp, Homo sapiens
ggaagctgaatccagagacagg

SEQ ID NO: 7339341 - DNA, 22 bp, Homo sapiens
cacaacttagcaatgttttaga

SEQ ID NO: 7339342 - DNA, 22 bp, Homo sapiens
cacaacttagcagcttgaaaca

SEQ ID NO: 7339343 - DNA, 19 bp, Homo sapiens
cacaacttcgcttgattcc

SEQ ID NO: 7339344 - DNA, 22 bp, Homo sapiens
cacaaatggttgtagacattaa

SEQ ID NO: 7339345 - DNA, 22 bp, Homo sapiens
cacaaatgtgcagaaatgtgag

SEQ ID NO: 7339346 - DNA, 23 bp, Homo sapiens
ggacatgtctctgggtattttga

SEQ ID NO: 7339347 - DNA, 22 bp, Homo sapiens
ggacatgtgcaacttctttgga

SEQ ID NO: 7339348 - DNA, 22 bp, Homo sapiens
ggacatggagctccatggaggc

SEQ ID NO: 7339349 - DNA, 22 bp, Homo sapiens
ggaccacagtgcatggcctgta

SEQ ID NO: 7339350 - DNA, 22 bp, Homo sapiens
ggagaagggcatggtagtttta

SEQ ID NO: 7339351 - DNA, 22 bp, Homo sapiens
ggagaagggtatgtgtggcgga

SEQ ID NO: 7339352 - DNA, 22 bp, Homo sapiens
ggagaagggccaattccatgta

SEQ ID NO: 7339353 - DNA, 20 bp, Homo sapiens
ggagagcagggaagacagta

SEQ ID NO: 7339354 - DNA, 22 bp, Homo sapiens
ggagagaggagcccactgctgt

SEQ ID NO: 7339355 - DNA, 22 bp, Homo sapiens
ggagaaggtgctggtcactgtg

SEQ ID NO: 7339356 - DNA, 22 bp, Homo sapiens
ggagaaggcgaagtcattcttt

SEQ ID NO: 7339357 - DNA, 21 bp, Homo sapiens
cacacagtgatctatccacat

SEQ ID NO: 7339358 - DNA, 22 bp, Homo sapiens
cacacagggagaaagaaagcct

SEQ ID NO: 7339359 - DNA, 22 bp, Homo sapiens
cacacaggatgaagcagcagaa

SEQ ID NO: 7339360 - DNA, 20 bp, Homo sapiens
ggaccagctgtctgaggggc

SEQ ID NO: 7339361 - DNA, 22 bp, Homo sapiens
caagcgtggctgctctgatgga

SEQ ID NO: 7339362 - DNA, 22 bp, Homo sapiens
caagctccttacatccacaggg

SEQ ID NO: 7339363 - DNA, 22 bp, Homo sapiens
caagctccttacatccacaggg

SEQ ID NO: 7339364 - DNA, 22 bp, Homo sapiens
gctggggagcaagagtagtgag

SEQ ID NO: 7339365 - DNA, 22 bp, Homo sapiens
gctggcccagcgtggggccgtg

SEQ ID NO: 7339366 - DNA, 22 bp, Homo sapiens
gctggcccagggtcacctagga

SEQ ID NO: 7339367 - DNA, 22 bp, Homo sapiens
gctggcccagggtcacctagga

SEQ ID NO: 7339368 - DNA, 17 bp, Homo sapiens
gctggctgacccatgcc

SEQ ID NO: 7339369 - DNA, 22 bp, Homo sapiens
caagcctcagaatcttctccat

SEQ ID NO: 7339370 - DNA, 21 bp, Homo sapiens
gctgcctgcccctcgggggct

SEQ ID NO: 7339371 - DNA, 22 bp, Homo sapiens
gctgcctgcctagttccacagt

SEQ ID NO: 7339372 - DNA, 22 bp, Homo sapiens
gctgctttgtgaaaatcattca

SEQ ID NO: 7339373 - DNA, 22 bp, Homo sapiens
caagaataaccagacaatagca

SEQ ID NO: 7339374 - DNA, 22 bp, Homo sapiens
caagaataaaatacatgttgat

SEQ ID NO: 7339375 - DNA, 22 bp, Homo sapiens
gctggcccagcgtggggccgtg

SEQ ID NO: 7339376 - DNA, 22 bp, Homo sapiens
gctggcccagcgtggggccgtg

SEQ ID NO: 7339377 - DNA, 22 bp, Homo sapiens
caagaagaggtgattggtaagt

SEQ ID NO: 7339378 - DNA, 22 bp, Homo sapiens
caagaagaggtgattggtaagt

SEQ ID NO: 7339379 - DNA, 22 bp, Homo sapiens
gctggactcaggggactcaggg

SEQ ID NO: 7339380 - DNA, 22 bp, Homo sapiens
gctggacaggccacatggagga

SEQ ID NO: 7339381 - DNA, 22 bp, Homo sapiens
gctggaattggacccagggctc

SEQ ID NO: 7339382 - DNA, 22 bp, Homo sapiens
caacacattgaagctatgatga

SEQ ID NO: 7339383 - DNA, 22 bp, Homo sapiens
caacacaggttctgcaaaggaa

SEQ ID NO: 7339384 - DNA, 22 bp, Homo sapiens
caaattttgtgtgttctctagt

SEQ ID NO: 7339385 - DNA, 22 bp, Homo sapiens
gctgccctgtccggctctcctg

SEQ ID NO: 7339386 - DNA, 22 bp, Homo sapiens
caagaaatggggaggggagttg

SEQ ID NO: 7339387 - DNA, 22 bp, Homo sapiens
caagaaactttattctgccata

SEQ ID NO: 7339388 - DNA, 22 bp, Homo sapiens
caactttctgttaaatgttagt

SEQ ID NO: 7339389 - DNA, 22 bp, Homo sapiens
caacttttctgtgaatttaagt

SEQ ID NO: 7339390 - DNA, 22 bp, Homo sapiens
caactttcacactccacatgct

SEQ ID NO: 7339391 - DNA, 22 bp, Homo sapiens
gctgcctgcacagagctgcttt

SEQ ID NO: 7339392 - DNA, 22 bp, Homo sapiens
caagaacagtttgccaaattgg

SEQ ID NO: 7339393 - DNA, 22 bp, Homo sapiens
caagaaatttcttaagaactaa

SEQ ID NO: 7339394 - DNA, 22 bp, Homo sapiens
gctgccctgactccagcagcct

SEQ ID NO: 7339395 - DNA, 22 bp, Homo sapiens
gctgccctcccagggcaagctt

SEQ ID NO: 7339396 - DNA, 22 bp, Homo sapiens
gctgccctctctggccccacac

SEQ ID NO: 7339397 - DNA, 22 bp, Homo sapiens
gctgccctctgtgacccggccc

SEQ ID NO: 7339398 - DNA, 18 bp, Homo sapiens
gctgccctagctcccctc

SEQ ID NO: 7339399 - DNA, 22 bp, Homo sapiens
gctgccctccagttcccacagt

SEQ ID NO: 7339400 - DNA, 22 bp, Homo sapiens
gctgccacgatctctgctgtag

SEQ ID NO: 7339401 - DNA, 23 bp, Homo sapiens
gctctggagctgggcctggcagg

SEQ ID NO: 7339402 - DNA, 22 bp, Homo sapiens
gctctggaacctgccaggatgc

SEQ ID NO: 7339403 - DNA, 22 bp, Homo sapiens
gctctgcttgcatcatgactgc

SEQ ID NO: 7339404 - DNA, 22 bp, Homo sapiens
gctctggaggctggaagaccat

SEQ ID NO: 7339405 - DNA, 23 bp, Homo sapiens
gctctggagctgggcctggcagg

SEQ ID NO: 7339406 - DNA, 22 bp, Homo sapiens
caaagtcttggtgatcaacttt

SEQ ID NO: 7339407 - DNA, 22 bp, Homo sapiens
cacaggtgtgtcctggtcttgt

SEQ ID NO: 7339408 - DNA, 22 bp, Homo sapiens
cacaggtgttcttgcagtgaaa

SEQ ID NO: 7339409 - DNA, 21 bp, Homo sapiens
cacaggtgggtcagtgaggcc

SEQ ID NO: 7339410 - DNA, 21 bp, Homo sapiens
cacaggtgggtcagtgaggcc

SEQ ID NO: 7339411 - DNA, 22 bp, Homo sapiens
cacagtgaagcatgcagacatc

SEQ ID NO: 7339412 - DNA, 22 bp, Homo sapiens
cacagtgcatgatgggcagaag

SEQ ID NO: 7339413 - DNA, 22 bp, Homo sapiens
cacagtgacagctatacagaga

SEQ ID NO: 7339414 - DNA, 19 bp, Homo sapiens
cacagtgcagccatttctc

SEQ ID NO: 7339415 - DNA, 22 bp, Homo sapiens
cacagtgcactaagctccgggg

SEQ ID NO: 7339416 - DNA, 22 bp, Homo sapiens
cacagtgcaatcggccacaaat

SEQ ID NO: 7339417 - DNA, 22 bp, Homo sapiens
cacaggtgcaagaagttgcagt

SEQ ID NO: 7339418 - DNA, 22 bp, Homo sapiens
cacaggtgctcctcggggagct

SEQ ID NO: 7339419 - DNA, 22 bp, Homo sapiens
cacaggtgctcctcggggagct

SEQ ID NO: 7339420 - DNA, 22 bp, Homo sapiens
cacaggtagatgccatgcagca

SEQ ID NO: 7339421 - DNA, 22 bp, Homo sapiens
cacaggggcaaactgtagggga

SEQ ID NO: 7339422 - DNA, 20 bp, Homo sapiens
cacaggccccaagacctgta

SEQ ID NO: 7339423 - DNA, 22 bp, Homo sapiens
cacagggcaggtactctcagag

SEQ ID NO: 7339424 - DNA, 18 bp, Homo sapiens
cacaggcaggtgataggt

SEQ ID NO: 7339425 - DNA, 22 bp, Homo sapiens
ggagagcctccacggcttctgt

SEQ ID NO: 7339426 - DNA, 22 bp, Homo sapiens
cacaggaggttaggaagtggtc

SEQ ID NO: 7339427 - DNA, 22 bp, Homo sapiens
cacaggaggttaggaagtggtc

SEQ ID NO: 7339428 - DNA, 22 bp, Homo sapiens
cacaggcacccctgactgctca

SEQ ID NO: 7339429 - DNA, 22 bp, Homo sapiens
cacaggcacccctgactgctca

SEQ ID NO: 7339430 - DNA, 22 bp, Homo sapiens
cacaggcacccctgactgctca

SEQ ID NO: 7339431 - DNA, 22 bp, Homo sapiens
cacaggcacgcctctggccagg

SEQ ID NO: 7339432 - DNA, 22 bp, Homo sapiens
cacaggcacgcctctggccagg

SEQ ID NO: 7339433 - DNA, 22 bp, Homo sapiens
cacaggcacgcctctggccagg

SEQ ID NO: 7339434 - DNA, 23 bp, Homo sapiens
cacaggcagaaatcaagacggta

SEQ ID NO: 7339435 - DNA, 23 bp, Homo sapiens
cacaggcagaaatcaagacggta

SEQ ID NO: 7339436 - DNA, 22 bp, Homo sapiens
cacaggcagccttgtagaagaa

SEQ ID NO: 7339437 - DNA, 22 bp, Homo sapiens
cacaggcaggaggttctccagt

SEQ ID NO: 7339438 - DNA, 22 bp, Homo sapiens
cacaggcaggaggttctccagt

SEQ ID NO: 7339439 - DNA, 22 bp, Homo sapiens
ggcaatgtctcttgcttccagg

SEQ ID NO: 7339440 - DNA, 22 bp, Homo sapiens
ggcaatatggtgaaaccccatc

SEQ ID NO: 7339441 - DNA, 16 bp, Homo sapiens
cacatatatttatatg

SEQ ID NO: 7339442 - DNA, 22 bp, Homo sapiens
cacatatatgggcccctgaggg

SEQ ID NO: 7339443 - DNA, 22 bp, Homo sapiens
cacatatatgaaatgaggaatt

SEQ ID NO: 7339444 - DNA, 22 bp, Homo sapiens
ggcacaaaggaataaagagaac

SEQ ID NO: 7339445 - DNA, 22 bp, Homo sapiens
ggcaatttgcagtttgtcttat

SEQ ID NO: 7339446 - DNA, 22 bp, Homo sapiens
ggcaatttggtcatttgtattg

SEQ ID NO: 7339447 - DNA, 22 bp, Homo sapiens
ggcaattttcatgaattattga

SEQ ID NO: 7339448 - DNA, 22 bp, Homo sapiens
cacatgaattgatgccaagtgc

SEQ ID NO: 7339449 - DNA, 22 bp, Homo sapiens
ggcagatactaagctgcttcct

SEQ ID NO: 7339450 - DNA, 20 bp, Homo sapiens
ggcagatacctgtgtttaag

SEQ ID NO: 7339451 - DNA, 22 bp, Homo sapiens
ggcagagtggagtgcggcctcc

SEQ ID NO: 7339452 - DNA, 22 bp, Homo sapiens
ggcagagtgctctgggcagggg

SEQ ID NO: 7339453 - DNA, 22 bp, Homo sapiens
cacatgcaggagccaatgtaca

SEQ ID NO: 7339454 - DNA, 22 bp, Homo sapiens
cacatgcaccagaaatcaacat

SEQ ID NO: 7339455 - DNA, 22 bp, Homo sapiens
cacattcatggagtttgcctgt

SEQ ID NO: 7339456 - DNA, 22 bp, Homo sapiens
cacattctgtccttgaactgca

SEQ ID NO: 7339457 - DNA, 22 bp, Homo sapiens
caccactgcttcctgccatctg

SEQ ID NO: 7339458 - DNA, 20 bp, Homo sapiens
cacatgctgtgtgtttctct

SEQ ID NO: 7339459 - DNA, 22 bp, Homo sapiens
cacatgcttagatttcagtgga

SEQ ID NO: 7339460 - DNA, 22 bp, Homo sapiens
cacatgtgggaaatggtgctta

SEQ ID NO: 7339461 - DNA, 22 bp, Homo sapiens
cacattcacttctctgtccacc

SEQ ID NO: 7339462 - DNA, 22 bp, Homo sapiens
caccaggctgaaccagagggga

SEQ ID NO: 7339463 - DNA, 22 bp, Homo sapiens
caccaggctgcccaggacaggg

SEQ ID NO: 7339464 - DNA, 22 bp, Homo sapiens
caccctgggctgggcctgttaa

SEQ ID NO: 7339465 - DNA, 22 bp, Homo sapiens
cacctgcctgctagagcctgac

SEQ ID NO: 7339466 - DNA, 22 bp, Homo sapiens
cacctggctggaagtgctccgg

SEQ ID NO: 7339467 - DNA, 22 bp, Homo sapiens
cacctggctgtgaagcctgggt

SEQ ID NO: 7339468 - DNA, 22 bp, Homo sapiens
ggccaggctggtctcagacttc

SEQ ID NO: 7339469 - DNA, 22 bp, Homo sapiens
ggccagggaggagaggcccctg

SEQ ID NO: 7339470 - DNA, 22 bp, Homo sapiens
ggccaggctgctgggaccccgc

SEQ ID NO: 7339471 - DNA, 22 bp, Homo sapiens
ggccaggctgccctgggagcag

SEQ ID NO: 7339472 - DNA, 22 bp, Homo sapiens
ggccaggctgccctgggagcag

SEQ ID NO: 7339473 - DNA, 22 bp, Homo sapiens
cactattttctcttcagatggc

SEQ ID NO: 7339474 - DNA, 22 bp, Homo sapiens
cactcagcccacccatgtttgt

SEQ ID NO: 7339475 - DNA, 22 bp, Homo sapiens
cactcagaggtttgattgctca

SEQ ID NO: 7339476 - DNA, 22 bp, Homo sapiens
cactcaggctgtgtcaggagga

SEQ ID NO: 7339477 - DNA, 22 bp, Homo sapiens
cactcagggtacaatggagggc

SEQ ID NO: 7339478 - DNA, 21 bp, Homo sapiens
cactcagggtatgtgccaggc

SEQ ID NO: 7339479 - DNA, 22 bp, Homo sapiens
cactcagggtacaatggagggc

SEQ ID NO: 7339480 - DNA, 22 bp, Homo sapiens
cactcagggatcaggtaaattc

SEQ ID NO: 7339481 - DNA, 21 bp, Homo sapiens
cactccacttagaacagggtt

SEQ ID NO: 7339482 - DNA, 22 bp, Homo sapiens
cactataatcctgttttagaac

SEQ ID NO: 7339483 - DNA, 22 bp, Homo sapiens
cactatttcctggattttgacg

SEQ ID NO: 7339484 - DNA, 21 bp, Homo sapiens
cactatttatatatgccagct

SEQ ID NO: 7339485 - DNA, 22 bp, Homo sapiens
cactgcactccagcctgggaga

SEQ ID NO: 7339486 - DNA, 22 bp, Homo sapiens
cactctccagcacaccccattt

SEQ ID NO: 7339487 - DNA, 22 bp, Homo sapiens
cacttaaatgttcctacagcag

SEQ ID NO: 7339488 - DNA, 22 bp, Homo sapiens
cacttaaatctgttgagaaaaa

SEQ ID NO: 7339489 - DNA, 22 bp, Homo sapiens
cactgtggagcaaatttattta

SEQ ID NO: 7339490 - DNA, 22 bp, Homo sapiens
ggctctgcttgaggccagcctg

SEQ ID NO: 7339491 - DNA, 20 bp, Homo sapiens
ggctctgcttgtgagcagcc

SEQ ID NO: 7339492 - DNA, 22 bp, Homo sapiens
cactttaactcacatttcagct

SEQ ID NO: 7339493 - DNA, 22 bp, Homo sapiens
ggctggcaagtcagtgctgatg

SEQ ID NO: 7339494 - DNA, 17 bp, Homo sapiens
ggctgctgtgctggtgc

SEQ ID NO: 7339495 - DNA, 17 bp, Homo sapiens
ggctgctgtgctggtgc

SEQ ID NO: 7339496 - DNA, 22 bp, Homo sapiens
cacttgtagaggcattattcca

SEQ ID NO: 7339497 - DNA, 21 bp, Homo sapiens
cactttaaaaatatctttata

SEQ ID NO: 7339498 - DNA, 22 bp, Homo sapiens
cacttctgttgccttgtgcaat

SEQ ID NO: 7339499 - DNA, 22 bp, Homo sapiens
cacttgcagactttgcctggtt

SEQ ID NO: 7339500 - DNA, 22 bp, Homo sapiens
cactgtaagatgagctttttta

SEQ ID NO: 7339501 - DNA, 22 bp, Homo sapiens
cactgtaaagcgtcacagggac

SEQ ID NO: 7339502 - DNA, 22 bp, Homo sapiens
cactgtactgggttgaaggacg

SEQ ID NO: 7339503 - DNA, 22 bp, Homo sapiens
cactgggatttggggtgtctta

SEQ ID NO: 7339504 - DNA, 22 bp, Homo sapiens
ggctctgcttgaggccagcctg

SEQ ID NO: 7339505 - DNA, 22 bp, Homo sapiens
ggctctgcttctcacctgttcc

SEQ ID NO: 7339506 - DNA, 22 bp, Homo sapiens
ggctctgcttcagaaggctcat

SEQ ID NO: 7339507 - DNA, 22 bp, Homo sapiens
ggctctgcttcctggaattgtg

SEQ ID NO: 7339508 - DNA, 22 bp, Homo sapiens
ggctctgctggattgaggccag

SEQ ID NO: 7339509 - DNA, 22 bp, Homo sapiens
ggctctgctggattgaggccag

SEQ ID NO: 7339510 - DNA, 22 bp, Homo sapiens
ggctctgctggtaagatgcctc

SEQ ID NO: 7339511 - DNA, 22 bp, Homo sapiens
cactgtactgtgaataaggagg

SEQ ID NO: 7339512 - DNA, 22 bp, Homo sapiens
cactgcactccagcctgggtga

SEQ ID NO: 7339513 - DNA, 22 bp, Homo sapiens
cactgcactccagcctgggtca

SEQ ID NO: 7339514 - DNA, 22 bp, Homo sapiens
cactgcactccagcctgggtca

SEQ ID NO: 7339515 - DNA, 22 bp, Homo sapiens
cactgcactccagcctgggtca

SEQ ID NO: 7339516 - DNA, 22 bp, Homo sapiens
cactgcactccagcctgggaga

SEQ ID NO: 7339517 - DNA, 22 bp, Homo sapiens
cactgcactccagcttgggtga

SEQ ID NO: 7339518 - DNA, 22 bp, Homo sapiens
cactgcactccagcctgggtga

SEQ ID NO: 7339519 - DNA, 22 bp, Homo sapiens
cactgggagagctggacttggg

SEQ ID NO: 7339520 - DNA, 22 bp, Homo sapiens
cactgcactccagcctgggtga

SEQ ID NO: 7339521 - DNA, 22 bp, Homo sapiens
atggctcatttatcttgcagcc

SEQ ID NO: 7339522 - DNA, 22 bp, Homo sapiens
atggctgaggctggaggtggca

SEQ ID NO: 7339523 - DNA, 22 bp, Homo sapiens
gagcacaggctttggtggacac

SEQ ID NO: 7339524 - DNA, 22 bp, Homo sapiens
gagcacaggctttggtggacac

SEQ ID NO: 7339525 - DNA, 22 bp, Homo sapiens
gagcacaggctgctgtgaactg

SEQ ID NO: 7339526 - DNA, 21 bp, Homo sapiens
atgggcagaggcagagaggct

SEQ ID NO: 7339527 - DNA, 22 bp, Homo sapiens
atgggcagacagggagctcacg

SEQ ID NO: 7339528 - DNA, 22 bp, Homo sapiens
atgggcagacagggagctcacg

SEQ ID NO: 7339529 - DNA, 22 bp, Homo sapiens
atgggcagagctggtgggaggc

SEQ ID NO: 7339530 - DNA, 22 bp, Homo sapiens
atgggcagacagggagctcacg

SEQ ID NO: 7339531 - DNA, 22 bp, Homo sapiens
atgggcagagctggtgggaggc

SEQ ID NO: 7339532 - DNA, 22 bp, Homo sapiens
gagccccaggacagctctagtt

SEQ ID NO: 7339533 - DNA, 22 bp, Homo sapiens
gagccccaggacagctctagtt

SEQ ID NO: 7339534 - DNA, 22 bp, Homo sapiens
gagcccgagcgcgtacccggcg

SEQ ID NO: 7339535 - DNA, 17 bp, Homo sapiens
gagcccgttatcgggga

SEQ ID NO: 7339536 - DNA, 22 bp, Homo sapiens
gagccccaccctagacattctg

SEQ ID NO: 7339537 - DNA, 22 bp, Homo sapiens
gagccccagccctgcttctata

SEQ ID NO: 7339538 - DNA, 22 bp, Homo sapiens
gagaagtgcagagtggttaagc

SEQ ID NO: 7339539 - DNA, 22 bp, Homo sapiens
gagaaggggtgatgtgggtaat

SEQ ID NO: 7339540 - DNA, 23 bp, Homo sapiens
gagaacagccacagagagctgtg

SEQ ID NO: 7339541 - DNA, 22 bp, Homo sapiens
atgcttaacttcctagtctata

SEQ ID NO: 7339542 - DNA, 23 bp, Homo sapiens
gagaacagccacagagagctgtg

SEQ ID NO: 7339543 - DNA, 22 bp, Homo sapiens
atgcttaactctgtacatagtt

SEQ ID NO: 7339544 - DNA, 22 bp, Homo sapiens
atgcttaaaaggctgcgttaga

SEQ ID NO: 7339545 - DNA, 22 bp, Homo sapiens
atgcttaaccttggtgtacaat

SEQ ID NO: 7339546 - DNA, 22 bp, Homo sapiens
atgctgtttgcttttagtctgc

SEQ ID NO: 7339547 - DNA, 22 bp, Homo sapiens
atgctgtgtctagcaggaacac

SEQ ID NO: 7339548 - DNA, 22 bp, Homo sapiens
atgctgtgtttgagaacctagg

SEQ ID NO: 7339549 - DNA, 22 bp, Homo sapiens
atgctgtgtttgagaacctagg

SEQ ID NO: 7339550 - DNA, 22 bp, Homo sapiens
atgctgtggtagacagcattcc

SEQ ID NO: 7339551 - DNA, 22 bp, Homo sapiens
atgctgtggtagacagcattcc

SEQ ID NO: 7339552 - DNA, 22 bp, Homo sapiens
atgctgtgtattttactctttc

SEQ ID NO: 7339553 - DNA, 22 bp, Homo sapiens
atgctgtgtcaccttaggattt

SEQ ID NO: 7339554 - DNA, 22 bp, Homo sapiens
atgctgtgtcaggaatttgata

SEQ ID NO: 7339555 - DNA, 22 bp, Homo sapiens
atgctgtgctggctaaccatgg

SEQ ID NO: 7339556 - DNA, 22 bp, Homo sapiens
atgctgtgaaaaagaaggctga

SEQ ID NO: 7339557 - DNA, 22 bp, Homo sapiens
atgctgtctctgctatccaaag

SEQ ID NO: 7339558 - DNA, 22 bp, Homo sapiens
atgctggtaagttgcaaatgtt

SEQ ID NO: 7339559 - DNA, 22 bp, Homo sapiens
gagacaggcagctagtgggtca

SEQ ID NO: 7339560 - DNA, 22 bp, Homo sapiens
gagacaggcagctagtgggtca

SEQ ID NO: 7339561 - DNA, 22 bp, Homo sapiens
atggagggtgtcagagagcgaa

SEQ ID NO: 7339562 - DNA, 22 bp, Homo sapiens
atggataatgtctctgtttccc

SEQ ID NO: 7339563 - DNA, 22 bp, Homo sapiens
atggataatgtctctgtttccc

SEQ ID NO: 7339564 - DNA, 21 bp, Homo sapiens
gagaatagaggggaagctgaa

SEQ ID NO: 7339565 - DNA, 22 bp, Homo sapiens
gagaatcatttacagaatgatt

SEQ ID NO: 7339566 - DNA, 22 bp, Homo sapiens
gagacagcacaggccactggga

SEQ ID NO: 7339567 - DNA, 21 bp, Homo sapiens
gagacagcccagtgccagggc

SEQ ID NO: 7339568 - DNA, 22 bp, Homo sapiens
atggatttgcttatacacatgt

SEQ ID NO: 7339569 - DNA, 22 bp, Homo sapiens
atggcaaaaactgcagttacct

SEQ ID NO: 7339570 - DNA, 22 bp, Homo sapiens
atggcaatgtggcttatttgga

SEQ ID NO: 7339571 - DNA, 22 bp, Homo sapiens
gaggttgggatgagggatacag

SEQ ID NO: 7339572 - DNA, 22 bp, Homo sapiens
gaggttgggaagtccaagctgg

SEQ ID NO: 7339573 - DNA, 22 bp, Homo sapiens
gaggtgtgatgcagagtggtgg

SEQ ID NO: 7339574 - DNA, 23 bp, Homo sapiens
gaggtgtgaattctgggtgctgc

SEQ ID NO: 7339575 - DNA, 22 bp, Homo sapiens
atgttacagttgagtaaattaa

SEQ ID NO: 7339576 - DNA, 22 bp, Homo sapiens
atgttacttagaataattctgg

SEQ ID NO: 7339577 - DNA, 17 bp, Homo sapiens
atgtggctaagctgctg

SEQ ID NO: 7339578 - DNA, 22 bp, Homo sapiens
atgttaaaagtctgagtgggag

SEQ ID NO: 7339579 - DNA, 23 bp, Homo sapiens
atgttaaacataactgaagagcc

SEQ ID NO: 7339580 - DNA, 22 bp, Homo sapiens
atgttaaaagtgaggatggcca

SEQ ID NO: 7339581 - DNA, 22 bp, Homo sapiens
atgtgctaagcactacttgtca

SEQ ID NO: 7339582 - DNA, 22 bp, Homo sapiens
atgtgaggtagataggatgcag

SEQ ID NO: 7339583 - DNA, 21 bp, Homo sapiens
atgtcagtggtttaacacaac

SEQ ID NO: 7339584 - DNA, 22 bp, Homo sapiens
atgtcagtctttctgtctcaga

SEQ ID NO: 7339585 - DNA, 22 bp, Homo sapiens
atgtcataaatatactgttcct

SEQ ID NO: 7339586 - DNA, 22 bp, Homo sapiens
atgtcagttgctgcttgaggta

SEQ ID NO: 7339587 - DNA, 22 bp, Homo sapiens
atgtcagttataaaagacagat

SEQ ID NO: 7339588 - DNA, 22 bp, Homo sapiens
atgtcagaagctggatgacagc

SEQ ID NO: 7339589 - DNA, 22 bp, Homo sapiens
atgtcagagcttccacaatagt

SEQ ID NO: 7339590 - DNA, 22 bp, Homo sapiens
atgtcagagcttccacaatagt

SEQ ID NO: 7339591 - DNA, 22 bp, Homo sapiens
atgtcactgtttaccagctcca

SEQ ID NO: 7339592 - DNA, 22 bp, Homo sapiens
atgtggaatgaacaaaggaggc

SEQ ID NO: 7339593 - DNA, 22 bp, Homo sapiens
atgtgctttctttgtttcataa

SEQ ID NO: 7339594 - DNA, 22 bp, Homo sapiens
atgtgctttccaatgctgtagg

SEQ ID NO: 7339595 - DNA, 22 bp, Homo sapiens
atgtggcagtgggaggtgaatt

SEQ ID NO: 7339596 - DNA, 22 bp, Homo sapiens
atgtggcattcttggtcatttc

SEQ ID NO: 7339597 - DNA, 22 bp, Homo sapiens
atgtggcaccgatctttagcca

SEQ ID NO: 7339598 - DNA, 22 bp, Homo sapiens
atgtgctgaaataaatgtggga

SEQ ID NO: 7339599 - DNA, 22 bp, Homo sapiens
atgtgctgagtgtgtatataca

SEQ ID NO: 7339600 - DNA, 20 bp, Homo sapiens
atgtgctgggcaatatgtta

SEQ ID NO: 7339601 - DNA, 20 bp, Homo sapiens
atgtgctgggcaatatgtta

SEQ ID NO: 7339602 - DNA, 22 bp, Homo sapiens
atgtgctggctaactggatggg

SEQ ID NO: 7339603 - DNA, 22 bp, Homo sapiens
atgtgcttcataatcttctcat

SEQ ID NO: 7339604 - DNA, 22 bp, Homo sapiens
atgtgctgtaatccattgaagg

SEQ ID NO: 7339605 - DNA, 21 bp, Homo sapiens
atgtgcttagctgctggtagt

SEQ ID NO: 7339606 - DNA, 22 bp, Homo sapiens
atgtgcttcaggatgtcagtgt

SEQ ID NO: 7339607 - DNA, 22 bp, Homo sapiens
atgtgcttggaaaagcagtggt

SEQ ID NO: 7339608 - DNA, 22 bp, Homo sapiens
atgtgcttggaaaagcagtggt

SEQ ID NO: 7339609 - DNA, 22 bp, Homo sapiens
atgtgcttggacattctaggaa

SEQ ID NO: 7339610 - DNA, 22 bp, Homo sapiens
atgtgcttgactactctctatt

SEQ ID NO: 7339611 - DNA, 22 bp, Homo sapiens
atgtgctttaggtttgtttaca

SEQ ID NO: 7339612 - DNA, 22 bp, Homo sapiens
gaggctccccatgaggccccag

SEQ ID NO: 7339613 - DNA, 22 bp, Homo sapiens
atgtatttactgagaaggaaac

SEQ ID NO: 7339614 - DNA, 23 bp, Homo sapiens
atgtatttaaatttcagtgatga

SEQ ID NO: 7339615 - DNA, 23 bp, Homo sapiens
atgtatttaaatttcagtgatga

SEQ ID NO: 7339616 - DNA, 22 bp, Homo sapiens
atgtatgtatgctgtgcttgca

SEQ ID NO: 7339617 - DNA, 22 bp, Homo sapiens
atgtatgtatgtacttttgtat

SEQ ID NO: 7339618 - DNA, 22 bp, Homo sapiens
atgtatcatgcagggtccatga

SEQ ID NO: 7339619 - DNA, 22 bp, Homo sapiens
atgtatgtgagctttgagatca

SEQ ID NO: 7339620 - DNA, 22 bp, Homo sapiens
gaggagctgtctttgtgatctt

SEQ ID NO: 7339621 - DNA, 22 bp, Homo sapiens
gaggagggagctggaagctctt

SEQ ID NO: 7339622 - DNA, 22 bp, Homo sapiens
gaggagggagctggaagctctt

SEQ ID NO: 7339623 - DNA, 22 bp, Homo sapiens
gaggagggcctggtgtcccttc

SEQ ID NO: 7339624 - DNA, 22 bp, Homo sapiens
gaggagggcagttcctctttta

SEQ ID NO: 7339625 - DNA, 22 bp, Homo sapiens
gaggagggcctggtgtcccttc

SEQ ID NO: 7339626 - DNA, 22 bp, Homo sapiens
gaggagggctttgttgatgtta

SEQ ID NO: 7339627 - DNA, 22 bp, Homo sapiens
gaggagctgggtcagggagaca

SEQ ID NO: 7339628 - DNA, 22 bp, Homo sapiens
gaggagctgggtcagggagaca

SEQ ID NO: 7339629 - DNA, 22 bp, Homo sapiens
atgggcaggcactggctctcag

SEQ ID NO: 7339630 - DNA, 22 bp, Homo sapiens
atgggcaggcactggctctcag

SEQ ID NO: 7339631 - DNA, 22 bp, Homo sapiens
atgggcaggcactggctctcag

SEQ ID NO: 7339632 - DNA, 22 bp, Homo sapiens
atgggcagctgcagcagtggtg

SEQ ID NO: 7339633 - DNA, 22 bp, Homo sapiens
atgggcagctgcagcagtggtg

SEQ ID NO: 7339634 - DNA, 22 bp, Homo sapiens
atgggcagctgcagcagtggtg

SEQ ID NO: 7339635 - DNA, 22 bp, Homo sapiens
atgggcaggcaaggtggcgagt

SEQ ID NO: 7339636 - DNA, 22 bp, Homo sapiens
atgggcagcagctgtcattttc

SEQ ID NO: 7339637 - DNA, 22 bp, Homo sapiens
atgggcagcagctgtcattttc

SEQ ID NO: 7339638 - DNA, 22 bp, Homo sapiens
atgggcagagtggggacaggaa

SEQ ID NO: 7339639 - DNA, 22 bp, Homo sapiens
atgggcagcagctgccattcat

SEQ ID NO: 7339640 - DNA, 22 bp, Homo sapiens
gaggaggggcacttgtctccta

SEQ ID NO: 7339641 - DNA, 22 bp, Homo sapiens
gaggaggggcacttgtctccta

SEQ ID NO: 7339642 - DNA, 22 bp, Homo sapiens
gaggaggggcacttgtctccta

SEQ ID NO: 7339643 - DNA, 22 bp, Homo sapiens
gaggaggggacagtacttgtgc

SEQ ID NO: 7339644 - DNA, 22 bp, Homo sapiens
gaggcacagagccctaggagct

SEQ ID NO: 7339645 - DNA, 22 bp, Homo sapiens
atgagaggtttcgtcagaggaa

SEQ ID NO: 7339646 - DNA, 22 bp, Homo sapiens
atgagagacaggaacgagctgg

SEQ ID NO: 7339647 - DNA, 22 bp, Homo sapiens
atgagaaagttaatcatcatga

SEQ ID NO: 7339648 - DNA, 22 bp, Homo sapiens
atgagaaatttattacaagcta

SEQ ID NO: 7339649 - DNA, 22 bp, Homo sapiens
atgacagaggagtgcaggtgat

SEQ ID NO: 7339650 - DNA, 22 bp, Homo sapiens
atgacagaccctctaaagacaa

SEQ ID NO: 7339651 - DNA, 19 bp, Homo sapiens
atgacagagttgataagtg

SEQ ID NO: 7339652 - DNA, 22 bp, Homo sapiens
atgacagatagtcttcatttgc

SEQ ID NO: 7339653 - DNA, 22 bp, Homo sapiens
atgacagaggattgtaaagagg

SEQ ID NO: 7339654 - DNA, 19 bp, Homo sapiens
ctttttcaccttctagaag

SEQ ID NO: 7339655 - DNA, 22 bp, Homo sapiens
atgaatttttctaagcttttgt

SEQ ID NO: 7339656 - DNA, 22 bp, Homo sapiens
atgaattgaggaaaacagtcgt

SEQ ID NO: 7339657 - DNA, 22 bp, Homo sapiens
atgacacaagagcagaagccat

SEQ ID NO: 7339658 - DNA, 22 bp, Homo sapiens
atgacacataaaacaaggactg

SEQ ID NO: 7339659 - DNA, 22 bp, Homo sapiens
atgacagaaggcctccctgaca

SEQ ID NO: 7339660 - DNA, 22 bp, Homo sapiens
atgacagacagaagggattttt

SEQ ID NO: 7339661 - DNA, 23 bp, Homo sapiens
atgacactcctgtgcgcaccctg

SEQ ID NO: 7339662 - DNA, 22 bp, Homo sapiens
atgacactctgcagggtgaatg

SEQ ID NO: 7339663 - DNA, 22 bp, Homo sapiens
ctttggaaaagcataccaagga

SEQ ID NO: 7339664 - DNA, 22 bp, Homo sapiens
ctttattgtccttcttaggtgg

SEQ ID NO: 7339665 - DNA, 22 bp, Homo sapiens
ctttacattaatttctactgat

SEQ ID NO: 7339666 - DNA, 17 bp, Homo sapiens
cttgttttccactggga

SEQ ID NO: 7339667 - DNA, 22 bp, Homo sapiens
cttgttttctaaaacatcattt

SEQ ID NO: 7339668 - DNA, 22 bp, Homo sapiens
atctttgatgtgtgcccattca

SEQ ID NO: 7339669 - DNA, 22 bp, Homo sapiens
atctttgatctttattgctaag

SEQ ID NO: 7339670 - DNA, 22 bp, Homo sapiens
cttgttttaaactgttgtggct

SEQ ID NO: 7339671 - DNA, 22 bp, Homo sapiens
atctttctccatatacatcttt

SEQ ID NO: 7339672 - DNA, 22 bp, Homo sapiens
atcttggattggagaaagaagt

SEQ ID NO: 7339673 - DNA, 22 bp, Homo sapiens
atctttcaatcaggaaaaatct

SEQ ID NO: 7339674 - DNA, 22 bp, Homo sapiens
atctggagaaaccgccaaggga

SEQ ID NO: 7339675 - DNA, 22 bp, Homo sapiens
atctggaattgaagaggtttga

SEQ ID NO: 7339676 - DNA, 22 bp, Homo sapiens
atctggaattaagagaaagtga

SEQ ID NO: 7339677 - DNA, 22 bp, Homo sapiens
atctggaagtaggagagtgggc

SEQ ID NO: 7339678 - DNA, 17 bp, Homo sapiens
atctggaagctagctga

SEQ ID NO: 7339679 - DNA, 22 bp, Homo sapiens
atctggaagtcagaggtttgca

SEQ ID NO: 7339680 - DNA, 22 bp, Homo sapiens
atctggaagtcagaggtttgca

SEQ ID NO: 7339681 - DNA, 22 bp, Homo sapiens
atctggaagtctccgaaggcag

SEQ ID NO: 7339682 - DNA, 22 bp, Homo sapiens
atctggaagttaagcttggtgc

SEQ ID NO: 7339683 - DNA, 22 bp, Homo sapiens
atctggaagttaagcttggtgc

SEQ ID NO: 7339684 - DNA, 22 bp, Homo sapiens
atctggaatagcatggggttga

SEQ ID NO: 7339685 - DNA, 22 bp, Homo sapiens
atctggaatccttgtggacaat

SEQ ID NO: 7339686 - DNA, 22 bp, Homo sapiens
atctggaatgtctcattgggaa

SEQ ID NO: 7339687 - DNA, 22 bp, Homo sapiens
atctggaatcttgctgaccctg

SEQ ID NO: 7339688 - DNA, 22 bp, Homo sapiens
atctggaatccttgtggacaat

SEQ ID NO: 7339689 - DNA, 22 bp, Homo sapiens
cttctcctctgagtcctgggag

SEQ ID NO: 7339690 - DNA, 22 bp, Homo sapiens
atgcaggaggactaaagggatg

SEQ ID NO: 7339691 - DNA, 22 bp, Homo sapiens
gaaggaggtgtcagttggactg

SEQ ID NO: 7339692 - DNA, 22 bp, Homo sapiens
gaaggagggagcggcgcggatt

SEQ ID NO: 7339693 - DNA, 22 bp, Homo sapiens
gaaggagggagcggcgcggatt

SEQ ID NO: 7339694 - DNA, 22 bp, Homo sapiens
atgcagtggcagctcctggtgt

SEQ ID NO: 7339695 - DNA, 22 bp, Homo sapiens
gaagccttgaactgcaaacccc

SEQ ID NO: 7339696 - DNA, 22 bp, Homo sapiens
gaagcagcagctggggacagtt

SEQ ID NO: 7339697 - DNA, 22 bp, Homo sapiens
gaagcagcaagtataggacagg

SEQ ID NO: 7339698 - DNA, 22 bp, Homo sapiens
gaagcagcaaatctgcagtatc

SEQ ID NO: 7339699 - DNA, 22 bp, Homo sapiens
gaagctctaaggtcattgcatt

SEQ ID NO: 7339700 - DNA, 22 bp, Homo sapiens
gaagctgggtcgctgggatcct

SEQ ID NO: 7339701 - DNA, 22 bp, Homo sapiens
gaagagcatatgaagagcatat

SEQ ID NO: 7339702 - DNA, 22 bp, Homo sapiens
gaagagatgacaaaggagcatg

SEQ ID NO: 7339703 - DNA, 22 bp, Homo sapiens
atgatggtaaattcagtatccg

SEQ ID NO: 7339704 - DNA, 19 bp, Homo sapiens
atgatggtcccattcacct

SEQ ID NO: 7339705 - DNA, 22 bp, Homo sapiens
atgatggtgggagatgacccag

SEQ ID NO: 7339706 - DNA, 22 bp, Homo sapiens
atgatggtgaggttgagcacag

SEQ ID NO: 7339707 - DNA, 22 bp, Homo sapiens
atgatggtgggtaatgtgtaaa

SEQ ID NO: 7339708 - DNA, 22 bp, Homo sapiens
atgatggttgtcctaggtgcat

SEQ ID NO: 7339709 - DNA, 22 bp, Homo sapiens
atgatgtaatggaaagaacaga

SEQ ID NO: 7339710 - DNA, 22 bp, Homo sapiens
atgatgtagtgacttggcagag

SEQ ID NO: 7339711 - DNA, 22 bp, Homo sapiens
atgatgttattttcagaaacat

SEQ ID NO: 7339712 - DNA, 22 bp, Homo sapiens
atgattactcccatttgataga

SEQ ID NO: 7339713 - DNA, 22 bp, Homo sapiens
gaagagagcagcaaactggagt

SEQ ID NO: 7339714 - DNA, 22 bp, Homo sapiens
atgagctagaaaaccatgtgga

SEQ ID NO: 7339715 - DNA, 22 bp, Homo sapiens
atgagctgagtttgtaagtctt

SEQ ID NO: 7339716 - DNA, 22 bp, Homo sapiens
atgagcccagaaatctcccttt

SEQ ID NO: 7339717 - DNA, 22 bp, Homo sapiens
atgagctgggccatccagtgat

SEQ ID NO: 7339718 - DNA, 22 bp, Homo sapiens
atgagctgtgggattccagagg

SEQ ID NO: 7339719 - DNA, 19 bp, Homo sapiens
atgagctggcatttcaggt

SEQ ID NO: 7339720 - DNA, 22 bp, Homo sapiens
atgagcatatgggaggagtact

SEQ ID NO: 7339721 - DNA, 22 bp, Homo sapiens
atgagcatccagaacagtgcct

SEQ ID NO: 7339722 - DNA, 22 bp, Homo sapiens
atgagcatctgacatttaaaac

SEQ ID NO: 7339723 - DNA, 22 bp, Homo sapiens
atgagcatctgagccagtgact

SEQ ID NO: 7339724 - DNA, 22 bp, Homo sapiens
atgagcatgtgactcaaaccaa

SEQ ID NO: 7339725 - DNA, 23 bp, Homo sapiens
atgagcatttttaatttctgtgg

SEQ ID NO: 7339726 - DNA, 19 bp, Homo sapiens
gaattttaggacttcagca

SEQ ID NO: 7339727 - DNA, 17 bp, Homo sapiens
gaatttcttggtcaaaa

SEQ ID NO: 7339728 - DNA, 22 bp, Homo sapiens
gaatttctggaccctttgagaa

SEQ ID NO: 7339729 - DNA, 22 bp, Homo sapiens
gaatttcctctaaacccctgag

SEQ ID NO: 7339730 - DNA, 22 bp, Homo sapiens
gaatttcagatcagagaccatt

SEQ ID NO: 7339731 - DNA, 22 bp, Homo sapiens
gaatttcaggacaactggaagg

SEQ ID NO: 7339732 - DNA, 22 bp, Homo sapiens
gaatttcattgctctgctgtgt

SEQ ID NO: 7339733 - DNA, 22 bp, Homo sapiens
atgctaaactatgatcattttc

SEQ ID NO: 7339734 - DNA, 22 bp, Homo sapiens
atgctaaagctttgctttcatt

SEQ ID NO: 7339735 - DNA, 22 bp, Homo sapiens
atgctaaatgttaatgttacct

SEQ ID NO: 7339736 - DNA, 22 bp, Homo sapiens
atgctaaatggccagtaccaaa

SEQ ID NO: 7339737 - DNA, 22 bp, Homo sapiens
atgctaaatggccagtaccaaa

SEQ ID NO: 7339738 - DNA, 22 bp, Homo sapiens
atgctaaaggggtaggcctcct

SEQ ID NO: 7339739 - DNA, 22 bp, Homo sapiens
atgctacatagatacaaaaatg

SEQ ID NO: 7339740 - DNA, 22 bp, Homo sapiens
atgctactcattaagtttgtca

SEQ ID NO: 7339741 - DNA, 22 bp, Homo sapiens
atgctacaggaagacgtcaggc

SEQ ID NO: 7339742 - DNA, 22 bp, Homo sapiens
atgctctgggcttttgaagtgg

SEQ ID NO: 7339743 - DNA, 16 bp, Homo sapiens
atgctgctattagagg

SEQ ID NO: 7339744 - DNA, 22 bp, Homo sapiens
atgctgaaaattggatttgaat

SEQ ID NO: 7339745 - DNA, 16 bp, Homo sapiens
atgctgctattagagg

SEQ ID NO: 7339746 - DNA, 22 bp, Homo sapiens
gacaggaaacaagaaggcagga

SEQ ID NO: 7339747 - DNA, 22 bp, Homo sapiens
atgcatttgtaaaatataatcg

SEQ ID NO: 7339748 - DNA, 22 bp, Homo sapiens
gaagtagcatgttgctgccaga

SEQ ID NO: 7339749 - DNA, 22 bp, Homo sapiens
gaagtatagcagatgttattta

SEQ ID NO: 7339750 - DNA, 22 bp, Homo sapiens
gaagtataggagacaaacaaga

SEQ ID NO: 7339751 - DNA, 22 bp, Homo sapiens
gaagtattatagcatattagcc

SEQ ID NO: 7339752 - DNA, 21 bp, Homo sapiens
gaagtacaccaggaaggccac

SEQ ID NO: 7339753 - DNA, 21 bp, Homo sapiens
gaagtacaccaggaaggccac

SEQ ID NO: 7339754 - DNA, 22 bp, Homo sapiens
gaagtacaggttgtgagagaat

SEQ ID NO: 7339755 - DNA, 22 bp, Homo sapiens
gaagtacaggttgtgagagaat

SEQ ID NO: 7339756 - DNA, 22 bp, Homo sapiens
gaagtacactactccttgagtc

SEQ ID NO: 7339757 - DNA, 22 bp, Homo sapiens
atgccactgcacttcagcttgg

SEQ ID NO: 7339758 - DNA, 22 bp, Homo sapiens
atgccactgcacttcagcctgg

SEQ ID NO: 7339759 - DNA, 22 bp, Homo sapiens
atgccactgcacttcagcctgg

SEQ ID NO: 7339760 - DNA, 22 bp, Homo sapiens
gaatttcacaaggtgaggataa

SEQ ID NO: 7339761 - DNA, 22 bp, Homo sapiens
atgccactgcacttcagcttgg

SEQ ID NO: 7339762 - DNA, 22 bp, Homo sapiens
gaatttcaaaagccagaacggg

SEQ ID NO: 7339763 - DNA, 22 bp, Homo sapiens
gaatttcaaagaggttaagagg

SEQ ID NO: 7339764 - DNA, 22 bp, Homo sapiens
gaatttcaacagtcctcaaatg

SEQ ID NO: 7339765 - DNA, 22 bp, Homo sapiens
gaatttcaagcagtgcaatgtt

SEQ ID NO: 7339766 - DNA, 22 bp, Homo sapiens
atgccactgcactccagcctgg

SEQ ID NO: 7339767 - DNA, 22 bp, Homo sapiens
atgccactgcactccagcctgg

SEQ ID NO: 7339768 - DNA, 22 bp, Homo sapiens
atgccactgcactccagcctag

SEQ ID NO: 7339769 - DNA, 22 bp, Homo sapiens
atgccactgcactccagcctag

SEQ ID NO: 7339770 - DNA, 22 bp, Homo sapiens
caaaagatacttgcatctaact

SEQ ID NO: 7339771 - DNA, 22 bp, Homo sapiens
gctcagagaagttgtgcctggc

SEQ ID NO: 7339772 - DNA, 22 bp, Homo sapiens
gctcagagaatcagcagacacc

SEQ ID NO: 7339773 - DNA, 22 bp, Homo sapiens
gctcagagaagcggtttcgcct

SEQ ID NO: 7339774 - DNA, 22 bp, Homo sapiens
attttgataatcatgttagaga

SEQ ID NO: 7339775 - DNA, 22 bp, Homo sapiens
attttgataatcatgttagaga

SEQ ID NO: 7339776 - DNA, 22 bp, Homo sapiens
attttgatgctatctaatgaat

SEQ ID NO: 7339777 - DNA, 22 bp, Homo sapiens
attttgatgtatctttgtagct

SEQ ID NO: 7339778 - DNA, 22 bp, Homo sapiens
attttgatgctatctaatgaat

SEQ ID NO: 7339779 - DNA, 22 bp, Homo sapiens
attttgctacagttggtggaaa

SEQ ID NO: 7339780 - DNA, 22 bp, Homo sapiens
attttgctgctatgccttgcaa

SEQ ID NO: 7339781 - DNA, 22 bp, Homo sapiens
attttgctggtctgaattactt

SEQ ID NO: 7339782 - DNA, 22 bp, Homo sapiens
attttgctgtggtacattagga

SEQ ID NO: 7339783 - DNA, 22 bp, Homo sapiens
caaagaagagatttacagagct

SEQ ID NO: 7339784 - DNA, 22 bp, Homo sapiens
caaagacacgggaaacaacgtt

SEQ ID NO: 7339785 - DNA, 22 bp, Homo sapiens
caaagaatcactcatctttagc

SEQ ID NO: 7339786 - DNA, 22 bp, Homo sapiens
caaagaatgagtgagtacataa

SEQ ID NO: 7339787 - DNA, 22 bp, Homo sapiens
gctctgctgtggaatcctctcc

SEQ ID NO: 7339788 - DNA, 22 bp, Homo sapiens
gctctgctgtcttcttgcaggc

SEQ ID NO: 7339789 - DNA, 20 bp, Homo sapiens
caaagacatgctaggggtgg

SEQ ID NO: 7339790 - DNA, 20 bp, Homo sapiens
caaagacatgctaggggtgg

SEQ ID NO: 7339791 - DNA, 22 bp, Homo sapiens
gctcccagggacactggccact

SEQ ID NO: 7339792 - DNA, 22 bp, Homo sapiens
gctccccaaaagctccaggaaa

SEQ ID NO: 7339793 - DNA, 22 bp, Homo sapiens
gctcccagggcagcgcagaaga

SEQ ID NO: 7339794 - DNA, 22 bp, Homo sapiens
gctcccagtctgatggaggaga

SEQ ID NO: 7339795 - DNA, 22 bp, Homo sapiens
atttgtaatttcttatctgtgt

SEQ ID NO: 7339796 - DNA, 22 bp, Homo sapiens
atttgtacaaatttatgttagt

SEQ ID NO: 7339797 - DNA, 22 bp, Homo sapiens
atttgtaagctagagccatgat

SEQ ID NO: 7339798 - DNA, 22 bp, Homo sapiens
atttgtaaagtgcttaaaagta

SEQ ID NO: 7339799 - DNA, 22 bp, Homo sapiens
atttgtaaagtgcttaaaagta

SEQ ID NO: 7339800 - DNA, 22 bp, Homo sapiens
atttgtcacacatagtttatcc

SEQ ID NO: 7339801 - DNA, 22 bp, Homo sapiens
atttgtcagtggaagtgattca

SEQ ID NO: 7339802 - DNA, 22 bp, Homo sapiens
atttgtaccatactgtttatta

SEQ ID NO: 7339803 - DNA, 22 bp, Homo sapiens
atttgtatcaatctcaatatat

SEQ ID NO: 7339804 - DNA, 22 bp, Homo sapiens
atttgtcaacaggcatttaggt

SEQ ID NO: 7339805 - DNA, 22 bp, Homo sapiens
atttgtcaataagatgaacata

SEQ ID NO: 7339806 - DNA, 22 bp, Homo sapiens
atttgtcaataagatgaacata

SEQ ID NO: 7339807 - DNA, 22 bp, Homo sapiens
atttgtatcttctaatattatc

SEQ ID NO: 7339808 - DNA, 22 bp, Homo sapiens
gccttccttacacctgctcagc

SEQ ID NO: 7339809 - DNA, 22 bp, Homo sapiens
attttcattttgcagggtgaga

SEQ ID NO: 7339810 - DNA, 21 bp, Homo sapiens
attttcattaattcagtgtgg

SEQ ID NO: 7339811 - DNA, 22 bp, Homo sapiens
attttccagcctttctagaact

SEQ ID NO: 7339812 - DNA, 21 bp, Homo sapiens
attttcattaattcagtgtgg

SEQ ID NO: 7339813 - DNA, 21 bp, Homo sapiens
attttcattaattcagtgtgg

SEQ ID NO: 7339814 - DNA, 22 bp, Homo sapiens
attttcatggcttctgctcagt

SEQ ID NO: 7339815 - DNA, 22 bp, Homo sapiens
attttcagttgaaaaagttggt

SEQ ID NO: 7339816 - DNA, 22 bp, Homo sapiens
attttcatcgctaggttggcct

SEQ ID NO: 7339817 - DNA, 22 bp, Homo sapiens
gccaggtggctgagcagctgca

SEQ ID NO: 7339818 - DNA, 22 bp, Homo sapiens
atttatgtatctgtgtagatca

SEQ ID NO: 7339819 - DNA, 22 bp, Homo sapiens
atttatcaacatgtaccattgg

SEQ ID NO: 7339820 - DNA, 22 bp, Homo sapiens
atttatcaacatgtaccattgg

SEQ ID NO: 7339821 - DNA, 22 bp, Homo sapiens
atttatattttgggagctcctg

SEQ ID NO: 7339822 - DNA, 22 bp, Homo sapiens
atttatcatcagaccttttaaa

SEQ ID NO: 7339823 - DNA, 22 bp, Homo sapiens
atttatcaccagttagctgact

SEQ ID NO: 7339824 - DNA, 22 bp, Homo sapiens
gccagccacttcccagactggc

SEQ ID NO: 7339825 - DNA, 22 bp, Homo sapiens
gccagccacttcagctatggct

SEQ ID NO: 7339826 - DNA, 22 bp, Homo sapiens
gccagccagaaacgtcacactg

SEQ ID NO: 7339827 - DNA, 23 bp, Homo sapiens
gccagccagaatttctccactgt

SEQ ID NO: 7339828 - DNA, 22 bp, Homo sapiens
gccagccagagtccatctgaga

SEQ ID NO: 7339829 - DNA, 22 bp, Homo sapiens
gccagccagagaggcatggtta

SEQ ID NO: 7339830 - DNA, 22 bp, Homo sapiens
gccagccaggaagaaagtaaga

SEQ ID NO: 7339831 - DNA, 22 bp, Homo sapiens
gccagccagagtggctgtgtgt

SEQ ID NO: 7339832 - DNA, 18 bp, Homo sapiens
gccagccaggcgttgctc

SEQ ID NO: 7339833 - DNA, 22 bp, Homo sapiens
gccagccagggaagggagagac

SEQ ID NO: 7339834 - DNA, 22 bp, Homo sapiens
gccagccagggaagggagagac

SEQ ID NO: 7339835 - DNA, 22 bp, Homo sapiens
gccagccataggccagcactgg

SEQ ID NO: 7339836 - DNA, 22 bp, Homo sapiens
gccagccagtttgctgatggct

SEQ ID NO: 7339837 - DNA, 21 bp, Homo sapiens
gccagctgcagggcttccttg

SEQ ID NO: 7339838 - DNA, 22 bp, Homo sapiens
gccagctgctcgcgtagggtag

SEQ ID NO: 7339839 - DNA, 22 bp, Homo sapiens
gccagctgcatctcctgggctg

SEQ ID NO: 7339840 - DNA, 22 bp, Homo sapiens
gccagctgccctctgctggtcc

SEQ ID NO: 7339841 - DNA, 22 bp, Homo sapiens
attgtactcacaaaacatgagt

SEQ ID NO: 7339842 - DNA, 22 bp, Homo sapiens
gccagatattcagaggtgaaag

SEQ ID NO: 7339843 - DNA, 22 bp, Homo sapiens
gccagccacgttagactggccc

SEQ ID NO: 7339844 - DNA, 22 bp, Homo sapiens
gccagccacaagggaggcttgt

SEQ ID NO: 7339845 - DNA, 22 bp, Homo sapiens
gccagccaagattgagaaggta

SEQ ID NO: 7339846 - DNA, 22 bp, Homo sapiens
attgtacagacatgggaaacaa

SEQ ID NO: 7339847 - DNA, 19 bp, Homo sapiens
atttattgtatgattccat

SEQ ID NO: 7339848 - DNA, 22 bp, Homo sapiens
gccatgcatccttggacttggc

SEQ ID NO: 7339849 - DNA, 22 bp, Homo sapiens
gccatgcatttcgctgggaggg

SEQ ID NO: 7339850 - DNA, 22 bp, Homo sapiens
gccatgcctgtgtctccaggcc

SEQ ID NO: 7339851 - DNA, 22 bp, Homo sapiens
gccatgagaagaaatgaagggc

SEQ ID NO: 7339852 - DNA, 22 bp, Homo sapiens
gccatgagatgttttatttgca

SEQ ID NO: 7339853 - DNA, 22 bp, Homo sapiens
gccatgagatgttttatttgca

SEQ ID NO: 7339854 - DNA, 22 bp, Homo sapiens
gccatgaggaactgtaagacaa

SEQ ID NO: 7339855 - DNA, 22 bp, Homo sapiens
gccatgaggctccgagaagtca

SEQ ID NO: 7339856 - DNA, 20 bp, Homo sapiens
gccatgaggggaggtgactg

SEQ ID NO: 7339857 - DNA, 22 bp, Homo sapiens
gccatgagtaaactggaaagcc

SEQ ID NO: 7339858 - DNA, 23 bp, Homo sapiens
gccatgagttccctttcacttgt

SEQ ID NO: 7339859 - DNA, 23 bp, Homo sapiens
gccatgagttccctttcacttgt

SEQ ID NO: 7339860 - DNA, 23 bp, Homo sapiens
gccatcctaaaacccctgtctgt

SEQ ID NO: 7339861 - DNA, 22 bp, Homo sapiens
gcccagtctccaggagactctc

SEQ ID NO: 7339862 - DNA, 22 bp, Homo sapiens
atttcttcaggtcagaaataga

SEQ ID NO: 7339863 - DNA, 22 bp, Homo sapiens
atttcttaaaacttcagggaga

SEQ ID NO: 7339864 - DNA, 22 bp, Homo sapiens
atttctgtttgctactataagt

SEQ ID NO: 7339865 - DNA, 18 bp, Homo sapiens
gccctggtggagctggtg

SEQ ID NO: 7339866 - DNA, 22 bp, Homo sapiens
gccctggtgtgcccagcatggg

SEQ ID NO: 7339867 - DNA, 22 bp, Homo sapiens
gccctggggaaggtgtctccaa

SEQ ID NO: 7339868 - DNA, 22 bp, Homo sapiens
gccctgtcctcctgactgagtg

SEQ ID NO: 7339869 - DNA, 22 bp, Homo sapiens
atttctgtttgctactataagt

SEQ ID NO: 7339870 - DNA, 22 bp, Homo sapiens
atttcccagggccctcatagtt

SEQ ID NO: 7339871 - DNA, 22 bp, Homo sapiens
atttcccagggccctcatagtt

SEQ ID NO: 7339872 - DNA, 22 bp, Homo sapiens
atttcccactctactacatgct

SEQ ID NO: 7339873 - DNA, 23 bp, Homo sapiens
atttcctactataaaagaggtaa

SEQ ID NO: 7339874 - DNA, 22 bp, Homo sapiens
gccctgcctgccggtgtgggtc

SEQ ID NO: 7339875 - DNA, 22 bp, Homo sapiens
gccctgggctccctgctccaca

SEQ ID NO: 7339876 - DNA, 22 bp, Homo sapiens
gcagagaaggattgaaaccaga

SEQ ID NO: 7339877 - DNA, 22 bp, Homo sapiens
attattaaaatgtgtttctctt

SEQ ID NO: 7339878 - DNA, 23 bp, Homo sapiens
attatccagtgcacttcacagct

SEQ ID NO: 7339879 - DNA, 22 bp, Homo sapiens
attatcttgataaaatggcagt

SEQ ID NO: 7339880 - DNA, 22 bp, Homo sapiens
gcagagactagtagtgcagact

SEQ ID NO: 7339881 - DNA, 22 bp, Homo sapiens
gcagagaccccgcagtgaggcc

SEQ ID NO: 7339882 - DNA, 22 bp, Homo sapiens
gcagagaccccgcagtgaggcc

SEQ ID NO: 7339883 - DNA, 22 bp, Homo sapiens
gcagagaggaatgaagccatcc

SEQ ID NO: 7339884 - DNA, 22 bp, Homo sapiens
gcagagagttgggctgcgccag

SEQ ID NO: 7339885 - DNA, 22 bp, Homo sapiens
gcagagaggatattattgtcca

SEQ ID NO: 7339886 - DNA, 22 bp, Homo sapiens
gcaccagggtgctgtgttctgg

SEQ ID NO: 7339887 - DNA, 22 bp, Homo sapiens
gcaccaggtgcagccgggcccc

SEQ ID NO: 7339888 - DNA, 22 bp, Homo sapiens
gcaccaggcagctgagcaggcc

SEQ ID NO: 7339889 - DNA, 22 bp, Homo sapiens
gcaccaggcttagagccccagg

SEQ ID NO: 7339890 - DNA, 22 bp, Homo sapiens
gcacagggccctgtgcgtaggt

SEQ ID NO: 7339891 - DNA, 22 bp, Homo sapiens
gcaccaggaggcccttctcatc

SEQ ID NO: 7339892 - DNA, 22 bp, Homo sapiens
gcacacagattaggaaacagaa

SEQ ID NO: 7339893 - DNA, 22 bp, Homo sapiens
gcacacagattaggaaacagaa

SEQ ID NO: 7339894 - DNA, 22 bp, Homo sapiens
gcacacagaattgattcactgt

SEQ ID NO: 7339895 - DNA, 22 bp, Homo sapiens
gatgtgtagagggaatttcaaa

SEQ ID NO: 7339896 - DNA, 22 bp, Homo sapiens
gatgtgcttagtacagatgtgt

SEQ ID NO: 7339897 - DNA, 22 bp, Homo sapiens
gatgtgctttgttaaacagatg

SEQ ID NO: 7339898 - DNA, 22 bp, Homo sapiens
gattcactcatattttacgttt

SEQ ID NO: 7339899 - DNA, 22 bp, Homo sapiens
gattccacagcttcgaggtctt

SEQ ID NO: 7339900 - DNA, 22 bp, Homo sapiens
gatgtctttagggcaaaatatt

SEQ ID NO: 7339901 - DNA, 22 bp, Homo sapiens
gatgtgaggactcatgtggagg

SEQ ID NO: 7339902 - DNA, 22 bp, Homo sapiens
attaaattggatctgcatagtt

SEQ ID NO: 7339903 - DNA, 22 bp, Homo sapiens
atgttattaaagtacagattct

SEQ ID NO: 7339904 - DNA, 22 bp, Homo sapiens
atgttatgtctgggaaggggta

SEQ ID NO: 7339905 - DNA, 22 bp, Homo sapiens
gagtggggcccactgctgggtg

SEQ ID NO: 7339906 - DNA, 22 bp, Homo sapiens
gagtggggaaagccaggacaga

SEQ ID NO: 7339907 - DNA, 21 bp, Homo sapiens
gagtgggctgagatggggctg

SEQ ID NO: 7339908 - DNA, 22 bp, Homo sapiens
gatggaggagatggcagggtgc

SEQ ID NO: 7339909 - DNA, 22 bp, Homo sapiens
attccacttgattttaggggaa

SEQ ID NO: 7339910 - DNA, 20 bp, Homo sapiens
attccacttgtttgaggtac

SEQ ID NO: 7339911 - DNA, 22 bp, Homo sapiens
attctgaagttgcaggagaagc

SEQ ID NO: 7339912 - DNA, 22 bp, Homo sapiens
attctgacctgaatagacttgg

SEQ ID NO: 7339913 - DNA, 22 bp, Homo sapiens
attctgagaggcacaatgtgga

SEQ ID NO: 7339914 - DNA, 22 bp, Homo sapiens
attctgatcattcaagatgtca

SEQ ID NO: 7339915 - DNA, 22 bp, Homo sapiens
gcaggcaaggaacagagactgt

SEQ ID NO: 7339916 - DNA, 22 bp, Homo sapiens
gcaggcaggaaggactaagtaa

SEQ ID NO: 7339917 - DNA, 22 bp, Homo sapiens
gcaggcaggaaggactaagtaa

SEQ ID NO: 7339918 - DNA, 22 bp, Homo sapiens
gcaggcaggaaggactaagtaa

SEQ ID NO: 7339919 - DNA, 22 bp, Homo sapiens
attccaaagcacatcagaacta

SEQ ID NO: 7339920 - DNA, 22 bp, Homo sapiens
attccacttccactagtttctc

SEQ ID NO: 7339921 - DNA, 22 bp, Homo sapiens
attcacaaatgctgccccattc

SEQ ID NO: 7339922 - DNA, 22 bp, Homo sapiens
attcacaaataacaggtgcaga

SEQ ID NO: 7339923 - DNA, 22 bp, Homo sapiens
attccaaacagtgctgcagact

SEQ ID NO: 7339924 - DNA, 19 bp, Homo sapiens
attcatttttgccttctaa

SEQ ID NO: 7339925 - DNA, 17 bp, Homo sapiens
attcatgaacatgtcct

SEQ ID NO: 7339926 - DNA, 22 bp, Homo sapiens
gcaggtgtgggtggctgccagg

SEQ ID NO: 7339927 - DNA, 22 bp, Homo sapiens
gcagtaaataattttgtgtata

SEQ ID NO: 7339928 - DNA, 22 bp, Homo sapiens
attgcaaggtgtagttatggtt

SEQ ID NO: 7339929 - DNA, 22 bp, Homo sapiens
gcatggagaagtgggaacaggt

SEQ ID NO: 7339930 - DNA, 22 bp, Homo sapiens
attgcaccttgggttttgaaag

SEQ ID NO: 7339931 - DNA, 22 bp, Homo sapiens
attctgccgctgccacttacta

SEQ ID NO: 7339932 - DNA, 22 bp, Homo sapiens
attctgcatgtaggtttgctca

SEQ ID NO: 7339933 - DNA, 20 bp, Homo sapiens
gcaggcagggaatgggggtg

SEQ ID NO: 7339934 - DNA, 20 bp, Homo sapiens
gcaggcagggaatgggggtg

SEQ ID NO: 7339935 - DNA, 22 bp, Homo sapiens
gcaggcaggtggcatcttgtga

SEQ ID NO: 7339936 - DNA, 22 bp, Homo sapiens
attctgcaactgttgttggtgg

SEQ ID NO: 7339937 - DNA, 22 bp, Homo sapiens
attctgcacatccaagaacagg

SEQ ID NO: 7339938 - DNA, 22 bp, Homo sapiens
gcagggcagtaagagctagagt

SEQ ID NO: 7339939 - DNA, 22 bp, Homo sapiens
gcagggcagtaagagctagagt

SEQ ID NO: 7339940 - DNA, 22 bp, Homo sapiens
attcttttaaatggcagtagta

SEQ ID NO: 7339941 - DNA, 22 bp, Homo sapiens
atagtatttccagaaatagtct

SEQ ID NO: 7339942 - DNA, 22 bp, Homo sapiens
atatattttgcggtcacgtggc

SEQ ID NO: 7339943 - DNA, 22 bp, Homo sapiens
atatattttgcggtcacgtggc

SEQ ID NO: 7339944 - DNA, 22 bp, Homo sapiens
atatattttgcggtcacgtggc

SEQ ID NO: 7339945 - DNA, 22 bp, Homo sapiens
atatattttttgagacagagtc

SEQ ID NO: 7339946 - DNA, 22 bp, Homo sapiens
atatattttttgagacagagtc

SEQ ID NO: 7339947 - DNA, 22 bp, Homo sapiens
atatattttttgagacagagtc

SEQ ID NO: 7339948 - DNA, 22 bp, Homo sapiens
atatcacagctctttcattgct

SEQ ID NO: 7339949 - DNA, 22 bp, Homo sapiens
atatcacagctctttcattgct

SEQ ID NO: 7339950 - DNA, 22 bp, Homo sapiens
atatcacagatgcagaaagaga

SEQ ID NO: 7339951 - DNA, 22 bp, Homo sapiens
atatcacagtagttgtttagtt

SEQ ID NO: 7339952 - DNA, 22 bp, Homo sapiens
atatcacagtagttgtttagtt

SEQ ID NO: 7339953 - DNA, 22 bp, Homo sapiens
atatcataaatcggtgcatgaa

SEQ ID NO: 7339954 - DNA, 22 bp, Homo sapiens
atatcacaaacaagtctgtact

SEQ ID NO: 7339955 - DNA, 22 bp, Homo sapiens
atatcacaaacaagtctgtact

SEQ ID NO: 7339956 - DNA, 23 bp, Homo sapiens
atatcacacccagtacagtctcc

SEQ ID NO: 7339957 - DNA, 23 bp, Homo sapiens
atatcacacccagtacagtctcc

SEQ ID NO: 7339958 - DNA, 22 bp, Homo sapiens
ctgggcctggcgttccaggctg

SEQ ID NO: 7339959 - DNA, 22 bp, Homo sapiens
ctgggcctgggaggccaggtct

SEQ ID NO: 7339960 - DNA, 22 bp, Homo sapiens
ctgggccatgggccagcgaggc

SEQ ID NO: 7339961 - DNA, 22 bp, Homo sapiens
ctgggcccacaagtggaatcgt

SEQ ID NO: 7339962 - DNA, 22 bp, Homo sapiens
ctgggccatctctctgcaagtg

SEQ ID NO: 7339963 - DNA, 22 bp, Homo sapiens
ctgggccagtctcggccgctct

SEQ ID NO: 7339964 - DNA, 22 bp, Homo sapiens
ctgggccaggaccagggttgaa

SEQ ID NO: 7339965 - DNA, 22 bp, Homo sapiens
ctgggcagtttacattcctacc

SEQ ID NO: 7339966 - DNA, 22 bp, Homo sapiens
ctgggcagttcgctttcgtttt

SEQ ID NO: 7339967 - DNA, 22 bp, Homo sapiens
ctgggccagtctcggccgctct

SEQ ID NO: 7339968 - DNA, 22 bp, Homo sapiens
ctggtggaggtgccaggatttg

SEQ ID NO: 7339969 - DNA, 22 bp, Homo sapiens
ctggtgggagcagcaggcagct

SEQ ID NO: 7339970 - DNA, 17 bp, Homo sapiens
ctggggatgtgggactc

SEQ ID NO: 7339971 - DNA, 20 bp, Homo sapiens
ctggggaggaggatgtgttc

SEQ ID NO: 7339972 - DNA, 22 bp, Homo sapiens
ctggggaggcagggctgcccct

SEQ ID NO: 7339973 - DNA, 22 bp, Homo sapiens
ctgtatgttccgttttgtcact

SEQ ID NO: 7339974 - DNA, 22 bp, Homo sapiens
ctgtatgttccgttttgtcact

SEQ ID NO: 7339975 - DNA, 22 bp, Homo sapiens
ctgtatttcccacattctctat

SEQ ID NO: 7339976 - DNA, 22 bp, Homo sapiens
ctgtccagcttggctcctgggg

SEQ ID NO: 7339977 - DNA, 22 bp, Homo sapiens
ctgtccagaaagggggcaacaa

SEQ ID NO: 7339978 - DNA, 21 bp, Homo sapiens
ctgtccacatcacagagcctc

SEQ ID NO: 7339979 - DNA, 22 bp, Homo sapiens
atattttgaagttaataatgtg

SEQ ID NO: 7339980 - DNA, 22 bp, Homo sapiens
atattttccgaacttgaggtag

SEQ ID NO: 7339981 - DNA, 22 bp, Homo sapiens
atatttgttagagtctatgtgt

SEQ ID NO: 7339982 - DNA, 22 bp, Homo sapiens
atatttgttgagttcttatgat

SEQ ID NO: 7339983 - DNA, 22 bp, Homo sapiens
ctgtaatgaactctttgtcagt

SEQ ID NO: 7339984 - DNA, 22 bp, Homo sapiens
cttcatgacccataaaaattta

SEQ ID NO: 7339985 - DNA, 22 bp, Homo sapiens
cttcatcatttgcactctaaga

SEQ ID NO: 7339986 - DNA, 19 bp, Homo sapiens
atctggaactcgtttgttt

SEQ ID NO: 7339987 - DNA, 21 bp, Homo sapiens
atctggaaattctgccagaga

SEQ ID NO: 7339988 - DNA, 22 bp, Homo sapiens
atctggaacaaagcttaggaat

SEQ ID NO: 7339989 - DNA, 22 bp, Homo sapiens
atctggaacaaagcttaggaat

SEQ ID NO: 7339990 - DNA, 22 bp, Homo sapiens
atctggaagccagatactcagt

SEQ ID NO: 7339991 - DNA, 22 bp, Homo sapiens
atctggaagattgaaggggagt

SEQ ID NO: 7339992 - DNA, 21 bp, Homo sapiens
atctggaagaactggtaagtg

SEQ ID NO: 7339993 - DNA, 22 bp, Homo sapiens
atctgcatttgaacaagctcct

SEQ ID NO: 7339994 - DNA, 22 bp, Homo sapiens
atctggaaaacacagtgtagac

SEQ ID NO: 7339995 - DNA, 22 bp, Homo sapiens
atctggaaataaatacgagttc

SEQ ID NO: 7339996 - DNA, 22 bp, Homo sapiens
atctatttctgctaataacaat

SEQ ID NO: 7339997 - DNA, 22 bp, Homo sapiens
atctcatcagatctgtataagc

SEQ ID NO: 7339998 - DNA, 22 bp, Homo sapiens
atctcataatcgtcattgcttt

SEQ ID NO: 7339999 - DNA, 22 bp, Homo sapiens
atctccagctggctgtgataaa

SEQ ID NO: 7340000 - DNA, 22 bp, Homo sapiens
cttcagcagatgtgctagagat

SEQ ID NO: 7340001 - DNA, 22 bp, Homo sapiens
cttcagcagcctcttgcataaa

SEQ ID NO: 7340002 - DNA, 22 bp, Homo sapiens
atccttggccctgaatgaagtt

SEQ ID NO: 7340003 - DNA, 21 bp, Homo sapiens
atccttgatcagaagagtgct

SEQ ID NO: 7340004 - DNA, 18 bp, Homo sapiens
atccttgatgagaggtct

SEQ ID NO: 7340005 - DNA, 22 bp, Homo sapiens
atccttgagccttatcttttgt

SEQ ID NO: 7340006 - DNA, 22 bp, Homo sapiens
atccttgagccaatgactgatt

SEQ ID NO: 7340007 - DNA, 22 bp, Homo sapiens
atccttgagaaaataaatgacc

SEQ ID NO: 7340008 - DNA, 22 bp, Homo sapiens
atccttctccaaaactggctcc

SEQ ID NO: 7340009 - DNA, 22 bp, Homo sapiens
atccttgacacactccagtact

SEQ ID NO: 7340010 - DNA, 22 bp, Homo sapiens
atccttgaatgactctgccctc

SEQ ID NO: 7340011 - DNA, 22 bp, Homo sapiens
atccttgaacttagacactagg

SEQ ID NO: 7340012 - DNA, 22 bp, Homo sapiens
cttcagatcctaatttgtcttt

SEQ ID NO: 7340013 - DNA, 22 bp, Homo sapiens
ctgtttctccacactcttccca

SEQ ID NO: 7340014 - DNA, 22 bp, Homo sapiens
ctgtttctccacactcttccca

SEQ ID NO: 7340015 - DNA, 22 bp, Homo sapiens
ctgtttcagctactgttccatg

SEQ ID NO: 7340016 - DNA, 22 bp, Homo sapiens
ctgtttcagaacttcttaaaaa

SEQ ID NO: 7340017 - DNA, 22 bp, Homo sapiens
ctgtttcaaagggtactgtgag

SEQ ID NO: 7340018 - DNA, 19 bp, Homo sapiens
atcaggaacaaggctgatc

SEQ ID NO: 7340019 - DNA, 20 bp, Homo sapiens
ctgtgctccgggttcctgga

SEQ ID NO: 7340020 - DNA, 22 bp, Homo sapiens
atcaggaagaattggatgctac

SEQ ID NO: 7340021 - DNA, 22 bp, Homo sapiens
atcaggaacgttcatggactgt

SEQ ID NO: 7340022 - DNA, 22 bp, Homo sapiens
atcaggaagcctgcactgagct

SEQ ID NO: 7340023 - DNA, 22 bp, Homo sapiens
atcaggaagtctgccacaaggc

SEQ ID NO: 7340024 - DNA, 22 bp, Homo sapiens
atcaggaagtctgccacaaggc

SEQ ID NO: 7340025 - DNA, 21 bp, Homo sapiens
atcagggatgggttggacacc

SEQ ID NO: 7340026 - DNA, 22 bp, Homo sapiens
ctgtgggagcacatgacagata

SEQ ID NO: 7340027 - DNA, 22 bp, Homo sapiens
ctgtgtatgactccagagggta

SEQ ID NO: 7340028 - DNA, 22 bp, Homo sapiens
ctgtgtatctctgtgggacaga

SEQ ID NO: 7340029 - DNA, 22 bp, Homo sapiens
ctgtgtattgaaaaagggttaa

SEQ ID NO: 7340030 - DNA, 23 bp, Homo sapiens
ctgtgctcagagggagggagagc

SEQ ID NO: 7340031 - DNA, 22 bp, Homo sapiens
ctgttagtaatgaagagaatgg

SEQ ID NO: 7340032 - DNA, 22 bp, Homo sapiens
ctgttactggacgcacgcagct

SEQ ID NO: 7340033 - DNA, 22 bp, Homo sapiens
ctgttatgcatggtcattgcct

SEQ ID NO: 7340034 - DNA, 23 bp, Homo sapiens
ctgttatgtaaatatgtttagtg

SEQ ID NO: 7340035 - DNA, 19 bp, Homo sapiens
ctgttattgtcagagctcc

SEQ ID NO: 7340036 - DNA, 22 bp, Homo sapiens
ctgttatttatgctgctccatt

SEQ ID NO: 7340037 - DNA, 22 bp, Homo sapiens
ctgtttatccctttggtcagca

SEQ ID NO: 7340038 - DNA, 22 bp, Homo sapiens
ctgtttatctctaacctgttta

SEQ ID NO: 7340039 - DNA, 22 bp, Homo sapiens
ctgtttattgagcaatctgcca

SEQ ID NO: 7340040 - DNA, 22 bp, Homo sapiens
ctgtttattgagcaatctgcca

SEQ ID NO: 7340041 - DNA, 22 bp, Homo sapiens
ctgtttattacgtaattaatat

SEQ ID NO: 7340042 - DNA, 20 bp, Homo sapiens
ctgtttattagaagtggatt

SEQ ID NO: 7340043 - DNA, 22 bp, Homo sapiens
ctgtttattacactggatagca

SEQ ID NO: 7340044 - DNA, 22 bp, Homo sapiens
ctgtgtgtgaacacagcccagc

SEQ ID NO: 7340045 - DNA, 22 bp, Homo sapiens
ctgttactcctttggcagatta

SEQ ID NO: 7340046 - DNA, 22 bp, Homo sapiens
ctgtgtgtgaacacagcccagc

SEQ ID NO: 7340047 - DNA, 22 bp, Homo sapiens
atcattcatcttattgccagtc

SEQ ID NO: 7340048 - DNA, 22 bp, Homo sapiens
atcattcatcttattgccagtc

SEQ ID NO: 7340049 - DNA, 22 bp, Homo sapiens
atcattcagtctctgggacagt

SEQ ID NO: 7340050 - DNA, 22 bp, Homo sapiens
ataatttacaactgcttttaat

SEQ ID NO: 7340051 - DNA, 20 bp, Homo sapiens
ataatttaccctgcaccact

SEQ ID NO: 7340052 - DNA, 22 bp, Homo sapiens
atacagaaaatgatgcagagtt

SEQ ID NO: 7340053 - DNA, 21 bp, Homo sapiens
atacagaacattgatccaaga

SEQ ID NO: 7340054 - DNA, 22 bp, Homo sapiens
ataatgtttcagtactgtctgt

SEQ ID NO: 7340055 - DNA, 22 bp, Homo sapiens
ctgcctgcttttctgggagccg

SEQ ID NO: 7340056 - DNA, 22 bp, Homo sapiens
ataattatctcagacacttgtt

SEQ ID NO: 7340057 - DNA, 22 bp, Homo sapiens
ataattaatttcagtaatctcc

SEQ ID NO: 7340058 - DNA, 22 bp, Homo sapiens
ataatttaaattagtatgtgat

SEQ ID NO: 7340059 - DNA, 22 bp, Homo sapiens
atacatctctttgaagtgcttt

SEQ ID NO: 7340060 - DNA, 22 bp, Homo sapiens
atacatgaggctcatttatgtc

SEQ ID NO: 7340061 - DNA, 22 bp, Homo sapiens
atacatgactcacacattctgc

SEQ ID NO: 7340062 - DNA, 22 bp, Homo sapiens
atacatgactcacacattctgc

SEQ ID NO: 7340063 - DNA, 22 bp, Homo sapiens
atacatgacagcatagcatcct

SEQ ID NO: 7340064 - DNA, 22 bp, Homo sapiens
atacatgatcactgtattataa

SEQ ID NO: 7340065 - DNA, 22 bp, Homo sapiens
atacagaagcctgtatttctgg

SEQ ID NO: 7340066 - DNA, 22 bp, Homo sapiens
ctggaaagttcaagataaagct

SEQ ID NO: 7340067 - DNA, 19 bp, Homo sapiens
ctggaaagttggcagtgag

SEQ ID NO: 7340068 - DNA, 22 bp, Homo sapiens
atagaattatggaaagcatctt

SEQ ID NO: 7340069 - DNA, 22 bp, Homo sapiens
atagaattctttgaaatttatg

SEQ ID NO: 7340070 - DNA, 22 bp, Homo sapiens
atagaattcgtgtttgtaattc

SEQ ID NO: 7340071 - DNA, 22 bp, Homo sapiens
atagacaaacacgaagatgaca

SEQ ID NO: 7340072 - DNA, 22 bp, Homo sapiens
atagaatttgcactaaatctgc

SEQ ID NO: 7340073 - DNA, 22 bp, Homo sapiens
atagacacagatctatatatgt

SEQ ID NO: 7340074 - DNA, 22 bp, Homo sapiens
atagacagcgcattaaaaatgt

SEQ ID NO: 7340075 - DNA, 22 bp, Homo sapiens
atagacagcgcattaaaaatgt

SEQ ID NO: 7340076 - DNA, 22 bp, Homo sapiens
ataggggcagatgaggaatggg

SEQ ID NO: 7340077 - DNA, 22 bp, Homo sapiens
atagggcctaaaaagtattgct

SEQ ID NO: 7340078 - DNA, 22 bp, Homo sapiens
atagtacacatcctacaatgtt

SEQ ID NO: 7340079 - DNA, 22 bp, Homo sapiens
atagtacacatcctacaatgtt

SEQ ID NO: 7340080 - DNA, 22 bp, Homo sapiens
atagtacaatcagttaattagt

SEQ ID NO: 7340081 - DNA, 22 bp, Homo sapiens
atagcagtgacattttaatgtg

SEQ ID NO: 7340082 - DNA, 22 bp, Homo sapiens
atagggaggaactgagtcagga

SEQ ID NO: 7340083 - DNA, 22 bp, Homo sapiens
atagaatatgacttttagatcc

SEQ ID NO: 7340084 - DNA, 19 bp, Homo sapiens
atagaaagggttaaagaca

SEQ ID NO: 7340085 - DNA, 23 bp, Homo sapiens
atagaaactaacaatttggctta

SEQ ID NO: 7340086 - DNA, 18 bp, Homo sapiens
atagaaacctttaatcag

SEQ ID NO: 7340087 - DNA, 22 bp, Homo sapiens
atagaaaggtctttggcagaca

SEQ ID NO: 7340088 - DNA, 22 bp, Homo sapiens
ctggccagtgcctgtgggcccc

SEQ ID NO: 7340089 - DNA, 22 bp, Homo sapiens
atagaaacagaggtcaggcatt

SEQ ID NO: 7340090 - DNA, 22 bp, Homo sapiens
atagaaacagatgcacttctct

SEQ ID NO: 7340091 - DNA, 22 bp, Homo sapiens
atagaaacagggaagcaaagca

SEQ ID NO: 7340092 - DNA, 22 bp, Homo sapiens
ctggccaggctctcacgtggtc

SEQ ID NO: 7340093 - DNA, 22 bp, Homo sapiens
ctggccagtgactgctcacccg

SEQ ID NO: 7340094 - DNA, 22 bp, Homo sapiens
ctggccagtgactgctcacccg

SEQ ID NO: 7340095 - DNA, 22 bp, Homo sapiens
ctggccagggtgcgatcgtggt

SEQ ID NO: 7340096 - DNA, 22 bp, Homo sapiens
ctggccaggttttgaacagttg

SEQ ID NO: 7340097 - DNA, 22 bp, Homo sapiens
ctggccaggcttgggacagaca

SEQ ID NO: 7340098 - DNA, 22 bp, Homo sapiens
agtttcacaaattgtcaatagc

SEQ ID NO: 7340099 - DNA, 22 bp, Homo sapiens
agtttatttctccatttaccta

SEQ ID NO: 7340100 - DNA, 22 bp, Homo sapiens
agtgttctagcgctgtgcttgt

SEQ ID NO: 7340101 - DNA, 23 bp, Homo sapiens
agtgttccagttggttgagagtg

SEQ ID NO: 7340102 - DNA, 22 bp, Homo sapiens
agtgttccacacatctggggaa

SEQ ID NO: 7340103 - DNA, 20 bp, Homo sapiens
agtgttccggaagactggca

SEQ ID NO: 7340104 - DNA, 22 bp, Homo sapiens
agtgttcctgctctcaggaagc

SEQ ID NO: 7340105 - DNA, 22 bp, Homo sapiens
agtgttccttgctttcccagag

SEQ ID NO: 7340106 - DNA, 22 bp, Homo sapiens
agtgttatttattgtttcataa

SEQ ID NO: 7340107 - DNA, 18 bp, Homo sapiens
agtgttaagtaagtagca

SEQ ID NO: 7340108 - DNA, 22 bp, Homo sapiens
agttttcaatatatgatagtga

SEQ ID NO: 7340109 - DNA, 22 bp, Homo sapiens
ctgatacactccctaaaatata

SEQ ID NO: 7340110 - DNA, 21 bp, Homo sapiens
ctgataattgttaaattattt

SEQ ID NO: 7340111 - DNA, 22 bp, Homo sapiens
ctgataatttcaaaaatcttca

SEQ ID NO: 7340112 - DNA, 22 bp, Homo sapiens
ctgatagacaatcaccatggga

SEQ ID NO: 7340113 - DNA, 22 bp, Homo sapiens
ctgataatacagcagtttgtct

SEQ ID NO: 7340114 - DNA, 22 bp, Homo sapiens
agtttcacatagctcagtgctc

SEQ ID NO: 7340115 - DNA, 22 bp, Homo sapiens
agtttcatattaccatgtcacc

SEQ ID NO: 7340116 - DNA, 22 bp, Homo sapiens
agtttctcttaatctagtatct

SEQ ID NO: 7340117 - DNA, 22 bp, Homo sapiens
agtttcttcatccaaaaaatgg

SEQ ID NO: 7340118 - DNA, 22 bp, Homo sapiens
ctgccctgtggctctgagtcat

SEQ ID NO: 7340119 - DNA, 22 bp, Homo sapiens
ctgccctgtggctctgagtcat

SEQ ID NO: 7340120 - DNA, 22 bp, Homo sapiens
ctgcctgcttttctgggagccg

SEQ ID NO: 7340121 - DNA, 22 bp, Homo sapiens
ctgcctgcttctgagccagagg

SEQ ID NO: 7340122 - DNA, 23 bp, Homo sapiens
ctgcctgctggggagacagatct

SEQ ID NO: 7340123 - DNA, 22 bp, Homo sapiens
ctgcctgctgcctgtggagggt

SEQ ID NO: 7340124 - DNA, 22 bp, Homo sapiens
ctgcctgctgcctgtggagggt

SEQ ID NO: 7340125 - DNA, 22 bp, Homo sapiens
ataatacatggttaacctcttt

SEQ ID NO: 7340126 - DNA, 22 bp, Homo sapiens
agttttctgacccctgctctat

SEQ ID NO: 7340127 - DNA, 22 bp, Homo sapiens
agttttcctttattgagtacca

SEQ ID NO: 7340128 - DNA, 22 bp, Homo sapiens
agttttctcacatcaaaaatga

SEQ ID NO: 7340129 - DNA, 22 bp, Homo sapiens
agttttctcacatcaaaaatga

SEQ ID NO: 7340130 - DNA, 22 bp, Homo sapiens
agttttctttcatctatcagca

SEQ ID NO: 7340131 - DNA, 22 bp, Homo sapiens
agttttctgctaaaccagctaa

SEQ ID NO: 7340132 - DNA, 22 bp, Homo sapiens
agttttgatactttctcttcat

SEQ ID NO: 7340133 - DNA, 22 bp, Homo sapiens
ctgcccgtccctttgctctcgc

SEQ ID NO: 7340134 - DNA, 22 bp, Homo sapiens
ctgccctctagggatgcactgg

SEQ ID NO: 7340135 - DNA, 22 bp, Homo sapiens
ctgccctctagaggaggactga

SEQ ID NO: 7340136 - DNA, 22 bp, Homo sapiens
ctgccctgacctgcctcagagt

SEQ ID NO: 7340137 - DNA, 22 bp, Homo sapiens
aggttgggatgagtgggtgagc

SEQ ID NO: 7340138 - DNA, 22 bp, Homo sapiens
aggttacagtcatctcagaatc

SEQ ID NO: 7340139 - DNA, 22 bp, Homo sapiens
cctggtgaatgttcatggactg

SEQ ID NO: 7340140 - DNA, 17 bp, Homo sapiens
aggtgtggtcaagggag

SEQ ID NO: 7340141 - DNA, 19 bp, Homo sapiens
aggtgtgggggctgcagac

SEQ ID NO: 7340142 - DNA, 19 bp, Homo sapiens
aggtgtgggggctgcagac

SEQ ID NO: 7340143 - DNA, 22 bp, Homo sapiens
aggtgtgggaaacgggtgacct

SEQ ID NO: 7340144 - DNA, 19 bp, Homo sapiens
aggtgtgggggctgcagac

SEQ ID NO: 7340145 - DNA, 22 bp, Homo sapiens
aggtgtggcttgaagtctctat

SEQ ID NO: 7340146 - DNA, 22 bp, Homo sapiens
aggtgtggctggggcagaggcc

SEQ ID NO: 7340147 - DNA, 22 bp, Homo sapiens
aggtgtgaagagttgacacatt

SEQ ID NO: 7340148 - DNA, 21 bp, Homo sapiens
aggtttatttcaacttcagga

SEQ ID NO: 7340149 - DNA, 22 bp, Homo sapiens
aggtttattatagaggatgacg

SEQ ID NO: 7340150 - DNA, 22 bp, Homo sapiens
agtaatgacaatttttatctgt

SEQ ID NO: 7340151 - DNA, 22 bp, Homo sapiens
agtcagaattcgatcccaggtc

SEQ ID NO: 7340152 - DNA, 22 bp, Homo sapiens
agtcagaatctgcattttaacc

SEQ ID NO: 7340153 - DNA, 22 bp, Homo sapiens
agtcagaagggcccttccttcc

SEQ ID NO: 7340154 - DNA, 22 bp, Homo sapiens
agtcagagaccctagatctaat

SEQ ID NO: 7340155 - DNA, 21 bp, Homo sapiens
ctacactgtgttagaaaatgg

SEQ ID NO: 7340156 - DNA, 22 bp, Homo sapiens
agtcaggctccttgcctttccc

SEQ ID NO: 7340157 - DNA, 22 bp, Homo sapiens
ctaaactagcagttctgcaaca

SEQ ID NO: 7340158 - DNA, 22 bp, Homo sapiens
ctaaacatgtagcttttgtggt

SEQ ID NO: 7340159 - DNA, 22 bp, Homo sapiens
ctaaacatgcaagagcttctgg

SEQ ID NO: 7340160 - DNA, 19 bp, Homo sapiens
cgtggagctggcaggcagg

SEQ ID NO: 7340161 - DNA, 22 bp, Homo sapiens
cgtgctctggactcgtggcaca

SEQ ID NO: 7340162 - DNA, 22 bp, Homo sapiens
ctaaacaagatactaatgaggt

SEQ ID NO: 7340163 - DNA, 22 bp, Homo sapiens
cggtcaggtgcagcgttggcac

SEQ ID NO: 7340164 - DNA, 22 bp, Homo sapiens
cgcggtggcggcctccagcgcc

SEQ ID NO: 7340165 - DNA, 22 bp, Homo sapiens
cgcggtggcggcctccagcgcc

SEQ ID NO: 7340166 - DNA, 22 bp, Homo sapiens
cgtgaggggggtaaggcgtccg

SEQ ID NO: 7340167 - DNA, 22 bp, Homo sapiens
cgtgatatttgtggtggatgaa

SEQ ID NO: 7340168 - DNA, 22 bp, Homo sapiens
cgcgggggtcctcaggcaggcg

SEQ ID NO: 7340169 - DNA, 22 bp, Homo sapiens
cgcgggggtcctcaggcaggcg

SEQ ID NO: 7340170 - DNA, 22 bp, Homo sapiens
cgcgctgcagacagcggaggcc

SEQ ID NO: 7340171 - DNA, 22 bp, Homo sapiens
cgcgctgcagacagcggaggcc

SEQ ID NO: 7340172 - DNA, 22 bp, Homo sapiens
cgcggaggaggtcaggaggtga

SEQ ID NO: 7340173 - DNA, 22 bp, Homo sapiens
cgcggctctgcgggccgctgag

SEQ ID NO: 7340174 - DNA, 22 bp, Homo sapiens
cgcgggcccctgcgctccgggc

SEQ ID NO: 7340175 - DNA, 22 bp, Homo sapiens
cgcgggcctccagacccagtat

SEQ ID NO: 7340176 - DNA, 22 bp, Homo sapiens
cgcgctctccttctggcaccca

SEQ ID NO: 7340177 - DNA, 22 bp, Homo sapiens
cctgcctggctgtcagcagagc

SEQ ID NO: 7340178 - DNA, 22 bp, Homo sapiens
cctggagcactctccctggctg

SEQ ID NO: 7340179 - DNA, 22 bp, Homo sapiens
cctggacctgcagcatcagcat

SEQ ID NO: 7340180 - DNA, 21 bp, Homo sapiens
cctggactaaaaccaggccac

SEQ ID NO: 7340181 - DNA, 22 bp, Homo sapiens
cctggagcatcaggaggaaggg

SEQ ID NO: 7340182 - DNA, 22 bp, Homo sapiens
cctggagcaggagctgcagagg

SEQ ID NO: 7340183 - DNA, 22 bp, Homo sapiens
agggtggaagatggcactatct

SEQ ID NO: 7340184 - DNA, 22 bp, Homo sapiens
agggtggagggagtccctgagc

SEQ ID NO: 7340185 - DNA, 22 bp, Homo sapiens
aggggctgtggaaaccaactct

SEQ ID NO: 7340186 - DNA, 22 bp, Homo sapiens
aggggctgtggaaaccaactct

SEQ ID NO: 7340187 - DNA, 22 bp, Homo sapiens
aggggctttggtgctggtcctg

SEQ ID NO: 7340188 - DNA, 22 bp, Homo sapiens
agggtggcactggtggctctat

SEQ ID NO: 7340189 - DNA, 19 bp, Homo sapiens
agggtggcaaaggagggtg

SEQ ID NO: 7340190 - DNA, 21 bp, Homo sapiens
agggtggctctgggtcagaac

SEQ ID NO: 7340191 - DNA, 22 bp, Homo sapiens
cctggccagccagggctggggt

SEQ ID NO: 7340192 - DNA, 22 bp, Homo sapiens
agggtggcttaattccaaaggg

SEQ ID NO: 7340193 - DNA, 20 bp, Homo sapiens
cctggagcctggaaggagtc

SEQ ID NO: 7340194 - DNA, 22 bp, Homo sapiens
cctggagcccaaggcagtgaga

SEQ ID NO: 7340195 - DNA, 22 bp, Homo sapiens
cctggagcccctctggccagcc

SEQ ID NO: 7340196 - DNA, 22 bp, Homo sapiens
agggtggcagttactggagcaa

SEQ ID NO: 7340197 - DNA, 22 bp, Homo sapiens
cctggagcgcgggtcaagctgg

SEQ ID NO: 7340198 - DNA, 22 bp, Homo sapiens
agggtggccatgagggagagat

SEQ ID NO: 7340199 - DNA, 22 bp, Homo sapiens
aggtataagaagattatttata

SEQ ID NO: 7340200 - DNA, 22 bp, Homo sapiens
cctggctcaaggcgaggactcc

SEQ ID NO: 7340201 - DNA, 22 bp, Homo sapiens
cctggctcaggcacgcatggct

SEQ ID NO: 7340202 - DNA, 22 bp, Homo sapiens
cctggctcagcagctctttctc

SEQ ID NO: 7340203 - DNA, 22 bp, Homo sapiens
aggtctggctcttctccacaga

SEQ ID NO: 7340204 - DNA, 22 bp, Homo sapiens
aggtctggaggcggagtcagga

SEQ ID NO: 7340205 - DNA, 22 bp, Homo sapiens
aggtctgggagttcattccctg

SEQ ID NO: 7340206 - DNA, 22 bp, Homo sapiens
aggtctggtgagagcaggtgct

SEQ ID NO: 7340207 - DNA, 22 bp, Homo sapiens
aggtgaggtttgggaggtgtca

SEQ ID NO: 7340208 - DNA, 22 bp, Homo sapiens
aggtgagggtgccagtgcatgg

SEQ ID NO: 7340209 - DNA, 22 bp, Homo sapiens
aggtgagggtgccagtgcatgg

SEQ ID NO: 7340210 - DNA, 22 bp, Homo sapiens
aggtgagggtgccagtgcatgg

SEQ ID NO: 7340211 - DNA, 19 bp, Homo sapiens
aggtgaggggcaccatgtc

SEQ ID NO: 7340212 - DNA, 22 bp, Homo sapiens
aggtctgtgaattcctgagaaa

SEQ ID NO: 7340213 - DNA, 22 bp, Homo sapiens
aggtctgtgattcactttgagt

SEQ ID NO: 7340214 - DNA, 22 bp, Homo sapiens
aggtctgtgcgctgttgataga

SEQ ID NO: 7340215 - DNA, 22 bp, Homo sapiens
aggtctgtgaattcctgagaaa

SEQ ID NO: 7340216 - DNA, 22 bp, Homo sapiens
aggtatgagcctctgcacccag

SEQ ID NO: 7340217 - DNA, 22 bp, Homo sapiens
aggtctggaaacagcagggaga

SEQ ID NO: 7340218 - DNA, 21 bp, Homo sapiens
aggtggagtgcttagcatcca

SEQ ID NO: 7340219 - DNA, 22 bp, Homo sapiens
aggtggagtgaaggaaaggcag

SEQ ID NO: 7340220 - DNA, 22 bp, Homo sapiens
aggtggagtgtgcagggagagc

SEQ ID NO: 7340221 - DNA, 22 bp, Homo sapiens
aggtggagtgtgcagggagagc

SEQ ID NO: 7340222 - DNA, 23 bp, Homo sapiens
aggtggagctgtgcagccggggc

SEQ ID NO: 7340223 - DNA, 22 bp, Homo sapiens
aggtggagatcagggactaagg

SEQ ID NO: 7340224 - DNA, 22 bp, Homo sapiens
aggtgcttggctcgtgcacaca

SEQ ID NO: 7340225 - DNA, 22 bp, Homo sapiens
aggtggagatcagggactaagg

SEQ ID NO: 7340226 - DNA, 22 bp, Homo sapiens
cctggtccccatcggcccagcg

SEQ ID NO: 7340227 - DNA, 22 bp, Homo sapiens
aggtggagtgtgcagggagagc

SEQ ID NO: 7340228 - DNA, 22 bp, Homo sapiens
aggtggagttaagtgtgaactg

SEQ ID NO: 7340229 - DNA, 22 bp, Homo sapiens
aggtggagttaagtgtgaactg

SEQ ID NO: 7340230 - DNA, 22 bp, Homo sapiens
aggtggagttggctgtagttca

SEQ ID NO: 7340231 - DNA, 22 bp, Homo sapiens
cctgggtgtcatgggcagctgg

SEQ ID NO: 7340232 - DNA, 22 bp, Homo sapiens
cctgggcaggccggacgctggg

SEQ ID NO: 7340233 - DNA, 22 bp, Homo sapiens
aggtgctgtttgtcagcagttt

SEQ ID NO: 7340234 - DNA, 22 bp, Homo sapiens
agtgacaggggaggcaggtgtg

SEQ ID NO: 7340235 - DNA, 22 bp, Homo sapiens
ctcaggcagttgtttgcatagt

SEQ ID NO: 7340236 - DNA, 21 bp, Homo sapiens
ctcaggcatttgaggagagtc

SEQ ID NO: 7340237 - DNA, 22 bp, Homo sapiens
ctccagggagctgcgggagcca

SEQ ID NO: 7340238 - DNA, 22 bp, Homo sapiens
agtgatttgactcttttattgt

SEQ ID NO: 7340239 - DNA, 22 bp, Homo sapiens
agtgcagagagcaatactctac

SEQ ID NO: 7340240 - DNA, 22 bp, Homo sapiens
agtgatttgcagtatttactaa

SEQ ID NO: 7340241 - DNA, 22 bp, Homo sapiens
agtgcagactgaaatgaccttc

SEQ ID NO: 7340242 - DNA, 22 bp, Homo sapiens
agtgcaggagcctggccagagc

SEQ ID NO: 7340243 - DNA, 23 bp, Homo sapiens
ctcctcgtaactctgtggtgggt

SEQ ID NO: 7340244 - DNA, 22 bp, Homo sapiens
ctcctcctggacacaggctgtg

SEQ ID NO: 7340245 - DNA, 22 bp, Homo sapiens
ctcctccttcctgtgttgtgca

SEQ ID NO: 7340246 - DNA, 22 bp, Homo sapiens
ctcctctcaggctggatggcgc

SEQ ID NO: 7340247 - DNA, 22 bp, Homo sapiens
ctcctctcaaaagtaggttgac

SEQ ID NO: 7340248 - DNA, 22 bp, Homo sapiens
ctcctcctaaatgattcttcct

SEQ ID NO: 7340249 - DNA, 22 bp, Homo sapiens
ctcctcctggacacaggctgtg

SEQ ID NO: 7340250 - DNA, 22 bp, Homo sapiens
ctcctcctcaaattagcttttg

SEQ ID NO: 7340251 - DNA, 22 bp, Homo sapiens
ctcctcagctgggaggagtccc

SEQ ID NO: 7340252 - DNA, 22 bp, Homo sapiens
ctcctcagagagcagcttgggg

SEQ ID NO: 7340253 - DNA, 22 bp, Homo sapiens
agtcatctcttctacaatatgg

SEQ ID NO: 7340254 - DNA, 22 bp, Homo sapiens
agtcatctctgagatagaagct

SEQ ID NO: 7340255 - DNA, 19 bp, Homo sapiens
agtcatctcactgtgccca

SEQ ID NO: 7340256 - DNA, 22 bp, Homo sapiens
agtcatctcaggtagcatttac

SEQ ID NO: 7340257 - DNA, 22 bp, Homo sapiens
agtcatctccaatatacaaagc

SEQ ID NO: 7340258 - DNA, 20 bp, Homo sapiens
agtcatctcctctactgctt

SEQ ID NO: 7340259 - DNA, 22 bp, Homo sapiens
agtcatctttatccaaaacact

SEQ ID NO: 7340260 - DNA, 22 bp, Homo sapiens
agtcatctgacctcttctcaga

SEQ ID NO: 7340261 - DNA, 22 bp, Homo sapiens
agtcatctggttttgcatggca

SEQ ID NO: 7340262 - DNA, 21 bp, Homo sapiens
agtcatctgttcattcaacag

SEQ ID NO: 7340263 - DNA, 22 bp, Homo sapiens
agtcatctatgggccacacgga

SEQ ID NO: 7340264 - DNA, 22 bp, Homo sapiens
agtcatctcaacagcttgccca

SEQ ID NO: 7340265 - DNA, 18 bp, Homo sapiens
agtcatttacttttgtga

SEQ ID NO: 7340266 - DNA, 20 bp, Homo sapiens
agtcattgggtgtccttcgg

SEQ ID NO: 7340267 - DNA, 22 bp, Homo sapiens
agtccaaagcagatgagggcca

SEQ ID NO: 7340268 - DNA, 22 bp, Homo sapiens
agtcattttgccagtcttcagg

SEQ ID NO: 7340269 - DNA, 23 bp, Homo sapiens
agtctgtgctgaagaagttacaa

SEQ ID NO: 7340270 - DNA, 22 bp, Homo sapiens
agtctggattagttgggggcaa

SEQ ID NO: 7340271 - DNA, 22 bp, Homo sapiens
agtctggagtgttttgtagcaa

SEQ ID NO: 7340272 - DNA, 22 bp, Homo sapiens
agtctggagtttgctactggac

SEQ ID NO: 7340273 - DNA, 22 bp, Homo sapiens
agtctggacctgctgggtctcc

SEQ ID NO: 7340274 - DNA, 22 bp, Homo sapiens
agtctggagcagcagtattggt

SEQ ID NO: 7340275 - DNA, 22 bp, Homo sapiens
agtctggagctcagacttggga

SEQ ID NO: 7340276 - DNA, 22 bp, Homo sapiens
agtctggaggtggcaggtgtgt

SEQ ID NO: 7340277 - DNA, 19 bp, Homo sapiens
agtctggagtaaaaggaat

SEQ ID NO: 7340278 - DNA, 22 bp, Homo sapiens
agtctggagtagagcctagaaa

SEQ ID NO: 7340279 - DNA, 22 bp, Homo sapiens
agtctggagtgattatgtggga

SEQ ID NO: 7340280 - DNA, 22 bp, Homo sapiens
agtctggagtgcggcggcagga

SEQ ID NO: 7340281 - DNA, 23 bp, Homo sapiens
agtctggaagtgcagtggctgga

SEQ ID NO: 7340282 - DNA, 22 bp, Homo sapiens
agtctggaataaaactacttac

SEQ ID NO: 7340283 - DNA, 22 bp, Homo sapiens
agtctggaatttggcctgagca

SEQ ID NO: 7340284 - DNA, 22 bp, Homo sapiens
agtctggacatgctgaacttgg

SEQ ID NO: 7340285 - DNA, 21 bp, Homo sapiens
agtctggaaaacacattcatg

SEQ ID NO: 7340286 - DNA, 22 bp, Homo sapiens
agtctggaaaatgcatgtttca

SEQ ID NO: 7340287 - DNA, 22 bp, Homo sapiens
agtctgtgtgaatgtgggcttt

SEQ ID NO: 7340288 - DNA, 20 bp, Homo sapiens
ctcaggatactgcaaagttg

SEQ ID NO: 7340289 - DNA, 22 bp, Homo sapiens
ctcaggatagattgtcctctca

SEQ ID NO: 7340290 - DNA, 22 bp, Homo sapiens
ctcaggatagctgcgcagcctg

SEQ ID NO: 7340291 - DNA, 22 bp, Homo sapiens
ctcaggatattgggctggagca

SEQ ID NO: 7340292 - DNA, 22 bp, Homo sapiens
ctcaggatccatctcctgccct

SEQ ID NO: 7340293 - DNA, 22 bp, Homo sapiens
ctcaggatcgcttgccctaggg

SEQ ID NO: 7340294 - DNA, 21 bp, Homo sapiens
ctcaggatcttatatattagt

SEQ ID NO: 7340295 - DNA, 22 bp, Homo sapiens
ctcaggatgaaagtcatggtga

SEQ ID NO: 7340296 - DNA, 22 bp, Homo sapiens
ctcaggatgcaattccatcaag

SEQ ID NO: 7340297 - DNA, 22 bp, Homo sapiens
ctcaggcacttttgtcacagac

SEQ ID NO: 7340298 - DNA, 22 bp, Homo sapiens
ctcaggcagttctgtagcctcc

SEQ ID NO: 7340299 - DNA, 22 bp, Homo sapiens
ctcaggcagttgtttgcatagt

SEQ ID NO: 7340300 - DNA, 22 bp, Homo sapiens
ctcaggcagtgccctctggccg

SEQ ID NO: 7340301 - DNA, 22 bp, Homo sapiens
ctcaggcaaggcccgcattctc

SEQ ID NO: 7340302 - DNA, 22 bp, Homo sapiens
ctcaggatttaaaggggcactc

SEQ ID NO: 7340303 - DNA, 22 bp, Homo sapiens
ctcaggatttactaatttcaag

SEQ ID NO: 7340304 - DNA, 22 bp, Homo sapiens
ctcaggcacgggtcagtgagcg

SEQ ID NO: 7340305 - DNA, 20 bp, Homo sapiens
ctcaggattgtctagcccct

SEQ ID NO: 7340306 - DNA, 22 bp, Homo sapiens
ctcaggattgtgcctagggaga

SEQ ID NO: 7340307 - DNA, 22 bp, Homo sapiens
ctcaggattctcgacactcaca

SEQ ID NO: 7340308 - DNA, 22 bp, Homo sapiens
ctcaggatgtcggtgactattg

SEQ ID NO: 7340309 - DNA, 22 bp, Homo sapiens
ctcaggattaaggaatctaaat

SEQ ID NO: 7340310 - DNA, 22 bp, Homo sapiens
ctcaggatgcaggtcacaggac

SEQ ID NO: 7340311 - DNA, 22 bp, Homo sapiens
ctcaggatggaagcctacagga

SEQ ID NO: 7340312 - DNA, 21 bp, Homo sapiens
ctcaggatggcggcctggtgg

SEQ ID NO: 7340313 - DNA, 22 bp, Homo sapiens
ctcaggatgtactacagaaggc

SEQ ID NO: 7340314 - DNA, 22 bp, Homo sapiens
agtgggcaaaacagctcagagc

SEQ ID NO: 7340315 - DNA, 18 bp, Homo sapiens
agtgggcacacagagaac

SEQ ID NO: 7340316 - DNA, 22 bp, Homo sapiens
agtgggcagcccaggaggtctt

SEQ ID NO: 7340317 - DNA, 22 bp, Homo sapiens
agtgggcaggcagggtgcgcag

SEQ ID NO: 7340318 - DNA, 22 bp, Homo sapiens
agtgggcttttttccgttccat

SEQ ID NO: 7340319 - DNA, 22 bp, Homo sapiens
agtgggcttactgagggagtgt

SEQ ID NO: 7340320 - DNA, 22 bp, Homo sapiens
agtgggcttactgagggagtgt

SEQ ID NO: 7340321 - DNA, 22 bp, Homo sapiens
agtgggctggtggcagggagaa

SEQ ID NO: 7340322 - DNA, 22 bp, Homo sapiens
agtgggctggtggcagggagaa

SEQ ID NO: 7340323 - DNA, 22 bp, Homo sapiens
agtgggcatgatctggtgtctg

SEQ ID NO: 7340324 - DNA, 22 bp, Homo sapiens
agtgggcccgagccagtggtct

SEQ ID NO: 7340325 - DNA, 22 bp, Homo sapiens
agtgggccggacagcccaggcc

SEQ ID NO: 7340326 - DNA, 22 bp, Homo sapiens
agtgggcccttgtcacactgat

SEQ ID NO: 7340327 - DNA, 22 bp, Homo sapiens
ctctgagaggctgccctgccat

SEQ ID NO: 7340328 - DNA, 22 bp, Homo sapiens
ctctgagaggtgagaagcagca

SEQ ID NO: 7340329 - DNA, 22 bp, Homo sapiens
ctctctgggggccatgccaaga

SEQ ID NO: 7340330 - DNA, 22 bp, Homo sapiens
ctctctgggcccagttggcacc

SEQ ID NO: 7340331 - DNA, 22 bp, Homo sapiens
agtgcaggccccaggccaggcc

SEQ ID NO: 7340332 - DNA, 22 bp, Homo sapiens
agtgcaggccccaggccaggcc

SEQ ID NO: 7340333 - DNA, 22 bp, Homo sapiens
agtggcagccgagcaggagatg

SEQ ID NO: 7340334 - DNA, 22 bp, Homo sapiens
ctcttaaagcttccagtttcaa

SEQ ID NO: 7340335 - DNA, 22 bp, Homo sapiens
ctcttaaataacatcattgctt

SEQ ID NO: 7340336 - DNA, 22 bp, Homo sapiens
ctcttaaataacatcattgctt

SEQ ID NO: 7340337 - DNA, 19 bp, Homo sapiens
ctcttaaattgtctcttgc

SEQ ID NO: 7340338 - DNA, 21 bp, Homo sapiens
ctctgtttgcctgctgccatc

SEQ ID NO: 7340339 - DNA, 22 bp, Homo sapiens
ctctgtttttcaatagttcttg

SEQ ID NO: 7340340 - DNA, 22 bp, Homo sapiens
ctctgtttttcaatagttcttg

SEQ ID NO: 7340341 - DNA, 22 bp, Homo sapiens
ctctgtttggcgctgctccttc

SEQ ID NO: 7340342 - DNA, 22 bp, Homo sapiens
ctcttaaaaacttgatatattt

SEQ ID NO: 7340343 - DNA, 22 bp, Homo sapiens
ctcttaaaattacctttgcaaa

SEQ ID NO: 7340344 - DNA, 23 bp, Homo sapiens
agtgtctgagtgcaggctgtgca

SEQ ID NO: 7340345 - DNA, 22 bp, Homo sapiens
agtggggacaatgagagcaggt

SEQ ID NO: 7340346 - DNA, 22 bp, Homo sapiens
agtggggaggtccaggccaccc

SEQ ID NO: 7340347 - DNA, 22 bp, Homo sapiens
agtggggacttatgccagcatt

SEQ ID NO: 7340348 - DNA, 18 bp, Homo sapiens
agtgtgtgccctttcagg

SEQ ID NO: 7340349 - DNA, 21 bp, Homo sapiens
agtgtgtgtggaatgagaata

SEQ ID NO: 7340350 - DNA, 21 bp, Homo sapiens
agtgtgtgtggaatgagaata

SEQ ID NO: 7340351 - DNA, 22 bp, Homo sapiens
agtgtgtgctgttccccggagg

SEQ ID NO: 7340352 - DNA, 22 bp, Homo sapiens
agtgtgggggctttggtgtcac

SEQ ID NO: 7340353 - DNA, 18 bp, Homo sapiens
agtgtgtgccctttcagg

SEQ ID NO: 7340354 - DNA, 21 bp, Homo sapiens
agtgtgttcttggcattacct

SEQ ID NO: 7340355 - DNA, 21 bp, Homo sapiens
agtgtgttcttggcattacct

SEQ ID NO: 7340356 - DNA, 22 bp, Homo sapiens
agtgtgttctcaatgaaaagaa

SEQ ID NO: 7340357 - DNA, 22 bp, Homo sapiens
agtgtgttctggtctaccttgg

SEQ ID NO: 7340358 - DNA, 22 bp, Homo sapiens
agtgtgttgtaggctcaaatgg

SEQ ID NO: 7340359 - DNA, 22 bp, Homo sapiens
agtgtgttgtaggctcaaatgg

SEQ ID NO: 7340360 - DNA, 22 bp, Homo sapiens
agtgtgtttaggctgcgggttg

SEQ ID NO: 7340361 - DNA, 22 bp, Homo sapiens
agtgtgtttggagcgagggagg

SEQ ID NO: 7340362 - DNA, 22 bp, Homo sapiens
agtgtgtgtttgggcggtttat

SEQ ID NO: 7340363 - DNA, 22 bp, Homo sapiens
agtgtgtgtttgggcggtttat

SEQ ID NO: 7340364 - DNA, 20 bp, Homo sapiens
agtgtgttcctcttactgtg

SEQ ID NO: 7340365 - DNA, 22 bp, Homo sapiens
agtgttaacatgaatggtttcc

SEQ ID NO: 7340366 - DNA, 22 bp, Homo sapiens
ctgaagcaaatgaaacagctct

SEQ ID NO: 7340367 - DNA, 22 bp, Homo sapiens
ctgaagcacagcatataaataa

SEQ ID NO: 7340368 - DNA, 22 bp, Homo sapiens
ctgaagctgggcacttcctttt

SEQ ID NO: 7340369 - DNA, 22 bp, Homo sapiens
ctgaagctgcataccaaagact

SEQ ID NO: 7340370 - DNA, 22 bp, Homo sapiens
ctgagaaagtgagggttaaaca

SEQ ID NO: 7340371 - DNA, 20 bp, Homo sapiens
cccaggagtttgctcttact

SEQ ID NO: 7340372 - DNA, 22 bp, Homo sapiens
cccaggagtttgagttcagcat

SEQ ID NO: 7340373 - DNA, 22 bp, Homo sapiens
cccagggcttttctcactagac

SEQ ID NO: 7340374 - DNA, 22 bp, Homo sapiens
cccagggcttgagtcatccatg

SEQ ID NO: 7340375 - DNA, 22 bp, Homo sapiens
cccaggggtaaggcgcagcgtg

SEQ ID NO: 7340376 - DNA, 22 bp, Homo sapiens
cccaggggaggtcctcagggaa

SEQ ID NO: 7340377 - DNA, 22 bp, Homo sapiens
cccaggggtaaggcgcagcgtg

SEQ ID NO: 7340378 - DNA, 22 bp, Homo sapiens
cccaggggtatccatggagaag

SEQ ID NO: 7340379 - DNA, 19 bp, Homo sapiens
cccaggggacccagcccta

SEQ ID NO: 7340380 - DNA, 19 bp, Homo sapiens
cccaggggacccagcccta

SEQ ID NO: 7340381 - DNA, 22 bp, Homo sapiens
cccaggggaggtcctcagggaa

SEQ ID NO: 7340382 - DNA, 23 bp, Homo sapiens
agggaagaaacatgaagggctgt

SEQ ID NO: 7340383 - DNA, 22 bp, Homo sapiens
cccagggctgcagatggaggct

SEQ ID NO: 7340384 - DNA, 22 bp, Homo sapiens
cccagggctgcagatggaggct

SEQ ID NO: 7340385 - DNA, 19 bp, Homo sapiens
aggcttctaccctgtccag

SEQ ID NO: 7340386 - DNA, 22 bp, Homo sapiens
aggctggctggcaggggacaca

SEQ ID NO: 7340387 - DNA, 22 bp, Homo sapiens
aggcttcactcgacatgccaat

SEQ ID NO: 7340388 - DNA, 22 bp, Homo sapiens
aggctggctgagctgcagcctg

SEQ ID NO: 7340389 - DNA, 22 bp, Homo sapiens
aggctggctgagctgcagcctg

SEQ ID NO: 7340390 - DNA, 22 bp, Homo sapiens
aggcttctctgcaagatgttaa

SEQ ID NO: 7340391 - DNA, 19 bp, Homo sapiens
aggcttggattgtggccaa

SEQ ID NO: 7340392 - DNA, 22 bp, Homo sapiens
cccaggaggtggagcttgcagt

SEQ ID NO: 7340393 - DNA, 21 bp, Homo sapiens
aggcttggatctagacaggcc

SEQ ID NO: 7340394 - DNA, 22 bp, Homo sapiens
aggcttggaggttctgtagcca

SEQ ID NO: 7340395 - DNA, 22 bp, Homo sapiens
agggatggagcccagctgttct

SEQ ID NO: 7340396 - DNA, 22 bp, Homo sapiens
agggatggaagctcgtctgcaa

SEQ ID NO: 7340397 - DNA, 22 bp, Homo sapiens
agggatggagtgcggcccggac

SEQ ID NO: 7340398 - DNA, 22 bp, Homo sapiens
agggagtgttacataatgggtt

SEQ ID NO: 7340399 - DNA, 22 bp, Homo sapiens
agggatgatcagggtagaggct

SEQ ID NO: 7340400 - DNA, 18 bp, Homo sapiens
agggatctagatggagtc

SEQ ID NO: 7340401 - DNA, 22 bp, Homo sapiens
cccaggggtatccatggagaag

SEQ ID NO: 7340402 - DNA, 22 bp, Homo sapiens
agggactcctctgctcggctgc

SEQ ID NO: 7340403 - DNA, 22 bp, Homo sapiens
agggagaacagttgcagcagac

SEQ ID NO: 7340404 - DNA, 22 bp, Homo sapiens
agggagaacagttgcagcagac

SEQ ID NO: 7340405 - DNA, 22 bp, Homo sapiens
agggagtggttaagaaggtgca

SEQ ID NO: 7340406 - DNA, 22 bp, Homo sapiens
agggcagagatctgagtgggca

SEQ ID NO: 7340407 - DNA, 22 bp, Homo sapiens
agggcagagatctgagtgggca

SEQ ID NO: 7340408 - DNA, 22 bp, Homo sapiens
agggcagagatctgagtgggca

SEQ ID NO: 7340409 - DNA, 22 bp, Homo sapiens
agggcagagattaattaagaca

SEQ ID NO: 7340410 - DNA, 22 bp, Homo sapiens
agggcagagcactgaattggga

SEQ ID NO: 7340411 - DNA, 22 bp, Homo sapiens
agggcagagctgtctaaatggc

SEQ ID NO: 7340412 - DNA, 22 bp, Homo sapiens
agggcagagagatgaatgggat

SEQ ID NO: 7340413 - DNA, 22 bp, Homo sapiens
agggcagagagatgaatgggat

SEQ ID NO: 7340414 - DNA, 22 bp, Homo sapiens
agggcagagacatgcttcctga

SEQ ID NO: 7340415 - DNA, 22 bp, Homo sapiens
agggcagagaaatgtagttgag

SEQ ID NO: 7340416 - DNA, 22 bp, Homo sapiens
ccctggaggaccccaatgtggc

SEQ ID NO: 7340417 - DNA, 22 bp, Homo sapiens
ccctggacggggaatatgactt

SEQ ID NO: 7340418 - DNA, 22 bp, Homo sapiens
ccctggacacacacttttattc

SEQ ID NO: 7340419 - DNA, 20 bp, Homo sapiens
ccctggactcctgagcaaac

SEQ ID NO: 7340420 - DNA, 20 bp, Homo sapiens
agggcagagggattacaggc

SEQ ID NO: 7340421 - DNA, 22 bp, Homo sapiens
agggcagagctgtctaaatggc

SEQ ID NO: 7340422 - DNA, 22 bp, Homo sapiens
agggcagaggcggacacggaag

SEQ ID NO: 7340423 - DNA, 22 bp, Homo sapiens
agggcagaggcggacacggaag

SEQ ID NO: 7340424 - DNA, 22 bp, Homo sapiens
ccctctgctcaggtgcataggc

SEQ ID NO: 7340425 - DNA, 22 bp, Homo sapiens
ccctctgcaggctggacctgcc

SEQ ID NO: 7340426 - DNA, 20 bp, Homo sapiens
ccctctgcacatggctgtgg

SEQ ID NO: 7340427 - DNA, 22 bp, Homo sapiens
ccctctgcctctgagtaggaca

SEQ ID NO: 7340428 - DNA, 22 bp, Homo sapiens
agggatgggtctaacccagaac

SEQ ID NO: 7340429 - DNA, 22 bp, Homo sapiens
agggatgggaactcctccagca

SEQ ID NO: 7340430 - DNA, 22 bp, Homo sapiens
agggatggatcttggccctgga

SEQ ID NO: 7340431 - DNA, 22 bp, Homo sapiens
agggatggatcttggccctgga

SEQ ID NO: 7340432 - DNA, 22 bp, Homo sapiens
ccctctctcaggctgacagcct

SEQ ID NO: 7340433 - DNA, 22 bp, Homo sapiens
ccctctcttagaagaaacacag

SEQ ID NO: 7340434 - DNA, 22 bp, Homo sapiens
ccctctctgacttctgaacttg

SEQ ID NO: 7340435 - DNA, 22 bp, Homo sapiens
ccctctctcggttgctgtggtt

SEQ ID NO: 7340436 - DNA, 22 bp, Homo sapiens
cctcctgcggcgtccgcgctct

SEQ ID NO: 7340437 - DNA, 22 bp, Homo sapiens
cctcctggaaaaattccctggc

SEQ ID NO: 7340438 - DNA, 22 bp, Homo sapiens
cctcctggccctgggcctggaa

SEQ ID NO: 7340439 - DNA, 22 bp, Homo sapiens
agggctgcaatgggagataact

SEQ ID NO: 7340440 - DNA, 23 bp, Homo sapiens
agggctgatgccattgcagctct

SEQ ID NO: 7340441 - DNA, 22 bp, Homo sapiens
agggctgagtggtgcagtcaaa

SEQ ID NO: 7340442 - DNA, 22 bp, Homo sapiens
cctctgggcaggtagcagcagc

SEQ ID NO: 7340443 - DNA, 16 bp, Homo sapiens
cctctgggcctgcaag

SEQ ID NO: 7340444 - DNA, 18 bp, Homo sapiens
cctctgccatagccagca

SEQ ID NO: 7340445 - DNA, 19 bp, Homo sapiens
cctctgccagcccgcctct

SEQ ID NO: 7340446 - DNA, 19 bp, Homo sapiens
cctctgccagcccgcctct

SEQ ID NO: 7340447 - DNA, 22 bp, Homo sapiens
agggctgcaatgggagataact

SEQ ID NO: 7340448 - DNA, 22 bp, Homo sapiens
agggctgcaccggggcttcgcg

SEQ ID NO: 7340449 - DNA, 22 bp, Homo sapiens
agggctgcaccggggcttcgcg

SEQ ID NO: 7340450 - DNA, 22 bp, Homo sapiens
agggctgcaggcaagatatggc

SEQ ID NO: 7340451 - DNA, 22 bp, Homo sapiens
agggctgcaggcaagatatggc

SEQ ID NO: 7340452 - DNA, 22 bp, Homo sapiens
cctctgggagactgctactgag

SEQ ID NO: 7340453 - DNA, 22 bp, Homo sapiens
cctctgggctgcctgcacgggt

SEQ ID NO: 7340454 - DNA, 22 bp, Homo sapiens
aggggagagaacataaggaagt

SEQ ID NO: 7340455 - DNA, 22 bp, Homo sapiens
aggggagaatttcaactcaggt

SEQ ID NO: 7340456 - DNA, 17 bp, Homo sapiens
aggggagagtgggaaga

SEQ ID NO: 7340457 - DNA, 17 bp, Homo sapiens
aggggagagtgggaaga

SEQ ID NO: 7340458 - DNA, 22 bp, Homo sapiens
aggggctgggacagagccaagc

SEQ ID NO: 7340459 - DNA, 22 bp, Homo sapiens
aggggctgggacagagccaagc

SEQ ID NO: 7340460 - DNA, 22 bp, Homo sapiens
aggggctggcttatctgagagt

SEQ ID NO: 7340461 - DNA, 22 bp, Homo sapiens
aggggctggcttatctgagagt

SEQ ID NO: 7340462 - DNA, 22 bp, Homo sapiens
aggggctggcttatctgagagt

SEQ ID NO: 7340463 - DNA, 22 bp, Homo sapiens
aggggctggagttcgaggttac

SEQ ID NO: 7340464 - DNA, 22 bp, Homo sapiens
aggggctggagttcgaggttac

SEQ ID NO: 7340465 - DNA, 22 bp, Homo sapiens
aggggctgctgggtccgcccct

SEQ ID NO: 7340466 - DNA, 22 bp, Homo sapiens
aggggctgctgggtccgcccct

SEQ ID NO: 7340467 - DNA, 22 bp, Homo sapiens
aggggctgcctggcttggcact

SEQ ID NO: 7340468 - DNA, 22 bp, Homo sapiens
aggggctgcctggcttggcact

SEQ ID NO: 7340469 - DNA, 22 bp, Homo sapiens
aggggctgcctggcttggcact

SEQ ID NO: 7340470 - DNA, 22 bp, Homo sapiens
ccgagagcaggtggccgctggt

SEQ ID NO: 7340471 - DNA, 22 bp, Homo sapiens
ccgagcccggagaggagctctt

SEQ ID NO: 7340472 - DNA, 22 bp, Homo sapiens
ccgagacactgagcagggtggg

SEQ ID NO: 7340473 - DNA, 22 bp, Homo sapiens
ccgaggctggagtgcagtggcg

SEQ ID NO: 7340474 - DNA, 22 bp, Homo sapiens
ccgaggctggcctcagggctgt

SEQ ID NO: 7340475 - DNA, 22 bp, Homo sapiens
agggccccatagtcactgcccg

SEQ ID NO: 7340476 - DNA, 22 bp, Homo sapiens
ccgccgtgcaggccgcgacgtg

SEQ ID NO: 7340477 - DNA, 22 bp, Homo sapiens
ccctttcttccgtgacttctgc

SEQ ID NO: 7340478 - DNA, 22 bp, Homo sapiens
agggccagaatccctcagtcta

SEQ ID NO: 7340479 - DNA, 22 bp, Homo sapiens
agggccagaatccctcagtcta

SEQ ID NO: 7340480 - DNA, 22 bp, Homo sapiens
agggccagaatccctcagtcta

SEQ ID NO: 7340481 - DNA, 22 bp, Homo sapiens
agggccagaggcaccttgcagc

SEQ ID NO: 7340482 - DNA, 22 bp, Homo sapiens
agggccagagtacatcagggct

SEQ ID NO: 7340483 - DNA, 22 bp, Homo sapiens
ccctggaggctggaggcagtag

SEQ ID NO: 7340484 - DNA, 22 bp, Homo sapiens
ccctggaggcaaaggttgcagt

SEQ ID NO: 7340485 - DNA, 22 bp, Homo sapiens
agggctcttcctttgcctctca

SEQ ID NO: 7340486 - DNA, 22 bp, Homo sapiens
cctcctctgtgcagctgtgggt

SEQ ID NO: 7340487 - DNA, 22 bp, Homo sapiens
agggctctgttggggtcagcac

SEQ ID NO: 7340488 - DNA, 22 bp, Homo sapiens
agggctctgtccccagaggccc

SEQ ID NO: 7340489 - DNA, 22 bp, Homo sapiens
agggctctggggtggcagagat

SEQ ID NO: 7340490 - DNA, 22 bp, Homo sapiens
agggctctggggtggcagagat

SEQ ID NO: 7340491 - DNA, 20 bp, Homo sapiens
agggctctgccttgctgatg

SEQ ID NO: 7340492 - DNA, 18 bp, Homo sapiens
agggctctctgctgggtt

SEQ ID NO: 7340493 - DNA, 22 bp, Homo sapiens
agggctcctatgatgctctgcc

SEQ ID NO: 7340494 - DNA, 22 bp, Homo sapiens
agggctccgggcaggcgatgga

SEQ ID NO: 7340495 - DNA, 22 bp, Homo sapiens
agggccctaaggaaggcacaca

SEQ ID NO: 7340496 - DNA, 22 bp, Homo sapiens
agggccctccccgctcagggca

SEQ ID NO: 7340497 - DNA, 22 bp, Homo sapiens
agggccctctgggcactgtggc

SEQ ID NO: 7340498 - DNA, 22 bp, Homo sapiens
agggccctgagttgcagccctg

SEQ ID NO: 7340499 - DNA, 22 bp, Homo sapiens
agggccctctggcaggccaggc

SEQ ID NO: 7340500 - DNA, 22 bp, Homo sapiens
agggcccttacgcaggcccttc

SEQ ID NO: 7340501 - DNA, 19 bp, Homo sapiens
agggctaggcacatagggc

SEQ ID NO: 7340502 - DNA, 22 bp, Homo sapiens
agggctatgattaatgatggtg

SEQ ID NO: 7340503 - DNA, 22 bp, Homo sapiens
agggctccaaggaagtgtagct

SEQ ID NO: 7340504 - DNA, 22 bp, Homo sapiens
agggctcccgcggtgtccggga

SEQ ID NO: 7340505 - DNA, 22 bp, Homo sapiens
agggctcccgtgaggtgactgc

SEQ ID NO: 7340506 - DNA, 22 bp, Homo sapiens
agggctccaggggctgggtgac

SEQ ID NO: 7340507 - DNA, 22 bp, Homo sapiens
ccaggaggaaagaccagcccat

SEQ ID NO: 7340508 - DNA, 22 bp, Homo sapiens
aggctcagtatagctggcaagt

SEQ ID NO: 7340509 - DNA, 22 bp, Homo sapiens
aggctcagtcccggcccgcgcc

SEQ ID NO: 7340510 - DNA, 22 bp, Homo sapiens
aggctcagtctgttcatgcact

SEQ ID NO: 7340511 - DNA, 22 bp, Homo sapiens
ccaggaggaaattctaaaggta

SEQ ID NO: 7340512 - DNA, 22 bp, Homo sapiens
aggctcagcctgggcctagagc

SEQ ID NO: 7340513 - DNA, 22 bp, Homo sapiens
aggctcaggtctcaggtctggc

SEQ ID NO: 7340514 - DNA, 22 bp, Homo sapiens
aggctcagtatagctggcaagt

SEQ ID NO: 7340515 - DNA, 22 bp, Homo sapiens
ccaggctgtaagagtgatgttg

SEQ ID NO: 7340516 - DNA, 22 bp, Homo sapiens
ccaggctgtaagagtgatgttg

SEQ ID NO: 7340517 - DNA, 23 bp, Homo sapiens
aggctccacatgggcactttgca

SEQ ID NO: 7340518 - DNA, 22 bp, Homo sapiens
aggctccaccccgccagacctt

SEQ ID NO: 7340519 - DNA, 22 bp, Homo sapiens
aggctcagttcacgtcaacttt

SEQ ID NO: 7340520 - DNA, 22 bp, Homo sapiens
aggctcagttcacgtcaacttt

SEQ ID NO: 7340521 - DNA, 22 bp, Homo sapiens
aggctcagttctgtggtgagcc

SEQ ID NO: 7340522 - DNA, 22 bp, Homo sapiens
aggctcagttctgtggtgagcc

SEQ ID NO: 7340523 - DNA, 22 bp, Homo sapiens
aggctcagtttggtttccattg

SEQ ID NO: 7340524 - DNA, 22 bp, Homo sapiens
ccagggagcggggctgggtctc

SEQ ID NO: 7340525 - DNA, 22 bp, Homo sapiens
aggctcctagcctgtggctggt

SEQ ID NO: 7340526 - DNA, 22 bp, Homo sapiens
aggctcctgagaggcagaggct

SEQ ID NO: 7340527 - DNA, 22 bp, Homo sapiens
aggctcctcggggctgacggcg

SEQ ID NO: 7340528 - DNA, 22 bp, Homo sapiens
ccagggagcccacaggacaatg

SEQ ID NO: 7340529 - DNA, 22 bp, Homo sapiens
ccagggtgaccagctggcctag

SEQ ID NO: 7340530 - DNA, 22 bp, Homo sapiens
ccagggtgaccctcccggtggc

SEQ ID NO: 7340531 - DNA, 22 bp, Homo sapiens
ccagggtgagaaaaggctggat

SEQ ID NO: 7340532 - DNA, 22 bp, Homo sapiens
ccagggtgaggaggctcccacg

SEQ ID NO: 7340533 - DNA, 22 bp, Homo sapiens
ccagggtgagtgtcatgggtta

SEQ ID NO: 7340534 - DNA, 22 bp, Homo sapiens
ccagggtgagtgtcatgggtta

SEQ ID NO: 7340535 - DNA, 22 bp, Homo sapiens
ccagggtgctctgtggcgtcgc

SEQ ID NO: 7340536 - DNA, 22 bp, Homo sapiens
aggctcctgggtgtggccgcca

SEQ ID NO: 7340537 - DNA, 20 bp, Homo sapiens
aggctcctgtacctgaggaa

SEQ ID NO: 7340538 - DNA, 22 bp, Homo sapiens
aggctcctgatcctggggtctg

SEQ ID NO: 7340539 - DNA, 22 bp, Homo sapiens
aggctgaggtgtgctgtgatcg

SEQ ID NO: 7340540 - DNA, 22 bp, Homo sapiens
ccatgcacaccagcaggcagac

SEQ ID NO: 7340541 - DNA, 22 bp, Homo sapiens
aggctctgtgcagcctgcatct

SEQ ID NO: 7340542 - DNA, 22 bp, Homo sapiens
aggctctgtgcatcctccccaa

SEQ ID NO: 7340543 - DNA, 22 bp, Homo sapiens
aggctctgtgatgtgccaggca

SEQ ID NO: 7340544 - DNA, 22 bp, Homo sapiens
ccagggtggaggctggatggag

SEQ ID NO: 7340545 - DNA, 22 bp, Homo sapiens
cccactgtctgttcccagggcc

SEQ ID NO: 7340546 - DNA, 22 bp, Homo sapiens
cccagagccggtggtgctcaca

SEQ ID NO: 7340547 - DNA, 22 bp, Homo sapiens
cccagagccgctcccctacttc

SEQ ID NO: 7340548 - DNA, 22 bp, Homo sapiens
aggctggcgtcaggggctgtac

SEQ ID NO: 7340549 - DNA, 22 bp, Homo sapiens
cccactgtctgttcccagggcc

SEQ ID NO: 7340550 - DNA, 16 bp, Homo sapiens
cccactgtctggtctt

SEQ ID NO: 7340551 - DNA, 18 bp, Homo sapiens
cccactgtccccacaggc

SEQ ID NO: 7340552 - DNA, 22 bp, Homo sapiens
cccactgctgctctccatggca

SEQ ID NO: 7340553 - DNA, 22 bp, Homo sapiens
aggctgcctggctgtgagtgaa

SEQ ID NO: 7340554 - DNA, 22 bp, Homo sapiens
aggctgcctcgtgagctcgctg

SEQ ID NO: 7340555 - DNA, 22 bp, Homo sapiens
aggctgcctctgcaggatccct

SEQ ID NO: 7340556 - DNA, 22 bp, Homo sapiens
aggctgcctcgtgagctcgctg

SEQ ID NO: 7340557 - DNA, 22 bp, Homo sapiens
aggctgcctcttttgagagggt

SEQ ID NO: 7340558 - DNA, 19 bp, Homo sapiens
aggctgcctcaccctccct

SEQ ID NO: 7340559 - DNA, 22 bp, Homo sapiens
ccaggacaagtgtggccatggc

SEQ ID NO: 7340560 - DNA, 22 bp, Homo sapiens
aggccctgggcagttctgtagc

SEQ ID NO: 7340561 - DNA, 22 bp, Homo sapiens
aggccctggggtctgttaaatt

SEQ ID NO: 7340562 - DNA, 22 bp, Homo sapiens
aggccctggctgggtttcttta

SEQ ID NO: 7340563 - DNA, 22 bp, Homo sapiens
aggccctgggagcagagatgca

SEQ ID NO: 7340564 - DNA, 18 bp, Homo sapiens
aggccctggcctcgaaca

SEQ ID NO: 7340565 - DNA, 22 bp, Homo sapiens
aggccctggcctgactcaatgt

SEQ ID NO: 7340566 - DNA, 22 bp, Homo sapiens
aggccctggcccccagagattc

SEQ ID NO: 7340567 - DNA, 22 bp, Homo sapiens
aggccctggcccccagagattc

SEQ ID NO: 7340568 - DNA, 22 bp, Homo sapiens
aggccctggcactgcctgggag

SEQ ID NO: 7340569 - DNA, 22 bp, Homo sapiens
ccaggagcaaagatcactggga

SEQ ID NO: 7340570 - DNA, 22 bp, Homo sapiens
ccagcctgaaatgcctcatcct

SEQ ID NO: 7340571 - DNA, 22 bp, Homo sapiens
ccagcctccatgtagatagctg

SEQ ID NO: 7340572 - DNA, 22 bp, Homo sapiens
ccagcctcatcgcctgcctgtc

SEQ ID NO: 7340573 - DNA, 22 bp, Homo sapiens
ccagcctcatcatattcctgct

SEQ ID NO: 7340574 - DNA, 22 bp, Homo sapiens
ccagccctgccagagagagctg

SEQ ID NO: 7340575 - DNA, 22 bp, Homo sapiens
aggcccagcccgtcctcgtgct

SEQ ID NO: 7340576 - DNA, 19 bp, Homo sapiens
ccagctggcctgggacctc

SEQ ID NO: 7340577 - DNA, 22 bp, Homo sapiens
ccagcttggagtaacaaatggt

SEQ ID NO: 7340578 - DNA, 22 bp, Homo sapiens
aggcaggggagctggaagggta

SEQ ID NO: 7340579 - DNA, 22 bp, Homo sapiens
aggcaggggagctggaagggta

SEQ ID NO: 7340580 - DNA, 22 bp, Homo sapiens
aggcaggggagctggaagggta

SEQ ID NO: 7340581 - DNA, 22 bp, Homo sapiens
aggcagggtgatgataatgatt

SEQ ID NO: 7340582 - DNA, 22 bp, Homo sapiens
ccagagagggcgccacctggag

SEQ ID NO: 7340583 - DNA, 20 bp, Homo sapiens
ccagagagtaggttagtgat

SEQ ID NO: 7340584 - DNA, 22 bp, Homo sapiens
ccagagagtaaacattttccgg

SEQ ID NO: 7340585 - DNA, 22 bp, Homo sapiens
ccagagagtaggaggcattatt

SEQ ID NO: 7340586 - DNA, 22 bp, Homo sapiens
ccagagaggtagcttaccctct

SEQ ID NO: 7340587 - DNA, 22 bp, Homo sapiens
ccagagaggggaagggcttgcc

SEQ ID NO: 7340588 - DNA, 22 bp, Homo sapiens
ccagagagtcgatgggggacac

SEQ ID NO: 7340589 - DNA, 22 bp, Homo sapiens
ccagagagtatcatggagagta

SEQ ID NO: 7340590 - DNA, 17 bp, Homo sapiens
ccagagagtagttagga

SEQ ID NO: 7340591 - DNA, 22 bp, Homo sapiens
aggccagacagctagaaacagg

SEQ ID NO: 7340592 - DNA, 22 bp, Homo sapiens
aggccagaagtcaaaaactcta

SEQ ID NO: 7340593 - DNA, 22 bp, Homo sapiens
aggccagaagccagaaatgctt

SEQ ID NO: 7340594 - DNA, 22 bp, Homo sapiens
aggccagaacagctctgcacca

SEQ ID NO: 7340595 - DNA, 22 bp, Homo sapiens
aggcatggatgtagcagtgacc

SEQ ID NO: 7340596 - DNA, 22 bp, Homo sapiens
ccagagtctttatattcctgaa

SEQ ID NO: 7340597 - DNA, 23 bp, Homo sapiens
aggcatggcatggatggtggctc

SEQ ID NO: 7340598 - DNA, 23 bp, Homo sapiens
aggcatggcatggatggtggctc

SEQ ID NO: 7340599 - DNA, 22 bp, Homo sapiens
aggcatggcactgagcagcttc

SEQ ID NO: 7340600 - DNA, 22 bp, Homo sapiens
aggcatggacatttcggcagct

SEQ ID NO: 7340601 - DNA, 22 bp, Homo sapiens
agctgagggcaggatggggtga

SEQ ID NO: 7340602 - DNA, 22 bp, Homo sapiens
agctgagggcaggatggggtga

SEQ ID NO: 7340603 - DNA, 22 bp, Homo sapiens
cagctctgtaaattccttcatc

SEQ ID NO: 7340604 - DNA, 22 bp, Homo sapiens
cagctctgggtgacaggagggc

SEQ ID NO: 7340605 - DNA, 22 bp, Homo sapiens
cagctctggtccagggagggca

SEQ ID NO: 7340606 - DNA, 22 bp, Homo sapiens
agctgccacatggtgtcactgt

SEQ ID NO: 7340607 - DNA, 22 bp, Homo sapiens
caggaagggggatccttggaag

SEQ ID NO: 7340608 - DNA, 22 bp, Homo sapiens
agctgcagtgaactgttttgtc

SEQ ID NO: 7340609 - DNA, 22 bp, Homo sapiens
caggaaggcgcggctgtgcctg

SEQ ID NO: 7340610 - DNA, 22 bp, Homo sapiens
caggaaggcgcggctgtgcctg

SEQ ID NO: 7340611 - DNA, 22 bp, Homo sapiens
caggaaggcccacctgtcctgt

SEQ ID NO: 7340612 - DNA, 22 bp, Homo sapiens
caggaaggcccacctgtcctgt

SEQ ID NO: 7340613 - DNA, 22 bp, Homo sapiens
caggaaggcgcggctgtgcctg

SEQ ID NO: 7340614 - DNA, 19 bp, Homo sapiens
caggaaggggcgaatctgg

SEQ ID NO: 7340615 - DNA, 22 bp, Homo sapiens
caggaaggggctcactctggcc

SEQ ID NO: 7340616 - DNA, 22 bp, Homo sapiens
caggaaggaccgtccagatcag

SEQ ID NO: 7340617 - DNA, 22 bp, Homo sapiens
caggaaggcccacctgtcctgt

SEQ ID NO: 7340618 - DNA, 22 bp, Homo sapiens
agctgcagataggatgttattt

SEQ ID NO: 7340619 - DNA, 22 bp, Homo sapiens
caggcactgtgctgagctctgc

SEQ ID NO: 7340620 - DNA, 22 bp, Homo sapiens
caggcactgtgttaggcactgt

SEQ ID NO: 7340621 - DNA, 22 bp, Homo sapiens
agctggccattgtgagtggcct

SEQ ID NO: 7340622 - DNA, 20 bp, Homo sapiens
agctggcccacaggtgtggg

SEQ ID NO: 7340623 - DNA, 22 bp, Homo sapiens
caggccagaggctgttgttgcg

SEQ ID NO: 7340624 - DNA, 22 bp, Homo sapiens
caggcatgagccaggcccctcc

SEQ ID NO: 7340625 - DNA, 22 bp, Homo sapiens
agctggccctcgagagccaatt

SEQ ID NO: 7340626 - DNA, 22 bp, Homo sapiens
agctgggctgggctgagctgag

SEQ ID NO: 7340627 - DNA, 22 bp, Homo sapiens
caggccaggctgcatttgcccc

SEQ ID NO: 7340628 - DNA, 22 bp, Homo sapiens
caggccagcggcccgcgcgttc

SEQ ID NO: 7340629 - DNA, 22 bp, Homo sapiens
caggccagcggcccgcgcgttc

SEQ ID NO: 7340630 - DNA, 22 bp, Homo sapiens
caggccagcgtccagaacaagc

SEQ ID NO: 7340631 - DNA, 22 bp, Homo sapiens
caggccagcttcctgacatcct

SEQ ID NO: 7340632 - DNA, 22 bp, Homo sapiens
caggccagcttcctgacatcct

SEQ ID NO: 7340633 - DNA, 20 bp, Homo sapiens
caggccagaggtttgatggc

SEQ ID NO: 7340634 - DNA, 22 bp, Homo sapiens
caggccagagtccaactccaga

SEQ ID NO: 7340635 - DNA, 22 bp, Homo sapiens
caggccagcagggcctccgtgg

SEQ ID NO: 7340636 - DNA, 22 bp, Homo sapiens
caggccagcagggcctccgtgg

SEQ ID NO: 7340637 - DNA, 22 bp, Homo sapiens
caggccagcagggcctccgtgg

SEQ ID NO: 7340638 - DNA, 22 bp, Homo sapiens
caggaggaggtgaggtagaact

SEQ ID NO: 7340639 - DNA, 22 bp, Homo sapiens
caggaggaggtgaggtagaact

SEQ ID NO: 7340640 - DNA, 22 bp, Homo sapiens
caggcactgtgcaagggtctcg

SEQ ID NO: 7340641 - DNA, 22 bp, Homo sapiens
caggcactgtgctgagctctgc

SEQ ID NO: 7340642 - DNA, 22 bp, Homo sapiens
caggcactgtgctagatccttg

SEQ ID NO: 7340643 - DNA, 22 bp, Homo sapiens
caggcactgtgcctcgctccct

SEQ ID NO: 7340644 - DNA, 22 bp, Homo sapiens
caggcactcattcagagaggtg

SEQ ID NO: 7340645 - DNA, 22 bp, Homo sapiens
agctgctgcccataggtgacat

SEQ ID NO: 7340646 - DNA, 22 bp, Homo sapiens
agctgctgcaagtggtgctaac

SEQ ID NO: 7340647 - DNA, 22 bp, Homo sapiens
agctgctgcgcctcaccctggc

SEQ ID NO: 7340648 - DNA, 22 bp, Homo sapiens
agctgctgcccataggtgacat

SEQ ID NO: 7340649 - DNA, 19 bp, Homo sapiens
agctgctggcccagggacc

SEQ ID NO: 7340650 - DNA, 19 bp, Homo sapiens
agctgctggcccagggacc

SEQ ID NO: 7340651 - DNA, 22 bp, Homo sapiens
caggctggagtgcagttgtgca

SEQ ID NO: 7340652 - DNA, 22 bp, Homo sapiens
caggctggagtgcagttgtgca

SEQ ID NO: 7340653 - DNA, 22 bp, Homo sapiens
caggctggagtgcagtgtcgcc

SEQ ID NO: 7340654 - DNA, 22 bp, Homo sapiens
caggctggagtgcagttgtgca

SEQ ID NO: 7340655 - DNA, 22 bp, Homo sapiens
caggctggagtgcagttgtgca

SEQ ID NO: 7340656 - DNA, 22 bp, Homo sapiens
cagggagaaatctccaggaggt

SEQ ID NO: 7340657 - DNA, 22 bp, Homo sapiens
caggctggagtgcagtggtgcc

SEQ ID NO: 7340658 - DNA, 22 bp, Homo sapiens
caggctggagtacaattgtgtg

SEQ ID NO: 7340659 - DNA, 22 bp, Homo sapiens
caggctggacattagatacata

SEQ ID NO: 7340660 - DNA, 22 bp, Homo sapiens
cagggagctggctggcgtgagt

SEQ ID NO: 7340661 - DNA, 22 bp, Homo sapiens
cagggagctattagggttagtg

SEQ ID NO: 7340662 - DNA, 22 bp, Homo sapiens
cagggagctctgggccggactc

SEQ ID NO: 7340663 - DNA, 22 bp, Homo sapiens
cagggatgggatggagtcagtt

SEQ ID NO: 7340664 - DNA, 22 bp, Homo sapiens
cagggatggcgctggctgcccg

SEQ ID NO: 7340665 - DNA, 22 bp, Homo sapiens
cagggatgggatggagtcagtt

SEQ ID NO: 7340666 - DNA, 22 bp, Homo sapiens
caggctgctgacaggcttggag

SEQ ID NO: 7340667 - DNA, 22 bp, Homo sapiens
caggctgcggtcggctctggtc

SEQ ID NO: 7340668 - DNA, 22 bp, Homo sapiens
caggctgcggtcggctctggtc

SEQ ID NO: 7340669 - DNA, 22 bp, Homo sapiens
caggctgcggccgtgtgagcat

SEQ ID NO: 7340670 - DNA, 22 bp, Homo sapiens
caggctgcctggaagaggactg

SEQ ID NO: 7340671 - DNA, 22 bp, Homo sapiens
caggctgcggtcggctctggtc

SEQ ID NO: 7340672 - DNA, 22 bp, Homo sapiens
caggctccactgtaggcagctc

SEQ ID NO: 7340673 - DNA, 22 bp, Homo sapiens
caggctccactgtaggcagctc

SEQ ID NO: 7340674 - DNA, 22 bp, Homo sapiens
caggctccaagccctctgatgt

SEQ ID NO: 7340675 - DNA, 22 bp, Homo sapiens
caggctccaagccctctgatgt

SEQ ID NO: 7340676 - DNA, 22 bp, Homo sapiens
caggcctggttgagccctgaga

SEQ ID NO: 7340677 - DNA, 18 bp, Homo sapiens
agctggggcctctggtcc

SEQ ID NO: 7340678 - DNA, 22 bp, Homo sapiens
agctgggcttggccaggtcgct

SEQ ID NO: 7340679 - DNA, 22 bp, Homo sapiens
agctggggcatttatccactaa

SEQ ID NO: 7340680 - DNA, 22 bp, Homo sapiens
caggtgaggctgaacagatgaa

SEQ ID NO: 7340681 - DNA, 22 bp, Homo sapiens
caggtgagttttcctccttggt

SEQ ID NO: 7340682 - DNA, 22 bp, Homo sapiens
caggtgagtttgctattgtaca

SEQ ID NO: 7340683 - DNA, 22 bp, Homo sapiens
caggtgagtaacaatgggtgat

SEQ ID NO: 7340684 - DNA, 22 bp, Homo sapiens
caggtgagctctatctagggag

SEQ ID NO: 7340685 - DNA, 22 bp, Homo sapiens
caggtgaggctgaacagatgaa

SEQ ID NO: 7340686 - DNA, 20 bp, Homo sapiens
caggtgagcagatctgggtg

SEQ ID NO: 7340687 - DNA, 22 bp, Homo sapiens
caggtgagaggcggtcctgcat

SEQ ID NO: 7340688 - DNA, 22 bp, Homo sapiens
cagggtgcctgtcctcagcaaa

SEQ ID NO: 7340689 - DNA, 22 bp, Homo sapiens
cagggtgcctctgctcccacca

SEQ ID NO: 7340690 - DNA, 22 bp, Homo sapiens
caggtgaccctcagtgtggact

SEQ ID NO: 7340691 - DNA, 22 bp, Homo sapiens
caggtgacatcaacaggaccac

SEQ ID NO: 7340692 - DNA, 22 bp, Homo sapiens
caggtgaccctcagtgtggact

SEQ ID NO: 7340693 - DNA, 22 bp, Homo sapiens
caggtgaccctctcacctgctt

SEQ ID NO: 7340694 - DNA, 22 bp, Homo sapiens
caggtgacctcagcgcctgcag

SEQ ID NO: 7340695 - DNA, 17 bp, Homo sapiens
caggtgacctggtgatg

SEQ ID NO: 7340696 - DNA, 22 bp, Homo sapiens
caggggctgtgggcggagcctc

SEQ ID NO: 7340697 - DNA, 22 bp, Homo sapiens
caggggctgtgggcggagcctc

SEQ ID NO: 7340698 - DNA, 22 bp, Homo sapiens
caggggctgtgggcggagcctc

SEQ ID NO: 7340699 - DNA, 22 bp, Homo sapiens
caggggctccctgggtgccagt

SEQ ID NO: 7340700 - DNA, 22 bp, Homo sapiens
caggggctccctgggtgccagt

SEQ ID NO: 7340701 - DNA, 22 bp, Homo sapiens
caggggctccctgggtgccagt

SEQ ID NO: 7340702 - DNA, 22 bp, Homo sapiens
caggggctctgggtgatgtgag

SEQ ID NO: 7340703 - DNA, 22 bp, Homo sapiens
caggggctctaatgcatgatca

SEQ ID NO: 7340704 - DNA, 22 bp, Homo sapiens
caggggctctaatgcatgatca

SEQ ID NO: 7340705 - DNA, 22 bp, Homo sapiens
caggggctgaaatgttggggtt

SEQ ID NO: 7340706 - DNA, 22 bp, Homo sapiens
caggggctgaaatgttggggtt

SEQ ID NO: 7340707 - DNA, 22 bp, Homo sapiens
caggggctgaaatgttggggtt

SEQ ID NO: 7340708 - DNA, 22 bp, Homo sapiens
caggggctgtggcacatggtgt

SEQ ID NO: 7340709 - DNA, 22 bp, Homo sapiens
caggggctgagaaggaacgtcc

SEQ ID NO: 7340710 - DNA, 22 bp, Homo sapiens
cagggctccccgcaccgcagcc

SEQ ID NO: 7340711 - DNA, 22 bp, Homo sapiens
cagggctccatgcagggactcc

SEQ ID NO: 7340712 - DNA, 22 bp, Homo sapiens
cagggcctgcctggttcctgga

SEQ ID NO: 7340713 - DNA, 22 bp, Homo sapiens
caggggcggtggctcacgcctg

SEQ ID NO: 7340714 - DNA, 22 bp, Homo sapiens
cagggctcgctcttgcccttcg

SEQ ID NO: 7340715 - DNA, 22 bp, Homo sapiens
cagggctcgctcgctcgctcgc

SEQ ID NO: 7340716 - DNA, 22 bp, Homo sapiens
cagggcctctcctccaggaact

SEQ ID NO: 7340717 - DNA, 22 bp, Homo sapiens
cagggcctcgaagcctctgggc

SEQ ID NO: 7340718 - DNA, 22 bp, Homo sapiens
cagggcctcgaagcctctgggc

SEQ ID NO: 7340719 - DNA, 22 bp, Homo sapiens
cagggcctcctaaggcatctaa

SEQ ID NO: 7340720 - DNA, 22 bp, Homo sapiens
cagggcctcgaagcctctgggc

SEQ ID NO: 7340721 - DNA, 22 bp, Homo sapiens
cagggcctgagggctgctctgc

SEQ ID NO: 7340722 - DNA, 22 bp, Homo sapiens
cagggcctctgtgggctctctc

SEQ ID NO: 7340723 - DNA, 22 bp, Homo sapiens
cagggcctcctaaggcatctaa

SEQ ID NO: 7340724 - DNA, 22 bp, Homo sapiens
cagggcctccccggcagtcttt

SEQ ID NO: 7340725 - DNA, 23 bp, Homo sapiens
cagggccaggcagcagctgtcac

SEQ ID NO: 7340726 - DNA, 22 bp, Homo sapiens
cagggatgtgatgagctgagcc

SEQ ID NO: 7340727 - DNA, 22 bp, Homo sapiens
cagggatgtctctggaagggag

SEQ ID NO: 7340728 - DNA, 22 bp, Homo sapiens
catggggcccatgtgctccaag

SEQ ID NO: 7340729 - DNA, 22 bp, Homo sapiens
catggggcccatgtgctccaag

SEQ ID NO: 7340730 - DNA, 22 bp, Homo sapiens
catgggggctgaggctgctgta

SEQ ID NO: 7340731 - DNA, 23 bp, Homo sapiens
catggggagcagtgctcctgacc

SEQ ID NO: 7340732 - DNA, 22 bp, Homo sapiens
catggggatgaggctgagactt

SEQ ID NO: 7340733 - DNA, 21 bp, Homo sapiens
aggatttctgtcatttcagat

SEQ ID NO: 7340734 - DNA, 22 bp, Homo sapiens
catgtcaataaatataactgca

SEQ ID NO: 7340735 - DNA, 22 bp, Homo sapiens
catgtcaacaggcccagaaaat

SEQ ID NO: 7340736 - DNA, 22 bp, Homo sapiens
aggatgttgctattggcagtct

SEQ ID NO: 7340737 - DNA, 22 bp, Homo sapiens
catggattgaatataaattaga

SEQ ID NO: 7340738 - DNA, 22 bp, Homo sapiens
catggatatattgtacagtagc

SEQ ID NO: 7340739 - DNA, 22 bp, Homo sapiens
catggatagatgaatgcttaaa

SEQ ID NO: 7340740 - DNA, 22 bp, Homo sapiens
catggatatattgtacagtagc

SEQ ID NO: 7340741 - DNA, 22 bp, Homo sapiens
catggaggagttaggtgtgagt

SEQ ID NO: 7340742 - DNA, 22 bp, Homo sapiens
catggaggccaggaaacagcct

SEQ ID NO: 7340743 - DNA, 22 bp, Homo sapiens
catggaggaccctcagggagct

SEQ ID NO: 7340744 - DNA, 22 bp, Homo sapiens
catggaggaccctcagggagct

SEQ ID NO: 7340745 - DNA, 22 bp, Homo sapiens
catggacagtgggacagtgtgt

SEQ ID NO: 7340746 - DNA, 22 bp, Homo sapiens
catggacaacctccattcgagt

SEQ ID NO: 7340747 - DNA, 22 bp, Homo sapiens
catggaatgtgagttgtttagt

SEQ ID NO: 7340748 - DNA, 22 bp, Homo sapiens
catggacatatgagacctttcc

SEQ ID NO: 7340749 - DNA, 22 bp, Homo sapiens
catggaggaccctcagggagct

SEQ ID NO: 7340750 - DNA, 16 bp, Homo sapiens
aggaggggaattagga

SEQ ID NO: 7340751 - DNA, 16 bp, Homo sapiens
aggaggggaattagga

SEQ ID NO: 7340752 - DNA, 16 bp, Homo sapiens
aggaggggaattagga

SEQ ID NO: 7340753 - DNA, 20 bp, Homo sapiens
aggaggggatagaatcaaag

SEQ ID NO: 7340754 - DNA, 22 bp, Homo sapiens
aggaggggcaatgatagtctgg

SEQ ID NO: 7340755 - DNA, 20 bp, Homo sapiens
aggaggggatagaatcaaag

SEQ ID NO: 7340756 - DNA, 20 bp, Homo sapiens
aggaggggatagaatcaaag

SEQ ID NO: 7340757 - DNA, 22 bp, Homo sapiens
catgcgggttccaggctgcact

SEQ ID NO: 7340758 - DNA, 22 bp, Homo sapiens
aggagggatagaaaaatacttg

SEQ ID NO: 7340759 - DNA, 22 bp, Homo sapiens
aggagggagcttaagccaggca

SEQ ID NO: 7340760 - DNA, 22 bp, Homo sapiens
aggagggcaggctggctgccta

SEQ ID NO: 7340761 - DNA, 21 bp, Homo sapiens
aggagggcacaaggccaggaa

SEQ ID NO: 7340762 - DNA, 22 bp, Homo sapiens
catttgaaattcttagaacaaa

SEQ ID NO: 7340763 - DNA, 22 bp, Homo sapiens
cattttaaatgatttaagccaa

SEQ ID NO: 7340764 - DNA, 21 bp, Homo sapiens
aggcagcaggatccagggaca

SEQ ID NO: 7340765 - DNA, 19 bp, Homo sapiens
aggcagcaggccagggatg

SEQ ID NO: 7340766 - DNA, 22 bp, Homo sapiens
aggcactgtactaggtacaggg

SEQ ID NO: 7340767 - DNA, 22 bp, Homo sapiens
aggcactggtctaccccttagt

SEQ ID NO: 7340768 - DNA, 22 bp, Homo sapiens
aggcactgtgctgatgtcttat

SEQ ID NO: 7340769 - DNA, 22 bp, Homo sapiens
aggcactgtgcagtcccaagca

SEQ ID NO: 7340770 - DNA, 22 bp, Homo sapiens
aggcactgtgcttcttatatgt

SEQ ID NO: 7340771 - DNA, 22 bp, Homo sapiens
aggcactgtggaagacatggtt

SEQ ID NO: 7340772 - DNA, 15 bp, Homo sapiens
aggcactgtgggacc

SEQ ID NO: 7340773 - DNA, 22 bp, Homo sapiens
catgttttgtgtacagaatatt

SEQ ID NO: 7340774 - DNA, 22 bp, Homo sapiens
ccaagatgagctggctccatgg

SEQ ID NO: 7340775 - DNA, 22 bp, Homo sapiens
ccaagatgatctttacagtgtt

SEQ ID NO: 7340776 - DNA, 22 bp, Homo sapiens
ccaagccgcggctcctcctgcg

SEQ ID NO: 7340777 - DNA, 21 bp, Homo sapiens
ccaagatgaataataatgagg

SEQ ID NO: 7340778 - DNA, 22 bp, Homo sapiens
ccaaaggccaggcactgaggtt

SEQ ID NO: 7340779 - DNA, 20 bp, Homo sapiens
ccaataaagctctataggga

SEQ ID NO: 7340780 - DNA, 18 bp, Homo sapiens
aggcaggctggagtgact

SEQ ID NO: 7340781 - DNA, 22 bp, Homo sapiens
ccaatactctttctccctgtgt

SEQ ID NO: 7340782 - DNA, 22 bp, Homo sapiens
ccaatactgaacttaaaagtat

SEQ ID NO: 7340783 - DNA, 22 bp, Homo sapiens
ccaatactgttgattcatagtg

SEQ ID NO: 7340784 - DNA, 22 bp, Homo sapiens
ccaatacttagattaaaatagt

SEQ ID NO: 7340785 - DNA, 22 bp, Homo sapiens
ccaatagagtgctgtaagaatt

SEQ ID NO: 7340786 - DNA, 22 bp, Homo sapiens
ccaaggtgggcagatcacgagg

SEQ ID NO: 7340787 - DNA, 22 bp, Homo sapiens
ccaaggagaaatgctgtgcttt

SEQ ID NO: 7340788 - DNA, 22 bp, Homo sapiens
ccaaggagaatgacaccatgga

SEQ ID NO: 7340789 - DNA, 22 bp, Homo sapiens
ccaagggctctgacttgcctgc

SEQ ID NO: 7340790 - DNA, 22 bp, Homo sapiens
ccaagctggatttagctgcaca

SEQ ID NO: 7340791 - DNA, 22 bp, Homo sapiens
cagtggtccctgaggttgctgg

SEQ ID NO: 7340792 - DNA, 22 bp, Homo sapiens
cagttctggaggctccacatct

SEQ ID NO: 7340793 - DNA, 22 bp, Homo sapiens
catattttagttgctgaacagc

SEQ ID NO: 7340794 - DNA, 22 bp, Homo sapiens
aggagggagcactatatgggga

SEQ ID NO: 7340795 - DNA, 22 bp, Homo sapiens
catagcaacagcatcaagtcaa

SEQ ID NO: 7340796 - DNA, 22 bp, Homo sapiens
catataaatacaacatgtgtta

SEQ ID NO: 7340797 - DNA, 22 bp, Homo sapiens
catataaatacaacatgtgtta

SEQ ID NO: 7340798 - DNA, 20 bp, Homo sapiens
catagtaaagacattttagg

SEQ ID NO: 7340799 - DNA, 22 bp, Homo sapiens
aggacattcatttcaaggagga

SEQ ID NO: 7340800 - DNA, 22 bp, Homo sapiens
aggacatgtttgtatcttcctt

SEQ ID NO: 7340801 - DNA, 22 bp, Homo sapiens
aggacaggattgagctgaactg

SEQ ID NO: 7340802 - DNA, 22 bp, Homo sapiens
caggtgggagccacagcgtaca

SEQ ID NO: 7340803 - DNA, 22 bp, Homo sapiens
caggtgggagccacagcgtaca

SEQ ID NO: 7340804 - DNA, 22 bp, Homo sapiens
caggtggcttattagggtcagt

SEQ ID NO: 7340805 - DNA, 22 bp, Homo sapiens
aggaccatcctaaggtaggcaa

SEQ ID NO: 7340806 - DNA, 22 bp, Homo sapiens
aggaccataagtagggcatgtg

SEQ ID NO: 7340807 - DNA, 22 bp, Homo sapiens
aggaccagtatgagagcatctg

SEQ ID NO: 7340808 - DNA, 22 bp, Homo sapiens
aggaccaggtctaatgaagaca

SEQ ID NO: 7340809 - DNA, 22 bp, Homo sapiens
aggacctggatcacagagatct

SEQ ID NO: 7340810 - DNA, 22 bp, Homo sapiens
aggacccaagcacagttcctgg

SEQ ID NO: 7340811 - DNA, 22 bp, Homo sapiens
aggaccctgagcgggcatgccg

SEQ ID NO: 7340812 - DNA, 22 bp, Homo sapiens
aggagaagtaaggctagatgat

SEQ ID NO: 7340813 - DNA, 22 bp, Homo sapiens
aggagaagtaaggctagatgat

SEQ ID NO: 7340814 - DNA, 19 bp, Homo sapiens
cagtggcctggaggtctct

SEQ ID NO: 7340815 - DNA, 22 bp, Homo sapiens
cagtggccaacttcctgcctct

SEQ ID NO: 7340816 - DNA, 21 bp, Homo sapiens
cagtgctcaggaatagagaga

SEQ ID NO: 7340817 - DNA, 21 bp, Homo sapiens
cagtgctcaatctgacagtgg

SEQ ID NO: 7340818 - DNA, 22 bp, Homo sapiens
cagtgctaggtcgtgtgctggg

SEQ ID NO: 7340819 - DNA, 22 bp, Homo sapiens
cagtgctcatagctgttcctcc

SEQ ID NO: 7340820 - DNA, 22 bp, Homo sapiens
cagtgctcctgatgtacccttg

SEQ ID NO: 7340821 - DNA, 22 bp, Homo sapiens
cagtgctcccgctgccgctgtg

SEQ ID NO: 7340822 - DNA, 22 bp, Homo sapiens
cagtgctcccgctgccgctgtg

SEQ ID NO: 7340823 - DNA, 22 bp, Homo sapiens
cagtgcctggatagcaacatga

SEQ ID NO: 7340824 - DNA, 22 bp, Homo sapiens
cagtgcctgggacccggctgtg

SEQ ID NO: 7340825 - DNA, 19 bp, Homo sapiens
aggactctggaggcatgag

SEQ ID NO: 7340826 - DNA, 22 bp, Homo sapiens
aggactcctgctgggaatggct

SEQ ID NO: 7340827 - DNA, 18 bp, Homo sapiens
aggactcctgggagttgg

SEQ ID NO: 7340828 - DNA, 22 bp, Homo sapiens
aggactaaagggagcctagact

SEQ ID NO: 7340829 - DNA, 22 bp, Homo sapiens
aggactccatgtgtcctggaga

SEQ ID NO: 7340830 - DNA, 22 bp, Homo sapiens
cagtgcccttccaggactgcag

SEQ ID NO: 7340831 - DNA, 22 bp, Homo sapiens
acatagcataaagaatgactct

SEQ ID NO: 7340832 - DNA, 22 bp, Homo sapiens
acatagcttaaatgagaagata

SEQ ID NO: 7340833 - DNA, 20 bp, Homo sapiens
acatagctatagaaagtcga

SEQ ID NO: 7340834 - DNA, 22 bp, Homo sapiens
acatagctcagcataatcgtgg

SEQ ID NO: 7340835 - DNA, 22 bp, Homo sapiens
acatagctcagtatcacttact

SEQ ID NO: 7340836 - DNA, 21 bp, Homo sapiens
acatacattatctttttaaaa

SEQ ID NO: 7340837 - DNA, 22 bp, Homo sapiens
acatagatggggtgtcatgtca

SEQ ID NO: 7340838 - DNA, 22 bp, Homo sapiens
acatagcaagtgctcaataaat

SEQ ID NO: 7340839 - DNA, 22 bp, Homo sapiens
acatagagcattggatatggga

SEQ ID NO: 7340840 - DNA, 22 bp, Homo sapiens
acatattttgaaagctttctaa

SEQ ID NO: 7340841 - DNA, 22 bp, Homo sapiens
acatatttccatgcagcatgtc

SEQ ID NO: 7340842 - DNA, 22 bp, Homo sapiens
acatattgagctctaaaagtac

SEQ ID NO: 7340843 - DNA, 22 bp, Homo sapiens
acatatattttcacacatggtt

SEQ ID NO: 7340844 - DNA, 21 bp, Homo sapiens
aggcagctggaaggcctggct

SEQ ID NO: 7340845 - DNA, 22 bp, Homo sapiens
aggcagctctgtggcctcccag

SEQ ID NO: 7340846 - DNA, 19 bp, Homo sapiens
aggatggagcaggcggtga

SEQ ID NO: 7340847 - DNA, 22 bp, Homo sapiens
acagtttaggatgagagaacac

SEQ ID NO: 7340848 - DNA, 22 bp, Homo sapiens
aggatgagattccagggtcaat

SEQ ID NO: 7340849 - DNA, 22 bp, Homo sapiens
aggatgagattccagggtcaat

SEQ ID NO: 7340850 - DNA, 22 bp, Homo sapiens
aggcactgcttctaagtaggaa

SEQ ID NO: 7340851 - DNA, 18 bp, Homo sapiens
aggcactggaattaaggg

SEQ ID NO: 7340852 - DNA, 20 bp, Homo sapiens
aggcactggatttcttatat

SEQ ID NO: 7340853 - DNA, 22 bp, Homo sapiens
aggcactgggaatatgctgagg

SEQ ID NO: 7340854 - DNA, 20 bp, Homo sapiens
aggcactggggataggtaag

SEQ ID NO: 7340855 - DNA, 22 bp, Homo sapiens
aggcactgggggatgagcaagg

SEQ ID NO: 7340856 - DNA, 22 bp, Homo sapiens
aggcactgggtaattagtagct

SEQ ID NO: 7340857 - DNA, 22 bp, Homo sapiens
acagtttgagaaccactagcct

SEQ ID NO: 7340858 - DNA, 22 bp, Homo sapiens
aggagcagaactgttgtggagg

SEQ ID NO: 7340859 - DNA, 22 bp, Homo sapiens
aggagcactgagccagcatggg

SEQ ID NO: 7340860 - DNA, 22 bp, Homo sapiens
aggagatggagctcagtgggca

SEQ ID NO: 7340861 - DNA, 22 bp, Homo sapiens
acagtacagctaatgtcattag

SEQ ID NO: 7340862 - DNA, 22 bp, Homo sapiens
acagtatatatggttatctgat

SEQ ID NO: 7340863 - DNA, 22 bp, Homo sapiens
acagtatattttcttgattgtt

SEQ ID NO: 7340864 - DNA, 22 bp, Homo sapiens
acaggtttagctcttagtagtc

SEQ ID NO: 7340865 - DNA, 22 bp, Homo sapiens
acaggtttgctgctgttttagg

SEQ ID NO: 7340866 - DNA, 22 bp, Homo sapiens
aggacacagacttagatttaaa

SEQ ID NO: 7340867 - DNA, 22 bp, Homo sapiens
aggacacagacttagatttaaa

SEQ ID NO: 7340868 - DNA, 22 bp, Homo sapiens
aggacacagctcttcagtaaga

SEQ ID NO: 7340869 - DNA, 22 bp, Homo sapiens
aggacacagctcttcagtaaga

SEQ ID NO: 7340870 - DNA, 22 bp, Homo sapiens
aggacacagctgctctgcagag

SEQ ID NO: 7340871 - DNA, 22 bp, Homo sapiens
acagtaaatcaacagaatatct

SEQ ID NO: 7340872 - DNA, 22 bp, Homo sapiens
acagtaaataatgcatgttgat

SEQ ID NO: 7340873 - DNA, 22 bp, Homo sapiens
acagtaaacaatgcagcaaatt

SEQ ID NO: 7340874 - DNA, 18 bp, Homo sapiens
acagtaaagaaaggaatt

SEQ ID NO: 7340875 - DNA, 22 bp, Homo sapiens
acagtaaaaagccttagaattt

SEQ ID NO: 7340876 - DNA, 22 bp, Homo sapiens
acagtaaaaagccttagaattt

SEQ ID NO: 7340877 - DNA, 22 bp, Homo sapiens
acagtaaaattaagggcagtta

SEQ ID NO: 7340878 - DNA, 22 bp, Homo sapiens
acagtaaaacatttttattagg

SEQ ID NO: 7340879 - DNA, 22 bp, Homo sapiens
acagtgtggggtgagatggaac

SEQ ID NO: 7340880 - DNA, 22 bp, Homo sapiens
acagtgtggtttgagcactggg

SEQ ID NO: 7340881 - DNA, 22 bp, Homo sapiens
acagtgggacagtgacggggga

SEQ ID NO: 7340882 - DNA, 22 bp, Homo sapiens
acagtcaggaatttgtaaaacg

SEQ ID NO: 7340883 - DNA, 19 bp, Homo sapiens
acagtcagggaataaagac

SEQ ID NO: 7340884 - DNA, 22 bp, Homo sapiens
acagtctactaaacatcatcag

SEQ ID NO: 7340885 - DNA, 20 bp, Homo sapiens
acagtcctgcactggtgttt

SEQ ID NO: 7340886 - DNA, 17 bp, Homo sapiens
agctgacatcaaaactt

SEQ ID NO: 7340887 - DNA, 22 bp, Homo sapiens
agctgaagtttagaattgtgaa

SEQ ID NO: 7340888 - DNA, 22 bp, Homo sapiens
agctgaagtcctcgcggtgcta

SEQ ID NO: 7340889 - DNA, 22 bp, Homo sapiens
agctgactgatgaagaggcctt

SEQ ID NO: 7340890 - DNA, 20 bp, Homo sapiens
agctgaagcccttggggaaa

SEQ ID NO: 7340891 - DNA, 22 bp, Homo sapiens
agctctggggtggagcccagga

SEQ ID NO: 7340892 - DNA, 22 bp, Homo sapiens
agctctgggtcacggctgccga

SEQ ID NO: 7340893 - DNA, 22 bp, Homo sapiens
acagctgggaactcacacagca

SEQ ID NO: 7340894 - DNA, 22 bp, Homo sapiens
acagctgggtgctgctcagagc

SEQ ID NO: 7340895 - DNA, 23 bp, Homo sapiens
acaggaggggacaggtggccgtg

SEQ ID NO: 7340896 - DNA, 22 bp, Homo sapiens
acaggagaaatctggtcaaaag

SEQ ID NO: 7340897 - DNA, 23 bp, Homo sapiens
acaggaggggacaggtggccgtg

SEQ ID NO: 7340898 - DNA, 22 bp, Homo sapiens
acaggaggggcatgaaagacgg

SEQ ID NO: 7340899 - DNA, 23 bp, Homo sapiens
acaggaggggacaggtggccgtg

SEQ ID NO: 7340900 - DNA, 22 bp, Homo sapiens
acaggaggggcatgaaagacgg

SEQ ID NO: 7340901 - DNA, 22 bp, Homo sapiens
acaggagtagggctggtggaga

SEQ ID NO: 7340902 - DNA, 22 bp, Homo sapiens
agctggattccagtgcagtcac

SEQ ID NO: 7340903 - DNA, 22 bp, Homo sapiens
acaggagtttctgacagagaca

SEQ ID NO: 7340904 - DNA, 22 bp, Homo sapiens
agctggtgtcacctccagtcca

SEQ ID NO: 7340905 - DNA, 22 bp, Homo sapiens
agctggtgtcctcctggagctg

SEQ ID NO: 7340906 - DNA, 22 bp, Homo sapiens
agctggtgtgccagttccagtt

SEQ ID NO: 7340907 - DNA, 22 bp, Homo sapiens
acaggcacaggtgtgccccacc

SEQ ID NO: 7340908 - DNA, 21 bp, Homo sapiens
acaggcaccatgcctgtgcct

SEQ ID NO: 7340909 - DNA, 22 bp, Homo sapiens
acaggcacctccaggggtatgt

SEQ ID NO: 7340910 - DNA, 22 bp, Homo sapiens
acaggcacctgccaccacatct

SEQ ID NO: 7340911 - DNA, 23 bp, Homo sapiens
acaggcaggcatggccaaatgtg

SEQ ID NO: 7340912 - DNA, 22 bp, Homo sapiens
acagggaagttctgcaacagga

SEQ ID NO: 7340913 - DNA, 19 bp, Homo sapiens
acagggaatttccacagaa

SEQ ID NO: 7340914 - DNA, 22 bp, Homo sapiens
acagggaagctcaggggctctg

SEQ ID NO: 7340915 - DNA, 22 bp, Homo sapiens
acaggctgttggggtccagggt

SEQ ID NO: 7340916 - DNA, 22 bp, Homo sapiens
acagggctcccagcaggtctgt

SEQ ID NO: 7340917 - DNA, 21 bp, Homo sapiens
acagggcttcagggagggtta

SEQ ID NO: 7340918 - DNA, 22 bp, Homo sapiens
aggaagaatgtttacatatcaa

SEQ ID NO: 7340919 - DNA, 22 bp, Homo sapiens
aggaagaaactgagctctgaca

SEQ ID NO: 7340920 - DNA, 22 bp, Homo sapiens
aggaagaaacctactagagttt

SEQ ID NO: 7340921 - DNA, 18 bp, Homo sapiens
acagggagggcgctgggg

SEQ ID NO: 7340922 - DNA, 21 bp, Homo sapiens
aggaagaaaggttggaggttg

SEQ ID NO: 7340923 - DNA, 22 bp, Homo sapiens
aggaagaacagataatggacgc

SEQ ID NO: 7340924 - DNA, 22 bp, Homo sapiens
aggacacactgttctcacgtaa

SEQ ID NO: 7340925 - DNA, 22 bp, Homo sapiens
aggacacactgttctcacgtaa

SEQ ID NO: 7340926 - DNA, 22 bp, Homo sapiens
aggacaattgagagtttgttga

SEQ ID NO: 7340927 - DNA, 19 bp, Homo sapiens
acaggggcctttccagggt

SEQ ID NO: 7340928 - DNA, 19 bp, Homo sapiens
acaggggctagcggaagca

SEQ ID NO: 7340929 - DNA, 22 bp, Homo sapiens
aggacaattagactctttgttt

SEQ ID NO: 7340930 - DNA, 22 bp, Homo sapiens
acaggggattgattggaagtct

SEQ ID NO: 7340931 - DNA, 19 bp, Homo sapiens
acagggcttggcctgacat

SEQ ID NO: 7340932 - DNA, 22 bp, Homo sapiens
acagggcttttaatcagtagtt

SEQ ID NO: 7340933 - DNA, 22 bp, Homo sapiens
acaggggcaggcaggacccttt

SEQ ID NO: 7340934 - DNA, 22 bp, Homo sapiens
acaggggcaagggctcacggcc

SEQ ID NO: 7340935 - DNA, 20 bp, Homo sapiens
acaggggcagcacaataatg

SEQ ID NO: 7340936 - DNA, 22 bp, Homo sapiens
agggggcatcaggtcctggctc

SEQ ID NO: 7340937 - DNA, 22 bp, Homo sapiens
agggggcatcaggtcctggctc

SEQ ID NO: 7340938 - DNA, 22 bp, Homo sapiens
agggggcaggagagacctgctg

SEQ ID NO: 7340939 - DNA, 22 bp, Homo sapiens
agggggcaggagagacctgctg

SEQ ID NO: 7340940 - DNA, 22 bp, Homo sapiens
agggggcatcaggtcctggctc

SEQ ID NO: 7340941 - DNA, 22 bp, Homo sapiens
agggggagtttcagttagaaag

SEQ ID NO: 7340942 - DNA, 22 bp, Homo sapiens
aggggcctggacatggacgcgc

SEQ ID NO: 7340943 - DNA, 22 bp, Homo sapiens
acccaggctggcgtgcagtggc

SEQ ID NO: 7340944 - DNA, 22 bp, Homo sapiens
agggggagcttggctactcctg

SEQ ID NO: 7340945 - DNA, 22 bp, Homo sapiens
agggggaggctgtgctgcgtct

SEQ ID NO: 7340946 - DNA, 22 bp, Homo sapiens
agggggaggctgtgctgcgtct

SEQ ID NO: 7340947 - DNA, 22 bp, Homo sapiens
agggggcccttgcaggtgagcg

SEQ ID NO: 7340948 - DNA, 22 bp, Homo sapiens
agggggcccttgcaggtgagcg

SEQ ID NO: 7340949 - DNA, 22 bp, Homo sapiens
agggggcccttgcaggtgagcg

SEQ ID NO: 7340950 - DNA, 22 bp, Homo sapiens
agggggctcagtgactgaagtg

SEQ ID NO: 7340951 - DNA, 22 bp, Homo sapiens
agggctgccccagtccagccgg

SEQ ID NO: 7340952 - DNA, 22 bp, Homo sapiens
agggctgcctgactccagagcc

SEQ ID NO: 7340953 - DNA, 22 bp, Homo sapiens
agggctgcctgctctgcattga

SEQ ID NO: 7340954 - DNA, 22 bp, Homo sapiens
agggctgctatgttgattcaga

SEQ ID NO: 7340955 - DNA, 22 bp, Homo sapiens
agggctgctaccttaatcagtt

SEQ ID NO: 7340956 - DNA, 19 bp, Homo sapiens
agggctgctctggcctggg

SEQ ID NO: 7340957 - DNA, 19 bp, Homo sapiens
agggctgctctggcctggg

SEQ ID NO: 7340958 - DNA, 19 bp, Homo sapiens
agggctgctctggcctggg

SEQ ID NO: 7340959 - DNA, 22 bp, Homo sapiens
agggctgctatgttgattcaga

SEQ ID NO: 7340960 - DNA, 22 bp, Homo sapiens
agggctgctcctccttcaggcc

SEQ ID NO: 7340961 - DNA, 22 bp, Homo sapiens
acccaggctggagtgcagtgat

SEQ ID NO: 7340962 - DNA, 22 bp, Homo sapiens
acccaggctggagtgcagtggc

SEQ ID NO: 7340963 - DNA, 22 bp, Homo sapiens
acccaggctggagtgcagtggg

SEQ ID NO: 7340964 - DNA, 22 bp, Homo sapiens
acccaggctggagtgcagtggt

SEQ ID NO: 7340965 - DNA, 22 bp, Homo sapiens
acccaggctggagtgcagtgtc

SEQ ID NO: 7340966 - DNA, 19 bp, Homo sapiens
accaggcctcagaggccct

SEQ ID NO: 7340967 - DNA, 22 bp, Homo sapiens
acccagcatgacacctgcacat

SEQ ID NO: 7340968 - DNA, 22 bp, Homo sapiens
acccagccatgttcagttctct

SEQ ID NO: 7340969 - DNA, 22 bp, Homo sapiens
acccagccacagcattgaggga

SEQ ID NO: 7340970 - DNA, 22 bp, Homo sapiens
acccagcctacaaagctcacct

SEQ ID NO: 7340971 - DNA, 22 bp, Homo sapiens
acccagcccagaatctggggcc

SEQ ID NO: 7340972 - DNA, 19 bp, Homo sapiens
acccagcccaggagtggca

SEQ ID NO: 7340973 - DNA, 22 bp, Homo sapiens
agggctgcccagtgtgagagct

SEQ ID NO: 7340974 - DNA, 22 bp, Homo sapiens
agggctgccatttctggcccaa

SEQ ID NO: 7340975 - DNA, 22 bp, Homo sapiens
agggctgcccagtgtgagagct

SEQ ID NO: 7340976 - DNA, 22 bp, Homo sapiens
agggctgcccagtgtgagagct

SEQ ID NO: 7340977 - DNA, 22 bp, Homo sapiens
agggctgacagtgaggagtcaa

SEQ ID NO: 7340978 - DNA, 22 bp, Homo sapiens
agggctgccatttctggcccaa

SEQ ID NO: 7340979 - DNA, 22 bp, Homo sapiens
agggctgacagtgaggagtcaa

SEQ ID NO: 7340980 - DNA, 22 bp, Homo sapiens
acccaggagacggaggtgcagt

SEQ ID NO: 7340981 - DNA, 22 bp, Homo sapiens
aggcttggctggcagccctggg

SEQ ID NO: 7340982 - DNA, 18 bp, Homo sapiens
aggcttgggcccagcagc

SEQ ID NO: 7340983 - DNA, 20 bp, Homo sapiens
aggcttggcttggcaggaac

SEQ ID NO: 7340984 - DNA, 18 bp, Homo sapiens
aggcttgggcccagcagc

SEQ ID NO: 7340985 - DNA, 22 bp, Homo sapiens
aggcttggtgccaaggagcctg

SEQ ID NO: 7340986 - DNA, 22 bp, Homo sapiens
agggagacacatgaggaagtca

SEQ ID NO: 7340987 - DNA, 19 bp, Homo sapiens
agggagaattccaagagga

SEQ ID NO: 7340988 - DNA, 22 bp, Homo sapiens
accagccaagactgcctggaat

SEQ ID NO: 7340989 - DNA, 22 bp, Homo sapiens
accagccaccaccaggagatcg

SEQ ID NO: 7340990 - DNA, 22 bp, Homo sapiens
accagccaccaccaggagatcg

SEQ ID NO: 7340991 - DNA, 22 bp, Homo sapiens
accagccagccacagtggctcc

SEQ ID NO: 7340992 - DNA, 22 bp, Homo sapiens
accagccagccacagtggctcc

SEQ ID NO: 7340993 - DNA, 22 bp, Homo sapiens
accagcattggacttagaatgc

SEQ ID NO: 7340994 - DNA, 22 bp, Homo sapiens
accagcaggccaggggcactgc

SEQ ID NO: 7340995 - DNA, 22 bp, Homo sapiens
accagcagctgcgggccactgc

SEQ ID NO: 7340996 - DNA, 22 bp, Homo sapiens
acatttgtatatatgcagcata

SEQ ID NO: 7340997 - DNA, 22 bp, Homo sapiens
acatttgtatatatgcagcata

SEQ ID NO: 7340998 - DNA, 22 bp, Homo sapiens
acatttgtatgcgtttttactg

SEQ ID NO: 7340999 - DNA, 22 bp, Homo sapiens
acatttgtatttggtgagtggt

SEQ ID NO: 7341000 - DNA, 22 bp, Homo sapiens
acatttgtatttggtgagtggt

SEQ ID NO: 7341001 - DNA, 22 bp, Homo sapiens
acatttgtctggctagaaagtt

SEQ ID NO: 7341002 - DNA, 22 bp, Homo sapiens
agggagaggagggtcttgttga

SEQ ID NO: 7341003 - DNA, 22 bp, Homo sapiens
agggagaggagcgtttcacatc

SEQ ID NO: 7341004 - DNA, 16 bp, Homo sapiens
agggagagaggaacat

SEQ ID NO: 7341005 - DNA, 18 bp, Homo sapiens
agggagagaccgcgggtc

SEQ ID NO: 7341006 - DNA, 22 bp, Homo sapiens
agggagagaagttatacaagat

SEQ ID NO: 7341007 - DNA, 22 bp, Homo sapiens
agggagagacatttccttcttg

SEQ ID NO: 7341008 - DNA, 22 bp, Homo sapiens
accagctagggtagcacatctc

SEQ ID NO: 7341009 - DNA, 22 bp, Homo sapiens
agggcagcacagctgtgctcct

SEQ ID NO: 7341010 - DNA, 22 bp, Homo sapiens
agggcagcaatgcagctgctgc

SEQ ID NO: 7341011 - DNA, 21 bp, Homo sapiens
agggcagattagctgtaagag

SEQ ID NO: 7341012 - DNA, 22 bp, Homo sapiens
agggcagcaaagtttgacctca

SEQ ID NO: 7341013 - DNA, 22 bp, Homo sapiens
agggcagatggaacttccccga

SEQ ID NO: 7341014 - DNA, 21 bp, Homo sapiens
agggcagattagctgtaagag

SEQ ID NO: 7341015 - DNA, 22 bp, Homo sapiens
acatttccacagactgaggtca

SEQ ID NO: 7341016 - DNA, 22 bp, Homo sapiens
acatttctagttgttcatctcc

SEQ ID NO: 7341017 - DNA, 22 bp, Homo sapiens
acattgattgagcacccattat

SEQ ID NO: 7341018 - DNA, 22 bp, Homo sapiens
acattgcaataataattctctt

SEQ ID NO: 7341019 - DNA, 20 bp, Homo sapiens
acattgattatgtttgtaga

SEQ ID NO: 7341020 - DNA, 22 bp, Homo sapiens
acattgatgatcccacttacag

SEQ ID NO: 7341021 - DNA, 22 bp, Homo sapiens
aggctctgttattctagagggc

SEQ ID NO: 7341022 - DNA, 22 bp, Homo sapiens
acatttgactgtagatacttgc

SEQ ID NO: 7341023 - DNA, 22 bp, Homo sapiens
acatttgagcatctactaagtg

SEQ ID NO: 7341024 - DNA, 22 bp, Homo sapiens
acatttgagcatatttcttgtc

SEQ ID NO: 7341025 - DNA, 22 bp, Homo sapiens
acatttgactctgttcatatta

SEQ ID NO: 7341026 - DNA, 22 bp, Homo sapiens
acatttgactacatttatatat

SEQ ID NO: 7341027 - DNA, 22 bp, Homo sapiens
acatttgactacatttatatat

SEQ ID NO: 7341028 - DNA, 22 bp, Homo sapiens
acatttgacatttagtatcagc

SEQ ID NO: 7341029 - DNA, 22 bp, Homo sapiens
acatttgataattataaagaca

SEQ ID NO: 7341030 - DNA, 22 bp, Homo sapiens
acatttgatggagttagtaggt

SEQ ID NO: 7341031 - DNA, 22 bp, Homo sapiens
acatttgatggagttagtaggt

SEQ ID NO: 7341032 - DNA, 22 bp, Homo sapiens
acatttgaggatgttaagaatg

SEQ ID NO: 7341033 - DNA, 20 bp, Homo sapiens
acatttgagtatcatctact

SEQ ID NO: 7341034 - DNA, 22 bp, Homo sapiens
acatttgagtcatatttgctta

SEQ ID NO: 7341035 - DNA, 22 bp, Homo sapiens
acatttgagtcatatttgctta

SEQ ID NO: 7341036 - DNA, 22 bp, Homo sapiens
acatttgattgatgaatcaaat

SEQ ID NO: 7341037 - DNA, 22 bp, Homo sapiens
acatttggacaatagtagacaa

SEQ ID NO: 7341038 - DNA, 22 bp, Homo sapiens
acatttggcaagaaagagaaac

SEQ ID NO: 7341039 - DNA, 22 bp, Homo sapiens
acatttggtaacacttgagcat

SEQ ID NO: 7341040 - DNA, 22 bp, Homo sapiens
aggctgagctggtagtgagtac

SEQ ID NO: 7341041 - DNA, 22 bp, Homo sapiens
acatttctttctattcagtagc

SEQ ID NO: 7341042 - DNA, 22 bp, Homo sapiens
acatgttagaaatgcagaatct

SEQ ID NO: 7341043 - DNA, 22 bp, Homo sapiens
aggccagggtcccacactcgca

SEQ ID NO: 7341044 - DNA, 22 bp, Homo sapiens
aggccaggcgagacacccggct

SEQ ID NO: 7341045 - DNA, 22 bp, Homo sapiens
acatgtttaagtttgttatatg

SEQ ID NO: 7341046 - DNA, 19 bp, Homo sapiens
acatgttttgcagaacagc

SEQ ID NO: 7341047 - DNA, 22 bp, Homo sapiens
aggcctctgggtctcctctgac

SEQ ID NO: 7341048 - DNA, 22 bp, Homo sapiens
aggcctcttgtcttcctcacat

SEQ ID NO: 7341049 - DNA, 22 bp, Homo sapiens
acatcatgagagacttaaattg

SEQ ID NO: 7341050 - DNA, 22 bp, Homo sapiens
acatccactatccttgcttgtt

SEQ ID NO: 7341051 - DNA, 22 bp, Homo sapiens
acatcacacgccttccaggagg

SEQ ID NO: 7341052 - DNA, 22 bp, Homo sapiens
acatcacagtagttaagccaga

SEQ ID NO: 7341053 - DNA, 22 bp, Homo sapiens
acatcagagggctcacatgatc

SEQ ID NO: 7341054 - DNA, 21 bp, Homo sapiens
acatcagagttgtgaaggtag

SEQ ID NO: 7341055 - DNA, 22 bp, Homo sapiens
acatgctagactttctttatga

SEQ ID NO: 7341056 - DNA, 22 bp, Homo sapiens
acatgctacacagagctcctcg

SEQ ID NO: 7341057 - DNA, 22 bp, Homo sapiens
acatgctacacagagctcctcg

SEQ ID NO: 7341058 - DNA, 22 bp, Homo sapiens
acatgccagcccatttaaatgg

SEQ ID NO: 7341059 - DNA, 22 bp, Homo sapiens
acatgcatacaagcacatgtag

SEQ ID NO: 7341060 - DNA, 22 bp, Homo sapiens
acatgcttccaaattatgttgg

SEQ ID NO: 7341061 - DNA, 22 bp, Homo sapiens
acatgctcattaaatattagct

SEQ ID NO: 7341062 - DNA, 22 bp, Homo sapiens
acatgctggatgaattacctac

SEQ ID NO: 7341063 - DNA, 22 bp, Homo sapiens
acatgctctcctaaggccctgt

SEQ ID NO: 7341064 - DNA, 22 bp, Homo sapiens
acatgctttgcacttacatcat

SEQ ID NO: 7341065 - DNA, 22 bp, Homo sapiens
agaaagtgaccttgaaaactgg

SEQ ID NO: 7341066 - DNA, 22 bp, Homo sapiens
agaaagtgaacgtgttcagttt

SEQ ID NO: 7341067 - DNA, 22 bp, Homo sapiens
agaaagttcactggtatatttt

SEQ ID NO: 7341068 - DNA, 22 bp, Homo sapiens
agaaagttatcacaaaattgag

SEQ ID NO: 7341069 - DNA, 22 bp, Homo sapiens
agaaagggttctctgaggtgct

SEQ ID NO: 7341070 - DNA, 22 bp, Homo sapiens
agaaagggttctctgaggtgct

SEQ ID NO: 7341071 - DNA, 22 bp, Homo sapiens
agaaagggttctctgaggtgct

SEQ ID NO: 7341072 - DNA, 22 bp, Homo sapiens
agaaagggctattttgaggtag

SEQ ID NO: 7341073 - DNA, 22 bp, Homo sapiens
agaaagggctattttgaggtag

SEQ ID NO: 7341074 - DNA, 22 bp, Homo sapiens
agaaagggtcactgaaagagga

SEQ ID NO: 7341075 - DNA, 22 bp, Homo sapiens
agaaagggtcactgaaagagga

SEQ ID NO: 7341076 - DNA, 22 bp, Homo sapiens
agaacagatgtgggcagacctg

SEQ ID NO: 7341077 - DNA, 22 bp, Homo sapiens
agaacacttttaaatggcttgt

SEQ ID NO: 7341078 - DNA, 22 bp, Homo sapiens
agaacagcaggaaggccaggta

SEQ ID NO: 7341079 - DNA, 22 bp, Homo sapiens
agaacagcagcacgtcaagctg

SEQ ID NO: 7341080 - DNA, 22 bp, Homo sapiens
agaacagcctatagtggccttt

SEQ ID NO: 7341081 - DNA, 22 bp, Homo sapiens
agaacagccaactgtgtaggag

SEQ ID NO: 7341082 - DNA, 22 bp, Homo sapiens
agaaattaggaaagtaacactt

SEQ ID NO: 7341083 - DNA, 22 bp, Homo sapiens
atctatttctgctaataacaat

SEQ ID NO: 7341084 - DNA, 22 bp, Homo sapiens
atctaattttcactcatttgct

SEQ ID NO: 7341085 - DNA, 22 bp, Homo sapiens
atctaagctcacaggcttgttg

SEQ ID NO: 7341086 - DNA, 22 bp, Homo sapiens
atctcacactgggtttgagggt

SEQ ID NO: 7341087 - DNA, 22 bp, Homo sapiens
atctcacatcctcagtagtgca

SEQ ID NO: 7341088 - DNA, 22 bp, Homo sapiens
atctaaagtgtcataagtagct

SEQ ID NO: 7341089 - DNA, 22 bp, Homo sapiens
atctaaaatgtggttagttggt

SEQ ID NO: 7341090 - DNA, 22 bp, Homo sapiens
atctaaaatgtggttagttggt

SEQ ID NO: 7341091 - DNA, 20 bp, Homo sapiens
atcggcttgcctggaaacaa

SEQ ID NO: 7341092 - DNA, 22 bp, Homo sapiens
atcatccaagcgtagttcttct

SEQ ID NO: 7341093 - DNA, 22 bp, Homo sapiens
agaacagctgcaaaacttaatc

SEQ ID NO: 7341094 - DNA, 22 bp, Homo sapiens
agaaaagtgctctagtgagagc

SEQ ID NO: 7341095 - DNA, 22 bp, Homo sapiens
atattcgtggtcaagtaaggcc

SEQ ID NO: 7341096 - DNA, 22 bp, Homo sapiens
atattcatcgtgtagaaatact

SEQ ID NO: 7341097 - DNA, 22 bp, Homo sapiens
atattacataaacatgagtgaa

SEQ ID NO: 7341098 - DNA, 22 bp, Homo sapiens
atattcatcgtgtagaaatact

SEQ ID NO: 7341099 - DNA, 22 bp, Homo sapiens
atatttataagcaagcaggact

SEQ ID NO: 7341100 - DNA, 22 bp, Homo sapiens
atatttcatggggttccatact

SEQ ID NO: 7341101 - DNA, 22 bp, Homo sapiens
atatttcatggggttccatact

SEQ ID NO: 7341102 - DNA, 22 bp, Homo sapiens
agaaagctccccatgagatgat

SEQ ID NO: 7341103 - DNA, 21 bp, Homo sapiens
atatttctcataaggttatgg

SEQ ID NO: 7341104 - DNA, 22 bp, Homo sapiens
atatttcagctttacttaggaa

SEQ ID NO: 7341105 - DNA, 22 bp, Homo sapiens
atatttcagctttacttaggaa

SEQ ID NO: 7341106 - DNA, 22 bp, Homo sapiens
atatttcacgtaggttgttttc

SEQ ID NO: 7341107 - DNA, 22 bp, Homo sapiens
atatttataaggcaggcaagta

SEQ ID NO: 7341108 - DNA, 22 bp, Homo sapiens
atatggaaatagcaatatggtt

SEQ ID NO: 7341109 - DNA, 22 bp, Homo sapiens
actttctcaggaattcacagac

SEQ ID NO: 7341110 - DNA, 20 bp, Homo sapiens
actttctcggtttctcacct

SEQ ID NO: 7341111 - DNA, 22 bp, Homo sapiens
atatgcttacagcttaaaatcc

SEQ ID NO: 7341112 - DNA, 22 bp, Homo sapiens
actttctattgtttagattctg

SEQ ID NO: 7341113 - DNA, 22 bp, Homo sapiens
actttcatggtagttgtattct

SEQ ID NO: 7341114 - DNA, 22 bp, Homo sapiens
actttcatttgtgaagactgta

SEQ ID NO: 7341115 - DNA, 22 bp, Homo sapiens
actttcagaattgtacagagtc

SEQ ID NO: 7341116 - DNA, 22 bp, Homo sapiens
actttagtctgtttcattatct

SEQ ID NO: 7341117 - DNA, 22 bp, Homo sapiens
actttatcaggaatcacacagc

SEQ ID NO: 7341118 - DNA, 22 bp, Homo sapiens
atactgtgtaaaatttgaacct

SEQ ID NO: 7341119 - DNA, 22 bp, Homo sapiens
atactgctgctgctgaaatcac

SEQ ID NO: 7341120 - DNA, 22 bp, Homo sapiens
atacatgtttgctggataaaca

SEQ ID NO: 7341121 - DNA, 22 bp, Homo sapiens
atacattagctcatatgattaa

SEQ ID NO: 7341122 - DNA, 22 bp, Homo sapiens
atacatgttgagaaaatatctg

SEQ ID NO: 7341123 - DNA, 22 bp, Homo sapiens
atacatgttgtaccatatgttt

SEQ ID NO: 7341124 - DNA, 22 bp, Homo sapiens
atacatgttgtaccatatgttt

SEQ ID NO: 7341125 - DNA, 22 bp, Homo sapiens
atacattattgttaaagaacat

SEQ ID NO: 7341126 - DNA, 22 bp, Homo sapiens
atacatgttcgtgtacatgttc

SEQ ID NO: 7341127 - DNA, 22 bp, Homo sapiens
atacagatgttgaatgttatat

SEQ ID NO: 7341128 - DNA, 22 bp, Homo sapiens
atacacttgtacattttttaat

SEQ ID NO: 7341129 - DNA, 22 bp, Homo sapiens
acttaatcattctctctgcttt

SEQ ID NO: 7341130 - DNA, 23 bp, Homo sapiens
acttaaatggttctttatctcag

SEQ ID NO: 7341131 - DNA, 21 bp, Homo sapiens
acttaaattccttgatattta

SEQ ID NO: 7341132 - DNA, 22 bp, Homo sapiens
acttaaatagaactcctcaata

SEQ ID NO: 7341133 - DNA, 22 bp, Homo sapiens
atacagattgctatacttacaa

SEQ ID NO: 7341134 - DNA, 22 bp, Homo sapiens
atacagcttacagttctaatgc

SEQ ID NO: 7341135 - DNA, 22 bp, Homo sapiens
atacaggtaggggacatacatc

SEQ ID NO: 7341136 - DNA, 22 bp, Homo sapiens
atacagcttacagttctaatgc

SEQ ID NO: 7341137 - DNA, 22 bp, Homo sapiens
atacagcttatgcatatatctc

SEQ ID NO: 7341138 - DNA, 22 bp, Homo sapiens
atacagctttctttcacatgag

SEQ ID NO: 7341139 - DNA, 19 bp, Homo sapiens
acttctgaggaactgcaca

SEQ ID NO: 7341140 - DNA, 19 bp, Homo sapiens
acttctgaggaactgcaca

SEQ ID NO: 7341141 - DNA, 22 bp, Homo sapiens
atacagtaaccacattctatag

SEQ ID NO: 7341142 - DNA, 22 bp, Homo sapiens
atacaggtggaactaaataaat

SEQ ID NO: 7341143 - DNA, 22 bp, Homo sapiens
atacaggttctctagggaacag

SEQ ID NO: 7341144 - DNA, 22 bp, Homo sapiens
actgtcacctaaattttcattg

SEQ ID NO: 7341145 - DNA, 22 bp, Homo sapiens
actgggaatggagcctgggcct

SEQ ID NO: 7341146 - DNA, 22 bp, Homo sapiens
actgtacatgtaaacattgtca

SEQ ID NO: 7341147 - DNA, 22 bp, Homo sapiens
ataagtaccactactgccttca

SEQ ID NO: 7341148 - DNA, 22 bp, Homo sapiens
actgtgcatctattgccattta

SEQ ID NO: 7341149 - DNA, 22 bp, Homo sapiens
ataatgacagcatttaaggact

SEQ ID NO: 7341150 - DNA, 22 bp, Homo sapiens
ataatcttgtatttcctaaagt

SEQ ID NO: 7341151 - DNA, 22 bp, Homo sapiens
ataaacagtaaatgtgagcagt

SEQ ID NO: 7341152 - DNA, 22 bp, Homo sapiens
ataaacagctccatttagtgcc

SEQ ID NO: 7341153 - DNA, 22 bp, Homo sapiens
ataaacagctccatttagtgcc

SEQ ID NO: 7341154 - DNA, 22 bp, Homo sapiens
ataaaatggtaaacgaagctga

SEQ ID NO: 7341155 - DNA, 22 bp, Homo sapiens
ataaaatttgctactgttaaat

SEQ ID NO: 7341156 - DNA, 22 bp, Homo sapiens
ataaaatgtctccactgggctc

SEQ ID NO: 7341157 - DNA, 22 bp, Homo sapiens
ataaaatttgctactgttaaat

SEQ ID NO: 7341158 - DNA, 22 bp, Homo sapiens
agtgcagggggaaagggtgtct

SEQ ID NO: 7341159 - DNA, 22 bp, Homo sapiens
agtgcaattttgctttcccaat

SEQ ID NO: 7341160 - DNA, 22 bp, Homo sapiens
actctgtgaagatgcaggcttg

SEQ ID NO: 7341161 - DNA, 22 bp, Homo sapiens
actctgtgaactctatcagata

SEQ ID NO: 7341162 - DNA, 21 bp, Homo sapiens
actctgtcttgagccatctgt

SEQ ID NO: 7341163 - DNA, 22 bp, Homo sapiens
actctgtcttcatatttgcatt

SEQ ID NO: 7341164 - DNA, 22 bp, Homo sapiens
actctgtcacctactcactgta

SEQ ID NO: 7341165 - DNA, 22 bp, Homo sapiens
actctgtgttttggtggcagca

SEQ ID NO: 7341166 - DNA, 22 bp, Homo sapiens
actctgtgtttagtgctgccat

SEQ ID NO: 7341167 - DNA, 22 bp, Homo sapiens
actctgtgtgagtagagcctgt

SEQ ID NO: 7341168 - DNA, 22 bp, Homo sapiens
actctgtgccaggcactttggg

SEQ ID NO: 7341169 - DNA, 22 bp, Homo sapiens
actctgtgaagtcttattatgc

SEQ ID NO: 7341170 - DNA, 22 bp, Homo sapiens
actctgtgctggggacctcatc

SEQ ID NO: 7341171 - DNA, 22 bp, Homo sapiens
actctgtgggtgagcctggaca

SEQ ID NO: 7341172 - DNA, 22 bp, Homo sapiens
agtgcatgccttcctgtggatg

SEQ ID NO: 7341173 - DNA, 22 bp, Homo sapiens
agtgcatgcgcttgggaggggt

SEQ ID NO: 7341174 - DNA, 22 bp, Homo sapiens
agtgcatagggggatgcacagc

SEQ ID NO: 7341175 - DNA, 20 bp, Homo sapiens
agtgcatggagggagagggc

SEQ ID NO: 7341176 - DNA, 22 bp, Homo sapiens
actgaggacagtgaggagggct

SEQ ID NO: 7341177 - DNA, 22 bp, Homo sapiens
actgagggccaaaggcactgag

SEQ ID NO: 7341178 - DNA, 21 bp, Homo sapiens
actgagggccagagaggacct

SEQ ID NO: 7341179 - DNA, 22 bp, Homo sapiens
actgagggagagtcttaggttg

SEQ ID NO: 7341180 - DNA, 22 bp, Homo sapiens
actctgtactttcttgttgtgt

SEQ ID NO: 7341181 - DNA, 22 bp, Homo sapiens
actcctggtgctgatgaagaga

SEQ ID NO: 7341182 - DNA, 22 bp, Homo sapiens
actcctggttcccagttgagat

SEQ ID NO: 7341183 - DNA, 17 bp, Homo sapiens
actcctggtctgaaggg

SEQ ID NO: 7341184 - DNA, 22 bp, Homo sapiens
actcctggtgctgatgaagaga

SEQ ID NO: 7341185 - DNA, 22 bp, Homo sapiens
actcctgggttgcagtcctcaa

SEQ ID NO: 7341186 - DNA, 22 bp, Homo sapiens
agtcccaggcagccgagccggt

SEQ ID NO: 7341187 - DNA, 22 bp, Homo sapiens
agtcccagtgacttggccagaa

SEQ ID NO: 7341188 - DNA, 21 bp, Homo sapiens
agtgtgtgataggcaggaaga

SEQ ID NO: 7341189 - DNA, 22 bp, Homo sapiens
agtgttcttcctatctgctgtt

SEQ ID NO: 7341190 - DNA, 22 bp, Homo sapiens
agtgtatacttttagtagaatt

SEQ ID NO: 7341191 - DNA, 22 bp, Homo sapiens
actggaaaggctctgaatggga

SEQ ID NO: 7341192 - DNA, 22 bp, Homo sapiens
actggaaagtattctttcactg

SEQ ID NO: 7341193 - DNA, 22 bp, Homo sapiens
actggaaaaccactgaaatgag

SEQ ID NO: 7341194 - DNA, 22 bp, Homo sapiens
agtggcagtggaaagcacacgg

SEQ ID NO: 7341195 - DNA, 22 bp, Homo sapiens
agtgtacatcagaacatatcaa

SEQ ID NO: 7341196 - DNA, 22 bp, Homo sapiens
agtgtacatcagaacatatcaa

SEQ ID NO: 7341197 - DNA, 22 bp, Homo sapiens
agtgtacatgtttacagcatct

SEQ ID NO: 7341198 - DNA, 22 bp, Homo sapiens
agtgtactgctgcggccgggac

SEQ ID NO: 7341199 - DNA, 22 bp, Homo sapiens
acctgcacagccccagaatgcc

SEQ ID NO: 7341200 - DNA, 22 bp, Homo sapiens
acctgcatgatgtctgaagcaa

SEQ ID NO: 7341201 - DNA, 22 bp, Homo sapiens
acctgcatgatggaacatgagg

SEQ ID NO: 7341202 - DNA, 22 bp, Homo sapiens
acctgatatgtttgatcaccct

SEQ ID NO: 7341203 - DNA, 22 bp, Homo sapiens
accctcccatttccatgtagca

SEQ ID NO: 7341204 - DNA, 22 bp, Homo sapiens
accctccccaagaggtcgtgcc

SEQ ID NO: 7341205 - DNA, 22 bp, Homo sapiens
acctcctccaaggagccatagg

SEQ ID NO: 7341206 - DNA, 22 bp, Homo sapiens
acctcccttgctaaagactgtg

SEQ ID NO: 7341207 - DNA, 22 bp, Homo sapiens
accctctgccttgagcagtgcc

SEQ ID NO: 7341208 - DNA, 22 bp, Homo sapiens
aggtggctatgaggatgcagtc

SEQ ID NO: 7341209 - DNA, 18 bp, Homo sapiens
aggtggcctgggagcttt

SEQ ID NO: 7341210 - DNA, 22 bp, Homo sapiens
aggtggccggtgccagccgggc

SEQ ID NO: 7341211 - DNA, 19 bp, Homo sapiens
acctggcctcttgagcaag

SEQ ID NO: 7341212 - DNA, 22 bp, Homo sapiens
acctggccccactgtgctgctg

SEQ ID NO: 7341213 - DNA, 19 bp, Homo sapiens
acctggcctcttgagcaag

SEQ ID NO: 7341214 - DNA, 22 bp, Homo sapiens
acctggccatccagctggcatc

SEQ ID NO: 7341215 - DNA, 22 bp, Homo sapiens
acctggccagtggggccgcgct

SEQ ID NO: 7341216 - DNA, 22 bp, Homo sapiens
acctggccaatttttgtatttt

SEQ ID NO: 7341217 - DNA, 19 bp, Homo sapiens
acctggccagagttcaata

SEQ ID NO: 7341218 - DNA, 22 bp, Homo sapiens
acctggagtcatttgaggagta

SEQ ID NO: 7341219 - DNA, 22 bp, Homo sapiens
aggtctctggggaactccaggg

SEQ ID NO: 7341220 - DNA, 22 bp, Homo sapiens
acggcgggagggtcactggcca

SEQ ID NO: 7341221 - DNA, 22 bp, Homo sapiens
aggttctttgtagtgtcattgg

SEQ ID NO: 7341222 - DNA, 22 bp, Homo sapiens
acgcagcacaaaggaaaggatc

SEQ ID NO: 7341223 - DNA, 22 bp, Homo sapiens
agtaaacagtaggaactgagaa

SEQ ID NO: 7341224 - DNA, 22 bp, Homo sapiens
actagactgggccagtcaaatt

SEQ ID NO: 7341225 - DNA, 23 bp, Homo sapiens
actagacttcatcgaaggttacc

SEQ ID NO: 7341226 - DNA, 22 bp, Homo sapiens
agtaaaattaatggatcagaag

SEQ ID NO: 7341227 - DNA, 22 bp, Homo sapiens
agtaaaattaatggatcagaag

SEQ ID NO: 7341228 - DNA, 22 bp, Homo sapiens
agtatttgatcagatgatagta

SEQ ID NO: 7341229 - DNA, 22 bp, Homo sapiens
agtatttcttcatatgattact

SEQ ID NO: 7341230 - DNA, 22 bp, Homo sapiens
agtatttcttcatatgattact

SEQ ID NO: 7341231 - DNA, 22 bp, Homo sapiens
actagtctgcattacaaaatag

SEQ ID NO: 7341232 - DNA, 22 bp, Homo sapiens
agtatatagtggcgctgtatgc

SEQ ID NO: 7341233 - DNA, 22 bp, Homo sapiens
agtatactagtgcagcatgtat

SEQ ID NO: 7341234 - DNA, 22 bp, Homo sapiens
agtccaggcgggtatagaggct

SEQ ID NO: 7341235 - DNA, 22 bp, Homo sapiens
attgccacctgttgctatggag

SEQ ID NO: 7341236 - DNA, 19 bp, Homo sapiens
attgccacattgggtcagg

SEQ ID NO: 7341237 - DNA, 22 bp, Homo sapiens
attgctacttcctcaggaaaac

SEQ ID NO: 7341238 - DNA, 22 bp, Homo sapiens
attgctaggaacaggttgcacc

SEQ ID NO: 7341239 - DNA, 22 bp, Homo sapiens
attgctcagcacaagcagcaga

SEQ ID NO: 7341240 - DNA, 22 bp, Homo sapiens
attgctgaaagtattttatgac

SEQ ID NO: 7341241 - DNA, 22 bp, Homo sapiens
agagttggccaaaaggggcatt

SEQ ID NO: 7341242 - DNA, 22 bp, Homo sapiens
agaggtcttaagatctagactg

SEQ ID NO: 7341243 - DNA, 22 bp, Homo sapiens
atttcacagctgctgttcaggt

SEQ ID NO: 7341244 - DNA, 22 bp, Homo sapiens
atttcacagctgctgttcaggt

SEQ ID NO: 7341245 - DNA, 22 bp, Homo sapiens
atttcacagcgtggttgactgc

SEQ ID NO: 7341246 - DNA, 22 bp, Homo sapiens
atttcacagcgtggttgactgc

SEQ ID NO: 7341247 - DNA, 22 bp, Homo sapiens
atttcacagcgtggttgactgc

SEQ ID NO: 7341248 - DNA, 22 bp, Homo sapiens
atttcacaaagaacagatgcag

SEQ ID NO: 7341249 - DNA, 22 bp, Homo sapiens
atttcacagctgtcagtgttac

SEQ ID NO: 7341250 - DNA, 22 bp, Homo sapiens
atttcacagctgtcagtgttac

SEQ ID NO: 7341251 - DNA, 22 bp, Homo sapiens
atttcacatctatctcagattt

SEQ ID NO: 7341252 - DNA, 22 bp, Homo sapiens
atttcacatctatctcagattt

SEQ ID NO: 7341253 - DNA, 22 bp, Homo sapiens
atttcacaggccagtggtgggg

SEQ ID NO: 7341254 - DNA, 22 bp, Homo sapiens
atttcacattaatttgatgctc

SEQ ID NO: 7341255 - DNA, 22 bp, Homo sapiens
atttcacattaatttgatgctc

SEQ ID NO: 7341256 - DNA, 22 bp, Homo sapiens
atttcacattaatttgatgctc

SEQ ID NO: 7341257 - DNA, 22 bp, Homo sapiens
atttcactcttaattgcttcct

SEQ ID NO: 7341258 - DNA, 22 bp, Homo sapiens
atttcactcattcatgttactt

SEQ ID NO: 7341259 - DNA, 22 bp, Homo sapiens
atttcactctccctgccactta

SEQ ID NO: 7341260 - DNA, 22 bp, Homo sapiens
agatacatcatttataccttca

SEQ ID NO: 7341261 - DNA, 22 bp, Homo sapiens
agatacatcatttataccttca

SEQ ID NO: 7341262 - DNA, 20 bp, Homo sapiens
agatacagtttaattactct

SEQ ID NO: 7341263 - DNA, 20 bp, Homo sapiens
agatacagtttaattactct

SEQ ID NO: 7341264 - DNA, 22 bp, Homo sapiens
atttcacttagtgtaatgtctt

SEQ ID NO: 7341265 - DNA, 17 bp, Homo sapiens
atttcacttagcatgag

SEQ ID NO: 7341266 - DNA, 17 bp, Homo sapiens
atttcacttagcatgag

SEQ ID NO: 7341267 - DNA, 22 bp, Homo sapiens
atttgttctcataaagaatgaa

SEQ ID NO: 7341268 - DNA, 22 bp, Homo sapiens
atttgttccacacatatttact

SEQ ID NO: 7341269 - DNA, 22 bp, Homo sapiens
atttggcacagcttttcctacc

SEQ ID NO: 7341270 - DNA, 22 bp, Homo sapiens
atttggcaacattaattgaatc

SEQ ID NO: 7341271 - DNA, 22 bp, Homo sapiens
atttggcagtataaattctggc

SEQ ID NO: 7341272 - DNA, 21 bp, Homo sapiens
caaaaggataggaaattaggg

SEQ ID NO: 7341273 - DNA, 22 bp, Homo sapiens
caaaaaacacagatgtctgtgt

SEQ ID NO: 7341274 - DNA, 22 bp, Homo sapiens
attttaaccctcttatatatac

SEQ ID NO: 7341275 - DNA, 22 bp, Homo sapiens
attttaaccctcttatatatac

SEQ ID NO: 7341276 - DNA, 22 bp, Homo sapiens
atttctcattttgcttcaaagg

SEQ ID NO: 7341277 - DNA, 22 bp, Homo sapiens
atttcctggtgtggaagtattt

SEQ ID NO: 7341278 - DNA, 22 bp, Homo sapiens
atttcctggtgtggaagtattt

SEQ ID NO: 7341279 - DNA, 22 bp, Homo sapiens
atttcctggttgcattggcttt

SEQ ID NO: 7341280 - DNA, 22 bp, Homo sapiens
atttcctgtaaaatggtactgc

SEQ ID NO: 7341281 - DNA, 22 bp, Homo sapiens
atttcctggtaccaggctttct

SEQ ID NO: 7341282 - DNA, 22 bp, Homo sapiens
atttcctggaggaatggaagca

SEQ ID NO: 7341283 - DNA, 22 bp, Homo sapiens
atttcctgcaggggctggtggg

SEQ ID NO: 7341284 - DNA, 22 bp, Homo sapiens
atttcctggaatgactagtggg

SEQ ID NO: 7341285 - DNA, 22 bp, Homo sapiens
atttcctgcaaggagtgggttt

SEQ ID NO: 7341286 - DNA, 17 bp, Homo sapiens
atttcctcagggctgag

SEQ ID NO: 7341287 - DNA, 22 bp, Homo sapiens
atttcctcatgatcataatgca

SEQ ID NO: 7341288 - DNA, 22 bp, Homo sapiens
atttcctgacagggcagtggta

SEQ ID NO: 7341289 - DNA, 23 bp, Homo sapiens
attattaaggacatggactttgt

SEQ ID NO: 7341290 - DNA, 22 bp, Homo sapiens
attattaaagcttaggtcttat

SEQ ID NO: 7341291 - DNA, 22 bp, Homo sapiens
agaggcagaagtgttcaaaccc

SEQ ID NO: 7341292 - DNA, 22 bp, Homo sapiens
agaggaggctctgggatcgtcc

SEQ ID NO: 7341293 - DNA, 22 bp, Homo sapiens
agaggaggccaggcccacacct

SEQ ID NO: 7341294 - DNA, 22 bp, Homo sapiens
agaggaggcagcttaactcagt

SEQ ID NO: 7341295 - DNA, 22 bp, Homo sapiens
agaggaggatttgtaaaggtct

SEQ ID NO: 7341296 - DNA, 22 bp, Homo sapiens
agaggaggcagcttaactcagt

SEQ ID NO: 7341297 - DNA, 20 bp, Homo sapiens
agaggaggattattttattc

SEQ ID NO: 7341298 - DNA, 22 bp, Homo sapiens
agaggaggaagagctttaaaat

SEQ ID NO: 7341299 - DNA, 22 bp, Homo sapiens
agaggagcttttggaaaaggcc

SEQ ID NO: 7341300 - DNA, 22 bp, Homo sapiens
agaggactgttggtcttagaaa

SEQ ID NO: 7341301 - DNA, 22 bp, Homo sapiens
agaggagaatccgtttccttgc

SEQ ID NO: 7341302 - DNA, 22 bp, Homo sapiens
agaggagctgggaggccctcgt

SEQ ID NO: 7341303 - DNA, 21 bp, Homo sapiens
atgtttacactgactactgtg

SEQ ID NO: 7341304 - DNA, 22 bp, Homo sapiens
agaggacagcccccttgtctgg

SEQ ID NO: 7341305 - DNA, 22 bp, Homo sapiens
agaggacacatctttcctcaaa

SEQ ID NO: 7341306 - DNA, 22 bp, Homo sapiens
agaggacaaaatgagaagtgct

SEQ ID NO: 7341307 - DNA, 22 bp, Homo sapiens
agaggacaaaatgagaagtgct

SEQ ID NO: 7341308 - DNA, 22 bp, Homo sapiens
atgtgtatacttgtgcttactc

SEQ ID NO: 7341309 - DNA, 22 bp, Homo sapiens
atgtgtatacttgtgcttactc

SEQ ID NO: 7341310 - DNA, 22 bp, Homo sapiens
atgtgtatatttggtgtcaata

SEQ ID NO: 7341311 - DNA, 22 bp, Homo sapiens
atgtgtatatttggtgtcaata

SEQ ID NO: 7341312 - DNA, 22 bp, Homo sapiens
atgtgtatatttattgtagttt

SEQ ID NO: 7341313 - DNA, 22 bp, Homo sapiens
agagctgggacttggactcaat

SEQ ID NO: 7341314 - DNA, 22 bp, Homo sapiens
agagctgggacttggactcaat

SEQ ID NO: 7341315 - DNA, 22 bp, Homo sapiens
agagctggtgcatattcagaaa

SEQ ID NO: 7341316 - DNA, 22 bp, Homo sapiens
agagctgtttattgatgtcaca

SEQ ID NO: 7341317 - DNA, 17 bp, Homo sapiens
agaggcagatacttgga

SEQ ID NO: 7341318 - DNA, 22 bp, Homo sapiens
agaggcagcagtcatactacag

SEQ ID NO: 7341319 - DNA, 22 bp, Homo sapiens
agaggcaggaggttgacttgag

SEQ ID NO: 7341320 - DNA, 22 bp, Homo sapiens
agaggcaggaagagctgatttt

SEQ ID NO: 7341321 - DNA, 20 bp, Homo sapiens
attcatgtctttataaaagc

SEQ ID NO: 7341322 - DNA, 22 bp, Homo sapiens
attcagtaggtctagaataaga

SEQ ID NO: 7341323 - DNA, 22 bp, Homo sapiens
attcatttagagggattaagca

SEQ ID NO: 7341324 - DNA, 22 bp, Homo sapiens
attcatttagagggattaagca

SEQ ID NO: 7341325 - DNA, 22 bp, Homo sapiens
attcatttaggtattcacttac

SEQ ID NO: 7341326 - DNA, 22 bp, Homo sapiens
agaggcctgtgtgctccagtgg

SEQ ID NO: 7341327 - DNA, 22 bp, Homo sapiens
attcatttgctattgtgtatgg

SEQ ID NO: 7341328 - DNA, 22 bp, Homo sapiens
attcatttgctattgtgtatgg

SEQ ID NO: 7341329 - DNA, 22 bp, Homo sapiens
agaggcctttctgttgagtgaa

SEQ ID NO: 7341330 - DNA, 22 bp, Homo sapiens
attgagggctgagaagggccct

SEQ ID NO: 7341331 - DNA, 22 bp, Homo sapiens
attgcatatgcagcacatcagg

SEQ ID NO: 7341332 - DNA, 22 bp, Homo sapiens
attgcaggctctgacaccaggc

SEQ ID NO: 7341333 - DNA, 22 bp, Homo sapiens
attgcaggccagtgtcctgggc

SEQ ID NO: 7341334 - DNA, 20 bp, Homo sapiens
attccatagttggcactttt

SEQ ID NO: 7341335 - DNA, 22 bp, Homo sapiens
agagggagaaaagaatcagttg

SEQ ID NO: 7341336 - DNA, 22 bp, Homo sapiens
agagggagaaaagaatcagttg

SEQ ID NO: 7341337 - DNA, 22 bp, Homo sapiens
agagggagaagctaaaataact

SEQ ID NO: 7341338 - DNA, 22 bp, Homo sapiens
agagggaaatccaggagtgctt

SEQ ID NO: 7341339 - DNA, 18 bp, Homo sapiens
agagggaatcagttggat

SEQ ID NO: 7341340 - DNA, 22 bp, Homo sapiens
atgaaagtggcttgattaaatg

SEQ ID NO: 7341341 - DNA, 22 bp, Homo sapiens
atgaaagtagggtaaaatcaca

SEQ ID NO: 7341342 - DNA, 22 bp, Homo sapiens
atgaaagcaacttatttgagat

SEQ ID NO: 7341343 - DNA, 22 bp, Homo sapiens
atgaaactgggataactatagc

SEQ ID NO: 7341344 - DNA, 22 bp, Homo sapiens
atgaaagcaacttatttgagat

SEQ ID NO: 7341345 - DNA, 22 bp, Homo sapiens
atgaaagcaggaattgttctgt

SEQ ID NO: 7341346 - DNA, 22 bp, Homo sapiens
atgaaatttgctgctaagttcc

SEQ ID NO: 7341347 - DNA, 22 bp, Homo sapiens
atgaacaataaaatagatcaca

SEQ ID NO: 7341348 - DNA, 22 bp, Homo sapiens
atgaacaagtatttgcatgagc

SEQ ID NO: 7341349 - DNA, 20 bp, Homo sapiens
atgaaattcctgttttctga

SEQ ID NO: 7341350 - DNA, 22 bp, Homo sapiens
atgaaattgatcttgaactttt

SEQ ID NO: 7341351 - DNA, 22 bp, Homo sapiens
atgaaatttgaccaattattta

SEQ ID NO: 7341352 - DNA, 22 bp, Homo sapiens
agacaaatggtaattatgtcta

SEQ ID NO: 7341353 - DNA, 22 bp, Homo sapiens
agacaaataactttttatgtcc

SEQ ID NO: 7341354 - DNA, 22 bp, Homo sapiens
agacaaaggattaatgatgatg

SEQ ID NO: 7341355 - DNA, 22 bp, Homo sapiens
agacaaaccttgttttatgatg

SEQ ID NO: 7341356 - DNA, 22 bp, Homo sapiens
agacaaagaaaccgtagaagca

SEQ ID NO: 7341357 - DNA, 22 bp, Homo sapiens
atgaacaatgactacatattga

SEQ ID NO: 7341358 - DNA, 22 bp, Homo sapiens
atgaacaataatcatgtctatg

SEQ ID NO: 7341359 - DNA, 22 bp, Homo sapiens
agaagtatttggctaaaagaca

SEQ ID NO: 7341360 - DNA, 22 bp, Homo sapiens
atctcagacatgttgtccatga

SEQ ID NO: 7341361 - DNA, 22 bp, Homo sapiens
atctcagacatgttgtccatga

SEQ ID NO: 7341362 - DNA, 22 bp, Homo sapiens
atctcagaaagtttaatttttc

SEQ ID NO: 7341363 - DNA, 22 bp, Homo sapiens
agaagttatccaccttagatgc

SEQ ID NO: 7341364 - DNA, 22 bp, Homo sapiens
agaagtggtgtgtggccgagct

SEQ ID NO: 7341365 - DNA, 22 bp, Homo sapiens
atgaaactctaacttaacaagt

SEQ ID NO: 7341366 - DNA, 22 bp, Homo sapiens
atgaaacatgctttgtggatga

SEQ ID NO: 7341367 - DNA, 22 bp, Homo sapiens
atctttgttatctcagatcttg

SEQ ID NO: 7341368 - DNA, 22 bp, Homo sapiens
atgcactgggccacagtatgac

SEQ ID NO: 7341369 - DNA, 22 bp, Homo sapiens
atgcactgtaagactagccatg

SEQ ID NO: 7341370 - DNA, 22 bp, Homo sapiens
atgcacatgaggcaagcaaaat

SEQ ID NO: 7341371 - DNA, 22 bp, Homo sapiens
atgcactgttggatatatttgt

SEQ ID NO: 7341372 - DNA, 22 bp, Homo sapiens
atgacaaaatgaatgcagctag

SEQ ID NO: 7341373 - DNA, 22 bp, Homo sapiens
agacaaatttcctgcaatgaag

SEQ ID NO: 7341374 - DNA, 22 bp, Homo sapiens
atgcacatacatatgctctata

SEQ ID NO: 7341375 - DNA, 20 bp, Homo sapiens
atgcacatacgcatgcacat

SEQ ID NO: 7341376 - DNA, 22 bp, Homo sapiens
atgacaaattcagaccatagca

SEQ ID NO: 7341377 - DNA, 22 bp, Homo sapiens
agacatttggagccaactttcc

SEQ ID NO: 7341378 - DNA, 22 bp, Homo sapiens
agacatttggaagatacacata

SEQ ID NO: 7341379 - DNA, 22 bp, Homo sapiens
agacatttggaagatacacata

SEQ ID NO: 7341380 - DNA, 22 bp, Homo sapiens
agacagctgggaaatggagtgt

SEQ ID NO: 7341381 - DNA, 22 bp, Homo sapiens
agacagctgggaaatggagtgt

SEQ ID NO: 7341382 - DNA, 22 bp, Homo sapiens
agacaggagagggaactgccgg

SEQ ID NO: 7341383 - DNA, 20 bp, Homo sapiens
agacaggagcccccattcag

SEQ ID NO: 7341384 - DNA, 22 bp, Homo sapiens
agacagcatgatacatgatgct

SEQ ID NO: 7341385 - DNA, 22 bp, Homo sapiens
agacagcatgatacatgatgct

SEQ ID NO: 7341386 - DNA, 22 bp, Homo sapiens
agacagcatgagcctgctgatg

SEQ ID NO: 7341387 - DNA, 22 bp, Homo sapiens
agacagcagggagcaggattca

SEQ ID NO: 7341388 - DNA, 22 bp, Homo sapiens
agacagcaggggagtctggttt

SEQ ID NO: 7341389 - DNA, 22 bp, Homo sapiens
agacagcagggagcaggattca

SEQ ID NO: 7341390 - DNA, 22 bp, Homo sapiens
agacagcagaaactagagcact

SEQ ID NO: 7341391 - DNA, 22 bp, Homo sapiens
agacagcatggagctgataaca

SEQ ID NO: 7341392 - DNA, 22 bp, Homo sapiens
agacagctatcaacaactttct

SEQ ID NO: 7341393 - DNA, 22 bp, Homo sapiens
agacagctagggctgcagggac

SEQ ID NO: 7341394 - DNA, 22 bp, Homo sapiens
agacagctgctcgcagagctat

SEQ ID NO: 7341395 - DNA, 22 bp, Homo sapiens
agagacagggttttgtcgtgtt

SEQ ID NO: 7341396 - DNA, 22 bp, Homo sapiens
agagaccaagggaatagtctca

SEQ ID NO: 7341397 - DNA, 21 bp, Homo sapiens
agagacagagaaagtaacatt

SEQ ID NO: 7341398 - DNA, 22 bp, Homo sapiens
agagactgatggagctcactct

SEQ ID NO: 7341399 - DNA, 22 bp, Homo sapiens
agagatgaaaagtggagactgg

SEQ ID NO: 7341400 - DNA, 22 bp, Homo sapiens
atggcctggggattcctgagca

SEQ ID NO: 7341401 - DNA, 22 bp, Homo sapiens
agaccaagactataatgagagg

SEQ ID NO: 7341402 - DNA, 22 bp, Homo sapiens
agaccaagaaaggatgaggatc

SEQ ID NO: 7341403 - DNA, 22 bp, Homo sapiens
agaccactcaaaattagtgtct

SEQ ID NO: 7341404 - DNA, 22 bp, Homo sapiens
agaccacagtcaggctcctggt

SEQ ID NO: 7341405 - DNA, 22 bp, Homo sapiens
agaccacaggcatgcacagagc

SEQ ID NO: 7341406 - DNA, 22 bp, Homo sapiens
agacattttagacataaaagat

SEQ ID NO: 7341407 - DNA, 22 bp, Homo sapiens
agaccactggcctcctgcagac

SEQ ID NO: 7341408 - DNA, 22 bp, Homo sapiens
atggccagcaagttcagaattt

SEQ ID NO: 7341409 - DNA, 23 bp, Homo sapiens
agacccagagactggctctgctc

SEQ ID NO: 7341410 - DNA, 22 bp, Homo sapiens
atggccagctcagagcactcag

SEQ ID NO: 7341411 - DNA, 22 bp, Homo sapiens
atggccagggtggcactgtggt

SEQ ID NO: 7341412 - DNA, 22 bp, Homo sapiens
atggccagtcaagcctctggct

SEQ ID NO: 7341413 - DNA, 22 bp, Homo sapiens
agagatggccttaggtgggaat

SEQ ID NO: 7341414 - DNA, 22 bp, Homo sapiens
atggggggatgaaggagtccaa

SEQ ID NO: 7341415 - DNA, 22 bp, Homo sapiens
agagatgacatgagggacttaa

SEQ ID NO: 7341416 - DNA, 22 bp, Homo sapiens
agagatgaatcttgagactctg

SEQ ID NO: 7341417 - DNA, 19 bp, Homo sapiens
agagatgctaagagtcttt

SEQ ID NO: 7341418 - DNA, 22 bp, Homo sapiens
atggggtggagtccgggcagcg

SEQ ID NO: 7341419 - DNA, 22 bp, Homo sapiens
atgtcaaatcagttttatcaga

SEQ ID NO: 7341420 - DNA, 22 bp, Homo sapiens
agagcctgcagtggagaccttg

SEQ ID NO: 7341421 - DNA, 22 bp, Homo sapiens
atgtgggtgagtgagagataga

SEQ ID NO: 7341422 - DNA, 22 bp, Homo sapiens
atgtgtaaaaggcatgttttat

SEQ ID NO: 7341423 - DNA, 22 bp, Homo sapiens
atgtgtaaattgttaggtttaa

SEQ ID NO: 7341424 - DNA, 22 bp, Homo sapiens
atgtgggagatttcaggaggtg

SEQ ID NO: 7341425 - DNA, 22 bp, Homo sapiens
atgtgggaaatacaagctaaaa

SEQ ID NO: 7341426 - DNA, 22 bp, Homo sapiens
atgtgggaaatacaagctaaaa

SEQ ID NO: 7341427 - DNA, 22 bp, Homo sapiens
atgtgggccgtgcgggtgtcct

SEQ ID NO: 7341428 - DNA, 22 bp, Homo sapiens
agcccagccggattcccagttc

SEQ ID NO: 7341429 - DNA, 22 bp, Homo sapiens
cagaggcagtggggttgctcct

SEQ ID NO: 7341430 - DNA, 22 bp, Homo sapiens
cagaggcagtggggttgctcct

SEQ ID NO: 7341431 - DNA, 20 bp, Homo sapiens
cagaggcattttcagactct

SEQ ID NO: 7341432 - DNA, 22 bp, Homo sapiens
cagaggcatactcccagtcttg

SEQ ID NO: 7341433 - DNA, 23 bp, Homo sapiens
cagaggcatcggattcaacatca

SEQ ID NO: 7341434 - DNA, 22 bp, Homo sapiens
cagagggaaaaggggagtaata

SEQ ID NO: 7341435 - DNA, 22 bp, Homo sapiens
cagagggaaaaggggagtaata

SEQ ID NO: 7341436 - DNA, 22 bp, Homo sapiens
cagagggacagtatgatgaaag

SEQ ID NO: 7341437 - DNA, 22 bp, Homo sapiens
cagagggacagtatgatgaaag

SEQ ID NO: 7341438 - DNA, 22 bp, Homo sapiens
cagagggagccctccaggagca

SEQ ID NO: 7341439 - DNA, 22 bp, Homo sapiens
cagagggagccctccaggagca

SEQ ID NO: 7341440 - DNA, 22 bp, Homo sapiens
agcccaggctggagtgcagtgg

SEQ ID NO: 7341441 - DNA, 22 bp, Homo sapiens
agcccaggctggagtgcagtgg

SEQ ID NO: 7341442 - DNA, 22 bp, Homo sapiens
agcccagggaaccaggaagtgg

SEQ ID NO: 7341443 - DNA, 20 bp, Homo sapiens
agcccaggcctgtgtgagtc

SEQ ID NO: 7341444 - DNA, 22 bp, Homo sapiens
agcccaaggccacacagttagt

SEQ ID NO: 7341445 - DNA, 22 bp, Homo sapiens
agcccagaaatgaaaggatgat

SEQ ID NO: 7341446 - DNA, 22 bp, Homo sapiens
agcccactgttttcatttctct

SEQ ID NO: 7341447 - DNA, 23 bp, Homo sapiens
agcccaccttgttagtcctgtgg

SEQ ID NO: 7341448 - DNA, 22 bp, Homo sapiens
agcccagagccccggccatgtt

SEQ ID NO: 7341449 - DNA, 22 bp, Homo sapiens
agcccagagacaatgctcagta

SEQ ID NO: 7341450 - DNA, 22 bp, Homo sapiens
agcccagagacaatgctcagta

SEQ ID NO: 7341451 - DNA, 22 bp, Homo sapiens
agcccagagacaatgctcagta

SEQ ID NO: 7341452 - DNA, 22 bp, Homo sapiens
agcccagaaatgaaaggatgat

SEQ ID NO: 7341453 - DNA, 22 bp, Homo sapiens
agcccagagggtagcagaagaa

SEQ ID NO: 7341454 - DNA, 22 bp, Homo sapiens
agcccagaggggtttgaggact

SEQ ID NO: 7341455 - DNA, 22 bp, Homo sapiens
agcccagagggtagcagaagaa

SEQ ID NO: 7341456 - DNA, 22 bp, Homo sapiens
agcccagcccgggctgcgcttt

SEQ ID NO: 7341457 - DNA, 22 bp, Homo sapiens
agcccagcactgggggcccagc

SEQ ID NO: 7341458 - DNA, 22 bp, Homo sapiens
cagactttctggaagctaaaaa

SEQ ID NO: 7341459 - DNA, 22 bp, Homo sapiens
cagagaaagggtgaattccttc

SEQ ID NO: 7341460 - DNA, 22 bp, Homo sapiens
agcccaagcataggagggaggc

SEQ ID NO: 7341461 - DNA, 22 bp, Homo sapiens
agcccaaagtcctgcttccctg

SEQ ID NO: 7341462 - DNA, 22 bp, Homo sapiens
cagacatatgttttaacagatt

SEQ ID NO: 7341463 - DNA, 22 bp, Homo sapiens
cagacaggttgcaaaacttcaa

SEQ ID NO: 7341464 - DNA, 22 bp, Homo sapiens
cagacaggttgcaaaacttcaa

SEQ ID NO: 7341465 - DNA, 22 bp, Homo sapiens
cagacaggtagggacagaacat

SEQ ID NO: 7341466 - DNA, 22 bp, Homo sapiens
cagacagtggacttgataaagg

SEQ ID NO: 7341467 - DNA, 22 bp, Homo sapiens
cagacagggttttggtctttgg

SEQ ID NO: 7341468 - DNA, 22 bp, Homo sapiens
agccagagagccccaggttcta

SEQ ID NO: 7341469 - DNA, 22 bp, Homo sapiens
agccagagactgtgtctgtaat

SEQ ID NO: 7341470 - DNA, 22 bp, Homo sapiens
agccagagactgtgtctgtaat

SEQ ID NO: 7341471 - DNA, 22 bp, Homo sapiens
agccactgtgcaggagcagtgt

SEQ ID NO: 7341472 - DNA, 22 bp, Homo sapiens
agccactgtgtgaccagctgtc

SEQ ID NO: 7341473 - DNA, 22 bp, Homo sapiens
cagaatccagaattgctgaggt

SEQ ID NO: 7341474 - DNA, 22 bp, Homo sapiens
cagaatcagtgacacatgtata

SEQ ID NO: 7341475 - DNA, 22 bp, Homo sapiens
cagaatcaagtccaattagcac

SEQ ID NO: 7341476 - DNA, 22 bp, Homo sapiens
cagaatgagtagcatcttcacc

SEQ ID NO: 7341477 - DNA, 22 bp, Homo sapiens
agccacgtccctgtcagggtca

SEQ ID NO: 7341478 - DNA, 22 bp, Homo sapiens
agccaccctaccagccctgaaa

SEQ ID NO: 7341479 - DNA, 22 bp, Homo sapiens
agccaccctaccagccctgaaa

SEQ ID NO: 7341480 - DNA, 22 bp, Homo sapiens
agcatatacaaactcatataca

SEQ ID NO: 7341481 - DNA, 22 bp, Homo sapiens
agcatataaatggacatatttg

SEQ ID NO: 7341482 - DNA, 22 bp, Homo sapiens
agccacaggaaacagagacagc

SEQ ID NO: 7341483 - DNA, 22 bp, Homo sapiens
cagaaatatcagttgaaagtgc

SEQ ID NO: 7341484 - DNA, 19 bp, Homo sapiens
cagaaatagcgaagtgtaa

SEQ ID NO: 7341485 - DNA, 22 bp, Homo sapiens
agccactccttcagcgtctgct

SEQ ID NO: 7341486 - DNA, 22 bp, Homo sapiens
agccactgcccttagccatttg

SEQ ID NO: 7341487 - DNA, 22 bp, Homo sapiens
agccactggcctgggcagctct

SEQ ID NO: 7341488 - DNA, 22 bp, Homo sapiens
agccactggcctgggcagctct

SEQ ID NO: 7341489 - DNA, 22 bp, Homo sapiens
cagaataagctgtgttgtcaag

SEQ ID NO: 7341490 - DNA, 22 bp, Homo sapiens
cagaataagctgtgttgtcaag

SEQ ID NO: 7341491 - DNA, 22 bp, Homo sapiens
cagaataatattggtctcatag

SEQ ID NO: 7341492 - DNA, 22 bp, Homo sapiens
cagagggcacatggtttcctca

SEQ ID NO: 7341493 - DNA, 22 bp, Homo sapiens
cagagggcactcggagtgacat

SEQ ID NO: 7341494 - DNA, 22 bp, Homo sapiens
cagaggtagggttggcccagga

SEQ ID NO: 7341495 - DNA, 22 bp, Homo sapiens
cagaggtcaagatctgaagtga

SEQ ID NO: 7341496 - DNA, 22 bp, Homo sapiens
cagaggtgctggagtgagtcct

SEQ ID NO: 7341497 - DNA, 22 bp, Homo sapiens
cagaggtgcatacaggtcatta

SEQ ID NO: 7341498 - DNA, 22 bp, Homo sapiens
agcctcctggagtttctgggat

SEQ ID NO: 7341499 - DNA, 22 bp, Homo sapiens
agcctccatctcccatctgtga

SEQ ID NO: 7341500 - DNA, 22 bp, Homo sapiens
agcctctgctggccctggcact

SEQ ID NO: 7341501 - DNA, 18 bp, Homo sapiens
agcctctggcagagagaa

SEQ ID NO: 7341502 - DNA, 22 bp, Homo sapiens
agcctctgatggctcccaagga

SEQ ID NO: 7341503 - DNA, 22 bp, Homo sapiens
agcctctgcacttcttacaggt

SEQ ID NO: 7341504 - DNA, 22 bp, Homo sapiens
agcctctggccctagactgctt

SEQ ID NO: 7341505 - DNA, 22 bp, Homo sapiens
agcctctggtcctccctcagct

SEQ ID NO: 7341506 - DNA, 22 bp, Homo sapiens
agcctctgtagaaagcagtgtg

SEQ ID NO: 7341507 - DNA, 22 bp, Homo sapiens
agcctggagttcccaggagaag

SEQ ID NO: 7341508 - DNA, 22 bp, Homo sapiens
agcctggagttcccaggagaag

SEQ ID NO: 7341509 - DNA, 22 bp, Homo sapiens
agcctcttccagctcctttcta

SEQ ID NO: 7341510 - DNA, 22 bp, Homo sapiens
cagcagctcaggctgcttccca

SEQ ID NO: 7341511 - DNA, 22 bp, Homo sapiens
cagcagctgactccaagagagc

SEQ ID NO: 7341512 - DNA, 22 bp, Homo sapiens
agctcctgattctcagagatag

SEQ ID NO: 7341513 - DNA, 22 bp, Homo sapiens
agctcctgatacatgcaggaat

SEQ ID NO: 7341514 - DNA, 23 bp, Homo sapiens
agctcctgaggccagcctctcct

SEQ ID NO: 7341515 - DNA, 22 bp, Homo sapiens
agctcctgatacatgcaggaat

SEQ ID NO: 7341516 - DNA, 22 bp, Homo sapiens
agctcctgatacatgcaggaat

SEQ ID NO: 7341517 - DNA, 18 bp, Homo sapiens
agctcctgaactctgtgg

SEQ ID NO: 7341518 - DNA, 22 bp, Homo sapiens
agctcctgaaaatccagactgg

SEQ ID NO: 7341519 - DNA, 22 bp, Homo sapiens
cagctccaaagccccactgtcc

SEQ ID NO: 7341520 - DNA, 22 bp, Homo sapiens
cagctccaaagccccactgtcc

SEQ ID NO: 7341521 - DNA, 21 bp, Homo sapiens
agctcagcaagatggaggctc

SEQ ID NO: 7341522 - DNA, 22 bp, Homo sapiens
agctcaggcaactctgggcccc

SEQ ID NO: 7341523 - DNA, 22 bp, Homo sapiens
agctcagcttcctctccatgct

SEQ ID NO: 7341524 - DNA, 21 bp, Homo sapiens
agctcagccgggcacagtggc

SEQ ID NO: 7341525 - DNA, 22 bp, Homo sapiens
cagctcaggaaggaaggccggc

SEQ ID NO: 7341526 - DNA, 22 bp, Homo sapiens
cagctcagtctggagagatgca

SEQ ID NO: 7341527 - DNA, 19 bp, Homo sapiens
cagctcaggactcagcccc

SEQ ID NO: 7341528 - DNA, 22 bp, Homo sapiens
cagctcaggctctccatgctcc

SEQ ID NO: 7341529 - DNA, 22 bp, Homo sapiens
cagctcaggctctccatgctcc

SEQ ID NO: 7341530 - DNA, 22 bp, Homo sapiens
cagccccacacggtctagctct

SEQ ID NO: 7341531 - DNA, 22 bp, Homo sapiens
cagccccagcacttagctgagt

SEQ ID NO: 7341532 - DNA, 22 bp, Homo sapiens
cagcatcaacattctcagctct

SEQ ID NO: 7341533 - DNA, 22 bp, Homo sapiens
cagccctgagaaggaggatctc

SEQ ID NO: 7341534 - DNA, 22 bp, Homo sapiens
cagccctgagagaaccatctat

SEQ ID NO: 7341535 - DNA, 22 bp, Homo sapiens
cagccctgcacgctgcctccgc

SEQ ID NO: 7341536 - DNA, 22 bp, Homo sapiens
cagccctgagttagcccacgga

SEQ ID NO: 7341537 - DNA, 22 bp, Homo sapiens
cagccctgcacgctgcctccgc

SEQ ID NO: 7341538 - DNA, 22 bp, Homo sapiens
cagcagtttcctatggttcagc

SEQ ID NO: 7341539 - DNA, 22 bp, Homo sapiens
cagcagtgtgcaggtgtgctgg

SEQ ID NO: 7341540 - DNA, 21 bp, Homo sapiens
cagcagtgtgtctgagctaga

SEQ ID NO: 7341541 - DNA, 22 bp, Homo sapiens
cagcagggtatacagggaattt

SEQ ID NO: 7341542 - DNA, 22 bp, Homo sapiens
cagcagggttaagtgactcacc

SEQ ID NO: 7341543 - DNA, 22 bp, Homo sapiens
caagagagatgcagctcactca

SEQ ID NO: 7341544 - DNA, 22 bp, Homo sapiens
agcagcaggctagggaactgct

SEQ ID NO: 7341545 - DNA, 22 bp, Homo sapiens
agcagcaggctgggatgagtct

SEQ ID NO: 7341546 - DNA, 22 bp, Homo sapiens
agcagcaggaggccattgtctt

SEQ ID NO: 7341547 - DNA, 22 bp, Homo sapiens
agcagcaggaggctgtccacca

SEQ ID NO: 7341548 - DNA, 22 bp, Homo sapiens
agcagccacccagctgctcatt

SEQ ID NO: 7341549 - DNA, 22 bp, Homo sapiens
agcagccagaaagggcagtcga

SEQ ID NO: 7341550 - DNA, 22 bp, Homo sapiens
agcagccagaaagggcagtcga

SEQ ID NO: 7341551 - DNA, 22 bp, Homo sapiens
agcagccagaaatccagaggtg

SEQ ID NO: 7341552 - DNA, 22 bp, Homo sapiens
agcagccagaaatccagaggtg

SEQ ID NO: 7341553 - DNA, 22 bp, Homo sapiens
agcagccaattggaggatgaag

SEQ ID NO: 7341554 - DNA, 22 bp, Homo sapiens
agcagccaaggtaacctgtgct

SEQ ID NO: 7341555 - DNA, 22 bp, Homo sapiens
agcagccacagcagatctgagt

SEQ ID NO: 7341556 - DNA, 22 bp, Homo sapiens
agcagccacacgcctccttctc

SEQ ID NO: 7341557 - DNA, 22 bp, Homo sapiens
agcagccacagtctgggacagg

SEQ ID NO: 7341558 - DNA, 22 bp, Homo sapiens
agcagccacccagctgctcatt

SEQ ID NO: 7341559 - DNA, 22 bp, Homo sapiens
agcagccacccagctgctcatt

SEQ ID NO: 7341560 - DNA, 22 bp, Homo sapiens
cacaagggagcttagaaaacat

SEQ ID NO: 7341561 - DNA, 22 bp, Homo sapiens
agcagccaaatgaagattttac

SEQ ID NO: 7341562 - DNA, 22 bp, Homo sapiens
agcagccaaccttacattcatc

SEQ ID NO: 7341563 - DNA, 22 bp, Homo sapiens
agcagccaaggtaacctgtgct

SEQ ID NO: 7341564 - DNA, 22 bp, Homo sapiens
caattttttccatgctcttaca

SEQ ID NO: 7341565 - DNA, 22 bp, Homo sapiens
caatttttgtacttatagtact

SEQ ID NO: 7341566 - DNA, 22 bp, Homo sapiens
agcagcaggcttaaggaaaagt

SEQ ID NO: 7341567 - DNA, 22 bp, Homo sapiens
agcagcagggacaaaggaacag

SEQ ID NO: 7341568 - DNA, 22 bp, Homo sapiens
agcagcagggacaaaggaacag

SEQ ID NO: 7341569 - DNA, 22 bp, Homo sapiens
caacagaaggtgtactactgaa

SEQ ID NO: 7341570 - DNA, 22 bp, Homo sapiens
caacagaaggaagcagggtcag

SEQ ID NO: 7341571 - DNA, 22 bp, Homo sapiens
caaattaatgtgtctcaaaata

SEQ ID NO: 7341572 - DNA, 22 bp, Homo sapiens
caacagctcagacacgggacct

SEQ ID NO: 7341573 - DNA, 22 bp, Homo sapiens
caacagctggaggcttggcccg

SEQ ID NO: 7341574 - DNA, 23 bp, Homo sapiens
caacagctgttagatatgggctt

SEQ ID NO: 7341575 - DNA, 22 bp, Homo sapiens
agcacattaagtgagttcatgt

SEQ ID NO: 7341576 - DNA, 22 bp, Homo sapiens
agcacattagtatctaagaaca

SEQ ID NO: 7341577 - DNA, 22 bp, Homo sapiens
agcacattttctcaaagctcat

SEQ ID NO: 7341578 - DNA, 22 bp, Homo sapiens
agcacattttatttaagaaaat

SEQ ID NO: 7341579 - DNA, 22 bp, Homo sapiens
agcacatttaagtatgaaatat

SEQ ID NO: 7341580 - DNA, 22 bp, Homo sapiens
agcacattgatttattttggag

SEQ ID NO: 7341581 - DNA, 22 bp, Homo sapiens
agcacattcccacctgtacttc

SEQ ID NO: 7341582 - DNA, 22 bp, Homo sapiens
agcacattctgccttgctttgc

SEQ ID NO: 7341583 - DNA, 22 bp, Homo sapiens
agcacattcttgccttaacctc

SEQ ID NO: 7341584 - DNA, 22 bp, Homo sapiens
caaaataccacgacttgtttta

SEQ ID NO: 7341585 - DNA, 22 bp, Homo sapiens
agcaaagctaccaattattgag

SEQ ID NO: 7341586 - DNA, 22 bp, Homo sapiens
agcaaagcatcactccaatctg

SEQ ID NO: 7341587 - DNA, 22 bp, Homo sapiens
agcaaagccgagacagccagtg

SEQ ID NO: 7341588 - DNA, 20 bp, Homo sapiens
agcacattaaacatactcct

SEQ ID NO: 7341589 - DNA, 19 bp, Homo sapiens
agcacagtttccacatgca

SEQ ID NO: 7341590 - DNA, 22 bp, Homo sapiens
agcacagttctttctctagctg

SEQ ID NO: 7341591 - DNA, 22 bp, Homo sapiens
agcacaggtgaaacagtcaggt

SEQ ID NO: 7341592 - DNA, 22 bp, Homo sapiens
cactgcacttcagcctgggtga

SEQ ID NO: 7341593 - DNA, 22 bp, Homo sapiens
cactgctacctctgcctcccgg

SEQ ID NO: 7341594 - DNA, 22 bp, Homo sapiens
cactgcttccattgttcacctg

SEQ ID NO: 7341595 - DNA, 22 bp, Homo sapiens
cactgctcgctgcagcatggcc

SEQ ID NO: 7341596 - DNA, 22 bp, Homo sapiens
agcatacaccctaaactgctta

SEQ ID NO: 7341597 - DNA, 22 bp, Homo sapiens
agcatacagtaggtgctcagtt

SEQ ID NO: 7341598 - DNA, 22 bp, Homo sapiens
agcagggctggggcacgagcca

SEQ ID NO: 7341599 - DNA, 22 bp, Homo sapiens
agcaggctgccttccaaagcct

SEQ ID NO: 7341600 - DNA, 22 bp, Homo sapiens
agcaggggctcctccacagcca

SEQ ID NO: 7341601 - DNA, 22 bp, Homo sapiens
agcagggctttgtctctgtgaa

SEQ ID NO: 7341602 - DNA, 22 bp, Homo sapiens
agcaggggctcctccacagcca

SEQ ID NO: 7341603 - DNA, 22 bp, Homo sapiens
agcaggggtaacagaaggaaag

SEQ ID NO: 7341604 - DNA, 22 bp, Homo sapiens
agcagggggccacagtcacagc

SEQ ID NO: 7341605 - DNA, 22 bp, Homo sapiens
agcagggttccttaaggccata

SEQ ID NO: 7341606 - DNA, 22 bp, Homo sapiens
cacccaggctggagtgcagggg

SEQ ID NO: 7341607 - DNA, 22 bp, Homo sapiens
cacccaggctggagtgcagggg

SEQ ID NO: 7341608 - DNA, 22 bp, Homo sapiens
cacccaggctggagagcagtgg

SEQ ID NO: 7341609 - DNA, 22 bp, Homo sapiens
cacagtttggttttgctgtaat

SEQ ID NO: 7341610 - DNA, 22 bp, Homo sapiens
agcaggctccaggctggccatc

SEQ ID NO: 7341611 - DNA, 22 bp, Homo sapiens
cacagttgtttgttcataagaa

SEQ ID NO: 7341612 - DNA, 22 bp, Homo sapiens
cacagtttatgatctcagtgaa

SEQ ID NO: 7341613 - DNA, 22 bp, Homo sapiens
cacagtttcaataattattctt

SEQ ID NO: 7341614 - DNA, 22 bp, Homo sapiens
cacagtttctataggtcagaat

SEQ ID NO: 7341615 - DNA, 22 bp, Homo sapiens
cacagtttggtatagaagtgat

SEQ ID NO: 7341616 - DNA, 22 bp, Homo sapiens
cacagtttggtatagaagtgat

SEQ ID NO: 7341617 - DNA, 22 bp, Homo sapiens
cacagtttgggtctccggggca

SEQ ID NO: 7341618 - DNA, 22 bp, Homo sapiens
cacagtttctgaacactttgca

SEQ ID NO: 7341619 - DNA, 22 bp, Homo sapiens
cacagtttctgaacactttgca

SEQ ID NO: 7341620 - DNA, 22 bp, Homo sapiens
cacagtttgcataggaaaaaca

SEQ ID NO: 7341621 - DNA, 22 bp, Homo sapiens
agcaggcaggaaggcagcactg

SEQ ID NO: 7341622 - DNA, 22 bp, Homo sapiens
agcaggcaggaaggcagcactg

SEQ ID NO: 7341623 - DNA, 22 bp, Homo sapiens
agcaggcacgctccctgcgcga

SEQ ID NO: 7341624 - DNA, 22 bp, Homo sapiens
cacacacagttttgtattctgt

SEQ ID NO: 7341625 - DNA, 22 bp, Homo sapiens
cacacactcttcctggcaccta

SEQ ID NO: 7341626 - DNA, 22 bp, Homo sapiens
cacacactcttcctggcaccta

SEQ ID NO: 7341627 - DNA, 22 bp, Homo sapiens
cacacactgttaatgtaggagt

SEQ ID NO: 7341628 - DNA, 22 bp, Homo sapiens
cacaattttcctttaagtgtat

SEQ ID NO: 7341629 - DNA, 22 bp, Homo sapiens
cacacacagttttgtattctgt

SEQ ID NO: 7341630 - DNA, 22 bp, Homo sapiens
aacttaaacccactcatgtaga

SEQ ID NO: 7341631 - DNA, 22 bp, Homo sapiens
aacttaaacaagctcccaagtt

SEQ ID NO: 7341632 - DNA, 22 bp, Homo sapiens
aactgttttttactagaggact

SEQ ID NO: 7341633 - DNA, 22 bp, Homo sapiens
aactgttacatagttatagatc

SEQ ID NO: 7341634 - DNA, 22 bp, Homo sapiens
aactgttattattttgcatggt

SEQ ID NO: 7341635 - DNA, 22 bp, Homo sapiens
aactgtttatgtaagtatgcag

SEQ ID NO: 7341636 - DNA, 22 bp, Homo sapiens
aactgtttaccatacacagtga

SEQ ID NO: 7341637 - DNA, 22 bp, Homo sapiens
aactgtttttcacgtgtctcat

SEQ ID NO: 7341638 - DNA, 22 bp, Homo sapiens
aactgtttggaactcttccaca

SEQ ID NO: 7341639 - DNA, 22 bp, Homo sapiens
aactgtttatgtaagtatgcag

SEQ ID NO: 7341640 - DNA, 22 bp, Homo sapiens
aatgataccaaacatgtagata

SEQ ID NO: 7341641 - DNA, 22 bp, Homo sapiens
aatgatatgcaaattatcatca

SEQ ID NO: 7341642 - DNA, 22 bp, Homo sapiens
aatcatcttcatcttacacaga

SEQ ID NO: 7341643 - DNA, 22 bp, Homo sapiens
aatcatgtgggatagtctgctc

SEQ ID NO: 7341644 - DNA, 22 bp, Homo sapiens
aatcatgtactgctgtggcttt

SEQ ID NO: 7341645 - DNA, 22 bp, Homo sapiens
aatcatgtttcagatgagtttt

SEQ ID NO: 7341646 - DNA, 22 bp, Homo sapiens
aatccacacatctggcatgtga

SEQ ID NO: 7341647 - DNA, 22 bp, Homo sapiens
aactgaaacgtatttttgagat

SEQ ID NO: 7341648 - DNA, 22 bp, Homo sapiens
aactgcataatatatcatgcag

SEQ ID NO: 7341649 - DNA, 23 bp, Homo sapiens
aactaccacaactcttgagatgc

SEQ ID NO: 7341650 - DNA, 22 bp, Homo sapiens
aacggaattgtttcgtcaagca

SEQ ID NO: 7341651 - DNA, 22 bp, Homo sapiens
aactacagaaaaggtaagctct

SEQ ID NO: 7341652 - DNA, 22 bp, Homo sapiens
aaccaacataggaatgcagaga

SEQ ID NO: 7341653 - DNA, 22 bp, Homo sapiens
aataacttcatcttcaggatag

SEQ ID NO: 7341654 - DNA, 22 bp, Homo sapiens
aataacttgaagatctcttcca

SEQ ID NO: 7341655 - DNA, 22 bp, Homo sapiens
aaccaaagaaaactgtggtgag

SEQ ID NO: 7341656 - DNA, 22 bp, Homo sapiens
aacatgctatgtgtctgaatca

SEQ ID NO: 7341657 - DNA, 22 bp, Homo sapiens
aacatgctatgtgtctgaatca

SEQ ID NO: 7341658 - DNA, 18 bp, Homo sapiens
aacatgcattagaactgc

SEQ ID NO: 7341659 - DNA, 22 bp, Homo sapiens
aacatgcatgttatttatcagt

SEQ ID NO: 7341660 - DNA, 22 bp, Homo sapiens
aacatgctcttcctggctagtc

SEQ ID NO: 7341661 - DNA, 22 bp, Homo sapiens
aacatgctctggattgctgtga

SEQ ID NO: 7341662 - DNA, 22 bp, Homo sapiens
aacatgctctggattgctgtga

SEQ ID NO: 7341663 - DNA, 22 bp, Homo sapiens
aacatgctctgtttcttggatg

SEQ ID NO: 7341664 - DNA, 22 bp, Homo sapiens
aacatgctctgtttcttggatg

SEQ ID NO: 7341665 - DNA, 22 bp, Homo sapiens
aacatgctgggtgtttttgatg

SEQ ID NO: 7341666 - DNA, 22 bp, Homo sapiens
aacatgctgcctttctacgagt

SEQ ID NO: 7341667 - DNA, 22 bp, Homo sapiens
aacatgctcttcctggctagtc

SEQ ID NO: 7341668 - DNA, 22 bp, Homo sapiens
aacatgcagtgagccgatgagg

SEQ ID NO: 7341669 - DNA, 22 bp, Homo sapiens
aacatgcaggttttagggttgc

SEQ ID NO: 7341670 - DNA, 22 bp, Homo sapiens
aacatgcacatcatagctcgtg

SEQ ID NO: 7341671 - DNA, 22 bp, Homo sapiens
aacatgcatgaagaagttatat

SEQ ID NO: 7341672 - DNA, 22 bp, Homo sapiens
aacatgcatgaagaagttatat

SEQ ID NO: 7341673 - DNA, 22 bp, Homo sapiens
aacaggggattagatagcaggc

SEQ ID NO: 7341674 - DNA, 22 bp, Homo sapiens
aacaggggctggttgaaagagc

SEQ ID NO: 7341675 - DNA, 20 bp, Homo sapiens
aacagggggctgcagagggc

SEQ ID NO: 7341676 - DNA, 20 bp, Homo sapiens
aacagggggctgcagagggc

SEQ ID NO: 7341677 - DNA, 22 bp, Homo sapiens
aacaggggtgggtgctactgga

SEQ ID NO: 7341678 - DNA, 22 bp, Homo sapiens
aacaggcaggagaattctgcct

SEQ ID NO: 7341679 - DNA, 22 bp, Homo sapiens
aacaggctaaattgtccatttc

SEQ ID NO: 7341680 - DNA, 20 bp, Homo sapiens
aacagggcagaagcggagac

SEQ ID NO: 7341681 - DNA, 22 bp, Homo sapiens
aacaggcaatttaggactcttt

SEQ ID NO: 7341682 - DNA, 22 bp, Homo sapiens
aacaggaggccttccagtccag

SEQ ID NO: 7341683 - DNA, 22 bp, Homo sapiens
aacaggaattgcaggcagatct

SEQ ID NO: 7341684 - DNA, 22 bp, Homo sapiens
aacaaagtagctgctgttctta

SEQ ID NO: 7341685 - DNA, 22 bp, Homo sapiens
aacaaagtacttttcagtgctt

SEQ ID NO: 7341686 - DNA, 22 bp, Homo sapiens
aacaaacctgggtggagaaagg

SEQ ID NO: 7341687 - DNA, 22 bp, Homo sapiens
aacaaaccttccctatacgtct

SEQ ID NO: 7341688 - DNA, 22 bp, Homo sapiens
aaattgcaaaagtacttttagg

SEQ ID NO: 7341689 - DNA, 22 bp, Homo sapiens
aaattgatgttcccagttgaaa

SEQ ID NO: 7341690 - DNA, 22 bp, Homo sapiens
aaattgagacttttttcctcca

SEQ ID NO: 7341691 - DNA, 22 bp, Homo sapiens
aaattctgatttaataagtgta

SEQ ID NO: 7341692 - DNA, 19 bp, Homo sapiens
aaattctgacagtctttta

SEQ ID NO: 7341693 - DNA, 22 bp, Homo sapiens
aaattctgcaatttgacaagat

SEQ ID NO: 7341694 - DNA, 22 bp, Homo sapiens
aaattctgcaatttgacaagat

SEQ ID NO: 7341695 - DNA, 22 bp, Homo sapiens
aaattctgtcctgaatgccatt

SEQ ID NO: 7341696 - DNA, 22 bp, Homo sapiens
aaattctgtcctgaatgccatt

SEQ ID NO: 7341697 - DNA, 22 bp, Homo sapiens
aaattctgtcctgaatgccatt

SEQ ID NO: 7341698 - DNA, 22 bp, Homo sapiens
aaattctatgtcaatgtttatt

SEQ ID NO: 7341699 - DNA, 22 bp, Homo sapiens
aaatgtgtatatgaaacatgat

SEQ ID NO: 7341700 - DNA, 22 bp, Homo sapiens
aaatgtgcttgtgatcagctgt

SEQ ID NO: 7341701 - DNA, 22 bp, Homo sapiens
aaatgtgtgcacaaagacagct

SEQ ID NO: 7341702 - DNA, 22 bp, Homo sapiens
aaatgtctatctggcatattcc

SEQ ID NO: 7341703 - DNA, 19 bp, Homo sapiens
aaatgtgcactgttttcca

SEQ ID NO: 7341704 - DNA, 22 bp, Homo sapiens
aagctgaggatacatgaagcct

SEQ ID NO: 7341705 - DNA, 22 bp, Homo sapiens
aaatgttttgctcccatgtggt

SEQ ID NO: 7341706 - DNA, 22 bp, Homo sapiens
aaatgttttgctcccatgtggt

SEQ ID NO: 7341707 - DNA, 22 bp, Homo sapiens
aaatgtttaagtgtaggagcaa

SEQ ID NO: 7341708 - DNA, 22 bp, Homo sapiens
aaatgtttaagtgtaggagcaa

SEQ ID NO: 7341709 - DNA, 22 bp, Homo sapiens
aaatgtttctacttgtgagcat

SEQ ID NO: 7341710 - DNA, 22 bp, Homo sapiens
aaatgtttctacttgtgagcat

SEQ ID NO: 7341711 - DNA, 22 bp, Homo sapiens
aaatgtgtttctttgtgaatgg

SEQ ID NO: 7341712 - DNA, 22 bp, Homo sapiens
aaatgtgttcctttgctacaga

SEQ ID NO: 7341713 - DNA, 22 bp, Homo sapiens
aaatgttctactttgataatta

SEQ ID NO: 7341714 - DNA, 22 bp, Homo sapiens
aaatgttaggttgtactgagtc

SEQ ID NO: 7341715 - DNA, 22 bp, Homo sapiens
aacactgaaatgtcttaagatt

SEQ ID NO: 7341716 - DNA, 23 bp, Homo sapiens
aaggtcacagaacttagcaagcc

SEQ ID NO: 7341717 - DNA, 22 bp, Homo sapiens
aaggtcattgttgcatgttctc

SEQ ID NO: 7341718 - DNA, 22 bp, Homo sapiens
aaggtcatttaacaatttatga

SEQ ID NO: 7341719 - DNA, 22 bp, Homo sapiens
aaggtcagagtgagctgtggcc

SEQ ID NO: 7341720 - DNA, 22 bp, Homo sapiens
aaggtcatggcaaattactttt

SEQ ID NO: 7341721 - DNA, 22 bp, Homo sapiens
aaggtcattggttctgaattct

SEQ ID NO: 7341722 - DNA, 22 bp, Homo sapiens
aaggtcattttttcctctgttg

SEQ ID NO: 7341723 - DNA, 22 bp, Homo sapiens
aacactaaaggtcagttagaag

SEQ ID NO: 7341724 - DNA, 22 bp, Homo sapiens
aacaaatcttaaagtaattcaa

SEQ ID NO: 7341725 - DNA, 22 bp, Homo sapiens
aacaaatggaacacaaatcttt

SEQ ID NO: 7341726 - DNA, 23 bp, Homo sapiens
aacagccacactgctgagattca

SEQ ID NO: 7341727 - DNA, 22 bp, Homo sapiens
aagtcattggtagcttgatagg

SEQ ID NO: 7341728 - DNA, 22 bp, Homo sapiens
aagtcattctatttctctatgt

SEQ ID NO: 7341729 - DNA, 22 bp, Homo sapiens
aacaggaatgaggagaaaaggt

SEQ ID NO: 7341730 - DNA, 22 bp, Homo sapiens
aacagcttgaggaatatcatca

SEQ ID NO: 7341731 - DNA, 22 bp, Homo sapiens
aacagagctggtgactccaggt

SEQ ID NO: 7341732 - DNA, 22 bp, Homo sapiens
aacagagcttgggtcatctcat

SEQ ID NO: 7341733 - DNA, 22 bp, Homo sapiens
aacagagctgaccagtgagggc

SEQ ID NO: 7341734 - DNA, 22 bp, Homo sapiens
aacagcagggatgacatggcca

SEQ ID NO: 7341735 - DNA, 22 bp, Homo sapiens
aacagcagggacttgaatggaa

SEQ ID NO: 7341736 - DNA, 22 bp, Homo sapiens
aacagcagggggacctgctggt

SEQ ID NO: 7341737 - DNA, 22 bp, Homo sapiens
aagaatacgtatcaacaatggt

SEQ ID NO: 7341738 - DNA, 23 bp, Homo sapiens
aagaataaatgacattaaaggtg

SEQ ID NO: 7341739 - DNA, 22 bp, Homo sapiens
aagaagcagagctgtgggtgtt

SEQ ID NO: 7341740 - DNA, 22 bp, Homo sapiens
aagaataaattaagatacttag

SEQ ID NO: 7341741 - DNA, 22 bp, Homo sapiens
aattgtcttgaaagcaacactt

SEQ ID NO: 7341742 - DNA, 22 bp, Homo sapiens
aattgtcatgtttggtagataa

SEQ ID NO: 7341743 - DNA, 22 bp, Homo sapiens
aattgtgctatgattatgaaag

SEQ ID NO: 7341744 - DNA, 20 bp, Homo sapiens
aattgttgactccccagaga

SEQ ID NO: 7341745 - DNA, 22 bp, Homo sapiens
aattgttgagcataaattatcg

SEQ ID NO: 7341746 - DNA, 22 bp, Homo sapiens
aattgttgggccctaccccaga

SEQ ID NO: 7341747 - DNA, 22 bp, Homo sapiens
aattgttgggtattcctgtgac

SEQ ID NO: 7341748 - DNA, 22 bp, Homo sapiens
aattgttgtacagaataaatga

SEQ ID NO: 7341749 - DNA, 22 bp, Homo sapiens
aatttaactgagagtactttta

SEQ ID NO: 7341750 - DNA, 22 bp, Homo sapiens
aagacaggaaaagctccaggcc

SEQ ID NO: 7341751 - DNA, 22 bp, Homo sapiens
aagacaggaaaagctccaggcc

SEQ ID NO: 7341752 - DNA, 22 bp, Homo sapiens
aagacactaagctttcaggata

SEQ ID NO: 7341753 - DNA, 22 bp, Homo sapiens
aagacagatgcaacctgctagc

SEQ ID NO: 7341754 - DNA, 22 bp, Homo sapiens
aagacaccatttgacagtggca

SEQ ID NO: 7341755 - DNA, 20 bp, Homo sapiens
aagacaccagtggcagcccc

SEQ ID NO: 7341756 - DNA, 22 bp, Homo sapiens
aagacagccagctccatgggat

SEQ ID NO: 7341757 - DNA, 22 bp, Homo sapiens
aatgttttacagatcccattag

SEQ ID NO: 7341758 - DNA, 22 bp, Homo sapiens
aatgttttaaaagagattgaga

SEQ ID NO: 7341759 - DNA, 22 bp, Homo sapiens
aatgttttatagctcaagcaat

SEQ ID NO: 7341760 - DNA, 22 bp, Homo sapiens
aatgttttagattactgctggg

SEQ ID NO: 7341761 - DNA, 22 bp, Homo sapiens
aagaagcactttcctacatgtt

SEQ ID NO: 7341762 - DNA, 22 bp, Homo sapiens
aatgttttctgactgctaactt

SEQ ID NO: 7341763 - DNA, 22 bp, Homo sapiens
aatgttttgcattagttttcta

SEQ ID NO: 7341764 - DNA, 22 bp, Homo sapiens
aatgttttcattatcctaactg

SEQ ID NO: 7341765 - DNA, 22 bp, Homo sapiens
aatgttttctctgtgaacacat

SEQ ID NO: 7341766 - DNA, 22 bp, Homo sapiens
aatgttttcccagtgcagacga

SEQ ID NO: 7341767 - DNA, 22 bp, Homo sapiens
aacttattgaacattctcgaat

SEQ ID NO: 7341768 - DNA, 22 bp, Homo sapiens
aacttcatgtaatttaaaacag

SEQ ID NO: 7341769 - DNA, 22 bp, Homo sapiens
aagaaagcattagacaggcatt

SEQ ID NO: 7341770 - DNA, 22 bp, Homo sapiens
aagaaatcagaaaagcattcgt

SEQ ID NO: 7341771 - DNA, 22 bp, Homo sapiens
aagaaatattgggccttataaa

SEQ ID NO: 7341772 - DNA, 22 bp, Homo sapiens
aagagctgtatgccatatgatt

SEQ ID NO: 7341773 - DNA, 22 bp, Homo sapiens
aagagctggcccaatctgagca

SEQ ID NO: 7341774 - DNA, 22 bp, Homo sapiens
aagagctggaagtgaagataac

SEQ ID NO: 7341775 - DNA, 22 bp, Homo sapiens
aagagctggagtttgcagccct

SEQ ID NO: 7341776 - DNA, 22 bp, Homo sapiens
aagagctgattaagtcatgagg

SEQ ID NO: 7341777 - DNA, 22 bp, Homo sapiens
aagagctgcatctaagccatga

SEQ ID NO: 7341778 - DNA, 22 bp, Homo sapiens
aagagaggggttgcatggaaat

SEQ ID NO: 7341779 - DNA, 22 bp, Homo sapiens
aagagaggacatggtgaacctg

SEQ ID NO: 7341780 - DNA, 17 bp, Homo sapiens
aagagaggctgagctgg

SEQ ID NO: 7341781 - DNA, 17 bp, Homo sapiens
aagagaggctgagctgg

SEQ ID NO: 7341782 - DNA, 22 bp, Homo sapiens
acaaggacgtcacttccacggt

SEQ ID NO: 7341783 - DNA, 20 bp, Homo sapiens
acaaagactggaaaagcaag

SEQ ID NO: 7341784 - DNA, 22 bp, Homo sapiens
aagacatacagacagtgagcca

SEQ ID NO: 7341785 - DNA, 22 bp, Homo sapiens
acaaagctagagaagagaattg

SEQ ID NO: 7341786 - DNA, 22 bp, Homo sapiens
aagagagaacacagcttgggca

SEQ ID NO: 7341787 - DNA, 22 bp, Homo sapiens
aagagagaacacagcttgggca

SEQ ID NO: 7341788 - DNA, 22 bp, Homo sapiens
acagagtatctatcaggagtat

SEQ ID NO: 7341789 - DNA, 22 bp, Homo sapiens
acagagtaggtgctcagtaaat

SEQ ID NO: 7341790 - DNA, 22 bp, Homo sapiens
acagagtagctcaagaagattg

SEQ ID NO: 7341791 - DNA, 22 bp, Homo sapiens
acagagtacattcagagactat

SEQ ID NO: 7341792 - DNA, 22 bp, Homo sapiens
acagagtacattcagagactat

SEQ ID NO: 7341793 - DNA, 20 bp, Homo sapiens
acagagtagaacatatgcca

SEQ ID NO: 7341794 - DNA, 22 bp, Homo sapiens
acagagtaaatccaagaacgct

SEQ ID NO: 7341795 - DNA, 22 bp, Homo sapiens
aagcagcctcatttgtggtaag

SEQ ID NO: 7341796 - DNA, 19 bp, Homo sapiens
aagcagccctggcaagagc

SEQ ID NO: 7341797 - DNA, 22 bp, Homo sapiens
aagcagcctggacttgggctgg

SEQ ID NO: 7341798 - DNA, 22 bp, Homo sapiens
aagcagcctggcatgatgcttt

SEQ ID NO: 7341799 - DNA, 22 bp, Homo sapiens
aagcagccactggccagttata

SEQ ID NO: 7341800 - DNA, 22 bp, Homo sapiens
aagcagccagccatcatgcccg

SEQ ID NO: 7341801 - DNA, 22 bp, Homo sapiens
aagcagccagccatcatgcccg

SEQ ID NO: 7341802 - DNA, 22 bp, Homo sapiens
aagcagccacctcatctccact

SEQ ID NO: 7341803 - DNA, 22 bp, Homo sapiens
aagcagccactggccagttata

SEQ ID NO: 7341804 - DNA, 22 bp, Homo sapiens
aagcagcatgattgtaatacta

SEQ ID NO: 7341805 - DNA, 22 bp, Homo sapiens
acagaattatcaggaaatgtta

SEQ ID NO: 7341806 - DNA, 22 bp, Homo sapiens
aagccaatcgtgtgaacttagt

SEQ ID NO: 7341807 - DNA, 22 bp, Homo sapiens
aagccaggagcgaggcctcggc

SEQ ID NO: 7341808 - DNA, 22 bp, Homo sapiens
aagccaggcatgcttggacagt

SEQ ID NO: 7341809 - DNA, 22 bp, Homo sapiens
acagcagcttgcgtgtctggtc

SEQ ID NO: 7341810 - DNA, 22 bp, Homo sapiens
acagcagcttcctgactgtact

SEQ ID NO: 7341811 - DNA, 22 bp, Homo sapiens
acagcagctgggttcccaccat

SEQ ID NO: 7341812 - DNA, 22 bp, Homo sapiens
acagcagctgggttcccaccat

SEQ ID NO: 7341813 - DNA, 22 bp, Homo sapiens
acagcagcttcctgactgtact

SEQ ID NO: 7341814 - DNA, 22 bp, Homo sapiens
acagcagcttcctgactgtact

SEQ ID NO: 7341815 - DNA, 22 bp, Homo sapiens
aagcatttgtgaaattcagatg

SEQ ID NO: 7341816 - DNA, 22 bp, Homo sapiens
aagcatttctgtttatctatcg

SEQ ID NO: 7341817 - DNA, 22 bp, Homo sapiens
aagcatttcaggtagagatatt

SEQ ID NO: 7341818 - DNA, 22 bp, Homo sapiens
aagcatggtttctgacgtcatg

SEQ ID NO: 7341819 - DNA, 22 bp, Homo sapiens
aagcattgtaagcagaagatgc

SEQ ID NO: 7341820 - DNA, 17 bp, Homo sapiens
aagcatttaatttgcta

SEQ ID NO: 7341821 - DNA, 22 bp, Homo sapiens
aagcatttcaatataatattca

SEQ ID NO: 7341822 - DNA, 22 bp, Homo sapiens
aagatttactagcataatagct

SEQ ID NO: 7341823 - DNA, 18 bp, Homo sapiens
aagaggctgttctgtggg

SEQ ID NO: 7341824 - DNA, 22 bp, Homo sapiens
aagaggcttatagtcttcctgt

SEQ ID NO: 7341825 - DNA, 22 bp, Homo sapiens
aagaggcttcagatccttcaga

SEQ ID NO: 7341826 - DNA, 22 bp, Homo sapiens
aagaggctggaggatactgcgc

SEQ ID NO: 7341827 - DNA, 22 bp, Homo sapiens
aagaggctagccggctcactaa

SEQ ID NO: 7341828 - DNA, 22 bp, Homo sapiens
aagaggcctggaggcagaggtg

SEQ ID NO: 7341829 - DNA, 22 bp, Homo sapiens
aagaggccttggtctgacctga

SEQ ID NO: 7341830 - DNA, 22 bp, Homo sapiens
acacaggggctcggctgggtgc

SEQ ID NO: 7341831 - DNA, 22 bp, Homo sapiens
acacaggggctcggctgggtgc

SEQ ID NO: 7341832 - DNA, 22 bp, Homo sapiens
acacaggggctcggctgggtgc

SEQ ID NO: 7341833 - DNA, 22 bp, Homo sapiens
acacagggtctagagttaggcc

SEQ ID NO: 7341834 - DNA, 22 bp, Homo sapiens
acacagggggcattctaggagt

SEQ ID NO: 7341835 - DNA, 22 bp, Homo sapiens
acacaggggaaagtggagctga

SEQ ID NO: 7341836 - DNA, 19 bp, Homo sapiens
acacagggctagagttaca

SEQ ID NO: 7341837 - DNA, 22 bp, Homo sapiens
acacaggggaaagtggagctga

SEQ ID NO: 7341838 - DNA, 22 bp, Homo sapiens
acacagtaggccaccatgtcat

SEQ ID NO: 7341839 - DNA, 22 bp, Homo sapiens
acacagtaggccaccatgtcat

SEQ ID NO: 7341840 - DNA, 22 bp, Homo sapiens
acacagtagtttgtcattgcta

SEQ ID NO: 7341841 - DNA, 22 bp, Homo sapiens
aagaggccccccagcaggtgaa

SEQ ID NO: 7341842 - DNA, 22 bp, Homo sapiens
aagatttctgcttttggaggca

SEQ ID NO: 7341843 - DNA, 22 bp, Homo sapiens
aagatttctgctcctgagagaa

SEQ ID NO: 7341844 - DNA, 22 bp, Homo sapiens
aagatttctgctcctgagagaa

SEQ ID NO: 7341845 - DNA, 22 bp, Homo sapiens
aagatttctctcctggaaagca

SEQ ID NO: 7341846 - DNA, 22 bp, Homo sapiens
aagatttcttacttattgatgc

SEQ ID NO: 7341847 - DNA, 22 bp, Homo sapiens
aagatttcttacttattgatgc

SEQ ID NO: 7341848 - DNA, 17 bp, Homo sapiens
aagatttcattagctga

SEQ ID NO: 7341849 - DNA, 22 bp, Homo sapiens
aagatttcagagtttgggggaa

SEQ ID NO: 7341850 - DNA, 22 bp, Homo sapiens
aagatttccatttctagctcat

SEQ ID NO: 7341851 - DNA, 22 bp, Homo sapiens
aagatttcctggatgtaattcc

SEQ ID NO: 7341852 - DNA, 22 bp, Homo sapiens
aagatttccttcagtagagcta

SEQ ID NO: 7341853 - DNA, 22 bp, Homo sapiens
aagatttactttctttgtaata

SEQ ID NO: 7341854 - DNA, 22 bp, Homo sapiens
aagatttattagatgcttacct

SEQ ID NO: 7341855 - DNA, 19 bp, Homo sapiens
acactgggagaagactgct

SEQ ID NO: 7341856 - DNA, 22 bp, Homo sapiens
aagcacagtgggcagagcagcc

SEQ ID NO: 7341857 - DNA, 22 bp, Homo sapiens
aagcacagggactttaggaata

SEQ ID NO: 7341858 - DNA, 22 bp, Homo sapiens
aagcacaggggaaataagttgt

SEQ ID NO: 7341859 - DNA, 22 bp, Homo sapiens
aagcacaggagacgcacagcca

SEQ ID NO: 7341860 - DNA, 22 bp, Homo sapiens
aagcacagaaaaggagcatgga

SEQ ID NO: 7341861 - DNA, 22 bp, Homo sapiens
acactgggttacctgtactatt

SEQ ID NO: 7341862 - DNA, 22 bp, Homo sapiens
aagcacaggatcttgaggagcg

SEQ ID NO: 7341863 - DNA, 22 bp, Homo sapiens
aaatgcatcagctcataagaga

SEQ ID NO: 7341864 - DNA, 22 bp, Homo sapiens
aaatgcatatcaaagacttgaa

SEQ ID NO: 7341865 - DNA, 21 bp, Homo sapiens
aaatgcaggctctttgttttc

SEQ ID NO: 7341866 - DNA, 22 bp, Homo sapiens
aaatgcaggaaattatgctttt

SEQ ID NO: 7341867 - DNA, 22 bp, Homo sapiens
aaatgcaggattaacagctttg

SEQ ID NO: 7341868 - DNA, 22 bp, Homo sapiens
aagcacagctggaacagcagga

SEQ ID NO: 7341869 - DNA, 22 bp, Homo sapiens
aagcacagattgctgcatccat

SEQ ID NO: 7341870 - DNA, 22 bp, Homo sapiens
aaatctaggctcatcctggtcc

SEQ ID NO: 7341871 - DNA, 22 bp, Homo sapiens
aaatctcaaaggcttagcatct

SEQ ID NO: 7341872 - DNA, 22 bp, Homo sapiens
aagcacagataaaacaggattc

SEQ ID NO: 7341873 - DNA, 22 bp, Homo sapiens
aagcacagagaggtaaagtaac

SEQ ID NO: 7341874 - DNA, 22 bp, Homo sapiens
aaatctcaaaggcttagcatct

SEQ ID NO: 7341875 - DNA, 22 bp, Homo sapiens
aaatgtcaaagacgtgtttttg

SEQ ID NO: 7341876 - DNA, 22 bp, Homo sapiens
aagctcttttacaatcctaggc

SEQ ID NO: 7341877 - DNA, 22 bp, Homo sapiens
aaatgtactgatacttatttta

SEQ ID NO: 7341878 - DNA, 22 bp, Homo sapiens
aaatgtaccttgatagtttggt

SEQ ID NO: 7341879 - DNA, 22 bp, Homo sapiens
aaatgtaccttgatagtttggt

SEQ ID NO: 7341880 - DNA, 18 bp, Homo sapiens
aaatgtactgtccatggc

SEQ ID NO: 7341881 - DNA, 22 bp, Homo sapiens
aaatgtactgatacttatttta

SEQ ID NO: 7341882 - DNA, 21 bp, Homo sapiens
aagcatcctctcaggagctgt

SEQ ID NO: 7341883 - DNA, 22 bp, Homo sapiens
aagcatcttaaaaagtatcaga

SEQ ID NO: 7341884 - DNA, 22 bp, Homo sapiens
aagcatgcagactacccctagg

SEQ ID NO: 7341885 - DNA, 22 bp, Homo sapiens
aaatgtacaacatccatatata

SEQ ID NO: 7341886 - DNA, 22 bp, Homo sapiens
aaatgtacactttgcatcttga

SEQ ID NO: 7341887 - DNA, 22 bp, Homo sapiens
aaatagcagcctttagttaaca

SEQ ID NO: 7341888 - DNA, 22 bp, Homo sapiens
aaatagctgtatttaccctgta

SEQ ID NO: 7341889 - DNA, 22 bp, Homo sapiens
aaatagctgaaagttcctagat

SEQ ID NO: 7341890 - DNA, 22 bp, Homo sapiens
aaatccagtttgtcatttccca

SEQ ID NO: 7341891 - DNA, 22 bp, Homo sapiens
aaatcagtaaatgttcattaac

SEQ ID NO: 7341892 - DNA, 22 bp, Homo sapiens
aaatccatcaaatcttctagaa

SEQ ID NO: 7341893 - DNA, 22 bp, Homo sapiens
aaatcccagatagtaatgtatt

SEQ ID NO: 7341894 - DNA, 22 bp, Homo sapiens
aaatcccactcagaaactgcca

SEQ ID NO: 7341895 - DNA, 23 bp, Homo sapiens
aaataggagtatctggatcatga

SEQ ID NO: 7341896 - DNA, 22 bp, Homo sapiens
aaatcagatgcttcctagttgg

SEQ ID NO: 7341897 - DNA, 22 bp, Homo sapiens
aaatagatttctctgggtttgt

SEQ ID NO: 7341898 - DNA, 22 bp, Homo sapiens
aaatactgtagataatagagtt

SEQ ID NO: 7341899 - DNA, 22 bp, Homo sapiens
aaatactgtagataatagagtt

SEQ ID NO: 7341900 - DNA, 22 bp, Homo sapiens
aaataattgagttggtcaatat

SEQ ID NO: 7341901 - DNA, 22 bp, Homo sapiens
aaataagaggacagatgtttgg

SEQ ID NO: 7341902 - DNA, 22 bp, Homo sapiens
aaataagcacttaactgtatca

SEQ ID NO: 7341903 - DNA, 22 bp, Homo sapiens
aaataactttctgtgtatagtc

SEQ ID NO: 7341904 - DNA, 22 bp, Homo sapiens
aaataagaaattcttctttgca

SEQ ID NO: 7341905 - DNA, 22 bp, Homo sapiens
aaagtcacatagcatcacttct

SEQ ID NO: 7341906 - DNA, 22 bp, Homo sapiens
aaagtgcagtaacttgcccaag

SEQ ID NO: 7341907 - DNA, 22 bp, Homo sapiens
aaagtgctggtattacaggtgt

SEQ ID NO: 7341908 - DNA, 22 bp, Homo sapiens
aaagtgcttctctttggtgggt

SEQ ID NO: 7341909 - DNA, 23 bp, Homo sapiens
aaagtgcttggcacgacacctgg

SEQ ID NO: 7341910 - DNA, 22 bp, Homo sapiens
aaagtatatttacttactgtga

SEQ ID NO: 7341911 - DNA, 22 bp, Homo sapiens
aaagtatatttacttactgtga

SEQ ID NO: 7341912 - DNA, 22 bp, Homo sapiens
aaaggaagatctatacacccca

SEQ ID NO: 7341913 - DNA, 22 bp, Homo sapiens
aaaggaagattgagcttttcca

SEQ ID NO: 7341914 - DNA, 22 bp, Homo sapiens
aaaggtttccgagctttaattt

SEQ ID NO: 7341915 - DNA, 22 bp, Homo sapiens
aaaggttttcatcacagcaaga

SEQ ID NO: 7341916 - DNA, 22 bp, Homo sapiens
aactaaaagtgtgtctcttgta

SEQ ID NO: 7341917 - DNA, 22 bp, Homo sapiens
aaagtagaacattttcttatct

SEQ ID NO: 7341918 - DNA, 22 bp, Homo sapiens
aaagtaattgtggtttctgtca

SEQ ID NO: 7341919 - DNA, 22 bp, Homo sapiens
aacaaacaaacattttgtcatc

SEQ ID NO: 7341920 - DNA, 22 bp, Homo sapiens
aaattttcctggtaaagatgga

SEQ ID NO: 7341921 - DNA, 22 bp, Homo sapiens
aaattttcctggtaaagatgga

SEQ ID NO: 7341922 - DNA, 22 bp, Homo sapiens
aaattttctctctaagacttaa

SEQ ID NO: 7341923 - DNA, 22 bp, Homo sapiens
aaattttgtattctagttctag

SEQ ID NO: 7341924 - DNA, 22 bp, Homo sapiens
aaagatatgtctccaaagagat

SEQ ID NO: 7341925 - DNA, 23 bp, Homo sapiens
aaagatcaaagtggcaggcctgt

SEQ ID NO: 7341926 - DNA, 22 bp, Homo sapiens
aaagccagttcttagagaaagc

SEQ ID NO: 7341927 - DNA, 22 bp, Homo sapiens
aacagcaatagcactattcatt

SEQ ID NO: 7341928 - DNA, 22 bp, Homo sapiens
aacagcaatagcactattcatt

SEQ ID NO: 7341929 - DNA, 22 bp, Homo sapiens
aacagcagaaactgcaagctac

SEQ ID NO: 7341930 - DNA, 22 bp, Homo sapiens
aacagcagcaagtaagcaggtc

SEQ ID NO: 7341931 - DNA, 22 bp, Homo sapiens
aacagcagcatgacagctgggt

SEQ ID NO: 7341932 - DNA, 22 bp, Homo sapiens
aaagctggcttttacaggggct

SEQ ID NO: 7341933 - DNA, 22 bp, Homo sapiens
aaagctgctttaaacatctatg

SEQ ID NO: 7341934 - DNA, 22 bp, Homo sapiens
aaagctgctatgaacattctat

SEQ ID NO: 7341935 - DNA, 22 bp, Homo sapiens
aaagctcttttccaagtattga

SEQ ID NO: 7341936 - DNA, 22 bp, Homo sapiens
aaaatgaagcaaaggcattcag

SEQ ID NO: 7341937 - DNA, 22 bp, Homo sapiens
aaaatgaacagaacaatgggga

SEQ ID NO: 7341938 - DNA, 23 bp, Homo sapiens
aaaatcttctgcctatgaagaaa

SEQ ID NO: 7341939 - DNA, 22 bp, Homo sapiens
aaaatctggtaatttgaatgtg

SEQ ID NO: 7341940 - DNA, 22 bp, Homo sapiens
aaaatcttgtgacttaggaagg

SEQ ID NO: 7341941 - DNA, 20 bp, Homo sapiens
aaaaacagtaatgctgaaga

SEQ ID NO: 7341942 - DNA, 22 bp, Homo sapiens
aaaaaattccattctgtgcctt

SEQ ID NO: 7341943 - DNA, 22 bp, Homo sapiens
aaaaaattatcatagttcctga

SEQ ID NO: 7341944 - DNA, 22 bp, Homo sapiens
aaaaaatcagatctttggttaa

SEQ ID NO: 7341945 - DNA, 22 bp, Homo sapiens
aaaaaagattgatggtggatgc

SEQ ID NO: 7341946 - DNA, 22 bp, Homo sapiens
aaacagaagggtaggtaaacat

SEQ ID NO: 7341947 - DNA, 22 bp, Homo sapiens
aaacagaaatttcctcatgctc

SEQ ID NO: 7341948 - DNA, 22 bp, Homo sapiens
aaaagacaggtgtctgcggccc

SEQ ID NO: 7341949 - DNA, 22 bp, Homo sapiens
aaaagacatatgtgggcattct

SEQ ID NO: 7341950 - DNA, 22 bp, Homo sapiens
aaaagacatctatttcaggcag

SEQ ID NO: 7341951 - DNA, 21 bp, Homo sapiens
aaacagagctgagtaatagat

SEQ ID NO: 7341952 - DNA, 22 bp, Homo sapiens
aaaaatagaaggattgactgag

SEQ ID NO: 7341953 - DNA, 22 bp, Homo sapiens
aaaatgaataagttaacccagg

SEQ ID NO: 7341954 - DNA, 22 bp, Homo sapiens
aaaaatagcttctcttgtccct

SEQ ID NO: 7341955 - DNA, 22 bp, Homo sapiens
aaaaatcacttttataggcagc

SEQ ID NO: 7341956 - DNA, 22 bp, Homo sapiens
aaaaatcacttttataggcagc

SEQ ID NO: 7341957 - DNA, 22 bp, Homo sapiens
aaaaatctatgactgcttctcc

SEQ ID NO: 7341958 - DNA, 22 bp, Homo sapiens
aaactcatgccattaatccttt

SEQ ID NO: 7341959 - DNA, 22 bp, Homo sapiens
aaactcagaaggtacagaaggg

SEQ ID NO: 7341960 - DNA, 22 bp, Homo sapiens
aaactatccctgccataatttt

SEQ ID NO: 7341961 - DNA, 22 bp, Homo sapiens
aaacccagagactagaaagacc

SEQ ID NO: 7341962 - DNA, 22 bp, Homo sapiens
aaactagattaccactgctaga

SEQ ID NO: 7341963 - DNA, 22 bp, Homo sapiens
aaaatccacaacgctcatttca

SEQ ID NO: 7341964 - DNA, 22 bp, Homo sapiens
aaaatcagtacactttattttg

SEQ ID NO: 7341965 - DNA, 22 bp, Homo sapiens
aaagaccatgtttacagctagg

SEQ ID NO: 7341966 - DNA, 22 bp, Homo sapiens
aaagaccatgtttacagctagg

SEQ ID NO: 7341967 - DNA, 22 bp, Homo sapiens
aaaatctgcttccttttacaga

SEQ ID NO: 7341968 - DNA, 22 bp, Homo sapiens
aaaatctaagtagcgagtaagg

SEQ ID NO: 7341969 - DNA, 20 bp, Homo sapiens
aaaatctcccagaaacttat

SEQ ID NO: 7341970 - DNA, 22 bp, Homo sapiens
aaaatctcattatcaggaaggg

SEQ ID NO: 7341971 - DNA, 23 bp, Homo sapiens
aaacaagccctaatgaagagtcc

SEQ ID NO: 7341972 - DNA, 22 bp, Homo sapiens
aaacaagcaagcacataatttt

SEQ ID NO: 7341973 - DNA, 22 bp, Homo sapiens
aaacaagcaagcacataatttt

SEQ ID NO: 7341974 - DNA, 22 bp, Homo sapiens
aaacaagtttagaataatgaat

SEQ ID NO: 7341975 - DNA, 22 bp, Homo sapiens
aaacaagtttagaataatgaat

SEQ ID NO: 7341976 - DNA, 22 bp, Homo sapiens
aaactgaattcaagtatccagt

SEQ ID NO: 7341977 - DNA, 22 bp, Homo sapiens
aaactgaattcccaagggcatg

SEQ ID NO: 7341978 - DNA, 21 bp, Homo sapiens
aaactgaccttgcctgagaca

SEQ ID NO: 7341979 - DNA, 22 bp, Homo sapiens
aaactgataaaataagtacatt

SEQ ID NO: 7341980 - DNA, 22 bp, Homo sapiens
aaactgataaaataagtacatt

SEQ ID NO: 7341981 - DNA, 22 bp, Homo sapiens
aaactgattttaacattgatat

SEQ ID NO: 7341982 - DNA, 22 bp, Homo sapiens
aaactgattttaacattgatat

SEQ ID NO: 7341983 - DNA, 22 bp, Homo sapiens
aaactgatgctcagagaggggc

SEQ ID NO: 7341984 - DNA, 22 bp, Homo sapiens
aaagaactaatgtgcaaggttt

SEQ ID NO: 7341985 - DNA, 22 bp, Homo sapiens
aaagagggacaggcgcagacac

SEQ ID NO: 7341986 - DNA, 22 bp, Homo sapiens
aaattaagagtaactctgtaga

SEQ ID NO: 7341987 - DNA, 22 bp, Homo sapiens
aaattaagagtaactctgtaga

SEQ ID NO: 7341988 - DNA, 22 bp, Homo sapiens
aaagagttgttgtataacagga

SEQ ID NO: 7341989 - DNA, 22 bp, Homo sapiens
aaagagttctgtttgagctgaa

SEQ ID NO: 7341990 - DNA, 22 bp, Homo sapiens
aaagagttgaaaactaacagtg

SEQ ID NO: 7341991 - DNA, 22 bp, Homo sapiens
aaattagaaatactttcaaagc

SEQ ID NO: 7341992 - DNA, 20 bp, Homo sapiens
aaattactgccacacatttc

SEQ ID NO: 7341993 - DNA, 22 bp, Homo sapiens
aaattaagggtgagaagagttg

SEQ ID NO: 7341994 - DNA, 22 bp, Homo sapiens
aaagaggatggagtagtcagct

SEQ ID NO: 7341995 - DNA, 22 bp, Homo sapiens
aaagaggaaccaagagcacgtg

SEQ ID NO: 7341996 - DNA, 22 bp, Homo sapiens
aaagagcatggaaagttcagga

SEQ ID NO: 7341997 - DNA, 22 bp, Homo sapiens
aaatgcagacagcttcacacac

SEQ ID NO: 7341998 - DNA, 22 bp, Homo sapiens
aaatgcagaatgatttcatcta

SEQ ID NO: 7341999 - DNA, 22 bp, Homo sapiens
aaagacacaaatgtagaccaaa

SEQ ID NO: 7342000 - DNA, 22 bp, Homo sapiens
aaacccagggttttgtcttccc

SEQ ID NO: 7342001 - DNA, 22 bp, Homo sapiens
aaacattgtacattctgtagct

SEQ ID NO: 7342002 - DNA, 22 bp, Homo sapiens
aaactagatgattatgaagcat

SEQ ID NO: 7342003 - DNA, 22 bp, Homo sapiens
aaaggtcagctgccatcgttct

SEQ ID NO: 7342004 - DNA, 22 bp, Homo sapiens
aaaggtcattgaaaaggaggaa

SEQ ID NO: 7342005 - DNA, 22 bp, Homo sapiens
aaaggtcaagctggactcaggt

SEQ ID NO: 7342006 - DNA, 22 bp, Homo sapiens
aaaggtcagacttaggctgggc

SEQ ID NO: 7342007 - DNA, 22 bp, Homo sapiens
aaaggtcaaaatcgtgacattg

SEQ ID NO: 7342008 - DNA, 22 bp, Homo sapiens
aaaggtagtacttctagaaggg

SEQ ID NO: 7342009 - DNA, 22 bp, Homo sapiens
aaacaatgttgtctccaagagg

SEQ ID NO: 7342010 - DNA, 22 bp, Homo sapiens
aaacacaagaggcagggtacag

SEQ ID NO: 7342011 - DNA, 22 bp, Homo sapiens
aaacaatgtacatttataatgc

SEQ ID NO: 7342012 - DNA, 22 bp, Homo sapiens
aaacaatgtacatttataatgc

SEQ ID NO: 7342013 - DNA, 17 bp, Homo sapiens
aaacaatgcagacaagc

SEQ ID NO: 7342014 - DNA, 22 bp, Homo sapiens
aaacaatgtacacatgaatgtt

SEQ ID NO: 7342015 - DNA, 22 bp, Homo sapiens
aaacaatgacaacacagctgcg

SEQ ID NO: 7342016 - DNA, 22 bp, Homo sapiens
aaacaatgagcttttacacact

SEQ ID NO: 7342017 - DNA, 22 bp, Homo sapiens
aaacaatgagcttttacacact

SEQ ID NO: 7342018 - DNA, 17 bp, Homo sapiens
aaacaatgcagacaagc

SEQ ID NO: 7342019 - DNA, 19 bp, Homo sapiens
aatgactgagtacattgtc

SEQ ID NO: 7342020 - DNA, 19 bp, Homo sapiens
aatgactgagtacattgtc

SEQ ID NO: 7342021 - DNA, 22 bp, Homo sapiens
aatgaccagcgcctgcagaggg

SEQ ID NO: 7342022 - DNA, 20 bp, Homo sapiens
agaaatactttggtataatg

SEQ ID NO: 7342023 - DNA, 22 bp, Homo sapiens
aatgaatgtttgttgagtgaag

SEQ ID NO: 7342024 - DNA, 22 bp, Homo sapiens
aatgaatgtgattaacttcaag

SEQ ID NO: 7342025 - DNA, 22 bp, Homo sapiens
aatgagaatgtaagtgaagaga

SEQ ID NO: 7342026 - DNA, 22 bp, Homo sapiens
aatgagaaccttgaaaggaact

SEQ ID NO: 7342027 - DNA, 22 bp, Homo sapiens
aatgagaaaacacagaggaggt

SEQ ID NO: 7342028 - DNA, 22 bp, Homo sapiens
aatgagaaaacacagaggaggt

SEQ ID NO: 7342029 - DNA, 23 bp, Homo sapiens
aatgagagaccatgtggagcaga

SEQ ID NO: 7342030 - DNA, 22 bp, Homo sapiens
agaaaacataggagacaggaaa

SEQ ID NO: 7342031 - DNA, 22 bp, Homo sapiens
agaaaacataggagacaggaaa

SEQ ID NO: 7342032 - DNA, 22 bp, Homo sapiens
agaaaacataggagacaggaaa

SEQ ID NO: 7342033 - DNA, 22 bp, Homo sapiens
agaaaactctacatctgtatgt

SEQ ID NO: 7342034 - DNA, 22 bp, Homo sapiens
aatgaacacatgtggtcagttt

SEQ ID NO: 7342035 - DNA, 22 bp, Homo sapiens
aatgaacaagagagagaacttt

SEQ ID NO: 7342036 - DNA, 22 bp, Homo sapiens
aatgaacaagaaagactttgag

SEQ ID NO: 7342037 - DNA, 22 bp, Homo sapiens
aatgaaactcgaaataatcaca

SEQ ID NO: 7342038 - DNA, 22 bp, Homo sapiens
agaaatacaaagtactaagata

SEQ ID NO: 7342039 - DNA, 23 bp, Homo sapiens
aatgaactgagaatctgtacagt

SEQ ID NO: 7342040 - DNA, 22 bp, Homo sapiens
aatgaactggagaacaatgacc

SEQ ID NO: 7342041 - DNA, 22 bp, Homo sapiens
aatgaacatataaagagatctt

SEQ ID NO: 7342042 - DNA, 22 bp, Homo sapiens
aatgaacagtgggtgaggtacc

SEQ ID NO: 7342043 - DNA, 22 bp, Homo sapiens
aatgaacatggacaagttaata

SEQ ID NO: 7342044 - DNA, 22 bp, Homo sapiens
aatgaacatataaagagatctt

SEQ ID NO: 7342045 - DNA, 22 bp, Homo sapiens
aatgaacatcaaatgcctacca

SEQ ID NO: 7342046 - DNA, 22 bp, Homo sapiens
aatgaactccgaacatttacat

SEQ ID NO: 7342047 - DNA, 22 bp, Homo sapiens
acttcttttcaaatcatgcaaa

SEQ ID NO: 7342048 - DNA, 21 bp, Homo sapiens
aatacagaaatgagtagttgc

SEQ ID NO: 7342049 - DNA, 22 bp, Homo sapiens
aatacagagaatgttatttgga

SEQ ID NO: 7342050 - DNA, 22 bp, Homo sapiens
aatacaatcaaattcactagca

SEQ ID NO: 7342051 - DNA, 22 bp, Homo sapiens
acttgaattatatttctagaga

SEQ ID NO: 7342052 - DNA, 22 bp, Homo sapiens
acttgaaaggaagctctaaaac

SEQ ID NO: 7342053 - DNA, 19 bp, Homo sapiens
acttgaaagcagagagttt

SEQ ID NO: 7342054 - DNA, 22 bp, Homo sapiens
acttgaaagaagtttccttaaa

SEQ ID NO: 7342055 - DNA, 22 bp, Homo sapiens
aatatatgactccactgcatga

SEQ ID NO: 7342056 - DNA, 22 bp, Homo sapiens
aatatatgagggagctatttga

SEQ ID NO: 7342057 - DNA, 22 bp, Homo sapiens
acttgagaaaccaagtagaaag

SEQ ID NO: 7342058 - DNA, 22 bp, Homo sapiens
acttgagagaatcggaggagtc

SEQ ID NO: 7342059 - DNA, 22 bp, Homo sapiens
aatatcagaatgtaatggtcct

SEQ ID NO: 7342060 - DNA, 23 bp, Homo sapiens
aatatatgtgtttttctgcttca

SEQ ID NO: 7342061 - DNA, 22 bp, Homo sapiens
aatccagctgtgtcacaggtga

SEQ ID NO: 7342062 - DNA, 22 bp, Homo sapiens
aatccagcacatggacacagtc

SEQ ID NO: 7342063 - DNA, 22 bp, Homo sapiens
aatcataattgtatacattcat

SEQ ID NO: 7342064 - DNA, 22 bp, Homo sapiens
acttgtttggtctcatgtttaa

SEQ ID NO: 7342065 - DNA, 22 bp, Homo sapiens
acttgtttctattgattccagt

SEQ ID NO: 7342066 - DNA, 22 bp, Homo sapiens
actgcctgtttggcatggcccc

SEQ ID NO: 7342067 - DNA, 22 bp, Homo sapiens
aataatattcctctgtgtgcgt

SEQ ID NO: 7342068 - DNA, 22 bp, Homo sapiens
actgcgctccagcctgggtgac

SEQ ID NO: 7342069 - DNA, 22 bp, Homo sapiens
aataatgtttatttgtattctc

SEQ ID NO: 7342070 - DNA, 22 bp, Homo sapiens
aataatgtgtgctgcagtctta

SEQ ID NO: 7342071 - DNA, 22 bp, Homo sapiens
aataattagtgggacagagaac

SEQ ID NO: 7342072 - DNA, 22 bp, Homo sapiens
aataatttccagccaactggaa

SEQ ID NO: 7342073 - DNA, 22 bp, Homo sapiens
aataattgtcaactatgctaca

SEQ ID NO: 7342074 - DNA, 22 bp, Homo sapiens
aataattatttgagagcagacc

SEQ ID NO: 7342075 - DNA, 22 bp, Homo sapiens
aataattttgagagcctggaaa

SEQ ID NO: 7342076 - DNA, 22 bp, Homo sapiens
aataattttagctcagagttgt

SEQ ID NO: 7342077 - DNA, 22 bp, Homo sapiens
aagtttcatgtggaggtagact

SEQ ID NO: 7342078 - DNA, 22 bp, Homo sapiens
aagtttcattgttcatgtaaca

SEQ ID NO: 7342079 - DNA, 22 bp, Homo sapiens
aagtttctattattacattcgt

SEQ ID NO: 7342080 - DNA, 22 bp, Homo sapiens
aagtttcaaatataaaattaca

SEQ ID NO: 7342081 - DNA, 22 bp, Homo sapiens
aataacttcagttcttacatta

SEQ ID NO: 7342082 - DNA, 22 bp, Homo sapiens
aataagaattgccagatttgaa

SEQ ID NO: 7342083 - DNA, 22 bp, Homo sapiens
aagttgtagatgaagtaattca

SEQ ID NO: 7342084 - DNA, 22 bp, Homo sapiens
aagttggtcgcaattagtcaca

SEQ ID NO: 7342085 - DNA, 22 bp, Homo sapiens
aagtttatgttggtaagatatc

SEQ ID NO: 7342086 - DNA, 20 bp, Homo sapiens
actccaggtggcatgaggac

SEQ ID NO: 7342087 - DNA, 20 bp, Homo sapiens
actccaggtggcatgaggac

SEQ ID NO: 7342088 - DNA, 22 bp, Homo sapiens
actccaggtgtgttggactcta

SEQ ID NO: 7342089 - DNA, 22 bp, Homo sapiens
actccaggttttttcactgaag

SEQ ID NO: 7342090 - DNA, 22 bp, Homo sapiens
aagtgttttctccccaccaggc

SEQ ID NO: 7342091 - DNA, 22 bp, Homo sapiens
actaattgctttcttgtgctga

SEQ ID NO: 7342092 - DNA, 22 bp, Homo sapiens
actaattggaacactttttgcc

SEQ ID NO: 7342093 - DNA, 22 bp, Homo sapiens
actaaggaatatgacaaactca

SEQ ID NO: 7342094 - DNA, 22 bp, Homo sapiens
aagtcacagctaaatagctaag

SEQ ID NO: 7342095 - DNA, 22 bp, Homo sapiens
aagtcacagctaaatagctaag

SEQ ID NO: 7342096 - DNA, 22 bp, Homo sapiens
aagtcactgttttagttttctc

SEQ ID NO: 7342097 - DNA, 22 bp, Homo sapiens
aagtcactgtgaaaggtgaagc

SEQ ID NO: 7342098 - DNA, 22 bp, Homo sapiens
aagtcactgtgaaaggtgaagc

SEQ ID NO: 7342099 - DNA, 22 bp, Homo sapiens
aagtcacttcttaggaaaggag

SEQ ID NO: 7342100 - DNA, 20 bp, Homo sapiens
aagtcacttaagatgggcag

SEQ ID NO: 7342101 - DNA, 19 bp, Homo sapiens
aagtcacttgagggcagga

SEQ ID NO: 7342102 - DNA, 22 bp, Homo sapiens
aagtcactgaaagggcagaaag

SEQ ID NO: 7342103 - DNA, 22 bp, Homo sapiens
aagtcactttcccattccttgc

SEQ ID NO: 7342104 - DNA, 22 bp, Homo sapiens
aagtcaggcttctcccagagcc

SEQ ID NO: 7342105 - DNA, 22 bp, Homo sapiens
aagtgctttaaaatttcctgag

SEQ ID NO: 7342106 - DNA, 21 bp, Homo sapiens
aagtggagaagaaaagctgga

SEQ ID NO: 7342107 - DNA, 22 bp, Homo sapiens
aagtggagccagggaaactgaa

SEQ ID NO: 7342108 - DNA, 22 bp, Homo sapiens
acagttgttttccagatatgtt

SEQ ID NO: 7342109 - DNA, 22 bp, Homo sapiens
acagttggttaacacaaatatt

SEQ ID NO: 7342110 - DNA, 22 bp, Homo sapiens
acagttgaggacttaaacaaaa

SEQ ID NO: 7342111 - DNA, 18 bp, Homo sapiens
aaggcagtatgattgcac

SEQ ID NO: 7342112 - DNA, 22 bp, Homo sapiens
aaggcagtaaaatctaccttgc

SEQ ID NO: 7342113 - DNA, 22 bp, Homo sapiens
aaggaagaaatgaataggtgga

SEQ ID NO: 7342114 - DNA, 22 bp, Homo sapiens
aaggaacttgccacagaaaaga

SEQ ID NO: 7342115 - DNA, 22 bp, Homo sapiens
aaggaactgatgctcaaagaat

SEQ ID NO: 7342116 - DNA, 22 bp, Homo sapiens
aaggcactacgctgctggggcg

SEQ ID NO: 7342117 - DNA, 22 bp, Homo sapiens
aaggcacttgcccagagctgca

SEQ ID NO: 7342118 - DNA, 22 bp, Homo sapiens
aaggcacttttctaaagacctt

SEQ ID NO: 7342119 - DNA, 22 bp, Homo sapiens
aaggcacttttcctgagatgat

SEQ ID NO: 7342120 - DNA, 22 bp, Homo sapiens
aaggcagaaagggatgtgagtg

SEQ ID NO: 7342121 - DNA, 21 bp, Homo sapiens
aaggcagaagcatggaatgag

SEQ ID NO: 7342122 - DNA, 22 bp, Homo sapiens
acagtagctaatattgcattat

SEQ ID NO: 7342123 - DNA, 22 bp, Homo sapiens
acagtagctaatattgcattat

SEQ ID NO: 7342124 - DNA, 22 bp, Homo sapiens
acagtagagtaaaagggagcct

SEQ ID NO: 7342125 - DNA, 22 bp, Homo sapiens
acagtactgagtactgagttgg

SEQ ID NO: 7342126 - DNA, 22 bp, Homo sapiens
acagtatagggcttatattgta

SEQ ID NO: 7342127 - DNA, 22 bp, Homo sapiens
aaggaaattaggttattttgct

SEQ ID NO: 7342128 - DNA, 22 bp, Homo sapiens
aagccagggtttgtggatctat

SEQ ID NO: 7342129 - DNA, 22 bp, Homo sapiens
aagccaggtgtttaggccagcg

SEQ ID NO: 7342130 - DNA, 22 bp, Homo sapiens
aagccaggccattctctggttc

SEQ ID NO: 7342131 - DNA, 22 bp, Homo sapiens
aagccagggattcctgagggag

SEQ ID NO: 7342132 - DNA, 22 bp, Homo sapiens
aagccaggctgcacttgctggg

SEQ ID NO: 7342133 - DNA, 22 bp, Homo sapiens
aagccaggggctgcttaggaga

SEQ ID NO: 7342134 - DNA, 22 bp, Homo sapiens
acaggcaggttgagaaacattt

SEQ ID NO: 7342135 - DNA, 22 bp, Homo sapiens
acaggcaggttgagaaacattt

SEQ ID NO: 7342136 - DNA, 22 bp, Homo sapiens
acagggctcctaggtggtgtgc

SEQ ID NO: 7342137 - DNA, 22 bp, Homo sapiens
acagggctcctaggtggtgtgc

SEQ ID NO: 7342138 - DNA, 22 bp, Homo sapiens
acagggctctgacaccaaggta

SEQ ID NO: 7342139 - DNA, 22 bp, Homo sapiens
acagggctccttgggctgacac

SEQ ID NO: 7342140 - DNA, 22 bp, Homo sapiens
acagggctcgtcgggccctcgg

SEQ ID NO: 7342141 - DNA, 19 bp, Homo sapiens
acagggctctggacgccat

SEQ ID NO: 7342142 - DNA, 19 bp, Homo sapiens
acagggctctggacgccat

SEQ ID NO: 7342143 - DNA, 22 bp, Homo sapiens
acagtacagctgaaactttagt

SEQ ID NO: 7342144 - DNA, 23 bp, Homo sapiens
acagggctgtccagggctaggtc

SEQ ID NO: 7342145 - DNA, 23 bp, Homo sapiens
acagggctgtccagggctaggtc

SEQ ID NO: 7342146 - DNA, 22 bp, Homo sapiens
acagtacagctgaaactttagt

SEQ ID NO: 7342147 - DNA, 22 bp, Homo sapiens
aaggaaagacatataaatgact

SEQ ID NO: 7342148 - DNA, 22 bp, Homo sapiens
aaggaaatacaacatgtattca

SEQ ID NO: 7342149 - DNA, 22 bp, Homo sapiens
accccccagataatcccttgag

SEQ ID NO: 7342150 - DNA, 22 bp, Homo sapiens
aagtacatttttaacttacagc

SEQ ID NO: 7342151 - DNA, 22 bp, Homo sapiens
aagtaccattcaaatgcaaata

SEQ ID NO: 7342152 - DNA, 22 bp, Homo sapiens
aagtaccaagtttgtttgacgc

SEQ ID NO: 7342153 - DNA, 23 bp, Homo sapiens
aagtacatatatttagatagtga

SEQ ID NO: 7342154 - DNA, 22 bp, Homo sapiens
aagtacagagcctcagtttgac

SEQ ID NO: 7342155 - DNA, 22 bp, Homo sapiens
aagtacagaatcattggaagca

SEQ ID NO: 7342156 - DNA, 22 bp, Homo sapiens
aagtacatgttgttcaaaagcc

SEQ ID NO: 7342157 - DNA, 22 bp, Homo sapiens
aaggtggggtcctgtcatctga

SEQ ID NO: 7342158 - DNA, 22 bp, Homo sapiens
accatcagtcattgtcagtggg

SEQ ID NO: 7342159 - DNA, 22 bp, Homo sapiens
accatgaggaaatacatttgtg

SEQ ID NO: 7342160 - DNA, 22 bp, Homo sapiens
accatgagttatttgacaggcc

SEQ ID NO: 7342161 - DNA, 22 bp, Homo sapiens
accatgaggaaatacatttgtg

SEQ ID NO: 7342162 - DNA, 22 bp, Homo sapiens
accatgccagtggcagccagac

SEQ ID NO: 7342163 - DNA, 22 bp, Homo sapiens
accatgctaaaacatgctgcta

SEQ ID NO: 7342164 - DNA, 22 bp, Homo sapiens
aaggtagggatgtattcagctt

SEQ ID NO: 7342165 - DNA, 22 bp, Homo sapiens
aaggtgaggattttgttctgct

SEQ ID NO: 7342166 - DNA, 22 bp, Homo sapiens
aaggtgaggattttgttctgct

SEQ ID NO: 7342167 - DNA, 22 bp, Homo sapiens
aaggtgagagggaaattttcca

SEQ ID NO: 7342168 - DNA, 17 bp, Homo sapiens
aaggtgagagctgttct

SEQ ID NO: 7342169 - DNA, 22 bp, Homo sapiens
aaggcatggcagggtttacaca

SEQ ID NO: 7342170 - DNA, 22 bp, Homo sapiens
aagggaaatcctcagcccagga

SEQ ID NO: 7342171 - DNA, 22 bp, Homo sapiens
aagggaaatggccaggcagaga

SEQ ID NO: 7342172 - DNA, 22 bp, Homo sapiens
aagggaagtttgcatcctcact

SEQ ID NO: 7342173 - DNA, 22 bp, Homo sapiens
aagggaaatcatatggtgcagt

SEQ ID NO: 7342174 - DNA, 22 bp, Homo sapiens
aagggaaactttcacaatgtcc

SEQ ID NO: 7342175 - DNA, 22 bp, Homo sapiens
aagggaaaatagttgatgacca

SEQ ID NO: 7342176 - DNA, 22 bp, Homo sapiens
aagggcctttcaaaggtgatta

SEQ ID NO: 7342177 - DNA, 22 bp, Homo sapiens
aagggcccttctgttagtggca

SEQ ID NO: 7342178 - DNA, 22 bp, Homo sapiens
aagggcccattctctcagaaaa

SEQ ID NO: 7342179 - DNA, 22 bp, Homo sapiens
aagggcccggctgtgggcagag

SEQ ID NO: 7342180 - DNA, 22 bp, Homo sapiens
aagggcccagccaagctatgct

SEQ ID NO: 7342181 - DNA, 22 bp, Homo sapiens
aagggccacatgccatttaaaa

SEQ ID NO: 7342182 - DNA, 22 bp, Homo sapiens
aagggccaagctcttctcccat

SEQ ID NO: 7342183 - DNA, 22 bp, Homo sapiens
aagggccacttactcctgctgt

SEQ ID NO: 7342184 - DNA, 22 bp, Homo sapiens
aagggccacatttgggtccctg

SEQ ID NO: 7342185 - DNA, 22 bp, Homo sapiens
aagggccagtagaattttagtg

SEQ ID NO: 7342186 - DNA, 22 bp, Homo sapiens
aagggccagggcagggttgtga

SEQ ID NO: 7342187 - DNA, 22 bp, Homo sapiens
aagggccagggctctagagata

SEQ ID NO: 7342188 - DNA, 22 bp, Homo sapiens
aagggccattgctgagagcagt

SEQ ID NO: 7342189 - DNA, 22 bp, Homo sapiens
aagggccattgctgagagcagt

SEQ ID NO: 7342190 - DNA, 22 bp, Homo sapiens
aagggccatgcctctactttct

SEQ ID NO: 7342191 - DNA, 22 bp, Homo sapiens
aagggccatcttggactcccca

SEQ ID NO: 7342192 - DNA, 22 bp, Homo sapiens
aagggccatcccagaacagaaa

SEQ ID NO: 7342193 - DNA, 22 bp, Homo sapiens
aagggccataacttgcagtgtt

SEQ ID NO: 7342194 - DNA, 22 bp, Homo sapiens
aatgttcaaaagcatcagtgaa

SEQ ID NO: 7342195 - DNA, 22 bp, Homo sapiens
aatgttcaaacagatcacttag

SEQ ID NO: 7342196 - DNA, 22 bp, Homo sapiens
aatgttcagaggacaatataaa

SEQ ID NO: 7342197 - DNA, 20 bp, Homo sapiens
aatgttcagtaattgtttta

SEQ ID NO: 7342198 - DNA, 22 bp, Homo sapiens
aatgttgcagagtgattgtcca

SEQ ID NO: 7342199 - DNA, 22 bp, Homo sapiens
aatgttcctatttaccccctaa

SEQ ID NO: 7342200 - DNA, 22 bp, Homo sapiens
aatgttgtatggtgccttcaga

SEQ ID NO: 7342201 - DNA, 22 bp, Homo sapiens
aatgttgttctctgcaaacaca

SEQ ID NO: 7342202 - DNA, 19 bp, Homo sapiens
aatgtttaagagaaaaagg

SEQ ID NO: 7342203 - DNA, 22 bp, Homo sapiens
aatgtttgaccaaaaaactgca

SEQ ID NO: 7342204 - DNA, 22 bp, Homo sapiens
aatgtttgaccaaaaaactgca

SEQ ID NO: 7342205 - DNA, 22 bp, Homo sapiens
aatgtttgaactttgcatattt

SEQ ID NO: 7342206 - DNA, 22 bp, Homo sapiens
aatgtttgcatctattcacatg

SEQ ID NO: 7342207 - DNA, 22 bp, Homo sapiens
aatgtttgcatctattcacatg

SEQ ID NO: 7342208 - DNA, 22 bp, Homo sapiens
aatgtttgcatctattcacatg

SEQ ID NO: 7342209 - DNA, 22 bp, Homo sapiens
aatgtttgaccaaaaaactgca

SEQ ID NO: 7342210 - DNA, 22 bp, Homo sapiens
aatgtttgagcatctacatgct

SEQ ID NO: 7342211 - DNA, 22 bp, Homo sapiens
aatgtttgagcatctacatgct

SEQ ID NO: 7342212 - DNA, 22 bp, Homo sapiens
aatgtttggctagatagatgga

SEQ ID NO: 7342213 - DNA, 22 bp, Homo sapiens
aattactgatctacaaaatcca

SEQ ID NO: 7342214 - DNA, 22 bp, Homo sapiens
aattaggcaaattaatttctct

SEQ ID NO: 7342215 - DNA, 22 bp, Homo sapiens
aatttacagttgctgatggtac

SEQ ID NO: 7342216 - DNA, 22 bp, Homo sapiens
aatttacagttgctgatggtac

SEQ ID NO: 7342217 - DNA, 20 bp, Homo sapiens
aatttactcacagaatgaat

SEQ ID NO: 7342218 - DNA, 20 bp, Homo sapiens
aatttactcacagaatgaat

SEQ ID NO: 7342219 - DNA, 20 bp, Homo sapiens
aatttactcacagaatgaat

SEQ ID NO: 7342220 - DNA, 23 bp, Homo sapiens
aatttagtttgagacattagcct

SEQ ID NO: 7342221 - DNA, 22 bp, Homo sapiens
aatttataataaatagggcttt

SEQ ID NO: 7342222 - DNA, 22 bp, Homo sapiens
aatttagtccttacagtgcaga

SEQ ID NO: 7342223 - DNA, 22 bp, Homo sapiens
aatttagtgtaaagctactgga

SEQ ID NO: 7342224 - DNA, 21 bp, Homo sapiens
aatttagtcaacagactgtgg

SEQ ID NO: 7342225 - DNA, 22 bp, Homo sapiens
agagctgggacttggactcaat

SEQ ID NO: 7342226 - DNA, 22 bp, Homo sapiens
aatttatatgtaattaggcaca

SEQ ID NO: 7342227 - DNA, 22 bp, Homo sapiens
aattatcagatataaaactgca

SEQ ID NO: 7342228 - DNA, 22 bp, Homo sapiens
aattatgtagccatatgaaaca

SEQ ID NO: 7342229 - DNA, 22 bp, Homo sapiens
aattatatgttaatcttcaatt

SEQ ID NO: 7342230 - DNA, 22 bp, Homo sapiens
aattatacattgaacaatctag

SEQ ID NO: 7342231 - DNA, 21 bp, Homo sapiens
agacagagtgcagtctacata

SEQ ID NO: 7342232 - DNA, 19 bp, Homo sapiens
agacagagctcagtgggtt

SEQ ID NO: 7342233 - DNA, 22 bp, Homo sapiens
agacagcagaaactagagcact

SEQ ID NO: 7342234 - DNA, 22 bp, Homo sapiens
agacagcagaaactagagcact

SEQ ID NO: 7342235 - DNA, 22 bp, Homo sapiens
agacaggctgctgtctgctagg

SEQ ID NO: 7342236 - DNA, 23 bp, Homo sapiens
agacactgtaaagaattgcagtt

SEQ ID NO: 7342237 - DNA, 19 bp, Homo sapiens
agacagagactgaaataga

SEQ ID NO: 7342238 - DNA, 22 bp, Homo sapiens
agaagggctacacgggctctcc

SEQ ID NO: 7342239 - DNA, 22 bp, Homo sapiens
agaagggccagctggacacctg

SEQ ID NO: 7342240 - DNA, 22 bp, Homo sapiens
agaaggggagaagctaccagga

SEQ ID NO: 7342241 - DNA, 22 bp, Homo sapiens
agaaggggcccaaggatgtcag

SEQ ID NO: 7342242 - DNA, 22 bp, Homo sapiens
agaaggtggctactcagtcatc

SEQ ID NO: 7342243 - DNA, 23 bp, Homo sapiens
agaaggtgggcctgctgagttat

SEQ ID NO: 7342244 - DNA, 23 bp, Homo sapiens
agaagggtccttggcagcgacag

SEQ ID NO: 7342245 - DNA, 22 bp, Homo sapiens
agaagtataaagaatgtttatg

SEQ ID NO: 7342246 - DNA, 22 bp, Homo sapiens
agaagtatcttgggaaggcact

SEQ ID NO: 7342247 - DNA, 22 bp, Homo sapiens
agaagtataactatttgctttc

SEQ ID NO: 7342248 - DNA, 22 bp, Homo sapiens
agaagtatcaggaagattctca

SEQ ID NO: 7342249 - DNA, 22 bp, Homo sapiens
agaagtatgtgagaaattatcc

SEQ ID NO: 7342250 - DNA, 22 bp, Homo sapiens
agaagtattctgcatgtactga

SEQ ID NO: 7342251 - DNA, 22 bp, Homo sapiens
aatgcaaacttcttgttacttg

SEQ ID NO: 7342252 - DNA, 22 bp, Homo sapiens
aatgtgttcagttaaatgaact

SEQ ID NO: 7342253 - DNA, 22 bp, Homo sapiens
aatgtctgctctactcaggagg

SEQ ID NO: 7342254 - DNA, 22 bp, Homo sapiens
aatgtctgtgccttaaaacttc

SEQ ID NO: 7342255 - DNA, 22 bp, Homo sapiens
aatgtctgaggctcatctgagg

SEQ ID NO: 7342256 - DNA, 22 bp, Homo sapiens
aatgtctgaaaatcagactgca

SEQ ID NO: 7342257 - DNA, 22 bp, Homo sapiens
aatgtctgcctgaactttatat

SEQ ID NO: 7342258 - DNA, 22 bp, Homo sapiens
aatgtctgccagaactgatcat

SEQ ID NO: 7342259 - DNA, 22 bp, Homo sapiens
aatgtctgagtctctgtatccc

SEQ ID NO: 7342260 - DNA, 22 bp, Homo sapiens
aatgtctgtctgcacgttgctt

SEQ ID NO: 7342261 - DNA, 22 bp, Homo sapiens
aatgtcattggtaaagattagg

SEQ ID NO: 7342262 - DNA, 22 bp, Homo sapiens
aatgtcatttaaagacaaagaa

SEQ ID NO: 7342263 - DNA, 22 bp, Homo sapiens
aatgtcatttttaaatgtgaga

SEQ ID NO: 7342264 - DNA, 22 bp, Homo sapiens
agacagggagggagcgcggctg

SEQ ID NO: 7342265 - DNA, 22 bp, Homo sapiens
agacagggccactcatcctcac

SEQ ID NO: 7342266 - DNA, 22 bp, Homo sapiens
agacagggtcttgatcagagct

SEQ ID NO: 7342267 - DNA, 22 bp, Homo sapiens
aatgtcatgagcctgctcttgt

SEQ ID NO: 7342268 - DNA, 22 bp, Homo sapiens
aatgtcatagcatttcttcaat

SEQ ID NO: 7342269 - DNA, 22 bp, Homo sapiens
aatgtcaatctcagagaacaca

SEQ ID NO: 7342270 - DNA, 22 bp, Homo sapiens
aatgtcaattaccagaacagaa

SEQ ID NO: 7342271 - DNA, 22 bp, Homo sapiens
aatttgttacacagcaatataa

SEQ ID NO: 7342272 - DNA, 22 bp, Homo sapiens
aattttattaactggatgtagc

SEQ ID NO: 7342273 - DNA, 22 bp, Homo sapiens
aattttattagaaggcaagggg

SEQ ID NO: 7342274 - DNA, 22 bp, Homo sapiens
agagctgggtggtggtgactca

SEQ ID NO: 7342275 - DNA, 22 bp, Homo sapiens
acaaaaagggagatgaggtaga

SEQ ID NO: 7342276 - DNA, 22 bp, Homo sapiens
aattttctgcctagcaaaaact

SEQ ID NO: 7342277 - DNA, 22 bp, Homo sapiens
aattttctgcctagcaaaaact

SEQ ID NO: 7342278 - DNA, 22 bp, Homo sapiens
acaaatgattatcacagaggag

SEQ ID NO: 7342279 - DNA, 22 bp, Homo sapiens
acaaatgagaatgtagacagag

SEQ ID NO: 7342280 - DNA, 22 bp, Homo sapiens
acaaatgactatttggtacagg

SEQ ID NO: 7342281 - DNA, 22 bp, Homo sapiens
acaaaccagcttaagcaagatg

SEQ ID NO: 7342282 - DNA, 22 bp, Homo sapiens
acaagggattgttgagtagtct

SEQ ID NO: 7342283 - DNA, 22 bp, Homo sapiens
acaaatgttacataagtttgga

SEQ ID NO: 7342284 - DNA, 22 bp, Homo sapiens
acaaatgtctcctcttttgtta

SEQ ID NO: 7342285 - DNA, 22 bp, Homo sapiens
acaaatggaacaatgaagactg

SEQ ID NO: 7342286 - DNA, 22 bp, Homo sapiens
acaaggtttggtcctatatttt

SEQ ID NO: 7342287 - DNA, 22 bp, Homo sapiens
acaagttaggttttaatccaaa

SEQ ID NO: 7342288 - DNA, 22 bp, Homo sapiens
agatggggcagaatggagccat

SEQ ID NO: 7342289 - DNA, 22 bp, Homo sapiens
agcaccatcagatgcaatatct

SEQ ID NO: 7342290 - DNA, 22 bp, Homo sapiens
agcaccatcacagctgtatgtc

SEQ ID NO: 7342291 - DNA, 22 bp, Homo sapiens
agcacaggtaatacagagtaac

SEQ ID NO: 7342292 - DNA, 22 bp, Homo sapiens
agcaagcagaattctgtcctct

SEQ ID NO: 7342293 - DNA, 22 bp, Homo sapiens
acaatgttttgaaacatctagg

SEQ ID NO: 7342294 - DNA, 22 bp, Homo sapiens
acaatgtttttgttcaaagagt

SEQ ID NO: 7342295 - DNA, 22 bp, Homo sapiens
acaattctgatggtttcccagt

SEQ ID NO: 7342296 - DNA, 20 bp, Homo sapiens
agcagtgtggggagactgtg

SEQ ID NO: 7342297 - DNA, 22 bp, Homo sapiens
agcagtggtgtgaggagggctc

SEQ ID NO: 7342298 - DNA, 22 bp, Homo sapiens
acagaacaagacctgcttattg

SEQ ID NO: 7342299 - DNA, 22 bp, Homo sapiens
acagaacaagacctgcttattg

SEQ ID NO: 7342300 - DNA, 22 bp, Homo sapiens
agccacagggggtgagggacaa

SEQ ID NO: 7342301 - DNA, 22 bp, Homo sapiens
agccacaggtgttggccagtgt

SEQ ID NO: 7342302 - DNA, 22 bp, Homo sapiens
acagaaattcaaactggaattt

SEQ ID NO: 7342303 - DNA, 22 bp, Homo sapiens
acagaaattcaaactggaattt

SEQ ID NO: 7342304 - DNA, 22 bp, Homo sapiens
acagaaattgctaatagctcat

SEQ ID NO: 7342305 - DNA, 22 bp, Homo sapiens
acagaaattgctaatagctcat

SEQ ID NO: 7342306 - DNA, 22 bp, Homo sapiens
acagaaattctgggacagaaaa

SEQ ID NO: 7342307 - DNA, 22 bp, Homo sapiens
acacattttggctaggtggaga

SEQ ID NO: 7342308 - DNA, 22 bp, Homo sapiens
acaccaccgtcccagcctcctg

SEQ ID NO: 7342309 - DNA, 22 bp, Homo sapiens
acacattatctcattaaatact

SEQ ID NO: 7342310 - DNA, 23 bp, Homo sapiens
agcagggccagaatacttgctgt

SEQ ID NO: 7342311 - DNA, 22 bp, Homo sapiens
agcagggcagttaaagggtcct

SEQ ID NO: 7342312 - DNA, 22 bp, Homo sapiens
agcagggcagttaaagggtcct

SEQ ID NO: 7342313 - DNA, 22 bp, Homo sapiens
agcagggcatgaataagggttt

SEQ ID NO: 7342314 - DNA, 23 bp, Homo sapiens
acactgtctcatggatagactgc

SEQ ID NO: 7342315 - DNA, 22 bp, Homo sapiens
acactgcagatgtaatttgagt

SEQ ID NO: 7342316 - DNA, 22 bp, Homo sapiens
acactgtaaagtgatgcttaaa

SEQ ID NO: 7342317 - DNA, 22 bp, Homo sapiens
acactgtaaattgagtgcgtga

SEQ ID NO: 7342318 - DNA, 22 bp, Homo sapiens
acactgtagactgttgaagtac

SEQ ID NO: 7342319 - DNA, 19 bp, Homo sapiens
acactgtagatatagctat

SEQ ID NO: 7342320 - DNA, 22 bp, Homo sapiens
acacaggcaagagtgcaggtct

SEQ ID NO: 7342321 - DNA, 22 bp, Homo sapiens
acaattttccccataggttatc

SEQ ID NO: 7342322 - DNA, 22 bp, Homo sapiens
acaatttcttatagttcaattc

SEQ ID NO: 7342323 - DNA, 22 bp, Homo sapiens
acacagatgggtagaaaacaga

SEQ ID NO: 7342324 - DNA, 22 bp, Homo sapiens
acacagatttcactggaataga

SEQ ID NO: 7342325 - DNA, 22 bp, Homo sapiens
acacaggaagagagataataat

SEQ ID NO: 7342326 - DNA, 22 bp, Homo sapiens
acacagcaacttgcagtatgga

SEQ ID NO: 7342327 - DNA, 22 bp, Homo sapiens
agcacccttcagcccagcctgg

SEQ ID NO: 7342328 - DNA, 22 bp, Homo sapiens
agcaccatttctctaaagcact

SEQ ID NO: 7342329 - DNA, 19 bp, Homo sapiens
agcacctatctggataagg

SEQ ID NO: 7342330 - DNA, 23 bp, Homo sapiens
agcacctactccataccaggcac

SEQ ID NO: 7342331 - DNA, 22 bp, Homo sapiens
acaatttatccattgtatagtt

SEQ ID NO: 7342332 - DNA, 22 bp, Homo sapiens
acacatatgtatgcatcatgtg

SEQ ID NO: 7342333 - DNA, 22 bp, Homo sapiens
acacatatatttgcatatacac

SEQ ID NO: 7342334 - DNA, 22 bp, Homo sapiens
acacatatatttgcatatacac

SEQ ID NO: 7342335 - DNA, 23 bp, Homo sapiens
acacatatattcagatacagatg

SEQ ID NO: 7342336 - DNA, 22 bp, Homo sapiens
acacatatctaagatagatgac

SEQ ID NO: 7342337 - DNA, 22 bp, Homo sapiens
acacatatggttgctgcagtga

SEQ ID NO: 7342338 - DNA, 22 bp, Homo sapiens
acacatatgccattacagcaaa

SEQ ID NO: 7342339 - DNA, 22 bp, Homo sapiens
acacataagaaactacaaagag

SEQ ID NO: 7342340 - DNA, 22 bp, Homo sapiens
agcagcagtgacagccgaaagc

SEQ ID NO: 7342341 - DNA, 22 bp, Homo sapiens
agcagcagtacatataagacta

SEQ ID NO: 7342342 - DNA, 22 bp, Homo sapiens
acacaggcaagagtgcaggtct

SEQ ID NO: 7342343 - DNA, 21 bp, Homo sapiens
acacaggcagtgtcccgaggt

SEQ ID NO: 7342344 - DNA, 21 bp, Homo sapiens
acacaggcagtgtcccgaggt

SEQ ID NO: 7342345 - DNA, 22 bp, Homo sapiens
agccatggcgccactagaggga

SEQ ID NO: 7342346 - DNA, 22 bp, Homo sapiens
agccatggtctcagggccataa

SEQ ID NO: 7342347 - DNA, 22 bp, Homo sapiens
agccacagtcaacctgtccata

SEQ ID NO: 7342348 - DNA, 22 bp, Homo sapiens
agccacaggtgttggccagtgt

SEQ ID NO: 7342349 - DNA, 22 bp, Homo sapiens
agccacagtcaacctgtccata

SEQ ID NO: 7342350 - DNA, 22 bp, Homo sapiens
acagagaggtaaaatatatagt

SEQ ID NO: 7342351 - DNA, 22 bp, Homo sapiens
acagagcaggtccagaagtgcc

SEQ ID NO: 7342352 - DNA, 22 bp, Homo sapiens
acagagagggagtgataaatcc

SEQ ID NO: 7342353 - DNA, 22 bp, Homo sapiens
agcccagctcctccacagaata

SEQ ID NO: 7342354 - DNA, 22 bp, Homo sapiens
agcccagctgcctgcctgctgt

SEQ ID NO: 7342355 - DNA, 22 bp, Homo sapiens
agcccagcggagcgggcccggg

SEQ ID NO: 7342356 - DNA, 22 bp, Homo sapiens
agcccaaactcatggtcctttg

SEQ ID NO: 7342357 - DNA, 22 bp, Homo sapiens
agcccaaacctgcgagcagagc

SEQ ID NO: 7342358 - DNA, 22 bp, Homo sapiens
agcccccagtctaaactgttgg

SEQ ID NO: 7342359 - DNA, 22 bp, Homo sapiens
agcccccaggagtctccacgcc

SEQ ID NO: 7342360 - DNA, 22 bp, Homo sapiens
agcccccaggatgcaaaatgac

SEQ ID NO: 7342361 - DNA, 22 bp, Homo sapiens
agcccccaggagtctccacgcc

SEQ ID NO: 7342362 - DNA, 19 bp, Homo sapiens
agcccccagacagcaggcc

SEQ ID NO: 7342363 - DNA, 23 bp, Homo sapiens
agcccctcatggtgtctagacag

SEQ ID NO: 7342364 - DNA, 22 bp, Homo sapiens
acagagcatataaagtgctttg

SEQ ID NO: 7342365 - DNA, 19 bp, Homo sapiens
acagagtgatgaggataga

SEQ ID NO: 7342366 - DNA, 22 bp, Homo sapiens
acagagtggagttcagtaaata

SEQ ID NO: 7342367 - DNA, 22 bp, Homo sapiens
acagataaggcagttaagagtt

SEQ ID NO: 7342368 - DNA, 22 bp, Homo sapiens
acagataaaagttgtttaaaat

SEQ ID NO: 7342369 - DNA, 19 bp, Homo sapiens
agctcctgttcagcagctc

SEQ ID NO: 7342370 - DNA, 22 bp, Homo sapiens
agctcctgttctgagagcagga

SEQ ID NO: 7342371 - DNA, 22 bp, Homo sapiens
agctcctgttctgagagcagga

SEQ ID NO: 7342372 - DNA, 22 bp, Homo sapiens
agctctggggcctgtcccacat

SEQ ID NO: 7342373 - DNA, 18 bp, Homo sapiens
agctctggggagatgggc

SEQ ID NO: 7342374 - DNA, 22 bp, Homo sapiens
agctctgggggaaagtctgctc

SEQ ID NO: 7342375 - DNA, 22 bp, Homo sapiens
acagcaggatttggcgatgttg

SEQ ID NO: 7342376 - DNA, 22 bp, Homo sapiens
agctcctgtgtgcccacctgct

SEQ ID NO: 7342377 - DNA, 22 bp, Homo sapiens
agctatttctcttattatatcc

SEQ ID NO: 7342378 - DNA, 22 bp, Homo sapiens
agctatttctcttattatatcc

SEQ ID NO: 7342379 - DNA, 22 bp, Homo sapiens
agctcaagcgtgggctgggcgc

SEQ ID NO: 7342380 - DNA, 22 bp, Homo sapiens
agctcaagcgtgggctgggcgc

SEQ ID NO: 7342381 - DNA, 22 bp, Homo sapiens
acagcaaaggacgaacactctg

SEQ ID NO: 7342382 - DNA, 22 bp, Homo sapiens
agcctgcaggatgggcagcacc

SEQ ID NO: 7342383 - DNA, 22 bp, Homo sapiens
acagcaatcaatatggcattct

SEQ ID NO: 7342384 - DNA, 22 bp, Homo sapiens
acagcaatctgagagacatagt

SEQ ID NO: 7342385 - DNA, 22 bp, Homo sapiens
acagcaatctgagagacatagt

SEQ ID NO: 7342386 - DNA, 23 bp, Homo sapiens
acagcaagaggaccagatgtgag

SEQ ID NO: 7342387 - DNA, 23 bp, Homo sapiens
acagcaagaggaccagatgtgag

SEQ ID NO: 7342388 - DNA, 22 bp, Homo sapiens
agctatgctgcagttgtggagt

SEQ ID NO: 7342389 - DNA, 22 bp, Homo sapiens
agctatgtgtgcagggacagga

SEQ ID NO: 7342390 - DNA, 22 bp, Homo sapiens
tactagaatgccactgttagtg

SEQ ID NO: 7342391 - DNA, 22 bp, Homo sapiens
tactagttctcatatgaaataa

SEQ ID NO: 7342392 - DNA, 22 bp, Homo sapiens
tactagaaattaccttctcact

SEQ ID NO: 7342393 - DNA, 22 bp, Homo sapiens
tactagtttctaccttacagaa

SEQ ID NO: 7342394 - DNA, 22 bp, Homo sapiens
tactatctagctctttgcagag

SEQ ID NO: 7342395 - DNA, 22 bp, Homo sapiens
tactatgtgaaaatactatagt

SEQ ID NO: 7342396 - DNA, 22 bp, Homo sapiens
tactacagtatgtgtgttatac

SEQ ID NO: 7342397 - DNA, 22 bp, Homo sapiens
taccatttcagtaaaaacttag

SEQ ID NO: 7342398 - DNA, 20 bp, Homo sapiens
taccatcatatgcatttaat

SEQ ID NO: 7342399 - DNA, 22 bp, Homo sapiens
taccagggaacagggatattaa

SEQ ID NO: 7342400 - DNA, 22 bp, Homo sapiens
taccagggaacagggatattaa

SEQ ID NO: 7342401 - DNA, 22 bp, Homo sapiens
tacttaaaaattatcaaagtgg

SEQ ID NO: 7342402 - DNA, 22 bp, Homo sapiens
tactgttttttagactcatggt

SEQ ID NO: 7342403 - DNA, 22 bp, Homo sapiens
tactgttttctttacaccatgt

SEQ ID NO: 7342404 - DNA, 22 bp, Homo sapiens
tactgtttcctgaagcagatgc

SEQ ID NO: 7342405 - DNA, 22 bp, Homo sapiens
tactgttatatatagcagcagt

SEQ ID NO: 7342406 - DNA, 22 bp, Homo sapiens
tacttaaataattgctgctatt

SEQ ID NO: 7342407 - DNA, 22 bp, Homo sapiens
tacttaaaactgatagaatctc

SEQ ID NO: 7342408 - DNA, 22 bp, Homo sapiens
tactgtactcaacatgtgagtt

SEQ ID NO: 7342409 - DNA, 22 bp, Homo sapiens
tactgttaatgttaaattcagg

SEQ ID NO: 7342410 - DNA, 22 bp, Homo sapiens
tactgtgttgtgctgaaaggga

SEQ ID NO: 7342411 - DNA, 22 bp, Homo sapiens
tactgtgttgtgctgaaaggga

SEQ ID NO: 7342412 - DNA, 22 bp, Homo sapiens
tactgtgtggtgagctgtctcc

SEQ ID NO: 7342413 - DNA, 22 bp, Homo sapiens
tactgtgtgaccctgggtaggt

SEQ ID NO: 7342414 - DNA, 22 bp, Homo sapiens
tactgtgtgaccctgggtaggt

SEQ ID NO: 7342415 - DNA, 22 bp, Homo sapiens
tactgtgtcttaggatgtggaa

SEQ ID NO: 7342416 - DNA, 22 bp, Homo sapiens
tactgtgtgcccagccgagctg

SEQ ID NO: 7342417 - DNA, 22 bp, Homo sapiens
tactgtgtgattccatttacgt

SEQ ID NO: 7342418 - DNA, 22 bp, Homo sapiens
tactctgccactaggagttctg

SEQ ID NO: 7342419 - DNA, 22 bp, Homo sapiens
tacatgcttccaactgccccat

SEQ ID NO: 7342420 - DNA, 22 bp, Homo sapiens
tacatgcttctatatgtgaagt

SEQ ID NO: 7342421 - DNA, 22 bp, Homo sapiens
tacatgcttaaaatgcaatgtt

SEQ ID NO: 7342422 - DNA, 22 bp, Homo sapiens
tacatgctccttatgagaatct

SEQ ID NO: 7342423 - DNA, 22 bp, Homo sapiens
tacatgctcttcaaggactcat

SEQ ID NO: 7342424 - DNA, 19 bp, Homo sapiens
tacatgctcttggttcagg

SEQ ID NO: 7342425 - DNA, 22 bp, Homo sapiens
tacatgctggtgactgtagaca

SEQ ID NO: 7342426 - DNA, 22 bp, Homo sapiens
tacatggttggcccattcttct

SEQ ID NO: 7342427 - DNA, 22 bp, Homo sapiens
tacatgcattggatggcaatag

SEQ ID NO: 7342428 - DNA, 22 bp, Homo sapiens
tacatgctccactttctcctgt

SEQ ID NO: 7342429 - DNA, 22 bp, Homo sapiens
tacatgctcagtaactttcagt

SEQ ID NO: 7342430 - DNA, 23 bp, Homo sapiens
tacatgctataatttcaccctca

SEQ ID NO: 7342431 - DNA, 22 bp, Homo sapiens
taccaagagttcttgcctgttt

SEQ ID NO: 7342432 - DNA, 22 bp, Homo sapiens
tacatgtaggtgacattttaat

SEQ ID NO: 7342433 - DNA, 22 bp, Homo sapiens
tacatgtaattttcatagtaag

SEQ ID NO: 7342434 - DNA, 22 bp, Homo sapiens
tacatgaagatgaatgtatggc

SEQ ID NO: 7342435 - DNA, 22 bp, Homo sapiens
tacatgacctagacttgctaaa

SEQ ID NO: 7342436 - DNA, 22 bp, Homo sapiens
tacatgcaaggatatttgtgcg

SEQ ID NO: 7342437 - DNA, 22 bp, Homo sapiens
tacatgcaatgaggattctagt

SEQ ID NO: 7342438 - DNA, 22 bp, Homo sapiens
tacatgcacatgaacatgtgtg

SEQ ID NO: 7342439 - DNA, 19 bp, Homo sapiens
tacatgcacatgtgcgtgc

SEQ ID NO: 7342440 - DNA, 18 bp, Homo sapiens
tacatgcataaatgaagc

SEQ ID NO: 7342441 - DNA, 22 bp, Homo sapiens
tacatgcatacttgtgtgtgta

SEQ ID NO: 7342442 - DNA, 22 bp, Homo sapiens
tacatgcatgtcacagaatgaa

SEQ ID NO: 7342443 - DNA, 22 bp, Homo sapiens
tacagtatttgaagaatatgag

SEQ ID NO: 7342444 - DNA, 20 bp, Homo sapiens
tacagtgtatgtatttaggc

SEQ ID NO: 7342445 - DNA, 22 bp, Homo sapiens
tacagtgctttttggtggagaa

SEQ ID NO: 7342446 - DNA, 22 bp, Homo sapiens
tacagtgcttggtatctagtaa

SEQ ID NO: 7342447 - DNA, 22 bp, Homo sapiens
tacagtgcatagaggcatgata

SEQ ID NO: 7342448 - DNA, 22 bp, Homo sapiens
tacagtgcgggtgcgggcctct

SEQ ID NO: 7342449 - DNA, 22 bp, Homo sapiens
tacagtgcgatttttaggcctc

SEQ ID NO: 7342450 - DNA, 22 bp, Homo sapiens
tacagtgcttggtatctagtaa

SEQ ID NO: 7342451 - DNA, 22 bp, Homo sapiens
tacagtgctagaacctgctgta

SEQ ID NO: 7342452 - DNA, 22 bp, Homo sapiens
tacagtgcttggtatctagtaa

SEQ ID NO: 7342453 - DNA, 22 bp, Homo sapiens
tacagtgcacatttcttaggaa

SEQ ID NO: 7342454 - DNA, 22 bp, Homo sapiens
tacagtgcaatgtgatgtagat

SEQ ID NO: 7342455 - DNA, 22 bp, Homo sapiens
tacagtaggattttcagggtct

SEQ ID NO: 7342456 - DNA, 22 bp, Homo sapiens
tacagagtaatttgcatgggga

SEQ ID NO: 7342457 - DNA, 22 bp, Homo sapiens
tacagacagtttttcagatatt

SEQ ID NO: 7342458 - DNA, 22 bp, Homo sapiens
tacagagatactctagatcaaa

SEQ ID NO: 7342459 - DNA, 22 bp, Homo sapiens
tacagagagtacagcatccaca

SEQ ID NO: 7342460 - DNA, 22 bp, Homo sapiens
tacagagatttattgctaaggc

SEQ ID NO: 7342461 - DNA, 22 bp, Homo sapiens
tacagagatgccgaagagtgaa

SEQ ID NO: 7342462 - DNA, 22 bp, Homo sapiens
tacagagatgtgaaaagctcta

SEQ ID NO: 7342463 - DNA, 22 bp, Homo sapiens
tacagagatgccgaagagtgaa

SEQ ID NO: 7342464 - DNA, 22 bp, Homo sapiens
taattgcagggtgtcagaatac

SEQ ID NO: 7342465 - DNA, 23 bp, Homo sapiens
taattcacatatacattgcttca

SEQ ID NO: 7342466 - DNA, 22 bp, Homo sapiens
taattcagtcattaatcttagc

SEQ ID NO: 7342467 - DNA, 22 bp, Homo sapiens
taattatttgaagacattagag

SEQ ID NO: 7342468 - DNA, 22 bp, Homo sapiens
taattattgtctgaagagttat

SEQ ID NO: 7342469 - DNA, 22 bp, Homo sapiens
taatgaacaatatatcaatagc

SEQ ID NO: 7342470 - DNA, 22 bp, Homo sapiens
taaggagagaatttagaggttt

SEQ ID NO: 7342471 - DNA, 22 bp, Homo sapiens
taatataccaaactgtaatttt

SEQ ID NO: 7342472 - DNA, 22 bp, Homo sapiens
taatatacttcccatagtttga

SEQ ID NO: 7342473 - DNA, 22 bp, Homo sapiens
taaggaaacaacttgtattttt

SEQ ID NO: 7342474 - DNA, 22 bp, Homo sapiens
taaggaaagtacatgttttgac

SEQ ID NO: 7342475 - DNA, 22 bp, Homo sapiens
taaggaagtacccattcttagg

SEQ ID NO: 7342476 - DNA, 18 bp, Homo sapiens
taaggaagggggtgaaga

SEQ ID NO: 7342477 - DNA, 22 bp, Homo sapiens
taaggaagtcacaagaatcgct

SEQ ID NO: 7342478 - DNA, 22 bp, Homo sapiens
taaggaaggggaaagacatgtc

SEQ ID NO: 7342479 - DNA, 22 bp, Homo sapiens
taaggaaggggaaagacatgtc

SEQ ID NO: 7342480 - DNA, 21 bp, Homo sapiens
taaggaagagcattttaggtc

SEQ ID NO: 7342481 - DNA, 21 bp, Homo sapiens
taaggaagagcattttaggtc

SEQ ID NO: 7342482 - DNA, 21 bp, Homo sapiens
taagccaccatgtgaaaccag

SEQ ID NO: 7342483 - DNA, 22 bp, Homo sapiens
taagccccctcaccctggcttc

SEQ ID NO: 7342484 - DNA, 22 bp, Homo sapiens
taagcattcaatgcttagcact

SEQ ID NO: 7342485 - DNA, 22 bp, Homo sapiens
taatttcaaatttcttagcgtg

SEQ ID NO: 7342486 - DNA, 22 bp, Homo sapiens
taatttcaatagcttgcataat

SEQ ID NO: 7342487 - DNA, 22 bp, Homo sapiens
taatttcaagtttagggctcta

SEQ ID NO: 7342488 - DNA, 22 bp, Homo sapiens
taatttcaaatttcttagcgtg

SEQ ID NO: 7342489 - DNA, 22 bp, Homo sapiens
tacaacattgtgttgcttcata

SEQ ID NO: 7342490 - DNA, 22 bp, Homo sapiens
tacaagaaatttctgcatatat

SEQ ID NO: 7342491 - DNA, 22 bp, Homo sapiens
tacaacttacttgaatggcttt

SEQ ID NO: 7342492 - DNA, 22 bp, Homo sapiens
tacaagaaggaaaactagcaat

SEQ ID NO: 7342493 - DNA, 22 bp, Homo sapiens
tacaagaatgtcttaaaagctc

SEQ ID NO: 7342494 - DNA, 22 bp, Homo sapiens
tacacaactgacaaccattctg

SEQ ID NO: 7342495 - DNA, 22 bp, Homo sapiens
tacagaatgttatgaagcatag

SEQ ID NO: 7342496 - DNA, 22 bp, Homo sapiens
tacagaattagattattagaga

SEQ ID NO: 7342497 - DNA, 22 bp, Homo sapiens
tacagacaaagagcatgcggta

SEQ ID NO: 7342498 - DNA, 22 bp, Homo sapiens
tacagacagtttttcagatatt

SEQ ID NO: 7342499 - DNA, 22 bp, Homo sapiens
tacagaatatagaagctggaag

SEQ ID NO: 7342500 - DNA, 22 bp, Homo sapiens
tacacatacattgcttacaagg

SEQ ID NO: 7342501 - DNA, 22 bp, Homo sapiens
tacacatacaccaatgtggtca

SEQ ID NO: 7342502 - DNA, 22 bp, Homo sapiens
tacacagttttgctcccatgat

SEQ ID NO: 7342503 - DNA, 22 bp, Homo sapiens
tacacacatgcatttgccttat

SEQ ID NO: 7342504 - DNA, 17 bp, Homo sapiens
taaagatcagccatgta

SEQ ID NO: 7342505 - DNA, 22 bp, Homo sapiens
taaagatgcccacattgcaggt

SEQ ID NO: 7342506 - DNA, 22 bp, Homo sapiens
taaagacatggtgtaggtgaac

SEQ ID NO: 7342507 - DNA, 22 bp, Homo sapiens
taaagcaaggcaaattgttggt

SEQ ID NO: 7342508 - DNA, 22 bp, Homo sapiens
taaagcaatttgagcaagttct

SEQ ID NO: 7342509 - DNA, 22 bp, Homo sapiens
taaatgcagcagtttctgttct

SEQ ID NO: 7342510 - DNA, 22 bp, Homo sapiens
taaatgcagcagtttctgttct

SEQ ID NO: 7342511 - DNA, 20 bp, Homo sapiens
taaatgcatctgttcaactg

SEQ ID NO: 7342512 - DNA, 22 bp, Homo sapiens
taaaactttgaaggtgctcagt

SEQ ID NO: 7342513 - DNA, 22 bp, Homo sapiens
taaaaggattagcaggatgggc

SEQ ID NO: 7342514 - DNA, 22 bp, Homo sapiens
taaaaggaggttgaagctgtca

SEQ ID NO: 7342515 - DNA, 22 bp, Homo sapiens
taaagacagatggaccagccat

SEQ ID NO: 7342516 - DNA, 23 bp, Homo sapiens
taaagacagccttcaggattctg

SEQ ID NO: 7342517 - DNA, 22 bp, Homo sapiens
taaagacatgcaaagtctaatt

SEQ ID NO: 7342518 - DNA, 22 bp, Homo sapiens
taaagacataggatcagggaga

SEQ ID NO: 7342519 - DNA, 20 bp, Homo sapiens
taaagacataagctactatc

SEQ ID NO: 7342520 - DNA, 22 bp, Homo sapiens
taacagtatccccatttgcaag

SEQ ID NO: 7342521 - DNA, 22 bp, Homo sapiens
taacagtgtggacttgagatct

SEQ ID NO: 7342522 - DNA, 22 bp, Homo sapiens
taacagtaaagtaagttagctt

SEQ ID NO: 7342523 - DNA, 22 bp, Homo sapiens
taacatcaaactgcattttcta

SEQ ID NO: 7342524 - DNA, 22 bp, Homo sapiens
taacatgatttgctatttagat

SEQ ID NO: 7342525 - DNA, 22 bp, Homo sapiens
taacatgagagctaagacatta

SEQ ID NO: 7342526 - DNA, 22 bp, Homo sapiens
taacaggcaaggtcacaccttg

SEQ ID NO: 7342527 - DNA, 22 bp, Homo sapiens
taaatgtttagtcttatttggg

SEQ ID NO: 7342528 - DNA, 22 bp, Homo sapiens
taaatgttttgtgggttgagtt

SEQ ID NO: 7342529 - DNA, 22 bp, Homo sapiens
taaatgttggcattggaggccg

SEQ ID NO: 7342530 - DNA, 22 bp, Homo sapiens
taaatgttgtaagtacatctaa

SEQ ID NO: 7342531 - DNA, 22 bp, Homo sapiens
taaatgttatgcccatcatcca

SEQ ID NO: 7342532 - DNA, 22 bp, Homo sapiens
taaatgttactttcctttcaca

SEQ ID NO: 7342533 - DNA, 22 bp, Homo sapiens
taaatgttactttcctttcaca

SEQ ID NO: 7342534 - DNA, 22 bp, Homo sapiens
taagagcagaacagcaacatat

SEQ ID NO: 7342535 - DNA, 22 bp, Homo sapiens
taagagaaggatctgttccagg

SEQ ID NO: 7342536 - DNA, 22 bp, Homo sapiens
taagaggatatttggccagaag

SEQ ID NO: 7342537 - DNA, 21 bp, Homo sapiens
taagcatatcagatagactct

SEQ ID NO: 7342538 - DNA, 21 bp, Homo sapiens
taagagcctaacacagaaagg

SEQ ID NO: 7342539 - DNA, 22 bp, Homo sapiens
taagacaaatactatttcaaga

SEQ ID NO: 7342540 - DNA, 22 bp, Homo sapiens
taagacagggtctattcttagt

SEQ ID NO: 7342541 - DNA, 22 bp, Homo sapiens
taacatgcagagtttagctttt

SEQ ID NO: 7342542 - DNA, 22 bp, Homo sapiens
taagacatccgttgcttataat

SEQ ID NO: 7342543 - DNA, 22 bp, Homo sapiens
taagacataaataggcttttta

SEQ ID NO: 7342544 - DNA, 21 bp, Homo sapiens
taagacagtatgaatactttc

SEQ ID NO: 7342545 - DNA, 22 bp, Homo sapiens
taagacatagccaagagcatcc

SEQ ID NO: 7342546 - DNA, 22 bp, Homo sapiens
taagacatggttgatctagtgt

SEQ ID NO: 7342547 - DNA, 22 bp, Homo sapiens
taagacatttgaaatgtgatcc

SEQ ID NO: 7342548 - DNA, 22 bp, Homo sapiens
taagacatttgacaaaccattt

SEQ ID NO: 7342549 - DNA, 22 bp, Homo sapiens
gttattgtccatttatttagca

SEQ ID NO: 7342550 - DNA, 22 bp, Homo sapiens
gttattgtccagcacagttggg

SEQ ID NO: 7342551 - DNA, 22 bp, Homo sapiens
gttatgatggccctttcctggt

SEQ ID NO: 7342552 - DNA, 22 bp, Homo sapiens
gttataggtcatgctatgtcaa

SEQ ID NO: 7342553 - DNA, 22 bp, Homo sapiens
gtgtttctggggcattcatagt

SEQ ID NO: 7342554 - DNA, 22 bp, Homo sapiens
gtgtttcctctagaagccatgg

SEQ ID NO: 7342555 - DNA, 21 bp, Homo sapiens
gtgtttcctgtttatggcttg

SEQ ID NO: 7342556 - DNA, 22 bp, Homo sapiens
gtgtttcctcacttctctgact

SEQ ID NO: 7342557 - DNA, 22 bp, Homo sapiens
gtgtttcctagtttaatgaatg

SEQ ID NO: 7342558 - DNA, 22 bp, Homo sapiens
gttaaataacctcatgtccgtt

SEQ ID NO: 7342559 - DNA, 22 bp, Homo sapiens
gtgtttgacttaggtacattaa

SEQ ID NO: 7342560 - DNA, 22 bp, Homo sapiens
gtgtttaatgcagatgtgggtg

SEQ ID NO: 7342561 - DNA, 22 bp, Homo sapiens
gtgtttccagttcagaaagcaa

SEQ ID NO: 7342562 - DNA, 22 bp, Homo sapiens
gttaaatgcactattgaaagct

SEQ ID NO: 7342563 - DNA, 22 bp, Homo sapiens
gttaaataacctcatgtccgtt

SEQ ID NO: 7342564 - DNA, 22 bp, Homo sapiens
gttaacacatgcaattgcactt

SEQ ID NO: 7342565 - DNA, 22 bp, Homo sapiens
gtgttctgggatgattgtagtg

SEQ ID NO: 7342566 - DNA, 22 bp, Homo sapiens
gtgttctctagagctgtacaaa

SEQ ID NO: 7342567 - DNA, 22 bp, Homo sapiens
gtgttccatgtttgaggtagtt

SEQ ID NO: 7342568 - DNA, 22 bp, Homo sapiens
gtgttgtggagcttgtcagggg

SEQ ID NO: 7342569 - DNA, 21 bp, Homo sapiens
gtgctgggacacagccaggct

SEQ ID NO: 7342570 - DNA, 22 bp, Homo sapiens
gtgctggctgccaggaggctgc

SEQ ID NO: 7342571 - DNA, 17 bp, Homo sapiens
gtgctggcctggggctc

SEQ ID NO: 7342572 - DNA, 22 bp, Homo sapiens
gtttatgaatgtgtcagacata

SEQ ID NO: 7342573 - DNA, 22 bp, Homo sapiens
gtttatgaatgttactatagag

SEQ ID NO: 7342574 - DNA, 22 bp, Homo sapiens
gtttatcacaataaataattct

SEQ ID NO: 7342575 - DNA, 22 bp, Homo sapiens
gtttatcattattattagcaac

SEQ ID NO: 7342576 - DNA, 22 bp, Homo sapiens
gttgacagaaaaataacatagc

SEQ ID NO: 7342577 - DNA, 22 bp, Homo sapiens
gttgacagaattgtgtggctgg

SEQ ID NO: 7342578 - DNA, 22 bp, Homo sapiens
gttgacagagcgcctttgaatt

SEQ ID NO: 7342579 - DNA, 22 bp, Homo sapiens
gttgacagctggtgagctgcta

SEQ ID NO: 7342580 - DNA, 22 bp, Homo sapiens
gttgacaggaaggcgttcccag

SEQ ID NO: 7342581 - DNA, 22 bp, Homo sapiens
gttgacagtgaccctgaaagca

SEQ ID NO: 7342582 - DNA, 22 bp, Homo sapiens
gtttctttctattgactgaaca

SEQ ID NO: 7342583 - DNA, 22 bp, Homo sapiens
gtttgaaaaaagcagtatgtaa

SEQ ID NO: 7342584 - DNA, 22 bp, Homo sapiens
gtttcacacatcctgcacatag

SEQ ID NO: 7342585 - DNA, 22 bp, Homo sapiens
gtttcacacatcctgcacatag

SEQ ID NO: 7342586 - DNA, 22 bp, Homo sapiens
gtttcacagtctgcagaatttt

SEQ ID NO: 7342587 - DNA, 22 bp, Homo sapiens
gtttcactgcactatagcacca

SEQ ID NO: 7342588 - DNA, 22 bp, Homo sapiens
gtttgaaacatgcacctggagg

SEQ ID NO: 7342589 - DNA, 21 bp, Homo sapiens
gtttgcatgaacaagtcagcc

SEQ ID NO: 7342590 - DNA, 22 bp, Homo sapiens
gtttgcatatttgcacaggaat

SEQ ID NO: 7342591 - DNA, 21 bp, Homo sapiens
gtttgcatgaacaagtcagcc

SEQ ID NO: 7342592 - DNA, 22 bp, Homo sapiens
gtttgcatggaagacagtgagt

SEQ ID NO: 7342593 - DNA, 22 bp, Homo sapiens
gtttgcatatttgcacaggaat

SEQ ID NO: 7342594 - DNA, 22 bp, Homo sapiens
gtttgcataaagtggatgcagg

SEQ ID NO: 7342595 - DNA, 22 bp, Homo sapiens
gtttgcatatctgtgaaatgga

SEQ ID NO: 7342596 - DNA, 22 bp, Homo sapiens
gtttgcataaagtggatgcagg

SEQ ID NO: 7342597 - DNA, 22 bp, Homo sapiens
gtttgtgtaacatgatgatgat

SEQ ID NO: 7342598 - DNA, 22 bp, Homo sapiens
gtttgcattccaatttagggga

SEQ ID NO: 7342599 - DNA, 22 bp, Homo sapiens
gtttgcattccaatttagggga

SEQ ID NO: 7342600 - DNA, 22 bp, Homo sapiens
gtttgcatgtattaagtcaata

SEQ ID NO: 7342601 - DNA, 17 bp, Homo sapiens
gtttgcatggtgttaac

SEQ ID NO: 7342602 - DNA, 22 bp, Homo sapiens
gtttgcatgtgtacttaattgg

SEQ ID NO: 7342603 - DNA, 22 bp, Homo sapiens
gtttgcatgtgtacttaattgg

SEQ ID NO: 7342604 - DNA, 22 bp, Homo sapiens
tatcagatggtgatacatatca

SEQ ID NO: 7342605 - DNA, 22 bp, Homo sapiens
tatcagatgacatcttctatgg

SEQ ID NO: 7342606 - DNA, 22 bp, Homo sapiens
tatcagataatcttttacaagc

SEQ ID NO: 7342607 - DNA, 21 bp, Homo sapiens
tatcagaagagaaagaatgat

SEQ ID NO: 7342608 - DNA, 22 bp, Homo sapiens
tatcagaaggcacatggagtct

SEQ ID NO: 7342609 - DNA, 22 bp, Homo sapiens
tatcacagtaaatctgggtgca

SEQ ID NO: 7342610 - DNA, 22 bp, Homo sapiens
tatcacatcaatgttttaaaat

SEQ ID NO: 7342611 - DNA, 22 bp, Homo sapiens
tatcacatacttctcatccagg

SEQ ID NO: 7342612 - DNA, 22 bp, Homo sapiens
tatcacttgcgttttggcagag

SEQ ID NO: 7342613 - DNA, 22 bp, Homo sapiens
tatcagaagacttacagtatcg

SEQ ID NO: 7342614 - DNA, 18 bp, Homo sapiens
tataaacacacttaggtt

SEQ ID NO: 7342615 - DNA, 22 bp, Homo sapiens
tatcacaggtgtgatttacatt

SEQ ID NO: 7342616 - DNA, 22 bp, Homo sapiens
tatgaattctgttcattgatga

SEQ ID NO: 7342617 - DNA, 20 bp, Homo sapiens
tatgacaacgcagcaaggca

SEQ ID NO: 7342618 - DNA, 22 bp, Homo sapiens
tatgacaagaaatacagaggta

SEQ ID NO: 7342619 - DNA, 22 bp, Homo sapiens
tatgacaaggtggagtatgagt

SEQ ID NO: 7342620 - DNA, 22 bp, Homo sapiens
tatgaaatgatggggaaaatag

SEQ ID NO: 7342621 - DNA, 22 bp, Homo sapiens
tatgaaatttaaacacagatca

SEQ ID NO: 7342622 - DNA, 22 bp, Homo sapiens
tatgaaatttaaacacagatca

SEQ ID NO: 7342623 - DNA, 22 bp, Homo sapiens
tatcatttagagtatttcttca

SEQ ID NO: 7342624 - DNA, 22 bp, Homo sapiens
tatcatttagagtatttcttca

SEQ ID NO: 7342625 - DNA, 22 bp, Homo sapiens
tatcatttgttattattagtgg

SEQ ID NO: 7342626 - DNA, 22 bp, Homo sapiens
tatcattttactgtgacatttt

SEQ ID NO: 7342627 - DNA, 22 bp, Homo sapiens
tatgaaagaatctcagagcaca

SEQ ID NO: 7342628 - DNA, 22 bp, Homo sapiens
tatgtatataggtgtgtgtctc

SEQ ID NO: 7342629 - DNA, 22 bp, Homo sapiens
tatgtataatcacagagtgtca

SEQ ID NO: 7342630 - DNA, 22 bp, Homo sapiens
tatgtataaatgcatgtgtgga

SEQ ID NO: 7342631 - DNA, 18 bp, Homo sapiens
tatgtataacatagttca

SEQ ID NO: 7342632 - DNA, 18 bp, Homo sapiens
tatgtagtatatgtgtat

SEQ ID NO: 7342633 - DNA, 22 bp, Homo sapiens
tatgtagtacttagtgcataca

SEQ ID NO: 7342634 - DNA, 22 bp, Homo sapiens
tatgtatccgtgtgtgtacaga

SEQ ID NO: 7342635 - DNA, 22 bp, Homo sapiens
tatgtatatatgttgggtagaa

SEQ ID NO: 7342636 - DNA, 22 bp, Homo sapiens
tatgtatatggtagaagtatgt

SEQ ID NO: 7342637 - DNA, 22 bp, Homo sapiens
tatgtatatgtgtgttgacaac

SEQ ID NO: 7342638 - DNA, 23 bp, Homo sapiens
tatgtatgtatgtttgtatggaa

SEQ ID NO: 7342639 - DNA, 22 bp, Homo sapiens
tatgtattagagctccatgagg

SEQ ID NO: 7342640 - DNA, 22 bp, Homo sapiens
tatgtcaaaaaagattatgttt

SEQ ID NO: 7342641 - DNA, 22 bp, Homo sapiens
tatgtattctgagtacaagttc

SEQ ID NO: 7342642 - DNA, 21 bp, Homo sapiens
tattaatatgtctaagctgat

SEQ ID NO: 7342643 - DNA, 22 bp, Homo sapiens
tattaagagatgtatgaagaga

SEQ ID NO: 7342644 - DNA, 22 bp, Homo sapiens
tattaacattttatgaaaataa

SEQ ID NO: 7342645 - DNA, 22 bp, Homo sapiens
tatgtttgttatcacaactagg

SEQ ID NO: 7342646 - DNA, 22 bp, Homo sapiens
tatgtttgttatcacaactagg

SEQ ID NO: 7342647 - DNA, 22 bp, Homo sapiens
tatgtttcttccttttcataca

SEQ ID NO: 7342648 - DNA, 22 bp, Homo sapiens
tattaaattatggatttaggag

SEQ ID NO: 7342649 - DNA, 22 bp, Homo sapiens
tatgtttgttatcacaactagg

SEQ ID NO: 7342650 - DNA, 22 bp, Homo sapiens
tatggaatggctattttctagg

SEQ ID NO: 7342651 - DNA, 22 bp, Homo sapiens
tatggaaataattagacaagtg

SEQ ID NO: 7342652 - DNA, 22 bp, Homo sapiens
tatggcttcttttgcaactact

SEQ ID NO: 7342653 - DNA, 22 bp, Homo sapiens
tatggcttgacttgcaccggca

SEQ ID NO: 7342654 - DNA, 20 bp, Homo sapiens
tatggcttgcagccaccctt

SEQ ID NO: 7342655 - DNA, 22 bp, Homo sapiens
tatggcttgagtttcagactat

SEQ ID NO: 7342656 - DNA, 22 bp, Homo sapiens
tatggcttctgggccaaattta

SEQ ID NO: 7342657 - DNA, 22 bp, Homo sapiens
tatggcttcttgtgttactgtg

SEQ ID NO: 7342658 - DNA, 22 bp, Homo sapiens
tatgtaagttgcaaatgaagga

SEQ ID NO: 7342659 - DNA, 22 bp, Homo sapiens
tatgtaagtgagatcatggagt

SEQ ID NO: 7342660 - DNA, 22 bp, Homo sapiens
tatgtactcatcaactattgaa

SEQ ID NO: 7342661 - DNA, 22 bp, Homo sapiens
tatggctttaaattgaaggagt

SEQ ID NO: 7342662 - DNA, 22 bp, Homo sapiens
tatggctttaaacaacttaggt

SEQ ID NO: 7342663 - DNA, 22 bp, Homo sapiens
tatggctttaaacttttcattt

SEQ ID NO: 7342664 - DNA, 20 bp, Homo sapiens
tatggcttggcaaagcttca

SEQ ID NO: 7342665 - DNA, 22 bp, Homo sapiens
tatggcttgtccctggtcagtc

SEQ ID NO: 7342666 - DNA, 22 bp, Homo sapiens
tatggcttgtctttataccagg

SEQ ID NO: 7342667 - DNA, 22 bp, Homo sapiens
tatggcttgtggagagttgtag

SEQ ID NO: 7342668 - DNA, 22 bp, Homo sapiens
tatggctttcaaaggaactcgg

SEQ ID NO: 7342669 - DNA, 22 bp, Homo sapiens
tatggctttctccatagggcag

SEQ ID NO: 7342670 - DNA, 21 bp, Homo sapiens
tatggctttactaagctgcac

SEQ ID NO: 7342671 - DNA, 22 bp, Homo sapiens
tatggcttttaaggagatctga

SEQ ID NO: 7342672 - DNA, 22 bp, Homo sapiens
tatggctttgaaagggcttttc

SEQ ID NO: 7342673 - DNA, 22 bp, Homo sapiens
tatggctttgggccaaatctac

SEQ ID NO: 7342674 - DNA, 22 bp, Homo sapiens
tatggcttttaactgtcgtatg

SEQ ID NO: 7342675 - DNA, 22 bp, Homo sapiens
tatggctttttattcatcttac

SEQ ID NO: 7342676 - DNA, 22 bp, Homo sapiens
tatggcttttcattcctatgtg

SEQ ID NO: 7342677 - DNA, 22 bp, Homo sapiens
tatggcttttcttcctccccca

SEQ ID NO: 7342678 - DNA, 22 bp, Homo sapiens
tatggcttttctttcctagtgt

SEQ ID NO: 7342679 - DNA, 22 bp, Homo sapiens
tatggcttttggcttctctctg

SEQ ID NO: 7342680 - DNA, 22 bp, Homo sapiens
tatggtaataatatgaaggtct

SEQ ID NO: 7342681 - DNA, 22 bp, Homo sapiens
tatttaaccagttaaatttcca

SEQ ID NO: 7342682 - DNA, 22 bp, Homo sapiens
tatttaagatgtgtcataaaga

SEQ ID NO: 7342683 - DNA, 22 bp, Homo sapiens
tatttaaaatagtgctccagca

SEQ ID NO: 7342684 - DNA, 22 bp, Homo sapiens
tattgtgctcaccattacatcc

SEQ ID NO: 7342685 - DNA, 22 bp, Homo sapiens
tattgttgttgtgagggggatg

SEQ ID NO: 7342686 - DNA, 22 bp, Homo sapiens
tattgtcaagaagtttatagtg

SEQ ID NO: 7342687 - DNA, 22 bp, Homo sapiens
tattgtccatgtgtctgttagc

SEQ ID NO: 7342688 - DNA, 22 bp, Homo sapiens
tattgtcacgtcttaattctag

SEQ ID NO: 7342689 - DNA, 22 bp, Homo sapiens
tattgtctgtttgaatgactat

SEQ ID NO: 7342690 - DNA, 22 bp, Homo sapiens
tattgtctgtttgaatgactat

SEQ ID NO: 7342691 - DNA, 22 bp, Homo sapiens
tattgtctcacagttttggagg

SEQ ID NO: 7342692 - DNA, 22 bp, Homo sapiens
tattacaaattataatgggaga

SEQ ID NO: 7342693 - DNA, 22 bp, Homo sapiens
tattacaaattataatgggaga

SEQ ID NO: 7342694 - DNA, 23 bp, Homo sapiens
tattacaattggtcttattaaga

SEQ ID NO: 7342695 - DNA, 23 bp, Homo sapiens
tattacaattggtcttattaaga

SEQ ID NO: 7342696 - DNA, 22 bp, Homo sapiens
tattttgaaagtctgttttgaa

SEQ ID NO: 7342697 - DNA, 22 bp, Homo sapiens
tattttgacgattttatgcaaa

SEQ ID NO: 7342698 - DNA, 22 bp, Homo sapiens
tattttctggggagagtgaacc

SEQ ID NO: 7342699 - DNA, 22 bp, Homo sapiens
tatttgctgaatctgattcaga

SEQ ID NO: 7342700 - DNA, 22 bp, Homo sapiens
tatttgctgtgcttattccatt

SEQ ID NO: 7342701 - DNA, 22 bp, Homo sapiens
tatttgctttgctttatagaga

SEQ ID NO: 7342702 - DNA, 22 bp, Homo sapiens
tatttgcttggaaacctaatcc

SEQ ID NO: 7342703 - DNA, 22 bp, Homo sapiens
tatttggacaccaagtagaagt

SEQ ID NO: 7342704 - DNA, 23 bp, Homo sapiens
tatttgctactggtaattctgga

SEQ ID NO: 7342705 - DNA, 23 bp, Homo sapiens
tatttgctactggtaattctgga

SEQ ID NO: 7342706 - DNA, 22 bp, Homo sapiens
tatttgcaggcttttgtcatgg

SEQ ID NO: 7342707 - DNA, 22 bp, Homo sapiens
tatttgcaggacatagatatgg

SEQ ID NO: 7342708 - DNA, 22 bp, Homo sapiens
tatttgaaggcatacattttga

SEQ ID NO: 7342709 - DNA, 22 bp, Homo sapiens
tatttcttgttattctcgttga

SEQ ID NO: 7342710 - DNA, 22 bp, Homo sapiens
tatttaattagtgattgtagag

SEQ ID NO: 7342711 - DNA, 22 bp, Homo sapiens
tcaaagatagatgttgagaaat

SEQ ID NO: 7342712 - DNA, 22 bp, Homo sapiens
tattttgcgttgagtcagattt

SEQ ID NO: 7342713 - DNA, 22 bp, Homo sapiens
tattttgaggtatttttgagct

SEQ ID NO: 7342714 - DNA, 22 bp, Homo sapiens
tattttgtatttatgcaagaaa

SEQ ID NO: 7342715 - DNA, 22 bp, Homo sapiens
tatttttgcctctcagataaaa

SEQ ID NO: 7342716 - DNA, 19 bp, Homo sapiens
tcaaaggcttttaggagac

SEQ ID NO: 7342717 - DNA, 22 bp, Homo sapiens
tcaaagtaccattatcagtgga

SEQ ID NO: 7342718 - DNA, 22 bp, Homo sapiens
tcaaagtaggggtaagccaggc

SEQ ID NO: 7342719 - DNA, 22 bp, Homo sapiens
tcaaatctttaacatgtgcaaa

SEQ ID NO: 7342720 - DNA, 22 bp, Homo sapiens
tcaaatgaagacagttgacttg

SEQ ID NO: 7342721 - DNA, 22 bp, Homo sapiens
tcaaatgacaagcacttttggg

SEQ ID NO: 7342722 - DNA, 21 bp, Homo sapiens
tcaaatcaggtatcactattg

SEQ ID NO: 7342723 - DNA, 22 bp, Homo sapiens
tcaaataccagcaatttcatgt

SEQ ID NO: 7342724 - DNA, 22 bp, Homo sapiens
tagggcagagtccaggatgggc

SEQ ID NO: 7342725 - DNA, 22 bp, Homo sapiens
tagggcagccacccaggctgct

SEQ ID NO: 7342726 - DNA, 22 bp, Homo sapiens
tagggcagattcggtggagttt

SEQ ID NO: 7342727 - DNA, 22 bp, Homo sapiens
tagggcagattcggtggagttt

SEQ ID NO: 7342728 - DNA, 22 bp, Homo sapiens
tagggcagattcggtggagttt

SEQ ID NO: 7342729 - DNA, 22 bp, Homo sapiens
tagggcagccttatagctccca

SEQ ID NO: 7342730 - DNA, 22 bp, Homo sapiens
tagggcagctgcatcaggcact

SEQ ID NO: 7342731 - DNA, 22 bp, Homo sapiens
tagggcagccacccaggctgct

SEQ ID NO: 7342732 - DNA, 22 bp, Homo sapiens
tagggcagccttatagctccca

SEQ ID NO: 7342733 - DNA, 22 bp, Homo sapiens
tagggctttgctcatcctaggt

SEQ ID NO: 7342734 - DNA, 22 bp, Homo sapiens
tagggcttagaaaagaatttac

SEQ ID NO: 7342735 - DNA, 22 bp, Homo sapiens
tagggctggcgtgctcagggaa

SEQ ID NO: 7342736 - DNA, 22 bp, Homo sapiens
tagggctgtggtcagtcctcta

SEQ ID NO: 7342737 - DNA, 22 bp, Homo sapiens
tagctgggactactggccctgc

SEQ ID NO: 7342738 - DNA, 22 bp, Homo sapiens
tagctgggagtgtctgatgggt

SEQ ID NO: 7342739 - DNA, 22 bp, Homo sapiens
tagttattgcctaggagcagct

SEQ ID NO: 7342740 - DNA, 22 bp, Homo sapiens
tagtttaatggtcaactaatga

SEQ ID NO: 7342741 - DNA, 22 bp, Homo sapiens
tagttcttggttcttagttctt

SEQ ID NO: 7342742 - DNA, 22 bp, Homo sapiens
tagttctttgacggtgctttga

SEQ ID NO: 7342743 - DNA, 22 bp, Homo sapiens
tagttcttactgttttcagcgt

SEQ ID NO: 7342744 - DNA, 22 bp, Homo sapiens
tagttctcaggacgtcaaggtt

SEQ ID NO: 7342745 - DNA, 22 bp, Homo sapiens
tagttttttcaacaaatggtgc

SEQ ID NO: 7342746 - DNA, 22 bp, Homo sapiens
tagttttttcaacaaatggtgc

SEQ ID NO: 7342747 - DNA, 22 bp, Homo sapiens
tagttttataatgttaacatct

SEQ ID NO: 7342748 - DNA, 22 bp, Homo sapiens
tagttttataatgttaacatct

SEQ ID NO: 7342749 - DNA, 22 bp, Homo sapiens
tagtttcatatgcaaaatagta

SEQ ID NO: 7342750 - DNA, 22 bp, Homo sapiens
tagtgctatagaagtgcttgcg

SEQ ID NO: 7342751 - DNA, 22 bp, Homo sapiens
tagttacagcaggcaggatata

SEQ ID NO: 7342752 - DNA, 22 bp, Homo sapiens
taggggctcagaacatgtcctt

SEQ ID NO: 7342753 - DNA, 21 bp, Homo sapiens
taggggctggggctccagctg

SEQ ID NO: 7342754 - DNA, 23 bp, Homo sapiens
taggggctggcgtggagcctgcg

SEQ ID NO: 7342755 - DNA, 22 bp, Homo sapiens
taggggcttgtaatttaataga

SEQ ID NO: 7342756 - DNA, 22 bp, Homo sapiens
taggggcagaagcggcggtcca

SEQ ID NO: 7342757 - DNA, 22 bp, Homo sapiens
tagtctctatgagtgaatcaca

SEQ ID NO: 7342758 - DNA, 22 bp, Homo sapiens
tagtctctatgagtgaatcaca

SEQ ID NO: 7342759 - DNA, 22 bp, Homo sapiens
tagagagagatatatacacaca

SEQ ID NO: 7342760 - DNA, 22 bp, Homo sapiens
tagagagagctgtggtggctct

SEQ ID NO: 7342761 - DNA, 20 bp, Homo sapiens
tagagagaggatattaaagt

SEQ ID NO: 7342762 - DNA, 20 bp, Homo sapiens
tagagagatatgggggttcc

SEQ ID NO: 7342763 - DNA, 22 bp, Homo sapiens
tagatacagtgttaagtgtgga

SEQ ID NO: 7342764 - DNA, 22 bp, Homo sapiens
tagagtgtaagctccttgaggg

SEQ ID NO: 7342765 - DNA, 22 bp, Homo sapiens
tagagtctagtgtatacaaagt

SEQ ID NO: 7342766 - DNA, 22 bp, Homo sapiens
tagatacctgctggacctcatt

SEQ ID NO: 7342767 - DNA, 22 bp, Homo sapiens
tagatacctgctggacctcatt

SEQ ID NO: 7342768 - DNA, 22 bp, Homo sapiens
tagatatatctgtcatactggt

SEQ ID NO: 7342769 - DNA, 22 bp, Homo sapiens
tagatataggacagtactgtat

SEQ ID NO: 7342770 - DNA, 22 bp, Homo sapiens
tagactgttacagcttttcaga

SEQ ID NO: 7342771 - DNA, 21 bp, Homo sapiens
tagaagcacataggttcaaag

SEQ ID NO: 7342772 - DNA, 22 bp, Homo sapiens
tagaacttagcactagacttgt

SEQ ID NO: 7342773 - DNA, 22 bp, Homo sapiens
tagaacatgacttatttttgga

SEQ ID NO: 7342774 - DNA, 23 bp, Homo sapiens
tagaacatcggtgtcttggagca

SEQ ID NO: 7342775 - DNA, 22 bp, Homo sapiens
tagcaaaatgtggatgtagttg

SEQ ID NO: 7342776 - DNA, 22 bp, Homo sapiens
tagatgaaagagggcctgtgag

SEQ ID NO: 7342777 - DNA, 22 bp, Homo sapiens
tagatgaaaggtctagcacagt

SEQ ID NO: 7342778 - DNA, 21 bp, Homo sapiens
tagatgaaatcagagtatttc

SEQ ID NO: 7342779 - DNA, 22 bp, Homo sapiens
tagcaacatggttatcacatta

SEQ ID NO: 7342780 - DNA, 22 bp, Homo sapiens
tagctgacgctaaataaatgtt

SEQ ID NO: 7342781 - DNA, 22 bp, Homo sapiens
tagctgctgcagcacagggagg

SEQ ID NO: 7342782 - DNA, 22 bp, Homo sapiens
tagctgcttagaaatcactgag

SEQ ID NO: 7342783 - DNA, 22 bp, Homo sapiens
tagcaggaataaaaatgtaccc

SEQ ID NO: 7342784 - DNA, 22 bp, Homo sapiens
tagcaggatcacagggagagcc

SEQ ID NO: 7342785 - DNA, 22 bp, Homo sapiens
tcagatgttgaaaaggaaaagt

SEQ ID NO: 7342786 - DNA, 22 bp, Homo sapiens
tcagatgtctctcagcagggtt

SEQ ID NO: 7342787 - DNA, 22 bp, Homo sapiens
tcagatgtctccaagggctggg

SEQ ID NO: 7342788 - DNA, 22 bp, Homo sapiens
tcagatttgaatattcctttcg

SEQ ID NO: 7342789 - DNA, 22 bp, Homo sapiens
tcagattttattttcctgttac

SEQ ID NO: 7342790 - DNA, 22 bp, Homo sapiens
tcagatttatgaatatactatg

SEQ ID NO: 7342791 - DNA, 22 bp, Homo sapiens
tcagatttcttcttgcaacggc

SEQ ID NO: 7342792 - DNA, 22 bp, Homo sapiens
tcagaatgtgcagaggaacagt

SEQ ID NO: 7342793 - DNA, 22 bp, Homo sapiens
tcagaatgggccttcctgtccc

SEQ ID NO: 7342794 - DNA, 22 bp, Homo sapiens
tcagaatgtgcagaggaacagt

SEQ ID NO: 7342795 - DNA, 19 bp, Homo sapiens
tcagaattctgtctcttga

SEQ ID NO: 7342796 - DNA, 22 bp, Homo sapiens
tcagaattgattttcaaaacag

SEQ ID NO: 7342797 - DNA, 22 bp, Homo sapiens
tcagagtgcagggagtagcagc

SEQ ID NO: 7342798 - DNA, 21 bp, Homo sapiens
tcagagtggaagacagtttga

SEQ ID NO: 7342799 - DNA, 22 bp, Homo sapiens
tcagagtgggagaatgtgccaa

SEQ ID NO: 7342800 - DNA, 22 bp, Homo sapiens
tcagagtgggagaatgtgccaa

SEQ ID NO: 7342801 - DNA, 22 bp, Homo sapiens
tcagagtgtgacttggtcatga

SEQ ID NO: 7342802 - DNA, 22 bp, Homo sapiens
tcagagtggtggttttgccttc

SEQ ID NO: 7342803 - DNA, 22 bp, Homo sapiens
tcagagtggtagcctattttct

SEQ ID NO: 7342804 - DNA, 22 bp, Homo sapiens
tcagagtgtgagacatattgga

SEQ ID NO: 7342805 - DNA, 22 bp, Homo sapiens
tcagagtgtggtgagatgtgca

SEQ ID NO: 7342806 - DNA, 22 bp, Homo sapiens
tcagagtgtggtgagatgtgca

SEQ ID NO: 7342807 - DNA, 22 bp, Homo sapiens
tcagagtgtggtgagatgtgca

SEQ ID NO: 7342808 - DNA, 22 bp, Homo sapiens
tcagagtgtggtgagatgtgca

SEQ ID NO: 7342809 - DNA, 21 bp, Homo sapiens
tcagagtgtgttacagcaagc

SEQ ID NO: 7342810 - DNA, 22 bp, Homo sapiens
tcagagtgttttactaaacaag

SEQ ID NO: 7342811 - DNA, 22 bp, Homo sapiens
tcagcagtgtagtttatcattc

SEQ ID NO: 7342812 - DNA, 22 bp, Homo sapiens
tcagcagtgtagtttatcattc

SEQ ID NO: 7342813 - DNA, 17 bp, Homo sapiens
tcagcaggggccaagct

SEQ ID NO: 7342814 - DNA, 22 bp, Homo sapiens
tcagcagggctgggagctgtga

SEQ ID NO: 7342815 - DNA, 22 bp, Homo sapiens
tcagcaggcccatcctccaggc

SEQ ID NO: 7342816 - DNA, 22 bp, Homo sapiens
tcagcaggcggttccttgtggg

SEQ ID NO: 7342817 - DNA, 22 bp, Homo sapiens
tcagcaggctctggttgaccat

SEQ ID NO: 7342818 - DNA, 21 bp, Homo sapiens
tcagcaaaataagcaaatgga

SEQ ID NO: 7342819 - DNA, 22 bp, Homo sapiens
tcagcaaaggaccagcacaggc

SEQ ID NO: 7342820 - DNA, 22 bp, Homo sapiens
tcagcaaaggaccagcacaggc

SEQ ID NO: 7342821 - DNA, 17 bp, Homo sapiens
tcagcaaagacaaagga

SEQ ID NO: 7342822 - DNA, 17 bp, Homo sapiens
tcagcaaagacaaagga

SEQ ID NO: 7342823 - DNA, 22 bp, Homo sapiens
tcagcaaatacttattgagcgc

SEQ ID NO: 7342824 - DNA, 22 bp, Homo sapiens
tcaggaagtataatcagattca

SEQ ID NO: 7342825 - DNA, 22 bp, Homo sapiens
tcaggacagagatcagaacttc

SEQ ID NO: 7342826 - DNA, 22 bp, Homo sapiens
tcaggacagccagggtgcagac

SEQ ID NO: 7342827 - DNA, 22 bp, Homo sapiens
tcaggacagaaggctgccaggg

SEQ ID NO: 7342828 - DNA, 22 bp, Homo sapiens
tcaggactagacatgaggaagg

SEQ ID NO: 7342829 - DNA, 19 bp, Homo sapiens
tcaggactgacttgaagtc

SEQ ID NO: 7342830 - DNA, 22 bp, Homo sapiens
tcaggagacaaagggtgcggag

SEQ ID NO: 7342831 - DNA, 22 bp, Homo sapiens
tcagccagaaagtgattttcag

SEQ ID NO: 7342832 - DNA, 22 bp, Homo sapiens
tcagccagaggcttcttggttt

SEQ ID NO: 7342833 - DNA, 22 bp, Homo sapiens
tcagcattttttgggtgtaact

SEQ ID NO: 7342834 - DNA, 22 bp, Homo sapiens
tcagccagagggggcaaaggaa

SEQ ID NO: 7342835 - DNA, 22 bp, Homo sapiens
tcagccagaggtggatgagtca

SEQ ID NO: 7342836 - DNA, 22 bp, Homo sapiens
tcagccagcatcagctaagtgc

SEQ ID NO: 7342837 - DNA, 22 bp, Homo sapiens
tcagccagcattacccctgact

SEQ ID NO: 7342838 - DNA, 22 bp, Homo sapiens
tcagccagccagctacaggctt

SEQ ID NO: 7342839 - DNA, 20 bp, Homo sapiens
tcagcatgctcctcagacat

SEQ ID NO: 7342840 - DNA, 22 bp, Homo sapiens
tcagcagttttatatgcagctt

SEQ ID NO: 7342841 - DNA, 22 bp, Homo sapiens
tcagccagctgtgtgcttctgc

SEQ ID NO: 7342842 - DNA, 22 bp, Homo sapiens
tcagccaggcacaatggcagct

SEQ ID NO: 7342843 - DNA, 22 bp, Homo sapiens
tcagccagctcttggactctga

SEQ ID NO: 7342844 - DNA, 20 bp, Homo sapiens
tcagccagctaacatgggga

SEQ ID NO: 7342845 - DNA, 22 bp, Homo sapiens
tcagccaggcagccccctggtc

SEQ ID NO: 7342846 - DNA, 22 bp, Homo sapiens
tcagccaggccaccttcagctt

SEQ ID NO: 7342847 - DNA, 22 bp, Homo sapiens
tcagctctgcctgtggaggcac

SEQ ID NO: 7342848 - DNA, 22 bp, Homo sapiens
tcaacaataggatatagcaggt

SEQ ID NO: 7342849 - DNA, 22 bp, Homo sapiens
tcaacatacatacatggtcagg

SEQ ID NO: 7342850 - DNA, 22 bp, Homo sapiens
tcaacagtggcaaagaggcacg

SEQ ID NO: 7342851 - DNA, 22 bp, Homo sapiens
tcaacagaagtgatagctatta

SEQ ID NO: 7342852 - DNA, 22 bp, Homo sapiens
tcaacactggctacagttatgc

SEQ ID NO: 7342853 - DNA, 22 bp, Homo sapiens
tcacagtgacttacagagattg

SEQ ID NO: 7342854 - DNA, 22 bp, Homo sapiens
tcacatttctcagcactgatga

SEQ ID NO: 7342855 - DNA, 22 bp, Homo sapiens
tcacatttctgattataccaaa

SEQ ID NO: 7342856 - DNA, 22 bp, Homo sapiens
tcacatttctttatgtagtctt

SEQ ID NO: 7342857 - DNA, 22 bp, Homo sapiens
tcacatttgataatgcccattg

SEQ ID NO: 7342858 - DNA, 18 bp, Homo sapiens
tcacatacttaggccctc

SEQ ID NO: 7342859 - DNA, 22 bp, Homo sapiens
tcacatgctactgagccagacc

SEQ ID NO: 7342860 - DNA, 22 bp, Homo sapiens
tcacatgctgtgggatctgtat

SEQ ID NO: 7342861 - DNA, 22 bp, Homo sapiens
tcacattgccattagttcagtt

SEQ ID NO: 7342862 - DNA, 22 bp, Homo sapiens
tcacattgccattagttcagtt

SEQ ID NO: 7342863 - DNA, 23 bp, Homo sapiens
tcacatttaacccctcagacctc

SEQ ID NO: 7342864 - DNA, 22 bp, Homo sapiens
tcacattgttcttagtttacct

SEQ ID NO: 7342865 - DNA, 22 bp, Homo sapiens
tcacattgccgtctgtgcactt

SEQ ID NO: 7342866 - DNA, 22 bp, Homo sapiens
tcacattgctcccatagtggat

SEQ ID NO: 7342867 - DNA, 22 bp, Homo sapiens
tcacattggaccttcctgacaa

SEQ ID NO: 7342868 - DNA, 22 bp, Homo sapiens
tcacattgtaggatagcagaga

SEQ ID NO: 7342869 - DNA, 22 bp, Homo sapiens
tcacattgtaggtcatttgcaa

SEQ ID NO: 7342870 - DNA, 22 bp, Homo sapiens
tcacattgttatgtaaatgttt

SEQ ID NO: 7342871 - DNA, 22 bp, Homo sapiens
tcacagtttccataggtcagca

SEQ ID NO: 7342872 - DNA, 22 bp, Homo sapiens
tcacagttttagaaaatagata

SEQ ID NO: 7342873 - DNA, 22 bp, Homo sapiens
tcacagttttaagtgtgatcca

SEQ ID NO: 7342874 - DNA, 22 bp, Homo sapiens
tcacagttttagaaaatagata

SEQ ID NO: 7342875 - DNA, 22 bp, Homo sapiens
tcacagtttcttttctgataaa

SEQ ID NO: 7342876 - DNA, 22 bp, Homo sapiens
tcacagtttcttttctgataaa

SEQ ID NO: 7342877 - DNA, 22 bp, Homo sapiens
tcacataaattatacaatttca

SEQ ID NO: 7342878 - DNA, 22 bp, Homo sapiens
tcacagttttagctgttaaata

SEQ ID NO: 7342879 - DNA, 22 bp, Homo sapiens
tcactgcaacctccacctcccg

SEQ ID NO: 7342880 - DNA, 22 bp, Homo sapiens
tcacattttatctattttaagt

SEQ ID NO: 7342881 - DNA, 22 bp, Homo sapiens
tcacattttatatctctggttt

SEQ ID NO: 7342882 - DNA, 22 bp, Homo sapiens
tcacattttatctattttaagt

SEQ ID NO: 7342883 - DNA, 22 bp, Homo sapiens
tcacattttagtaccatgattt

SEQ ID NO: 7342884 - DNA, 22 bp, Homo sapiens
tcacattttagtaccatgattt

SEQ ID NO: 7342885 - DNA, 22 bp, Homo sapiens
tcacatttgtgttttattagag

SEQ ID NO: 7342886 - DNA, 22 bp, Homo sapiens
tcacatttggagaaagcctgcc

SEQ ID NO: 7342887 - DNA, 22 bp, Homo sapiens
tcacatttgtgttttattagag

SEQ ID NO: 7342888 - DNA, 22 bp, Homo sapiens
tcacatttgcaattgcattgtt

SEQ ID NO: 7342889 - DNA, 22 bp, Homo sapiens
tcactgcaacctccacctcctg

SEQ ID NO: 7342890 - DNA, 22 bp, Homo sapiens
tcagaaaatgaaatggactctc

SEQ ID NO: 7342891 - DNA, 22 bp, Homo sapiens
tcagaaaatgaaatggactctc

SEQ ID NO: 7342892 - DNA, 22 bp, Homo sapiens
tcagaatatattcatgttgtca

SEQ ID NO: 7342893 - DNA, 22 bp, Homo sapiens
tcagaatgaaatttctttcaga

SEQ ID NO: 7342894 - DNA, 22 bp, Homo sapiens
tcagaatctttctagagtctag

SEQ ID NO: 7342895 - DNA, 22 bp, Homo sapiens
tcagaatggacccagactatag

SEQ ID NO: 7342896 - DNA, 20 bp, Homo sapiens
tcagaacagtagaggagcta

SEQ ID NO: 7342897 - DNA, 22 bp, Homo sapiens
tcagaacagctctcagatatcc

SEQ ID NO: 7342898 - DNA, 22 bp, Homo sapiens
tcagaacagcagggtgtggctg

SEQ ID NO: 7342899 - DNA, 22 bp, Homo sapiens
tcagaacaggactggctgccat

SEQ ID NO: 7342900 - DNA, 22 bp, Homo sapiens
tcagaacagaagctggctataa

SEQ ID NO: 7342901 - DNA, 22 bp, Homo sapiens
tcagaacagcacagggtgattt

SEQ ID NO: 7342902 - DNA, 22 bp, Homo sapiens
tcagaacagaagaaggaacacg

SEQ ID NO: 7342903 - DNA, 22 bp, Homo sapiens
tcattgtcttgatatgattgtc

SEQ ID NO: 7342904 - DNA, 22 bp, Homo sapiens
tcatttacatagaaacaatata

SEQ ID NO: 7342905 - DNA, 22 bp, Homo sapiens
tcatttatattgtattctgtag

SEQ ID NO: 7342906 - DNA, 22 bp, Homo sapiens
tcatttaattggttttgctcgt

SEQ ID NO: 7342907 - DNA, 22 bp, Homo sapiens
tcatttaataatttttgagtag

SEQ ID NO: 7342908 - DNA, 22 bp, Homo sapiens
tcatttaaaatgtaccaggatt

SEQ ID NO: 7342909 - DNA, 22 bp, Homo sapiens
tcatttctgagccttccatgat

SEQ ID NO: 7342910 - DNA, 22 bp, Homo sapiens
tcatttctattgctactgtctg

SEQ ID NO: 7342911 - DNA, 22 bp, Homo sapiens
tcatttcaatgatactactaag

SEQ ID NO: 7342912 - DNA, 21 bp, Homo sapiens
tcatttcagggccttggcttc

SEQ ID NO: 7342913 - DNA, 22 bp, Homo sapiens
tcatttcagccatttttaaatg

SEQ ID NO: 7342914 - DNA, 22 bp, Homo sapiens
tcatttcagccatttttaaatg

SEQ ID NO: 7342915 - DNA, 22 bp, Homo sapiens
tcatttcagatgcatttagaat

SEQ ID NO: 7342916 - DNA, 22 bp, Homo sapiens
tcatttcagatgcatttagaat

SEQ ID NO: 7342917 - DNA, 22 bp, Homo sapiens
tcatttcagttgttccctggtt

SEQ ID NO: 7342918 - DNA, 22 bp, Homo sapiens
tcatttcagttcagaggccttt

SEQ ID NO: 7342919 - DNA, 22 bp, Homo sapiens
tcatttcagtggcacagaagat

SEQ ID NO: 7342920 - DNA, 23 bp, Homo sapiens
tcatttcaggttgcatggtacca

SEQ ID NO: 7342921 - DNA, 19 bp, Homo sapiens
tccaatttgtatgttttca

SEQ ID NO: 7342922 - DNA, 20 bp, Homo sapiens
tccaatgtaggataaatgtg

SEQ ID NO: 7342923 - DNA, 22 bp, Homo sapiens
tccaaggccgcaggctgggcct

SEQ ID NO: 7342924 - DNA, 22 bp, Homo sapiens
tccaaggccgcaggctgggcct

SEQ ID NO: 7342925 - DNA, 22 bp, Homo sapiens
tccaaggcctggcagcacaaag

SEQ ID NO: 7342926 - DNA, 22 bp, Homo sapiens
tccaaggctccggccctggcgt

SEQ ID NO: 7342927 - DNA, 22 bp, Homo sapiens
tccaaggctccggccctggcgt

SEQ ID NO: 7342928 - DNA, 22 bp, Homo sapiens
tccaagggcagcagccatagcc

SEQ ID NO: 7342929 - DNA, 22 bp, Homo sapiens
tccaaggtcagcgagagtcact

SEQ ID NO: 7342930 - DNA, 21 bp, Homo sapiens
tccaagtctggggcatgtgtg

SEQ ID NO: 7342931 - DNA, 22 bp, Homo sapiens
tccaactccacctttgtctccc

SEQ ID NO: 7342932 - DNA, 22 bp, Homo sapiens
tccaagaagagcctttctcctc

SEQ ID NO: 7342933 - DNA, 22 bp, Homo sapiens
tccaaatgagctctgccttcca

SEQ ID NO: 7342934 - DNA, 21 bp, Homo sapiens
tccaaatcccattctgtagtc

SEQ ID NO: 7342935 - DNA, 22 bp, Homo sapiens
tccaaatattcggtctttctga

SEQ ID NO: 7342936 - DNA, 22 bp, Homo sapiens
tccaaatattcatctacttctg

SEQ ID NO: 7342937 - DNA, 22 bp, Homo sapiens
tccaagctttccatgccctcac

SEQ ID NO: 7342938 - DNA, 22 bp, Homo sapiens
tccaagctctctatgccatgat

SEQ ID NO: 7342939 - DNA, 21 bp, Homo sapiens
tccaagccttcaacacattca

SEQ ID NO: 7342940 - DNA, 22 bp, Homo sapiens
tccaaggcatagacacagtgcc

SEQ ID NO: 7342941 - DNA, 19 bp, Homo sapiens
tccaaggcatggcccagtg

SEQ ID NO: 7342942 - DNA, 22 bp, Homo sapiens
tcatttgttctcattctctact

SEQ ID NO: 7342943 - DNA, 22 bp, Homo sapiens
tcatttgtggaagtgattgtgg

SEQ ID NO: 7342944 - DNA, 22 bp, Homo sapiens
tcatttgtctggcacagggaat

SEQ ID NO: 7342945 - DNA, 22 bp, Homo sapiens
tcatttgtaccattttttaaga

SEQ ID NO: 7342946 - DNA, 22 bp, Homo sapiens
tcatttgtaccattttttaaga

SEQ ID NO: 7342947 - DNA, 18 bp, Homo sapiens
tccaaaatcatgtatttt

SEQ ID NO: 7342948 - DNA, 21 bp, Homo sapiens
tccaaacctgtctctggctct

SEQ ID NO: 7342949 - DNA, 19 bp, Homo sapiens
tccaaagaagttcacattt

SEQ ID NO: 7342950 - DNA, 22 bp, Homo sapiens
tccaaagaatagaggtgacatt

SEQ ID NO: 7342951 - DNA, 22 bp, Homo sapiens
tcatgcagataagaataagtaa

SEQ ID NO: 7342952 - DNA, 22 bp, Homo sapiens
tcatgaaaatagatcagaaatt

SEQ ID NO: 7342953 - DNA, 22 bp, Homo sapiens
tcatgaaaaattttccatgtca

SEQ ID NO: 7342954 - DNA, 22 bp, Homo sapiens
tcatctgtctgagagacttctg

SEQ ID NO: 7342955 - DNA, 22 bp, Homo sapiens
tcataaatgcagtgtcataaat

SEQ ID NO: 7342956 - DNA, 22 bp, Homo sapiens
tcataaattatctatttggcta

SEQ ID NO: 7342957 - DNA, 22 bp, Homo sapiens
tcagtctccatctgcttgtctt

SEQ ID NO: 7342958 - DNA, 22 bp, Homo sapiens
tcagtctcctttcctctagaca

SEQ ID NO: 7342959 - DNA, 22 bp, Homo sapiens
tcagtctccatctgcttgtctt

SEQ ID NO: 7342960 - DNA, 22 bp, Homo sapiens
tcagtgtttacatgcatccttg

SEQ ID NO: 7342961 - DNA, 22 bp, Homo sapiens
tcagtatgatgagagggaaatt

SEQ ID NO: 7342962 - DNA, 21 bp, Homo sapiens
tcagtcctgttagcctttggg

SEQ ID NO: 7342963 - DNA, 23 bp, Homo sapiens
tcataaatattagcacagtagga

SEQ ID NO: 7342964 - DNA, 23 bp, Homo sapiens
tcataaatattagcacagtagga

SEQ ID NO: 7342965 - DNA, 22 bp, Homo sapiens
tcataaatcatactccatttgc

SEQ ID NO: 7342966 - DNA, 22 bp, Homo sapiens
tcagttacctgacagtggttat

SEQ ID NO: 7342967 - DNA, 22 bp, Homo sapiens
tcagtgtttcctgtggtacagc

SEQ ID NO: 7342968 - DNA, 22 bp, Homo sapiens
tcagtgttttaactgtctttta

SEQ ID NO: 7342969 - DNA, 22 bp, Homo sapiens
tcaggcttgtctctagagcaat

SEQ ID NO: 7342970 - DNA, 22 bp, Homo sapiens
tcaggctgttcctgtccaaaat

SEQ ID NO: 7342971 - DNA, 22 bp, Homo sapiens
tcaggctgtatatcttgcactc

SEQ ID NO: 7342972 - DNA, 22 bp, Homo sapiens
tcaggctgtatatcttgcactc

SEQ ID NO: 7342973 - DNA, 17 bp, Homo sapiens
tcaggctgggtgcagtg

SEQ ID NO: 7342974 - DNA, 17 bp, Homo sapiens
tcaggctgggtgcagtg

SEQ ID NO: 7342975 - DNA, 22 bp, Homo sapiens
tcaggagagagttgggtaggct

SEQ ID NO: 7342976 - DNA, 22 bp, Homo sapiens
tcaggctgtagggcccctggag

SEQ ID NO: 7342977 - DNA, 22 bp, Homo sapiens
tcaggctgtaaatggtgtgggt

SEQ ID NO: 7342978 - DNA, 22 bp, Homo sapiens
tcaggctggtggtcagatggct

SEQ ID NO: 7342979 - DNA, 20 bp, Homo sapiens
tcaggctggtgggctttccc

SEQ ID NO: 7342980 - DNA, 22 bp, Homo sapiens
tcaggctggtccccacagtgga

SEQ ID NO: 7342981 - DNA, 22 bp, Homo sapiens
tcagtacagcttagtcttctca

SEQ ID NO: 7342982 - DNA, 23 bp, Homo sapiens
tcagtaaatggtaaagtctcttc

SEQ ID NO: 7342983 - DNA, 22 bp, Homo sapiens
tcagtaaataactcagatgctc

SEQ ID NO: 7342984 - DNA, 22 bp, Homo sapiens
tcagtaaaacctgcttttagtg

SEQ ID NO: 7342985 - DNA, 22 bp, Homo sapiens
tcagggccgccggggatctcgc

SEQ ID NO: 7342986 - DNA, 22 bp, Homo sapiens
tcagggcctttgcagttgtttt

SEQ ID NO: 7342987 - DNA, 22 bp, Homo sapiens
tcagggcctgagcttttaatta

SEQ ID NO: 7342988 - DNA, 22 bp, Homo sapiens
tcagggccggggctgtggcgag

SEQ ID NO: 7342989 - DNA, 22 bp, Homo sapiens
tcagggccctggcaggaaacag

SEQ ID NO: 7342990 - DNA, 19 bp, Homo sapiens
tcagggccgcagagggtac

SEQ ID NO: 7342991 - DNA, 22 bp, Homo sapiens
tcagggcatccattgcctgttg

SEQ ID NO: 7342992 - DNA, 22 bp, Homo sapiens
tcctctggttatacttgcaccc

SEQ ID NO: 7342993 - DNA, 22 bp, Homo sapiens
tcctcttcagagggacctcggg

SEQ ID NO: 7342994 - DNA, 22 bp, Homo sapiens
tcctctttaaatgcttttatct

SEQ ID NO: 7342995 - DNA, 22 bp, Homo sapiens
tcctcttctgtggattccctga

SEQ ID NO: 7342996 - DNA, 22 bp, Homo sapiens
tcctctggtcctgcagcagatc

SEQ ID NO: 7342997 - DNA, 22 bp, Homo sapiens
tcctctggggtcagggcactac

SEQ ID NO: 7342998 - DNA, 22 bp, Homo sapiens
tcctctggggtcagggcactac

SEQ ID NO: 7342999 - DNA, 22 bp, Homo sapiens
tcctcaggtgactaggtatctt

SEQ ID NO: 7343000 - DNA, 22 bp, Homo sapiens
tcctgaaattctggttgtcact

SEQ ID NO: 7343001 - DNA, 22 bp, Homo sapiens
tcctgaaattctggttgtcact

SEQ ID NO: 7343002 - DNA, 22 bp, Homo sapiens
tcctgaaatttgttttaattct

SEQ ID NO: 7343003 - DNA, 22 bp, Homo sapiens
tcctgaaaataatttcacaaga

SEQ ID NO: 7343004 - DNA, 19 bp, Homo sapiens
tcctgaaaacttctggaat

SEQ ID NO: 7343005 - DNA, 22 bp, Homo sapiens
tcctgcacaccttgagcttgga

SEQ ID NO: 7343006 - DNA, 22 bp, Homo sapiens
tcctgcagagccgccctcaggt

SEQ ID NO: 7343007 - DNA, 22 bp, Homo sapiens
tcctgcagccactgcaggcaga

SEQ ID NO: 7343008 - DNA, 22 bp, Homo sapiens
tcctgcagctgaagctcatgtg

SEQ ID NO: 7343009 - DNA, 22 bp, Homo sapiens
tccatggagtttttatttggta

SEQ ID NO: 7343010 - DNA, 22 bp, Homo sapiens
tccattatacttctgattcaaa

SEQ ID NO: 7343011 - DNA, 22 bp, Homo sapiens
tccattcattcaggtatttagt

SEQ ID NO: 7343012 - DNA, 22 bp, Homo sapiens
tccattctttttacctctcaga

SEQ ID NO: 7343013 - DNA, 22 bp, Homo sapiens
tcccaaatataatgcaagagac

SEQ ID NO: 7343014 - DNA, 22 bp, Homo sapiens
tcccaagagctactcaatggaa

SEQ ID NO: 7343015 - DNA, 22 bp, Homo sapiens
tcccagcctggaccctgccagt

SEQ ID NO: 7343016 - DNA, 22 bp, Homo sapiens
tcccagcctggaccctgccagt

SEQ ID NO: 7343017 - DNA, 22 bp, Homo sapiens
tcccagccttatctcccctggc

SEQ ID NO: 7343018 - DNA, 22 bp, Homo sapiens
tcccagccttccagtctggttt

SEQ ID NO: 7343019 - DNA, 22 bp, Homo sapiens
tcccagccttccttgtggtgaa

SEQ ID NO: 7343020 - DNA, 22 bp, Homo sapiens
tcccagccttccagtctggttt

SEQ ID NO: 7343021 - DNA, 22 bp, Homo sapiens
tcccagcctttctttctccagc

SEQ ID NO: 7343022 - DNA, 22 bp, Homo sapiens
tcccagccttccttgtggtgaa

SEQ ID NO: 7343023 - DNA, 22 bp, Homo sapiens
tcccagccggtgcctgggtccc

SEQ ID NO: 7343024 - DNA, 22 bp, Homo sapiens
tcccagcctcctgacagttttg

SEQ ID NO: 7343025 - DNA, 22 bp, Homo sapiens
tcccagcctgacagtgcatcaa

SEQ ID NO: 7343026 - DNA, 23 bp, Homo sapiens
tcccagcctcttctcttgcatac

SEQ ID NO: 7343027 - DNA, 22 bp, Homo sapiens
tcccagccacaggtgtagccct

SEQ ID NO: 7343028 - DNA, 22 bp, Homo sapiens
tcccagccggtgcctgggtccc

SEQ ID NO: 7343029 - DNA, 21 bp, Homo sapiens
tccacaatagggaaattcacc

SEQ ID NO: 7343030 - DNA, 21 bp, Homo sapiens
tccacaagttagaaggaaatt

SEQ ID NO: 7343031 - DNA, 18 bp, Homo sapiens
tccaggcctgaagtgtcc

SEQ ID NO: 7343032 - DNA, 22 bp, Homo sapiens
tccaggctacttggattcctgg

SEQ ID NO: 7343033 - DNA, 22 bp, Homo sapiens
tccaggccttgacaggtcagtt

SEQ ID NO: 7343034 - DNA, 22 bp, Homo sapiens
tccaggctggagtgcagtggcg

SEQ ID NO: 7343035 - DNA, 22 bp, Homo sapiens
tccaggctggagtgcagtggca

SEQ ID NO: 7343036 - DNA, 22 bp, Homo sapiens
tccaggctacttggattcctgg

SEQ ID NO: 7343037 - DNA, 22 bp, Homo sapiens
tccaggctagagtgcagtggcc

SEQ ID NO: 7343038 - DNA, 21 bp, Homo sapiens
tccagggaacttctcaggaat

SEQ ID NO: 7343039 - DNA, 22 bp, Homo sapiens
tccagggaaggtgtgaggctgg

SEQ ID NO: 7343040 - DNA, 18 bp, Homo sapiens
tccagggcttcctcctct

SEQ ID NO: 7343041 - DNA, 22 bp, Homo sapiens
tccagggctgggttggctcagc

SEQ ID NO: 7343042 - DNA, 22 bp, Homo sapiens
tccagggacagcgctggagcta

SEQ ID NO: 7343043 - DNA, 22 bp, Homo sapiens
tccagggctgacttgggagagg

SEQ ID NO: 7343044 - DNA, 22 bp, Homo sapiens
tccagggctgacttgggagagg

SEQ ID NO: 7343045 - DNA, 22 bp, Homo sapiens
tccaggtgagtgcaggtgcaga

SEQ ID NO: 7343046 - DNA, 22 bp, Homo sapiens
tccaggtgggctgcacccaggc

SEQ ID NO: 7343047 - DNA, 18 bp, Homo sapiens
tccagggcttcctcctct

SEQ ID NO: 7343048 - DNA, 22 bp, Homo sapiens
tccagggcttgacagggtgcct

SEQ ID NO: 7343049 - DNA, 22 bp, Homo sapiens
tccagggcttgacagggtgcct

SEQ ID NO: 7343050 - DNA, 22 bp, Homo sapiens
tccagggcttggctgggacggt

SEQ ID NO: 7343051 - DNA, 19 bp, Homo sapiens
tccagggctttatggcttt

SEQ ID NO: 7343052 - DNA, 19 bp, Homo sapiens
tccagggctttatggcttt

SEQ ID NO: 7343053 - DNA, 21 bp, Homo sapiens
tccagggctttgattctctca

SEQ ID NO: 7343054 - DNA, 22 bp, Homo sapiens
tcctattggtagacatttctgt

SEQ ID NO: 7343055 - DNA, 22 bp, Homo sapiens
tcctataattagaagcaatttg

SEQ ID NO: 7343056 - DNA, 22 bp, Homo sapiens
tcctcacaagcaagcacaggta

SEQ ID NO: 7343057 - DNA, 22 bp, Homo sapiens
tcctcacacccataccactgac

SEQ ID NO: 7343058 - DNA, 22 bp, Homo sapiens
tcctcactgcagtgctccgagc

SEQ ID NO: 7343059 - DNA, 22 bp, Homo sapiens
tcctcagaatcacctggcagct

SEQ ID NO: 7343060 - DNA, 22 bp, Homo sapiens
tcctcagggcggcctccgtctt

SEQ ID NO: 7343061 - DNA, 19 bp, Homo sapiens
tcctcaggggctcacagac

SEQ ID NO: 7343062 - DNA, 21 bp, Homo sapiens
tcctcagggccccagagcact

SEQ ID NO: 7343063 - DNA, 22 bp, Homo sapiens
tcctcaggtcaaagcaggagaa

SEQ ID NO: 7343064 - DNA, 22 bp, Homo sapiens
tcctcaggtcaaagcaggagaa

SEQ ID NO: 7343065 - DNA, 22 bp, Homo sapiens
tcctcaggggtttcaggtgtac

SEQ ID NO: 7343066 - DNA, 22 bp, Homo sapiens
tcctcagggggccaacccagcc

SEQ ID NO: 7343067 - DNA, 22 bp, Homo sapiens
tcctcagatataaatgagggtg

SEQ ID NO: 7343068 - DNA, 22 bp, Homo sapiens
tcctcagagatgggcatctaag

SEQ ID NO: 7343069 - DNA, 22 bp, Homo sapiens
tcctaacgtataatttcaggtt

SEQ ID NO: 7343070 - DNA, 22 bp, Homo sapiens
tcctagaataatctttgactgc

SEQ ID NO: 7343071 - DNA, 22 bp, Homo sapiens
tcctagaatgcacctctgctgt

SEQ ID NO: 7343072 - DNA, 16 bp, Homo sapiens
tccctgggagtggtgg

SEQ ID NO: 7343073 - DNA, 18 bp, Homo sapiens
tccctgggatataattac

SEQ ID NO: 7343074 - DNA, 22 bp, Homo sapiens
tccggtgctgaaggcccaggtg

SEQ ID NO: 7343075 - DNA, 22 bp, Homo sapiens
tccgtatttgactattgcaccg

SEQ ID NO: 7343076 - DNA, 22 bp, Homo sapiens
tcctaacgctggttctatcaac

SEQ ID NO: 7343077 - DNA, 20 bp, Homo sapiens
tcctaacgaggcccattgca

SEQ ID NO: 7343078 - DNA, 22 bp, Homo sapiens
tcctaaatacatatcaaagatc

SEQ ID NO: 7343079 - DNA, 22 bp, Homo sapiens
tccctgggaccggcagctcaca

SEQ ID NO: 7343080 - DNA, 22 bp, Homo sapiens
tccctgggacggccttttggag

SEQ ID NO: 7343081 - DNA, 22 bp, Homo sapiens
tccctgggagatgatgatgagg

SEQ ID NO: 7343082 - DNA, 15 bp, Homo sapiens
tccctgggagatggt

SEQ ID NO: 7343083 - DNA, 22 bp, Homo sapiens
tccctgggactcagacatggaa

SEQ ID NO: 7343084 - DNA, 22 bp, Homo sapiens
tccctgggaaatgtcagtttca

SEQ ID NO: 7343085 - DNA, 22 bp, Homo sapiens
tccctgggaattaatatttgga

SEQ ID NO: 7343086 - DNA, 22 bp, Homo sapiens
tccctgggaacaaaggatgaga

SEQ ID NO: 7343087 - DNA, 22 bp, Homo sapiens
tccctggctggtgtagagggat

SEQ ID NO: 7343088 - DNA, 22 bp, Homo sapiens
tccctgcctctcagacttcctt

SEQ ID NO: 7343089 - DNA, 22 bp, Homo sapiens
tccctgcctcctggcagtgcca

SEQ ID NO: 7343090 - DNA, 22 bp, Homo sapiens
tccctcagagggcaagcgcaga

SEQ ID NO: 7343091 - DNA, 22 bp, Homo sapiens
tcccaggctggggccaggtgac

SEQ ID NO: 7343092 - DNA, 22 bp, Homo sapiens
tccctccccacttctgagcttt

SEQ ID NO: 7343093 - DNA, 22 bp, Homo sapiens
tccctccagaatggtgaggaag

SEQ ID NO: 7343094 - DNA, 22 bp, Homo sapiens
tccctgccctgccttcatggtt

SEQ ID NO: 7343095 - DNA, 18 bp, Homo sapiens
tccctccctgctgtggcc

SEQ ID NO: 7343096 - DNA, 22 bp, Homo sapiens
ggtgaggctggcttgccttctt

SEQ ID NO: 7343097 - DNA, 22 bp, Homo sapiens
ggtgaggctaagtgacacaggg

SEQ ID NO: 7343098 - DNA, 18 bp, Homo sapiens
ggtgaggcggcggccagc

SEQ ID NO: 7343099 - DNA, 18 bp, Homo sapiens
ggtgaggcggcggccagc

SEQ ID NO: 7343100 - DNA, 18 bp, Homo sapiens
ggtgaggcggcggccagc

SEQ ID NO: 7343101 - DNA, 22 bp, Homo sapiens
ggtgaggcaggtggctgctgag

SEQ ID NO: 7343102 - DNA, 22 bp, Homo sapiens
ggtgaggcaggtggctgctgag

SEQ ID NO: 7343103 - DNA, 22 bp, Homo sapiens
ggtgaggcccagtgatctgtgt

SEQ ID NO: 7343104 - DNA, 18 bp, Homo sapiens
ggtgagggagctggaagc

SEQ ID NO: 7343105 - DNA, 22 bp, Homo sapiens
ggtggaaggcctggaaggaggc

SEQ ID NO: 7343106 - DNA, 22 bp, Homo sapiens
ggtggacaaatgaatgactgaa

SEQ ID NO: 7343107 - DNA, 21 bp, Homo sapiens
ggtgctcgctgatgaggagtg

SEQ ID NO: 7343108 - DNA, 22 bp, Homo sapiens
ggtgagggagtggaacgaggtg

SEQ ID NO: 7343109 - DNA, 21 bp, Homo sapiens
ggtgctcctccatgctgctct

SEQ ID NO: 7343110 - DNA, 21 bp, Homo sapiens
ggtgctcctccatgctgctct

SEQ ID NO: 7343111 - DNA, 22 bp, Homo sapiens
ggtgaggaaagatggtgacagt

SEQ ID NO: 7343112 - DNA, 22 bp, Homo sapiens
ggtgacagcgggtcaagaggag

SEQ ID NO: 7343113 - DNA, 22 bp, Homo sapiens
ggtgagaggcagtgctgtggaa

SEQ ID NO: 7343114 - DNA, 22 bp, Homo sapiens
ggtgagaggcagtgctgtggaa

SEQ ID NO: 7343115 - DNA, 22 bp, Homo sapiens
ggtgagaggcctgagagctgga

SEQ ID NO: 7343116 - DNA, 22 bp, Homo sapiens
ggtccctgaagatgcctgagga

SEQ ID NO: 7343117 - DNA, 22 bp, Homo sapiens
gggtggtgtattagagctgcag

SEQ ID NO: 7343118 - DNA, 18 bp, Homo sapiens
gggtggtgtgctcttcgc

SEQ ID NO: 7343119 - DNA, 22 bp, Homo sapiens
gggttgggactgtcatctggag

SEQ ID NO: 7343120 - DNA, 22 bp, Homo sapiens
gggttggattacttagggagaa

SEQ ID NO: 7343121 - DNA, 23 bp, Homo sapiens
gggtttccttctggctcctcctt

SEQ ID NO: 7343122 - DNA, 22 bp, Homo sapiens
gggttttccttctgcattggag

SEQ ID NO: 7343123 - DNA, 22 bp, Homo sapiens
ggtggcagagaggaggtagttt

SEQ ID NO: 7343124 - DNA, 22 bp, Homo sapiens
ggtgggcaggcgaggcccaggt

SEQ ID NO: 7343125 - DNA, 22 bp, Homo sapiens
ggtgggcaggcgaggcccaggt

SEQ ID NO: 7343126 - DNA, 19 bp, Homo sapiens
ggtggcagaacgtgggtcc

SEQ ID NO: 7343127 - DNA, 22 bp, Homo sapiens
ggtggagagctggatgagaggt

SEQ ID NO: 7343128 - DNA, 22 bp, Homo sapiens
ggtggagctggaccaggagagg

SEQ ID NO: 7343129 - DNA, 22 bp, Homo sapiens
ggtggagctatacgggatggct

SEQ ID NO: 7343130 - DNA, 22 bp, Homo sapiens
ggtggagcgcagggtgctggcg

SEQ ID NO: 7343131 - DNA, 22 bp, Homo sapiens
ggtgggcgactgagaggggttt

SEQ ID NO: 7343132 - DNA, 22 bp, Homo sapiens
ggtgggcaggtcactctgcctc

SEQ ID NO: 7343133 - DNA, 22 bp, Homo sapiens
ggtgggccaggaaggccgccag

SEQ ID NO: 7343134 - DNA, 22 bp, Homo sapiens
ggtgggcaggtcactctgcctc

SEQ ID NO: 7343135 - DNA, 22 bp, Homo sapiens
ggtgggccaggaaggccgccag

SEQ ID NO: 7343136 - DNA, 22 bp, Homo sapiens
ggtggggccagggctccaacct

SEQ ID NO: 7343137 - DNA, 22 bp, Homo sapiens
ggtggggccagggctccaacct

SEQ ID NO: 7343138 - DNA, 22 bp, Homo sapiens
ggtgggtgcagggggcttctta

SEQ ID NO: 7343139 - DNA, 22 bp, Homo sapiens
ggtgggtgagccctgggagctg

SEQ ID NO: 7343140 - DNA, 19 bp, Homo sapiens
ggtgggtgacctccccacc

SEQ ID NO: 7343141 - DNA, 22 bp, Homo sapiens
ggtggggcctgctccagcggcc

SEQ ID NO: 7343142 - DNA, 22 bp, Homo sapiens
ggtggggccctggcactggtat

SEQ ID NO: 7343143 - DNA, 22 bp, Homo sapiens
ggttcagggatgtgggtgatgc

SEQ ID NO: 7343144 - DNA, 22 bp, Homo sapiens
ggtttaatggagatatttcaga

SEQ ID NO: 7343145 - DNA, 17 bp, Homo sapiens
ggtttaatccttacctg

SEQ ID NO: 7343146 - DNA, 22 bp, Homo sapiens
ggttgttgtgaaggtgaagaga

SEQ ID NO: 7343147 - DNA, 22 bp, Homo sapiens
ggttcacactttcatgatttca

SEQ ID NO: 7343148 - DNA, 22 bp, Homo sapiens
ggtggtggagccagctgggagt

SEQ ID NO: 7343149 - DNA, 19 bp, Homo sapiens
ggtgtttcttcattttcca

SEQ ID NO: 7343150 - DNA, 22 bp, Homo sapiens
ggttaaggaataggccatttag

SEQ ID NO: 7343151 - DNA, 22 bp, Homo sapiens
ggttaaggctttacagtcaaac

SEQ ID NO: 7343152 - DNA, 23 bp, Homo sapiens
ggtggtgctcatatctcaggcct

SEQ ID NO: 7343153 - DNA, 22 bp, Homo sapiens
ggtggtctgcgcagcccagggt

SEQ ID NO: 7343154 - DNA, 21 bp, Homo sapiens
gggtggtctagctcaggaact

SEQ ID NO: 7343155 - DNA, 22 bp, Homo sapiens
gggtggtcatctgaaggtctgg

SEQ ID NO: 7343156 - DNA, 22 bp, Homo sapiens
gggtggtctggcaggctggaaa

SEQ ID NO: 7343157 - DNA, 22 bp, Homo sapiens
gggtggtctggcaggctggaaa

SEQ ID NO: 7343158 - DNA, 21 bp, Homo sapiens
gggtggtctgctgaagaggga

SEQ ID NO: 7343159 - DNA, 22 bp, Homo sapiens
gggtggtggccagcagtgggca

SEQ ID NO: 7343160 - DNA, 21 bp, Homo sapiens
gggtggggttccagccttttc

SEQ ID NO: 7343161 - DNA, 22 bp, Homo sapiens
gggtggagccagttgactctgt

SEQ ID NO: 7343162 - DNA, 22 bp, Homo sapiens
gggtggagaggctaagtccagt

SEQ ID NO: 7343163 - DNA, 22 bp, Homo sapiens
gggtggagagaaagaaacgtga

SEQ ID NO: 7343164 - DNA, 23 bp, Homo sapiens
gggtgctgcctgtagtcatgctg

SEQ ID NO: 7343165 - DNA, 18 bp, Homo sapiens
gggtgctggggccccttg

SEQ ID NO: 7343166 - DNA, 21 bp, Homo sapiens
gggtgctgtggtcatgcagga

SEQ ID NO: 7343167 - DNA, 18 bp, Homo sapiens
gggtgcaggcactgactg

SEQ ID NO: 7343168 - DNA, 22 bp, Homo sapiens
gggtgagggatgagccttcttc

SEQ ID NO: 7343169 - DNA, 22 bp, Homo sapiens
gggtgcagagcttaactgtagg

SEQ ID NO: 7343170 - DNA, 22 bp, Homo sapiens
gggtgagggatgagccttcttc

SEQ ID NO: 7343171 - DNA, 22 bp, Homo sapiens
gggtgaggcccatttgaggcca

SEQ ID NO: 7343172 - DNA, 22 bp, Homo sapiens
gggtgaggcccatttgaggcca

SEQ ID NO: 7343173 - DNA, 22 bp, Homo sapiens
gggtgaggccttgctgccatca

SEQ ID NO: 7343174 - DNA, 22 bp, Homo sapiens
gggtgaggcccatttgaggcca

SEQ ID NO: 7343175 - DNA, 22 bp, Homo sapiens
gggtgaggagctgccagtcatg

SEQ ID NO: 7343176 - DNA, 22 bp, Homo sapiens
gggtgaggagctgccagtcatg

SEQ ID NO: 7343177 - DNA, 20 bp, Homo sapiens
gggtgaggatggagaatttg

SEQ ID NO: 7343178 - DNA, 22 bp, Homo sapiens
ggggccaggtccagcttccaaa

SEQ ID NO: 7343179 - DNA, 22 bp, Homo sapiens
ggggccagcttcgcgtgctctt

SEQ ID NO: 7343180 - DNA, 22 bp, Homo sapiens
ggggccagcttcgcgtgctctt

SEQ ID NO: 7343181 - DNA, 22 bp, Homo sapiens
ggggccaggtccagcttccaaa

SEQ ID NO: 7343182 - DNA, 22 bp, Homo sapiens
ggggccagtaggagtgatgtac

SEQ ID NO: 7343183 - DNA, 22 bp, Homo sapiens
ggggccagcttcgcgtgctctt

SEQ ID NO: 7343184 - DNA, 22 bp, Homo sapiens
ggggccagatatcactaaggtt

SEQ ID NO: 7343185 - DNA, 22 bp, Homo sapiens
ggggcccttgtggctgcaggcc

SEQ ID NO: 7343186 - DNA, 22 bp, Homo sapiens
ggggtagggcgattgctgcttt

SEQ ID NO: 7343187 - DNA, 22 bp, Homo sapiens
ggggtgagttagcgtcggcttg

SEQ ID NO: 7343188 - DNA, 22 bp, Homo sapiens
ggggcccctcggacacgtgcgg

SEQ ID NO: 7343189 - DNA, 22 bp, Homo sapiens
ggggcccgggcactggccgtca

SEQ ID NO: 7343190 - DNA, 19 bp, Homo sapiens
ggggcccggggtctgcgag

SEQ ID NO: 7343191 - DNA, 22 bp, Homo sapiens
ggggcccttgtggctgcaggcc

SEQ ID NO: 7343192 - DNA, 22 bp, Homo sapiens
ggggcccagggcagcagtgcag

SEQ ID NO: 7343193 - DNA, 22 bp, Homo sapiens
ggggcccagcacccctcctcgc

SEQ ID NO: 7343194 - DNA, 22 bp, Homo sapiens
ggggtggattcctacaggtcca

SEQ ID NO: 7343195 - DNA, 22 bp, Homo sapiens
ggggtggatttcaggcggtgtc

SEQ ID NO: 7343196 - DNA, 22 bp, Homo sapiens
ggggtggatttcaggcggtgtc

SEQ ID NO: 7343197 - DNA, 22 bp, Homo sapiens
ggggtggatttcaggcggtgtc

SEQ ID NO: 7343198 - DNA, 22 bp, Homo sapiens
ggggtggccaaggactctgacc

SEQ ID NO: 7343199 - DNA, 22 bp, Homo sapiens
ggggtggatcaggcaggcccag

SEQ ID NO: 7343200 - DNA, 22 bp, Homo sapiens
ggggtggagctaaatgtctact

SEQ ID NO: 7343201 - DNA, 22 bp, Homo sapiens
ggggtggattcctacaggtcca

SEQ ID NO: 7343202 - DNA, 22 bp, Homo sapiens
ggggtggatcaggcaggcccag

SEQ ID NO: 7343203 - DNA, 22 bp, Homo sapiens
ggggtggagatggtggcccttt

SEQ ID NO: 7343204 - DNA, 22 bp, Homo sapiens
ggggtggagatggtggcccttt

SEQ ID NO: 7343205 - DNA, 22 bp, Homo sapiens
ggggtgctgaagatgtcatggt

SEQ ID NO: 7343206 - DNA, 22 bp, Homo sapiens
ggggtgagttagcgtcggcttg

SEQ ID NO: 7343207 - DNA, 19 bp, Homo sapiens
ggggtgctagggagggatc

SEQ ID NO: 7343208 - DNA, 19 bp, Homo sapiens
ggggtgctagggagggatc

SEQ ID NO: 7343209 - DNA, 22 bp, Homo sapiens
ggggtgctagagtggggccact

SEQ ID NO: 7343210 - DNA, 22 bp, Homo sapiens
ggggtggctggcacctcctggt

SEQ ID NO: 7343211 - DNA, 22 bp, Homo sapiens
ggggtggcctgtaggcagcatg

SEQ ID NO: 7343212 - DNA, 22 bp, Homo sapiens
ggggtggcctgtaggcagcatg

SEQ ID NO: 7343213 - DNA, 22 bp, Homo sapiens
ggggtgggagtgccatccttga

SEQ ID NO: 7343214 - DNA, 19 bp, Homo sapiens
ggggtggctggggctccag

SEQ ID NO: 7343215 - DNA, 19 bp, Homo sapiens
ggggtggctggggctccag

SEQ ID NO: 7343216 - DNA, 22 bp, Homo sapiens
ggggccagatatcactaaggtt

SEQ ID NO: 7343217 - DNA, 22 bp, Homo sapiens
ggggccagagaggacccaggtg

SEQ ID NO: 7343218 - DNA, 22 bp, Homo sapiens
ggggccagagaggacccaggtg

SEQ ID NO: 7343219 - DNA, 22 bp, Homo sapiens
ggggcagtgaggtggcagcccg

SEQ ID NO: 7343220 - DNA, 20 bp, Homo sapiens
ggggcaggtttttatggcta

SEQ ID NO: 7343221 - DNA, 20 bp, Homo sapiens
ggggcaggtttttatggcta

SEQ ID NO: 7343222 - DNA, 22 bp, Homo sapiens
ggggcatcagaaccctgtggga

SEQ ID NO: 7343223 - DNA, 22 bp, Homo sapiens
ggggcagggaggttatcgccga

SEQ ID NO: 7343224 - DNA, 22 bp, Homo sapiens
ggggcagggaggttatcgccga

SEQ ID NO: 7343225 - DNA, 22 bp, Homo sapiens
ggggcagggaggttatcgccga

SEQ ID NO: 7343226 - DNA, 22 bp, Homo sapiens
ggggcagggaggttatcgccga

SEQ ID NO: 7343227 - DNA, 20 bp, Homo sapiens
ggggcaggtttttatggcta

SEQ ID NO: 7343228 - DNA, 22 bp, Homo sapiens
ggggaggctgatgtgggcaaag

SEQ ID NO: 7343229 - DNA, 22 bp, Homo sapiens
ggggaggctgatgtgggcaaag

SEQ ID NO: 7343230 - DNA, 22 bp, Homo sapiens
ggggagtgacgcagggccatag

SEQ ID NO: 7343231 - DNA, 22 bp, Homo sapiens
ggggagtgttttcatgggcttg

SEQ ID NO: 7343232 - DNA, 22 bp, Homo sapiens
ggggagtgttttcatgggcttg

SEQ ID NO: 7343233 - DNA, 22 bp, Homo sapiens
ggggatctaggcttatgagggc

SEQ ID NO: 7343234 - DNA, 22 bp, Homo sapiens
ggggcaggaggtgttctctttt

SEQ ID NO: 7343235 - DNA, 22 bp, Homo sapiens
ggggcaggaggtgttctctttt

SEQ ID NO: 7343236 - DNA, 22 bp, Homo sapiens
ggggcaggaggtgttctctttt

SEQ ID NO: 7343237 - DNA, 22 bp, Homo sapiens
ggggcaggaggtgttctctttt

SEQ ID NO: 7343238 - DNA, 22 bp, Homo sapiens
ggggaggagccatgtaactagt

SEQ ID NO: 7343239 - DNA, 22 bp, Homo sapiens
ggggaggacctttccaaggctt

SEQ ID NO: 7343240 - DNA, 22 bp, Homo sapiens
ggggaggacctttccaaggctt

SEQ ID NO: 7343241 - DNA, 22 bp, Homo sapiens
ggggaggacctttccaaggctt

SEQ ID NO: 7343242 - DNA, 22 bp, Homo sapiens
ggggaggcaagatgaagtgagg

SEQ ID NO: 7343243 - DNA, 22 bp, Homo sapiens
ggggaggccagtggaccgtccc

SEQ ID NO: 7343244 - DNA, 22 bp, Homo sapiens
ggggaggctgatgtgggcaaag

SEQ ID NO: 7343245 - DNA, 16 bp, Homo sapiens
gggctgggggattctg

SEQ ID NO: 7343246 - DNA, 18 bp, Homo sapiens
gggctgtgttcatgccca

SEQ ID NO: 7343247 - DNA, 18 bp, Homo sapiens
gggctgtgttcatgccca

SEQ ID NO: 7343248 - DNA, 18 bp, Homo sapiens
gggctgtgttcatgccca

SEQ ID NO: 7343249 - DNA, 22 bp, Homo sapiens
gggctgtgtgcccacttcccat

SEQ ID NO: 7343250 - DNA, 22 bp, Homo sapiens
gggctgtgtgcccacttcccat

SEQ ID NO: 7343251 - DNA, 22 bp, Homo sapiens
gggctgtgtgcagtacgggtcc

SEQ ID NO: 7343252 - DNA, 22 bp, Homo sapiens
gggctctgggatgctcttagag

SEQ ID NO: 7343253 - DNA, 18 bp, Homo sapiens
gggctctggcatctgggt

SEQ ID NO: 7343254 - DNA, 18 bp, Homo sapiens
gggctctggcatctgggt

SEQ ID NO: 7343255 - DNA, 19 bp, Homo sapiens
gggctctggcctcagtggg

SEQ ID NO: 7343256 - DNA, 19 bp, Homo sapiens
gggctctggcctcagtggg

SEQ ID NO: 7343257 - DNA, 22 bp, Homo sapiens
gggcttcagttctgaccatctt

SEQ ID NO: 7343258 - DNA, 20 bp, Homo sapiens
gggctgttgctcttggtttg

SEQ ID NO: 7343259 - DNA, 22 bp, Homo sapiens
gtgctgccagacagtgagaggg

SEQ ID NO: 7343260 - DNA, 22 bp, Homo sapiens
gtgctgccggcatagcagtgaa

SEQ ID NO: 7343261 - DNA, 22 bp, Homo sapiens
gtgctgcctgccagcttctggg

SEQ ID NO: 7343262 - DNA, 22 bp, Homo sapiens
gtgctgcctgccagcttctggg

SEQ ID NO: 7343263 - DNA, 21 bp, Homo sapiens
gtgctgctagcgggacgggag

SEQ ID NO: 7343264 - DNA, 22 bp, Homo sapiens
gtgctgctgaaaaacaaagtct

SEQ ID NO: 7343265 - DNA, 22 bp, Homo sapiens
gtgctggaccctggaaggtggt

SEQ ID NO: 7343266 - DNA, 22 bp, Homo sapiens
gtgctggaccctggaaggtggt

SEQ ID NO: 7343267 - DNA, 20 bp, Homo sapiens
gtgctggagttaggaaaggt

SEQ ID NO: 7343268 - DNA, 22 bp, Homo sapiens
gtgctgcttgggggcagagcag

SEQ ID NO: 7343269 - DNA, 22 bp, Homo sapiens
gtgctgacaggagcctggcggt

SEQ ID NO: 7343270 - DNA, 22 bp, Homo sapiens
gtgctgagaacaaaagtggaca

SEQ ID NO: 7343271 - DNA, 22 bp, Homo sapiens
gtgaggcagcaggagcctctgt

SEQ ID NO: 7343272 - DNA, 22 bp, Homo sapiens
gtgaggcaggcattctcctttc

SEQ ID NO: 7343273 - DNA, 22 bp, Homo sapiens
gtgaggcagagatgccaaaact

SEQ ID NO: 7343274 - DNA, 22 bp, Homo sapiens
gtgaggcagaagttccctttta

SEQ ID NO: 7343275 - DNA, 22 bp, Homo sapiens
gtgaggatgtactgagataaat

SEQ ID NO: 7343276 - DNA, 22 bp, Homo sapiens
gtgaggcaagggcatactaggc

SEQ ID NO: 7343277 - DNA, 22 bp, Homo sapiens
gtgaggatcaaatgaaatagca

SEQ ID NO: 7343278 - DNA, 22 bp, Homo sapiens
gtgaggatgtactgagataaat

SEQ ID NO: 7343279 - DNA, 22 bp, Homo sapiens
gtgcaggatttatagcccagct

SEQ ID NO: 7343280 - DNA, 22 bp, Homo sapiens
gtgcaggatttatagcccagct

SEQ ID NO: 7343281 - DNA, 22 bp, Homo sapiens
gtgcaggcaaaagggccaggcc

SEQ ID NO: 7343282 - DNA, 22 bp, Homo sapiens
gtgcaggcaaaagggccaggcc

SEQ ID NO: 7343283 - DNA, 22 bp, Homo sapiens
gtgcagggagcccagaaggtcc

SEQ ID NO: 7343284 - DNA, 22 bp, Homo sapiens
gtgcaggaggtaacatagcaaa

SEQ ID NO: 7343285 - DNA, 22 bp, Homo sapiens
gtgcaggaggtaacatagcaaa

SEQ ID NO: 7343286 - DNA, 22 bp, Homo sapiens
gtgcaggatctcagaacaagtg

SEQ ID NO: 7343287 - DNA, 22 bp, Homo sapiens
gtgcaggatgttgggaatcagg

SEQ ID NO: 7343288 - DNA, 22 bp, Homo sapiens
gtgcaggatctcagaacaagtg

SEQ ID NO: 7343289 - DNA, 22 bp, Homo sapiens
gtgcaggatgttgggaatcagg

SEQ ID NO: 7343290 - DNA, 22 bp, Homo sapiens
gtgcaggagtaggagagggctt

SEQ ID NO: 7343291 - DNA, 22 bp, Homo sapiens
gtgcaggagtaggagagggctt

SEQ ID NO: 7343292 - DNA, 22 bp, Homo sapiens
gtgcaggggatcaggttgcagc

SEQ ID NO: 7343293 - DNA, 17 bp, Homo sapiens
gtgcagggatgaaggat

SEQ ID NO: 7343294 - DNA, 17 bp, Homo sapiens
gtgcagggatgaaggat

SEQ ID NO: 7343295 - DNA, 22 bp, Homo sapiens
gtgcagggcagccgaatgggct

SEQ ID NO: 7343296 - DNA, 22 bp, Homo sapiens
gtgcagggctggcaccggaggc

SEQ ID NO: 7343297 - DNA, 22 bp, Homo sapiens
gtgagctgggtgaatggtaggg

SEQ ID NO: 7343298 - DNA, 17 bp, Homo sapiens
gtgagctgagtcaggac

SEQ ID NO: 7343299 - DNA, 22 bp, Homo sapiens
gtgagccgagtatagttcatag

SEQ ID NO: 7343300 - DNA, 22 bp, Homo sapiens
gtgagcatgtagtaatctggag

SEQ ID NO: 7343301 - DNA, 22 bp, Homo sapiens
gtgagcatatatgtaatcgttt

SEQ ID NO: 7343302 - DNA, 22 bp, Homo sapiens
gtgagcatcaaaaacgtgtatg

SEQ ID NO: 7343303 - DNA, 22 bp, Homo sapiens
gtgagcatcccttaccggaagt

SEQ ID NO: 7343304 - DNA, 22 bp, Homo sapiens
gtgagcatcttggcagatatga

SEQ ID NO: 7343305 - DNA, 22 bp, Homo sapiens
gtgagcatgccgtccaagtcac

SEQ ID NO: 7343306 - DNA, 22 bp, Homo sapiens
gtgagcatagtaccaggtagta

SEQ ID NO: 7343307 - DNA, 22 bp, Homo sapiens
gtgagcataacaacagagttta

SEQ ID NO: 7343308 - DNA, 22 bp, Homo sapiens
gtgaggagctctttgactcacg

SEQ ID NO: 7343309 - DNA, 22 bp, Homo sapiens
gtctttcatggatattcagttt

SEQ ID NO: 7343310 - DNA, 22 bp, Homo sapiens
gtcttttttacaccttacatca

SEQ ID NO: 7343311 - DNA, 22 bp, Homo sapiens
gtgaaaagagagcctgtgtcag

SEQ ID NO: 7343312 - DNA, 22 bp, Homo sapiens
gtgagcagggcaggactgggga

SEQ ID NO: 7343313 - DNA, 22 bp, Homo sapiens
gtctccagggacacactagccg

SEQ ID NO: 7343314 - DNA, 22 bp, Homo sapiens
gtctccagttacagcagccagg

SEQ ID NO: 7343315 - DNA, 22 bp, Homo sapiens
gtctccagttacagcagccagg

SEQ ID NO: 7343316 - DNA, 22 bp, Homo sapiens
gtctaattcctgctcttactca

SEQ ID NO: 7343317 - DNA, 22 bp, Homo sapiens
gtctatgtgtaatagcatgtgt

SEQ ID NO: 7343318 - DNA, 22 bp, Homo sapiens
gtctccagaggttacatcctgt

SEQ ID NO: 7343319 - DNA, 22 bp, Homo sapiens
gtctatgatattttgttatagc

SEQ ID NO: 7343320 - DNA, 22 bp, Homo sapiens
gtctatatattgcttgaataat

SEQ ID NO: 7343321 - DNA, 22 bp, Homo sapiens
gtcactgacatggtcattggca

SEQ ID NO: 7343322 - DNA, 22 bp, Homo sapiens
gtcactgacaagagagaagaac

SEQ ID NO: 7343323 - DNA, 22 bp, Homo sapiens
gtcactgactctgggagatgtg

SEQ ID NO: 7343324 - DNA, 22 bp, Homo sapiens
gtcagaaaacttccctttgagt

SEQ ID NO: 7343325 - DNA, 22 bp, Homo sapiens
gtcagaaaacttccctttgagt

SEQ ID NO: 7343326 - DNA, 22 bp, Homo sapiens
gtcagaaaccagtcaaacaaga

SEQ ID NO: 7343327 - DNA, 22 bp, Homo sapiens
gtcctctgtagggctgggccac

SEQ ID NO: 7343328 - DNA, 22 bp, Homo sapiens
gtccaggcctgcctctgaggag

SEQ ID NO: 7343329 - DNA, 22 bp, Homo sapiens
gtatttttaggtaaggaaagta

SEQ ID NO: 7343330 - DNA, 22 bp, Homo sapiens
gtatttttagtagagtcggggt

SEQ ID NO: 7343331 - DNA, 22 bp, Homo sapiens
gtatttttcagttaggagctta

SEQ ID NO: 7343332 - DNA, 22 bp, Homo sapiens
gtatttttcattccaagtgaga

SEQ ID NO: 7343333 - DNA, 22 bp, Homo sapiens
gtcaaaatgagctttgttattg

SEQ ID NO: 7343334 - DNA, 22 bp, Homo sapiens
gtagtgtgtaggcactgtgctc

SEQ ID NO: 7343335 - DNA, 22 bp, Homo sapiens
gtatacagatacttagacgtgc

SEQ ID NO: 7343336 - DNA, 22 bp, Homo sapiens
gtataaggattccagttgctcc

SEQ ID NO: 7343337 - DNA, 22 bp, Homo sapiens
gtatacatagatgatgaacaag

SEQ ID NO: 7343338 - DNA, 22 bp, Homo sapiens
gtaggggtcaggtagggactct

SEQ ID NO: 7343339 - DNA, 22 bp, Homo sapiens
gtaggggccagaaagacttaga

SEQ ID NO: 7343340 - DNA, 22 bp, Homo sapiens
gtaggggtgctgagatctggaa

SEQ ID NO: 7343341 - DNA, 22 bp, Homo sapiens
gtagggctcagtaaatactttg

SEQ ID NO: 7343342 - DNA, 22 bp, Homo sapiens
gtagtcccagctaccccggagg

SEQ ID NO: 7343343 - DNA, 22 bp, Homo sapiens
gtagtattttctgtgatgtagg

SEQ ID NO: 7343344 - DNA, 22 bp, Homo sapiens
gtacaacaggattgatgtacca

SEQ ID NO: 7343345 - DNA, 22 bp, Homo sapiens
gtacaaattaggaagctttgtg

SEQ ID NO: 7343346 - DNA, 22 bp, Homo sapiens
gggccctgtgatttcttgagga

SEQ ID NO: 7343347 - DNA, 22 bp, Homo sapiens
gggccggagctgggtcccgcgc

SEQ ID NO: 7343348 - DNA, 22 bp, Homo sapiens
gggccggagctgggtcccgcgc

SEQ ID NO: 7343349 - DNA, 22 bp, Homo sapiens
gggccctggggcctgatttgca

SEQ ID NO: 7343350 - DNA, 21 bp, Homo sapiens
gggctatgttggccaccttcc

SEQ ID NO: 7343351 - DNA, 22 bp, Homo sapiens
gggctaggtctgatcagagaag

SEQ ID NO: 7343352 - DNA, 22 bp, Homo sapiens
gggctaggtctgatcagagaag

SEQ ID NO: 7343353 - DNA, 22 bp, Homo sapiens
gggccctcagtcccaggccttc

SEQ ID NO: 7343354 - DNA, 22 bp, Homo sapiens
gggccctgatctgtgagcgcag

SEQ ID NO: 7343355 - DNA, 22 bp, Homo sapiens
gggccctgatctgtgagcgcag

SEQ ID NO: 7343356 - DNA, 22 bp, Homo sapiens
gggccctgccccgtggctctga

SEQ ID NO: 7343357 - DNA, 22 bp, Homo sapiens
gggccctgccccgtggctctga

SEQ ID NO: 7343358 - DNA, 22 bp, Homo sapiens
gggccctgccccgtggctctga

SEQ ID NO: 7343359 - DNA, 22 bp, Homo sapiens
gggccctgcctaaggaacacac

SEQ ID NO: 7343360 - DNA, 22 bp, Homo sapiens
gggccctggggatgtggacgcg

SEQ ID NO: 7343361 - DNA, 22 bp, Homo sapiens
gggccctgggattcagagcaag

SEQ ID NO: 7343362 - DNA, 22 bp, Homo sapiens
gggccctgggattcagagcaag

SEQ ID NO: 7343363 - DNA, 22 bp, Homo sapiens
gggcaggtgtgcagagctgttg

SEQ ID NO: 7343364 - DNA, 22 bp, Homo sapiens
gggcaggtgtgcagagctgttg

SEQ ID NO: 7343365 - DNA, 22 bp, Homo sapiens
gggcaggtggcagggtctctgg

SEQ ID NO: 7343366 - DNA, 22 bp, Homo sapiens
gggcaggtggcagggtctctgg

SEQ ID NO: 7343367 - DNA, 22 bp, Homo sapiens
gggcaggtggcagggtctctgg

SEQ ID NO: 7343368 - DNA, 22 bp, Homo sapiens
gggcaggtggagggcccagcca

SEQ ID NO: 7343369 - DNA, 22 bp, Homo sapiens
gggcaggtggcaaagccagagg

SEQ ID NO: 7343370 - DNA, 22 bp, Homo sapiens
gggcaggtgcccagggccagag

SEQ ID NO: 7343371 - DNA, 22 bp, Homo sapiens
gggccccttgctgctctgctgg

SEQ ID NO: 7343372 - DNA, 22 bp, Homo sapiens
gggccccttgtatctctggctc

SEQ ID NO: 7343373 - DNA, 22 bp, Homo sapiens
gggccccactggggctgcctgc

SEQ ID NO: 7343374 - DNA, 22 bp, Homo sapiens
gggccccagtcctcccacgtgg

SEQ ID NO: 7343375 - DNA, 22 bp, Homo sapiens
gggcaggtgtttccaaggtgag

SEQ ID NO: 7343376 - DNA, 22 bp, Homo sapiens
gggcaggtgtttccaaggtgag

SEQ ID NO: 7343377 - DNA, 22 bp, Homo sapiens
gggcccagtaccctctgccaag

SEQ ID NO: 7343378 - DNA, 22 bp, Homo sapiens
gggcccagtaccctctgccaag

SEQ ID NO: 7343379 - DNA, 22 bp, Homo sapiens
gggccccaaaatgccaggctct

SEQ ID NO: 7343380 - DNA, 22 bp, Homo sapiens
gggctctggaaatgggagctcc

SEQ ID NO: 7343381 - DNA, 22 bp, Homo sapiens
gggctctggaaatgggagctcc

SEQ ID NO: 7343382 - DNA, 22 bp, Homo sapiens
gggctctggatggagcctgcag

SEQ ID NO: 7343383 - DNA, 22 bp, Homo sapiens
gggctccaaaatcctgtagcct

SEQ ID NO: 7343384 - DNA, 22 bp, Homo sapiens
gggctccaacggtgagcatgga

SEQ ID NO: 7343385 - DNA, 22 bp, Homo sapiens
gggctctgaatcccaggtctgc

SEQ ID NO: 7343386 - DNA, 21 bp, Homo sapiens
gggctcagcgctcggctcctc

SEQ ID NO: 7343387 - DNA, 21 bp, Homo sapiens
gggctcagcgctcggctcctc

SEQ ID NO: 7343388 - DNA, 22 bp, Homo sapiens
gggctcagctgggcgtgctggt

SEQ ID NO: 7343389 - DNA, 22 bp, Homo sapiens
gggctcagttctgcttcatgct

SEQ ID NO: 7343390 - DNA, 22 bp, Homo sapiens
gggctcagacatccctcctgga

SEQ ID NO: 7343391 - DNA, 22 bp, Homo sapiens
gggctcagaggagtggcctggg

SEQ ID NO: 7343392 - DNA, 23 bp, Homo sapiens
gggctcagatttcattctgtgcc

SEQ ID NO: 7343393 - DNA, 22 bp, Homo sapiens
gggctcagccccattgaaccag

SEQ ID NO: 7343394 - DNA, 22 bp, Homo sapiens
gggctcagccccattgaaccag

SEQ ID NO: 7343395 - DNA, 22 bp, Homo sapiens
gggagtggagagcaatggatga

SEQ ID NO: 7343396 - DNA, 22 bp, Homo sapiens
gggagtggattatgtggaccca

SEQ ID NO: 7343397 - DNA, 22 bp, Homo sapiens
gggaggttgaggctgcagtgag

SEQ ID NO: 7343398 - DNA, 22 bp, Homo sapiens
gggagcgggactgcgcaggctt

SEQ ID NO: 7343399 - DNA, 22 bp, Homo sapiens
gggagctctccctgaggcctgg

SEQ ID NO: 7343400 - DNA, 22 bp, Homo sapiens
gggagtgggtttggcctaggcc

SEQ ID NO: 7343401 - DNA, 22 bp, Homo sapiens
gggagtggggcttaccttgaag

SEQ ID NO: 7343402 - DNA, 22 bp, Homo sapiens
gggagtggtcctttcctatctg

SEQ ID NO: 7343403 - DNA, 22 bp, Homo sapiens
gggagtgggtttggcctaggcc

SEQ ID NO: 7343404 - DNA, 22 bp, Homo sapiens
gggagtggttgatggtgaaaat

SEQ ID NO: 7343405 - DNA, 19 bp, Homo sapiens
gggatcagcccagggctct

SEQ ID NO: 7343406 - DNA, 20 bp, Homo sapiens
gggatcaggaaaggaggcta

SEQ ID NO: 7343407 - DNA, 19 bp, Homo sapiens
gggatcagcccagggctct

SEQ ID NO: 7343408 - DNA, 22 bp, Homo sapiens
gggcagagactcagaaacagaa

SEQ ID NO: 7343409 - DNA, 22 bp, Homo sapiens
gggcagagactcagaaacagaa

SEQ ID NO: 7343410 - DNA, 22 bp, Homo sapiens
gggcagagagctggaactcctt

SEQ ID NO: 7343411 - DNA, 22 bp, Homo sapiens
gggcactgggtcttctccacgc

SEQ ID NO: 7343412 - DNA, 22 bp, Homo sapiens
gggcagaggctctggcccatcc

SEQ ID NO: 7343413 - DNA, 20 bp, Homo sapiens
gggcagagccagccagtccc

SEQ ID NO: 7343414 - DNA, 20 bp, Homo sapiens
gggcagagccagccagtccc

SEQ ID NO: 7343415 - DNA, 22 bp, Homo sapiens
gggcagagagctggaactcctt

SEQ ID NO: 7343416 - DNA, 20 bp, Homo sapiens
gggcagagccagccagtccc

SEQ ID NO: 7343417 - DNA, 22 bp, Homo sapiens
gggcagagagctggaactcctt

SEQ ID NO: 7343418 - DNA, 22 bp, Homo sapiens
gggcagaggctctggcccatcc

SEQ ID NO: 7343419 - DNA, 22 bp, Homo sapiens
gggcagaggctctggcccatcc

SEQ ID NO: 7343420 - DNA, 21 bp, Homo sapiens
gggcagaggggcctcctgggt

SEQ ID NO: 7343421 - DNA, 21 bp, Homo sapiens
gggcagaggggcctcctgggt

SEQ ID NO: 7343422 - DNA, 21 bp, Homo sapiens
gggcagaggggcctcctgggt

SEQ ID NO: 7343423 - DNA, 21 bp, Homo sapiens
gggcagaggggcctcctgggt

SEQ ID NO: 7343424 - DNA, 17 bp, Homo sapiens
gggcagggactcctggg

SEQ ID NO: 7343425 - DNA, 22 bp, Homo sapiens
gggcaggtgacctcttgtcctg

SEQ ID NO: 7343426 - DNA, 22 bp, Homo sapiens
gggcaggtgattttggctccat

SEQ ID NO: 7343427 - DNA, 22 bp, Homo sapiens
gggcaggtgattttggctccat

SEQ ID NO: 7343428 - DNA, 22 bp, Homo sapiens
gggcaggtctgggtcagcctga

SEQ ID NO: 7343429 - DNA, 22 bp, Homo sapiens
gggcaggtgccagctccctgtc

SEQ ID NO: 7343430 - DNA, 21 bp, Homo sapiens
gggcaggtctctgatgtcaac

SEQ ID NO: 7343431 - DNA, 15 bp, Homo sapiens
gggcaggtctggggc

SEQ ID NO: 7343432 - DNA, 17 bp, Homo sapiens
ggctggagcagctcccc

SEQ ID NO: 7343433 - DNA, 22 bp, Homo sapiens
ggctggagacaacgtcctgccc

SEQ ID NO: 7343434 - DNA, 22 bp, Homo sapiens
ggctgcaggcttccctccagca

SEQ ID NO: 7343435 - DNA, 22 bp, Homo sapiens
ggctctgcggcgtgtgcgcagg

SEQ ID NO: 7343436 - DNA, 22 bp, Homo sapiens
ggctctgcgcctgcggggactt

SEQ ID NO: 7343437 - DNA, 22 bp, Homo sapiens
ggctctgcgcggtaaagtgact

SEQ ID NO: 7343438 - DNA, 22 bp, Homo sapiens
ggctctgcggcgtgtgcgcagg

SEQ ID NO: 7343439 - DNA, 17 bp, Homo sapiens
ggctgcagtccaggagg

SEQ ID NO: 7343440 - DNA, 22 bp, Homo sapiens
ggctgcctcctcgagacaggat

SEQ ID NO: 7343441 - DNA, 22 bp, Homo sapiens
ggctgccagtgagtgcagaccg

SEQ ID NO: 7343442 - DNA, 22 bp, Homo sapiens
ggctgccaggagggaggccagt

SEQ ID NO: 7343443 - DNA, 22 bp, Homo sapiens
ggctgcagttgtgtgaaggccg

SEQ ID NO: 7343444 - DNA, 22 bp, Homo sapiens
ggctgccacatgccatgtcctc

SEQ ID NO: 7343445 - DNA, 22 bp, Homo sapiens
ggctgccaggagaagctcagtg

SEQ ID NO: 7343446 - DNA, 22 bp, Homo sapiens
ggctgtggtctcatctagcctt

SEQ ID NO: 7343447 - DNA, 22 bp, Homo sapiens
ggctgtggggccgggtacagtg

SEQ ID NO: 7343448 - DNA, 22 bp, Homo sapiens
ggctgtggggccgggtacagtg

SEQ ID NO: 7343449 - DNA, 22 bp, Homo sapiens
ggctgtgggatgcataggagct

SEQ ID NO: 7343450 - DNA, 22 bp, Homo sapiens
ggctgtgggtgtgacaggcctc

SEQ ID NO: 7343451 - DNA, 22 bp, Homo sapiens
ggctgtggggggagcctgcccg

SEQ ID NO: 7343452 - DNA, 22 bp, Homo sapiens
ggctgtgggccagctagaccct

SEQ ID NO: 7343453 - DNA, 22 bp, Homo sapiens
ggctgtggcagctggaagtggt

SEQ ID NO: 7343454 - DNA, 22 bp, Homo sapiens
ggctgtggcagctggaagtggt

SEQ ID NO: 7343455 - DNA, 22 bp, Homo sapiens
ggctgtggcattaggtgaggcc

SEQ ID NO: 7343456 - DNA, 22 bp, Homo sapiens
ggctgtggcattaggtgaggcc

SEQ ID NO: 7343457 - DNA, 22 bp, Homo sapiens
ggctgtggacactgagctcaga

SEQ ID NO: 7343458 - DNA, 18 bp, Homo sapiens
ggctgtgcgtggaggctg

SEQ ID NO: 7343459 - DNA, 22 bp, Homo sapiens
ggctgtgcgtcatccggctgca

SEQ ID NO: 7343460 - DNA, 22 bp, Homo sapiens
ggctgtgcgggcagccgtggga

SEQ ID NO: 7343461 - DNA, 23 bp, Homo sapiens
gggagccaggacctcgcgcccca

SEQ ID NO: 7343462 - DNA, 22 bp, Homo sapiens
gggagccagcagggcatggagc

SEQ ID NO: 7343463 - DNA, 22 bp, Homo sapiens
gggagccactcagctgagagtt

SEQ ID NO: 7343464 - DNA, 22 bp, Homo sapiens
gggagccacagtagcagctact

SEQ ID NO: 7343465 - DNA, 23 bp, Homo sapiens
gggagatgggaaatgaaggctct

SEQ ID NO: 7343466 - DNA, 22 bp, Homo sapiens
gggaaggcatacctgagggaga

SEQ ID NO: 7343467 - DNA, 22 bp, Homo sapiens
gggaaggcaggattctctggtg

SEQ ID NO: 7343468 - DNA, 22 bp, Homo sapiens
gggaaggcaccatggtgttcca

SEQ ID NO: 7343469 - DNA, 22 bp, Homo sapiens
gggaaggcagtgtctggttgaa

SEQ ID NO: 7343470 - DNA, 22 bp, Homo sapiens
gggaaggcagtgggaggaactg

SEQ ID NO: 7343471 - DNA, 22 bp, Homo sapiens
gggaagagtgtcggttgaagtg

SEQ ID NO: 7343472 - DNA, 22 bp, Homo sapiens
gggaagagtaactagcccatgt

SEQ ID NO: 7343473 - DNA, 22 bp, Homo sapiens
gggaagagggagctggaatgat

SEQ ID NO: 7343474 - DNA, 17 bp, Homo sapiens
ggctctcttccagactt

SEQ ID NO: 7343475 - DNA, 22 bp, Homo sapiens
ggctcagcaatgatgagcccct

SEQ ID NO: 7343476 - DNA, 22 bp, Homo sapiens
ggctcactgcaacttccgcctc

SEQ ID NO: 7343477 - DNA, 22 bp, Homo sapiens
ggctcagaaactaaaggcgctg

SEQ ID NO: 7343478 - DNA, 22 bp, Homo sapiens
ggctcagaaggccatgctctgc

SEQ ID NO: 7343479 - DNA, 22 bp, Homo sapiens
ggctcagaggccagcaggtaga

SEQ ID NO: 7343480 - DNA, 22 bp, Homo sapiens
ggctctgcactcagagtcattc

SEQ ID NO: 7343481 - DNA, 22 bp, Homo sapiens
ggctctgcatgcaggttgtcag

SEQ ID NO: 7343482 - DNA, 22 bp, Homo sapiens
ggctctgcatgtgagtgggtgg

SEQ ID NO: 7343483 - DNA, 22 bp, Homo sapiens
ggctctgcagtgacttgagggg

SEQ ID NO: 7343484 - DNA, 22 bp, Homo sapiens
ggctctgcagagggcccagctt

SEQ ID NO: 7343485 - DNA, 22 bp, Homo sapiens
ggctctgccacttcttggctgt

SEQ ID NO: 7343486 - DNA, 22 bp, Homo sapiens
ggctctgccatttcctagctgc

SEQ ID NO: 7343487 - DNA, 22 bp, Homo sapiens
ggctctgcccaggtggacagca

SEQ ID NO: 7343488 - DNA, 20 bp, Homo sapiens
ggctctgccccaccccgtcc

SEQ ID NO: 7343489 - DNA, 22 bp, Homo sapiens
ggctctgcccgcggctgcccac

SEQ ID NO: 7343490 - DNA, 22 bp, Homo sapiens
ggctctgcctctgaccctctgg

SEQ ID NO: 7343491 - DNA, 22 bp, Homo sapiens
ggctctgcctgcccagcagcac

SEQ ID NO: 7343492 - DNA, 22 bp, Homo sapiens
ggctctgcctgcctgagtgtcc

SEQ ID NO: 7343493 - DNA, 22 bp, Homo sapiens
ggctctgcgcctgcggggactt

SEQ ID NO: 7343494 - DNA, 22 bp, Homo sapiens
ggctctgcctgcctgagtgtcc

SEQ ID NO: 7343495 - DNA, 22 bp, Homo sapiens
ggctagggacacagctctgctc

SEQ ID NO: 7343496 - DNA, 23 bp, Homo sapiens
ggctcacacggagtgcctccacc

SEQ ID NO: 7343497 - DNA, 22 bp, Homo sapiens
ggcctctggtcaagacaagcat

SEQ ID NO: 7343498 - DNA, 22 bp, Homo sapiens
ggcctctggggtcctgagccca

SEQ ID NO: 7343499 - DNA, 22 bp, Homo sapiens
ggcctctgcttatgctgatgac

SEQ ID NO: 7343500 - DNA, 22 bp, Homo sapiens
ggcctctctgagagcagacgtt

SEQ ID NO: 7343501 - DNA, 22 bp, Homo sapiens
ggcctctcttgggacagctgtc

SEQ ID NO: 7343502 - DNA, 21 bp, Homo sapiens
ggcctcccggaccgcagcgcc

SEQ ID NO: 7343503 - DNA, 22 bp, Homo sapiens
ggcctctgcctcatctgggcac

SEQ ID NO: 7343504 - DNA, 22 bp, Homo sapiens
ggcctctgcctcatctgggcac

SEQ ID NO: 7343505 - DNA, 22 bp, Homo sapiens
ggcctctgccccagccacacct

SEQ ID NO: 7343506 - DNA, 22 bp, Homo sapiens
ggcctctgccccgcggggctcg

SEQ ID NO: 7343507 - DNA, 19 bp, Homo sapiens
ggcctctgcaggccgcccc

SEQ ID NO: 7343508 - DNA, 22 bp, Homo sapiens
ggcctctgcaactggctgtggc

SEQ ID NO: 7343509 - DNA, 22 bp, Homo sapiens
ggcctctgcaactggctgtggc

SEQ ID NO: 7343510 - DNA, 22 bp, Homo sapiens
ggcccaggctggagtgcggtgg

SEQ ID NO: 7343511 - DNA, 22 bp, Homo sapiens
ggcccaggctggagtgcagtgg

SEQ ID NO: 7343512 - DNA, 22 bp, Homo sapiens
ggcccaggctggagtgcagtgg

SEQ ID NO: 7343513 - DNA, 22 bp, Homo sapiens
ggcccagctgtgcttccagccc

SEQ ID NO: 7343514 - DNA, 22 bp, Homo sapiens
ggcccagctttcattccttgct

SEQ ID NO: 7343515 - DNA, 22 bp, Homo sapiens
ggcccagctgggcggggacacg

SEQ ID NO: 7343516 - DNA, 22 bp, Homo sapiens
ggcccagctgggcggggacacg

SEQ ID NO: 7343517 - DNA, 22 bp, Homo sapiens
ggcccatgcatcctgtgcagcc

SEQ ID NO: 7343518 - DNA, 22 bp, Homo sapiens
ggcccaggctggagtgcggtgg

SEQ ID NO: 7343519 - DNA, 22 bp, Homo sapiens
ggcccaggctggagtgcggtgg

SEQ ID NO: 7343520 - DNA, 22 bp, Homo sapiens
ggcccaggtccagcgagtacct

SEQ ID NO: 7343521 - DNA, 20 bp, Homo sapiens
ggccagctggaggcgccggg

SEQ ID NO: 7343522 - DNA, 22 bp, Homo sapiens
ggccagctggagttccgggtgg

SEQ ID NO: 7343523 - DNA, 22 bp, Homo sapiens
ggcccagcgaggccacctacag

SEQ ID NO: 7343524 - DNA, 21 bp, Homo sapiens
ggccagctgcatatgtcactg

SEQ ID NO: 7343525 - DNA, 22 bp, Homo sapiens
ggccagctgctcagtgtctctg

SEQ ID NO: 7343526 - DNA, 22 bp, Homo sapiens
ggccagctgccaccagccctat

SEQ ID NO: 7343527 - DNA, 21 bp, Homo sapiens
ggccagcagcgtccactgtgg

SEQ ID NO: 7343528 - DNA, 22 bp, Homo sapiens
ggccagcatatagagtgaagta

SEQ ID NO: 7343529 - DNA, 22 bp, Homo sapiens
ggcagtgggaaataagtgagaa

SEQ ID NO: 7343530 - DNA, 22 bp, Homo sapiens
ggccacagtctctggaaggatg

SEQ ID NO: 7343531 - DNA, 22 bp, Homo sapiens
ggccacagtctctggaaggatg

SEQ ID NO: 7343532 - DNA, 22 bp, Homo sapiens
ggccacagagggcgggatgctg

SEQ ID NO: 7343533 - DNA, 22 bp, Homo sapiens
ggccacagcagatgcttcagat

SEQ ID NO: 7343534 - DNA, 22 bp, Homo sapiens
ggccagagtctatatgcagaca

SEQ ID NO: 7343535 - DNA, 22 bp, Homo sapiens
ggcaggctttcagcatcaagtc

SEQ ID NO: 7343536 - DNA, 22 bp, Homo sapiens
ggcaggcttgatatggggggac

SEQ ID NO: 7343537 - DNA, 22 bp, Homo sapiens
ggcagctcgatgacttctgcat

SEQ ID NO: 7343538 - DNA, 20 bp, Homo sapiens
ggcagcgggttcgggcgcag

SEQ ID NO: 7343539 - DNA, 22 bp, Homo sapiens
ggcagccctttctggccagctc

SEQ ID NO: 7343540 - DNA, 22 bp, Homo sapiens
ggcagccctttctggccagctc

SEQ ID NO: 7343541 - DNA, 22 bp, Homo sapiens
ggcagccatgtcccagggcttc

SEQ ID NO: 7343542 - DNA, 22 bp, Homo sapiens
ggcagccatgtgggcagcgagt

SEQ ID NO: 7343543 - DNA, 22 bp, Homo sapiens
ggcagccatgtgggcagcgagt

SEQ ID NO: 7343544 - DNA, 22 bp, Homo sapiens
ggcagccccagaaacagttcag

SEQ ID NO: 7343545 - DNA, 22 bp, Homo sapiens
ggcagccttgactagtgactta

SEQ ID NO: 7343546 - DNA, 21 bp, Homo sapiens
ggcagcctctgtggaagggga

SEQ ID NO: 7343547 - DNA, 22 bp, Homo sapiens
ggcagggactttgcaaatcttt

SEQ ID NO: 7343548 - DNA, 22 bp, Homo sapiens
ggcagggactatgtttcatgga

SEQ ID NO: 7343549 - DNA, 22 bp, Homo sapiens
ggcagggaagctggcatcacgg

SEQ ID NO: 7343550 - DNA, 18 bp, Homo sapiens
ggcagggaaaagataggg

SEQ ID NO: 7343551 - DNA, 22 bp, Homo sapiens
ggcaggggtcctggtgttgact

SEQ ID NO: 7343552 - DNA, 17 bp, Homo sapiens
ggcagtggaggaagaga

SEQ ID NO: 7343553 - DNA, 22 bp, Homo sapiens
ggcagtgcccggtgcctcctct

SEQ ID NO: 7343554 - DNA, 22 bp, Homo sapiens
ggcagtgcaggcccttcagcct

SEQ ID NO: 7343555 - DNA, 22 bp, Homo sapiens
ggcagtgcaaggcagcctggat

SEQ ID NO: 7343556 - DNA, 22 bp, Homo sapiens
ggcagtgatgtcaaacagtgaa

SEQ ID NO: 7343557 - DNA, 21 bp, Homo sapiens
ggcagtgatgtgaagtgcatc

SEQ ID NO: 7343558 - DNA, 22 bp, Homo sapiens
ggcagtgactggggacccccaa

SEQ ID NO: 7343559 - DNA, 22 bp, Homo sapiens
ggcagcagaactggccctgtat

SEQ ID NO: 7343560 - DNA, 22 bp, Homo sapiens
ggcagcactgcagcttgttggg

SEQ ID NO: 7343561 - DNA, 22 bp, Homo sapiens
ggcagatgttgcagtgagcaga

SEQ ID NO: 7343562 - DNA, 22 bp, Homo sapiens
ggcagaggtgacagtgtctttt

SEQ ID NO: 7343563 - DNA, 22 bp, Homo sapiens
ggcagaggtgaagttcacaagg

SEQ ID NO: 7343564 - DNA, 22 bp, Homo sapiens
ggcagaggtgaagttcacaagg

SEQ ID NO: 7343565 - DNA, 22 bp, Homo sapiens
ggcactgataatgtcctctctc

SEQ ID NO: 7343566 - DNA, 22 bp, Homo sapiens
ggcactgatctgatttccctcc

SEQ ID NO: 7343567 - DNA, 22 bp, Homo sapiens
ggcactgattccattcatgaag

SEQ ID NO: 7343568 - DNA, 22 bp, Homo sapiens
ggcactgaaccaggacacaagc

SEQ ID NO: 7343569 - DNA, 23 bp, Homo sapiens
ggcactgaagctacaatggtgag

SEQ ID NO: 7343570 - DNA, 22 bp, Homo sapiens
ggcactgaagtgggtgttgggt

SEQ ID NO: 7343571 - DNA, 22 bp, Homo sapiens
ggcacgtgcctaaggagcaggc

SEQ ID NO: 7343572 - DNA, 22 bp, Homo sapiens
ggcacgtgcctaaggagcaggc

SEQ ID NO: 7343573 - DNA, 22 bp, Homo sapiens
ggcactgaatttcttggcatct

SEQ ID NO: 7343574 - DNA, 22 bp, Homo sapiens
ggcactgacactagcatggcac

SEQ ID NO: 7343575 - DNA, 22 bp, Homo sapiens
ggcactgactgtgcagcgcacc

SEQ ID NO: 7343576 - DNA, 21 bp, Homo sapiens
ggcactgagccagatggactc

SEQ ID NO: 7343577 - DNA, 22 bp, Homo sapiens
ggcactgagaacaggctgactt

SEQ ID NO: 7343578 - DNA, 22 bp, Homo sapiens
ggcactgagaggctcttcctaa

SEQ ID NO: 7343579 - DNA, 22 bp, Homo sapiens
ggcactgagctgccttggggca

SEQ ID NO: 7343580 - DNA, 22 bp, Homo sapiens
ggcactgagcgggctctgagcg

SEQ ID NO: 7343581 - DNA, 22 bp, Homo sapiens
ggaggcagaacttcccgtcagt

SEQ ID NO: 7343582 - DNA, 22 bp, Homo sapiens
ggcaccaggctgggcataggcc

SEQ ID NO: 7343583 - DNA, 18 bp, Homo sapiens
ggcacctctcttgcctta

SEQ ID NO: 7343584 - DNA, 22 bp, Homo sapiens
ggcacccttggggggccacagc

SEQ ID NO: 7343585 - DNA, 22 bp, Homo sapiens
ggcacctggtaagtgctcagta

SEQ ID NO: 7343586 - DNA, 22 bp, Homo sapiens
ggaggaggtgggttaagttgta

SEQ ID NO: 7343587 - DNA, 22 bp, Homo sapiens
ggaggaggggtttacattggaa

SEQ ID NO: 7343588 - DNA, 22 bp, Homo sapiens
ggaggagtcagttgggctgctt

SEQ ID NO: 7343589 - DNA, 22 bp, Homo sapiens
ggaggagtcagttgggctgctt

SEQ ID NO: 7343590 - DNA, 22 bp, Homo sapiens
ggaggaggggtttacattggaa

SEQ ID NO: 7343591 - DNA, 22 bp, Homo sapiens
ggaggaggggtgactgaatgct

SEQ ID NO: 7343592 - DNA, 22 bp, Homo sapiens
ggaggatgagctacgaggagct

SEQ ID NO: 7343593 - DNA, 19 bp, Homo sapiens
gctctccctctcagttgag

SEQ ID NO: 7343594 - DNA, 22 bp, Homo sapiens
gctccctcccaccagcctgcag

SEQ ID NO: 7343595 - DNA, 22 bp, Homo sapiens
gctccctgaaaagaacaaagtc

SEQ ID NO: 7343596 - DNA, 22 bp, Homo sapiens
gctctccaggggctcccaggat

SEQ ID NO: 7343597 - DNA, 22 bp, Homo sapiens
gctctccaggtccaagaatcca

SEQ ID NO: 7343598 - DNA, 22 bp, Homo sapiens
gctccctcccaccagcctgcag

SEQ ID NO: 7343599 - DNA, 20 bp, Homo sapiens
gctcccagcctgcagtcccc

SEQ ID NO: 7343600 - DNA, 20 bp, Homo sapiens
gctcccagcctgcagtcccc

SEQ ID NO: 7343601 - DNA, 22 bp, Homo sapiens
gctcccagcattgcttcccagg

SEQ ID NO: 7343602 - DNA, 22 bp, Homo sapiens
gctcccagcattgctgctgaat

SEQ ID NO: 7343603 - DNA, 22 bp, Homo sapiens
gctcccaggatgaggagccagg

SEQ ID NO: 7343604 - DNA, 22 bp, Homo sapiens
gctcccagctggagcctcaaca

SEQ ID NO: 7343605 - DNA, 22 bp, Homo sapiens
gctctgtatgagggtgagagat

SEQ ID NO: 7343606 - DNA, 22 bp, Homo sapiens
gctctgtgaccttaggcaagtt

SEQ ID NO: 7343607 - DNA, 22 bp, Homo sapiens
gctctgtgaagggtgttgctca

SEQ ID NO: 7343608 - DNA, 21 bp, Homo sapiens
gctctgtgaaatttcaccagg

SEQ ID NO: 7343609 - DNA, 18 bp, Homo sapiens
gctctgtgaccttgagca

SEQ ID NO: 7343610 - DNA, 22 bp, Homo sapiens
gctctgtgagccacttgatgta

SEQ ID NO: 7343611 - DNA, 22 bp, Homo sapiens
gctctgtgagtattggccctgg

SEQ ID NO: 7343612 - DNA, 22 bp, Homo sapiens
gctctgtggcaggaggtcttgt

SEQ ID NO: 7343613 - DNA, 22 bp, Homo sapiens
gctctgtgctagaactaagaat

SEQ ID NO: 7343614 - DNA, 20 bp, Homo sapiens
gctctgtgctggcggaggct

SEQ ID NO: 7343615 - DNA, 22 bp, Homo sapiens
gctctgtgcccctgccgtggac

SEQ ID NO: 7343616 - DNA, 22 bp, Homo sapiens
gctctgtgctactttgaactct

SEQ ID NO: 7343617 - DNA, 22 bp, Homo sapiens
gctctgtgccagggctgggcca

SEQ ID NO: 7343618 - DNA, 22 bp, Homo sapiens
gctctgtgcaaatagcacccct

SEQ ID NO: 7343619 - DNA, 19 bp, Homo sapiens
gctctgtgatgctgagggg

SEQ ID NO: 7343620 - DNA, 22 bp, Homo sapiens
gctctgtgccacatgcagtgtt

SEQ ID NO: 7343621 - DNA, 22 bp, Homo sapiens
gctctgtgcagttcagggacac

SEQ ID NO: 7343622 - DNA, 22 bp, Homo sapiens
gctctgggtagccactgcctgg

SEQ ID NO: 7343623 - DNA, 22 bp, Homo sapiens
gctctgtacctgcggagatgag

SEQ ID NO: 7343624 - DNA, 22 bp, Homo sapiens
gctcagggagagagggcagccg

SEQ ID NO: 7343625 - DNA, 22 bp, Homo sapiens
gctcagggaactttttgcaggc

SEQ ID NO: 7343626 - DNA, 22 bp, Homo sapiens
gctcagggagagagggcagccg

SEQ ID NO: 7343627 - DNA, 22 bp, Homo sapiens
gctcagggagagagggcagccg

SEQ ID NO: 7343628 - DNA, 20 bp, Homo sapiens
gctcagggcctgggtctgga

SEQ ID NO: 7343629 - DNA, 20 bp, Homo sapiens
gctcagggcctgggtctgga

SEQ ID NO: 7343630 - DNA, 22 bp, Homo sapiens
gctcagggcctggctgcggact

SEQ ID NO: 7343631 - DNA, 22 bp, Homo sapiens
gctcccagactgaccagaggtg

SEQ ID NO: 7343632 - DNA, 22 bp, Homo sapiens
gctcccagcaattgaggcagcc

SEQ ID NO: 7343633 - DNA, 22 bp, Homo sapiens
gctcatattcaactatcttcac

SEQ ID NO: 7343634 - DNA, 22 bp, Homo sapiens
gctcagggcgcgagggacgtgg

SEQ ID NO: 7343635 - DNA, 20 bp, Homo sapiens
gctcagggcctgggtctgga

SEQ ID NO: 7343636 - DNA, 18 bp, Homo sapiens
gctagggcatgcatggtg

SEQ ID NO: 7343637 - DNA, 22 bp, Homo sapiens
gctgagggtaacacttcgggat

SEQ ID NO: 7343638 - DNA, 20 bp, Homo sapiens
gctgaggggtctatggcata

SEQ ID NO: 7343639 - DNA, 22 bp, Homo sapiens
gctgagggtaacacttcgggat

SEQ ID NO: 7343640 - DNA, 22 bp, Homo sapiens
gctgagggtctgttcatgttgc

SEQ ID NO: 7343641 - DNA, 22 bp, Homo sapiens
gctctgtgtatgtggcaggtgc

SEQ ID NO: 7343642 - DNA, 22 bp, Homo sapiens
gctgagggggaaggaaagctga

SEQ ID NO: 7343643 - DNA, 22 bp, Homo sapiens
gctctgtgggtgagtagaatct

SEQ ID NO: 7343644 - DNA, 22 bp, Homo sapiens
gctctgtgggggaaatcctggg

SEQ ID NO: 7343645 - DNA, 22 bp, Homo sapiens
gctctgtggcattcatgggcag

SEQ ID NO: 7343646 - DNA, 22 bp, Homo sapiens
gctctgtggcattcatgggcag

SEQ ID NO: 7343647 - DNA, 22 bp, Homo sapiens
gctctgtgtaaatgtagggtcc

SEQ ID NO: 7343648 - DNA, 20 bp, Homo sapiens
gctctgtggtttgagtctcc

SEQ ID NO: 7343649 - DNA, 22 bp, Homo sapiens
gctctgtggtggggcagagttt

SEQ ID NO: 7343650 - DNA, 22 bp, Homo sapiens
gctgagtcttgagcactgagca

SEQ ID NO: 7343651 - DNA, 20 bp, Homo sapiens
gctgaggtttcttcctatat

SEQ ID NO: 7343652 - DNA, 22 bp, Homo sapiens
gctgaggtttcaggagtggcag

SEQ ID NO: 7343653 - DNA, 22 bp, Homo sapiens
gctgaggtgtcaccttgctggg

SEQ ID NO: 7343654 - DNA, 22 bp, Homo sapiens
gctgaggtggctgccttagtaa

SEQ ID NO: 7343655 - DNA, 18 bp, Homo sapiens
gctgcaggccctccgagg

SEQ ID NO: 7343656 - DNA, 22 bp, Homo sapiens
gctgatagactgaatgttggga

SEQ ID NO: 7343657 - DNA, 22 bp, Homo sapiens
gctgcagggctctcacaggggg

SEQ ID NO: 7343658 - DNA, 22 bp, Homo sapiens
gctgcagggctctcacaggggg

SEQ ID NO: 7343659 - DNA, 22 bp, Homo sapiens
gctgcagggagctggaaggctc

SEQ ID NO: 7343660 - DNA, 22 bp, Homo sapiens
gctgcagggagctggaaggctc

SEQ ID NO: 7343661 - DNA, 22 bp, Homo sapiens
gctgcaggcgcctgcggtctct

SEQ ID NO: 7343662 - DNA, 22 bp, Homo sapiens
gctgcaggcggccgtggtggcg

SEQ ID NO: 7343663 - DNA, 22 bp, Homo sapiens
gctgcaggctctgcaggaattg

SEQ ID NO: 7343664 - DNA, 22 bp, Homo sapiens
gctgcaggctgtggcaggggag

SEQ ID NO: 7343665 - DNA, 22 bp, Homo sapiens
gctgcagggagctggaaggctc

SEQ ID NO: 7343666 - DNA, 22 bp, Homo sapiens
gctgcctcctgaaagcgctctg

SEQ ID NO: 7343667 - DNA, 22 bp, Homo sapiens
gctgcctccactggctcccagt

SEQ ID NO: 7343668 - DNA, 22 bp, Homo sapiens
gctgcctcccagagccctgcag

SEQ ID NO: 7343669 - DNA, 22 bp, Homo sapiens
gctgcctcccagagccctgcag

SEQ ID NO: 7343670 - DNA, 18 bp, Homo sapiens
gctgctggtggagggagc

SEQ ID NO: 7343671 - DNA, 22 bp, Homo sapiens
gctggagctgcagcctgggcct

SEQ ID NO: 7343672 - DNA, 16 bp, Homo sapiens
gctggagggaggggtt

SEQ ID NO: 7343673 - DNA, 22 bp, Homo sapiens
gctggaggggtaataggatggg

SEQ ID NO: 7343674 - DNA, 22 bp, Homo sapiens
gctggaggggtaataggatggg

SEQ ID NO: 7343675 - DNA, 22 bp, Homo sapiens
gctgcctgaaatgttgcctagc

SEQ ID NO: 7343676 - DNA, 22 bp, Homo sapiens
gctgctgcttgaaggctcggag

SEQ ID NO: 7343677 - DNA, 22 bp, Homo sapiens
gctgctggcgctgggcgtccgg

SEQ ID NO: 7343678 - DNA, 19 bp, Homo sapiens
gctgctggctctggctgga

SEQ ID NO: 7343679 - DNA, 22 bp, Homo sapiens
gctggagtgcagttgcacagtc

SEQ ID NO: 7343680 - DNA, 22 bp, Homo sapiens
gctggagtgatgcctgtgtctc

SEQ ID NO: 7343681 - DNA, 22 bp, Homo sapiens
gctggaggtagggaggtcctgt

SEQ ID NO: 7343682 - DNA, 22 bp, Homo sapiens
gctggaggtggtgagaaaaggt

SEQ ID NO: 7343683 - DNA, 22 bp, Homo sapiens
gctggaggtggtgagaaaaggt

SEQ ID NO: 7343684 - DNA, 22 bp, Homo sapiens
gctggaggtggtgagaaaaggt

SEQ ID NO: 7343685 - DNA, 22 bp, Homo sapiens
gctggaggtttcacctgagttt

SEQ ID NO: 7343686 - DNA, 23 bp, Homo sapiens
gcttgtctagtgaattcatatct

SEQ ID NO: 7343687 - DNA, 22 bp, Homo sapiens
gcttgtttctatttatcaagta

SEQ ID NO: 7343688 - DNA, 22 bp, Homo sapiens
gcttaaatcccaatgctagacc

SEQ ID NO: 7343689 - DNA, 22 bp, Homo sapiens
gcttaaattgtttgtggatagt

SEQ ID NO: 7343690 - DNA, 22 bp, Homo sapiens
gcttggggtcatgaggctgctg

SEQ ID NO: 7343691 - DNA, 22 bp, Homo sapiens
gcttaaaatccatgatttttac

SEQ ID NO: 7343692 - DNA, 22 bp, Homo sapiens
gctgtttgcccccactccttca

SEQ ID NO: 7343693 - DNA, 22 bp, Homo sapiens
gctgtttgaggcacatgattaa

SEQ ID NO: 7343694 - DNA, 22 bp, Homo sapiens
gctgtgtgctgggcatggcact

SEQ ID NO: 7343695 - DNA, 22 bp, Homo sapiens
gctgtgttcattttgcatatgt

SEQ ID NO: 7343696 - DNA, 22 bp, Homo sapiens
gctgtgttgggaatcatgtggg

SEQ ID NO: 7343697 - DNA, 22 bp, Homo sapiens
gctgtgttgggaatcatgtggg

SEQ ID NO: 7343698 - DNA, 22 bp, Homo sapiens
gctgtgtttgacagtagcagac

SEQ ID NO: 7343699 - DNA, 22 bp, Homo sapiens
gctgtgttggtgaagctgtagc

SEQ ID NO: 7343700 - DNA, 22 bp, Homo sapiens
gcttttattgtctttacgacga

SEQ ID NO: 7343701 - DNA, 22 bp, Homo sapiens
gctgtacatttgtgtacacttg

SEQ ID NO: 7343702 - DNA, 22 bp, Homo sapiens
gctgtacattctgtgggtttgg

SEQ ID NO: 7343703 - DNA, 22 bp, Homo sapiens
gctgtacattctgcacaggccc

SEQ ID NO: 7343704 - DNA, 19 bp, Homo sapiens
gctgtacagtaaggagaca

SEQ ID NO: 7343705 - DNA, 22 bp, Homo sapiens
gctgtacagggttatcctttcc

SEQ ID NO: 7343706 - DNA, 22 bp, Homo sapiens
gctgtacatcacaatttgctgt

SEQ ID NO: 7343707 - DNA, 22 bp, Homo sapiens
gctgtacagtttactaggtggg

SEQ ID NO: 7343708 - DNA, 22 bp, Homo sapiens
gctggtcagggtattggaggcc

SEQ ID NO: 7343709 - DNA, 19 bp, Homo sapiens
gctggccacgccccagttg

SEQ ID NO: 7343710 - DNA, 22 bp, Homo sapiens
gctggccacagatccccaggga

SEQ ID NO: 7343711 - DNA, 19 bp, Homo sapiens
gctgtattaaagatacatg

SEQ ID NO: 7343712 - DNA, 22 bp, Homo sapiens
gctgtatgagttcatgtgtaga

SEQ ID NO: 7343713 - DNA, 22 bp, Homo sapiens
gctgtagtgaatggccgcgttc

SEQ ID NO: 7343714 - DNA, 23 bp, Homo sapiens
gctgtctgtcatctctgcgggag

SEQ ID NO: 7343715 - DNA, 22 bp, Homo sapiens
gctgtcctcgtctctcacgcaa

SEQ ID NO: 7343716 - DNA, 22 bp, Homo sapiens
gctgtcctcttggactcagggc

SEQ ID NO: 7343717 - DNA, 22 bp, Homo sapiens
gctgtcccgctgacttccagct

SEQ ID NO: 7343718 - DNA, 22 bp, Homo sapiens
gctgtccctttcacaaggtttt

SEQ ID NO: 7343719 - DNA, 22 bp, Homo sapiens
gctgtcctgggaacaggcacta

SEQ ID NO: 7343720 - DNA, 23 bp, Homo sapiens
gctgtccccatgctccatccctg

SEQ ID NO: 7343721 - DNA, 20 bp, Homo sapiens
gctgtcccaggccaaagggc

SEQ ID NO: 7343722 - DNA, 22 bp, Homo sapiens
ggacagggctcttggcactcct

SEQ ID NO: 7343723 - DNA, 22 bp, Homo sapiens
ggacagggctcttggcactcct

SEQ ID NO: 7343724 - DNA, 22 bp, Homo sapiens
ggacagggctcttggcactcct

SEQ ID NO: 7343725 - DNA, 22 bp, Homo sapiens
ggacaggggcgtggggattgtt

SEQ ID NO: 7343726 - DNA, 22 bp, Homo sapiens
ggacaggggcgtggggattgtt

SEQ ID NO: 7343727 - DNA, 19 bp, Homo sapiens
ggacagggggagcttttat

SEQ ID NO: 7343728 - DNA, 22 bp, Homo sapiens
ggacaggctgcatctgagcatg

SEQ ID NO: 7343729 - DNA, 22 bp, Homo sapiens
ggacagggatcattatctgagc

SEQ ID NO: 7343730 - DNA, 23 bp, Homo sapiens
ggacagggccctgccctatggcc

SEQ ID NO: 7343731 - DNA, 23 bp, Homo sapiens
ggacagggccctgccctatggcc

SEQ ID NO: 7343732 - DNA, 22 bp, Homo sapiens
ggacaggcgcagggccaaggaa

SEQ ID NO: 7343733 - DNA, 22 bp, Homo sapiens
ggacaggcctggcacagtactg

SEQ ID NO: 7343734 - DNA, 22 bp, Homo sapiens
ggacaggccgcctcggtggggg

SEQ ID NO: 7343735 - DNA, 22 bp, Homo sapiens
ggacaggccctctggtcagctt

SEQ ID NO: 7343736 - DNA, 22 bp, Homo sapiens
ggacaggcccggggagcctgga

SEQ ID NO: 7343737 - DNA, 22 bp, Homo sapiens
ggacaggccctctggtcagctt

SEQ ID NO: 7343738 - DNA, 22 bp, Homo sapiens
ggacaggcaggtgatttccaga

SEQ ID NO: 7343739 - DNA, 22 bp, Homo sapiens
ggacaggccatatggaatacat

SEQ ID NO: 7343740 - DNA, 22 bp, Homo sapiens
ggactgtctactaacaagaagc

SEQ ID NO: 7343741 - DNA, 22 bp, Homo sapiens
ggactgggtcactaagatagta

SEQ ID NO: 7343742 - DNA, 22 bp, Homo sapiens
ggactggccggcgctgaggccc

SEQ ID NO: 7343743 - DNA, 22 bp, Homo sapiens
ggactgggaatcagggagatgc

SEQ ID NO: 7343744 - DNA, 22 bp, Homo sapiens
ggactgggtaggagcccagggc

SEQ ID NO: 7343745 - DNA, 22 bp, Homo sapiens
ggagaaaggataggaatgtgct

SEQ ID NO: 7343746 - DNA, 22 bp, Homo sapiens
ggagaaaggcatagcagaacct

SEQ ID NO: 7343747 - DNA, 22 bp, Homo sapiens
ggagaaaggataggaatgtgct

SEQ ID NO: 7343748 - DNA, 22 bp, Homo sapiens
ggagaaaattgatgaagttggc

SEQ ID NO: 7343749 - DNA, 22 bp, Homo sapiens
ggagaaagaaatttttgattgg

SEQ ID NO: 7343750 - DNA, 22 bp, Homo sapiens
ggagaaagaagacgaacattgt

SEQ ID NO: 7343751 - DNA, 22 bp, Homo sapiens
ggacaggataagagacactgcc

SEQ ID NO: 7343752 - DNA, 22 bp, Homo sapiens
ggaaggctttgaggggtgctgg

SEQ ID NO: 7343753 - DNA, 22 bp, Homo sapiens
ggaaggctccacccaaggcgag

SEQ ID NO: 7343754 - DNA, 19 bp, Homo sapiens
ggaaggccacggcaggctt

SEQ ID NO: 7343755 - DNA, 22 bp, Homo sapiens
ggaaggcagtgaaggggctgat

SEQ ID NO: 7343756 - DNA, 19 bp, Homo sapiens
ggaaggcagaggggctgtg

SEQ ID NO: 7343757 - DNA, 22 bp, Homo sapiens
ggaaggaggggcaaagcagttc

SEQ ID NO: 7343758 - DNA, 22 bp, Homo sapiens
ggaaggaagtgcagactttaaa

SEQ ID NO: 7343759 - DNA, 22 bp, Homo sapiens
ggaaggaattccaagactaaag

SEQ ID NO: 7343760 - DNA, 19 bp, Homo sapiens
ggaaggagagaaatgcatg

SEQ ID NO: 7343761 - DNA, 22 bp, Homo sapiens
ggagcccaagtctgcactcggc

SEQ ID NO: 7343762 - DNA, 22 bp, Homo sapiens
ggagccatgttttcagcatgat

SEQ ID NO: 7343763 - DNA, 22 bp, Homo sapiens
ggagcccaagtctgcactcggc

SEQ ID NO: 7343764 - DNA, 22 bp, Homo sapiens
ggagccaggcatatcggggcac

SEQ ID NO: 7343765 - DNA, 17 bp, Homo sapiens
ggagccaggagcccacc

SEQ ID NO: 7343766 - DNA, 22 bp, Homo sapiens
ggagaagaggagctggaagcct

SEQ ID NO: 7343767 - DNA, 17 bp, Homo sapiens
ggagccaggagcccacc

SEQ ID NO: 7343768 - DNA, 22 bp, Homo sapiens
ggagaaagtacagcaggcaaca

SEQ ID NO: 7343769 - DNA, 22 bp, Homo sapiens
ggagaaagtacagcaggcaaca

SEQ ID NO: 7343770 - DNA, 22 bp, Homo sapiens
ggagctgcatttagggagcctt

SEQ ID NO: 7343771 - DNA, 22 bp, Homo sapiens
ggagctggtcagccttgagcat

SEQ ID NO: 7343772 - DNA, 22 bp, Homo sapiens
ggaggaggggcgctttgtctat

SEQ ID NO: 7343773 - DNA, 22 bp, Homo sapiens
ggaggaggcggcagaagttcct

SEQ ID NO: 7343774 - DNA, 22 bp, Homo sapiens
ggaggaggcggcagaagttcct

SEQ ID NO: 7343775 - DNA, 22 bp, Homo sapiens
gcctccctgtttcctgctccaa

SEQ ID NO: 7343776 - DNA, 22 bp, Homo sapiens
gcctccctgttcttccacaata

SEQ ID NO: 7343777 - DNA, 22 bp, Homo sapiens
gcctccctgtagaggccagcct

SEQ ID NO: 7343778 - DNA, 18 bp, Homo sapiens
gcctccctggctacactt

SEQ ID NO: 7343779 - DNA, 22 bp, Homo sapiens
gcctcccttggtgtctcccggg

SEQ ID NO: 7343780 - DNA, 22 bp, Homo sapiens
gcctccacccctggggagtgga

SEQ ID NO: 7343781 - DNA, 22 bp, Homo sapiens
gcctccaccgaacgctctcttg

SEQ ID NO: 7343782 - DNA, 22 bp, Homo sapiens
gcctccactgatcagacttgac

SEQ ID NO: 7343783 - DNA, 22 bp, Homo sapiens
gcctccacttctttagtatgac

SEQ ID NO: 7343784 - DNA, 22 bp, Homo sapiens
gcctccacttctttagtatgac

SEQ ID NO: 7343785 - DNA, 22 bp, Homo sapiens
gcctccacttttgctggcttct

SEQ ID NO: 7343786 - DNA, 22 bp, Homo sapiens
gcctccactgatcagacttgac

SEQ ID NO: 7343787 - DNA, 22 bp, Homo sapiens
gcctccctccaccactgcaggt

SEQ ID NO: 7343788 - DNA, 22 bp, Homo sapiens
gcctccctggcccacagcagcg

SEQ ID NO: 7343789 - DNA, 22 bp, Homo sapiens
gcctccctgagtcacccaagca

SEQ ID NO: 7343790 - DNA, 22 bp, Homo sapiens
gcctgcagcctcaagggctgag

SEQ ID NO: 7343791 - DNA, 22 bp, Homo sapiens
gcctgcagccagggagttctct

SEQ ID NO: 7343792 - DNA, 18 bp, Homo sapiens
gcctgcaggcacgggggt

SEQ ID NO: 7343793 - DNA, 22 bp, Homo sapiens
gcctgcacccacaggcatggcc

SEQ ID NO: 7343794 - DNA, 22 bp, Homo sapiens
gcctgcagacgtgttttcctca

SEQ ID NO: 7343795 - DNA, 22 bp, Homo sapiens
gcctggagaaaggaaggtggga

SEQ ID NO: 7343796 - DNA, 22 bp, Homo sapiens
gcctggagtgcagtggcgtgat

SEQ ID NO: 7343797 - DNA, 22 bp, Homo sapiens
gcctggagaggaagccggtgga

SEQ ID NO: 7343798 - DNA, 22 bp, Homo sapiens
gcctggagacagcagaggcggc

SEQ ID NO: 7343799 - DNA, 22 bp, Homo sapiens
gcccctctccttgtgcacctgc

SEQ ID NO: 7343800 - DNA, 22 bp, Homo sapiens
gcccacagaggcaccaccaggc

SEQ ID NO: 7343801 - DNA, 22 bp, Homo sapiens
gcccacagctcgttcctctcct

SEQ ID NO: 7343802 - DNA, 22 bp, Homo sapiens
gcccaaggtcccatggcagcac

SEQ ID NO: 7343803 - DNA, 22 bp, Homo sapiens
gcccacacaccagctcaggagg

SEQ ID NO: 7343804 - DNA, 21 bp, Homo sapiens
gcccaatgaacctgggcagct

SEQ ID NO: 7343805 - DNA, 22 bp, Homo sapiens
gccctacctcagtccagatctg

SEQ ID NO: 7343806 - DNA, 22 bp, Homo sapiens
gccctagccatcctgtgctctg

SEQ ID NO: 7343807 - DNA, 22 bp, Homo sapiens
gccctagccatcctgtgctctg

SEQ ID NO: 7343808 - DNA, 22 bp, Homo sapiens
gcccgtgtgcagagtgggagct

SEQ ID NO: 7343809 - DNA, 22 bp, Homo sapiens
gcccctgttgtggctttgtcta

SEQ ID NO: 7343810 - DNA, 22 bp, Homo sapiens
gcccgcagagatctttaacaaa

SEQ ID NO: 7343811 - DNA, 22 bp, Homo sapiens
gccctagcgccagctcagcacc

SEQ ID NO: 7343812 - DNA, 22 bp, Homo sapiens
gccctaggcttttgtgactgcc

SEQ ID NO: 7343813 - DNA, 21 bp, Homo sapiens
gccctaggctacctggagcgc

SEQ ID NO: 7343814 - DNA, 22 bp, Homo sapiens
gccctgcttctggcatgcagaa

SEQ ID NO: 7343815 - DNA, 22 bp, Homo sapiens
gcctcaggtaaaacttgagttt

SEQ ID NO: 7343816 - DNA, 22 bp, Homo sapiens
gcctcagggggagaggccagct

SEQ ID NO: 7343817 - DNA, 22 bp, Homo sapiens
gcctcaggtgcatctctcattc

SEQ ID NO: 7343818 - DNA, 18 bp, Homo sapiens
gcctccaccatggagggt

SEQ ID NO: 7343819 - DNA, 20 bp, Homo sapiens
gcctccaccccaggcttcag

SEQ ID NO: 7343820 - DNA, 20 bp, Homo sapiens
gcctccaccccaggcttcag

SEQ ID NO: 7343821 - DNA, 19 bp, Homo sapiens
gcctcatttccacctcccc

SEQ ID NO: 7343822 - DNA, 19 bp, Homo sapiens
gcctcatttccacctcccc

SEQ ID NO: 7343823 - DNA, 22 bp, Homo sapiens
gcctcaggtgcatctctcattc

SEQ ID NO: 7343824 - DNA, 23 bp, Homo sapiens
gccctgctgggacctcctgctac

SEQ ID NO: 7343825 - DNA, 23 bp, Homo sapiens
gccctgctgggacctcctgctac

SEQ ID NO: 7343826 - DNA, 22 bp, Homo sapiens
gccctgctgcgcagcacgcatg

SEQ ID NO: 7343827 - DNA, 22 bp, Homo sapiens
gccctgctcttttgcccaccca

SEQ ID NO: 7343828 - DNA, 22 bp, Homo sapiens
gccctgctaatttcgtactttt

SEQ ID NO: 7343829 - DNA, 22 bp, Homo sapiens
gccctgcgccgtcccgctggtg

SEQ ID NO: 7343830 - DNA, 22 bp, Homo sapiens
gccctgcctgtctgctgggagg

SEQ ID NO: 7343831 - DNA, 17 bp, Homo sapiens
gccctgcctgctgccct

SEQ ID NO: 7343832 - DNA, 22 bp, Homo sapiens
gccctgctctggtctctgcccg

SEQ ID NO: 7343833 - DNA, 22 bp, Homo sapiens
gccctgctctggtctctgcccg

SEQ ID NO: 7343834 - DNA, 22 bp, Homo sapiens
gccactttgatgatataaaaac

SEQ ID NO: 7343835 - DNA, 22 bp, Homo sapiens
gccacttctgcctggcagggcc

SEQ ID NO: 7343836 - DNA, 22 bp, Homo sapiens
gccagctgtaggtggtgggttg

SEQ ID NO: 7343837 - DNA, 22 bp, Homo sapiens
gccagctgaggccgtgcaggct

SEQ ID NO: 7343838 - DNA, 22 bp, Homo sapiens
gccaggaacacaatgccaagct

SEQ ID NO: 7343839 - DNA, 18 bp, Homo sapiens
gccaggaagaggaatgtg

SEQ ID NO: 7343840 - DNA, 22 bp, Homo sapiens
gccaggaagcagttagatgggt

SEQ ID NO: 7343841 - DNA, 22 bp, Homo sapiens
gccaggctcagtagcgattcct

SEQ ID NO: 7343842 - DNA, 22 bp, Homo sapiens
gccaggctcagcagtcaacctg

SEQ ID NO: 7343843 - DNA, 22 bp, Homo sapiens
gccaggctaagaaaggtgtgat

SEQ ID NO: 7343844 - DNA, 22 bp, Homo sapiens
gccaggcgggtctcaaactcct

SEQ ID NO: 7343845 - DNA, 22 bp, Homo sapiens
gccaggctccaggccctcctga

SEQ ID NO: 7343846 - DNA, 22 bp, Homo sapiens
gccaggctccccggatccctgg

SEQ ID NO: 7343847 - DNA, 23 bp, Homo sapiens
gccaggctccggtctgtggccac

SEQ ID NO: 7343848 - DNA, 22 bp, Homo sapiens
gcccaagccgccttccagagac

SEQ ID NO: 7343849 - DNA, 20 bp, Homo sapiens
gcccaaggtccagaaggggg

SEQ ID NO: 7343850 - DNA, 22 bp, Homo sapiens
gcccaaggtcacacacaggaag

SEQ ID NO: 7343851 - DNA, 20 bp, Homo sapiens
gcccaagcgccggccgcaga

SEQ ID NO: 7343852 - DNA, 22 bp, Homo sapiens
gccaccctgcaaatgcccagga

SEQ ID NO: 7343853 - DNA, 22 bp, Homo sapiens
gccaccctgcaaatgcccagga

SEQ ID NO: 7343854 - DNA, 22 bp, Homo sapiens
gccaccctggaccaccctgggc

SEQ ID NO: 7343855 - DNA, 22 bp, Homo sapiens
gcatttcatgtaagtcagacca

SEQ ID NO: 7343856 - DNA, 18 bp, Homo sapiens
gccaccctcctcgtctcc

SEQ ID NO: 7343857 - DNA, 19 bp, Homo sapiens
gcatttcaggcatgtttgc

SEQ ID NO: 7343858 - DNA, 22 bp, Homo sapiens
gcattgtcaaaagtggtatgac

SEQ ID NO: 7343859 - DNA, 22 bp, Homo sapiens
gcattgtcctgcttctgagtgt

SEQ ID NO: 7343860 - DNA, 23 bp, Homo sapiens
gcatttacagactcacttttcta

SEQ ID NO: 7343861 - DNA, 23 bp, Homo sapiens
gcattgtctccccacttctgggc

SEQ ID NO: 7343862 - DNA, 22 bp, Homo sapiens
gccactgttgctcctcaggaaa

SEQ ID NO: 7343863 - DNA, 22 bp, Homo sapiens
gccactgtggtcctcccatgat

SEQ ID NO: 7343864 - DNA, 22 bp, Homo sapiens
gccactgtgttgatctagcctg

SEQ ID NO: 7343865 - DNA, 22 bp, Homo sapiens
gccactgttcttctttgttcca

SEQ ID NO: 7343866 - DNA, 22 bp, Homo sapiens
gccactgttccaccatcttgat

SEQ ID NO: 7343867 - DNA, 20 bp, Homo sapiens
gccactgtgcttacactgct

SEQ ID NO: 7343868 - DNA, 21 bp, Homo sapiens
gccactgtgcacactaaccca

SEQ ID NO: 7343869 - DNA, 22 bp, Homo sapiens
gccacccttgcgtcactgacat

SEQ ID NO: 7343870 - DNA, 22 bp, Homo sapiens
gccacccttgcgtcactgacat

SEQ ID NO: 7343871 - DNA, 22 bp, Homo sapiens
gccaccctggacgcactgttcg

SEQ ID NO: 7343872 - DNA, 22 bp, Homo sapiens
gccacccttatcccatgcttct

SEQ ID NO: 7343873 - DNA, 22 bp, Homo sapiens
gcagtgtttgtgttctcacatg

SEQ ID NO: 7343874 - DNA, 22 bp, Homo sapiens
gcagtgtttttcaatgcttcca

SEQ ID NO: 7343875 - DNA, 22 bp, Homo sapiens
gcagtgttttacagaccagcat

SEQ ID NO: 7343876 - DNA, 22 bp, Homo sapiens
gcagttacctattttgtagaaa

SEQ ID NO: 7343877 - DNA, 21 bp, Homo sapiens
gcagttaatagcagagcacac

SEQ ID NO: 7343878 - DNA, 17 bp, Homo sapiens
gcagttaaattaagatg

SEQ ID NO: 7343879 - DNA, 22 bp, Homo sapiens
gcagttactagcaatttgtgaa

SEQ ID NO: 7343880 - DNA, 22 bp, Homo sapiens
gcagttacttctgagaagtgaa

SEQ ID NO: 7343881 - DNA, 22 bp, Homo sapiens
gcagttgctcttgaggcacttt

SEQ ID NO: 7343882 - DNA, 22 bp, Homo sapiens
gcagtgttggtttgctctgcag

SEQ ID NO: 7343883 - DNA, 22 bp, Homo sapiens
gcagtgttggcaggatggggct

SEQ ID NO: 7343884 - DNA, 22 bp, Homo sapiens
gcagtgtttggatccatagcga

SEQ ID NO: 7343885 - DNA, 23 bp, Homo sapiens
gcagtgtttgcttcatcttatcc

SEQ ID NO: 7343886 - DNA, 22 bp, Homo sapiens
gcagtgtttcccagagatggaa

SEQ ID NO: 7343887 - DNA, 22 bp, Homo sapiens
gcagtgtttcagtgctttttct

SEQ ID NO: 7343888 - DNA, 22 bp, Homo sapiens
gcagtgtttcaaatcaaaggca

SEQ ID NO: 7343889 - DNA, 22 bp, Homo sapiens
gcagtgtttacatattagaaac

SEQ ID NO: 7343890 - DNA, 22 bp, Homo sapiens
gcagtgttgttaaaagattaga

SEQ ID NO: 7343891 - DNA, 22 bp, Homo sapiens
gcagtgttgtgatccaggtctt

SEQ ID NO: 7343892 - DNA, 22 bp, Homo sapiens
gcattaatgtaagacccactcc

SEQ ID NO: 7343893 - DNA, 22 bp, Homo sapiens
gcagcaagaataatttgggtag

SEQ ID NO: 7343894 - DNA, 22 bp, Homo sapiens
gcagcaaacttccacaagtaga

SEQ ID NO: 7343895 - DNA, 22 bp, Homo sapiens
gcagagtgggagcccagggctg

SEQ ID NO: 7343896 - DNA, 22 bp, Homo sapiens
gcagagtgagccgaggctgctc

SEQ ID NO: 7343897 - DNA, 22 bp, Homo sapiens
gcagagtgagccgaggctgctc

SEQ ID NO: 7343898 - DNA, 22 bp, Homo sapiens
gcagagtgatggaatgtgggtg

SEQ ID NO: 7343899 - DNA, 22 bp, Homo sapiens
gcagagtgagccgaggctgctc

SEQ ID NO: 7343900 - DNA, 22 bp, Homo sapiens
gcagagtgaggaagagcttcca

SEQ ID NO: 7343901 - DNA, 22 bp, Homo sapiens
gcagagtgccgagatggaagcg

SEQ ID NO: 7343902 - DNA, 18 bp, Homo sapiens
gcagagtgcgtctctgtg

SEQ ID NO: 7343903 - DNA, 22 bp, Homo sapiens
gcagagtgggagcccagggctg

SEQ ID NO: 7343904 - DNA, 22 bp, Homo sapiens
gcagaggtgtgggaggggccac

SEQ ID NO: 7343905 - DNA, 22 bp, Homo sapiens
gcagacagggctacagaggtac

SEQ ID NO: 7343906 - DNA, 22 bp, Homo sapiens
gcagaggtgtgggaggggccac

SEQ ID NO: 7343907 - DNA, 22 bp, Homo sapiens
gcagagtcaggattccatccca

SEQ ID NO: 7343908 - DNA, 22 bp, Homo sapiens
gcagaaggatccgcaggtgcaa

SEQ ID NO: 7343909 - DNA, 22 bp, Homo sapiens
gcacatttctcaaagaattgtc

SEQ ID NO: 7343910 - DNA, 22 bp, Homo sapiens
gcacatttgccactgagctcct

SEQ ID NO: 7343911 - DNA, 22 bp, Homo sapiens
gcaccactaagagcagggaccg

SEQ ID NO: 7343912 - DNA, 22 bp, Homo sapiens
gcagaaggcctcttggttaata

SEQ ID NO: 7343913 - DNA, 22 bp, Homo sapiens
gcacagagtgggtgagatgtgg

SEQ ID NO: 7343914 - DNA, 22 bp, Homo sapiens
gcacagcaatttctataagctc

SEQ ID NO: 7343915 - DNA, 22 bp, Homo sapiens
gcacagagtcactagctaagca

SEQ ID NO: 7343916 - DNA, 22 bp, Homo sapiens
gcacagcagctgggggccctgg

SEQ ID NO: 7343917 - DNA, 22 bp, Homo sapiens
gcacagcagacttggtggggct

SEQ ID NO: 7343918 - DNA, 22 bp, Homo sapiens
gcacagcacagcaacatgtttt

SEQ ID NO: 7343919 - DNA, 22 bp, Homo sapiens
gcacattgcttgcccattgtaa

SEQ ID NO: 7343920 - DNA, 22 bp, Homo sapiens
gcacattgttactcttactgtg

SEQ ID NO: 7343921 - DNA, 22 bp, Homo sapiens
gcacatggcggccagcaggtga

SEQ ID NO: 7343922 - DNA, 22 bp, Homo sapiens
gcacagagagtcccgggtgccc

SEQ ID NO: 7343923 - DNA, 22 bp, Homo sapiens
gcacagagggcagtgagcctct

SEQ ID NO: 7343924 - DNA, 22 bp, Homo sapiens
gcacagagagtcccgggtgccc

SEQ ID NO: 7343925 - DNA, 22 bp, Homo sapiens
gcacagactttgattgcagtca

SEQ ID NO: 7343926 - DNA, 22 bp, Homo sapiens
gcacagagaggctgtgagcgcc

SEQ ID NO: 7343927 - DNA, 22 bp, Homo sapiens
gcacagagaggctgtgagcgcc

SEQ ID NO: 7343928 - DNA, 22 bp, Homo sapiens
gcacagaaccagacatgaggca

SEQ ID NO: 7343929 - DNA, 22 bp, Homo sapiens
gcaatactgagattattgtact

SEQ ID NO: 7343930 - DNA, 22 bp, Homo sapiens
gcaatactaagtgacttttggg

SEQ ID NO: 7343931 - DNA, 22 bp, Homo sapiens
gcaatactcaacacttttgctt

SEQ ID NO: 7343932 - DNA, 22 bp, Homo sapiens
gcacagactttgattgcagtca

SEQ ID NO: 7343933 - DNA, 22 bp, Homo sapiens
gcacagactcaccttaatttga

SEQ ID NO: 7343934 - DNA, 22 bp, Homo sapiens
gcacagactgtatcttaatcat

SEQ ID NO: 7343935 - DNA, 22 bp, Homo sapiens
gcacagacaccattaaatattt

SEQ ID NO: 7343936 - DNA, 22 bp, Homo sapiens
gcacagacagaatccctactcc

SEQ ID NO: 7343937 - DNA, 22 bp, Homo sapiens
gcacagacatatccatatttac

SEQ ID NO: 7343938 - DNA, 22 bp, Homo sapiens
gcacagacccaccatctatagt

SEQ ID NO: 7343939 - DNA, 22 bp, Homo sapiens
gcacagacagaatccctactcc

SEQ ID NO: 7343940 - DNA, 22 bp, Homo sapiens
gcacagaataacactctgggct

SEQ ID NO: 7343941 - DNA, 22 bp, Homo sapiens
gcaaggagactgtagggccaag

SEQ ID NO: 7343942 - DNA, 19 bp, Homo sapiens
gagtattttccaacttggt

SEQ ID NO: 7343943 - DNA, 18 bp, Homo sapiens
gagtagcattgaggaaac

SEQ ID NO: 7343944 - DNA, 22 bp, Homo sapiens
gagtagggtttccaggttagag

SEQ ID NO: 7343945 - DNA, 22 bp, Homo sapiens
gcaataaaatgtaatgattggg

SEQ ID NO: 7343946 - DNA, 22 bp, Homo sapiens
gcaataaagattttactgtcag

SEQ ID NO: 7343947 - DNA, 22 bp, Homo sapiens
gcaatacagtaagagtactgta

SEQ ID NO: 7343948 - DNA, 23 bp, Homo sapiens
gcaatacaagactggtcatgagc

SEQ ID NO: 7343949 - DNA, 22 bp, Homo sapiens
gcaataaagtagcagctcatca

SEQ ID NO: 7343950 - DNA, 17 bp, Homo sapiens
gcagccagtgcagcagg

SEQ ID NO: 7343951 - DNA, 22 bp, Homo sapiens
gcagccagtatcctctgagatt

SEQ ID NO: 7343952 - DNA, 22 bp, Homo sapiens
gcagccaggaagcccaggacac

SEQ ID NO: 7343953 - DNA, 22 bp, Homo sapiens
gcagccaggaagcccaggacac

SEQ ID NO: 7343954 - DNA, 22 bp, Homo sapiens
gcagccagtgggatgagaaaga

SEQ ID NO: 7343955 - DNA, 22 bp, Homo sapiens
gcagcccacagctggaggccta

SEQ ID NO: 7343956 - DNA, 22 bp, Homo sapiens
gcagcccacagctggaggccta

SEQ ID NO: 7343957 - DNA, 22 bp, Homo sapiens
gcagcccaatggactgagacag

SEQ ID NO: 7343958 - DNA, 22 bp, Homo sapiens
gcagcccaatggactgagacag

SEQ ID NO: 7343959 - DNA, 22 bp, Homo sapiens
gcagctgggacactgaggccag

SEQ ID NO: 7343960 - DNA, 22 bp, Homo sapiens
gcagctggctcagagaggtggg

SEQ ID NO: 7343961 - DNA, 22 bp, Homo sapiens
gcagctggctcagagaggtggg

SEQ ID NO: 7343962 - DNA, 22 bp, Homo sapiens
gcagctggctcagagaggtggg

SEQ ID NO: 7343963 - DNA, 22 bp, Homo sapiens
gcagccagcccctctgacctct

SEQ ID NO: 7343964 - DNA, 22 bp, Homo sapiens
gcagccagcaggaagcgggaga

SEQ ID NO: 7343965 - DNA, 22 bp, Homo sapiens
gcagccagagggggtgtgatca

SEQ ID NO: 7343966 - DNA, 21 bp, Homo sapiens
gcagccagacgggattcagtt

SEQ ID NO: 7343967 - DNA, 22 bp, Homo sapiens
gcagccaggaaagctggaccct

SEQ ID NO: 7343968 - DNA, 21 bp, Homo sapiens
gcagccagccgagaccatgcc

SEQ ID NO: 7343969 - DNA, 22 bp, Homo sapiens
gcagccagccctagtcccactt

SEQ ID NO: 7343970 - DNA, 21 bp, Homo sapiens
gcagccactgccttcaacaat

SEQ ID NO: 7343971 - DNA, 22 bp, Homo sapiens
gcagccactctcattccacgtg

SEQ ID NO: 7343972 - DNA, 22 bp, Homo sapiens
gcagccactctcattccacgtg

SEQ ID NO: 7343973 - DNA, 22 bp, Homo sapiens
gcagccactgggagtgcttata

SEQ ID NO: 7343974 - DNA, 22 bp, Homo sapiens
gcagccactgggagtgcttata

SEQ ID NO: 7343975 - DNA, 22 bp, Homo sapiens
gcagccagaagactcagaacaa

SEQ ID NO: 7343976 - DNA, 22 bp, Homo sapiens
gcagccactttgcaaccaagag

SEQ ID NO: 7343977 - DNA, 22 bp, Homo sapiens
gcagccactttgcaaccaagag

SEQ ID NO: 7343978 - DNA, 22 bp, Homo sapiens
gcagccactagttttcctgttt

SEQ ID NO: 7343979 - DNA, 19 bp, Homo sapiens
gcagccaccgcggcggccg

SEQ ID NO: 7343980 - DNA, 22 bp, Homo sapiens
gcagccacctcccatggcgggg

SEQ ID NO: 7343981 - DNA, 22 bp, Homo sapiens
gcagccacctcccatggcgggg

SEQ ID NO: 7343982 - DNA, 22 bp, Homo sapiens
gcagccaccctcaaggctgaat

SEQ ID NO: 7343983 - DNA, 19 bp, Homo sapiens
gcagccaccgcggcggccg

SEQ ID NO: 7343984 - DNA, 19 bp, Homo sapiens
gcagccaccgcggcggccg

SEQ ID NO: 7343985 - DNA, 22 bp, Homo sapiens
gcagcagcccagggctctcaga

SEQ ID NO: 7343986 - DNA, 21 bp, Homo sapiens
gcagccacagccaccaagcta

SEQ ID NO: 7343987 - DNA, 21 bp, Homo sapiens
gcagccacagccaccaagcta

SEQ ID NO: 7343988 - DNA, 21 bp, Homo sapiens
gcagccacagccaccaagcta

SEQ ID NO: 7343989 - DNA, 22 bp, Homo sapiens
gcagccacagaggagggatgca

SEQ ID NO: 7343990 - DNA, 22 bp, Homo sapiens
gcagcaatcttcacagtgtcat

SEQ ID NO: 7343991 - DNA, 22 bp, Homo sapiens
gcagcagaaggccaaggggagc

SEQ ID NO: 7343992 - DNA, 22 bp, Homo sapiens
gcagcagcagggagtctgactt

SEQ ID NO: 7343993 - DNA, 22 bp, Homo sapiens
gcagcagcaggcgctcggccgt

SEQ ID NO: 7343994 - DNA, 22 bp, Homo sapiens
gcagcagcaggcgctcggccgt

SEQ ID NO: 7343995 - DNA, 19 bp, Homo sapiens
gcaggtcattaggctaggt

SEQ ID NO: 7343996 - DNA, 22 bp, Homo sapiens
gcaggtccagtcaccagagaga

SEQ ID NO: 7343997 - DNA, 19 bp, Homo sapiens
gcaggtagagacagcagcc

SEQ ID NO: 7343998 - DNA, 19 bp, Homo sapiens
gcagggtgttgactgtccc

SEQ ID NO: 7343999 - DNA, 22 bp, Homo sapiens
gcaggtctggcatagagcctgc

SEQ ID NO: 7344000 - DNA, 22 bp, Homo sapiens
gcaggtgatgtgatgtgagcat

SEQ ID NO: 7344001 - DNA, 22 bp, Homo sapiens
gcagggcagggcaagaactggg

SEQ ID NO: 7344002 - DNA, 22 bp, Homo sapiens
gcagggcatgggccctgtctgc

SEQ ID NO: 7344003 - DNA, 22 bp, Homo sapiens
gcagggccagggctcaggctgt

SEQ ID NO: 7344004 - DNA, 22 bp, Homo sapiens
gcagggccagggctcaggctgt

SEQ ID NO: 7344005 - DNA, 22 bp, Homo sapiens
gcagggccaggtacaagaagca

SEQ ID NO: 7344006 - DNA, 22 bp, Homo sapiens
gcagggccaggtacaagaagca

SEQ ID NO: 7344007 - DNA, 22 bp, Homo sapiens
gcagggccagtgcagagaggaa

SEQ ID NO: 7344008 - DNA, 19 bp, Homo sapiens
gcagggtgttgactgtccc

SEQ ID NO: 7344009 - DNA, 22 bp, Homo sapiens
gcagggtgtgtctcatacagtt

SEQ ID NO: 7344010 - DNA, 22 bp, Homo sapiens
gcagggtgtgtctcatacagtt

SEQ ID NO: 7344011 - DNA, 19 bp, Homo sapiens
gcagggtggcagagctctt

SEQ ID NO: 7344012 - DNA, 22 bp, Homo sapiens
gcagggccagtgcagagaggaa

SEQ ID NO: 7344013 - DNA, 22 bp, Homo sapiens
gcagggccttagcagcggctgc

SEQ ID NO: 7344014 - DNA, 22 bp, Homo sapiens
gcagggcagctgaagctaggtg

SEQ ID NO: 7344015 - DNA, 22 bp, Homo sapiens
gcaggccctcctctagcaaggc

SEQ ID NO: 7344016 - DNA, 19 bp, Homo sapiens
gcaggcccagtcgggctgg

SEQ ID NO: 7344017 - DNA, 22 bp, Homo sapiens
gcaggcctcccctgctggagct

SEQ ID NO: 7344018 - DNA, 22 bp, Homo sapiens
gcaggcctcccctgctggagct

SEQ ID NO: 7344019 - DNA, 22 bp, Homo sapiens
gcaggcagtttgcttttccctc

SEQ ID NO: 7344020 - DNA, 22 bp, Homo sapiens
gcagctgtatcacttttaaaca

SEQ ID NO: 7344021 - DNA, 23 bp, Homo sapiens
gcagctggttagaagggaaggag

SEQ ID NO: 7344022 - DNA, 22 bp, Homo sapiens
gcaggccattcaggagatgtgc

SEQ ID NO: 7344023 - DNA, 22 bp, Homo sapiens
gcaggccagctgtgcagatggg

SEQ ID NO: 7344024 - DNA, 22 bp, Homo sapiens
gcaggccaagccctcgcagaga

SEQ ID NO: 7344025 - DNA, 22 bp, Homo sapiens
ctgggggtgagcagcagcgacg

SEQ ID NO: 7344026 - DNA, 22 bp, Homo sapiens
ctgggggtcgcgcctctgggca

SEQ ID NO: 7344027 - DNA, 22 bp, Homo sapiens
ctggggggctactgacagagga

SEQ ID NO: 7344028 - DNA, 22 bp, Homo sapiens
ctggggtggaggagctcccctg

SEQ ID NO: 7344029 - DNA, 22 bp, Homo sapiens
ctggggtggaggagctcccctg

SEQ ID NO: 7344030 - DNA, 22 bp, Homo sapiens
ctggggtggtgcaggcctcatg

SEQ ID NO: 7344031 - DNA, 20 bp, Homo sapiens
ctgggctcggtggccctggc

SEQ ID NO: 7344032 - DNA, 20 bp, Homo sapiens
ctgggctcggtggccctggc

SEQ ID NO: 7344033 - DNA, 20 bp, Homo sapiens
ctgggctcggtggccctggc

SEQ ID NO: 7344034 - DNA, 22 bp, Homo sapiens
ctggggctggtgaggcaggctc

SEQ ID NO: 7344035 - DNA, 22 bp, Homo sapiens
ctgggggcaatggtcagagtgt

SEQ ID NO: 7344036 - DNA, 22 bp, Homo sapiens
ctgggggccttacggaactcca

SEQ ID NO: 7344037 - DNA, 22 bp, Homo sapiens
ctgggggccttacggaactcca

SEQ ID NO: 7344038 - DNA, 22 bp, Homo sapiens
ctggtgcctcctccctgtgctt

SEQ ID NO: 7344039 - DNA, 22 bp, Homo sapiens
ctggtgcctcctctcccaggtc

SEQ ID NO: 7344040 - DNA, 22 bp, Homo sapiens
ctggttattttgtttggcagag

SEQ ID NO: 7344041 - DNA, 22 bp, Homo sapiens
ctgggtgtagcccagtatgagg

SEQ ID NO: 7344042 - DNA, 22 bp, Homo sapiens
ctgggtggctgtccagccagcc

SEQ ID NO: 7344043 - DNA, 22 bp, Homo sapiens
ctgggtggctgtccagccagcc

SEQ ID NO: 7344044 - DNA, 22 bp, Homo sapiens
ctgggttgatctcagccctaag

SEQ ID NO: 7344045 - DNA, 22 bp, Homo sapiens
ctgggtttagggtctccccttg

SEQ ID NO: 7344046 - DNA, 22 bp, Homo sapiens
ctgggcctcatccccagagttt

SEQ ID NO: 7344047 - DNA, 22 bp, Homo sapiens
ctgggcctcatccagccacaac

SEQ ID NO: 7344048 - DNA, 22 bp, Homo sapiens
ctgggcccaggcggctctcgga

SEQ ID NO: 7344049 - DNA, 22 bp, Homo sapiens
ctgggctcaaatcctggccctg

SEQ ID NO: 7344050 - DNA, 22 bp, Homo sapiens
ctgggctcaaatcctggccctg

SEQ ID NO: 7344051 - DNA, 22 bp, Homo sapiens
ctgggaggcggaggttgcagtg

SEQ ID NO: 7344052 - DNA, 22 bp, Homo sapiens
ctgggagtcaccaggagcaagg

SEQ ID NO: 7344053 - DNA, 22 bp, Homo sapiens
ctgggatggctccgctgctgct

SEQ ID NO: 7344054 - DNA, 22 bp, Homo sapiens
ctgggccagatccagcctcaca

SEQ ID NO: 7344055 - DNA, 22 bp, Homo sapiens
ctgggcccacgagggctctggg

SEQ ID NO: 7344056 - DNA, 22 bp, Homo sapiens
ctgggcccacgagggctctggg

SEQ ID NO: 7344057 - DNA, 22 bp, Homo sapiens
ctgggagtgtccctctggtaat

SEQ ID NO: 7344058 - DNA, 22 bp, Homo sapiens
ctgtgggagcagcaccaaggac

SEQ ID NO: 7344059 - DNA, 22 bp, Homo sapiens
ctgtgggagggaaggcgcggcc

SEQ ID NO: 7344060 - DNA, 22 bp, Homo sapiens
ctgtgggagggtgagagaacca

SEQ ID NO: 7344061 - DNA, 22 bp, Homo sapiens
ctgtgggatcccatgactttcc

SEQ ID NO: 7344062 - DNA, 22 bp, Homo sapiens
ctgtgggagcactggggaccga

SEQ ID NO: 7344063 - DNA, 22 bp, Homo sapiens
ctgtggctttctctgcctcctt

SEQ ID NO: 7344064 - DNA, 22 bp, Homo sapiens
ctgtgggattcatgacattaat

SEQ ID NO: 7344065 - DNA, 22 bp, Homo sapiens
ctgtgggatgggacctcagctg

SEQ ID NO: 7344066 - DNA, 22 bp, Homo sapiens
ctgtgggcctagtctggcctag

SEQ ID NO: 7344067 - DNA, 22 bp, Homo sapiens
ctgtgggcctagtctggcctag

SEQ ID NO: 7344068 - DNA, 22 bp, Homo sapiens
ctgtgggcatttgagtgtgggt

SEQ ID NO: 7344069 - DNA, 22 bp, Homo sapiens
ctgtgggcgcctgtcagcctca

SEQ ID NO: 7344070 - DNA, 19 bp, Homo sapiens
ctgtgggcggaggaggggc

SEQ ID NO: 7344071 - DNA, 19 bp, Homo sapiens
ctgtgggcggaggaggggc

SEQ ID NO: 7344072 - DNA, 22 bp, Homo sapiens
ctgtgggcgcctgtcagcctca

SEQ ID NO: 7344073 - DNA, 20 bp, Homo sapiens
ctgtggcatcttgaaggagg

SEQ ID NO: 7344074 - DNA, 23 bp, Homo sapiens
ctgtggcaagtcctgcacctgcc

SEQ ID NO: 7344075 - DNA, 22 bp, Homo sapiens
ctgtggatttacttgagaagct

SEQ ID NO: 7344076 - DNA, 22 bp, Homo sapiens
ctgtgtgtgaacacagcccagc

SEQ ID NO: 7344077 - DNA, 22 bp, Homo sapiens
ctgtggtcaccaggctggggcc

SEQ ID NO: 7344078 - DNA, 22 bp, Homo sapiens
ctgtggggccaaattctcctct

SEQ ID NO: 7344079 - DNA, 22 bp, Homo sapiens
ctgtgggctgaaagtgctcccg

SEQ ID NO: 7344080 - DNA, 22 bp, Homo sapiens
ctgtgtttgctatgcaaagaca

SEQ ID NO: 7344081 - DNA, 22 bp, Homo sapiens
ctgtgtttgctatgcaaagaca

SEQ ID NO: 7344082 - DNA, 22 bp, Homo sapiens
ctgtgtttggacaacttttcag

SEQ ID NO: 7344083 - DNA, 22 bp, Homo sapiens
ctgtgtttggacaacttttcag

SEQ ID NO: 7344084 - DNA, 22 bp, Homo sapiens
ctgtgttttgattaaaaagcaa

SEQ ID NO: 7344085 - DNA, 22 bp, Homo sapiens
ctgtgttttgagatattattaa

SEQ ID NO: 7344086 - DNA, 22 bp, Homo sapiens
ctgtgtttttggtctgatctat

SEQ ID NO: 7344087 - DNA, 22 bp, Homo sapiens
ctgtgtttctaagtaaaggagc

SEQ ID NO: 7344088 - DNA, 22 bp, Homo sapiens
ctgtgtttctgagaagtgggga

SEQ ID NO: 7344089 - DNA, 22 bp, Homo sapiens
ctgtgtttctcttgacccaagt

SEQ ID NO: 7344090 - DNA, 22 bp, Homo sapiens
ctgtgtgtttatatcatttcct

SEQ ID NO: 7344091 - DNA, 22 bp, Homo sapiens
ctgtgtgtttatatcatttcct

SEQ ID NO: 7344092 - DNA, 22 bp, Homo sapiens
ctgtgtgtttatatcatttcct

SEQ ID NO: 7344093 - DNA, 22 bp, Homo sapiens
ctgtgtgtttatatcatttcct

SEQ ID NO: 7344094 - DNA, 22 bp, Homo sapiens
ctgtgtgtgagaagcaggttga

SEQ ID NO: 7344095 - DNA, 22 bp, Homo sapiens
ctgtgtgtgagaagcaggttga

SEQ ID NO: 7344096 - DNA, 23 bp, Homo sapiens
ctgtgtgtgccgagggtggccac

SEQ ID NO: 7344097 - DNA, 23 bp, Homo sapiens
ctgtgtgtgccgagggtggccac

SEQ ID NO: 7344098 - DNA, 22 bp, Homo sapiens
ctgtgtgtgctacaggcttcca

SEQ ID NO: 7344099 - DNA, 22 bp, Homo sapiens
ctgtgtgtgctacaggcttcca

SEQ ID NO: 7344100 - DNA, 22 bp, Homo sapiens
ctgtgtgtgtctgcagcatact

SEQ ID NO: 7344101 - DNA, 22 bp, Homo sapiens
ctgtgtgtgtctgcagcatact

SEQ ID NO: 7344102 - DNA, 22 bp, Homo sapiens
ctgtgtgtgtctgcagcatact

SEQ ID NO: 7344103 - DNA, 18 bp, Homo sapiens
ctgtcccatcctcaggtt

SEQ ID NO: 7344104 - DNA, 22 bp, Homo sapiens
ctgtcccagtgatcctgagtgc

SEQ ID NO: 7344105 - DNA, 21 bp, Homo sapiens
ctgtccccagtgagcaccccc

SEQ ID NO: 7344106 - DNA, 22 bp, Homo sapiens
ctgtccccgcgagtccagagct

SEQ ID NO: 7344107 - DNA, 22 bp, Homo sapiens
ctgtccctcagttctgggcaaa

SEQ ID NO: 7344108 - DNA, 22 bp, Homo sapiens
ctgtcccagatgttctcagcac

SEQ ID NO: 7344109 - DNA, 22 bp, Homo sapiens
ctgtccattttgaattttcagt

SEQ ID NO: 7344110 - DNA, 20 bp, Homo sapiens
ctgtccatatttgaaaatgc

SEQ ID NO: 7344111 - DNA, 22 bp, Homo sapiens
ctggttttccaatgttttgact

SEQ ID NO: 7344112 - DNA, 21 bp, Homo sapiens
ctgtcatgcaaccattctcca

SEQ ID NO: 7344113 - DNA, 21 bp, Homo sapiens
ctgtcatgcaaccattctcca

SEQ ID NO: 7344114 - DNA, 22 bp, Homo sapiens
ctgtcagttcttccagatagag

SEQ ID NO: 7344115 - DNA, 22 bp, Homo sapiens
ctgtcatggtcagattgtcatc

SEQ ID NO: 7344116 - DNA, 22 bp, Homo sapiens
ctgtcatggtttgaatgctcgc

SEQ ID NO: 7344117 - DNA, 22 bp, Homo sapiens
ctgtcatggtcagattgtcatc

SEQ ID NO: 7344118 - DNA, 22 bp, Homo sapiens
ctggtttagtaggggactgaag

SEQ ID NO: 7344119 - DNA, 22 bp, Homo sapiens
ctgtgaatttaaagcacacatc

SEQ ID NO: 7344120 - DNA, 22 bp, Homo sapiens
ctgtgacagtttctcagaattt

SEQ ID NO: 7344121 - DNA, 22 bp, Homo sapiens
ctgtgacagtttctcagacttt

SEQ ID NO: 7344122 - DNA, 21 bp, Homo sapiens
ctgtccctctttgcttccctc

SEQ ID NO: 7344123 - DNA, 22 bp, Homo sapiens
ctgtccctcatcacctctgggt

SEQ ID NO: 7344124 - DNA, 22 bp, Homo sapiens
ctgtgaggcggaaaggactctc

SEQ ID NO: 7344125 - DNA, 22 bp, Homo sapiens
ctgtgaggcgggtggagtggag

SEQ ID NO: 7344126 - DNA, 22 bp, Homo sapiens
ctgtgaggcctttggccagata

SEQ ID NO: 7344127 - DNA, 22 bp, Homo sapiens
ctgtgaggcctttggccagata

SEQ ID NO: 7344128 - DNA, 22 bp, Homo sapiens
ctgtgagctgggtggccaggac

SEQ ID NO: 7344129 - DNA, 22 bp, Homo sapiens
ctgtgacttccggatgacatga

SEQ ID NO: 7344130 - DNA, 22 bp, Homo sapiens
ctgtgagctaggaggtaattta

SEQ ID NO: 7344131 - DNA, 22 bp, Homo sapiens
ctgtgacttttgccctgtacca

SEQ ID NO: 7344132 - DNA, 20 bp, Homo sapiens
cttcttcagcctatgcttca

SEQ ID NO: 7344133 - DNA, 20 bp, Homo sapiens
cttcttcagtagtttgttct

SEQ ID NO: 7344134 - DNA, 22 bp, Homo sapiens
cttccctcctggattccagact

SEQ ID NO: 7344135 - DNA, 22 bp, Homo sapiens
cttccctcctggattccagact

SEQ ID NO: 7344136 - DNA, 22 bp, Homo sapiens
cttccctggtgttagcccaatg

SEQ ID NO: 7344137 - DNA, 22 bp, Homo sapiens
cttcactaatcactgaactcca

SEQ ID NO: 7344138 - DNA, 22 bp, Homo sapiens
cttcacataaacaaagggccat

SEQ ID NO: 7344139 - DNA, 20 bp, Homo sapiens
ctgttaaaaggtatgaattc

SEQ ID NO: 7344140 - DNA, 22 bp, Homo sapiens
ctgttaaaaagaccaatggatt

SEQ ID NO: 7344141 - DNA, 22 bp, Homo sapiens
ctgttaaaagcactgccatcct

SEQ ID NO: 7344142 - DNA, 22 bp, Homo sapiens
ctgttaaagatagttaagcttc

SEQ ID NO: 7344143 - DNA, 22 bp, Homo sapiens
ctgttaaagtgatcctttgtta

SEQ ID NO: 7344144 - DNA, 22 bp, Homo sapiens
ctgttaaagtgatcctttgtta

SEQ ID NO: 7344145 - DNA, 22 bp, Homo sapiens
ctgttaaatagactgcagtgca

SEQ ID NO: 7344146 - DNA, 22 bp, Homo sapiens
ctgttaaaatgtggtcttaaaa

SEQ ID NO: 7344147 - DNA, 22 bp, Homo sapiens
ctgttaaatgagaaagcagact

SEQ ID NO: 7344148 - DNA, 22 bp, Homo sapiens
ctgttaaatagactgcagtgca

SEQ ID NO: 7344149 - DNA, 20 bp, Homo sapiens
ctttctctaatttataagta

SEQ ID NO: 7344150 - DNA, 22 bp, Homo sapiens
ctttctctgtgtttcacatgct

SEQ ID NO: 7344151 - DNA, 22 bp, Homo sapiens
ctttgcataatgaatgatcata

SEQ ID NO: 7344152 - DNA, 22 bp, Homo sapiens
ctttgcatacaatttttagaaa

SEQ ID NO: 7344153 - DNA, 21 bp, Homo sapiens
ctttgcatacagatgccaatt

SEQ ID NO: 7344154 - DNA, 21 bp, Homo sapiens
ctttgcatctatatgttctca

SEQ ID NO: 7344155 - DNA, 22 bp, Homo sapiens
ctttgcatgggtctgaaggctt

SEQ ID NO: 7344156 - DNA, 21 bp, Homo sapiens
ctttgcatctatatgttctca

SEQ ID NO: 7344157 - DNA, 22 bp, Homo sapiens
ctttgcatgtggtagaaggttc

SEQ ID NO: 7344158 - DNA, 22 bp, Homo sapiens
ctttgcattctcagcacagagc

SEQ ID NO: 7344159 - DNA, 22 bp, Homo sapiens
ctttgcattttgcccaactgtg

SEQ ID NO: 7344160 - DNA, 22 bp, Homo sapiens
ctttggaacaagaagaaatggc

SEQ ID NO: 7344161 - DNA, 22 bp, Homo sapiens
cttggaggaaaggcagggagac

SEQ ID NO: 7344162 - DNA, 22 bp, Homo sapiens
cttcttctctacatcctttgat

SEQ ID NO: 7344163 - DNA, 22 bp, Homo sapiens
cttcttcctgctgcagcctcca

SEQ ID NO: 7344164 - DNA, 22 bp, Homo sapiens
cttgcctgaggaacagagggta

SEQ ID NO: 7344165 - DNA, 22 bp, Homo sapiens
cttggactggacccgaggaatg

SEQ ID NO: 7344166 - DNA, 22 bp, Homo sapiens
cttggacttccaggaagtattt

SEQ ID NO: 7344167 - DNA, 22 bp, Homo sapiens
cttggaaactttccctgggcac

SEQ ID NO: 7344168 - DNA, 22 bp, Homo sapiens
cttgctttccaaatgactcact

SEQ ID NO: 7344169 - DNA, 22 bp, Homo sapiens
cttggaaaggaatcttttacca

SEQ ID NO: 7344170 - DNA, 22 bp, Homo sapiens
gaaactgagtaggctagagcac

SEQ ID NO: 7344171 - DNA, 22 bp, Homo sapiens
gaaagaatcaactatgtctctg

SEQ ID NO: 7344172 - DNA, 22 bp, Homo sapiens
gaaagaatgctatagtgacttc

SEQ ID NO: 7344173 - DNA, 22 bp, Homo sapiens
gaaagaatgctgggagccatct

SEQ ID NO: 7344174 - DNA, 22 bp, Homo sapiens
gaaacttgataattgaaacaga

SEQ ID NO: 7344175 - DNA, 22 bp, Homo sapiens
gaaaaatgctccaaatctgtgg

SEQ ID NO: 7344176 - DNA, 22 bp, Homo sapiens
gaaacagcccctgtgtgaagca

SEQ ID NO: 7344177 - DNA, 22 bp, Homo sapiens
gaaacagctagaaagccattgg

SEQ ID NO: 7344178 - DNA, 22 bp, Homo sapiens
ctttttgttgtataagcccttt

SEQ ID NO: 7344179 - DNA, 22 bp, Homo sapiens
ctttggcaagggttttaattgt

SEQ ID NO: 7344180 - DNA, 22 bp, Homo sapiens
ctttggcaacacatgtgggaca

SEQ ID NO: 7344181 - DNA, 22 bp, Homo sapiens
ctttggaggtcatagccaagag

SEQ ID NO: 7344182 - DNA, 22 bp, Homo sapiens
ctttggaagtaaagtcagcagg

SEQ ID NO: 7344183 - DNA, 22 bp, Homo sapiens
ctttttctaatcataattgtct

SEQ ID NO: 7344184 - DNA, 20 bp, Homo sapiens
ctttttctccagctctgagc

SEQ ID NO: 7344185 - DNA, 22 bp, Homo sapiens
ctttttctgatgttccatgatt

SEQ ID NO: 7344186 - DNA, 22 bp, Homo sapiens
ctttttgtctctgtcctgatga

SEQ ID NO: 7344187 - DNA, 22 bp, Homo sapiens
cttttgttctacagctggggaa

SEQ ID NO: 7344188 - DNA, 22 bp, Homo sapiens
cttttgttgcccttgtcgcagg

SEQ ID NO: 7344189 - DNA, 22 bp, Homo sapiens
ctttggcacagtctcatttgat

SEQ ID NO: 7344190 - DNA, 22 bp, Homo sapiens
ctttggcacagtgtttactagc

SEQ ID NO: 7344191 - DNA, 22 bp, Homo sapiens
ctttggcacagtgtttactagc

SEQ ID NO: 7344192 - DNA, 23 bp, Homo sapiens
ctttggcactttacaataaactc

SEQ ID NO: 7344193 - DNA, 22 bp, Homo sapiens
ctttggcaatgtcattttcaat

SEQ ID NO: 7344194 - DNA, 22 bp, Homo sapiens
gaaatatacattgcaggaagag

SEQ ID NO: 7344195 - DNA, 22 bp, Homo sapiens
gaaatacaggaatgccacacag

SEQ ID NO: 7344196 - DNA, 22 bp, Homo sapiens
gaaagacatagttgcaagatgg

SEQ ID NO: 7344197 - DNA, 22 bp, Homo sapiens
gaaagacatagttgcaagatgg

SEQ ID NO: 7344198 - DNA, 22 bp, Homo sapiens
gaaatgtcctcatgaaggaagt

SEQ ID NO: 7344199 - DNA, 22 bp, Homo sapiens
gaaatgtctctggatttgcttt

SEQ ID NO: 7344200 - DNA, 22 bp, Homo sapiens
gaaatgtctcttgatttttgga

SEQ ID NO: 7344201 - DNA, 22 bp, Homo sapiens
gaaatgtctttgacaagagagg

SEQ ID NO: 7344202 - DNA, 22 bp, Homo sapiens
gaaatgtatttgacagtccttg

SEQ ID NO: 7344203 - DNA, 22 bp, Homo sapiens
gaaatgtcatagtcttcaagcc

SEQ ID NO: 7344204 - DNA, 22 bp, Homo sapiens
gaaatgtcaagatatgtttgga

SEQ ID NO: 7344205 - DNA, 20 bp, Homo sapiens
gaaatgtatctcttgattct

SEQ ID NO: 7344206 - DNA, 22 bp, Homo sapiens
gaaatattgggactcagagctt

SEQ ID NO: 7344207 - DNA, 22 bp, Homo sapiens
gaagaagacatggaacaatagt

SEQ ID NO: 7344208 - DNA, 22 bp, Homo sapiens
gaagaactttagggcagaattt

SEQ ID NO: 7344209 - DNA, 22 bp, Homo sapiens
gaagaactgtgacagaagcagt

SEQ ID NO: 7344210 - DNA, 22 bp, Homo sapiens
gaagaactaactgaccatgaat

SEQ ID NO: 7344211 - DNA, 22 bp, Homo sapiens
gaagaacacttcatgattcatt

SEQ ID NO: 7344212 - DNA, 22 bp, Homo sapiens
gaaattaagcaggggtctgtgg

SEQ ID NO: 7344213 - DNA, 22 bp, Homo sapiens
gaaattattgctagagactgca

SEQ ID NO: 7344214 - DNA, 22 bp, Homo sapiens
gaaatgttatgagatatgtact

SEQ ID NO: 7344215 - DNA, 22 bp, Homo sapiens
gaaatgttatgagatatgtact

SEQ ID NO: 7344216 - DNA, 22 bp, Homo sapiens
gaaatgttcctgatccctgatt

SEQ ID NO: 7344217 - DNA, 22 bp, Homo sapiens
gaaatgttggacacttgaaatt

SEQ ID NO: 7344218 - DNA, 22 bp, Homo sapiens
gaaatgttgtcctgtctcttga

SEQ ID NO: 7344219 - DNA, 22 bp, Homo sapiens
gaaatgttgtctctgcagcaat

SEQ ID NO: 7344220 - DNA, 22 bp, Homo sapiens
gaaatgtttccttttgtatgct

SEQ ID NO: 7344221 - DNA, 23 bp, Homo sapiens
gaaatgtttcttgattaatccta

SEQ ID NO: 7344222 - DNA, 22 bp, Homo sapiens
gaaatgttttacaaggcatact

SEQ ID NO: 7344223 - DNA, 22 bp, Homo sapiens
gaaatgtttgggaggagtcaac

SEQ ID NO: 7344224 - DNA, 22 bp, Homo sapiens
gaaatgttttacaaggcatact

SEQ ID NO: 7344225 - DNA, 22 bp, Homo sapiens
gaaattaaccacctttggcttt

SEQ ID NO: 7344226 - DNA, 22 bp, Homo sapiens
gaaattaagcaggggtctgtgg

SEQ ID NO: 7344227 - DNA, 22 bp, Homo sapiens
gaatttatctacgttaagtatg

SEQ ID NO: 7344228 - DNA, 22 bp, Homo sapiens
gaattttcaggtagcaatttca

SEQ ID NO: 7344229 - DNA, 22 bp, Homo sapiens
gacaaaacacattagtttaaaa

SEQ ID NO: 7344230 - DNA, 22 bp, Homo sapiens
gaatttttctggaagcaattat

SEQ ID NO: 7344231 - DNA, 22 bp, Homo sapiens
gacaaaagtgttttgaacaagg

SEQ ID NO: 7344232 - DNA, 21 bp, Homo sapiens
gacaaacatttcatagcttta

SEQ ID NO: 7344233 - DNA, 22 bp, Homo sapiens
gacaaaactgagatcacactgt

SEQ ID NO: 7344234 - DNA, 22 bp, Homo sapiens
gacaaagcagacaagataattc

SEQ ID NO: 7344235 - DNA, 18 bp, Homo sapiens
gacaaatgcaatttaaag

SEQ ID NO: 7344236 - DNA, 18 bp, Homo sapiens
gacaaatgcaatttaaag

SEQ ID NO: 7344237 - DNA, 22 bp, Homo sapiens
gacaacaataatgtggagctga

SEQ ID NO: 7344238 - DNA, 22 bp, Homo sapiens
gacagcaggatgtgaggggatg

SEQ ID NO: 7344239 - DNA, 22 bp, Homo sapiens
gacagcagggacatgtaggaag

SEQ ID NO: 7344240 - DNA, 22 bp, Homo sapiens
gacaacacatgtatgccactct

SEQ ID NO: 7344241 - DNA, 22 bp, Homo sapiens
gacagcagccacagggagaggg

SEQ ID NO: 7344242 - DNA, 22 bp, Homo sapiens
gacagcagccacagggagaggg

SEQ ID NO: 7344243 - DNA, 22 bp, Homo sapiens
gaatgtttttaggaatgttatg

SEQ ID NO: 7344244 - DNA, 22 bp, Homo sapiens
gaatgtttgtgcagagtcatct

SEQ ID NO: 7344245 - DNA, 22 bp, Homo sapiens
gaatgtttttaggaatgttatg

SEQ ID NO: 7344246 - DNA, 22 bp, Homo sapiens
gaatgtttttataagtgttaca

SEQ ID NO: 7344247 - DNA, 22 bp, Homo sapiens
gaatgtttttataagtgttaca

SEQ ID NO: 7344248 - DNA, 22 bp, Homo sapiens
gaatgtttttcaaacctgtggc

SEQ ID NO: 7344249 - DNA, 22 bp, Homo sapiens
gaatgtttttcaaacctgtggc

SEQ ID NO: 7344250 - DNA, 22 bp, Homo sapiens
gaatgtttttcattggtgactc

SEQ ID NO: 7344251 - DNA, 22 bp, Homo sapiens
gaatgtttttcattggtgactc

SEQ ID NO: 7344252 - DNA, 22 bp, Homo sapiens
gaattacataataaaatgagag

SEQ ID NO: 7344253 - DNA, 22 bp, Homo sapiens
gaattacaaagtgagacaagct

SEQ ID NO: 7344254 - DNA, 22 bp, Homo sapiens
gaatggaaactgggagatggcc

SEQ ID NO: 7344255 - DNA, 22 bp, Homo sapiens
gaatgtttgtgcagagtcatct

SEQ ID NO: 7344256 - DNA, 22 bp, Homo sapiens
gaatgtttgactaaaggtagct

SEQ ID NO: 7344257 - DNA, 19 bp, Homo sapiens
gaatgtttgtattcagcgc

SEQ ID NO: 7344258 - DNA, 19 bp, Homo sapiens
gaatgtttgtattcagcgc

SEQ ID NO: 7344259 - DNA, 19 bp, Homo sapiens
gaatgggttctgtagggag

SEQ ID NO: 7344260 - DNA, 22 bp, Homo sapiens
gacctggggtggaaggaaggca

SEQ ID NO: 7344261 - DNA, 22 bp, Homo sapiens
gacctggttgactgtgagcagg

SEQ ID NO: 7344262 - DNA, 22 bp, Homo sapiens
gaccttgtaaattttcactcca

SEQ ID NO: 7344263 - DNA, 22 bp, Homo sapiens
gactaggggcagcgtgggagct

SEQ ID NO: 7344264 - DNA, 22 bp, Homo sapiens
gactatgtgtattttactcacc

SEQ ID NO: 7344265 - DNA, 22 bp, Homo sapiens
gacatgcatattcactcttctt

SEQ ID NO: 7344266 - DNA, 22 bp, Homo sapiens
gacatgcatattcactcttctt

SEQ ID NO: 7344267 - DNA, 22 bp, Homo sapiens
gacatgaatgttatactttatt

SEQ ID NO: 7344268 - DNA, 22 bp, Homo sapiens
gacatgcattaagacacactga

SEQ ID NO: 7344269 - DNA, 22 bp, Homo sapiens
gacatgcatgaatgcaggtctc

SEQ ID NO: 7344270 - DNA, 22 bp, Homo sapiens
gacctggcatattcattggcac

SEQ ID NO: 7344271 - DNA, 22 bp, Homo sapiens
gacatgtcggatagaatgagtt

SEQ ID NO: 7344272 - DNA, 22 bp, Homo sapiens
gacagcctggcttaatctgtct

SEQ ID NO: 7344273 - DNA, 22 bp, Homo sapiens
gacagcctcatgaggagcaaaa

SEQ ID NO: 7344274 - DNA, 22 bp, Homo sapiens
gacagctccagctcctccaggc

SEQ ID NO: 7344275 - DNA, 22 bp, Homo sapiens
gacagctccttttggtgcatat

SEQ ID NO: 7344276 - DNA, 22 bp, Homo sapiens
gacagctccttttggtgcatat

SEQ ID NO: 7344277 - DNA, 22 bp, Homo sapiens
gacagctcctttctgaggatga

SEQ ID NO: 7344278 - DNA, 22 bp, Homo sapiens
gacagcagtttttctctagggt

SEQ ID NO: 7344279 - DNA, 22 bp, Homo sapiens
gacagcaggtgcttgggaaagg

SEQ ID NO: 7344280 - DNA, 22 bp, Homo sapiens
gacatacagaatctgcagactt

SEQ ID NO: 7344281 - DNA, 22 bp, Homo sapiens
gacatacagaatctgcagactt

SEQ ID NO: 7344282 - DNA, 22 bp, Homo sapiens
gacatacagcatggtctatgaa

SEQ ID NO: 7344283 - DNA, 22 bp, Homo sapiens
gacagtgcatttcctggcatgg

SEQ ID NO: 7344284 - DNA, 22 bp, Homo sapiens
gacatatactatggatggttct

SEQ ID NO: 7344285 - DNA, 22 bp, Homo sapiens
gacatacagccctctccctggt

SEQ ID NO: 7344286 - DNA, 22 bp, Homo sapiens
gacatatgatattaaatgagca

SEQ ID NO: 7344287 - DNA, 22 bp, Homo sapiens
gacatcaattcagcattttaag

SEQ ID NO: 7344288 - DNA, 22 bp, Homo sapiens
gacatcatagggtgggaggaaa

SEQ ID NO: 7344289 - DNA, 22 bp, Homo sapiens
gagaaggaagttgagccagcat

SEQ ID NO: 7344290 - DNA, 22 bp, Homo sapiens
gagaagcaggtttagcagacaa

SEQ ID NO: 7344291 - DNA, 22 bp, Homo sapiens
gagaagcaggtttagcagacaa

SEQ ID NO: 7344292 - DNA, 22 bp, Homo sapiens
gagaagcaggtttagcagacaa

SEQ ID NO: 7344293 - DNA, 22 bp, Homo sapiens
gagaagcaggtttagcagacaa

SEQ ID NO: 7344294 - DNA, 22 bp, Homo sapiens
gagaagcaatttccaactgtgc

SEQ ID NO: 7344295 - DNA, 22 bp, Homo sapiens
gagaagcaatcagtggccaccc

SEQ ID NO: 7344296 - DNA, 22 bp, Homo sapiens
gagaagcaatcgtgacatctcc

SEQ ID NO: 7344297 - DNA, 22 bp, Homo sapiens
gagaagcaatcagcagccaccc

SEQ ID NO: 7344298 - DNA, 22 bp, Homo sapiens
gagaaagggaacttacagagtg

SEQ ID NO: 7344299 - DNA, 22 bp, Homo sapiens
gagaaagggaacttacagagtg

SEQ ID NO: 7344300 - DNA, 22 bp, Homo sapiens
gagaagcaatcagcagccaccc

SEQ ID NO: 7344301 - DNA, 22 bp, Homo sapiens
gagaagaacttgggcaaagtca

SEQ ID NO: 7344302 - DNA, 22 bp, Homo sapiens
gagaagaacttgggcaaagtca

SEQ ID NO: 7344303 - DNA, 22 bp, Homo sapiens
gagaggagaagcctgcgcttca

SEQ ID NO: 7344304 - DNA, 22 bp, Homo sapiens
gagaggagacttatccagattg

SEQ ID NO: 7344305 - DNA, 22 bp, Homo sapiens
gagaggaggtggctatgacagc

SEQ ID NO: 7344306 - DNA, 18 bp, Homo sapiens
gagaggagccagaatttt

SEQ ID NO: 7344307 - DNA, 22 bp, Homo sapiens
gagaggagtagacactttggtt

SEQ ID NO: 7344308 - DNA, 22 bp, Homo sapiens
gagaggagtaggctgatggtgc

SEQ ID NO: 7344309 - DNA, 22 bp, Homo sapiens
gagaggagtaggctgatggtgc

SEQ ID NO: 7344310 - DNA, 22 bp, Homo sapiens
gagagccagcagtaaagacatt

SEQ ID NO: 7344311 - DNA, 22 bp, Homo sapiens
gagagccctacaaggcgttttg

SEQ ID NO: 7344312 - DNA, 22 bp, Homo sapiens
gagagccatggtggagatgggg

SEQ ID NO: 7344313 - DNA, 22 bp, Homo sapiens
gagagccatggtggagatgggg

SEQ ID NO: 7344314 - DNA, 22 bp, Homo sapiens
gagagacagcacacagtgtggg

SEQ ID NO: 7344315 - DNA, 22 bp, Homo sapiens
gagagacagcagaacgtgcagc

SEQ ID NO: 7344316 - DNA, 22 bp, Homo sapiens
gagagagaaccccgtgcccttc

SEQ ID NO: 7344317 - DNA, 22 bp, Homo sapiens
gagagagaaaatgactccggac

SEQ ID NO: 7344318 - DNA, 22 bp, Homo sapiens
gagagactggaatgggctgtgg

SEQ ID NO: 7344319 - DNA, 22 bp, Homo sapiens
gagagactgggcagggccggca

SEQ ID NO: 7344320 - DNA, 22 bp, Homo sapiens
gagcagaactactcacatatcg

SEQ ID NO: 7344321 - DNA, 22 bp, Homo sapiens
gagcagaactactcacatatcg

SEQ ID NO: 7344322 - DNA, 22 bp, Homo sapiens
gagcagaactactcacatatcg

SEQ ID NO: 7344323 - DNA, 22 bp, Homo sapiens
gagcacgttgaagcgcactgtc

SEQ ID NO: 7344324 - DNA, 22 bp, Homo sapiens
gagcacagtaaagcagtgtcac

SEQ ID NO: 7344325 - DNA, 22 bp, Homo sapiens
gagcaccctacctgccactgag

SEQ ID NO: 7344326 - DNA, 22 bp, Homo sapiens
gagcacatgtggagagtctggg

SEQ ID NO: 7344327 - DNA, 22 bp, Homo sapiens
gagcacatgagaggaaatcaaa

SEQ ID NO: 7344328 - DNA, 23 bp, Homo sapiens
gagcagagcgggcgggggtcctg

SEQ ID NO: 7344329 - DNA, 18 bp, Homo sapiens
gagcagaggagggttttt

SEQ ID NO: 7344330 - DNA, 22 bp, Homo sapiens
gagcaggaaggccagaagggtc

SEQ ID NO: 7344331 - DNA, 22 bp, Homo sapiens
gagcaggaaggccagaagggtc

SEQ ID NO: 7344332 - DNA, 22 bp, Homo sapiens
gagcaggaactgaaaatgagac

SEQ ID NO: 7344333 - DNA, 22 bp, Homo sapiens
gagcaatagcaccaattaactc

SEQ ID NO: 7344334 - DNA, 22 bp, Homo sapiens
gagcacagatcctggagccaca

SEQ ID NO: 7344335 - DNA, 22 bp, Homo sapiens
gagaggagttactatttccgag

SEQ ID NO: 7344336 - DNA, 22 bp, Homo sapiens
gagaggagtccctatcacagtt

SEQ ID NO: 7344337 - DNA, 22 bp, Homo sapiens
gagaggagtccctatcacagtt

SEQ ID NO: 7344338 - DNA, 22 bp, Homo sapiens
gagaggagtccctatcacagtt

SEQ ID NO: 7344339 - DNA, 22 bp, Homo sapiens
gagaggagtccctatcacagtt

SEQ ID NO: 7344340 - DNA, 22 bp, Homo sapiens
gagaggcaggaatcctgggtga

SEQ ID NO: 7344341 - DNA, 20 bp, Homo sapiens
gagatttccaatcatgccca

SEQ ID NO: 7344342 - DNA, 22 bp, Homo sapiens
gagatttccatattttgtaaca

SEQ ID NO: 7344343 - DNA, 22 bp, Homo sapiens
gagatttcttttgatgcctgtc

SEQ ID NO: 7344344 - DNA, 22 bp, Homo sapiens
gagcaaaataaattctgacaaa

SEQ ID NO: 7344345 - DNA, 22 bp, Homo sapiens
gagcaacacattgaatgaggat

SEQ ID NO: 7344346 - DNA, 22 bp, Homo sapiens
gagggacagctaaagagaaatt

SEQ ID NO: 7344347 - DNA, 22 bp, Homo sapiens
gagggacagctaaagagaaatt

SEQ ID NO: 7344348 - DNA, 22 bp, Homo sapiens
gagggccacgttcagggctctc

SEQ ID NO: 7344349 - DNA, 22 bp, Homo sapiens
gagggccacgttcagggctctc

SEQ ID NO: 7344350 - DNA, 22 bp, Homo sapiens
gagggccacgttcagggctctc

SEQ ID NO: 7344351 - DNA, 22 bp, Homo sapiens
gagggccacttgaatgttttca

SEQ ID NO: 7344352 - DNA, 22 bp, Homo sapiens
gagggccagagtcctggggtca

SEQ ID NO: 7344353 - DNA, 22 bp, Homo sapiens
gagggccagaaagttattgaga

SEQ ID NO: 7344354 - DNA, 22 bp, Homo sapiens
gaggctgtaacttgggcactgg

SEQ ID NO: 7344355 - DNA, 22 bp, Homo sapiens
gaggctgtctgttagcctggga

SEQ ID NO: 7344356 - DNA, 22 bp, Homo sapiens
gagggaaggtcacccttgtagc

SEQ ID NO: 7344357 - DNA, 22 bp, Homo sapiens
gagggaagaggcctgacatttt

SEQ ID NO: 7344358 - DNA, 22 bp, Homo sapiens
gagggccagatcccaggaggaa

SEQ ID NO: 7344359 - DNA, 22 bp, Homo sapiens
gagggccagcagcctcagcatg

SEQ ID NO: 7344360 - DNA, 22 bp, Homo sapiens
gagggccagcagcctcagcatg

SEQ ID NO: 7344361 - DNA, 22 bp, Homo sapiens
gagggccaggcggagacaggcg

SEQ ID NO: 7344362 - DNA, 22 bp, Homo sapiens
gagggccaggcggagacaggcg

SEQ ID NO: 7344363 - DNA, 22 bp, Homo sapiens
gagggccaggcggagacaggcg

SEQ ID NO: 7344364 - DNA, 22 bp, Homo sapiens
gagggccaggtagatatcagga

SEQ ID NO: 7344365 - DNA, 22 bp, Homo sapiens
gagggccattctgagggggtga

SEQ ID NO: 7344366 - DNA, 22 bp, Homo sapiens
gagggccagcctgccaagggcc

SEQ ID NO: 7344367 - DNA, 22 bp, Homo sapiens
gagggccagcagcctcagcatg

SEQ ID NO: 7344368 - DNA, 22 bp, Homo sapiens
gagggccagcctgccaagggcc

SEQ ID NO: 7344369 - DNA, 22 bp, Homo sapiens
gagggccaggcagcaagaaggc

SEQ ID NO: 7344370 - DNA, 22 bp, Homo sapiens
gagggccctggctggctccagc

SEQ ID NO: 7344371 - DNA, 22 bp, Homo sapiens
gagggcctctgctgctccacat

SEQ ID NO: 7344372 - DNA, 22 bp, Homo sapiens
gagggctgataacaggaataca

SEQ ID NO: 7344373 - DNA, 22 bp, Homo sapiens
gaggctggttctgaagtactgt

SEQ ID NO: 7344374 - DNA, 22 bp, Homo sapiens
gaggctggtggttagttccatt

SEQ ID NO: 7344375 - DNA, 22 bp, Homo sapiens
gaggctggtaggaaaggaaaca

SEQ ID NO: 7344376 - DNA, 22 bp, Homo sapiens
gaggctagagcaggggctcaat

SEQ ID NO: 7344377 - DNA, 22 bp, Homo sapiens
gaggcggcggccgagcctggct

SEQ ID NO: 7344378 - DNA, 22 bp, Homo sapiens
gaggcgggcagatcacctgagg

SEQ ID NO: 7344379 - DNA, 22 bp, Homo sapiens
gaggcggccagcgaggccgcaa

SEQ ID NO: 7344380 - DNA, 22 bp, Homo sapiens
gaggcgcagcccggaggagaca

SEQ ID NO: 7344381 - DNA, 22 bp, Homo sapiens
gaggcgcagcccggaggagaca

SEQ ID NO: 7344382 - DNA, 22 bp, Homo sapiens
gaggctcaaacctggacagagc

SEQ ID NO: 7344383 - DNA, 19 bp, Homo sapiens
gaggcgaggcgtgcaggag

SEQ ID NO: 7344384 - DNA, 22 bp, Homo sapiens
gaggcgagaagctggagatggt

SEQ ID NO: 7344385 - DNA, 22 bp, Homo sapiens
gaggcgagaagctggagatggt

SEQ ID NO: 7344386 - DNA, 22 bp, Homo sapiens
gaggcctgtagtcatggatgta

SEQ ID NO: 7344387 - DNA, 22 bp, Homo sapiens
gaggcctggtttgcatgagaat

SEQ ID NO: 7344388 - DNA, 22 bp, Homo sapiens
gaggcctggtctatgagatgtt

SEQ ID NO: 7344389 - DNA, 22 bp, Homo sapiens
gaggcctgggttggaggtgcat

SEQ ID NO: 7344390 - DNA, 22 bp, Homo sapiens
gaggcctggtagccgagcccca

SEQ ID NO: 7344391 - DNA, 22 bp, Homo sapiens
gaggtctgcttatctctcacag

SEQ ID NO: 7344392 - DNA, 22 bp, Homo sapiens
gaggtctgccttcaggagagtt

SEQ ID NO: 7344393 - DNA, 22 bp, Homo sapiens
gaggtctgggatggggcctgaa

SEQ ID NO: 7344394 - DNA, 22 bp, Homo sapiens
gaggtctgggcttgggcctggt

SEQ ID NO: 7344395 - DNA, 22 bp, Homo sapiens
gagggtggtggcttaaggtgct

SEQ ID NO: 7344396 - DNA, 22 bp, Homo sapiens
gagggtgggtttcttgcacgtc

SEQ ID NO: 7344397 - DNA, 22 bp, Homo sapiens
gagggtggtggcttaaggtgct

SEQ ID NO: 7344398 - DNA, 22 bp, Homo sapiens
gagggtgggctcctatctgggt

SEQ ID NO: 7344399 - DNA, 22 bp, Homo sapiens
gagggtggggaatagactgcta

SEQ ID NO: 7344400 - DNA, 22 bp, Homo sapiens
gagggtgggctttgttcctcca

SEQ ID NO: 7344401 - DNA, 22 bp, Homo sapiens
gagggtgggccagatatgaggg

SEQ ID NO: 7344402 - DNA, 22 bp, Homo sapiens
gagggtgggccagatatgaggg

SEQ ID NO: 7344403 - DNA, 20 bp, Homo sapiens
gagggtgggacttcctaggc

SEQ ID NO: 7344404 - DNA, 22 bp, Homo sapiens
gagggtgggtacaccagccctc

SEQ ID NO: 7344405 - DNA, 22 bp, Homo sapiens
gagggtggggaatagactgcta

SEQ ID NO: 7344406 - DNA, 22 bp, Homo sapiens
gagggtgggtacaccagccctc

SEQ ID NO: 7344407 - DNA, 22 bp, Homo sapiens
gagggtgggtacaccagccctc

SEQ ID NO: 7344408 - DNA, 22 bp, Homo sapiens
gagggctgatgcttacttattt

SEQ ID NO: 7344409 - DNA, 22 bp, Homo sapiens
gagggctgataacaggaataca

SEQ ID NO: 7344410 - DNA, 22 bp, Homo sapiens
gagggtgcaggcaagagcaaaa

SEQ ID NO: 7344411 - DNA, 22 bp, Homo sapiens
gagggtgcaggcaagagcaaaa

SEQ ID NO: 7344412 - DNA, 22 bp, Homo sapiens
gagggtggaaagggtgtacctg

SEQ ID NO: 7344413 - DNA, 22 bp, Homo sapiens
gagggtggaaagggtgtacctg

SEQ ID NO: 7344414 - DNA, 22 bp, Homo sapiens
gagggtcttacctaagcagggt

SEQ ID NO: 7344415 - DNA, 22 bp, Homo sapiens
gagggtgcagctgggccccacg

SEQ ID NO: 7344416 - DNA, 22 bp, Homo sapiens
gagggtggctcctccctgggcc

SEQ ID NO: 7344417 - DNA, 22 bp, Homo sapiens
gagggtggctcctccctgggcc

SEQ ID NO: 7344418 - DNA, 22 bp, Homo sapiens
gagggtggctcctccctgggcc

SEQ ID NO: 7344419 - DNA, 22 bp, Homo sapiens
gagggtggctcctccctgggcc

SEQ ID NO: 7344420 - DNA, 22 bp, Homo sapiens
gagggtggcctttagagcccat

SEQ ID NO: 7344421 - DNA, 22 bp, Homo sapiens
gagggtggcctttagagcccat

SEQ ID NO: 7344422 - DNA, 22 bp, Homo sapiens
gagggtggcctttagagcccat

SEQ ID NO: 7344423 - DNA, 22 bp, Homo sapiens
gagggtggcctttagagcccat

SEQ ID NO: 7344424 - DNA, 22 bp, Homo sapiens
gagggtggaagagctgctgaga

SEQ ID NO: 7344425 - DNA, 22 bp, Homo sapiens
gagggtggaagagctgctgaga

SEQ ID NO: 7344426 - DNA, 22 bp, Homo sapiens
gagggtggagctccagaatctg

SEQ ID NO: 7344427 - DNA, 22 bp, Homo sapiens
gagggtggatcagcctgattgg

SEQ ID NO: 7344428 - DNA, 22 bp, Homo sapiens
gagggtggagctccagaatctg

SEQ ID NO: 7344429 - DNA, 22 bp, Homo sapiens
gaggtggctccttcagggaata

SEQ ID NO: 7344430 - DNA, 22 bp, Homo sapiens
gaggtggatgttgcagtgagct

SEQ ID NO: 7344431 - DNA, 22 bp, Homo sapiens
gaggtggctgcttgctgggaaa

SEQ ID NO: 7344432 - DNA, 22 bp, Homo sapiens
gaggtggctgggagtagggaat

SEQ ID NO: 7344433 - DNA, 22 bp, Homo sapiens
gaggtgagtggatcacgaggtc

SEQ ID NO: 7344434 - DNA, 22 bp, Homo sapiens
gaggtgagaagggggtcagatg

SEQ ID NO: 7344435 - DNA, 22 bp, Homo sapiens
gaggtgagaagggggtcagatg

SEQ ID NO: 7344436 - DNA, 22 bp, Homo sapiens
gaggtgagaagggggtcagatg

SEQ ID NO: 7344437 - DNA, 22 bp, Homo sapiens
gaggtcttagaagaaaaatcat

SEQ ID NO: 7344438 - DNA, 22 bp, Homo sapiens
gaggtgagtggatcacgaggtc

SEQ ID NO: 7344439 - DNA, 22 bp, Homo sapiens
gaggtgagtggatcacgaggtc

SEQ ID NO: 7344440 - DNA, 22 bp, Homo sapiens
gaggtgctgctgtacttcttgc

SEQ ID NO: 7344441 - DNA, 22 bp, Homo sapiens
gaggttttaggctgccattatt

SEQ ID NO: 7344442 - DNA, 22 bp, Homo sapiens
gaggttttaagttgaaggggga

SEQ ID NO: 7344443 - DNA, 22 bp, Homo sapiens
gagctgggattcatctatgtct

SEQ ID NO: 7344444 - DNA, 22 bp, Homo sapiens
gagctcctggattgctcctagg

SEQ ID NO: 7344445 - DNA, 22 bp, Homo sapiens
gaggacaggagactcactgttt

SEQ ID NO: 7344446 - DNA, 22 bp, Homo sapiens
gaggacaggagactcactgttt

SEQ ID NO: 7344447 - DNA, 20 bp, Homo sapiens
gagctgtgctctcaggagcc

SEQ ID NO: 7344448 - DNA, 22 bp, Homo sapiens
gagctgtggaaggcagggacca

SEQ ID NO: 7344449 - DNA, 20 bp, Homo sapiens
gagctgtgctctcaggagcc

SEQ ID NO: 7344450 - DNA, 22 bp, Homo sapiens
gagcaggacgtgggaatgggaa

SEQ ID NO: 7344451 - DNA, 22 bp, Homo sapiens
gagcaggcaactctgcagtgcc

SEQ ID NO: 7344452 - DNA, 22 bp, Homo sapiens
gagcaggcattctagtggctga

SEQ ID NO: 7344453 - DNA, 22 bp, Homo sapiens
gagcaggccagcaatggaaggg

SEQ ID NO: 7344454 - DNA, 22 bp, Homo sapiens
gagcaggcctggggtgaggcct

SEQ ID NO: 7344455 - DNA, 22 bp, Homo sapiens
gagcaggcctggggtgaggcct

SEQ ID NO: 7344456 - DNA, 22 bp, Homo sapiens
gagctcagaggattctggggag

SEQ ID NO: 7344457 - DNA, 22 bp, Homo sapiens
gagctcagcccaaagagcagtg

SEQ ID NO: 7344458 - DNA, 22 bp, Homo sapiens
gagctcagcaaaggtctgtgtg

SEQ ID NO: 7344459 - DNA, 22 bp, Homo sapiens
gagctccaccaccttcaggcag

SEQ ID NO: 7344460 - DNA, 22 bp, Homo sapiens
gagctccagggaacagcagcta

SEQ ID NO: 7344461 - DNA, 22 bp, Homo sapiens
gagctcagtgtagtcatggctt

SEQ ID NO: 7344462 - DNA, 23 bp, Homo sapiens
gagctcaggtagggctcgcccgc

SEQ ID NO: 7344463 - DNA, 22 bp, Homo sapiens
gagctcaggtggtcaaaacaat

SEQ ID NO: 7344464 - DNA, 22 bp, Homo sapiens
gaggcatgcagagctggagcag

SEQ ID NO: 7344465 - DNA, 22 bp, Homo sapiens
gaggcatggcctgaggctagga

SEQ ID NO: 7344466 - DNA, 22 bp, Homo sapiens
gaggcctgggttggaggtgcat

SEQ ID NO: 7344467 - DNA, 22 bp, Homo sapiens
gaggcctggaattccagcctgg

SEQ ID NO: 7344468 - DNA, 22 bp, Homo sapiens
gaggccagaatgagtctctggg

SEQ ID NO: 7344469 - DNA, 22 bp, Homo sapiens
gaggccagaagtgcctcgggct

SEQ ID NO: 7344470 - DNA, 22 bp, Homo sapiens
gaggccagaagtgcctcgggct

SEQ ID NO: 7344471 - DNA, 22 bp, Homo sapiens
gaggacgggcttcatggggcct

SEQ ID NO: 7344472 - DNA, 22 bp, Homo sapiens
gaggactctgggcgtgtatggg

SEQ ID NO: 7344473 - DNA, 22 bp, Homo sapiens
gaggacagtgtgatctgccagc

SEQ ID NO: 7344474 - DNA, 22 bp, Homo sapiens
gaggacagtgtgatctgccagc

SEQ ID NO: 7344475 - DNA, 17 bp, Homo sapiens
gaggacagggaagtagg

SEQ ID NO: 7344476 - DNA, 17 bp, Homo sapiens
gaggacagggaagtagg

SEQ ID NO: 7344477 - DNA, 17 bp, Homo sapiens
gaggacagggaagtagg

SEQ ID NO: 7344478 - DNA, 22 bp, Homo sapiens
gaggagagaacattcctccata

SEQ ID NO: 7344479 - DNA, 22 bp, Homo sapiens
gaggagactgacagcagattct

SEQ ID NO: 7344480 - DNA, 21 bp, Homo sapiens
gaggactgcacactctgattg

SEQ ID NO: 7344481 - DNA, 22 bp, Homo sapiens
gaggactctttgagtctgacat

SEQ ID NO: 7344482 - DNA, 18 bp, Homo sapiens
gaggatggaaggagatgc

SEQ ID NO: 7344483 - DNA, 22 bp, Homo sapiens
gaggatgctgcagtgcaggaca

SEQ ID NO: 7344484 - DNA, 22 bp, Homo sapiens
gaggatcatttgagcctaggag

SEQ ID NO: 7344485 - DNA, 20 bp, Homo sapiens
gaggatgcagacagagggca

SEQ ID NO: 7344486 - DNA, 22 bp, Homo sapiens
gaggatgcctgggtcggggaag

SEQ ID NO: 7344487 - DNA, 19 bp, Homo sapiens
gaggatgctcggtcccagg

SEQ ID NO: 7344488 - DNA, 22 bp, Homo sapiens
gaggagtggagttgctgggttg

SEQ ID NO: 7344489 - DNA, 22 bp, Homo sapiens
gaggagtgccagccgtggagtc

SEQ ID NO: 7344490 - DNA, 22 bp, Homo sapiens
gaggagtgccagccgtggagtc

SEQ ID NO: 7344491 - DNA, 22 bp, Homo sapiens
gaggagtctttttagggcctga

SEQ ID NO: 7344492 - DNA, 22 bp, Homo sapiens
gaggaggttccgggtggagaag

SEQ ID NO: 7344493 - DNA, 22 bp, Homo sapiens
gaggaggttccgggtggagaag

SEQ ID NO: 7344494 - DNA, 22 bp, Homo sapiens
gaggagagaagctaacggtgct

SEQ ID NO: 7344495 - DNA, 22 bp, Homo sapiens
gaggagagaagctaacggtgct

SEQ ID NO: 7344496 - DNA, 22 bp, Homo sapiens
ttataacatcaatcagagttaa

SEQ ID NO: 7344497 - DNA, 22 bp, Homo sapiens
ttatatttctggtagccttcag

SEQ ID NO: 7344498 - DNA, 22 bp, Homo sapiens
ttatatttctggtagccttcag

SEQ ID NO: 7344499 - DNA, 20 bp, Homo sapiens
ccttgccagtagggctggga

SEQ ID NO: 7344500 - DNA, 22 bp, Homo sapiens
ccttgcaggggaacaggcagtg

SEQ ID NO: 7344501 - DNA, 22 bp, Homo sapiens
ttataaaggtttgtgcatattt

SEQ ID NO: 7344502 - DNA, 21 bp, Homo sapiens
ttagcaaagcaaacacatgct

SEQ ID NO: 7344503 - DNA, 22 bp, Homo sapiens
ttacataacggtatgaaaaatg

SEQ ID NO: 7344504 - DNA, 20 bp, Homo sapiens
ccttcagaacttacatagta

SEQ ID NO: 7344505 - DNA, 22 bp, Homo sapiens
ccttcagaggtgtagattgcgt

SEQ ID NO: 7344506 - DNA, 23 bp, Homo sapiens
ccttcagaagaagtaacaggggc

SEQ ID NO: 7344507 - DNA, 22 bp, Homo sapiens
ccttcagacctagacaggaatc

SEQ ID NO: 7344508 - DNA, 23 bp, Homo sapiens
ccttaaatatctaccctgtggca

SEQ ID NO: 7344509 - DNA, 22 bp, Homo sapiens
ccttaaattctccatttgaaag

SEQ ID NO: 7344510 - DNA, 22 bp, Homo sapiens
ttaagcatggaagtgaaataat

SEQ ID NO: 7344511 - DNA, 22 bp, Homo sapiens
ttaagcaacacacattaattat

SEQ ID NO: 7344512 - DNA, 22 bp, Homo sapiens
cctgtttgttacctcgtttgag

SEQ ID NO: 7344513 - DNA, 22 bp, Homo sapiens
ttacagttggtattagaccaaa

SEQ ID NO: 7344514 - DNA, 22 bp, Homo sapiens
ttacagttgcccccagcctcgc

SEQ ID NO: 7344515 - DNA, 22 bp, Homo sapiens
ttacagttgcccccagcctcgc

SEQ ID NO: 7344516 - DNA, 21 bp, Homo sapiens
ttacagaatccatgggaagtc

SEQ ID NO: 7344517 - DNA, 22 bp, Homo sapiens
ttacagttgttctatcagcatg

SEQ ID NO: 7344518 - DNA, 22 bp, Homo sapiens
ttacagttgttctatcagcatg

SEQ ID NO: 7344519 - DNA, 22 bp, Homo sapiens
ttacagtttaccaagaatattg

SEQ ID NO: 7344520 - DNA, 22 bp, Homo sapiens
ttacagtttagtccaagccaga

SEQ ID NO: 7344521 - DNA, 22 bp, Homo sapiens
ttacagtttagtccaagccaga

SEQ ID NO: 7344522 - DNA, 22 bp, Homo sapiens
ttaaattccagcctcataatag

SEQ ID NO: 7344523 - DNA, 22 bp, Homo sapiens
ttaaatttctacgtgatccagg

SEQ ID NO: 7344524 - DNA, 22 bp, Homo sapiens
ttaaattgtcatttgagcaatg

SEQ ID NO: 7344525 - DNA, 22 bp, Homo sapiens
ttaagatgatgtttcttgttgt

SEQ ID NO: 7344526 - DNA, 22 bp, Homo sapiens
ttaagatgttcagataatttgg

SEQ ID NO: 7344527 - DNA, 22 bp, Homo sapiens
ttaagcaaatgtcagttgttag

SEQ ID NO: 7344528 - DNA, 22 bp, Homo sapiens
ttaagaggagatcatactggag

SEQ ID NO: 7344529 - DNA, 22 bp, Homo sapiens
ttaagagggtgatgctagcatt

SEQ ID NO: 7344530 - DNA, 22 bp, Homo sapiens
ttaaattattgagggattgtca

SEQ ID NO: 7344531 - DNA, 22 bp, Homo sapiens
ttaaatagtaggtctattttgg

SEQ ID NO: 7344532 - DNA, 22 bp, Homo sapiens
tgtcaatatgtaataactgaat

SEQ ID NO: 7344533 - DNA, 22 bp, Homo sapiens
tgtcaataactggagtcattat

SEQ ID NO: 7344534 - DNA, 21 bp, Homo sapiens
tgtcagagcttgtaggacatt

SEQ ID NO: 7344535 - DNA, 20 bp, Homo sapiens
tgtcagcaattaggagaaaa

SEQ ID NO: 7344536 - DNA, 22 bp, Homo sapiens
cggggaggcttcggattaaagc

SEQ ID NO: 7344537 - DNA, 22 bp, Homo sapiens
cggggaggcttcggattaaagc

SEQ ID NO: 7344538 - DNA, 22 bp, Homo sapiens
cggggacacactggcagctcct

SEQ ID NO: 7344539 - DNA, 22 bp, Homo sapiens
cggggaaaatgaagcaggtgga

SEQ ID NO: 7344540 - DNA, 22 bp, Homo sapiens
cgggctggctgcagctgctgga

SEQ ID NO: 7344541 - DNA, 22 bp, Homo sapiens
cgggctggctgcagctgctgga

SEQ ID NO: 7344542 - DNA, 22 bp, Homo sapiens
cgggaggaaaggcgaggctctg

SEQ ID NO: 7344543 - DNA, 23 bp, Homo sapiens
cggggccagggtcaggaccggtc

SEQ ID NO: 7344544 - DNA, 22 bp, Homo sapiens
cggggcaggagtccctgtagag

SEQ ID NO: 7344545 - DNA, 22 bp, Homo sapiens
cggggcaggagtccctgtagag

SEQ ID NO: 7344546 - DNA, 22 bp, Homo sapiens
cggggagggcagaggctccctc

SEQ ID NO: 7344547 - DNA, 22 bp, Homo sapiens
cggggagggcagaggctccctc

SEQ ID NO: 7344548 - DNA, 22 bp, Homo sapiens
cggggagggcagaggctccctc

SEQ ID NO: 7344549 - DNA, 22 bp, Homo sapiens
cggggcagagggtcttctccag

SEQ ID NO: 7344550 - DNA, 22 bp, Homo sapiens
cggggcaggagtccctgtagag

SEQ ID NO: 7344551 - DNA, 22 bp, Homo sapiens
cggggcagagggtcttctccag

SEQ ID NO: 7344552 - DNA, 22 bp, Homo sapiens
cggggcagaaagttgtcttttg

SEQ ID NO: 7344553 - DNA, 22 bp, Homo sapiens
cggggctgctcgtcctcctgtg

SEQ ID NO: 7344554 - DNA, 22 bp, Homo sapiens
cggggctgctcgtcctcctgtg

SEQ ID NO: 7344555 - DNA, 21 bp, Homo sapiens
cgtgactgggtccgtctggct

SEQ ID NO: 7344556 - DNA, 22 bp, Homo sapiens
cggggctggcacaggtgaccac

SEQ ID NO: 7344557 - DNA, 22 bp, Homo sapiens
cgtgggagtggtgggtgctcag

SEQ ID NO: 7344558 - DNA, 22 bp, Homo sapiens
cgtgggaggaaaaatgggcttc

SEQ ID NO: 7344559 - DNA, 22 bp, Homo sapiens
cgtggggacccacgtgcagcac

SEQ ID NO: 7344560 - DNA, 22 bp, Homo sapiens
cggggccctggggctgaaggtc

SEQ ID NO: 7344561 - DNA, 22 bp, Homo sapiens
cggggccctggggctgaaggtc

SEQ ID NO: 7344562 - DNA, 22 bp, Homo sapiens
cggggcctaccgctgcgtggcc

SEQ ID NO: 7344563 - DNA, 22 bp, Homo sapiens
cggggcctagtctacctcggca

SEQ ID NO: 7344564 - DNA, 22 bp, Homo sapiens
cggggcctcagtttccccacct

SEQ ID NO: 7344565 - DNA, 22 bp, Homo sapiens
cggggcctaccgctgcgtggcc

SEQ ID NO: 7344566 - DNA, 22 bp, Homo sapiens
cggggcgagcagacggcggcaa

SEQ ID NO: 7344567 - DNA, 22 bp, Homo sapiens
cggggcctgtgccagcctgtgg

SEQ ID NO: 7344568 - DNA, 22 bp, Homo sapiens
cggggcctcgtcactctttgcg

SEQ ID NO: 7344569 - DNA, 22 bp, Homo sapiens
cggggctgaggcaacgcggaga

SEQ ID NO: 7344570 - DNA, 22 bp, Homo sapiens
cggggctgacagcaggtgtgct

SEQ ID NO: 7344571 - DNA, 22 bp, Homo sapiens
cggcagagccctgagtcagcct

SEQ ID NO: 7344572 - DNA, 22 bp, Homo sapiens
cggcagagtgtgtgcgtgcatg

SEQ ID NO: 7344573 - DNA, 22 bp, Homo sapiens
cggcagagtgtgtgcgtgcatg

SEQ ID NO: 7344574 - DNA, 22 bp, Homo sapiens
cggcagagcttcctgctcagcg

SEQ ID NO: 7344575 - DNA, 22 bp, Homo sapiens
cggcagagcttcctgctcagcg

SEQ ID NO: 7344576 - DNA, 22 bp, Homo sapiens
cggagaggacctgcaactcgct

SEQ ID NO: 7344577 - DNA, 22 bp, Homo sapiens
cggagaggtgggggcagcatct

SEQ ID NO: 7344578 - DNA, 22 bp, Homo sapiens
ttcaaattaccacatttgctta

SEQ ID NO: 7344579 - DNA, 22 bp, Homo sapiens
ccttttctggccaccaagcgct

SEQ ID NO: 7344580 - DNA, 22 bp, Homo sapiens
ccttttcttgccactgactcgg

SEQ ID NO: 7344581 - DNA, 22 bp, Homo sapiens
cctttttcagcttctagaggct

SEQ ID NO: 7344582 - DNA, 22 bp, Homo sapiens
ttatccactttagtttcagtat

SEQ ID NO: 7344583 - DNA, 22 bp, Homo sapiens
ttatccaagcagaagctgcaca

SEQ ID NO: 7344584 - DNA, 22 bp, Homo sapiens
cgaaacatctatgatcattaat

SEQ ID NO: 7344585 - DNA, 21 bp, Homo sapiens
cgacaggagaggcagccagcc

SEQ ID NO: 7344586 - DNA, 22 bp, Homo sapiens
cgagaggctggacagggctggg

SEQ ID NO: 7344587 - DNA, 22 bp, Homo sapiens
cgagagtggacagggcgcagct

SEQ ID NO: 7344588 - DNA, 22 bp, Homo sapiens
ttatttcatgtaaaatttatgt

SEQ ID NO: 7344589 - DNA, 22 bp, Homo sapiens
ttatttcatgtaaaatttatgt

SEQ ID NO: 7344590 - DNA, 22 bp, Homo sapiens
ttatttcatataatgttatcaa

SEQ ID NO: 7344591 - DNA, 22 bp, Homo sapiens
cgctcctgaccagctgtgtccc

SEQ ID NO: 7344592 - DNA, 20 bp, Homo sapiens
cgctcctgttcccggtccca

SEQ ID NO: 7344593 - DNA, 20 bp, Homo sapiens
cgctcctgttcccggtccca

SEQ ID NO: 7344594 - DNA, 22 bp, Homo sapiens
cgctccttgagcgtgtcggcct

SEQ ID NO: 7344595 - DNA, 22 bp, Homo sapiens
cgctgataaacgtcacgttccc

SEQ ID NO: 7344596 - DNA, 20 bp, Homo sapiens
ttatttcagttgctagattg

SEQ ID NO: 7344597 - DNA, 22 bp, Homo sapiens
ttatttatgttaacagtcgaga

SEQ ID NO: 7344598 - DNA, 22 bp, Homo sapiens
ttatttattgtgtacctactgt

SEQ ID NO: 7344599 - DNA, 22 bp, Homo sapiens
ttattgcaactttagggataga

SEQ ID NO: 7344600 - DNA, 17 bp, Homo sapiens
ttattgcagtgctgaag

SEQ ID NO: 7344601 - DNA, 22 bp, Homo sapiens
ttattgcagatggtgtgagaga

SEQ ID NO: 7344602 - DNA, 22 bp, Homo sapiens
ttctggaagctgcaggtggccg

SEQ ID NO: 7344603 - DNA, 22 bp, Homo sapiens
ttctggaagccctaagggagaa

SEQ ID NO: 7344604 - DNA, 22 bp, Homo sapiens
ttctggaagccccagagtcaga

SEQ ID NO: 7344605 - DNA, 22 bp, Homo sapiens
ttctggaagccccagagtcaga

SEQ ID NO: 7344606 - DNA, 22 bp, Homo sapiens
ttctggaagccatgggaacagg

SEQ ID NO: 7344607 - DNA, 22 bp, Homo sapiens
ttctggaagcagtggggagtga

SEQ ID NO: 7344608 - DNA, 23 bp, Homo sapiens
ttctggaagatttacttgagaca

SEQ ID NO: 7344609 - DNA, 22 bp, Homo sapiens
ttctggaaggcagggagaaccc

SEQ ID NO: 7344610 - DNA, 22 bp, Homo sapiens
ttctggaagctgggcagcaccc

SEQ ID NO: 7344611 - DNA, 22 bp, Homo sapiens
ttctggaagctggaaaaggcaa

SEQ ID NO: 7344612 - DNA, 22 bp, Homo sapiens
ttctggaagctgggcagcaccc

SEQ ID NO: 7344613 - DNA, 22 bp, Homo sapiens
ttctggaagcttttggagagaa

SEQ ID NO: 7344614 - DNA, 22 bp, Homo sapiens
ttctggaaggatgtttctatct

SEQ ID NO: 7344615 - DNA, 22 bp, Homo sapiens
ttctggaactatactgttggtg

SEQ ID NO: 7344616 - DNA, 22 bp, Homo sapiens
ttctggaagaataatgggcaaa

SEQ ID NO: 7344617 - DNA, 22 bp, Homo sapiens
ttctggaagaggtgtaagtata

SEQ ID NO: 7344618 - DNA, 22 bp, Homo sapiens
ttctggaagagtaaaataagcc

SEQ ID NO: 7344619 - DNA, 22 bp, Homo sapiens
ttctggaagatacctctcctaa

SEQ ID NO: 7344620 - DNA, 22 bp, Homo sapiens
ttctggaacatagcaagaagtt

SEQ ID NO: 7344621 - DNA, 22 bp, Homo sapiens
ttctggaaccagcctgcctggg

SEQ ID NO: 7344622 - DNA, 22 bp, Homo sapiens
ttctggaaccaacatgccagtt

SEQ ID NO: 7344623 - DNA, 22 bp, Homo sapiens
ttctatgctcaatggagccttt

SEQ ID NO: 7344624 - DNA, 22 bp, Homo sapiens
cgttggtctgtcccctggcacc

SEQ ID NO: 7344625 - DNA, 22 bp, Homo sapiens
cgttggtctgtcccctggcacc

SEQ ID NO: 7344626 - DNA, 22 bp, Homo sapiens
cgtgtgttgaaagatgtacatc

SEQ ID NO: 7344627 - DNA, 22 bp, Homo sapiens
cgtgtgttgaaagatgtacatc

SEQ ID NO: 7344628 - DNA, 22 bp, Homo sapiens
cgtgtgttgaaagatgtacatc

SEQ ID NO: 7344629 - DNA, 22 bp, Homo sapiens
ctaaaaatccacactaggtgaa

SEQ ID NO: 7344630 - DNA, 23 bp, Homo sapiens
cgttttttcctcagatgttctgg

SEQ ID NO: 7344631 - DNA, 18 bp, Homo sapiens
cgtttttccgggattgca

SEQ ID NO: 7344632 - DNA, 22 bp, Homo sapiens
cgttttcatgggtagaggttct

SEQ ID NO: 7344633 - DNA, 22 bp, Homo sapiens
cgtgtcatctgagccttgggcg

SEQ ID NO: 7344634 - DNA, 22 bp, Homo sapiens
cgtgtctgggatagcagaagta

SEQ ID NO: 7344635 - DNA, 17 bp, Homo sapiens
cgtgtgcttgtgtgcac

SEQ ID NO: 7344636 - DNA, 22 bp, Homo sapiens
cgtgtgtgtacctgcgcattta

SEQ ID NO: 7344637 - DNA, 22 bp, Homo sapiens
ctagagaaaccccatgagcttt

SEQ ID NO: 7344638 - DNA, 22 bp, Homo sapiens
ctagaaatattttacagtcaag

SEQ ID NO: 7344639 - DNA, 22 bp, Homo sapiens
ctagagaacaacattcatatgg

SEQ ID NO: 7344640 - DNA, 22 bp, Homo sapiens
ctagagggatgttaggatagca

SEQ ID NO: 7344641 - DNA, 22 bp, Homo sapiens
ttctatgctagtggaaagcttc

SEQ ID NO: 7344642 - DNA, 22 bp, Homo sapiens
ttctatgcctgagaagaagccg

SEQ ID NO: 7344643 - DNA, 22 bp, Homo sapiens
ctagatccattttctgtctctg

SEQ ID NO: 7344644 - DNA, 17 bp, Homo sapiens
ctagagagaaagagcta

SEQ ID NO: 7344645 - DNA, 22 bp, Homo sapiens
ctcacaggttctgcagctcaca

SEQ ID NO: 7344646 - DNA, 22 bp, Homo sapiens
ctatagaaacaacctctctttc

SEQ ID NO: 7344647 - DNA, 22 bp, Homo sapiens
ctcacaggttctgcagctcaca

SEQ ID NO: 7344648 - DNA, 22 bp, Homo sapiens
ctatacatcccaatttcagaga

SEQ ID NO: 7344649 - DNA, 22 bp, Homo sapiens
ctatagaaaattgtatcacacg

SEQ ID NO: 7344650 - DNA, 22 bp, Homo sapiens
ctatacagcagcttactagtta

SEQ ID NO: 7344651 - DNA, 22 bp, Homo sapiens
ctatacagcagcttactagtta

SEQ ID NO: 7344652 - DNA, 22 bp, Homo sapiens
ctatacagtaaccacagtgatt

SEQ ID NO: 7344653 - DNA, 22 bp, Homo sapiens
ctcacccctgtaattccagcac

SEQ ID NO: 7344654 - DNA, 22 bp, Homo sapiens
ctcacccatatctccatgactc

SEQ ID NO: 7344655 - DNA, 22 bp, Homo sapiens
ctcactgaggcatcccattact

SEQ ID NO: 7344656 - DNA, 22 bp, Homo sapiens
ctcactgacagagattgaaaat

SEQ ID NO: 7344657 - DNA, 22 bp, Homo sapiens
ctcactgacgaggaagctgaga

SEQ ID NO: 7344658 - DNA, 22 bp, Homo sapiens
ctcactgactgcaagtcaagtt

SEQ ID NO: 7344659 - DNA, 22 bp, Homo sapiens
ctcactgaaacctccgcctccc

SEQ ID NO: 7344660 - DNA, 22 bp, Homo sapiens
ctcactgaaccttggcacctca

SEQ ID NO: 7344661 - DNA, 22 bp, Homo sapiens
ctataattatgctcaaaatgta

SEQ ID NO: 7344662 - DNA, 22 bp, Homo sapiens
ctcagagaagtctttgctaaac

SEQ ID NO: 7344663 - DNA, 22 bp, Homo sapiens
ttctttctgtccataatgagac

SEQ ID NO: 7344664 - DNA, 22 bp, Homo sapiens
ctcagagagggcaccagggcca

SEQ ID NO: 7344665 - DNA, 22 bp, Homo sapiens
ctcagagatatagtccctgctt

SEQ ID NO: 7344666 - DNA, 22 bp, Homo sapiens
ctcagagcccagggtacacccg

SEQ ID NO: 7344667 - DNA, 22 bp, Homo sapiens
ctcagagccccaggagggtgtg

SEQ ID NO: 7344668 - DNA, 22 bp, Homo sapiens
ctcagagccagttagcaggtgc

SEQ ID NO: 7344669 - DNA, 22 bp, Homo sapiens
ctccactcaacaagcccagtgt

SEQ ID NO: 7344670 - DNA, 22 bp, Homo sapiens
ttggatccatctcaggcatagg

SEQ ID NO: 7344671 - DNA, 22 bp, Homo sapiens
ttggagggtcttccacagccat

SEQ ID NO: 7344672 - DNA, 22 bp, Homo sapiens
ttggaggggccactgcagagct

SEQ ID NO: 7344673 - DNA, 22 bp, Homo sapiens
ttggagggactgagcttcagtc

SEQ ID NO: 7344674 - DNA, 22 bp, Homo sapiens
ttggagggacagatggctaggc

SEQ ID NO: 7344675 - DNA, 22 bp, Homo sapiens
ctcagtgctgaggaaagttgaa

SEQ ID NO: 7344676 - DNA, 22 bp, Homo sapiens
ttggctgaaggttaagtgctgg

SEQ ID NO: 7344677 - DNA, 22 bp, Homo sapiens
ctccaggacagattcagggcca

SEQ ID NO: 7344678 - DNA, 22 bp, Homo sapiens
ctccagaggatgcaggtgaggg

SEQ ID NO: 7344679 - DNA, 22 bp, Homo sapiens
ctccagagggtcagactctgag

SEQ ID NO: 7344680 - DNA, 22 bp, Homo sapiens
ctccagagggtcagactctgag

SEQ ID NO: 7344681 - DNA, 22 bp, Homo sapiens
ctccagagtcacactgcctggg

SEQ ID NO: 7344682 - DNA, 22 bp, Homo sapiens
ctccagagtcacactgcctggg

SEQ ID NO: 7344683 - DNA, 22 bp, Homo sapiens
ctcagggtaatgaaagacgaat

SEQ ID NO: 7344684 - DNA, 22 bp, Homo sapiens
ctcagggtaatgaaagacgaat

SEQ ID NO: 7344685 - DNA, 22 bp, Homo sapiens
ctcagggtctggtccttagatt

SEQ ID NO: 7344686 - DNA, 22 bp, Homo sapiens
ctcagggtgagaaattgatcca

SEQ ID NO: 7344687 - DNA, 21 bp, Homo sapiens
ctcaggggattttgagattag

SEQ ID NO: 7344688 - DNA, 22 bp, Homo sapiens
ctcagggctggaaagccaggaa

SEQ ID NO: 7344689 - DNA, 22 bp, Homo sapiens
ctcagggctggaaagccaggaa

SEQ ID NO: 7344690 - DNA, 22 bp, Homo sapiens
ctcaggggacctggctccgagt

SEQ ID NO: 7344691 - DNA, 22 bp, Homo sapiens
ctcagggcagtatggctgagag

SEQ ID NO: 7344692 - DNA, 22 bp, Homo sapiens
ctcagggcagtatggctgagag

SEQ ID NO: 7344693 - DNA, 22 bp, Homo sapiens
ctcagggcagtatggctgagag

SEQ ID NO: 7344694 - DNA, 18 bp, Homo sapiens
ctcagggcatcagtctgg

SEQ ID NO: 7344695 - DNA, 22 bp, Homo sapiens
ttgcatcaggtagacaactata

SEQ ID NO: 7344696 - DNA, 22 bp, Homo sapiens
ttgcatgcaaggcctccgtggc

SEQ ID NO: 7344697 - DNA, 22 bp, Homo sapiens
ttgcatcagaattacttggagg

SEQ ID NO: 7344698 - DNA, 22 bp, Homo sapiens
ttgcagaaaacagttttcttgt

SEQ ID NO: 7344699 - DNA, 22 bp, Homo sapiens
ttgcagaacttaaagacagagt

SEQ ID NO: 7344700 - DNA, 22 bp, Homo sapiens
ctcaggaggatgactgccttgg

SEQ ID NO: 7344701 - DNA, 22 bp, Homo sapiens
ctcaggaggtggtagaggccct

SEQ ID NO: 7344702 - DNA, 22 bp, Homo sapiens
ctcaggagacagtgtccacatg

SEQ ID NO: 7344703 - DNA, 22 bp, Homo sapiens
ctcaggaaggaagcagggagcc

SEQ ID NO: 7344704 - DNA, 22 bp, Homo sapiens
ctcaggaagcacaggccctaca

SEQ ID NO: 7344705 - DNA, 22 bp, Homo sapiens
ctcaggaaccgcggcagcagcc

SEQ ID NO: 7344706 - DNA, 22 bp, Homo sapiens
ctcaggacttggttagtgtttt

SEQ ID NO: 7344707 - DNA, 22 bp, Homo sapiens
tttcacatagaaagtgatttac

SEQ ID NO: 7344708 - DNA, 22 bp, Homo sapiens
tttcagaaattatattagatgc

SEQ ID NO: 7344709 - DNA, 22 bp, Homo sapiens
tttcagaaattgttattattct

SEQ ID NO: 7344710 - DNA, 22 bp, Homo sapiens
tttcagtttatgtcttgaatta

SEQ ID NO: 7344711 - DNA, 22 bp, Homo sapiens
ctccttcctggttagcacctta

SEQ ID NO: 7344712 - DNA, 22 bp, Homo sapiens
ctccttcccctactcagcatcc

SEQ ID NO: 7344713 - DNA, 22 bp, Homo sapiens
tttcagaatatcgattcagtga

SEQ ID NO: 7344714 - DNA, 22 bp, Homo sapiens
ctccttagtgcctctgcacgag

SEQ ID NO: 7344715 - DNA, 22 bp, Homo sapiens
tttattcacttcagtgccaaag

SEQ ID NO: 7344716 - DNA, 22 bp, Homo sapiens
tttatgcagcgtttcaccaccc

SEQ ID NO: 7344717 - DNA, 22 bp, Homo sapiens
tttatgattattttaaagcagc

SEQ ID NO: 7344718 - DNA, 22 bp, Homo sapiens
ctccaggagggggatggctgta

SEQ ID NO: 7344719 - DNA, 18 bp, Homo sapiens
tttatgagctgtgggacc

SEQ ID NO: 7344720 - DNA, 22 bp, Homo sapiens
ctccaggcccacggccgcggcc

SEQ ID NO: 7344721 - DNA, 22 bp, Homo sapiens
ctccaggcccacgtcgaggagg

SEQ ID NO: 7344722 - DNA, 22 bp, Homo sapiens
ctccaggccatggctgcggagg

SEQ ID NO: 7344723 - DNA, 22 bp, Homo sapiens
tttctcaaggtgtcatgtattt

SEQ ID NO: 7344724 - DNA, 22 bp, Homo sapiens
tttctcaaggtgtcatgtattt

SEQ ID NO: 7344725 - DNA, 22 bp, Homo sapiens
tttctcaagttcagatatttga

SEQ ID NO: 7344726 - DNA, 18 bp, Homo sapiens
ctctctggtctggatccc

SEQ ID NO: 7344727 - DNA, 22 bp, Homo sapiens
tttcatgttacatttaaaatgt

SEQ ID NO: 7344728 - DNA, 22 bp, Homo sapiens
tttcatgttacatttaaaatgt

SEQ ID NO: 7344729 - DNA, 22 bp, Homo sapiens
tttcattatacagcttcataaa

SEQ ID NO: 7344730 - DNA, 22 bp, Homo sapiens
tttccaataaagtgtcattgtt

SEQ ID NO: 7344731 - DNA, 22 bp, Homo sapiens
tttccacatcaccatgaggtga

SEQ ID NO: 7344732 - DNA, 22 bp, Homo sapiens
tttctacaacacttctgaatct

SEQ ID NO: 7344733 - DNA, 22 bp, Homo sapiens
tttctacagctggtgcaacttt

SEQ ID NO: 7344734 - DNA, 22 bp, Homo sapiens
tttgttcatgcctatattctca

SEQ ID NO: 7344735 - DNA, 22 bp, Homo sapiens
tttggaatgtagtttaatcatc

SEQ ID NO: 7344736 - DNA, 22 bp, Homo sapiens
ctctgtgcttatgctccatggg

SEQ ID NO: 7344737 - DNA, 22 bp, Homo sapiens
ctctggtttatttcttggaaag

SEQ ID NO: 7344738 - DNA, 22 bp, Homo sapiens
ctctgtgggccagagaggcccc

SEQ ID NO: 7344739 - DNA, 22 bp, Homo sapiens
ctctgtggtaaaatagcagtat

SEQ ID NO: 7344740 - DNA, 22 bp, Homo sapiens
ctctgtgggggagaggcagctg

SEQ ID NO: 7344741 - DNA, 22 bp, Homo sapiens
ctctgtgtatccaagttcaggt

SEQ ID NO: 7344742 - DNA, 22 bp, Homo sapiens
ctctgtgtgctggtggggtcct

SEQ ID NO: 7344743 - DNA, 22 bp, Homo sapiens
ctctgtgtggtatgattgtcat

SEQ ID NO: 7344744 - DNA, 22 bp, Homo sapiens
ctctgtgtggtcctctgtattg

SEQ ID NO: 7344745 - DNA, 22 bp, Homo sapiens
ctctgtgttcagcctagcagaa

SEQ ID NO: 7344746 - DNA, 22 bp, Homo sapiens
ttttgctgttatatgctattat

SEQ ID NO: 7344747 - DNA, 21 bp, Homo sapiens
ttttgctgttttagaatgaga

SEQ ID NO: 7344748 - DNA, 22 bp, Homo sapiens
ttttgcttaatctagattttgc

SEQ ID NO: 7344749 - DNA, 22 bp, Homo sapiens
ttttgctggtttatctctatta

SEQ ID NO: 7344750 - DNA, 22 bp, Homo sapiens
tttgaaagacagaatatttttg

SEQ ID NO: 7344751 - DNA, 22 bp, Homo sapiens
tttgaaacctagttatatgact

SEQ ID NO: 7344752 - DNA, 22 bp, Homo sapiens
tttgaaacccgtcactttgagt

SEQ ID NO: 7344753 - DNA, 22 bp, Homo sapiens
tttcttgtaagatgtttattaa

SEQ ID NO: 7344754 - DNA, 22 bp, Homo sapiens
ctctgacaccatctcatgacag

SEQ ID NO: 7344755 - DNA, 22 bp, Homo sapiens
ctctgacaagacagaccataac

SEQ ID NO: 7344756 - DNA, 19 bp, Homo sapiens
tttgaaagagttttattgg

SEQ ID NO: 7344757 - DNA, 21 bp, Homo sapiens
tttgaatagaaatagtgctta

SEQ ID NO: 7344758 - DNA, 22 bp, Homo sapiens
ctctgcagagcctccagcccag

SEQ ID NO: 7344759 - DNA, 22 bp, Homo sapiens
ctctgcaccttgtaggaggcaa

SEQ ID NO: 7344760 - DNA, 22 bp, Homo sapiens
ctctggagtgcagcctggtggc

SEQ ID NO: 7344761 - DNA, 22 bp, Homo sapiens
ctctggccccagtggccccttg

SEQ ID NO: 7344762 - DNA, 22 bp, Homo sapiens
ctctggccagagcctgcgggaa

SEQ ID NO: 7344763 - DNA, 19 bp, Homo sapiens
ctctggcctctggatgctg

SEQ ID NO: 7344764 - DNA, 22 bp, Homo sapiens
ctctggcctgcttcctcaggta

SEQ ID NO: 7344765 - DNA, 22 bp, Homo sapiens
ctctggcctggggcctgctccc

SEQ ID NO: 7344766 - DNA, 22 bp, Homo sapiens
tttgagaaaggggatttaattc

SEQ ID NO: 7344767 - DNA, 22 bp, Homo sapiens
tttgagaaaaccagaaagatct

SEQ ID NO: 7344768 - DNA, 22 bp, Homo sapiens
ctgcccaggctgaaggaacatc

SEQ ID NO: 7344769 - DNA, 22 bp, Homo sapiens
ctgccccacaggcttggtaggg

SEQ ID NO: 7344770 - DNA, 22 bp, Homo sapiens
ctgcccagtttgggagcctttc

SEQ ID NO: 7344771 - DNA, 22 bp, Homo sapiens
ctgccccctgctttgtccttga

SEQ ID NO: 7344772 - DNA, 22 bp, Homo sapiens
ctgcccacacctgagctgggcc

SEQ ID NO: 7344773 - DNA, 22 bp, Homo sapiens
ctgccattggattttcacattt

SEQ ID NO: 7344774 - DNA, 22 bp, Homo sapiens
ctgcccagattttaccacctgc

SEQ ID NO: 7344775 - DNA, 20 bp, Homo sapiens
ctgcccagccactgagggat

SEQ ID NO: 7344776 - DNA, 22 bp, Homo sapiens
ctgcaggagtgaaagcaggcct

SEQ ID NO: 7344777 - DNA, 22 bp, Homo sapiens
ctgcaggagtgaaagcaggcct

SEQ ID NO: 7344778 - DNA, 22 bp, Homo sapiens
ctgcaggattctcccagttgga

SEQ ID NO: 7344779 - DNA, 21 bp, Homo sapiens
ctgcaggatgctgaagccagg

SEQ ID NO: 7344780 - DNA, 22 bp, Homo sapiens
ctgcaggaggatcctgagagtg

SEQ ID NO: 7344781 - DNA, 22 bp, Homo sapiens
ctgcaggaggatcctgagagtg

SEQ ID NO: 7344782 - DNA, 22 bp, Homo sapiens
ctgcaggagggctggggaagcc

SEQ ID NO: 7344783 - DNA, 22 bp, Homo sapiens
ctgcaggactgaaagatgaggt

SEQ ID NO: 7344784 - DNA, 22 bp, Homo sapiens
ctgcaggaaggggacggagtgg

SEQ ID NO: 7344785 - DNA, 22 bp, Homo sapiens
ctgcaggaattcaaagtgagct

SEQ ID NO: 7344786 - DNA, 22 bp, Homo sapiens
ctgcaggacagggccggaggcc

SEQ ID NO: 7344787 - DNA, 22 bp, Homo sapiens
ctgcaggacagggccggaggcc

SEQ ID NO: 7344788 - DNA, 22 bp, Homo sapiens
ctgcagcctcaacctcctgagc

SEQ ID NO: 7344789 - DNA, 22 bp, Homo sapiens
ctgcagcctaggtgcagctggg

SEQ ID NO: 7344790 - DNA, 22 bp, Homo sapiens
ctgaggtttacaagctattgct

SEQ ID NO: 7344791 - DNA, 16 bp, Homo sapiens
ctgaggtttggccaca

SEQ ID NO: 7344792 - DNA, 22 bp, Homo sapiens
ctgaggttggagatattgcaga

SEQ ID NO: 7344793 - DNA, 22 bp, Homo sapiens
ctgaggcctggccccaccacag

SEQ ID NO: 7344794 - DNA, 22 bp, Homo sapiens
ctgaggcctgtgttggggcagt

SEQ ID NO: 7344795 - DNA, 22 bp, Homo sapiens
ctgagcatgctacatgcagcac

SEQ ID NO: 7344796 - DNA, 22 bp, Homo sapiens
ctgagcatgctcctcttttcca

SEQ ID NO: 7344797 - DNA, 22 bp, Homo sapiens
ctgagcatggccggtccatggt

SEQ ID NO: 7344798 - DNA, 22 bp, Homo sapiens
ctgagcattatcttggattttg

SEQ ID NO: 7344799 - DNA, 22 bp, Homo sapiens
ctgagcatcatggcagaatctt

SEQ ID NO: 7344800 - DNA, 17 bp, Homo sapiens
ctgagcatccgtgctct

SEQ ID NO: 7344801 - DNA, 22 bp, Homo sapiens
ctgagcatccagcaggtactgc

SEQ ID NO: 7344802 - DNA, 22 bp, Homo sapiens
ctgagcatttgccggagcgtca

SEQ ID NO: 7344803 - DNA, 22 bp, Homo sapiens
ctgagcatttgcctttttaaca

SEQ ID NO: 7344804 - DNA, 22 bp, Homo sapiens
ctgagcatttgtgcagcttctc

SEQ ID NO: 7344805 - DNA, 22 bp, Homo sapiens
ctgaggggaaaagtcaggatga

SEQ ID NO: 7344806 - DNA, 23 bp, Homo sapiens
ctgaggggaaaagggcttcaggc

SEQ ID NO: 7344807 - DNA, 22 bp, Homo sapiens
ctcttcctagtgtgcagcgtgg

SEQ ID NO: 7344808 - DNA, 22 bp, Homo sapiens
ctcttctgtacctcggcctcca

SEQ ID NO: 7344809 - DNA, 22 bp, Homo sapiens
ctcttcctacagtctgctatgc

SEQ ID NO: 7344810 - DNA, 22 bp, Homo sapiens
ctgagcagtctagccaggtgtt

SEQ ID NO: 7344811 - DNA, 22 bp, Homo sapiens
ctgagcagtctagccaggtgtt

SEQ ID NO: 7344812 - DNA, 22 bp, Homo sapiens
ctgagcagtgctttgcagtggg

SEQ ID NO: 7344813 - DNA, 19 bp, Homo sapiens
ctgagcaggcaggtaggat

SEQ ID NO: 7344814 - DNA, 22 bp, Homo sapiens
ctgagcaggcggtggagcggct

SEQ ID NO: 7344815 - DNA, 22 bp, Homo sapiens
ctgagcaggcggtggagcggct

SEQ ID NO: 7344816 - DNA, 19 bp, Homo sapiens
ctgagcagcggcagcactt

SEQ ID NO: 7344817 - DNA, 22 bp, Homo sapiens
ctgagcagctccctgagtggtc

SEQ ID NO: 7344818 - DNA, 22 bp, Homo sapiens
ctgagcagcgtggggagctggc

SEQ ID NO: 7344819 - DNA, 22 bp, Homo sapiens
ctgagcagcgtggggagctggc

SEQ ID NO: 7344820 - DNA, 22 bp, Homo sapiens
ctgagcaggacagtgggagacc

SEQ ID NO: 7344821 - DNA, 22 bp, Homo sapiens
ctgagcagaagggtgcacgtgc

SEQ ID NO: 7344822 - DNA, 19 bp, Homo sapiens
ctgagcagcggcagcactt

SEQ ID NO: 7344823 - DNA, 22 bp, Homo sapiens
ctgagcagaccatggcagaggt

SEQ ID NO: 7344824 - DNA, 22 bp, Homo sapiens
ctggaagggtcagagtgatgag

SEQ ID NO: 7344825 - DNA, 22 bp, Homo sapiens
ctggaaggtaacaaggccatta

SEQ ID NO: 7344826 - DNA, 22 bp, Homo sapiens
ctggagaaaatccatgtgtatg

SEQ ID NO: 7344827 - DNA, 22 bp, Homo sapiens
ctggagaaacatcaggcatagg

SEQ ID NO: 7344828 - DNA, 22 bp, Homo sapiens
ctggagaaacatcaggcatagg

SEQ ID NO: 7344829 - DNA, 22 bp, Homo sapiens
ctggaaggagaaggaggctgtg

SEQ ID NO: 7344830 - DNA, 22 bp, Homo sapiens
ctggaagggggacagccacaca

SEQ ID NO: 7344831 - DNA, 22 bp, Homo sapiens
ctggaaagtgaggagagttcca

SEQ ID NO: 7344832 - DNA, 22 bp, Homo sapiens
ctggaaagtcaggtcagaaact

SEQ ID NO: 7344833 - DNA, 22 bp, Homo sapiens
ctggaaagtgtctccatcctgg

SEQ ID NO: 7344834 - DNA, 22 bp, Homo sapiens
ctggaaagtgtctccatcctgg

SEQ ID NO: 7344835 - DNA, 22 bp, Homo sapiens
ctggaaagtgcatgtaatgagg

SEQ ID NO: 7344836 - DNA, 22 bp, Homo sapiens
ctggaaagtgctgagacaattg

SEQ ID NO: 7344837 - DNA, 22 bp, Homo sapiens
ctggaaagtgcttttctgagag

SEQ ID NO: 7344838 - DNA, 22 bp, Homo sapiens
ctggagcctaggttgacctggg

SEQ ID NO: 7344839 - DNA, 17 bp, Homo sapiens
ctggagcctccaactcc

SEQ ID NO: 7344840 - DNA, 22 bp, Homo sapiens
ctggagccggcgagccccagcc

SEQ ID NO: 7344841 - DNA, 22 bp, Homo sapiens
ctggagccggcgagccccagcc

SEQ ID NO: 7344842 - DNA, 22 bp, Homo sapiens
ctggagccccaggctgtgcaga

SEQ ID NO: 7344843 - DNA, 22 bp, Homo sapiens
ctggagccccaggctgtgcaga

SEQ ID NO: 7344844 - DNA, 22 bp, Homo sapiens
ctggagccctgaatgggcagga

SEQ ID NO: 7344845 - DNA, 22 bp, Homo sapiens
ctggagagggagccctggcagt

SEQ ID NO: 7344846 - DNA, 22 bp, Homo sapiens
ctgctgtcaaaaatcactccat

SEQ ID NO: 7344847 - DNA, 22 bp, Homo sapiens
ctgctggttgcacagagctagg

SEQ ID NO: 7344848 - DNA, 22 bp, Homo sapiens
ctgctgtcccagcctcctcaca

SEQ ID NO: 7344849 - DNA, 22 bp, Homo sapiens
ctgctgggtccccctgctgatt

SEQ ID NO: 7344850 - DNA, 22 bp, Homo sapiens
ctgctgggtctatgcaagtgga

SEQ ID NO: 7344851 - DNA, 19 bp, Homo sapiens
ctgctgggtgctgagggag

SEQ ID NO: 7344852 - DNA, 19 bp, Homo sapiens
ctgctgggtgctgagggag

SEQ ID NO: 7344853 - DNA, 22 bp, Homo sapiens
ctgctgggtctatgcaagtgga

SEQ ID NO: 7344854 - DNA, 22 bp, Homo sapiens
ctgctgagaaccagggagaatt

SEQ ID NO: 7344855 - DNA, 22 bp, Homo sapiens
ctgctgagactggctttgtgtc

SEQ ID NO: 7344856 - DNA, 22 bp, Homo sapiens
ctgctgagaaaagactgaggga

SEQ ID NO: 7344857 - DNA, 22 bp, Homo sapiens
ctgctgagcatcagggctgccc

SEQ ID NO: 7344858 - DNA, 22 bp, Homo sapiens
ctgctgagatgccaggagctct

SEQ ID NO: 7344859 - DNA, 22 bp, Homo sapiens
ctgctgagagctgaaggctgta

SEQ ID NO: 7344860 - DNA, 20 bp, Homo sapiens
ctgctgagagcctggcttgc

SEQ ID NO: 7344861 - DNA, 22 bp, Homo sapiens
ctgctgagagctgaaggctgta

SEQ ID NO: 7344862 - DNA, 22 bp, Homo sapiens
ctgctgagagccacgtggcaca

SEQ ID NO: 7344863 - DNA, 20 bp, Homo sapiens
ctgctgagagcctggcttgc

SEQ ID NO: 7344864 - DNA, 22 bp, Homo sapiens
ctgccttggtttctagcagggc

SEQ ID NO: 7344865 - DNA, 22 bp, Homo sapiens
ctgctctgaccctttcaccttc

SEQ ID NO: 7344866 - DNA, 21 bp, Homo sapiens
ctgctctgacagtgaggccag

SEQ ID NO: 7344867 - DNA, 22 bp, Homo sapiens
ctgctctgtttcttagctgggt

SEQ ID NO: 7344868 - DNA, 22 bp, Homo sapiens
ctgctcttcacactacacccgt

SEQ ID NO: 7344869 - DNA, 22 bp, Homo sapiens
ctgcctgtggacaccctggagg

SEQ ID NO: 7344870 - DNA, 22 bp, Homo sapiens
ctgcctgtgggtacaagtggaa

SEQ ID NO: 7344871 - DNA, 22 bp, Homo sapiens
ctgcctgtgtgtgcctgcagaa

SEQ ID NO: 7344872 - DNA, 22 bp, Homo sapiens
ctgccttccaaccccagactcc

SEQ ID NO: 7344873 - DNA, 18 bp, Homo sapiens
ctgcctgttgctgagagg

SEQ ID NO: 7344874 - DNA, 22 bp, Homo sapiens
ctgcctgttcctgatcattcta

SEQ ID NO: 7344875 - DNA, 19 bp, Homo sapiens
ctgcctgttatggagagaa

SEQ ID NO: 7344876 - DNA, 22 bp, Homo sapiens
caggggagtgagtccctctctg

SEQ ID NO: 7344877 - DNA, 22 bp, Homo sapiens
caggggagttttatgcaacaga

SEQ ID NO: 7344878 - DNA, 22 bp, Homo sapiens
caggggagttttatgcaacaga

SEQ ID NO: 7344879 - DNA, 22 bp, Homo sapiens
caggggcaagaatgctgtcagc

SEQ ID NO: 7344880 - DNA, 22 bp, Homo sapiens
tagtgaaacagttatcaatctg

SEQ ID NO: 7344881 - DNA, 22 bp, Homo sapiens
tatatttaaatccaggttgaaa

SEQ ID NO: 7344882 - DNA, 22 bp, Homo sapiens
tatatttaaatccaggttgaaa

SEQ ID NO: 7344883 - DNA, 22 bp, Homo sapiens
tagtgaatgttggctattaata

SEQ ID NO: 7344884 - DNA, 22 bp, Homo sapiens
tagtgaaatttatgcacagcta

SEQ ID NO: 7344885 - DNA, 22 bp, Homo sapiens
tagtgaaagtcaaagacagcta

SEQ ID NO: 7344886 - DNA, 22 bp, Homo sapiens
tagtgaaagtattaaacagctg

SEQ ID NO: 7344887 - DNA, 22 bp, Homo sapiens
cagggtggcactcagcgcatct

SEQ ID NO: 7344888 - DNA, 22 bp, Homo sapiens
cagggtggcaggcaccatggcc

SEQ ID NO: 7344889 - DNA, 22 bp, Homo sapiens
cagggtggcaggcaccatggcc

SEQ ID NO: 7344890 - DNA, 22 bp, Homo sapiens
cagggtggccaggtagataata

SEQ ID NO: 7344891 - DNA, 22 bp, Homo sapiens
tatcatttaacagaatcattgc

SEQ ID NO: 7344892 - DNA, 22 bp, Homo sapiens
tatcatttaacagaatcattgc

SEQ ID NO: 7344893 - DNA, 22 bp, Homo sapiens
tatcatgcttaccattttcaaa

SEQ ID NO: 7344894 - DNA, 22 bp, Homo sapiens
tatcagtatggattcatggatt

SEQ ID NO: 7344895 - DNA, 22 bp, Homo sapiens
tatcagtctcctggctgtgtca

SEQ ID NO: 7344896 - DNA, 22 bp, Homo sapiens
tatcagtgtggtttctggactg

SEQ ID NO: 7344897 - DNA, 22 bp, Homo sapiens
tatcagtggtcacaagatacat

SEQ ID NO: 7344898 - DNA, 23 bp, Homo sapiens
tatcagtgtgatgaggctgctgc

SEQ ID NO: 7344899 - DNA, 22 bp, Homo sapiens
caggggacagtatggtggatga

SEQ ID NO: 7344900 - DNA, 22 bp, Homo sapiens
caggggacattaaagctccata

SEQ ID NO: 7344901 - DNA, 22 bp, Homo sapiens
tagggtggttagaaggagtatg

SEQ ID NO: 7344902 - DNA, 22 bp, Homo sapiens
tagggtggagactggaagcagg

SEQ ID NO: 7344903 - DNA, 22 bp, Homo sapiens
tagggtggagactggaagcagg

SEQ ID NO: 7344904 - DNA, 23 bp, Homo sapiens
tagggcagctgggagggacatgc

SEQ ID NO: 7344905 - DNA, 22 bp, Homo sapiens
tagggacaaagagctgaggcct

SEQ ID NO: 7344906 - DNA, 22 bp, Homo sapiens
tagggctccactcccagagatt

SEQ ID NO: 7344907 - DNA, 18 bp, Homo sapiens
tagggccaaaatggaaaa

SEQ ID NO: 7344908 - DNA, 22 bp, Homo sapiens
tagggccagataggcttcttga

SEQ ID NO: 7344909 - DNA, 22 bp, Homo sapiens
tagggccagttagggaagcttt

SEQ ID NO: 7344910 - DNA, 22 bp, Homo sapiens
tagggccatgtctgtcttgttc

SEQ ID NO: 7344911 - DNA, 22 bp, Homo sapiens
cagggcaggaatttgacattgc

SEQ ID NO: 7344912 - DNA, 22 bp, Homo sapiens
taggacatgctacataaatagg

SEQ ID NO: 7344913 - DNA, 22 bp, Homo sapiens
tagctcctacaagtacagcaaa

SEQ ID NO: 7344914 - DNA, 22 bp, Homo sapiens
tagctagaaagtttcagctgtg

SEQ ID NO: 7344915 - DNA, 22 bp, Homo sapiens
tagctactgatgcaagagtttg

SEQ ID NO: 7344916 - DNA, 22 bp, Homo sapiens
cagggcagagggaaactccttt

SEQ ID NO: 7344917 - DNA, 22 bp, Homo sapiens
cagggcagccaggccccgtggg

SEQ ID NO: 7344918 - DNA, 22 bp, Homo sapiens
cagggcagcttcctttgttagg

SEQ ID NO: 7344919 - DNA, 22 bp, Homo sapiens
cagggcctgcctggttcctgga

SEQ ID NO: 7344920 - DNA, 22 bp, Homo sapiens
cagggcctggagctgggcctgc

SEQ ID NO: 7344921 - DNA, 22 bp, Homo sapiens
cagggcctggagctgggcctgc

SEQ ID NO: 7344922 - DNA, 19 bp, Homo sapiens
taggaccctggtggccccc

SEQ ID NO: 7344923 - DNA, 22 bp, Homo sapiens
taggagaagagtcagggcctaa

SEQ ID NO: 7344924 - DNA, 22 bp, Homo sapiens
taggagaggtgaatggcacact

SEQ ID NO: 7344925 - DNA, 22 bp, Homo sapiens
cagggcctgtcacgacgctcat

SEQ ID NO: 7344926 - DNA, 22 bp, Homo sapiens
cagggcggggtctgccggccct

SEQ ID NO: 7344927 - DNA, 22 bp, Homo sapiens
cagggctcaggctctgggattc

SEQ ID NO: 7344928 - DNA, 22 bp, Homo sapiens
cagggctagggagccctcctgg

SEQ ID NO: 7344929 - DNA, 22 bp, Homo sapiens
cagggctagggagccctcctgg

SEQ ID NO: 7344930 - DNA, 22 bp, Homo sapiens
cagggctcactcggctggcgtc

SEQ ID NO: 7344931 - DNA, 22 bp, Homo sapiens
cagggctcactcggctggcgtc

SEQ ID NO: 7344932 - DNA, 22 bp, Homo sapiens
tactcactattctatcagatag

SEQ ID NO: 7344933 - DNA, 22 bp, Homo sapiens
tactcattcatgttgttgtatg

SEQ ID NO: 7344934 - DNA, 22 bp, Homo sapiens
tactcagaaggaattgtgtttt

SEQ ID NO: 7344935 - DNA, 21 bp, Homo sapiens
tactgtagccttgcactgtag

SEQ ID NO: 7344936 - DNA, 22 bp, Homo sapiens
tactatgttcttcctaaatagt

SEQ ID NO: 7344937 - DNA, 22 bp, Homo sapiens
tactatttatggagtggttatt

SEQ ID NO: 7344938 - DNA, 22 bp, Homo sapiens
tactatttggaattttaaattg

SEQ ID NO: 7344939 - DNA, 22 bp, Homo sapiens
tactatttggaattttaaattg

SEQ ID NO: 7344940 - DNA, 22 bp, Homo sapiens
gtgaggggtggctgagcagttt

SEQ ID NO: 7344941 - DNA, 22 bp, Homo sapiens
gtgaggggccaagagtagggca

SEQ ID NO: 7344942 - DNA, 22 bp, Homo sapiens
gtgaggggccaagagtagggca

SEQ ID NO: 7344943 - DNA, 22 bp, Homo sapiens
gtgaggggccaagagtagggca

SEQ ID NO: 7344944 - DNA, 22 bp, Homo sapiens
gtgaggggtctggacgcacagt

SEQ ID NO: 7344945 - DNA, 22 bp, Homo sapiens
gtgaggggtggctgagcagttt

SEQ ID NO: 7344946 - DNA, 22 bp, Homo sapiens
gtgaggggagtaaagccatgtt

SEQ ID NO: 7344947 - DNA, 22 bp, Homo sapiens
gtgaggggagtaaagccatgtt

SEQ ID NO: 7344948 - DNA, 17 bp, Homo sapiens
gtgagggcagaggatgg

SEQ ID NO: 7344949 - DNA, 22 bp, Homo sapiens
gtgagggcagcttggtcagtgt

SEQ ID NO: 7344950 - DNA, 17 bp, Homo sapiens
gtgagggcagaggatgg

SEQ ID NO: 7344951 - DNA, 20 bp, Homo sapiens
cagccctgtgacctggccct

SEQ ID NO: 7344952 - DNA, 22 bp, Homo sapiens
gtgagggataatatgcggggtt

SEQ ID NO: 7344953 - DNA, 22 bp, Homo sapiens
caggctggagtgcagtggcgct

SEQ ID NO: 7344954 - DNA, 22 bp, Homo sapiens
caggctggagtgcagtggcgcc

SEQ ID NO: 7344955 - DNA, 22 bp, Homo sapiens
caggctggagtgcagtggcgcc

SEQ ID NO: 7344956 - DNA, 22 bp, Homo sapiens
caggctggagtgcagtggcgct

SEQ ID NO: 7344957 - DNA, 22 bp, Homo sapiens
caggctggagtgcagtggcgct

SEQ ID NO: 7344958 - DNA, 18 bp, Homo sapiens
tagaatataggtcattct

SEQ ID NO: 7344959 - DNA, 22 bp, Homo sapiens
caggctggagtgcagtggggcg

SEQ ID NO: 7344960 - DNA, 22 bp, Homo sapiens
tagaacatcaggttgaatttgg

SEQ ID NO: 7344961 - DNA, 22 bp, Homo sapiens
caggctggagtgcaatggcaca

SEQ ID NO: 7344962 - DNA, 22 bp, Homo sapiens
caggctggagtgcaatgacgcc

SEQ ID NO: 7344963 - DNA, 22 bp, Homo sapiens
caggctggagtgcaatggcaca

SEQ ID NO: 7344964 - DNA, 22 bp, Homo sapiens
caggctggagtgcagtggcgcc

SEQ ID NO: 7344965 - DNA, 22 bp, Homo sapiens
caggctggagtgcaatggtgct

SEQ ID NO: 7344966 - DNA, 22 bp, Homo sapiens
tactgtgcagctgtgctttggg

SEQ ID NO: 7344967 - DNA, 22 bp, Homo sapiens
caggctggagtgagtgtagtgg

SEQ ID NO: 7344968 - DNA, 22 bp, Homo sapiens
caggctggagtgagtgtagtgg

SEQ ID NO: 7344969 - DNA, 22 bp, Homo sapiens
cagggcaagtttgagattattt

SEQ ID NO: 7344970 - DNA, 22 bp, Homo sapiens
cagggcacagttatggaggtgg

SEQ ID NO: 7344971 - DNA, 21 bp, Homo sapiens
cagggcacacagaggatggta

SEQ ID NO: 7344972 - DNA, 22 bp, Homo sapiens
cagggcagaacatatagatagt

SEQ ID NO: 7344973 - DNA, 22 bp, Homo sapiens
cagggcagaaggcactctactc

SEQ ID NO: 7344974 - DNA, 21 bp, Homo sapiens
tagcaatacgtggaccatggg

SEQ ID NO: 7344975 - DNA, 22 bp, Homo sapiens
tagcaagatcgtgtctctaaaa

SEQ ID NO: 7344976 - DNA, 22 bp, Homo sapiens
caggctggtcccagagcattgc

SEQ ID NO: 7344977 - DNA, 22 bp, Homo sapiens
caggctggtcccagagcattgc

SEQ ID NO: 7344978 - DNA, 22 bp, Homo sapiens
caggctgggctggtgttagagt

SEQ ID NO: 7344979 - DNA, 22 bp, Homo sapiens
caggctgggctggtgttagagt

SEQ ID NO: 7344980 - DNA, 22 bp, Homo sapiens
caggctgggctccggagataaa

SEQ ID NO: 7344981 - DNA, 22 bp, Homo sapiens
caggctgggctccggagataaa

SEQ ID NO: 7344982 - DNA, 22 bp, Homo sapiens
caggctgggctccggagataaa

SEQ ID NO: 7344983 - DNA, 22 bp, Homo sapiens
caggctgggcagcctccccggc

SEQ ID NO: 7344984 - DNA, 22 bp, Homo sapiens
caggctgggcagcctccccggc

SEQ ID NO: 7344985 - DNA, 22 bp, Homo sapiens
tagaatatgtggtaggatctgg

SEQ ID NO: 7344986 - DNA, 22 bp, Homo sapiens
tagaatcaagcagtagagcaga

SEQ ID NO: 7344987 - DNA, 22 bp, Homo sapiens
tagagtgtcataacagtgccca

SEQ ID NO: 7344988 - DNA, 22 bp, Homo sapiens
tagagtgtcataacagtgccca

SEQ ID NO: 7344989 - DNA, 19 bp, Homo sapiens
tagaggagaagggaagtgg

SEQ ID NO: 7344990 - DNA, 19 bp, Homo sapiens
tagaggagaagggaagtgg

SEQ ID NO: 7344991 - DNA, 22 bp, Homo sapiens
tagaggagaacacaaattatag

SEQ ID NO: 7344992 - DNA, 18 bp, Homo sapiens
tagagttactacatgatt

SEQ ID NO: 7344993 - DNA, 22 bp, Homo sapiens
tagataaaagggcaaagggcat

SEQ ID NO: 7344994 - DNA, 22 bp, Homo sapiens
tagagcttagtatcctgttaag

SEQ ID NO: 7344995 - DNA, 22 bp, Homo sapiens
cagtgggggtgaggccgaggta

SEQ ID NO: 7344996 - DNA, 22 bp, Homo sapiens
cagtggggggactgaggcctga

SEQ ID NO: 7344997 - DNA, 23 bp, Homo sapiens
cagtgggcttctaactgctcctg

SEQ ID NO: 7344998 - DNA, 22 bp, Homo sapiens
cagtgggatatgggggcagcat

SEQ ID NO: 7344999 - DNA, 21 bp, Homo sapiens
cagtgggctgctgcgctccag

SEQ ID NO: 7345000 - DNA, 22 bp, Homo sapiens
cagtgccaggagacaagatcag

SEQ ID NO: 7345001 - DNA, 21 bp, Homo sapiens
cagtggcagttcttgcctctg

SEQ ID NO: 7345002 - DNA, 22 bp, Homo sapiens
tcagagaaataattgctgagtt

SEQ ID NO: 7345003 - DNA, 22 bp, Homo sapiens
cagtgtctccagatgctccaat

SEQ ID NO: 7345004 - DNA, 22 bp, Homo sapiens
tcagactgaccgaagcatctgg

SEQ ID NO: 7345005 - DNA, 22 bp, Homo sapiens
tcagactgtgtcataagtaggt

SEQ ID NO: 7345006 - DNA, 22 bp, Homo sapiens
tcagactgtttgcaccataggc

SEQ ID NO: 7345007 - DNA, 22 bp, Homo sapiens
tcagacttttaaagactgaatg

SEQ ID NO: 7345008 - DNA, 21 bp, Homo sapiens
tcagacttgagctcttctaca

SEQ ID NO: 7345009 - DNA, 22 bp, Homo sapiens
cagttaaacagattgagtgtta

SEQ ID NO: 7345010 - DNA, 22 bp, Homo sapiens
cagtgtttgtggaattcaggtg

SEQ ID NO: 7345011 - DNA, 22 bp, Homo sapiens
cagtgtgacttctgagctgcca

SEQ ID NO: 7345012 - DNA, 22 bp, Homo sapiens
cagtgtctgcctttctgtttgg

SEQ ID NO: 7345013 - DNA, 22 bp, Homo sapiens
cagttacattaataatgcacat

SEQ ID NO: 7345014 - DNA, 18 bp, Homo sapiens
cagttacaccttcattca

SEQ ID NO: 7345015 - DNA, 22 bp, Homo sapiens
cagttacatatttagtaggtta

SEQ ID NO: 7345016 - DNA, 22 bp, Homo sapiens
cagttacatgctcatgtcatca

SEQ ID NO: 7345017 - DNA, 22 bp, Homo sapiens
cagttaatgtcctatacaatag

SEQ ID NO: 7345018 - DNA, 22 bp, Homo sapiens
cagttaaatttggctgttttct

SEQ ID NO: 7345019 - DNA, 22 bp, Homo sapiens
tcagcagccgcagctgactcag

SEQ ID NO: 7345020 - DNA, 19 bp, Homo sapiens
cagtttaactaattttatc

SEQ ID NO: 7345021 - DNA, 23 bp, Homo sapiens
tcagcagcagaagtgctgggatg

SEQ ID NO: 7345022 - DNA, 22 bp, Homo sapiens
tcagcagcagctcagcatgttt

SEQ ID NO: 7345023 - DNA, 22 bp, Homo sapiens
tcagcagcagctcagcatgttt

SEQ ID NO: 7345024 - DNA, 19 bp, Homo sapiens
tcagcagcactgtgatttc

SEQ ID NO: 7345025 - DNA, 21 bp, Homo sapiens
tcaggaaacacctcttaagga

SEQ ID NO: 7345026 - DNA, 22 bp, Homo sapiens
cataaaatggcttgttctttaa

SEQ ID NO: 7345027 - DNA, 19 bp, Homo sapiens
cataaatgtacaagataca

SEQ ID NO: 7345028 - DNA, 22 bp, Homo sapiens
cataaattcagttctgcctctt

SEQ ID NO: 7345029 - DNA, 22 bp, Homo sapiens
cataaattgtacccattccaac

SEQ ID NO: 7345030 - DNA, 22 bp, Homo sapiens
cataaagtagcagagcatgact

SEQ ID NO: 7345031 - DNA, 22 bp, Homo sapiens
cagtttacctatatgtaaattt

SEQ ID NO: 7345032 - DNA, 22 bp, Homo sapiens
tcagctttggtcacattgagtt

SEQ ID NO: 7345033 - DNA, 22 bp, Homo sapiens
cagtgccaagccacagatcact

SEQ ID NO: 7345034 - DNA, 17 bp, Homo sapiens
tcacagttggtctcagt

SEQ ID NO: 7345035 - DNA, 17 bp, Homo sapiens
tcacagttggtctcagt

SEQ ID NO: 7345036 - DNA, 21 bp, Homo sapiens
tcacagttggccaggcattta

SEQ ID NO: 7345037 - DNA, 22 bp, Homo sapiens
tcacagttgagcaggttgtgca

SEQ ID NO: 7345038 - DNA, 22 bp, Homo sapiens
tcacagttgattgaaacacagc

SEQ ID NO: 7345039 - DNA, 22 bp, Homo sapiens
tcacagttctagaggtaagcag

SEQ ID NO: 7345040 - DNA, 22 bp, Homo sapiens
tcacagttcatctgataaacta

SEQ ID NO: 7345041 - DNA, 21 bp, Homo sapiens
tcacagttcaagatgaacccc

SEQ ID NO: 7345042 - DNA, 22 bp, Homo sapiens
tcacagttcatctgataaacta

SEQ ID NO: 7345043 - DNA, 21 bp, Homo sapiens
tcacagttcaagatgaacccc

SEQ ID NO: 7345044 - DNA, 22 bp, Homo sapiens
tcacagttcaactagttcagat

SEQ ID NO: 7345045 - DNA, 23 bp, Homo sapiens
tcacagttacttttgcatcaacc

SEQ ID NO: 7345046 - DNA, 22 bp, Homo sapiens
tcacagttatagtctgtagaat

SEQ ID NO: 7345047 - DNA, 22 bp, Homo sapiens
tcacagttatgggccttggtca

SEQ ID NO: 7345048 - DNA, 22 bp, Homo sapiens
tcacagttcaaaccccatatct

SEQ ID NO: 7345049 - DNA, 22 bp, Homo sapiens
tcacagttactccttcagatga

SEQ ID NO: 7345050 - DNA, 23 bp, Homo sapiens
tcacagttacttttgcatcaacc

SEQ ID NO: 7345051 - DNA, 22 bp, Homo sapiens
tcacagttactccttcagatga

SEQ ID NO: 7345052 - DNA, 22 bp, Homo sapiens
tcacagttaattgttggaatgt

SEQ ID NO: 7345053 - DNA, 22 bp, Homo sapiens
tcacagttaattgttggaatgt

SEQ ID NO: 7345054 - DNA, 22 bp, Homo sapiens
tcacagactgtgttgctactca

SEQ ID NO: 7345055 - DNA, 21 bp, Homo sapiens
tcacagactggtcagtgaggc

SEQ ID NO: 7345056 - DNA, 21 bp, Homo sapiens
tcacagactggtcagtgaggc

SEQ ID NO: 7345057 - DNA, 22 bp, Homo sapiens
tcacagactggtcagtcaactt

SEQ ID NO: 7345058 - DNA, 22 bp, Homo sapiens
tcacagactcttgattgtctaa

SEQ ID NO: 7345059 - DNA, 22 bp, Homo sapiens
tcacagacttgtctccagggat

SEQ ID NO: 7345060 - DNA, 18 bp, Homo sapiens
tcacagacttactgggcc

SEQ ID NO: 7345061 - DNA, 22 bp, Homo sapiens
tcacagactgtgttgctactca

SEQ ID NO: 7345062 - DNA, 18 bp, Homo sapiens
tcacagacttactgggcc

SEQ ID NO: 7345063 - DNA, 22 bp, Homo sapiens
tcacagacttgtctccagggat

SEQ ID NO: 7345064 - DNA, 22 bp, Homo sapiens
tcacaggaccctgagggtggcg

SEQ ID NO: 7345065 - DNA, 22 bp, Homo sapiens
tcacaaatcattttatctgtgt

SEQ ID NO: 7345066 - DNA, 22 bp, Homo sapiens
tcacaaatattttaacagtagg

SEQ ID NO: 7345067 - DNA, 22 bp, Homo sapiens
tatttcttttcgtgacttattg

SEQ ID NO: 7345068 - DNA, 21 bp, Homo sapiens
tatttctttgactctctccct

SEQ ID NO: 7345069 - DNA, 22 bp, Homo sapiens
tcacaaatgtctcctgtcctgt

SEQ ID NO: 7345070 - DNA, 22 bp, Homo sapiens
tcacaacgcctctgcaaatcct

SEQ ID NO: 7345071 - DNA, 22 bp, Homo sapiens
cagtgagaattcagtaggtact

SEQ ID NO: 7345072 - DNA, 22 bp, Homo sapiens
cagtgagaccttctaaggtggt

SEQ ID NO: 7345073 - DNA, 22 bp, Homo sapiens
tcacagactcaagggcatagga

SEQ ID NO: 7345074 - DNA, 22 bp, Homo sapiens
tcacagacgcatcctcaggtag

SEQ ID NO: 7345075 - DNA, 22 bp, Homo sapiens
tcacagacgcatcctcaggtag

SEQ ID NO: 7345076 - DNA, 22 bp, Homo sapiens
tcacagactcaagggcatagga

SEQ ID NO: 7345077 - DNA, 22 bp, Homo sapiens
tcacagacgcctcccctcgcct

SEQ ID NO: 7345078 - DNA, 22 bp, Homo sapiens
tcacactttatttatttcatgc

SEQ ID NO: 7345079 - DNA, 22 bp, Homo sapiens
tcacagacctggtgggaggtgg

SEQ ID NO: 7345080 - DNA, 22 bp, Homo sapiens
tcacagacctggtgggaggtgg

SEQ ID NO: 7345081 - DNA, 22 bp, Homo sapiens
cagtgagataccacagagcaaa

SEQ ID NO: 7345082 - DNA, 22 bp, Homo sapiens
cagtgagctcatggccaagtca

SEQ ID NO: 7345083 - DNA, 22 bp, Homo sapiens
cagtgagcacggccagagggga

SEQ ID NO: 7345084 - DNA, 22 bp, Homo sapiens
cagtgaggaagctgtctggacc

SEQ ID NO: 7345085 - DNA, 22 bp, Homo sapiens
cagtagcttcagttgaggcctg

SEQ ID NO: 7345086 - DNA, 22 bp, Homo sapiens
tatttccaaaagcctattatga

SEQ ID NO: 7345087 - DNA, 22 bp, Homo sapiens
tatttccacaccttttgaatct

SEQ ID NO: 7345088 - DNA, 22 bp, Homo sapiens
tatttccacctattattttctg

SEQ ID NO: 7345089 - DNA, 22 bp, Homo sapiens
tatttccacctattattttctg

SEQ ID NO: 7345090 - DNA, 22 bp, Homo sapiens
tatttccagaggagtatagaag

SEQ ID NO: 7345091 - DNA, 22 bp, Homo sapiens
tatttcttgttccctccaagtt

SEQ ID NO: 7345092 - DNA, 21 bp, Homo sapiens
tatttctttgactctctccct

SEQ ID NO: 7345093 - DNA, 22 bp, Homo sapiens
caggttctgggtcctgggtcct

SEQ ID NO: 7345094 - DNA, 22 bp, Homo sapiens
tatttcagtcacttcttctctg

SEQ ID NO: 7345095 - DNA, 22 bp, Homo sapiens
tatttcagtcacttcttctctg

SEQ ID NO: 7345096 - DNA, 21 bp, Homo sapiens
tatttagttttacaaatgtgg

SEQ ID NO: 7345097 - DNA, 22 bp, Homo sapiens
tatttataacagtgagaacggg

SEQ ID NO: 7345098 - DNA, 22 bp, Homo sapiens
tatttcattctttatcaggagc

SEQ ID NO: 7345099 - DNA, 22 bp, Homo sapiens
cagggtgggcacccagcctcca

SEQ ID NO: 7345100 - DNA, 22 bp, Homo sapiens
cagggtgggcacccagcctcca

SEQ ID NO: 7345101 - DNA, 22 bp, Homo sapiens
cagggtgggcacccagcctcca

SEQ ID NO: 7345102 - DNA, 22 bp, Homo sapiens
cagggtggccctgtggtctcat

SEQ ID NO: 7345103 - DNA, 22 bp, Homo sapiens
cagggtggggaaatagcgccct

SEQ ID NO: 7345104 - DNA, 22 bp, Homo sapiens
cagggtggggaaatagcgccct

SEQ ID NO: 7345105 - DNA, 22 bp, Homo sapiens
caggtgtttcctgaagttgatg

SEQ ID NO: 7345106 - DNA, 22 bp, Homo sapiens
caggtgtttaggtttcatggat

SEQ ID NO: 7345107 - DNA, 22 bp, Homo sapiens
caggtgttgtctaaagcttcag

SEQ ID NO: 7345108 - DNA, 22 bp, Homo sapiens
caggtgttgggagaagagataa

SEQ ID NO: 7345109 - DNA, 22 bp, Homo sapiens
caggtgttggaagggcagtggg

SEQ ID NO: 7345110 - DNA, 22 bp, Homo sapiens
tcatgaagtccaaactaaagca

SEQ ID NO: 7345111 - DNA, 18 bp, Homo sapiens
tcatgaggtagaggctgg

SEQ ID NO: 7345112 - DNA, 22 bp, Homo sapiens
tcatgcaacggctcgctgagcc

SEQ ID NO: 7345113 - DNA, 22 bp, Homo sapiens
tcatgcaaggctgaaacatggt

SEQ ID NO: 7345114 - DNA, 22 bp, Homo sapiens
tcatgcaaggctgaaacatggt

SEQ ID NO: 7345115 - DNA, 22 bp, Homo sapiens
tcatgcaacaacacattctggc

SEQ ID NO: 7345116 - DNA, 22 bp, Homo sapiens
catctttgggctgcatggaagg

SEQ ID NO: 7345117 - DNA, 22 bp, Homo sapiens
catctttgggctgcatggaagg

SEQ ID NO: 7345118 - DNA, 22 bp, Homo sapiens
tcatgcacatgtgtcaccatca

SEQ ID NO: 7345119 - DNA, 22 bp, Homo sapiens
tcatgcactacataacgatgtt

SEQ ID NO: 7345120 - DNA, 22 bp, Homo sapiens
tcatgcacagctcttagcacca

SEQ ID NO: 7345121 - DNA, 22 bp, Homo sapiens
tcatgcacatgtgtcaccatca

SEQ ID NO: 7345122 - DNA, 22 bp, Homo sapiens
catctttgttttggatataatc

SEQ ID NO: 7345123 - DNA, 22 bp, Homo sapiens
catctttggttttctatatgcc

SEQ ID NO: 7345124 - DNA, 22 bp, Homo sapiens
catctttggttttctatatgcc

SEQ ID NO: 7345125 - DNA, 22 bp, Homo sapiens
catgaaaataacattgttgtga

SEQ ID NO: 7345126 - DNA, 22 bp, Homo sapiens
catgaaaaatttactgttaaca

SEQ ID NO: 7345127 - DNA, 18 bp, Homo sapiens
tcattcattaaacttggc

SEQ ID NO: 7345128 - DNA, 22 bp, Homo sapiens
tcatttatcgctgccttttaaa

SEQ ID NO: 7345129 - DNA, 22 bp, Homo sapiens
tcattctgcatcactcttgctc

SEQ ID NO: 7345130 - DNA, 19 bp, Homo sapiens
tcattgaacataattactt

SEQ ID NO: 7345131 - DNA, 22 bp, Homo sapiens
tcattctctgggatgcagtttg

SEQ ID NO: 7345132 - DNA, 22 bp, Homo sapiens
tcattccttatccgtatctttt

SEQ ID NO: 7345133 - DNA, 22 bp, Homo sapiens
tcattcctttacagttgatcct

SEQ ID NO: 7345134 - DNA, 22 bp, Homo sapiens
tcattccttaacattcatttgc

SEQ ID NO: 7345135 - DNA, 22 bp, Homo sapiens
tcattcctcaggaagggattta

SEQ ID NO: 7345136 - DNA, 22 bp, Homo sapiens
tcattcctccagcgggagtcca

SEQ ID NO: 7345137 - DNA, 22 bp, Homo sapiens
tccagacattttatagcagtct

SEQ ID NO: 7345138 - DNA, 22 bp, Homo sapiens
tccacatagagcttagaagcaa

SEQ ID NO: 7345139 - DNA, 22 bp, Homo sapiens
tccacagtctatttttagtcta

SEQ ID NO: 7345140 - DNA, 22 bp, Homo sapiens
tccacaggtccggcatgaacag

SEQ ID NO: 7345141 - DNA, 22 bp, Homo sapiens
tccacaggtatgaggccccacc

SEQ ID NO: 7345142 - DNA, 22 bp, Homo sapiens
tccacaggtatttctccttgct

SEQ ID NO: 7345143 - DNA, 17 bp, Homo sapiens
tccaagccagcttgcct

SEQ ID NO: 7345144 - DNA, 20 bp, Homo sapiens
tccaagccctccttccattc

SEQ ID NO: 7345145 - DNA, 22 bp, Homo sapiens
catgtgtgtgagggaaacatgt

SEQ ID NO: 7345146 - DNA, 22 bp, Homo sapiens
catgtgtgtctccaccagctgc

SEQ ID NO: 7345147 - DNA, 22 bp, Homo sapiens
catgtgtgtccatgtgactaag

SEQ ID NO: 7345148 - DNA, 22 bp, Homo sapiens
catgttaaaatatacattctga

SEQ ID NO: 7345149 - DNA, 18 bp, Homo sapiens
tccaggctccaggctaac

SEQ ID NO: 7345150 - DNA, 22 bp, Homo sapiens
tccaggcccatggagcagagct

SEQ ID NO: 7345151 - DNA, 22 bp, Homo sapiens
tccagctggcttcggaagtgga

SEQ ID NO: 7345152 - DNA, 20 bp, Homo sapiens
tccaggcagctcagagtgtc

SEQ ID NO: 7345153 - DNA, 20 bp, Homo sapiens
tccaggcagctcagagtgtc

SEQ ID NO: 7345154 - DNA, 22 bp, Homo sapiens
tccaggcagcccttcctgactc

SEQ ID NO: 7345155 - DNA, 22 bp, Homo sapiens
tccaggccccactgaagcccct

SEQ ID NO: 7345156 - DNA, 22 bp, Homo sapiens
tccagactctgtcacttcctag

SEQ ID NO: 7345157 - DNA, 21 bp, Homo sapiens
tccagacctccctctcctagc

SEQ ID NO: 7345158 - DNA, 22 bp, Homo sapiens
tccagcctaatgttcttcccac

SEQ ID NO: 7345159 - DNA, 22 bp, Homo sapiens
tccagccgccggccctgcaggt

SEQ ID NO: 7345160 - DNA, 22 bp, Homo sapiens
tccagccgtcacagccacattc

SEQ ID NO: 7345161 - DNA, 22 bp, Homo sapiens
tccagctgacatctcctgaggg

SEQ ID NO: 7345162 - DNA, 22 bp, Homo sapiens
tccagcctcatttctcctgctt

SEQ ID NO: 7345163 - DNA, 22 bp, Homo sapiens
tccagcctcatttctcctgctt

SEQ ID NO: 7345164 - DNA, 17 bp, Homo sapiens
tccagcctcctctgctg

SEQ ID NO: 7345165 - DNA, 22 bp, Homo sapiens
tccagcctcctatttaccctaa

SEQ ID NO: 7345166 - DNA, 17 bp, Homo sapiens
tccagcctcctctgctg

SEQ ID NO: 7345167 - DNA, 22 bp, Homo sapiens
catttggattttgaagagagta

SEQ ID NO: 7345168 - DNA, 22 bp, Homo sapiens
catttggaccaaaatagccaac

SEQ ID NO: 7345169 - DNA, 22 bp, Homo sapiens
tcctcagggaagatgagcctca

SEQ ID NO: 7345170 - DNA, 22 bp, Homo sapiens
catttgtagctatttactgtat

SEQ ID NO: 7345171 - DNA, 22 bp, Homo sapiens
catttgtatagtgcttagacca

SEQ ID NO: 7345172 - DNA, 22 bp, Homo sapiens
catttgtagttaaaaatgtctc

SEQ ID NO: 7345173 - DNA, 22 bp, Homo sapiens
tcctctccatgtctcacgccac

SEQ ID NO: 7345174 - DNA, 22 bp, Homo sapiens
tcctctccatattttctgattt

SEQ ID NO: 7345175 - DNA, 22 bp, Homo sapiens
tcctctccaggtgagccgaaat

SEQ ID NO: 7345176 - DNA, 22 bp, Homo sapiens
tccctataattgcacatccatt

SEQ ID NO: 7345177 - DNA, 22 bp, Homo sapiens
tccctagtcgcatctgtggaga

SEQ ID NO: 7345178 - DNA, 22 bp, Homo sapiens
tcctcaggcggtgaggaggggc

SEQ ID NO: 7345179 - DNA, 22 bp, Homo sapiens
tcctcaggctgcctggaagact

SEQ ID NO: 7345180 - DNA, 22 bp, Homo sapiens
tcctcaggatgtggagtagaat

SEQ ID NO: 7345181 - DNA, 22 bp, Homo sapiens
tcctcaggatgtggggtagaat

SEQ ID NO: 7345182 - DNA, 22 bp, Homo sapiens
tcctcaggatctaggagtgctt

SEQ ID NO: 7345183 - DNA, 22 bp, Homo sapiens
tcctcaggagagctcctatgcc

SEQ ID NO: 7345184 - DNA, 22 bp, Homo sapiens
cattgcacgggcgtctgtctgt

SEQ ID NO: 7345185 - DNA, 22 bp, Homo sapiens
cattgcacagccctgtggtgat

SEQ ID NO: 7345186 - DNA, 22 bp, Homo sapiens
cattgcacatctgagaagagat

SEQ ID NO: 7345187 - DNA, 22 bp, Homo sapiens
cattgcaccacattgcatccct

SEQ ID NO: 7345188 - DNA, 22 bp, Homo sapiens
cattgcacaccagcctgggcaa

SEQ ID NO: 7345189 - DNA, 22 bp, Homo sapiens
tccccactcaccactggccaaa

SEQ ID NO: 7345190 - DNA, 18 bp, Homo sapiens
cattgacagtatatcttt

SEQ ID NO: 7345191 - DNA, 22 bp, Homo sapiens
tcccaggaggtgcttcctagga

SEQ ID NO: 7345192 - DNA, 22 bp, Homo sapiens
cattgaaaaacgttgactgagt

SEQ ID NO: 7345193 - DNA, 22 bp, Homo sapiens
tccccactctgggccaccacaa

SEQ ID NO: 7345194 - DNA, 22 bp, Homo sapiens
tccccactctctcctggagctt

SEQ ID NO: 7345195 - DNA, 22 bp, Homo sapiens
tccccactcctgggcagatgcg

SEQ ID NO: 7345196 - DNA, 22 bp, Homo sapiens
tccccactgggcctcctctttc

SEQ ID NO: 7345197 - DNA, 19 bp, Homo sapiens
tccccagcacctctgagtc

SEQ ID NO: 7345198 - DNA, 19 bp, Homo sapiens
tccccagcacctctgagtc

SEQ ID NO: 7345199 - DNA, 19 bp, Homo sapiens
tccccagcacctctgagtc

SEQ ID NO: 7345200 - DNA, 22 bp, Homo sapiens
tccccagccgtgaaggagagga

SEQ ID NO: 7345201 - DNA, 22 bp, Homo sapiens
tccccagcattgagggtctctc

SEQ ID NO: 7345202 - DNA, 22 bp, Homo sapiens
tccccagcattgagggtctctc

SEQ ID NO: 7345203 - DNA, 22 bp, Homo sapiens
tccccagctctgtgcttccact

SEQ ID NO: 7345204 - DNA, 22 bp, Homo sapiens
tccccagcttgctacttctgct

SEQ ID NO: 7345205 - DNA, 22 bp, Homo sapiens
tcccagccacagtttccacctg

SEQ ID NO: 7345206 - DNA, 22 bp, Homo sapiens
tcccagccacagtttccacctg

SEQ ID NO: 7345207 - DNA, 22 bp, Homo sapiens
tcccagccaggctctaccactt

SEQ ID NO: 7345208 - DNA, 22 bp, Homo sapiens
tcccagccaggctctaccactt

SEQ ID NO: 7345209 - DNA, 22 bp, Homo sapiens
tcccagcccaggtatgatgata

SEQ ID NO: 7345210 - DNA, 22 bp, Homo sapiens
tcccagcccagatttgtgtgac

SEQ ID NO: 7345211 - DNA, 22 bp, Homo sapiens
tcccagcccagacttctccagt

SEQ ID NO: 7345212 - DNA, 22 bp, Homo sapiens
tcccagccattcctttaggtgt

SEQ ID NO: 7345213 - DNA, 21 bp, Homo sapiens
tcccactctaaatggactgaa

SEQ ID NO: 7345214 - DNA, 22 bp, Homo sapiens
tcccactgagcatatgcagatg

SEQ ID NO: 7345215 - DNA, 22 bp, Homo sapiens
cattcatttatgaaatatctat

SEQ ID NO: 7345216 - DNA, 22 bp, Homo sapiens
catgttaatatgcattgagtac

SEQ ID NO: 7345217 - DNA, 22 bp, Homo sapiens
catgttaatatgcattgagtac

SEQ ID NO: 7345218 - DNA, 22 bp, Homo sapiens
catgttaactaagattaactat

SEQ ID NO: 7345219 - DNA, 22 bp, Homo sapiens
catgttttctaggctttcacaa

SEQ ID NO: 7345220 - DNA, 22 bp, Homo sapiens
cattcaaattaagattttgtta

SEQ ID NO: 7345221 - DNA, 22 bp, Homo sapiens
cattcacaaaaccacatgccat

SEQ ID NO: 7345222 - DNA, 22 bp, Homo sapiens
cattcacagcaggtcagctgaa

SEQ ID NO: 7345223 - DNA, 22 bp, Homo sapiens
cattcacaactgagcattgttg

SEQ ID NO: 7345224 - DNA, 22 bp, Homo sapiens
cattcacaatggattgcttcaa

SEQ ID NO: 7345225 - DNA, 22 bp, Homo sapiens
cattcacattcttcttactgtt

SEQ ID NO: 7345226 - DNA, 22 bp, Homo sapiens
ccagcagcccacaggcgtccct

SEQ ID NO: 7345227 - DNA, 22 bp, Homo sapiens
ccagcagcgatagggtgagtgc

SEQ ID NO: 7345228 - DNA, 22 bp, Homo sapiens
ccagcagccagagaaggacctc

SEQ ID NO: 7345229 - DNA, 22 bp, Homo sapiens
ccagcagcatcctgcagcactt

SEQ ID NO: 7345230 - DNA, 22 bp, Homo sapiens
ccagcagcaggccaggccctcc

SEQ ID NO: 7345231 - DNA, 22 bp, Homo sapiens
ccagcagctgctatgtggtttt

SEQ ID NO: 7345232 - DNA, 22 bp, Homo sapiens
ccagcagctgcaaagcctgggt

SEQ ID NO: 7345233 - DNA, 22 bp, Homo sapiens
ccagcagctcagctactggtca

SEQ ID NO: 7345234 - DNA, 21 bp, Homo sapiens
ccagcagctcaaggatctctt

SEQ ID NO: 7345235 - DNA, 22 bp, Homo sapiens
ccagcagctccctcagggtccg

SEQ ID NO: 7345236 - DNA, 22 bp, Homo sapiens
ccagcagctccctcagggtccg

SEQ ID NO: 7345237 - DNA, 22 bp, Homo sapiens
ccagcagctttattggctctcc

SEQ ID NO: 7345238 - DNA, 22 bp, Homo sapiens
ccagcagggcagtgccctggac

SEQ ID NO: 7345239 - DNA, 22 bp, Homo sapiens
ccagcagggaaaaacccaccaa

SEQ ID NO: 7345240 - DNA, 22 bp, Homo sapiens
ccagcagggcagtgccctggac

SEQ ID NO: 7345241 - DNA, 22 bp, Homo sapiens
tctctgcccaagtttctcaagt

SEQ ID NO: 7345242 - DNA, 22 bp, Homo sapiens
tctctgatgacctatgatgttg

SEQ ID NO: 7345243 - DNA, 22 bp, Homo sapiens
tctgaattaatcatgcctcttt

SEQ ID NO: 7345244 - DNA, 22 bp, Homo sapiens
tctgaattcagtatggtctttc

SEQ ID NO: 7345245 - DNA, 22 bp, Homo sapiens
tctgaagtgatcatcatttctc

SEQ ID NO: 7345246 - DNA, 19 bp, Homo sapiens
tctgaagtccagggcatac

SEQ ID NO: 7345247 - DNA, 18 bp, Homo sapiens
ccagcatgccagaggctg

SEQ ID NO: 7345248 - DNA, 23 bp, Homo sapiens
tctctgtgtgcctcagtttcttc

SEQ ID NO: 7345249 - DNA, 22 bp, Homo sapiens
tctctgtgtgccttcatctgcc

SEQ ID NO: 7345250 - DNA, 22 bp, Homo sapiens
ccagcaggtgtagggctcatgg

SEQ ID NO: 7345251 - DNA, 19 bp, Homo sapiens
ccagcaggttcatttcagg

SEQ ID NO: 7345252 - DNA, 22 bp, Homo sapiens
ccagcaggtgtagggctcatgg

SEQ ID NO: 7345253 - DNA, 22 bp, Homo sapiens
tctctgtgtgttggctgtatat

SEQ ID NO: 7345254 - DNA, 21 bp, Homo sapiens
tctctgtgttcaaggtgccag

SEQ ID NO: 7345255 - DNA, 22 bp, Homo sapiens
tctctgtgttccctgttttctc

SEQ ID NO: 7345256 - DNA, 22 bp, Homo sapiens
tctctgtgtgtgtgacagcatt

SEQ ID NO: 7345257 - DNA, 22 bp, Homo sapiens
tctctgtgtgggagatcttttt

SEQ ID NO: 7345258 - DNA, 22 bp, Homo sapiens
tctctgtgttgcaggaaaatct

SEQ ID NO: 7345259 - DNA, 22 bp, Homo sapiens
ccagcccttagataaacctggc

SEQ ID NO: 7345260 - DNA, 22 bp, Homo sapiens
ccagccctgtttatgtgtcact

SEQ ID NO: 7345261 - DNA, 19 bp, Homo sapiens
ccagccctgtcacttcttg

SEQ ID NO: 7345262 - DNA, 22 bp, Homo sapiens
ccagccctgtaaggatgaggca

SEQ ID NO: 7345263 - DNA, 22 bp, Homo sapiens
ccagccacgaagctcccttcat

SEQ ID NO: 7345264 - DNA, 22 bp, Homo sapiens
ccagccacagcttccagctcct

SEQ ID NO: 7345265 - DNA, 22 bp, Homo sapiens
tctgagagctctggggcccctt

SEQ ID NO: 7345266 - DNA, 22 bp, Homo sapiens
tctgatattggacaattcaggg

SEQ ID NO: 7345267 - DNA, 22 bp, Homo sapiens
tctgatatgaatgtctagctct

SEQ ID NO: 7345268 - DNA, 22 bp, Homo sapiens
tctgatatctctccctgggtca

SEQ ID NO: 7345269 - DNA, 22 bp, Homo sapiens
tctgatatcgcactaaactctg

SEQ ID NO: 7345270 - DNA, 21 bp, Homo sapiens
tctgatatatccccaagttac

SEQ ID NO: 7345271 - DNA, 22 bp, Homo sapiens
tctgatataaaagtgacattca

SEQ ID NO: 7345272 - DNA, 22 bp, Homo sapiens
tctcaacaccacttgctgaaga

SEQ ID NO: 7345273 - DNA, 22 bp, Homo sapiens
tctcaacagtgaaatgtgtttg

SEQ ID NO: 7345274 - DNA, 22 bp, Homo sapiens
tctcaaatttgttagataaaat

SEQ ID NO: 7345275 - DNA, 23 bp, Homo sapiens
tctcaagaggaagcagggctcat

SEQ ID NO: 7345276 - DNA, 16 bp, Homo sapiens
ccacctgcagctctca

SEQ ID NO: 7345277 - DNA, 22 bp, Homo sapiens
ccacctcctaggcctggagaag

SEQ ID NO: 7345278 - DNA, 22 bp, Homo sapiens
tctccacagtcccacctcgctt

SEQ ID NO: 7345279 - DNA, 22 bp, Homo sapiens
tctccacagaaggttccaggcc

SEQ ID NO: 7345280 - DNA, 22 bp, Homo sapiens
ccagaaaactctacatgcttgt

SEQ ID NO: 7345281 - DNA, 22 bp, Homo sapiens
ccacttttcactaagatgaatt

SEQ ID NO: 7345282 - DNA, 20 bp, Homo sapiens
tctccctgcccatctcagat

SEQ ID NO: 7345283 - DNA, 23 bp, Homo sapiens
tctccctgaggttgttagcatta

SEQ ID NO: 7345284 - DNA, 22 bp, Homo sapiens
tctccctgtttgctacgctatc

SEQ ID NO: 7345285 - DNA, 16 bp, Homo sapiens
tctccctgttctccaa

SEQ ID NO: 7345286 - DNA, 22 bp, Homo sapiens
tctccctgtggaggacccctta

SEQ ID NO: 7345287 - DNA, 22 bp, Homo sapiens
tctccctggagccctgaagcat

SEQ ID NO: 7345288 - DNA, 22 bp, Homo sapiens
tctccgatcacaggttttcaat

SEQ ID NO: 7345289 - DNA, 22 bp, Homo sapiens
tctccgggtgcatgtgtgtgcc

SEQ ID NO: 7345290 - DNA, 22 bp, Homo sapiens
tctccgggtggcggcgaaggga

SEQ ID NO: 7345291 - DNA, 22 bp, Homo sapiens
ccagagaggccaaggtcgtggt

SEQ ID NO: 7345292 - DNA, 22 bp, Homo sapiens
ccagagaggcaaaactccttcc

SEQ ID NO: 7345293 - DNA, 22 bp, Homo sapiens
ccagagaggccaaggtcgtggt

SEQ ID NO: 7345294 - DNA, 22 bp, Homo sapiens
ccagagagagtactgggctctg

SEQ ID NO: 7345295 - DNA, 22 bp, Homo sapiens
ccagagagattgcttctaaaga

SEQ ID NO: 7345296 - DNA, 22 bp, Homo sapiens
ccagagagagtactgggctctg

SEQ ID NO: 7345297 - DNA, 21 bp, Homo sapiens
ccagagagagggaagtgggtt

SEQ ID NO: 7345298 - DNA, 19 bp, Homo sapiens
ccagagagctaggtacaga

SEQ ID NO: 7345299 - DNA, 22 bp, Homo sapiens
ccagagagctacaaggcataaa

SEQ ID NO: 7345300 - DNA, 22 bp, Homo sapiens
ccagagagagaggtcaatggca

SEQ ID NO: 7345301 - DNA, 22 bp, Homo sapiens
tctccaggaaccatcatggtaa

SEQ ID NO: 7345302 - DNA, 18 bp, Homo sapiens
tctccacttctgtgagaa

SEQ ID NO: 7345303 - DNA, 22 bp, Homo sapiens
tctccactattttctagctctt

SEQ ID NO: 7345304 - DNA, 22 bp, Homo sapiens
tctccactctgagtgcctttca

SEQ ID NO: 7345305 - DNA, 22 bp, Homo sapiens
ccacatctcggtcccctctttg

SEQ ID NO: 7345306 - DNA, 22 bp, Homo sapiens
ccacagtgattcacttttgaag

SEQ ID NO: 7345307 - DNA, 22 bp, Homo sapiens
ccacatctgcagtcccttctgt

SEQ ID NO: 7345308 - DNA, 22 bp, Homo sapiens
ccacattggcctcagaggttag

SEQ ID NO: 7345309 - DNA, 22 bp, Homo sapiens
ccacattgactgtctgtagatt

SEQ ID NO: 7345310 - DNA, 22 bp, Homo sapiens
ccacattcatcagttgttaatg

SEQ ID NO: 7345311 - DNA, 22 bp, Homo sapiens
ccacattctcatgtaatccttt

SEQ ID NO: 7345312 - DNA, 22 bp, Homo sapiens
ccacattcaccagctgcacgac

SEQ ID NO: 7345313 - DNA, 22 bp, Homo sapiens
ccacatgctctctctccaggtt

SEQ ID NO: 7345314 - DNA, 22 bp, Homo sapiens
tcctctccatgtctcacgccac

SEQ ID NO: 7345315 - DNA, 21 bp, Homo sapiens
tcctctccatgatctgtttgt

SEQ ID NO: 7345316 - DNA, 18 bp, Homo sapiens
tcctctctttccccaggg

SEQ ID NO: 7345317 - DNA, 18 bp, Homo sapiens
tcctctctttccccaggg

SEQ ID NO: 7345318 - DNA, 22 bp, Homo sapiens
tcctctgagctcaaaatccagc

SEQ ID NO: 7345319 - DNA, 22 bp, Homo sapiens
tcgcggggaagtggtgggctaa

SEQ ID NO: 7345320 - DNA, 22 bp, Homo sapiens
tcgcggggaagtggtgggctaa

SEQ ID NO: 7345321 - DNA, 22 bp, Homo sapiens
tcctttccagcctcacctcagc

SEQ ID NO: 7345322 - DNA, 22 bp, Homo sapiens
ccaccagcagtgtgcaaggatt

SEQ ID NO: 7345323 - DNA, 22 bp, Homo sapiens
ccaccagaccaccaagagcaac

SEQ ID NO: 7345324 - DNA, 22 bp, Homo sapiens
ccaccagagcttcgtggcttaa

SEQ ID NO: 7345325 - DNA, 22 bp, Homo sapiens
ccaccagaagctgggagaagct

SEQ ID NO: 7345326 - DNA, 22 bp, Homo sapiens
ccaccagaagctgggagaagct

SEQ ID NO: 7345327 - DNA, 22 bp, Homo sapiens
tcgggccataggctaggtccct

SEQ ID NO: 7345328 - DNA, 19 bp, Homo sapiens
tcgctgtgttcatagagct

SEQ ID NO: 7345329 - DNA, 22 bp, Homo sapiens
ccaccgccatggcgttgtacag

SEQ ID NO: 7345330 - DNA, 22 bp, Homo sapiens
ccaccctgtgtttttgccattg

SEQ ID NO: 7345331 - DNA, 22 bp, Homo sapiens
ccacccttccattcttcctctt

SEQ ID NO: 7345332 - DNA, 22 bp, Homo sapiens
ccaccctggactcgaggcccga

SEQ ID NO: 7345333 - DNA, 22 bp, Homo sapiens
ccaccctgtgcaggcgtgggta

SEQ ID NO: 7345334 - DNA, 20 bp, Homo sapiens
ccaccctgtccggggcggag

SEQ ID NO: 7345335 - DNA, 19 bp, Homo sapiens
ccaccctgggagctcactc

SEQ ID NO: 7345336 - DNA, 22 bp, Homo sapiens
ccaccctgggttctgatgtgga

SEQ ID NO: 7345337 - DNA, 22 bp, Homo sapiens
cctggaggcggaggttgcagtg

SEQ ID NO: 7345338 - DNA, 22 bp, Homo sapiens
cctggaggcggaggttgcagtg

SEQ ID NO: 7345339 - DNA, 22 bp, Homo sapiens
cctggaggagcgctgaccagct

SEQ ID NO: 7345340 - DNA, 22 bp, Homo sapiens
cctggaggcagaaataggactt

SEQ ID NO: 7345341 - DNA, 22 bp, Homo sapiens
cctggagggcagcccattctgg

SEQ ID NO: 7345342 - DNA, 22 bp, Homo sapiens
cctggaggctctgggagggcag

SEQ ID NO: 7345343 - DNA, 22 bp, Homo sapiens
cctggaggctctgggagggcag

SEQ ID NO: 7345344 - DNA, 22 bp, Homo sapiens
cctggagggaccctggccctgt

SEQ ID NO: 7345345 - DNA, 22 bp, Homo sapiens
cctggagcttttccagttgaca

SEQ ID NO: 7345346 - DNA, 22 bp, Homo sapiens
cctggagcttggtcacgctgcg

SEQ ID NO: 7345347 - DNA, 18 bp, Homo sapiens
cctggagctccacagcaa

SEQ ID NO: 7345348 - DNA, 22 bp, Homo sapiens
tgtcaacacacctatctcaatt

SEQ ID NO: 7345349 - DNA, 22 bp, Homo sapiens
tgtattctaaatacatcttacc

SEQ ID NO: 7345350 - DNA, 22 bp, Homo sapiens
tgtcaaatagtagaaagatggc

SEQ ID NO: 7345351 - DNA, 18 bp, Homo sapiens
cctggaggtcttcggggt

SEQ ID NO: 7345352 - DNA, 18 bp, Homo sapiens
cctggaggtcttcggggt

SEQ ID NO: 7345353 - DNA, 22 bp, Homo sapiens
cctggaggggaccaggaccagg

SEQ ID NO: 7345354 - DNA, 16 bp, Homo sapiens
cctggaggtcacttca

SEQ ID NO: 7345355 - DNA, 22 bp, Homo sapiens
cctggagggcgccgcacagtcc

SEQ ID NO: 7345356 - DNA, 22 bp, Homo sapiens
cctggagggcgccgcacagtcc

SEQ ID NO: 7345357 - DNA, 22 bp, Homo sapiens
cctggaggggaccaggaccagg

SEQ ID NO: 7345358 - DNA, 22 bp, Homo sapiens
tgtaatgggctactaggaagag

SEQ ID NO: 7345359 - DNA, 22 bp, Homo sapiens
tgtacatacatagatatacaca

SEQ ID NO: 7345360 - DNA, 22 bp, Homo sapiens
tgtacatatatgtatgtacgca

SEQ ID NO: 7345361 - DNA, 22 bp, Homo sapiens
tgtacatgaataaaagatcttg

SEQ ID NO: 7345362 - DNA, 22 bp, Homo sapiens
tgtacatattcaagcacttcta

SEQ ID NO: 7345363 - DNA, 22 bp, Homo sapiens
tgtacatagaaaggatacagct

SEQ ID NO: 7345364 - DNA, 22 bp, Homo sapiens
tgtacatgtgtctgtatatctt

SEQ ID NO: 7345365 - DNA, 22 bp, Homo sapiens
tgtacatgacagagagagccaa

SEQ ID NO: 7345366 - DNA, 22 bp, Homo sapiens
cctggagcacatggcaggaggc

SEQ ID NO: 7345367 - DNA, 22 bp, Homo sapiens
cctggagctcactgggagccgg

SEQ ID NO: 7345368 - DNA, 22 bp, Homo sapiens
cctggagctcactgggagccgg

SEQ ID NO: 7345369 - DNA, 22 bp, Homo sapiens
tgtaatatatataactgtgtgc

SEQ ID NO: 7345370 - DNA, 22 bp, Homo sapiens
tggtctgaggaacaccagcact

SEQ ID NO: 7345371 - DNA, 22 bp, Homo sapiens
tggtctgcatttattcaagact

SEQ ID NO: 7345372 - DNA, 22 bp, Homo sapiens
tggtctgcctggatcacagccc

SEQ ID NO: 7345373 - DNA, 22 bp, Homo sapiens
tggtctgaactaagacagtagt

SEQ ID NO: 7345374 - DNA, 22 bp, Homo sapiens
tggtctggaactcctggcttca

SEQ ID NO: 7345375 - DNA, 22 bp, Homo sapiens
cctgctggcattcttgctccct

SEQ ID NO: 7345376 - DNA, 22 bp, Homo sapiens
cctgctggccactgctccacct

SEQ ID NO: 7345377 - DNA, 22 bp, Homo sapiens
cctgccaggctttgggcttctg

SEQ ID NO: 7345378 - DNA, 22 bp, Homo sapiens
tgggtatacaaataatctcttt

SEQ ID NO: 7345379 - DNA, 22 bp, Homo sapiens
tgggtatatatgttgctacaga

SEQ ID NO: 7345380 - DNA, 22 bp, Homo sapiens
tgggtaggtgctggggattcag

SEQ ID NO: 7345381 - DNA, 22 bp, Homo sapiens
tgggtcagaatcagagagttgc

SEQ ID NO: 7345382 - DNA, 22 bp, Homo sapiens
tgggtcagacagccagtgggcc

SEQ ID NO: 7345383 - DNA, 22 bp, Homo sapiens
tgggtcagagcagacctctgga

SEQ ID NO: 7345384 - DNA, 23 bp, Homo sapiens
cctgcctgttctaactccatttc

SEQ ID NO: 7345385 - DNA, 22 bp, Homo sapiens
cctgcctgtctttatcccctgt

SEQ ID NO: 7345386 - DNA, 22 bp, Homo sapiens
cctgcctgtccctcagtccaca

SEQ ID NO: 7345387 - DNA, 22 bp, Homo sapiens
tgggtcagaggacctcgtggcc

SEQ ID NO: 7345388 - DNA, 22 bp, Homo sapiens
cctgaggcttaatctgtcccaa

SEQ ID NO: 7345389 - DNA, 22 bp, Homo sapiens
cctgaataatttgtgaaaagat

SEQ ID NO: 7345390 - DNA, 22 bp, Homo sapiens
cctgaccctccttagagtccag

SEQ ID NO: 7345391 - DNA, 22 bp, Homo sapiens
cctgagaataacaaattgctgc

SEQ ID NO: 7345392 - DNA, 22 bp, Homo sapiens
cctgagaaatagcatcattttt

SEQ ID NO: 7345393 - DNA, 22 bp, Homo sapiens
cctgccaggagctggtgctgca

SEQ ID NO: 7345394 - DNA, 22 bp, Homo sapiens
cctgcaccaggcccagcatggt

SEQ ID NO: 7345395 - DNA, 22 bp, Homo sapiens
cctgcacctaacacaacgctct

SEQ ID NO: 7345396 - DNA, 22 bp, Homo sapiens
tggggtcctctcacttggaggg

SEQ ID NO: 7345397 - DNA, 17 bp, Homo sapiens
tggggtccccgatggtg

SEQ ID NO: 7345398 - DNA, 22 bp, Homo sapiens
cctgcaccacaaggcttcagag

SEQ ID NO: 7345399 - DNA, 23 bp, Homo sapiens
cctgcaaagaaacaagccacctg

SEQ ID NO: 7345400 - DNA, 22 bp, Homo sapiens
tgggggtggttcttgcctccag

SEQ ID NO: 7345401 - DNA, 22 bp, Homo sapiens
tgggggtggttcttgcctccag

SEQ ID NO: 7345402 - DNA, 21 bp, Homo sapiens
tgggggagaattggttgcttt

SEQ ID NO: 7345403 - DNA, 21 bp, Homo sapiens
tgggggagaattggttgcttt

SEQ ID NO: 7345404 - DNA, 22 bp, Homo sapiens
tgggggagagaggcattctttc

SEQ ID NO: 7345405 - DNA, 22 bp, Homo sapiens
cctgaggtcagcggttcccaca

SEQ ID NO: 7345406 - DNA, 22 bp, Homo sapiens
cctgaggtcatgcatttccaac

SEQ ID NO: 7345407 - DNA, 22 bp, Homo sapiens
tgggggtgtgccagggacctcc

SEQ ID NO: 7345408 - DNA, 22 bp, Homo sapiens
tgggggtgtcctggtgcacaca

SEQ ID NO: 7345409 - DNA, 22 bp, Homo sapiens
tggggtccagtgccaccccaag

SEQ ID NO: 7345410 - DNA, 22 bp, Homo sapiens
tggggtccagtgcctggcaagg

SEQ ID NO: 7345411 - DNA, 22 bp, Homo sapiens
tggggtcccaactctgattgat

SEQ ID NO: 7345412 - DNA, 22 bp, Homo sapiens
tggggtcccactcagctcccct

SEQ ID NO: 7345413 - DNA, 23 bp, Homo sapiens
cctgaagggtcagggtcctcagc

SEQ ID NO: 7345414 - DNA, 22 bp, Homo sapiens
cctgaaaatcaaggtagtttgg

SEQ ID NO: 7345415 - DNA, 22 bp, Homo sapiens
cctcttctgagtgagactccct

SEQ ID NO: 7345416 - DNA, 22 bp, Homo sapiens
cctctggctcacagcaccaact

SEQ ID NO: 7345417 - DNA, 22 bp, Homo sapiens
cctctggccagagaaaggccag

SEQ ID NO: 7345418 - DNA, 22 bp, Homo sapiens
cctctggcctaggccgggagag

SEQ ID NO: 7345419 - DNA, 22 bp, Homo sapiens
tgggccagaagtatgcatgttt

SEQ ID NO: 7345420 - DNA, 22 bp, Homo sapiens
tgggccacttgaaagtggatgt

SEQ ID NO: 7345421 - DNA, 22 bp, Homo sapiens
tgggccagaggcatggagctat

SEQ ID NO: 7345422 - DNA, 21 bp, Homo sapiens
tgggagagcgttgctgtcctc

SEQ ID NO: 7345423 - DNA, 21 bp, Homo sapiens
tggctctgaaagagtgctgca

SEQ ID NO: 7345424 - DNA, 21 bp, Homo sapiens
tggctctgaaagagtgctgca

SEQ ID NO: 7345425 - DNA, 22 bp, Homo sapiens
cctccctgccggctggactagt

SEQ ID NO: 7345426 - DNA, 22 bp, Homo sapiens
cctccctgcgctcctgcggcgg

SEQ ID NO: 7345427 - DNA, 22 bp, Homo sapiens
cctccctgctcctcaactggca

SEQ ID NO: 7345428 - DNA, 22 bp, Homo sapiens
cctctggcaacttcacagccca

SEQ ID NO: 7345429 - DNA, 22 bp, Homo sapiens
cctctggcatagcaagtggcct

SEQ ID NO: 7345430 - DNA, 22 bp, Homo sapiens
tgggagcctggcaggccagagg

SEQ ID NO: 7345431 - DNA, 22 bp, Homo sapiens
tggaggtactcaggcacagagt

SEQ ID NO: 7345432 - DNA, 19 bp, Homo sapiens
tggaggggtttgaatgtgg

SEQ ID NO: 7345433 - DNA, 19 bp, Homo sapiens
tggaggggtttgaatgtgg

SEQ ID NO: 7345434 - DNA, 19 bp, Homo sapiens
tggaggggtttgaatgtgg

SEQ ID NO: 7345435 - DNA, 22 bp, Homo sapiens
tggaggtacataatgagagggt

SEQ ID NO: 7345436 - DNA, 22 bp, Homo sapiens
tggaggggcaatggagcgcgga

SEQ ID NO: 7345437 - DNA, 22 bp, Homo sapiens
tggaggggcaatggagcgcgga

SEQ ID NO: 7345438 - DNA, 22 bp, Homo sapiens
tggaggggcaatggagcgcgga

SEQ ID NO: 7345439 - DNA, 22 bp, Homo sapiens
tggaggtgagtgtggtacagca

SEQ ID NO: 7345440 - DNA, 22 bp, Homo sapiens
ccctggagctagtctgagcaga

SEQ ID NO: 7345441 - DNA, 22 bp, Homo sapiens
ccctggagctgcttgcatgttg

SEQ ID NO: 7345442 - DNA, 22 bp, Homo sapiens
tggaggccagaggtactgggac

SEQ ID NO: 7345443 - DNA, 22 bp, Homo sapiens
ccctgctcttctgactcaagct

SEQ ID NO: 7345444 - DNA, 22 bp, Homo sapiens
ccctgccttgtctgggctaggt

SEQ ID NO: 7345445 - DNA, 22 bp, Homo sapiens
ccctgccttggggtccacaccg

SEQ ID NO: 7345446 - DNA, 22 bp, Homo sapiens
ccctgccttcttggcctttaaa

SEQ ID NO: 7345447 - DNA, 23 bp, Homo sapiens
tggacagtagggtagacagtgcc

SEQ ID NO: 7345448 - DNA, 22 bp, Homo sapiens
tggacagtattgtgaagcaggc

SEQ ID NO: 7345449 - DNA, 22 bp, Homo sapiens
tggacagtgcagatacagaatg

SEQ ID NO: 7345450 - DNA, 22 bp, Homo sapiens
tggacagtaggaagagtgtggg

SEQ ID NO: 7345451 - DNA, 22 bp, Homo sapiens
tggacaggttgagtaggaggag

SEQ ID NO: 7345452 - DNA, 22 bp, Homo sapiens
ccctgcctctgaagctgctcag

SEQ ID NO: 7345453 - DNA, 22 bp, Homo sapiens
ccctgcctgtgggcatcaacat

SEQ ID NO: 7345454 - DNA, 22 bp, Homo sapiens
tggacaggtgcacacagcagcc

SEQ ID NO: 7345455 - DNA, 22 bp, Homo sapiens
tggacaggtgcacacagcagcc

SEQ ID NO: 7345456 - DNA, 22 bp, Homo sapiens
tggaagggaacaggtgggtgtt

SEQ ID NO: 7345457 - DNA, 21 bp, Homo sapiens
tggaagggaagtcttggttgt

SEQ ID NO: 7345458 - DNA, 22 bp, Homo sapiens
tgcctgctccagtcctgtccac

SEQ ID NO: 7345459 - DNA, 21 bp, Homo sapiens
tgctttctaaaaatactattg

SEQ ID NO: 7345460 - DNA, 22 bp, Homo sapiens
tgcctcagtttctccatatgaa

SEQ ID NO: 7345461 - DNA, 22 bp, Homo sapiens
tgcctcagtttcatctgcagaa

SEQ ID NO: 7345462 - DNA, 22 bp, Homo sapiens
tgcctcataacactcctggagt

SEQ ID NO: 7345463 - DNA, 23 bp, Homo sapiens
tgcctccaccgagggccaggcat

SEQ ID NO: 7345464 - DNA, 22 bp, Homo sapiens
tgcctgcctctggcagccctgc

SEQ ID NO: 7345465 - DNA, 22 bp, Homo sapiens
tgcctgccctttccacacagcc

SEQ ID NO: 7345466 - DNA, 22 bp, Homo sapiens
tgcctgccgctgtctagtactg

SEQ ID NO: 7345467 - DNA, 22 bp, Homo sapiens
tggaagaataggatagaagaac

SEQ ID NO: 7345468 - DNA, 22 bp, Homo sapiens
tggaagaatgtttgccttataa

SEQ ID NO: 7345469 - DNA, 22 bp, Homo sapiens
tggaagaatgctccacagggaa

SEQ ID NO: 7345470 - DNA, 22 bp, Homo sapiens
tggaagaatttggggataaatt

SEQ ID NO: 7345471 - DNA, 22 bp, Homo sapiens
tggaaggcatgggaactgttct

SEQ ID NO: 7345472 - DNA, 22 bp, Homo sapiens
tggaaggcatttcacacaggat

SEQ ID NO: 7345473 - DNA, 19 bp, Homo sapiens
tggaaggctaagacacttg

SEQ ID NO: 7345474 - DNA, 22 bp, Homo sapiens
tggaaggcttcatatgtaaaga

SEQ ID NO: 7345475 - DNA, 22 bp, Homo sapiens
tggaagggaaagtttggggtcc

SEQ ID NO: 7345476 - DNA, 22 bp, Homo sapiens
ccgtcccctctgaccttgctga

SEQ ID NO: 7345477 - DNA, 22 bp, Homo sapiens
ccgtctgcagcctccaggagtt

SEQ ID NO: 7345478 - DNA, 22 bp, Homo sapiens
ccgtccccagccacctgctgat

SEQ ID NO: 7345479 - DNA, 22 bp, Homo sapiens
ccgtggtcacctgagctccttg

SEQ ID NO: 7345480 - DNA, 22 bp, Homo sapiens
ccgtggtcacctgagctccttg

SEQ ID NO: 7345481 - DNA, 22 bp, Homo sapiens
ccggggtgcgaggagcgtcttt

SEQ ID NO: 7345482 - DNA, 22 bp, Homo sapiens
ccggggacttaaagtgaaggaa

SEQ ID NO: 7345483 - DNA, 22 bp, Homo sapiens
ccgggtggggactccaggtttc

SEQ ID NO: 7345484 - DNA, 22 bp, Homo sapiens
ccgggccccacggtgacctcag

SEQ ID NO: 7345485 - DNA, 22 bp, Homo sapiens
ccgggccgccccgcgtttctta

SEQ ID NO: 7345486 - DNA, 22 bp, Homo sapiens
ccgggcctcgggacaccgggta

SEQ ID NO: 7345487 - DNA, 22 bp, Homo sapiens
ccgggcgggggctctcgtcacc

SEQ ID NO: 7345488 - DNA, 22 bp, Homo sapiens
cctcacagggccaggcccctca

SEQ ID NO: 7345489 - DNA, 22 bp, Homo sapiens
cctcacccactacactcaaggg

SEQ ID NO: 7345490 - DNA, 22 bp, Homo sapiens
cctcacccagtcacctaggtgg

SEQ ID NO: 7345491 - DNA, 22 bp, Homo sapiens
cctcacagcctcatgcccagcc

SEQ ID NO: 7345492 - DNA, 22 bp, Homo sapiens
cctcacagcttgggcaaacggc

SEQ ID NO: 7345493 - DNA, 17 bp, Homo sapiens
cctcacagggaccagac

SEQ ID NO: 7345494 - DNA, 20 bp, Homo sapiens
cctcacagggcagagagggg

SEQ ID NO: 7345495 - DNA, 17 bp, Homo sapiens
cctcacagggaccagac

SEQ ID NO: 7345496 - DNA, 20 bp, Homo sapiens
cctcacagggcagagagggg

SEQ ID NO: 7345497 - DNA, 22 bp, Homo sapiens
cctatgttcttggcaagcagca

SEQ ID NO: 7345498 - DNA, 21 bp, Homo sapiens
cctattgaatataggaagatt

SEQ ID NO: 7345499 - DNA, 22 bp, Homo sapiens
cctattgacaattctcttctcc

SEQ ID NO: 7345500 - DNA, 22 bp, Homo sapiens
cctcacagcccttggcccagga

SEQ ID NO: 7345501 - DNA, 22 bp, Homo sapiens
cctcacagagcccagatgtcta

SEQ ID NO: 7345502 - DNA, 22 bp, Homo sapiens
cctcacagaggggcagccatct

SEQ ID NO: 7345503 - DNA, 22 bp, Homo sapiens
ccctgtcctgctaggccctggt

SEQ ID NO: 7345504 - DNA, 22 bp, Homo sapiens
ccctggtgccctgggtcagcct

SEQ ID NO: 7345505 - DNA, 22 bp, Homo sapiens
ccctgtgagcggctggatgcct

SEQ ID NO: 7345506 - DNA, 22 bp, Homo sapiens
ccctgtgcagatggcagctggg

SEQ ID NO: 7345507 - DNA, 22 bp, Homo sapiens
ccctgtgcacacacttcactct

SEQ ID NO: 7345508 - DNA, 22 bp, Homo sapiens
ccctgtgcctagttggcctaaa

SEQ ID NO: 7345509 - DNA, 22 bp, Homo sapiens
ccctgtgccagagaggcaggag

SEQ ID NO: 7345510 - DNA, 22 bp, Homo sapiens
ccgccgtgtcgacaggccctgg

SEQ ID NO: 7345511 - DNA, 22 bp, Homo sapiens
ccgcgaggtggaggttgcagtg

SEQ ID NO: 7345512 - DNA, 22 bp, Homo sapiens
ccctttcattggcagagctctc

SEQ ID NO: 7345513 - DNA, 22 bp, Homo sapiens
ccgcggggtcatggctgggccg

SEQ ID NO: 7345514 - DNA, 22 bp, Homo sapiens
ccgcggggtcatggctgggccg

SEQ ID NO: 7345515 - DNA, 22 bp, Homo sapiens
ccgcggggcgtgggctcttacc

SEQ ID NO: 7345516 - DNA, 22 bp, Homo sapiens
cctcagccttggccccaggcag

SEQ ID NO: 7345517 - DNA, 22 bp, Homo sapiens
cctcagcccctgaatggagaga

SEQ ID NO: 7345518 - DNA, 22 bp, Homo sapiens
tggccctgcttatgtctctctt

SEQ ID NO: 7345519 - DNA, 22 bp, Homo sapiens
tggcctcaccactagctgggtg

SEQ ID NO: 7345520 - DNA, 22 bp, Homo sapiens
tggcctcagatttcaggggtgg

SEQ ID NO: 7345521 - DNA, 22 bp, Homo sapiens
cctcacctcagtctgggcctca

SEQ ID NO: 7345522 - DNA, 22 bp, Homo sapiens
cctcagaagactttagggaaga

SEQ ID NO: 7345523 - DNA, 22 bp, Homo sapiens
tggctagctgtgggctggaagc

SEQ ID NO: 7345524 - DNA, 22 bp, Homo sapiens
tggctcagccattcgtgttgcc

SEQ ID NO: 7345525 - DNA, 22 bp, Homo sapiens
tggctcagccagccctaggaac

SEQ ID NO: 7345526 - DNA, 22 bp, Homo sapiens
tggctcagcctggccctttcat

SEQ ID NO: 7345527 - DNA, 22 bp, Homo sapiens
tggctcagccattcgtgttgcc

SEQ ID NO: 7345528 - DNA, 22 bp, Homo sapiens
tggctcagcgcggcctggtctt

SEQ ID NO: 7345529 - DNA, 22 bp, Homo sapiens
tggctcagcctggccctttcat

SEQ ID NO: 7345530 - DNA, 23 bp, Homo sapiens
tggctcagctagttttccatttc

SEQ ID NO: 7345531 - DNA, 22 bp, Homo sapiens
tggctcagcgcggcctggtctt

SEQ ID NO: 7345532 - DNA, 22 bp, Homo sapiens
tggctcagcggtggcagcagac

SEQ ID NO: 7345533 - DNA, 22 bp, Homo sapiens
cctccccatgacccggtgctgg

SEQ ID NO: 7345534 - DNA, 22 bp, Homo sapiens
tggctcagctgactcggcttct

SEQ ID NO: 7345535 - DNA, 22 bp, Homo sapiens
tgaacaggagaaaggtttcttt

SEQ ID NO: 7345536 - DNA, 18 bp, Homo sapiens
tgaacagctgagactatc

SEQ ID NO: 7345537 - DNA, 22 bp, Homo sapiens
tgaacagctatcttgtcagtgt

SEQ ID NO: 7345538 - DNA, 22 bp, Homo sapiens
tgaacagatggcccagcagagg

SEQ ID NO: 7345539 - DNA, 20 bp, Homo sapiens
tgaacactggggtgtttcag

SEQ ID NO: 7345540 - DNA, 20 bp, Homo sapiens
tgaacactggggtgtttcag

SEQ ID NO: 7345541 - DNA, 22 bp, Homo sapiens
tgaacactgtccagagccatta

SEQ ID NO: 7345542 - DNA, 22 bp, Homo sapiens
tgaacactgccatatttaagaa

SEQ ID NO: 7345543 - DNA, 22 bp, Homo sapiens
tgaacaggtcttagtaggttct

SEQ ID NO: 7345544 - DNA, 22 bp, Homo sapiens
tgaagagatagaagtacatgct

SEQ ID NO: 7345545 - DNA, 22 bp, Homo sapiens
tgaaggaatgagtatactgttt

SEQ ID NO: 7345546 - DNA, 22 bp, Homo sapiens
tgaaggaatgagtatactgttt

SEQ ID NO: 7345547 - DNA, 22 bp, Homo sapiens
tgaaggaatggaggatcagagc

SEQ ID NO: 7345548 - DNA, 22 bp, Homo sapiens
tgaaggaatggaggatcagagc

SEQ ID NO: 7345549 - DNA, 22 bp, Homo sapiens
tgaaggagaaatggaaagtggg

SEQ ID NO: 7345550 - DNA, 17 bp, Homo sapiens
tgaaggaaggatgatgt

SEQ ID NO: 7345551 - DNA, 17 bp, Homo sapiens
tgaaggaaggatgatgt

SEQ ID NO: 7345552 - DNA, 22 bp, Homo sapiens
tgaaggaagaataggcagtgtt

SEQ ID NO: 7345553 - DNA, 22 bp, Homo sapiens
tgaaggaagaataggcagtgtt

SEQ ID NO: 7345554 - DNA, 22 bp, Homo sapiens
tgaaggaatgagggagtgggtc

SEQ ID NO: 7345555 - DNA, 22 bp, Homo sapiens
tgaaggaatgagggagtgggtc

SEQ ID NO: 7345556 - DNA, 22 bp, Homo sapiens
tgaaggaaatgacggcagaaga

SEQ ID NO: 7345557 - DNA, 22 bp, Homo sapiens
tgaaggaaatgacggcagaaga

SEQ ID NO: 7345558 - DNA, 22 bp, Homo sapiens
tgaaggaaagagggaacatccc

SEQ ID NO: 7345559 - DNA, 22 bp, Homo sapiens
tgaaggaaagagggaacatccc

SEQ ID NO: 7345560 - DNA, 22 bp, Homo sapiens
tgaacacataaaagcaaagggt

SEQ ID NO: 7345561 - DNA, 18 bp, Homo sapiens
tgaacacagtacaattcc

SEQ ID NO: 7345562 - DNA, 22 bp, Homo sapiens
ccaggctgccgaggaaagaaag

SEQ ID NO: 7345563 - DNA, 22 bp, Homo sapiens
ccaggctgctcacaagctgccc

SEQ ID NO: 7345564 - DNA, 22 bp, Homo sapiens
ccaggctgctcacaagctgccc

SEQ ID NO: 7345565 - DNA, 22 bp, Homo sapiens
ccaggctgccgaggaaagaaag

SEQ ID NO: 7345566 - DNA, 22 bp, Homo sapiens
ccaggctgcagtcaaggggcat

SEQ ID NO: 7345567 - DNA, 22 bp, Homo sapiens
ccaggctgcagtcaaggggcat

SEQ ID NO: 7345568 - DNA, 22 bp, Homo sapiens
tgaaagctttgggacagtgtga

SEQ ID NO: 7345569 - DNA, 20 bp, Homo sapiens
tgaaagcatgtggtatttgg

SEQ ID NO: 7345570 - DNA, 22 bp, Homo sapiens
tgaaagcatgcttgccaagctt

SEQ ID NO: 7345571 - DNA, 22 bp, Homo sapiens
tgaaagcattagtctaaggtag

SEQ ID NO: 7345572 - DNA, 22 bp, Homo sapiens
tgaaagcattagtctaaggtag

SEQ ID NO: 7345573 - DNA, 22 bp, Homo sapiens
tgaaagctgcccagtggaatta

SEQ ID NO: 7345574 - DNA, 22 bp, Homo sapiens
tgaaagctctgtcatcattcct

SEQ ID NO: 7345575 - DNA, 22 bp, Homo sapiens
tgaaagcatatgctaaagacca

SEQ ID NO: 7345576 - DNA, 22 bp, Homo sapiens
tgaaagcatatgctaaagacca

SEQ ID NO: 7345577 - DNA, 22 bp, Homo sapiens
tgaaagcagtgatttctccttc

SEQ ID NO: 7345578 - DNA, 22 bp, Homo sapiens
tgaaagcagtgccatgattatg

SEQ ID NO: 7345579 - DNA, 22 bp, Homo sapiens
tgaaagcagtgatttctccttc

SEQ ID NO: 7345580 - DNA, 22 bp, Homo sapiens
tgaaagcagcaccaataccatt

SEQ ID NO: 7345581 - DNA, 22 bp, Homo sapiens
tgaaagcaggcgggctacttta

SEQ ID NO: 7345582 - DNA, 22 bp, Homo sapiens
tgaaagcagatagctctgttgt

SEQ ID NO: 7345583 - DNA, 22 bp, Homo sapiens
tgaaacagctatcagtagactg

SEQ ID NO: 7345584 - DNA, 22 bp, Homo sapiens
tgaaacaggaagtaaacagaca

SEQ ID NO: 7345585 - DNA, 22 bp, Homo sapiens
ccaggctccgcatagaccccac

SEQ ID NO: 7345586 - DNA, 22 bp, Homo sapiens
ccaggctcctcatgatcttgtt

SEQ ID NO: 7345587 - DNA, 22 bp, Homo sapiens
ccaggctcctcatgatcttgtt

SEQ ID NO: 7345588 - DNA, 22 bp, Homo sapiens
tctttcaaagctgtagtagatt

SEQ ID NO: 7345589 - DNA, 22 bp, Homo sapiens
tctttcaaagcaaaatgaggct

SEQ ID NO: 7345590 - DNA, 19 bp, Homo sapiens
ccaggcctggcgtctccgc

SEQ ID NO: 7345591 - DNA, 22 bp, Homo sapiens
ccaggctcactgactaccacat

SEQ ID NO: 7345592 - DNA, 22 bp, Homo sapiens
ccaggctcagggcagactttca

SEQ ID NO: 7345593 - DNA, 22 bp, Homo sapiens
ccaggctcaggcctgctcgttg

SEQ ID NO: 7345594 - DNA, 17 bp, Homo sapiens
ccaggctccatcactgt

SEQ ID NO: 7345595 - DNA, 17 bp, Homo sapiens
ccaggctccatcactgt

SEQ ID NO: 7345596 - DNA, 22 bp, Homo sapiens
ccagcccttgctgaagggtggc

SEQ ID NO: 7345597 - DNA, 22 bp, Homo sapiens
ccagcccttgctgaagggtggc

SEQ ID NO: 7345598 - DNA, 22 bp, Homo sapiens
ccagccggactccacttcccgt

SEQ ID NO: 7345599 - DNA, 22 bp, Homo sapiens
ccagcccttgagatggaaggga

SEQ ID NO: 7345600 - DNA, 22 bp, Homo sapiens
tctgcagacaggaagctgaggc

SEQ ID NO: 7345601 - DNA, 22 bp, Homo sapiens
tcttgtgtggtggaagatatgg

SEQ ID NO: 7345602 - DNA, 22 bp, Homo sapiens
tcttgtttctgtatataatgac

SEQ ID NO: 7345603 - DNA, 22 bp, Homo sapiens
tcttgtctaggacagtgatgtg

SEQ ID NO: 7345604 - DNA, 22 bp, Homo sapiens
tcttgtctgcagatactttgaa

SEQ ID NO: 7345605 - DNA, 22 bp, Homo sapiens
tcttgtttggattttgggcagt

SEQ ID NO: 7345606 - DNA, 21 bp, Homo sapiens
ccagcctcagatcagggagct

SEQ ID NO: 7345607 - DNA, 22 bp, Homo sapiens
tgacagagcatgtagtgacagc

SEQ ID NO: 7345608 - DNA, 22 bp, Homo sapiens
tgacagaggcacccacaactat

SEQ ID NO: 7345609 - DNA, 22 bp, Homo sapiens
tgacagagatggaatgaatctt

SEQ ID NO: 7345610 - DNA, 22 bp, Homo sapiens
tgacagagtccagaagtagtgt

SEQ ID NO: 7345611 - DNA, 22 bp, Homo sapiens
tgacagagtccagaagtagtgt

SEQ ID NO: 7345612 - DNA, 22 bp, Homo sapiens
ccagggccaagagacctcgagg

SEQ ID NO: 7345613 - DNA, 22 bp, Homo sapiens
tgacaatgggtggacaagatag

SEQ ID NO: 7345614 - DNA, 22 bp, Homo sapiens
tgaaggagaattaataggcatt

SEQ ID NO: 7345615 - DNA, 22 bp, Homo sapiens
ccagggccagtaagattggcat

SEQ ID NO: 7345616 - DNA, 23 bp, Homo sapiens
ccagggcccctacaccactgtcc

SEQ ID NO: 7345617 - DNA, 22 bp, Homo sapiens
ccagggcccacggccagaatag

SEQ ID NO: 7345618 - DNA, 22 bp, Homo sapiens
tgaccacagacccaatgactac

SEQ ID NO: 7345619 - DNA, 22 bp, Homo sapiens
tgaccactgacctcagccctgg

SEQ ID NO: 7345620 - DNA, 22 bp, Homo sapiens
tgaccatttgatctacattcca

SEQ ID NO: 7345621 - DNA, 22 bp, Homo sapiens
tgagaaaacagtttgtaataat

SEQ ID NO: 7345622 - DNA, 22 bp, Homo sapiens
tgagaaaactcaaagacagatc

SEQ ID NO: 7345623 - DNA, 22 bp, Homo sapiens
tgagaaaactcaaagacagatc

SEQ ID NO: 7345624 - DNA, 22 bp, Homo sapiens
tgagcccaggagttggaggctg

SEQ ID NO: 7345625 - DNA, 22 bp, Homo sapiens
tgagcagaaaagaatgctgagc

SEQ ID NO: 7345626 - DNA, 22 bp, Homo sapiens
tgaggaatgctgagcagaggaa

SEQ ID NO: 7345627 - DNA, 22 bp, Homo sapiens
ccagggtggggtccaggaacca

SEQ ID NO: 7345628 - DNA, 22 bp, Homo sapiens
ccagggtgtgagaaggaagtag

SEQ ID NO: 7345629 - DNA, 22 bp, Homo sapiens
ccagggtgtgagaaggaagtag

SEQ ID NO: 7345630 - DNA, 22 bp, Homo sapiens
ccagggtgtagggattccagat

SEQ ID NO: 7345631 - DNA, 22 bp, Homo sapiens
ccagggtggcgtagatgctggg

SEQ ID NO: 7345632 - DNA, 22 bp, Homo sapiens
ccagggtggggcaggcccactg

SEQ ID NO: 7345633 - DNA, 22 bp, Homo sapiens
ccagggtgggaggctgaaggcg

SEQ ID NO: 7345634 - DNA, 22 bp, Homo sapiens
ccagggtgtgggcgtcggcacg

SEQ ID NO: 7345635 - DNA, 22 bp, Homo sapiens
tgagacttgtgagtccttctag

SEQ ID NO: 7345636 - DNA, 22 bp, Homo sapiens
tgagacttaagaggtcatgttg

SEQ ID NO: 7345637 - DNA, 22 bp, Homo sapiens
tgagacttcctgatgaggcccg

SEQ ID NO: 7345638 - DNA, 22 bp, Homo sapiens
tgagacttggcactgaggaact

SEQ ID NO: 7345639 - DNA, 22 bp, Homo sapiens
tgagagtggttcagctcagaag

SEQ ID NO: 7345640 - DNA, 18 bp, Homo sapiens
tgagagtgtgtgctcttg

SEQ ID NO: 7345641 - DNA, 22 bp, Homo sapiens
tgagagtgaaatgtcacatgtc

SEQ ID NO: 7345642 - DNA, 19 bp, Homo sapiens
tgagagtgaggaaggcttc

SEQ ID NO: 7345643 - DNA, 22 bp, Homo sapiens
tgagagtgattggttcgaatgt

SEQ ID NO: 7345644 - DNA, 22 bp, Homo sapiens
tgagagtctttaaattctgaga

SEQ ID NO: 7345645 - DNA, 22 bp, Homo sapiens
tgagagtctcagacctcctggt

SEQ ID NO: 7345646 - DNA, 23 bp, Homo sapiens
tgagcacctaatgctgggcactg

SEQ ID NO: 7345647 - DNA, 22 bp, Homo sapiens
tgagataactctgatttatgtt

SEQ ID NO: 7345648 - DNA, 22 bp, Homo sapiens
cccagctccgagctccgagccg

SEQ ID NO: 7345649 - DNA, 22 bp, Homo sapiens
cccaggaattggaggctgcagt

SEQ ID NO: 7345650 - DNA, 22 bp, Homo sapiens
tgcagtctggatgtcctcagat

SEQ ID NO: 7345651 - DNA, 22 bp, Homo sapiens
tgcagtggaagaggtggagatc

SEQ ID NO: 7345652 - DNA, 22 bp, Homo sapiens
tgcagtgatgcttctggctcag

SEQ ID NO: 7345653 - DNA, 22 bp, Homo sapiens
cccagctcatcaggagccgccc

SEQ ID NO: 7345654 - DNA, 22 bp, Homo sapiens
tgcagtggaatctggagagcag

SEQ ID NO: 7345655 - DNA, 20 bp, Homo sapiens
cccagcccgggccgcgctcg

SEQ ID NO: 7345656 - DNA, 22 bp, Homo sapiens
cccagcccccgagtgtctggaa

SEQ ID NO: 7345657 - DNA, 22 bp, Homo sapiens
cccagcccagcgttcgaggggt

SEQ ID NO: 7345658 - DNA, 18 bp, Homo sapiens
cccagcccaccatttctc

SEQ ID NO: 7345659 - DNA, 19 bp, Homo sapiens
cccagccaggtcttgcatc

SEQ ID NO: 7345660 - DNA, 22 bp, Homo sapiens
cccagccaaaagcaagtttacc

SEQ ID NO: 7345661 - DNA, 22 bp, Homo sapiens
cccagccaaggtgctggtgttg

SEQ ID NO: 7345662 - DNA, 22 bp, Homo sapiens
cccagccagcctcttcccatat

SEQ ID NO: 7345663 - DNA, 22 bp, Homo sapiens
cccagccaagtgatctgaccgc

SEQ ID NO: 7345664 - DNA, 22 bp, Homo sapiens
tgccctcattataagaggctca

SEQ ID NO: 7345665 - DNA, 22 bp, Homo sapiens
tgccctctgcctcctctgcaga

SEQ ID NO: 7345666 - DNA, 22 bp, Homo sapiens
tgccctctgcaggccgccatgg

SEQ ID NO: 7345667 - DNA, 20 bp, Homo sapiens
cccaggagtgagcagcttta

SEQ ID NO: 7345668 - DNA, 19 bp, Homo sapiens
cccaggagtctggctggtt

SEQ ID NO: 7345669 - DNA, 22 bp, Homo sapiens
tgccctggttctgtgggtgagc

SEQ ID NO: 7345670 - DNA, 23 bp, Homo sapiens
tgcctcagtggaatgtgagggtg

SEQ ID NO: 7345671 - DNA, 19 bp, Homo sapiens
cccaggagtctggctggtt

SEQ ID NO: 7345672 - DNA, 22 bp, Homo sapiens
cccaggaggcagagcttgcagt

SEQ ID NO: 7345673 - DNA, 22 bp, Homo sapiens
cccaggaggcagaggttggagc

SEQ ID NO: 7345674 - DNA, 22 bp, Homo sapiens
cccaggaggcctgcctggccgg

SEQ ID NO: 7345675 - DNA, 22 bp, Homo sapiens
cccaggagacagaaacagaggt

SEQ ID NO: 7345676 - DNA, 21 bp, Homo sapiens
cccaggaggagctccggctcc

SEQ ID NO: 7345677 - DNA, 22 bp, Homo sapiens
tgaggcagtcaccccctcctgc

SEQ ID NO: 7345678 - DNA, 22 bp, Homo sapiens
tgaggcagtattttagtgactt

SEQ ID NO: 7345679 - DNA, 22 bp, Homo sapiens
tgaggcaggtaagcaagttttg

SEQ ID NO: 7345680 - DNA, 22 bp, Homo sapiens
tgaggcagtattctccattcca

SEQ ID NO: 7345681 - DNA, 22 bp, Homo sapiens
tgaggcaggtggattacaaggt

SEQ ID NO: 7345682 - DNA, 22 bp, Homo sapiens
ccagtgtggtttaggataggga

SEQ ID NO: 7345683 - DNA, 23 bp, Homo sapiens
ccagtgtggtaggtccacaggtg

SEQ ID NO: 7345684 - DNA, 22 bp, Homo sapiens
tgaggcagtgatgtttaagcac

SEQ ID NO: 7345685 - DNA, 18 bp, Homo sapiens
tgaggcagtcagtgatgg

SEQ ID NO: 7345686 - DNA, 22 bp, Homo sapiens
tgatacataaaccatcattttg

SEQ ID NO: 7345687 - DNA, 22 bp, Homo sapiens
tgaggcagtgctgggaagcctg

SEQ ID NO: 7345688 - DNA, 22 bp, Homo sapiens
tgatacataaaccatcattttg

SEQ ID NO: 7345689 - DNA, 22 bp, Homo sapiens
tgatgactgccattctattact

SEQ ID NO: 7345690 - DNA, 19 bp, Homo sapiens
ccatggagagagatgcatt

SEQ ID NO: 7345691 - DNA, 22 bp, Homo sapiens
ccatggaagaactgatgtgcca

SEQ ID NO: 7345692 - DNA, 22 bp, Homo sapiens
cccaaccccaacttcctatgtt

SEQ ID NO: 7345693 - DNA, 21 bp, Homo sapiens
cccaacccatttccagttcat

SEQ ID NO: 7345694 - DNA, 23 bp, Homo sapiens
ccatggccaatgtcaagctacta

SEQ ID NO: 7345695 - DNA, 20 bp, Homo sapiens
ccatggccacatctgtgctg

SEQ ID NO: 7345696 - DNA, 22 bp, Homo sapiens
ccattgtagtatctgttttagt

SEQ ID NO: 7345697 - DNA, 22 bp, Homo sapiens
ccatttaacacagagttttcca

SEQ ID NO: 7345698 - DNA, 22 bp, Homo sapiens
ccatttttcataaactatccaa

SEQ ID NO: 7345699 - DNA, 22 bp, Homo sapiens
ccatttttcataaactatccaa

SEQ ID NO: 7345700 - DNA, 22 bp, Homo sapiens
cccagagaagtgaagtgacttg

SEQ ID NO: 7345701 - DNA, 22 bp, Homo sapiens
cccagagaaccttctgtgccac

SEQ ID NO: 7345702 - DNA, 22 bp, Homo sapiens
tgcagaggtttgtggtgttgct

SEQ ID NO: 7345703 - DNA, 22 bp, Homo sapiens
tgcagaggtttccaggcaagtt

SEQ ID NO: 7345704 - DNA, 22 bp, Homo sapiens
tgcagaggtttccaggcaagtt

SEQ ID NO: 7345705 - DNA, 22 bp, Homo sapiens
tgcagaggtttttaatacattt

SEQ ID NO: 7345706 - DNA, 22 bp, Homo sapiens
tgcagaggtttgtggtgttgct

SEQ ID NO: 7345707 - DNA, 22 bp, Homo sapiens
cccagcagaccgctgtgatggc

SEQ ID NO: 7345708 - DNA, 22 bp, Homo sapiens
cccagcagaatctgatgagggc

SEQ ID NO: 7345709 - DNA, 22 bp, Homo sapiens
cccacaggcaggggcagagaca

SEQ ID NO: 7345710 - DNA, 22 bp, Homo sapiens
cccacaggcaggtgcatgggct

SEQ ID NO: 7345711 - DNA, 22 bp, Homo sapiens
cccacaggctaggggtagggca

SEQ ID NO: 7345712 - DNA, 22 bp, Homo sapiens
tgcagagatagaactactttct

SEQ ID NO: 7345713 - DNA, 22 bp, Homo sapiens
cccacccagcctggctgagggg

SEQ ID NO: 7345714 - DNA, 22 bp, Homo sapiens
cccacccagctgagccgctcac

SEQ ID NO: 7345715 - DNA, 22 bp, Homo sapiens
cccacccagcctggctgagggg

SEQ ID NO: 7345716 - DNA, 23 bp, Homo sapiens
cccacatgtctgagtcagtgcca

SEQ ID NO: 7345717 - DNA, 23 bp, Homo sapiens
cccacatgtctgagtcagtgcca

SEQ ID NO: 7345718 - DNA, 22 bp, Homo sapiens
tgcagaggtgaaagactagcaa

SEQ ID NO: 7345719 - DNA, 22 bp, Homo sapiens
tgcagaggtttccaggcaagtt

SEQ ID NO: 7345720 - DNA, 22 bp, Homo sapiens
tgcagaggtgttgctgagataa

SEQ ID NO: 7345721 - DNA, 22 bp, Homo sapiens
tttgacagatccttaactcagc

SEQ ID NO: 7345722 - DNA, 22 bp, Homo sapiens
tttgacagatctcagagcattt

SEQ ID NO: 7345723 - DNA, 22 bp, Homo sapiens
tttgacagcagataaaataaaa

SEQ ID NO: 7345724 - DNA, 22 bp, Homo sapiens
tttgataagagctgctgaaact

SEQ ID NO: 7345725 - DNA, 22 bp, Homo sapiens
tttgatagttgattaaattcca

SEQ ID NO: 7345726 - DNA, 22 bp, Homo sapiens
tttgattctaagttctgtcaac

SEQ ID NO: 7345727 - DNA, 22 bp, Homo sapiens
tttgatttactataagcagcac

SEQ ID NO: 7345728 - DNA, 22 bp, Homo sapiens
tttgatgcatggatgtattttc

SEQ ID NO: 7345729 - DNA, 22 bp, Homo sapiens
tttgatttactggatattctca

SEQ ID NO: 7345730 - DNA, 22 bp, Homo sapiens
tttgtaaaagcccaagctgtag

SEQ ID NO: 7345731 - DNA, 22 bp, Homo sapiens
tttgtaaaagcccaagctgtag

SEQ ID NO: 7345732 - DNA, 22 bp, Homo sapiens
tttggtaagtcaggaatgcttc

SEQ ID NO: 7345733 - DNA, 22 bp, Homo sapiens
tttggaaagtgtgatttcaagg

SEQ ID NO: 7345734 - DNA, 22 bp, Homo sapiens
tttggaaagtgtacaaatttga

SEQ ID NO: 7345735 - DNA, 22 bp, Homo sapiens
tttggaaacacggtcatcttcc

SEQ ID NO: 7345736 - DNA, 22 bp, Homo sapiens
tttggaaaattttctaagtctg

SEQ ID NO: 7345737 - DNA, 22 bp, Homo sapiens
tttcctctgatgctgacttgga

SEQ ID NO: 7345738 - DNA, 22 bp, Homo sapiens
tttcctctgatgctgacttgga

SEQ ID NO: 7345739 - DNA, 22 bp, Homo sapiens
tttcctctgagtgagctgggag

SEQ ID NO: 7345740 - DNA, 22 bp, Homo sapiens
tttcctctgagtgagctgggag

SEQ ID NO: 7345741 - DNA, 22 bp, Homo sapiens
tttcctctgactgctcccctgc

SEQ ID NO: 7345742 - DNA, 22 bp, Homo sapiens
tttcctctgagtgagctgggag

SEQ ID NO: 7345743 - DNA, 22 bp, Homo sapiens
tttcctctgactgctcccctgc

SEQ ID NO: 7345744 - DNA, 22 bp, Homo sapiens
tttcctctgactgctcccctgc

SEQ ID NO: 7345745 - DNA, 22 bp, Homo sapiens
tttcctctccaccaggaggtct

SEQ ID NO: 7345746 - DNA, 22 bp, Homo sapiens
tttcctctccaccaggaggtct

SEQ ID NO: 7345747 - DNA, 22 bp, Homo sapiens
tttcctctccggggcctccagg

SEQ ID NO: 7345748 - DNA, 22 bp, Homo sapiens
tttcctctccggggcctccagg

SEQ ID NO: 7345749 - DNA, 22 bp, Homo sapiens
tttcctctccggggcctccagg

SEQ ID NO: 7345750 - DNA, 22 bp, Homo sapiens
tttcctctccggggcctccagg

SEQ ID NO: 7345751 - DNA, 22 bp, Homo sapiens
tttcctcctagcctccagccgc

SEQ ID NO: 7345752 - DNA, 22 bp, Homo sapiens
tttcctctaaacgcatttgctt

SEQ ID NO: 7345753 - DNA, 22 bp, Homo sapiens
tttcctcctagcctccagccgc

SEQ ID NO: 7345754 - DNA, 22 bp, Homo sapiens
tttcctctccaccaggaggtct

SEQ ID NO: 7345755 - DNA, 22 bp, Homo sapiens
tttcctctaaacgcatttgctt

SEQ ID NO: 7345756 - DNA, 22 bp, Homo sapiens
tttcccctcagtactaaacata

SEQ ID NO: 7345757 - DNA, 22 bp, Homo sapiens
tttcccctgaaagcaacctcct

SEQ ID NO: 7345758 - DNA, 22 bp, Homo sapiens
tttccctttagcctgagaatcc

SEQ ID NO: 7345759 - DNA, 22 bp, Homo sapiens
tttcctaacacaatgcatgaga

SEQ ID NO: 7345760 - DNA, 22 bp, Homo sapiens
tttcccttgttccttcctctga

SEQ ID NO: 7345761 - DNA, 22 bp, Homo sapiens
tttgacaacagcaaatgtcaca

SEQ ID NO: 7345762 - DNA, 22 bp, Homo sapiens
tttgacaaatccttcagcaatg

SEQ ID NO: 7345763 - DNA, 22 bp, Homo sapiens
tttgacaagagggcatcttcag

SEQ ID NO: 7345764 - DNA, 22 bp, Homo sapiens
tttgacaataattgcatttata

SEQ ID NO: 7345765 - DNA, 22 bp, Homo sapiens
tttgacagagctcttagtctct

SEQ ID NO: 7345766 - DNA, 22 bp, Homo sapiens
tttgacagaggttgtggtgtat

SEQ ID NO: 7345767 - DNA, 22 bp, Homo sapiens
tttgacagagttgtgaggattt

SEQ ID NO: 7345768 - DNA, 19 bp, Homo sapiens
tttgacagagtttgagcat

SEQ ID NO: 7345769 - DNA, 22 bp, Homo sapiens
tttgacagatagatgttatgtt

SEQ ID NO: 7345770 - DNA, 22 bp, Homo sapiens
tttgacagaaagttattatttt

SEQ ID NO: 7345771 - DNA, 22 bp, Homo sapiens
tttgacagacagtgctgggaca

SEQ ID NO: 7345772 - DNA, 22 bp, Homo sapiens
tttgacagacatttactacatt

SEQ ID NO: 7345773 - DNA, 22 bp, Homo sapiens
tttgaagataaatatggagaaa

SEQ ID NO: 7345774 - DNA, 22 bp, Homo sapiens
tttgaatctgatatggcagcat

SEQ ID NO: 7345775 - DNA, 22 bp, Homo sapiens
tttgaaagcctggcttttctct

SEQ ID NO: 7345776 - DNA, 21 bp, Homo sapiens
tttgaaagccctatgttttca

SEQ ID NO: 7345777 - DNA, 19 bp, Homo sapiens
tttgaaaggattgttattt

SEQ ID NO: 7345778 - DNA, 22 bp, Homo sapiens
ttttatgttgctataataggta

SEQ ID NO: 7345779 - DNA, 22 bp, Homo sapiens
ttttatgttcctctttatgcga

SEQ ID NO: 7345780 - DNA, 22 bp, Homo sapiens
ttttatgtgtcaaagcagtggt

SEQ ID NO: 7345781 - DNA, 22 bp, Homo sapiens
ttttatgtgtgaaatgctgtct

SEQ ID NO: 7345782 - DNA, 22 bp, Homo sapiens
ttttattgcaataaagtgtgta

SEQ ID NO: 7345783 - DNA, 22 bp, Homo sapiens
ttttcatgtgatgtgacatttc

SEQ ID NO: 7345784 - DNA, 22 bp, Homo sapiens
ttttcatggccaccgcaagtga

SEQ ID NO: 7345785 - DNA, 22 bp, Homo sapiens
ttttcattgtaaatcaggaaac

SEQ ID NO: 7345786 - DNA, 22 bp, Homo sapiens
ttttcatgttccttgttaagtg

SEQ ID NO: 7345787 - DNA, 22 bp, Homo sapiens
ttttcatgttccttgttaagtg

SEQ ID NO: 7345788 - DNA, 22 bp, Homo sapiens
ttttctcaagatccaatgcact

SEQ ID NO: 7345789 - DNA, 19 bp, Homo sapiens
ttttctcagcttctagcgg

SEQ ID NO: 7345790 - DNA, 22 bp, Homo sapiens
ttttctcaggtgcttatctaag

SEQ ID NO: 7345791 - DNA, 22 bp, Homo sapiens
ttttctcttgttaatgtactga

SEQ ID NO: 7345792 - DNA, 22 bp, Homo sapiens
ttttctgaagtttaagacattt

SEQ ID NO: 7345793 - DNA, 22 bp, Homo sapiens
ttttcatttttgtagatgcaag

SEQ ID NO: 7345794 - DNA, 22 bp, Homo sapiens
ttttctgtttgcttcaagacat

SEQ ID NO: 7345795 - DNA, 22 bp, Homo sapiens
ttttctgcctgcgtgtttagga

SEQ ID NO: 7345796 - DNA, 22 bp, Homo sapiens
ttttcttactgtctgtgatcct

SEQ ID NO: 7345797 - DNA, 22 bp, Homo sapiens
ttttcttaggtgctccaagtag

SEQ ID NO: 7345798 - DNA, 22 bp, Homo sapiens
ttttcttatggtgaagcacaaa

SEQ ID NO: 7345799 - DNA, 22 bp, Homo sapiens
ttttcttatgtgcagctatatg

SEQ ID NO: 7345800 - DNA, 22 bp, Homo sapiens
tttgtaaagtctgttctgagtt

SEQ ID NO: 7345801 - DNA, 22 bp, Homo sapiens
tttgtaaatagcagtactcatg

SEQ ID NO: 7345802 - DNA, 22 bp, Homo sapiens
tttgtaaaaggaggaagcatgg

SEQ ID NO: 7345803 - DNA, 22 bp, Homo sapiens
tttgtaaaggcctgaatttcag

SEQ ID NO: 7345804 - DNA, 22 bp, Homo sapiens
tttgtaaaggcctgaatttcag

SEQ ID NO: 7345805 - DNA, 22 bp, Homo sapiens
tttgtgtgtgctcacatagatg

SEQ ID NO: 7345806 - DNA, 22 bp, Homo sapiens
tttgtgtgtatatgtatataga

SEQ ID NO: 7345807 - DNA, 22 bp, Homo sapiens
tttgtaagcaagttaacatttt

SEQ ID NO: 7345808 - DNA, 22 bp, Homo sapiens
tttgttaagatgctgttctgct

SEQ ID NO: 7345809 - DNA, 22 bp, Homo sapiens
tttgttaaggagtattgcttct

SEQ ID NO: 7345810 - DNA, 22 bp, Homo sapiens
tttgttaaggagtattgcttct

SEQ ID NO: 7345811 - DNA, 22 bp, Homo sapiens
tttgttaattcttatgttagag

SEQ ID NO: 7345812 - DNA, 22 bp, Homo sapiens
tttgttcaacatcacttccacc

SEQ ID NO: 7345813 - DNA, 22 bp, Homo sapiens
tttgtgttttcactagcagtgt

SEQ ID NO: 7345814 - DNA, 22 bp, Homo sapiens
tttgtgtttgtacaatgcacta

SEQ ID NO: 7345815 - DNA, 22 bp, Homo sapiens
tttgttaaaatgcagattctgt

SEQ ID NO: 7345816 - DNA, 22 bp, Homo sapiens
ttttaatgggcgactattatgg

SEQ ID NO: 7345817 - DNA, 22 bp, Homo sapiens
ttttaatgtgctctgcaatgat

SEQ ID NO: 7345818 - DNA, 22 bp, Homo sapiens
ttttatgtaatccttactgtcg

SEQ ID NO: 7345819 - DNA, 20 bp, Homo sapiens
ttttatgtcaccttcctgtc

SEQ ID NO: 7345820 - DNA, 22 bp, Homo sapiens
ttttatgtaatccttactgtcg

SEQ ID NO: 7345821 - DNA, 21 bp, Homo sapiens
ttttaacaaggatttccctag

SEQ ID NO: 7345822 - DNA, 22 bp, Homo sapiens
ttttaaaggctgtatgaccaag

SEQ ID NO: 7345823 - DNA, 22 bp, Homo sapiens
ttttaacactcagcactatctc

SEQ ID NO: 7345824 - DNA, 22 bp, Homo sapiens
tttgttcacatgtcatgtacaa

SEQ ID NO: 7345825 - DNA, 22 bp, Homo sapiens
ttttaaaggatagctctggttg

SEQ ID NO: 7345826 - DNA, 22 bp, Homo sapiens
ttttaaaggatactcttgtcta

SEQ ID NO: 7345827 - DNA, 22 bp, Homo sapiens
ttttaaaggcagattatggctt

SEQ ID NO: 7345828 - DNA, 22 bp, Homo sapiens
ttttaaagagatgctgtgcata

SEQ ID NO: 7345829 - DNA, 22 bp, Homo sapiens
ttttaaaggatactcttgtcta

SEQ ID NO: 7345830 - DNA, 22 bp, Homo sapiens
tttttataccacctctcactta

SEQ ID NO: 7345831 - DNA, 22 bp, Homo sapiens
tttttataactcttttgtgaca

SEQ ID NO: 7345832 - DNA, 23 bp, Homo sapiens
tttttagttacacctctgccacc

SEQ ID NO: 7345833 - DNA, 23 bp, Homo sapiens
ttcatttaggagttcataagagc

SEQ ID NO: 7345834 - DNA, 22 bp, Homo sapiens
ttcatttagcatgctaaacctg

SEQ ID NO: 7345835 - DNA, 22 bp, Homo sapiens
ttcatttaatttgtgtattaac

SEQ ID NO: 7345836 - DNA, 22 bp, Homo sapiens
ttcatttgagtttatagttgct

SEQ ID NO: 7345837 - DNA, 22 bp, Homo sapiens
ttcatttattcagcaggtattt

SEQ ID NO: 7345838 - DNA, 22 bp, Homo sapiens
ttcagttttgcttttaatcatg

SEQ ID NO: 7345839 - DNA, 21 bp, Homo sapiens
ttcataaaccattctcatgca

SEQ ID NO: 7345840 - DNA, 22 bp, Homo sapiens
ttcagtttcaaatcctggatgc

SEQ ID NO: 7345841 - DNA, 22 bp, Homo sapiens
ttcagtttcaaatcctgtgaag

SEQ ID NO: 7345842 - DNA, 22 bp, Homo sapiens
ttcagttttctttagaatgtag

SEQ ID NO: 7345843 - DNA, 22 bp, Homo sapiens
ttcagttttattgtactgctat

SEQ ID NO: 7345844 - DNA, 22 bp, Homo sapiens
ttcagtttatacctgttgatta

SEQ ID NO: 7345845 - DNA, 22 bp, Homo sapiens
ttcagtttatacctgttgatta

SEQ ID NO: 7345846 - DNA, 22 bp, Homo sapiens
ttcatttgtggtgaatgaagtg

SEQ ID NO: 7345847 - DNA, 22 bp, Homo sapiens
ttcatttgtctgctatagatcc

SEQ ID NO: 7345848 - DNA, 20 bp, Homo sapiens
ttcatttgggaaaatctgcg

SEQ ID NO: 7345849 - DNA, 22 bp, Homo sapiens
ttcatttgggatgagtcagaag

SEQ ID NO: 7345850 - DNA, 22 bp, Homo sapiens
ttcatttgggatgagtcagaag

SEQ ID NO: 7345851 - DNA, 22 bp, Homo sapiens
ttcatttgtccaaatactatgt

SEQ ID NO: 7345852 - DNA, 19 bp, Homo sapiens
ttcatttgtatctgctcac

SEQ ID NO: 7345853 - DNA, 22 bp, Homo sapiens
ttcatttggcctctgcttaaaa

SEQ ID NO: 7345854 - DNA, 22 bp, Homo sapiens
ttccagtgaccatagagtatgg

SEQ ID NO: 7345855 - DNA, 22 bp, Homo sapiens
ttccagttaaggaagctattct

SEQ ID NO: 7345856 - DNA, 22 bp, Homo sapiens
ttccagttcccatgaggattaa

SEQ ID NO: 7345857 - DNA, 22 bp, Homo sapiens
ttccagttcactccatttctgg

SEQ ID NO: 7345858 - DNA, 22 bp, Homo sapiens
ttccagttcagatgcaacaggg

SEQ ID NO: 7345859 - DNA, 22 bp, Homo sapiens
ttccaggctcttccaggctgtc

SEQ ID NO: 7345860 - DNA, 22 bp, Homo sapiens
ttcacagggcagcagctgagcc

SEQ ID NO: 7345861 - DNA, 22 bp, Homo sapiens
ttcagacttaaaagatcccagc

SEQ ID NO: 7345862 - DNA, 22 bp, Homo sapiens
ttcagacttcttgactggcttt

SEQ ID NO: 7345863 - DNA, 22 bp, Homo sapiens
ttcagactttgtggggccctcc

SEQ ID NO: 7345864 - DNA, 22 bp, Homo sapiens
ttcagcaactgagtgtctttta

SEQ ID NO: 7345865 - DNA, 22 bp, Homo sapiens
ttcagcaagaatttactgagct

SEQ ID NO: 7345866 - DNA, 22 bp, Homo sapiens
ttcagcaagaccaccatgtacc

SEQ ID NO: 7345867 - DNA, 22 bp, Homo sapiens
ttcagcaacctataaatcccag

SEQ ID NO: 7345868 - DNA, 22 bp, Homo sapiens
ttcagcaactcaaacctattag

SEQ ID NO: 7345869 - DNA, 22 bp, Homo sapiens
ttcagcaaggcatgtgcaggag

SEQ ID NO: 7345870 - DNA, 21 bp, Homo sapiens
ttcagcaagcactctggacac

SEQ ID NO: 7345871 - DNA, 22 bp, Homo sapiens
ttcagcaagtgtctctactgtc

SEQ ID NO: 7345872 - DNA, 22 bp, Homo sapiens
ttcagcaatgacagcctatata

SEQ ID NO: 7345873 - DNA, 22 bp, Homo sapiens
ttcagcaatgggatggtgcagg

SEQ ID NO: 7345874 - DNA, 22 bp, Homo sapiens
ttcagcaaatggactgttcagg

SEQ ID NO: 7345875 - DNA, 22 bp, Homo sapiens
ttcagcaaatggcttgagataa

SEQ ID NO: 7345876 - DNA, 22 bp, Homo sapiens
ttcagcaacatttgttgagtgc

SEQ ID NO: 7345877 - DNA, 22 bp, Homo sapiens
ttcagcaaccagaaaggctggg

SEQ ID NO: 7345878 - DNA, 22 bp, Homo sapiens
ttcagagccagcaacactaggc

SEQ ID NO: 7345879 - DNA, 22 bp, Homo sapiens
ttcagtgtccctagtagaagtt

SEQ ID NO: 7345880 - DNA, 22 bp, Homo sapiens
ttcagcaattttttaagctaat

SEQ ID NO: 7345881 - DNA, 22 bp, Homo sapiens
ttcagcacaagactagacaggt

SEQ ID NO: 7345882 - DNA, 22 bp, Homo sapiens
ttcacagattgactggattcct

SEQ ID NO: 7345883 - DNA, 22 bp, Homo sapiens
ttcacagctaagagctaagtaa

SEQ ID NO: 7345884 - DNA, 22 bp, Homo sapiens
ttcacagctccttttactcaac

SEQ ID NO: 7345885 - DNA, 22 bp, Homo sapiens
ttcacagctccttttactcaac

SEQ ID NO: 7345886 - DNA, 19 bp, Homo sapiens
ttcacagctctgtgtcagt

SEQ ID NO: 7345887 - DNA, 22 bp, Homo sapiens
ttcacaatctggcttagcattg

SEQ ID NO: 7345888 - DNA, 22 bp, Homo sapiens
ttcacagagagaactcaaacca

SEQ ID NO: 7345889 - DNA, 22 bp, Homo sapiens
ttcaaagagaaattgtattttc

SEQ ID NO: 7345890 - DNA, 22 bp, Homo sapiens
ttcaaagagttgggtgtctggg

SEQ ID NO: 7345891 - DNA, 21 bp, Homo sapiens
ttcaaagagtgggcattgtca

SEQ ID NO: 7345892 - DNA, 22 bp, Homo sapiens
ttcaaagataatgtagcatttt

SEQ ID NO: 7345893 - DNA, 22 bp, Homo sapiens
ttattaggaaaaggtcagatgt

SEQ ID NO: 7345894 - DNA, 22 bp, Homo sapiens
ttattataatgagggataaaaa

SEQ ID NO: 7345895 - DNA, 22 bp, Homo sapiens
ttatatatcttgatttgttcca

SEQ ID NO: 7345896 - DNA, 22 bp, Homo sapiens
ttatatatatgtagaggtcacg

SEQ ID NO: 7345897 - DNA, 22 bp, Homo sapiens
ttattaagtgcctacaataaag

SEQ ID NO: 7345898 - DNA, 22 bp, Homo sapiens
ttattacaatgcagaaaataga

SEQ ID NO: 7345899 - DNA, 22 bp, Homo sapiens
ttattgttaggcttttggaatt

SEQ ID NO: 7345900 - DNA, 22 bp, Homo sapiens
ttcaaacagttgcacaacttat

SEQ ID NO: 7345901 - DNA, 22 bp, Homo sapiens
ttagctttggattgcatttagt

SEQ ID NO: 7345902 - DNA, 22 bp, Homo sapiens
ttagctttcttggagaattaca

SEQ ID NO: 7345903 - DNA, 22 bp, Homo sapiens
ttatagaatccagttgttgtat

SEQ ID NO: 7345904 - DNA, 22 bp, Homo sapiens
ttatagaaggagcattcactta

SEQ ID NO: 7345905 - DNA, 22 bp, Homo sapiens
ttatagaacggttctgtgcaaa

SEQ ID NO: 7345906 - DNA, 22 bp, Homo sapiens
ttatagaacagcctcctctaga

SEQ ID NO: 7345907 - DNA, 22 bp, Homo sapiens
ttatagaatggtggattttctg

SEQ ID NO: 7345908 - DNA, 22 bp, Homo sapiens
ttatataactcaggtgggctca

SEQ ID NO: 7345909 - DNA, 22 bp, Homo sapiens
ttatatactgtggtagtactgt

SEQ ID NO: 7345910 - DNA, 22 bp, Homo sapiens
ttatagttatgaaagactgagg

SEQ ID NO: 7345911 - DNA, 22 bp, Homo sapiens
ttatagttagtaggtcattaaa

SEQ ID NO: 7345912 - DNA, 22 bp, Homo sapiens
ttataggaatctgcatgtgtga

SEQ ID NO: 7345913 - DNA, 22 bp, Homo sapiens
ttagctctggattaagcagaaa

SEQ ID NO: 7345914 - DNA, 22 bp, Homo sapiens
ttagctgagtggtgctggctca

SEQ ID NO: 7345915 - DNA, 22 bp, Homo sapiens
tcctgctgctacctggcccacg

SEQ ID NO: 7345916 - DNA, 22 bp, Homo sapiens
ttcttcagactactgatgattg

SEQ ID NO: 7345917 - DNA, 22 bp, Homo sapiens
ttcttcaagggtaaaggcaacg

SEQ ID NO: 7345918 - DNA, 22 bp, Homo sapiens
ttcttcaaccatctacataaac

SEQ ID NO: 7345919 - DNA, 22 bp, Homo sapiens
ttcttttaatgtctggctttca

SEQ ID NO: 7345920 - DNA, 22 bp, Homo sapiens
ttctttgttgagcaagtaggac

SEQ ID NO: 7345921 - DNA, 22 bp, Homo sapiens
ttctttgtttgataagtatgct

SEQ ID NO: 7345922 - DNA, 22 bp, Homo sapiens
ttctttgtttgataagtatgct

SEQ ID NO: 7345923 - DNA, 22 bp, Homo sapiens
ttgaaaggcctgtttatccagc

SEQ ID NO: 7345924 - DNA, 22 bp, Homo sapiens
ttgaaaggcacaggcacctggg

SEQ ID NO: 7345925 - DNA, 22 bp, Homo sapiens
ttgaaagggatatatctttctg

SEQ ID NO: 7345926 - DNA, 22 bp, Homo sapiens
ttgaaatatttgggagtgtttg

SEQ ID NO: 7345927 - DNA, 22 bp, Homo sapiens
ttgaaatcaccactagcatttg

SEQ ID NO: 7345928 - DNA, 22 bp, Homo sapiens
ttgaaaggaatacagaggccta

SEQ ID NO: 7345929 - DNA, 22 bp, Homo sapiens
ttgaacattggcaatttcatat

SEQ ID NO: 7345930 - DNA, 22 bp, Homo sapiens
ttgaacattggcaatttcatat

SEQ ID NO: 7345931 - DNA, 22 bp, Homo sapiens
ttgaacattttctatgttatag

SEQ ID NO: 7345932 - DNA, 22 bp, Homo sapiens
ttgaacaatttggtatacaaac

SEQ ID NO: 7345933 - DNA, 22 bp, Homo sapiens
ttgaacagctgttacattgtta

SEQ ID NO: 7345934 - DNA, 22 bp, Homo sapiens
ttgaacagttttgtcaggttca

SEQ ID NO: 7345935 - DNA, 20 bp, Homo sapiens
ttgaaattggatggtagcta

SEQ ID NO: 7345936 - DNA, 22 bp, Homo sapiens
ttgaaatgtagtcctgccttca

SEQ ID NO: 7345937 - DNA, 22 bp, Homo sapiens
ttctgtgtcttcttgttctgtg

SEQ ID NO: 7345938 - DNA, 22 bp, Homo sapiens
ttctgtggtctcccatgtctgt

SEQ ID NO: 7345939 - DNA, 22 bp, Homo sapiens
ttctgtgcccattttaaaatgg

SEQ ID NO: 7345940 - DNA, 22 bp, Homo sapiens
ttctgtaagggatttattctga

SEQ ID NO: 7345941 - DNA, 22 bp, Homo sapiens
ttctgtctgtaaacttctcaat

SEQ ID NO: 7345942 - DNA, 22 bp, Homo sapiens
ttctggagctaaagtccactct

SEQ ID NO: 7345943 - DNA, 22 bp, Homo sapiens
ttctggagctctcgaccccact

SEQ ID NO: 7345944 - DNA, 22 bp, Homo sapiens
ttctggagccgggcctgggcag

SEQ ID NO: 7345945 - DNA, 22 bp, Homo sapiens
ttctggagccccaagatctgta

SEQ ID NO: 7345946 - DNA, 22 bp, Homo sapiens
ttctggagaggaacagaaaggt

SEQ ID NO: 7345947 - DNA, 22 bp, Homo sapiens
ttctggagatagtcaggcatta

SEQ ID NO: 7345948 - DNA, 22 bp, Homo sapiens
ttctggagatctgcctatggga

SEQ ID NO: 7345949 - DNA, 22 bp, Homo sapiens
ttctggagatgacttttagaaa

SEQ ID NO: 7345950 - DNA, 22 bp, Homo sapiens
ttctggagattgagaaggcatt

SEQ ID NO: 7345951 - DNA, 22 bp, Homo sapiens
ttctggaatcctcaaaacatga

SEQ ID NO: 7345952 - DNA, 22 bp, Homo sapiens
ttctggaatatttgacacaatt

SEQ ID NO: 7345953 - DNA, 22 bp, Homo sapiens
ttctggaattctggctatggta

SEQ ID NO: 7345954 - DNA, 22 bp, Homo sapiens
ttctggaatgcctgttctaatt

SEQ ID NO: 7345955 - DNA, 22 bp, Homo sapiens
ttctggaattcttgcagccact

SEQ ID NO: 7345956 - DNA, 22 bp, Homo sapiens
ttctggagaataatcagcattg

SEQ ID NO: 7345957 - DNA, 22 bp, Homo sapiens
ttctggagaatcaccaccaggc

SEQ ID NO: 7345958 - DNA, 22 bp, Homo sapiens
ttctggagaaaattctgtcatt

SEQ ID NO: 7345959 - DNA, 23 bp, Homo sapiens
ttctggagaaaggaccatagctt

SEQ ID NO: 7345960 - DNA, 22 bp, Homo sapiens
ttctggagacccagcaacaggg

SEQ ID NO: 7345961 - DNA, 22 bp, Homo sapiens
ttctggagagaaaccttacaaa

SEQ ID NO: 7345962 - DNA, 22 bp, Homo sapiens
ttctggagagaagaccagtgtg

SEQ ID NO: 7345963 - DNA, 22 bp, Homo sapiens
ttctggaagttggaaatagcag

SEQ ID NO: 7345964 - DNA, 22 bp, Homo sapiens
ttctggaagttttctcctgtgg

SEQ ID NO: 7345965 - DNA, 22 bp, Homo sapiens
ttctggaatactaagttccttt

SEQ ID NO: 7345966 - DNA, 22 bp, Homo sapiens
ttctggaagtggaatttttgta

SEQ ID NO: 7345967 - DNA, 22 bp, Homo sapiens
ttctggaagggtggagtagctt

SEQ ID NO: 7345968 - DNA, 22 bp, Homo sapiens
ttctggaagtgttagaatctgg

SEQ ID NO: 7345969 - DNA, 22 bp, Homo sapiens
ttctggaaatgttgctgaggcc

SEQ ID NO: 7345970 - DNA, 22 bp, Homo sapiens
ttctggaaatgggtatagagca

SEQ ID NO: 7345971 - DNA, 22 bp, Homo sapiens
ttctggaaatcagcagagggtg

SEQ ID NO: 7345972 - DNA, 22 bp, Homo sapiens
ttctggaaatgaatgctaggaa

SEQ ID NO: 7345973 - DNA, 22 bp, Homo sapiens
ttctggaaatgcacaactaatt

SEQ ID NO: 7345974 - DNA, 22 bp, Homo sapiens
ttctctggggactgtctctatt

SEQ ID NO: 7345975 - DNA, 22 bp, Homo sapiens
ttctcagattccccttttaata

SEQ ID NO: 7345976 - DNA, 22 bp, Homo sapiens
ttctcaggaactcagtgtcagc

SEQ ID NO: 7345977 - DNA, 22 bp, Homo sapiens
ttctccaagggatttctgcctt

SEQ ID NO: 7345978 - DNA, 22 bp, Homo sapiens
ttctccaaggatacagtcctgt

SEQ ID NO: 7345979 - DNA, 22 bp, Homo sapiens
ttctctaagagttatatgaatt

SEQ ID NO: 7345980 - DNA, 22 bp, Homo sapiens
ttctcctctgttggccttccct

SEQ ID NO: 7345981 - DNA, 22 bp, Homo sapiens
ttctcctctgttggccttccct

SEQ ID NO: 7345982 - DNA, 22 bp, Homo sapiens
ttctctaagctggctgaggtct

SEQ ID NO: 7345983 - DNA, 22 bp, Homo sapiens
ttctctctggacctgggatgcg

SEQ ID NO: 7345984 - DNA, 22 bp, Homo sapiens
ttctctcccatgaagcttctat

SEQ ID NO: 7345985 - DNA, 22 bp, Homo sapiens
ttctctcttccagttcccactt

SEQ ID NO: 7345986 - DNA, 22 bp, Homo sapiens
ttcctggaaattatgctcacct

SEQ ID NO: 7345987 - DNA, 17 bp, Homo sapiens
ttccagtttagtattgt

SEQ ID NO: 7345988 - DNA, 22 bp, Homo sapiens
ttccagtttgcagttgacacta

SEQ ID NO: 7345989 - DNA, 22 bp, Homo sapiens
ttccagttggcactgcaattta

SEQ ID NO: 7345990 - DNA, 22 bp, Homo sapiens
ttccagttcttctgtaagcact

SEQ ID NO: 7345991 - DNA, 19 bp, Homo sapiens
ttccagttctaatctcttc

SEQ ID NO: 7345992 - DNA, 22 bp, Homo sapiens
ttcctgaatcccaaggagagct

SEQ ID NO: 7345993 - DNA, 20 bp, Homo sapiens
ttccttggattgtgtcttga

SEQ ID NO: 7345994 - DNA, 22 bp, Homo sapiens
ttccttcttccagaggctgccc

SEQ ID NO: 7345995 - DNA, 22 bp, Homo sapiens
ttccttctggaggctccagggg

SEQ ID NO: 7345996 - DNA, 22 bp, Homo sapiens
ttccttctggaggctccagggg

SEQ ID NO: 7345997 - DNA, 22 bp, Homo sapiens
tttagcaagtatttactgacta

SEQ ID NO: 7345998 - DNA, 22 bp, Homo sapiens
tttagcaagtatttactgacta

SEQ ID NO: 7345999 - DNA, 22 bp, Homo sapiens
tttagagaccctctgctatttt

SEQ ID NO: 7346000 - DNA, 22 bp, Homo sapiens
tttagagacacactggcatttg

SEQ ID NO: 7346001 - DNA, 21 bp, Homo sapiens
tttagagaatactcactattt

SEQ ID NO: 7346002 - DNA, 22 bp, Homo sapiens
tttaccaaggcatagtaatctc

SEQ ID NO: 7346003 - DNA, 22 bp, Homo sapiens
tttaccaactgtagatctgcta

SEQ ID NO: 7346004 - DNA, 22 bp, Homo sapiens
tttagaagttcacacatttaaa

SEQ ID NO: 7346005 - DNA, 22 bp, Homo sapiens
tttagcaggcagggatgggtgt

SEQ ID NO: 7346006 - DNA, 22 bp, Homo sapiens
tttatatagagatttgtgcatg

SEQ ID NO: 7346007 - DNA, 22 bp, Homo sapiens
tttatatagagatttgtgcatg

SEQ ID NO: 7346008 - DNA, 22 bp, Homo sapiens
tttagcatcgaagtaaatttag

SEQ ID NO: 7346009 - DNA, 22 bp, Homo sapiens
tttatcatcttgtttttaaagc

SEQ ID NO: 7346010 - DNA, 23 bp, Homo sapiens
tttatccaactctgtaatctctc

SEQ ID NO: 7346011 - DNA, 22 bp, Homo sapiens
tttatccaagcacaatttctaa

SEQ ID NO: 7346012 - DNA, 20 bp, Homo sapiens
tttatcaggcacttactatt

SEQ ID NO: 7346013 - DNA, 21 bp, Homo sapiens
tttatcatcacgagcttgagc

SEQ ID NO: 7346014 - DNA, 22 bp, Homo sapiens
tttatcagaggctatgtttcat

SEQ ID NO: 7346015 - DNA, 20 bp, Homo sapiens
tttatcaggcacttactatt

SEQ ID NO: 7346016 - DNA, 22 bp, Homo sapiens
tttatccattcaccagttgaac

SEQ ID NO: 7346017 - DNA, 22 bp, Homo sapiens
tttatctattgtattgttgatg

SEQ ID NO: 7346018 - DNA, 22 bp, Homo sapiens
tttatccagcagctattcaaaa

SEQ ID NO: 7346019 - DNA, 22 bp, Homo sapiens
tttatctgagctgatagatagt

SEQ ID NO: 7346020 - DNA, 22 bp, Homo sapiens
tttattcaagatgaggttcatg

SEQ ID NO: 7346021 - DNA, 22 bp, Homo sapiens
tttaagcacagggataaagtta

SEQ ID NO: 7346022 - DNA, 19 bp, Homo sapiens
tttaagcaatagtatcttg

SEQ ID NO: 7346023 - DNA, 22 bp, Homo sapiens
tttaaggaggggctcacgtggg

SEQ ID NO: 7346024 - DNA, 22 bp, Homo sapiens
tttaaggaggggctcacgtggg

SEQ ID NO: 7346025 - DNA, 22 bp, Homo sapiens
tttaaggaaaaaatgtacttag

SEQ ID NO: 7346026 - DNA, 22 bp, Homo sapiens
tttaaggagctactcaccgtca

SEQ ID NO: 7346027 - DNA, 22 bp, Homo sapiens
tttaagcagagaaatgatgtat

SEQ ID NO: 7346028 - DNA, 22 bp, Homo sapiens
tttaaggatgtaaaggaagaag

SEQ ID NO: 7346029 - DNA, 22 bp, Homo sapiens
tttaaggatgtaaaggaagaag

SEQ ID NO: 7346030 - DNA, 22 bp, Homo sapiens
tttaaggattgtccatagtgtt

SEQ ID NO: 7346031 - DNA, 22 bp, Homo sapiens
tttaaggatgatgtgatatata

SEQ ID NO: 7346032 - DNA, 22 bp, Homo sapiens
tttaatctattccctaaacacc

SEQ ID NO: 7346033 - DNA, 22 bp, Homo sapiens
tttaatcttcaaaatagtctta

SEQ ID NO: 7346034 - DNA, 22 bp, Homo sapiens
tttaatcttcaaaatagtctta

SEQ ID NO: 7346035 - DNA, 22 bp, Homo sapiens
tttacagtcaccaaactttgct

SEQ ID NO: 7346036 - DNA, 22 bp, Homo sapiens
tttaatgaggtctctcgctggc

SEQ ID NO: 7346037 - DNA, 22 bp, Homo sapiens
tttaatgaggtctctcgctggc

SEQ ID NO: 7346038 - DNA, 22 bp, Homo sapiens
tttaatgatagtcttacgaaaa

SEQ ID NO: 7346039 - DNA, 22 bp, Homo sapiens
tttaagatggtattttataaag

SEQ ID NO: 7346040 - DNA, 22 bp, Homo sapiens
tttaagatggtattttataaag

SEQ ID NO: 7346041 - DNA, 22 bp, Homo sapiens
tttaaatgttcatgatactgaa

SEQ ID NO: 7346042 - DNA, 22 bp, Homo sapiens
tttaaagtgctgctcctatcct

SEQ ID NO: 7346043 - DNA, 22 bp, Homo sapiens
tttaaataggactcctgggggt

SEQ ID NO: 7346044 - DNA, 22 bp, Homo sapiens
tttaaagaaattcctcatcttt

SEQ ID NO: 7346045 - DNA, 21 bp, Homo sapiens
tttaaagaataggaagggagg

SEQ ID NO: 7346046 - DNA, 22 bp, Homo sapiens
tttaaagagaatgtgaaggagt

SEQ ID NO: 7346047 - DNA, 17 bp, Homo sapiens
tttaaactactacaagg

SEQ ID NO: 7346048 - DNA, 22 bp, Homo sapiens
tttaaactaacagtacacgttg

SEQ ID NO: 7346049 - DNA, 22 bp, Homo sapiens
ttgtgtgtagactcagccattg

SEQ ID NO: 7346050 - DNA, 22 bp, Homo sapiens
ttgtgtgtactggttatgggca

SEQ ID NO: 7346051 - DNA, 22 bp, Homo sapiens
ttgtgtgctgagggcctgctgt

SEQ ID NO: 7346052 - DNA, 22 bp, Homo sapiens
ttgtgtgcataaattctgatgt

SEQ ID NO: 7346053 - DNA, 17 bp, Homo sapiens
ttgtgtgtagttctgat

SEQ ID NO: 7346054 - DNA, 17 bp, Homo sapiens
ttgtgtgtagttctgat

SEQ ID NO: 7346055 - DNA, 22 bp, Homo sapiens
ttgtgtgtagactcagccattg

SEQ ID NO: 7346056 - DNA, 22 bp, Homo sapiens
tttaaacatcttgttgccttaa

SEQ ID NO: 7346057 - DNA, 22 bp, Homo sapiens
tttcaagagggaactgaacaca

SEQ ID NO: 7346058 - DNA, 22 bp, Homo sapiens
tttcaagacgttaagtcagctt

SEQ ID NO: 7346059 - DNA, 22 bp, Homo sapiens
tttcaagactcattgagtattg

SEQ ID NO: 7346060 - DNA, 22 bp, Homo sapiens
tttcaagactcattgagtattg

SEQ ID NO: 7346061 - DNA, 23 bp, Homo sapiens
tttcaacaggcagagaagactta

SEQ ID NO: 7346062 - DNA, 22 bp, Homo sapiens
tttcaacaggatgataataggc

SEQ ID NO: 7346063 - DNA, 17 bp, Homo sapiens
tttcaacatcactcagc

SEQ ID NO: 7346064 - DNA, 20 bp, Homo sapiens
tttcacaatgaacatgtctc

SEQ ID NO: 7346065 - DNA, 23 bp, Homo sapiens
tttcacaatgagcattacagaat

SEQ ID NO: 7346066 - DNA, 23 bp, Homo sapiens
tttcacaatgagcattacagaat

SEQ ID NO: 7346067 - DNA, 22 bp, Homo sapiens
tttcacagatgttttggagtct

SEQ ID NO: 7346068 - DNA, 22 bp, Homo sapiens
tttcacagatataagatttcac

SEQ ID NO: 7346069 - DNA, 22 bp, Homo sapiens
tttcacagagaaatataacagg

SEQ ID NO: 7346070 - DNA, 22 bp, Homo sapiens
tttcacagaactcactaaggag

SEQ ID NO: 7346071 - DNA, 22 bp, Homo sapiens
tttattgacccaaagcgagagt

SEQ ID NO: 7346072 - DNA, 22 bp, Homo sapiens
tttcaacagctctcaaatgatc

SEQ ID NO: 7346073 - DNA, 21 bp, Homo sapiens
tttattctcagatacagggag

SEQ ID NO: 7346074 - DNA, 22 bp, Homo sapiens
tttcccagttccctgctctata

SEQ ID NO: 7346075 - DNA, 22 bp, Homo sapiens
tttcccatcttagcagattaaa

SEQ ID NO: 7346076 - DNA, 22 bp, Homo sapiens
tttcatgtgcaattagcaatat

SEQ ID NO: 7346077 - DNA, 22 bp, Homo sapiens
tttcatgtacttttttgataga

SEQ ID NO: 7346078 - DNA, 22 bp, Homo sapiens
tttcatgtacttttttgataga

SEQ ID NO: 7346079 - DNA, 22 bp, Homo sapiens
tttcatgtacttttttgataga

SEQ ID NO: 7346080 - DNA, 22 bp, Homo sapiens
tttcatgtactgtcgaagttga

SEQ ID NO: 7346081 - DNA, 22 bp, Homo sapiens
tttcatgttacagtgtaaaagt

SEQ ID NO: 7346082 - DNA, 22 bp, Homo sapiens
tttcatgttacagtgtaaaagt

SEQ ID NO: 7346083 - DNA, 22 bp, Homo sapiens
tttcatgaggggcaaaatctca

SEQ ID NO: 7346084 - DNA, 22 bp, Homo sapiens
tttcatgagattcctccacatc

SEQ ID NO: 7346085 - DNA, 22 bp, Homo sapiens
tttcatgtaatcatttaggtgg

SEQ ID NO: 7346086 - DNA, 22 bp, Homo sapiens
tttcatgtaatcatttaggtgg

SEQ ID NO: 7346087 - DNA, 22 bp, Homo sapiens
tttcagagcctttatctctcta

SEQ ID NO: 7346088 - DNA, 22 bp, Homo sapiens
tttcagaaagcatcatcaaagt

SEQ ID NO: 7346089 - DNA, 22 bp, Homo sapiens
tttcagaaagcatcatcaaagt

SEQ ID NO: 7346090 - DNA, 22 bp, Homo sapiens
tttcactgttaggagtatgcta

SEQ ID NO: 7346091 - DNA, 22 bp, Homo sapiens
tttcagaaaacttatcatcagt

SEQ ID NO: 7346092 - DNA, 22 bp, Homo sapiens
tttcactcagctctcattgtct

SEQ ID NO: 7346093 - DNA, 22 bp, Homo sapiens
tttcacatttgttttaagaagt

SEQ ID NO: 7346094 - DNA, 22 bp, Homo sapiens
tttcacagcagaatttctgagg

SEQ ID NO: 7346095 - DNA, 18 bp, Homo sapiens
tttcacagattcatgact

SEQ ID NO: 7346096 - DNA, 22 bp, Homo sapiens
ttggacactgagactagcaagc

SEQ ID NO: 7346097 - DNA, 21 bp, Homo sapiens
ttggaacaagcagcagtttgc

SEQ ID NO: 7346098 - DNA, 22 bp, Homo sapiens
ttggaaattgcaagtgatttgc

SEQ ID NO: 7346099 - DNA, 22 bp, Homo sapiens
ttggaaatgcaaatatattgaa

SEQ ID NO: 7346100 - DNA, 22 bp, Homo sapiens
ttggaaatgcatttgttattat

SEQ ID NO: 7346101 - DNA, 22 bp, Homo sapiens
ttggaaagaagggctgagcaag

SEQ ID NO: 7346102 - DNA, 22 bp, Homo sapiens
ttggaaagcaacttttgagagt

SEQ ID NO: 7346103 - DNA, 22 bp, Homo sapiens
ttggaaagcaagctggacatac

SEQ ID NO: 7346104 - DNA, 22 bp, Homo sapiens
ttggaaagaccgaattcctgtt

SEQ ID NO: 7346105 - DNA, 22 bp, Homo sapiens
ttggaaagattattattatgaa

SEQ ID NO: 7346106 - DNA, 22 bp, Homo sapiens
ttggaaaggagattctattgtg

SEQ ID NO: 7346107 - DNA, 22 bp, Homo sapiens
ttggaaagcagccgcagccaat

SEQ ID NO: 7346108 - DNA, 22 bp, Homo sapiens
ttggaaagcccattatttggac

SEQ ID NO: 7346109 - DNA, 22 bp, Homo sapiens
ttggaaagcccattatttggac

SEQ ID NO: 7346110 - DNA, 22 bp, Homo sapiens
ttggaaaggagtttttagctat

SEQ ID NO: 7346111 - DNA, 22 bp, Homo sapiens
ttggaaagggaggaatgtagac

SEQ ID NO: 7346112 - DNA, 22 bp, Homo sapiens
ttggaaagtttttactgaagac

SEQ ID NO: 7346113 - DNA, 22 bp, Homo sapiens
ttggaaagtctcacccagttga

SEQ ID NO: 7346114 - DNA, 22 bp, Homo sapiens
ttggaaagtgacgttcaactgt

SEQ ID NO: 7346115 - DNA, 22 bp, Homo sapiens
ttggaaaggtgcttttgtctgt

SEQ ID NO: 7346116 - DNA, 22 bp, Homo sapiens
ttggaaagggatatctgtactt

SEQ ID NO: 7346117 - DNA, 22 bp, Homo sapiens
ttggaaaccaggctttgagacg

SEQ ID NO: 7346118 - DNA, 22 bp, Homo sapiens
ttggaaacaagatttctactta

SEQ ID NO: 7346119 - DNA, 22 bp, Homo sapiens
ttgcattgttgcaatgaagtat

SEQ ID NO: 7346120 - DNA, 22 bp, Homo sapiens
ttgcattgtgattacagaggtg

SEQ ID NO: 7346121 - DNA, 19 bp, Homo sapiens
ttgcattgtagttggactg

SEQ ID NO: 7346122 - DNA, 20 bp, Homo sapiens
ttgcattggatgtgcaggtg

SEQ ID NO: 7346123 - DNA, 22 bp, Homo sapiens
ttgcattgggagtgaggagacc

SEQ ID NO: 7346124 - DNA, 22 bp, Homo sapiens
ttgcattgtaggatgttagaag

SEQ ID NO: 7346125 - DNA, 22 bp, Homo sapiens
ttgcattgatgttccttcttgc

SEQ ID NO: 7346126 - DNA, 22 bp, Homo sapiens
ttgcattgcttggtcttcaaga

SEQ ID NO: 7346127 - DNA, 22 bp, Homo sapiens
ttgcattgatgtctatacgctg

SEQ ID NO: 7346128 - DNA, 22 bp, Homo sapiens
ttgcattgatcccagcttgggc

SEQ ID NO: 7346129 - DNA, 22 bp, Homo sapiens
ttgcattgaaaatatattttaa

SEQ ID NO: 7346130 - DNA, 22 bp, Homo sapiens
ttgcattgaatgcacattttta

SEQ ID NO: 7346131 - DNA, 22 bp, Homo sapiens
ttgctctccagaggctcacagc

SEQ ID NO: 7346132 - DNA, 22 bp, Homo sapiens
ttgcttaattctgaaaatatag

SEQ ID NO: 7346133 - DNA, 22 bp, Homo sapiens
ttgctgttttacatctggtggg

SEQ ID NO: 7346134 - DNA, 22 bp, Homo sapiens
ttgctgtttctctgtgtctggt

SEQ ID NO: 7346135 - DNA, 22 bp, Homo sapiens
ttgctgtttaatgatgtcttat

SEQ ID NO: 7346136 - DNA, 22 bp, Homo sapiens
ttgctgtgaaaccatgggaagt

SEQ ID NO: 7346137 - DNA, 22 bp, Homo sapiens
ttgctgtgtcatttgtttaatc

SEQ ID NO: 7346138 - DNA, 22 bp, Homo sapiens
ttgctgaaaggtagctgtgtgg

SEQ ID NO: 7346139 - DNA, 22 bp, Homo sapiens
ttgctgaaaggtagctgtgtgg

SEQ ID NO: 7346140 - DNA, 22 bp, Homo sapiens
ttgctgaaaacagtgggtattg

SEQ ID NO: 7346141 - DNA, 22 bp, Homo sapiens
ttgctgaaatctatgacatcct

SEQ ID NO: 7346142 - DNA, 22 bp, Homo sapiens
ttgcagggttgacactgcctgc

SEQ ID NO: 7346143 - DNA, 22 bp, Homo sapiens
ttgcagggttgaccaataggct

SEQ ID NO: 7346144 - DNA, 22 bp, Homo sapiens
ttgcagggcaggaccatggaca

SEQ ID NO: 7346145 - DNA, 22 bp, Homo sapiens
ttgcagggcatctatgtctggt

SEQ ID NO: 7346146 - DNA, 22 bp, Homo sapiens
ttgcagaattaagcagagagcc

SEQ ID NO: 7346147 - DNA, 23 bp, Homo sapiens
ttgcagaagcagacgaccataat

SEQ ID NO: 7346148 - DNA, 22 bp, Homo sapiens
ttgcagaagggcacagtgatca

SEQ ID NO: 7346149 - DNA, 22 bp, Homo sapiens
ttgcagaatacttattctgtat

SEQ ID NO: 7346150 - DNA, 22 bp, Homo sapiens
ttgcagaatacttattctgtat

SEQ ID NO: 7346151 - DNA, 22 bp, Homo sapiens
ttgcacaaaaaattgttgaata

SEQ ID NO: 7346152 - DNA, 22 bp, Homo sapiens
ttgacaggatataaagacataa

SEQ ID NO: 7346153 - DNA, 22 bp, Homo sapiens
ttgcaattgctatggagagcgt

SEQ ID NO: 7346154 - DNA, 22 bp, Homo sapiens
ttgacagagctaggtcaactct

SEQ ID NO: 7346155 - DNA, 22 bp, Homo sapiens
ttgacagaatgttacatataga

SEQ ID NO: 7346156 - DNA, 22 bp, Homo sapiens
ttgacagagaaaagtgtgactt

SEQ ID NO: 7346157 - DNA, 22 bp, Homo sapiens
ttgacagatgtgaaagtgagca

SEQ ID NO: 7346158 - DNA, 22 bp, Homo sapiens
ttgacagaaatgtatttgcatg

SEQ ID NO: 7346159 - DNA, 22 bp, Homo sapiens
ttgacaaaggaccttgctattt

SEQ ID NO: 7346160 - DNA, 22 bp, Homo sapiens
ttgacaaagatatattcatgct

SEQ ID NO: 7346161 - DNA, 22 bp, Homo sapiens
ttgacaatccctgttagaagtg

SEQ ID NO: 7346162 - DNA, 22 bp, Homo sapiens
ttgacaattgggagatataaag

SEQ ID NO: 7346163 - DNA, 22 bp, Homo sapiens
ttgacaatgcactgtgctaagt

SEQ ID NO: 7346164 - DNA, 22 bp, Homo sapiens
ttgacacagatcaatattcaac

SEQ ID NO: 7346165 - DNA, 22 bp, Homo sapiens
ttgtatttctccactttctgtt

SEQ ID NO: 7346166 - DNA, 22 bp, Homo sapiens
ttgtacataatgaaaggaggct

SEQ ID NO: 7346167 - DNA, 22 bp, Homo sapiens
ttgtacattctgaatctgtcct

SEQ ID NO: 7346168 - DNA, 22 bp, Homo sapiens
ttgtacatttgttcagttctga

SEQ ID NO: 7346169 - DNA, 22 bp, Homo sapiens
ttgtacattctatgggtttgga

SEQ ID NO: 7346170 - DNA, 22 bp, Homo sapiens
ttgtactatcaccatgtcatgt

SEQ ID NO: 7346171 - DNA, 22 bp, Homo sapiens
ttgtaacacttttctattaata

SEQ ID NO: 7346172 - DNA, 22 bp, Homo sapiens
ttgtaacacttttctattaata

SEQ ID NO: 7346173 - DNA, 22 bp, Homo sapiens
ttgtaacaatctgtcataaatg

SEQ ID NO: 7346174 - DNA, 22 bp, Homo sapiens
ttgtaacagctgcttaatagag

SEQ ID NO: 7346175 - DNA, 22 bp, Homo sapiens
ttgtaacagctgcttaatagag

SEQ ID NO: 7346176 - DNA, 22 bp, Homo sapiens
ttgtaacagtagctgtcagctc

SEQ ID NO: 7346177 - DNA, 22 bp, Homo sapiens
ttgtaagagagaattgcaaatt

SEQ ID NO: 7346178 - DNA, 22 bp, Homo sapiens
ttgtaaagggcatttgcacagt

SEQ ID NO: 7346179 - DNA, 22 bp, Homo sapiens
ttgtaaacttgtttgaaggtat

SEQ ID NO: 7346180 - DNA, 22 bp, Homo sapiens
ttgtccattgtgacaagtgtgg

SEQ ID NO: 7346181 - DNA, 22 bp, Homo sapiens
ttgtccctgcccctgcttgctt

SEQ ID NO: 7346182 - DNA, 22 bp, Homo sapiens
ttgtcccattgcgaatgtgagt

SEQ ID NO: 7346183 - DNA, 22 bp, Homo sapiens
ttgtcccttcagtaagagtgga

SEQ ID NO: 7346184 - DNA, 22 bp, Homo sapiens
ttgtcatatttataaaatgtaa

SEQ ID NO: 7346185 - DNA, 22 bp, Homo sapiens
ttgtcatgagtcacaaaaataa

SEQ ID NO: 7346186 - DNA, 22 bp, Homo sapiens
ttgtcatatttataaaatgtaa

SEQ ID NO: 7346187 - DNA, 22 bp, Homo sapiens
ttgtcatggatggaagggatat

SEQ ID NO: 7346188 - DNA, 22 bp, Homo sapiens
ttgtgggatctccctgttgctc

SEQ ID NO: 7346189 - DNA, 22 bp, Homo sapiens
ttgtgggatggctcttcccaaa

SEQ ID NO: 7346190 - DNA, 22 bp, Homo sapiens
ttgtgtattttttgatactaac

SEQ ID NO: 7346191 - DNA, 22 bp, Homo sapiens
ttgtgtatttcctgaaggtaag

SEQ ID NO: 7346192 - DNA, 20 bp, Homo sapiens
ttgtgtaggtctaatgcata

SEQ ID NO: 7346193 - DNA, 22 bp, Homo sapiens
ttgggcaggtgtggctctcctt

SEQ ID NO: 7346194 - DNA, 22 bp, Homo sapiens
ttgggcaggtgaagagagggct

SEQ ID NO: 7346195 - DNA, 22 bp, Homo sapiens
ttgggcaggtgaagagagggct

SEQ ID NO: 7346196 - DNA, 22 bp, Homo sapiens
ttgggcagggaaaggacaggca

SEQ ID NO: 7346197 - DNA, 22 bp, Homo sapiens
ttgggcagtgattagttcatga

SEQ ID NO: 7346198 - DNA, 22 bp, Homo sapiens
ttgggcagtgattagttcatga

SEQ ID NO: 7346199 - DNA, 22 bp, Homo sapiens
ttgggcagtctggctgcagagt

SEQ ID NO: 7346200 - DNA, 22 bp, Homo sapiens
ttgggcagtagcctcttggtgt

SEQ ID NO: 7346201 - DNA, 22 bp, Homo sapiens
ttgggcagtctggctgcagagt

SEQ ID NO: 7346202 - DNA, 22 bp, Homo sapiens
ttgggaaggcgtggaagcagaa

SEQ ID NO: 7346203 - DNA, 22 bp, Homo sapiens
ttgggaaggcgtggaagcagaa

SEQ ID NO: 7346204 - DNA, 22 bp, Homo sapiens
ttggccatctaagcccagccac

SEQ ID NO: 7346205 - DNA, 22 bp, Homo sapiens
ttgggaagtttaatgacagact

SEQ ID NO: 7346206 - DNA, 22 bp, Homo sapiens
ttggaggaggcattggaggatt

SEQ ID NO: 7346207 - DNA, 22 bp, Homo sapiens
ttggaggactagttaagagacc

SEQ ID NO: 7346208 - DNA, 22 bp, Homo sapiens
ttggaggaagctcatgggggat

SEQ ID NO: 7346209 - DNA, 22 bp, Homo sapiens
ttggagctaccaggaagggctg

SEQ ID NO: 7346210 - DNA, 19 bp, Homo sapiens
ttggcagctgagatcctgc

SEQ ID NO: 7346211 - DNA, 22 bp, Homo sapiens
ttggcagtcaccatcgtgtaga

SEQ ID NO: 7346212 - DNA, 22 bp, Homo sapiens
ttggcagtcagtcttggtgctt

SEQ ID NO: 7346213 - DNA, 20 bp, Homo sapiens
ttggcagttaagaatcttac

SEQ ID NO: 7346214 - DNA, 22 bp, Homo sapiens
ttggcagtgatgcagcttgttc

SEQ ID NO: 7346215 - DNA, 22 bp, Homo sapiens
ttggagatgtaaaattcagaga

SEQ ID NO: 7346216 - DNA, 22 bp, Homo sapiens
ttggagatatcacaccttcaca

SEQ ID NO: 7346217 - DNA, 22 bp, Homo sapiens
ttggactcaaaaggagatttac

SEQ ID NO: 7346218 - DNA, 22 bp, Homo sapiens
ttggactcatgatcacttcggg

SEQ ID NO: 7346219 - DNA, 22 bp, Homo sapiens
ttggactcctctttcctcttgg

SEQ ID NO: 7346220 - DNA, 22 bp, Homo sapiens
ttggactctgggattctggatt

SEQ ID NO: 7346221 - DNA, 22 bp, Homo sapiens
gtaaacatgctgtgtactcagc

SEQ ID NO: 7346222 - DNA, 22 bp, Homo sapiens
gtaaacatcagccactctattt

SEQ ID NO: 7346223 - DNA, 22 bp, Homo sapiens
gtaaacatcgacccaacagggg

SEQ ID NO: 7346224 - DNA, 22 bp, Homo sapiens
ggtgtgcatggcacagggcttg

SEQ ID NO: 7346225 - DNA, 22 bp, Homo sapiens
ggtgtgaattggcatggtgctt

SEQ ID NO: 7346226 - DNA, 22 bp, Homo sapiens
gtaagacatagatttctcatga

SEQ ID NO: 7346227 - DNA, 22 bp, Homo sapiens
gtaagatttaaaatagcaattg

SEQ ID NO: 7346228 - DNA, 22 bp, Homo sapiens
gtaagatttaaaatagcaattg

SEQ ID NO: 7346229 - DNA, 22 bp, Homo sapiens
ggtgtccttgctccttcagctt

SEQ ID NO: 7346230 - DNA, 22 bp, Homo sapiens
cagcagacttactagaatgtaa

SEQ ID NO: 7346231 - DNA, 22 bp, Homo sapiens
cagcagactggagtaggcagtg

SEQ ID NO: 7346232 - DNA, 22 bp, Homo sapiens
cagcagactggagtaggcagtg

SEQ ID NO: 7346233 - DNA, 22 bp, Homo sapiens
cagatggaacacagaaaggaga

SEQ ID NO: 7346234 - DNA, 22 bp, Homo sapiens
cagatggagtcccgtggagttc

SEQ ID NO: 7346235 - DNA, 22 bp, Homo sapiens
ggtggcagtagcactgggcctg

SEQ ID NO: 7346236 - DNA, 22 bp, Homo sapiens
ggtggcagggagtgtccctggg

SEQ ID NO: 7346237 - DNA, 22 bp, Homo sapiens
ggtggcagtgcttgcgggtcta

SEQ ID NO: 7346238 - DNA, 22 bp, Homo sapiens
cagatgcttcgtgggtgagcac

SEQ ID NO: 7346239 - DNA, 22 bp, Homo sapiens
cagatgcttcgtgggtgagcac

SEQ ID NO: 7346240 - DNA, 22 bp, Homo sapiens
ggtgcagctggacagagaagcc

SEQ ID NO: 7346241 - DNA, 22 bp, Homo sapiens
ggtgcagaggagccagctgggg

SEQ ID NO: 7346242 - DNA, 22 bp, Homo sapiens
ggtgcagaagaaagcagtcatt

SEQ ID NO: 7346243 - DNA, 22 bp, Homo sapiens
ggtgcagaaggaagggagctgg

SEQ ID NO: 7346244 - DNA, 22 bp, Homo sapiens
ggtgcagagcagtgtcagagca

SEQ ID NO: 7346245 - DNA, 22 bp, Homo sapiens
cagataaatagatagataaact

SEQ ID NO: 7346246 - DNA, 22 bp, Homo sapiens
cagataaatagacttggtcaga

SEQ ID NO: 7346247 - DNA, 22 bp, Homo sapiens
cagatactcaagcttagacttt

SEQ ID NO: 7346248 - DNA, 22 bp, Homo sapiens
cagatatattttccttattagg

SEQ ID NO: 7346249 - DNA, 22 bp, Homo sapiens
ggtgagaggcagaggacagctt

SEQ ID NO: 7346250 - DNA, 22 bp, Homo sapiens
cagatatattttatttggtcaa

SEQ ID NO: 7346251 - DNA, 22 bp, Homo sapiens
cagaggctgctctgggtggcat

SEQ ID NO: 7346252 - DNA, 22 bp, Homo sapiens
cagaggctgccagccatgtgca

SEQ ID NO: 7346253 - DNA, 22 bp, Homo sapiens
cagaggctgatgtgggatgggc

SEQ ID NO: 7346254 - DNA, 22 bp, Homo sapiens
cagaggctgctctgggtggcat

SEQ ID NO: 7346255 - DNA, 22 bp, Homo sapiens
ggggtaggtcatagcccctcta

SEQ ID NO: 7346256 - DNA, 22 bp, Homo sapiens
ggggtaggtcatagcccctcta

SEQ ID NO: 7346257 - DNA, 21 bp, Homo sapiens
ggggtatacctatgagatagt

SEQ ID NO: 7346258 - DNA, 22 bp, Homo sapiens
cagaggctgatggctgtagcca

SEQ ID NO: 7346259 - DNA, 21 bp, Homo sapiens
cagaggctgagagggcaatct

SEQ ID NO: 7346260 - DNA, 22 bp, Homo sapiens
cagaggcctttctacagtgata

SEQ ID NO: 7346261 - DNA, 22 bp, Homo sapiens
ggggtgagatcaaggaagccct

SEQ ID NO: 7346262 - DNA, 22 bp, Homo sapiens
cagagtgaaaactgagctcaaa

SEQ ID NO: 7346263 - DNA, 22 bp, Homo sapiens
ggggtctgggttgctcggcctt

SEQ ID NO: 7346264 - DNA, 22 bp, Homo sapiens
ggggtctgggttgctcggcctt

SEQ ID NO: 7346265 - DNA, 22 bp, Homo sapiens
ggggtcggggcatagccactta

SEQ ID NO: 7346266 - DNA, 22 bp, Homo sapiens
ggggtcctggaggccagctgga

SEQ ID NO: 7346267 - DNA, 22 bp, Homo sapiens
cagagtgggctgtcagccacca

SEQ ID NO: 7346268 - DNA, 22 bp, Homo sapiens
cagagtgttgaccataagccca

SEQ ID NO: 7346269 - DNA, 22 bp, Homo sapiens
cagagtgtattctgcagttgca

SEQ ID NO: 7346270 - DNA, 22 bp, Homo sapiens
cagagtgtggcatcttccaact

SEQ ID NO: 7346271 - DNA, 22 bp, Homo sapiens
cagagtgtatctgtgtaagcat

SEQ ID NO: 7346272 - DNA, 16 bp, Homo sapiens
cagagtgtaaacagga

SEQ ID NO: 7346273 - DNA, 22 bp, Homo sapiens
cagagtgttagcgctggttggg

SEQ ID NO: 7346274 - DNA, 22 bp, Homo sapiens
cagagtgtttctttgggtgggt

SEQ ID NO: 7346275 - DNA, 22 bp, Homo sapiens
cagaggaccattgtatgtattg

SEQ ID NO: 7346276 - DNA, 22 bp, Homo sapiens
cagaggaccagaaaggggccca

SEQ ID NO: 7346277 - DNA, 22 bp, Homo sapiens
cagaggaccagaaaggggccca

SEQ ID NO: 7346278 - DNA, 22 bp, Homo sapiens
cagaggacaatagaatggaaag

SEQ ID NO: 7346279 - DNA, 22 bp, Homo sapiens
ggggcgctcggagggatcccct

SEQ ID NO: 7346280 - DNA, 22 bp, Homo sapiens
cagaggacctgtgtggccagag

SEQ ID NO: 7346281 - DNA, 22 bp, Homo sapiens
cagaggaagctgggtgtggagt

SEQ ID NO: 7346282 - DNA, 22 bp, Homo sapiens
cagaggaagcagacacatcttg

SEQ ID NO: 7346283 - DNA, 22 bp, Homo sapiens
cagaggaagggtgctgcgaaag

SEQ ID NO: 7346284 - DNA, 22 bp, Homo sapiens
cagaggaaggctctgggaatgt

SEQ ID NO: 7346285 - DNA, 22 bp, Homo sapiens
gggggcagtaacctcaaagtgt

SEQ ID NO: 7346286 - DNA, 19 bp, Homo sapiens
cagaggcactttctcttag

SEQ ID NO: 7346287 - DNA, 22 bp, Homo sapiens
gggggcaggtctggaactttga

SEQ ID NO: 7346288 - DNA, 22 bp, Homo sapiens
gggggcagaatgtactcttgtc

SEQ ID NO: 7346289 - DNA, 22 bp, Homo sapiens
gggggcagaatgtactcttgtc

SEQ ID NO: 7346290 - DNA, 22 bp, Homo sapiens
gggggaggtgaatgcaataagg

SEQ ID NO: 7346291 - DNA, 22 bp, Homo sapiens
gggggaggtgaatgcaataagg

SEQ ID NO: 7346292 - DNA, 22 bp, Homo sapiens
gggggatgctcaggaggctgct

SEQ ID NO: 7346293 - DNA, 22 bp, Homo sapiens
cagaggcagaggtcatctctgg

SEQ ID NO: 7346294 - DNA, 22 bp, Homo sapiens
cagaggcagaatggagatttgg

SEQ ID NO: 7346295 - DNA, 21 bp, Homo sapiens
cagagcttgctgagaggcctg

SEQ ID NO: 7346296 - DNA, 22 bp, Homo sapiens
gggctctgcagtgacttgaggg

SEQ ID NO: 7346297 - DNA, 21 bp, Homo sapiens
gggctctgccctcctggagct

SEQ ID NO: 7346298 - DNA, 21 bp, Homo sapiens
gggctctgccctcctggagct

SEQ ID NO: 7346299 - DNA, 22 bp, Homo sapiens
cagagcttctgacagctgctgc

SEQ ID NO: 7346300 - DNA, 22 bp, Homo sapiens
gggctctgcctggctgggagta

SEQ ID NO: 7346301 - DNA, 22 bp, Homo sapiens
gggctctgcctggctgggagta

SEQ ID NO: 7346302 - DNA, 22 bp, Homo sapiens
gggctcagtcctggttctaccc

SEQ ID NO: 7346303 - DNA, 22 bp, Homo sapiens
gggctcagggacacatgtgtgt

SEQ ID NO: 7346304 - DNA, 22 bp, Homo sapiens
gggctcaggagtttgaggctgc

SEQ ID NO: 7346305 - DNA, 22 bp, Homo sapiens
gggctcaggcctggcctctcac

SEQ ID NO: 7346306 - DNA, 22 bp, Homo sapiens
gggctcaggcctggcctctcac

SEQ ID NO: 7346307 - DNA, 22 bp, Homo sapiens
gggctcaggcctggcctctcac

SEQ ID NO: 7346308 - DNA, 22 bp, Homo sapiens
gggctctgcacgttctggcgtc

SEQ ID NO: 7346309 - DNA, 22 bp, Homo sapiens
gggctctgcacgttctggcgtc

SEQ ID NO: 7346310 - DNA, 22 bp, Homo sapiens
gggctcagtcctggttctaccc

SEQ ID NO: 7346311 - DNA, 22 bp, Homo sapiens
gggctcagtcggcaagcccctt

SEQ ID NO: 7346312 - DNA, 22 bp, Homo sapiens
gggctcagtcggcaagcccctt

SEQ ID NO: 7346313 - DNA, 22 bp, Homo sapiens
gggctcagtcggcaagcccctt

SEQ ID NO: 7346314 - DNA, 22 bp, Homo sapiens
gggctcagtctgcggcgcgcgg

SEQ ID NO: 7346315 - DNA, 22 bp, Homo sapiens
gggctcagtctggcgtggaatg

SEQ ID NO: 7346316 - DNA, 17 bp, Homo sapiens
gggcgcgggtagagccc

SEQ ID NO: 7346317 - DNA, 22 bp, Homo sapiens
cagagcagcctccagggggagc

SEQ ID NO: 7346318 - DNA, 18 bp, Homo sapiens
cagagcagaggtggagcg

SEQ ID NO: 7346319 - DNA, 20 bp, Homo sapiens
gggccctgggattcagagca

SEQ ID NO: 7346320 - DNA, 22 bp, Homo sapiens
gggccctggctttcctgttctt

SEQ ID NO: 7346321 - DNA, 20 bp, Homo sapiens
gggccctgggattcagagca

SEQ ID NO: 7346322 - DNA, 18 bp, Homo sapiens
gggccctggcgtccgccc

SEQ ID NO: 7346323 - DNA, 22 bp, Homo sapiens
gggccctggatttaagcatgga

SEQ ID NO: 7346324 - DNA, 22 bp, Homo sapiens
gggccctggccgaatccctctg

SEQ ID NO: 7346325 - DNA, 22 bp, Homo sapiens
gggccctggacgtggcggcaga

SEQ ID NO: 7346326 - DNA, 22 bp, Homo sapiens
gggccctggacgtggcggcaga

SEQ ID NO: 7346327 - DNA, 22 bp, Homo sapiens
gggccctgcgtccggaagtctg

SEQ ID NO: 7346328 - DNA, 22 bp, Homo sapiens
gggccctgcgactcgcggcgga

SEQ ID NO: 7346329 - DNA, 16 bp, Homo sapiens
cagagaggacagaggc

SEQ ID NO: 7346330 - DNA, 16 bp, Homo sapiens
cagagaggacagaggc

SEQ ID NO: 7346331 - DNA, 22 bp, Homo sapiens
cagagagagtggggtgtggatt

SEQ ID NO: 7346332 - DNA, 22 bp, Homo sapiens
cagagagagtctgtccctgaag

SEQ ID NO: 7346333 - DNA, 22 bp, Homo sapiens
cagagagcatgggaggcccgag

SEQ ID NO: 7346334 - DNA, 22 bp, Homo sapiens
cagagagagcaggaaacctccg

SEQ ID NO: 7346335 - DNA, 22 bp, Homo sapiens
cagagagaatcttggcagctga

SEQ ID NO: 7346336 - DNA, 22 bp, Homo sapiens
cagagagaatcttggcagctga

SEQ ID NO: 7346337 - DNA, 19 bp, Homo sapiens
cagagagaccaaggcgcca

SEQ ID NO: 7346338 - DNA, 22 bp, Homo sapiens
cagagagaggtgccgataatgg

SEQ ID NO: 7346339 - DNA, 22 bp, Homo sapiens
cagagagagtcaaatctttgct

SEQ ID NO: 7346340 - DNA, 22 bp, Homo sapiens
cagagagaggggctgcctggcc

SEQ ID NO: 7346341 - DNA, 22 bp, Homo sapiens
cagagagaggccactgctatta

SEQ ID NO: 7346342 - DNA, 22 bp, Homo sapiens
cagagagaatatgtagtatgga

SEQ ID NO: 7346343 - DNA, 22 bp, Homo sapiens
cagagacagtttcacagggtct

SEQ ID NO: 7346344 - DNA, 18 bp, Homo sapiens
cagaagcaggcagtgcag

SEQ ID NO: 7346345 - DNA, 22 bp, Homo sapiens
cagaagcaagagccggagctag

SEQ ID NO: 7346346 - DNA, 22 bp, Homo sapiens
cagaagcaagtagtgattcttt

SEQ ID NO: 7346347 - DNA, 22 bp, Homo sapiens
cagaagcacatgtttacatgta

SEQ ID NO: 7346348 - DNA, 22 bp, Homo sapiens
gtgcaggagcaggagccatgtc

SEQ ID NO: 7346349 - DNA, 22 bp, Homo sapiens
gtgcaggagcaggagccatgtc

SEQ ID NO: 7346350 - DNA, 22 bp, Homo sapiens
gtgcagcctgtcgccagtggat

SEQ ID NO: 7346351 - DNA, 22 bp, Homo sapiens
gtgcaaaatgatatcctgaagc

SEQ ID NO: 7346352 - DNA, 22 bp, Homo sapiens
gtgcaaaagtaattgcggtttt

SEQ ID NO: 7346353 - DNA, 22 bp, Homo sapiens
gtgcaaaagtaattgtggtttt

SEQ ID NO: 7346354 - DNA, 22 bp, Homo sapiens
gtgcaaaagtcattgtggtttt

SEQ ID NO: 7346355 - DNA, 22 bp, Homo sapiens
gtgcaaaagtaattgaggtttt

SEQ ID NO: 7346356 - DNA, 22 bp, Homo sapiens
gtgaagtaagtactattaagat

SEQ ID NO: 7346357 - DNA, 22 bp, Homo sapiens
gtctcagataacatgtattcta

SEQ ID NO: 7346358 - DNA, 22 bp, Homo sapiens
gtctcagattcagacatctaca

SEQ ID NO: 7346359 - DNA, 22 bp, Homo sapiens
gtctctgtgtctgagagagccc

SEQ ID NO: 7346360 - DNA, 22 bp, Homo sapiens
gtctctgtcttaggccaggcct

SEQ ID NO: 7346361 - DNA, 22 bp, Homo sapiens
cagcaggtcccactgagggccc

SEQ ID NO: 7346362 - DNA, 22 bp, Homo sapiens
cagcagggaagctgtgctgttt

SEQ ID NO: 7346363 - DNA, 22 bp, Homo sapiens
cagcagagacggtaagcagaac

SEQ ID NO: 7346364 - DNA, 22 bp, Homo sapiens
cagcagagcatttggtaggagg

SEQ ID NO: 7346365 - DNA, 22 bp, Homo sapiens
cagcaggttaacagaggctggt

SEQ ID NO: 7346366 - DNA, 22 bp, Homo sapiens
cagcaggtcttgttgctgctga

SEQ ID NO: 7346367 - DNA, 22 bp, Homo sapiens
gtctatttgggatcatgatatg

SEQ ID NO: 7346368 - DNA, 22 bp, Homo sapiens
gtctcacacagagtagattttg

SEQ ID NO: 7346369 - DNA, 20 bp, Homo sapiens
gtctcagaatggatttgcat

SEQ ID NO: 7346370 - DNA, 22 bp, Homo sapiens
gtctcagagtcctacttattcc

SEQ ID NO: 7346371 - DNA, 22 bp, Homo sapiens
gtctcagaccaccctctttggc

SEQ ID NO: 7346372 - DNA, 22 bp, Homo sapiens
gtctcagagagctactctctta

SEQ ID NO: 7346373 - DNA, 22 bp, Homo sapiens
gtctcagagagctactctctta

SEQ ID NO: 7346374 - DNA, 22 bp, Homo sapiens
cagcatgcattttctctctttg

SEQ ID NO: 7346375 - DNA, 22 bp, Homo sapiens
cagcatgcattttctctctttg

SEQ ID NO: 7346376 - DNA, 22 bp, Homo sapiens
cagcatgcagcccctggcagct

SEQ ID NO: 7346377 - DNA, 22 bp, Homo sapiens
cagcatgcagcccctggcagct

SEQ ID NO: 7346378 - DNA, 22 bp, Homo sapiens
cagcatgatttatcacaaccct

SEQ ID NO: 7346379 - DNA, 22 bp, Homo sapiens
cagcagtggctgcaggcagctg

SEQ ID NO: 7346380 - DNA, 22 bp, Homo sapiens
cagcagtggctgcaggcagctg

SEQ ID NO: 7346381 - DNA, 22 bp, Homo sapiens
gtcctctgtgtaggctgcagac

SEQ ID NO: 7346382 - DNA, 22 bp, Homo sapiens
gtcctctgtgtaggctgcagac

SEQ ID NO: 7346383 - DNA, 22 bp, Homo sapiens
gtcctatattcttttaaaattt

SEQ ID NO: 7346384 - DNA, 21 bp, Homo sapiens
gtgcatggagaaaggcttgct

SEQ ID NO: 7346385 - DNA, 22 bp, Homo sapiens
gtgcatgctgcagtatgatttc

SEQ ID NO: 7346386 - DNA, 22 bp, Homo sapiens
gtgcaggagccaggggtaggaa

SEQ ID NO: 7346387 - DNA, 22 bp, Homo sapiens
gtgcaggagccaggggtaggaa

SEQ ID NO: 7346388 - DNA, 22 bp, Homo sapiens
gtgcaggagctcccgcagtggt

SEQ ID NO: 7346389 - DNA, 22 bp, Homo sapiens
gtgcaggaggatgacaactgca

SEQ ID NO: 7346390 - DNA, 22 bp, Homo sapiens
cagccctgtgcggagggccctg

SEQ ID NO: 7346391 - DNA, 20 bp, Homo sapiens
cagcctccactcactcagct

SEQ ID NO: 7346392 - DNA, 22 bp, Homo sapiens
cagccgtcagatgtgccgcagc

SEQ ID NO: 7346393 - DNA, 21 bp, Homo sapiens
cagctccactaaagcagctgt

SEQ ID NO: 7346394 - DNA, 22 bp, Homo sapiens
cagctcaggaaggaaggccggc

SEQ ID NO: 7346395 - DNA, 21 bp, Homo sapiens
cagctccactaaagcagctgt

SEQ ID NO: 7346396 - DNA, 21 bp, Homo sapiens
cagctccactaaagcagctgt

SEQ ID NO: 7346397 - DNA, 22 bp, Homo sapiens
cagctccacttgagtggggcct

SEQ ID NO: 7346398 - DNA, 22 bp, Homo sapiens
cagctccagcccaggcagctcc

SEQ ID NO: 7346399 - DNA, 22 bp, Homo sapiens
cagctccagcccaggcagctcc

SEQ ID NO: 7346400 - DNA, 22 bp, Homo sapiens
cagctccagcccaggcagctcc

SEQ ID NO: 7346401 - DNA, 22 bp, Homo sapiens
cagctccagccaccggggggtg

SEQ ID NO: 7346402 - DNA, 22 bp, Homo sapiens
cagctccatcttgcttatacca

SEQ ID NO: 7346403 - DNA, 23 bp, Homo sapiens
cagctccagtgcactcaggtagc

SEQ ID NO: 7346404 - DNA, 23 bp, Homo sapiens
cagctccagtgcactcaggtagc

SEQ ID NO: 7346405 - DNA, 22 bp, Homo sapiens
cagctccagctctgggcgcctc

SEQ ID NO: 7346406 - DNA, 22 bp, Homo sapiens
cagctccagcctgacaccaaga

SEQ ID NO: 7346407 - DNA, 22 bp, Homo sapiens
cagctccagcctgacaccaaga

SEQ ID NO: 7346408 - DNA, 22 bp, Homo sapiens
cagctccagccgactgtaagaa

SEQ ID NO: 7346409 - DNA, 22 bp, Homo sapiens
cagctcccagtggcagctcctt

SEQ ID NO: 7346410 - DNA, 22 bp, Homo sapiens
gtgctgagcacaaggcccagag

SEQ ID NO: 7346411 - DNA, 22 bp, Homo sapiens
cagctctgagactgaggctatg

SEQ ID NO: 7346412 - DNA, 22 bp, Homo sapiens
cagctcctgaggactgctggga

SEQ ID NO: 7346413 - DNA, 22 bp, Homo sapiens
cagctcctgcagctgctgccgt

SEQ ID NO: 7346414 - DNA, 22 bp, Homo sapiens
cagctcctctggccagccctgc

SEQ ID NO: 7346415 - DNA, 22 bp, Homo sapiens
cagctcctctgttagccctggg

SEQ ID NO: 7346416 - DNA, 22 bp, Homo sapiens
cagctcctctggccagccctgc

SEQ ID NO: 7346417 - DNA, 22 bp, Homo sapiens
cagctcctagatcggcgaagtg

SEQ ID NO: 7346418 - DNA, 22 bp, Homo sapiens
gctggtcctcaagggcacagcc

SEQ ID NO: 7346419 - DNA, 22 bp, Homo sapiens
gctggtgctctgggccctgagg

SEQ ID NO: 7346420 - DNA, 22 bp, Homo sapiens
gctggtgcattagctgcagttc

SEQ ID NO: 7346421 - DNA, 22 bp, Homo sapiens
gctggtgctctgggccctgagg

SEQ ID NO: 7346422 - DNA, 22 bp, Homo sapiens
gctggtggcagagctccgcggc

SEQ ID NO: 7346423 - DNA, 22 bp, Homo sapiens
caatcccatcaccatctgctct

SEQ ID NO: 7346424 - DNA, 22 bp, Homo sapiens
gctgtaaataagcttacttgaa

SEQ ID NO: 7346425 - DNA, 22 bp, Homo sapiens
caatgcatacttcgaaatttca

SEQ ID NO: 7346426 - DNA, 20 bp, Homo sapiens
caagtgtagaaactaataag

SEQ ID NO: 7346427 - DNA, 20 bp, Homo sapiens
gctgggctaccactggccct

SEQ ID NO: 7346428 - DNA, 20 bp, Homo sapiens
gctgggctaccactggccct

SEQ ID NO: 7346429 - DNA, 22 bp, Homo sapiens
caagttcttaactctgagcagc

SEQ ID NO: 7346430 - DNA, 22 bp, Homo sapiens
caagttctactgggacatcagt

SEQ ID NO: 7346431 - DNA, 22 bp, Homo sapiens
caatgcatgatggaattgcctt

SEQ ID NO: 7346432 - DNA, 22 bp, Homo sapiens
caatggttctcaaactatcatg

SEQ ID NO: 7346433 - DNA, 22 bp, Homo sapiens
caatggtggtgtcagaagagat

SEQ ID NO: 7346434 - DNA, 22 bp, Homo sapiens
caatggcctcccaagcaggggg

SEQ ID NO: 7346435 - DNA, 22 bp, Homo sapiens
caatgtaaatattttctaatca

SEQ ID NO: 7346436 - DNA, 22 bp, Homo sapiens
caatggttgaaccctgtcatga

SEQ ID NO: 7346437 - DNA, 22 bp, Homo sapiens
gcttccagaccccagtccctca

SEQ ID NO: 7346438 - DNA, 20 bp, Homo sapiens
gcttccagaggaggccccgt

SEQ ID NO: 7346439 - DNA, 22 bp, Homo sapiens
ggaaattgatctgagctcacct

SEQ ID NO: 7346440 - DNA, 22 bp, Homo sapiens
ggaaatgtatgtattaagcacc

SEQ ID NO: 7346441 - DNA, 17 bp, Homo sapiens
ggaaatgtacctctttt

SEQ ID NO: 7346442 - DNA, 22 bp, Homo sapiens
ggaacactgccttttattttcc

SEQ ID NO: 7346443 - DNA, 22 bp, Homo sapiens
ggaacactcagaaatgctcgtc

SEQ ID NO: 7346444 - DNA, 19 bp, Homo sapiens
gcttccagcactgcaggag

SEQ ID NO: 7346445 - DNA, 22 bp, Homo sapiens
gcttccagcaccagcagagggg

SEQ ID NO: 7346446 - DNA, 22 bp, Homo sapiens
caaattgatctgtctttatgaa

SEQ ID NO: 7346447 - DNA, 22 bp, Homo sapiens
caaatttaggtaacagtctgta

SEQ ID NO: 7346448 - DNA, 22 bp, Homo sapiens
gctgaggtaggaggttgcagtg

SEQ ID NO: 7346449 - DNA, 22 bp, Homo sapiens
gctgaggtgaggctggaaagga

SEQ ID NO: 7346450 - DNA, 22 bp, Homo sapiens
gctgaggtccagcattcgccta

SEQ ID NO: 7346451 - DNA, 16 bp, Homo sapiens
gctggagggaggggtt

SEQ ID NO: 7346452 - DNA, 22 bp, Homo sapiens
gctggaggctggagtgcagtgg

SEQ ID NO: 7346453 - DNA, 20 bp, Homo sapiens
gctgaggtggaggaaggaga

SEQ ID NO: 7346454 - DNA, 19 bp, Homo sapiens
gctgaggtggaggaaggag

SEQ ID NO: 7346455 - DNA, 22 bp, Homo sapiens
gctgggagccctggtctgctcc

SEQ ID NO: 7346456 - DNA, 22 bp, Homo sapiens
gctgggccagccagacatgtga

SEQ ID NO: 7346457 - DNA, 22 bp, Homo sapiens
gctgggcccagatcccaggatc

SEQ ID NO: 7346458 - DNA, 22 bp, Homo sapiens
gctgggccgacctgggctgcag

SEQ ID NO: 7346459 - DNA, 21 bp, Homo sapiens
gctgggcctgtacttgccctg

SEQ ID NO: 7346460 - DNA, 22 bp, Homo sapiens
gctgggccgacctgggctgcag

SEQ ID NO: 7346461 - DNA, 22 bp, Homo sapiens
gctgggccctgggtgccctagc

SEQ ID NO: 7346462 - DNA, 22 bp, Homo sapiens
gctgggagcaaagccatgcata

SEQ ID NO: 7346463 - DNA, 19 bp, Homo sapiens
gctgggagcagaccctccc

SEQ ID NO: 7346464 - DNA, 22 bp, Homo sapiens
gctggccatatattttgctgtt

SEQ ID NO: 7346465 - DNA, 22 bp, Homo sapiens
gctggccatggggagtgaggag

SEQ ID NO: 7346466 - DNA, 22 bp, Homo sapiens
gctggcccagcgcccagggcag

SEQ ID NO: 7346467 - DNA, 22 bp, Homo sapiens
gctggcccagcgcccagggcag

SEQ ID NO: 7346468 - DNA, 22 bp, Homo sapiens
gctggcccagcgcccagggcag

SEQ ID NO: 7346469 - DNA, 22 bp, Homo sapiens
gctggcccagcgcccagggcag

SEQ ID NO: 7346470 - DNA, 22 bp, Homo sapiens
cacagcccccttgacactctgg

SEQ ID NO: 7346471 - DNA, 19 bp, Homo sapiens
cacagccacagccaacctc

SEQ ID NO: 7346472 - DNA, 22 bp, Homo sapiens
cacagcagggcatggctgttgt

SEQ ID NO: 7346473 - DNA, 22 bp, Homo sapiens
cacagcaggcagaacgtgggca

SEQ ID NO: 7346474 - DNA, 22 bp, Homo sapiens
cacagcataatgaaatatactt

SEQ ID NO: 7346475 - DNA, 22 bp, Homo sapiens
cacagcataatgaaatatactt

SEQ ID NO: 7346476 - DNA, 22 bp, Homo sapiens
cacagcagtctttcactaaata

SEQ ID NO: 7346477 - DNA, 22 bp, Homo sapiens
ggaggagacggagtgattagtg

SEQ ID NO: 7346478 - DNA, 22 bp, Homo sapiens
ggaggagagaggttgcaaacac

SEQ ID NO: 7346479 - DNA, 22 bp, Homo sapiens
ggaggagattcccctctcactt

SEQ ID NO: 7346480 - DNA, 22 bp, Homo sapiens
ggaggagaccctgtgtcagttt

SEQ ID NO: 7346481 - DNA, 22 bp, Homo sapiens
ggaggagaccctgtgtcagttt

SEQ ID NO: 7346482 - DNA, 22 bp, Homo sapiens
ggaggagcacttgacggggtct

SEQ ID NO: 7346483 - DNA, 22 bp, Homo sapiens
ggaggagcacttctgagctcag

SEQ ID NO: 7346484 - DNA, 22 bp, Homo sapiens
ggaggagacagtaaaaagcacg

SEQ ID NO: 7346485 - DNA, 22 bp, Homo sapiens
ggaggagacagtaaaaagcacg

SEQ ID NO: 7346486 - DNA, 22 bp, Homo sapiens
ggaggggatttagtagatgcta

SEQ ID NO: 7346487 - DNA, 22 bp, Homo sapiens
ggaggggagtctcccaaagccg

SEQ ID NO: 7346488 - DNA, 19 bp, Homo sapiens
cacagctctgctcagggaa

SEQ ID NO: 7346489 - DNA, 19 bp, Homo sapiens
cacagctctgctcagggaa

SEQ ID NO: 7346490 - DNA, 22 bp, Homo sapiens
ggagggcaacttttcagtaggt

SEQ ID NO: 7346491 - DNA, 22 bp, Homo sapiens
ggagggagtttcattcctgccc

SEQ ID NO: 7346492 - DNA, 22 bp, Homo sapiens
cacagctaactttcactgagca

SEQ ID NO: 7346493 - DNA, 22 bp, Homo sapiens
cacagctaatggaagtggaatc

SEQ ID NO: 7346494 - DNA, 22 bp, Homo sapiens
cacagctacctgcatgcctgct

SEQ ID NO: 7346495 - DNA, 22 bp, Homo sapiens
ggaggggcaggtcccaagttgt

SEQ ID NO: 7346496 - DNA, 22 bp, Homo sapiens
ggaggggcaggtcccaagttgt

SEQ ID NO: 7346497 - DNA, 22 bp, Homo sapiens
ggaggggcagccatggaactcc

SEQ ID NO: 7346498 - DNA, 22 bp, Homo sapiens
ggaggggcagccatggaactcc

SEQ ID NO: 7346499 - DNA, 22 bp, Homo sapiens
ggaggggcagccatggaactcc

SEQ ID NO: 7346500 - DNA, 22 bp, Homo sapiens
ggaggggcagccatggaactcc

SEQ ID NO: 7346501 - DNA, 22 bp, Homo sapiens
ggaggggcatagttcaccatca

SEQ ID NO: 7346502 - DNA, 22 bp, Homo sapiens
ggaggggcatagttcaccatca

SEQ ID NO: 7346503 - DNA, 22 bp, Homo sapiens
ggaggggcatagttcaccatca

SEQ ID NO: 7346504 - DNA, 22 bp, Homo sapiens
ggaggggcaggtcccaagttgt

SEQ ID NO: 7346505 - DNA, 22 bp, Homo sapiens
ggaggggccggctgcctgccac

SEQ ID NO: 7346506 - DNA, 22 bp, Homo sapiens
ggaggggccggctgcctgccac

SEQ ID NO: 7346507 - DNA, 22 bp, Homo sapiens
ggaggggccggctgcctgccac

SEQ ID NO: 7346508 - DNA, 22 bp, Homo sapiens
cacaggagaggttaatgggggc

SEQ ID NO: 7346509 - DNA, 22 bp, Homo sapiens
cacaggagagctgggaggtgcc

SEQ ID NO: 7346510 - DNA, 22 bp, Homo sapiens
cacaggagagctgggaggtgcc

SEQ ID NO: 7346511 - DNA, 22 bp, Homo sapiens
cacaggagaaaggggaagctcg

SEQ ID NO: 7346512 - DNA, 17 bp, Homo sapiens
ggagagtgggaatggcc

SEQ ID NO: 7346513 - DNA, 16 bp, Homo sapiens
ggagagtgtctgcaaa

SEQ ID NO: 7346514 - DNA, 22 bp, Homo sapiens
ggagagtgggagcaactgttgc

SEQ ID NO: 7346515 - DNA, 17 bp, Homo sapiens
ggagagtgggaatggcc

SEQ ID NO: 7346516 - DNA, 22 bp, Homo sapiens
ggagagtggattccagctgtat

SEQ ID NO: 7346517 - DNA, 18 bp, Homo sapiens
ggagagtgagatcaaaca

SEQ ID NO: 7346518 - DNA, 22 bp, Homo sapiens
ggagaggtgtattcagtgggtc

SEQ ID NO: 7346519 - DNA, 18 bp, Homo sapiens
ggagagtgacagagtcgt

SEQ ID NO: 7346520 - DNA, 22 bp, Homo sapiens
ggagagtccggatatgtaatat

SEQ ID NO: 7346521 - DNA, 22 bp, Homo sapiens
ggacagcgtggctggtggaggg

SEQ ID NO: 7346522 - DNA, 22 bp, Homo sapiens
ggacagcattctactgtaggca

SEQ ID NO: 7346523 - DNA, 22 bp, Homo sapiens
cacagagaatactgctcttgct

SEQ ID NO: 7346524 - DNA, 22 bp, Homo sapiens
cacagagaactgtgggagtgtg

SEQ ID NO: 7346525 - DNA, 22 bp, Homo sapiens
ggagatactatctttacaattc

SEQ ID NO: 7346526 - DNA, 22 bp, Homo sapiens
cacagagacagaagcacttatg

SEQ ID NO: 7346527 - DNA, 22 bp, Homo sapiens
cacagagaattcccatatgtga

SEQ ID NO: 7346528 - DNA, 22 bp, Homo sapiens
cacagagacagaagcacttatg

SEQ ID NO: 7346529 - DNA, 22 bp, Homo sapiens
cacagagaatgatgagtcactg

SEQ ID NO: 7346530 - DNA, 22 bp, Homo sapiens
cacagagacatgatgtcattgc

SEQ ID NO: 7346531 - DNA, 22 bp, Homo sapiens
cacagagacagatctattttgc

SEQ ID NO: 7346532 - DNA, 22 bp, Homo sapiens
cacagcaggcactatacagggc

SEQ ID NO: 7346533 - DNA, 22 bp, Homo sapiens
ggaacactggctcaattatatc

SEQ ID NO: 7346534 - DNA, 20 bp, Homo sapiens
ggaacactgttcattctgta

SEQ ID NO: 7346535 - DNA, 22 bp, Homo sapiens
ggaacaggaaaggagggatgct

SEQ ID NO: 7346536 - DNA, 22 bp, Homo sapiens
ggaacaggaaaggagggatgct

SEQ ID NO: 7346537 - DNA, 22 bp, Homo sapiens
ggaacaggaaaggagggatgct

SEQ ID NO: 7346538 - DNA, 22 bp, Homo sapiens
ggaagagagatcccatagatgt

SEQ ID NO: 7346539 - DNA, 22 bp, Homo sapiens
ggaagagaatttctctcttttt

SEQ ID NO: 7346540 - DNA, 19 bp, Homo sapiens
ggaagagaggaaaggtgga

SEQ ID NO: 7346541 - DNA, 22 bp, Homo sapiens
ggacaaaggtctggggaacctg

SEQ ID NO: 7346542 - DNA, 22 bp, Homo sapiens
ggacaagcctgtgagtgggttt

SEQ ID NO: 7346543 - DNA, 22 bp, Homo sapiens
ggaagagattctttacattcat

SEQ ID NO: 7346544 - DNA, 22 bp, Homo sapiens
ggaaggggccttgagcaaactg

SEQ ID NO: 7346545 - DNA, 22 bp, Homo sapiens
ggacagcacagctcttgacaac

SEQ ID NO: 7346546 - DNA, 22 bp, Homo sapiens
ggacagagggttgacagagtat

SEQ ID NO: 7346547 - DNA, 22 bp, Homo sapiens
ggacagagggttgacagagtat

SEQ ID NO: 7346548 - DNA, 22 bp, Homo sapiens
ggacagagggttgacagagtat

SEQ ID NO: 7346549 - DNA, 19 bp, Homo sapiens
ggacacagaaagctgcatt

SEQ ID NO: 7346550 - DNA, 22 bp, Homo sapiens
ggacacacaagttatctaatga

SEQ ID NO: 7346551 - DNA, 19 bp, Homo sapiens
ggccccagccagggtatca

SEQ ID NO: 7346552 - DNA, 22 bp, Homo sapiens
ggccccagcctcagtcccctga

SEQ ID NO: 7346553 - DNA, 21 bp, Homo sapiens
ggccccagcccatgggttctc

SEQ ID NO: 7346554 - DNA, 22 bp, Homo sapiens
ggcccagcacagtgcttggggg

SEQ ID NO: 7346555 - DNA, 22 bp, Homo sapiens
ggcccagcatcttgtgaagttt

SEQ ID NO: 7346556 - DNA, 22 bp, Homo sapiens
ggcccagcccgagtcagccttc

SEQ ID NO: 7346557 - DNA, 22 bp, Homo sapiens
ggccccagcagaccctcctctg

SEQ ID NO: 7346558 - DNA, 22 bp, Homo sapiens
ggcccagaggggttgagcatct

SEQ ID NO: 7346559 - DNA, 22 bp, Homo sapiens
ggcgccagcccaggccgtcgtg

SEQ ID NO: 7346560 - DNA, 22 bp, Homo sapiens
ggcgcccccttcaaacagagca

SEQ ID NO: 7346561 - DNA, 22 bp, Homo sapiens
ggcgccctggtgccgcaccgcg

SEQ ID NO: 7346562 - DNA, 22 bp, Homo sapiens
ggcgcaggccttggatcctggt

SEQ ID NO: 7346563 - DNA, 22 bp, Homo sapiens
ggcgcaggccttggatcctggt

SEQ ID NO: 7346564 - DNA, 22 bp, Homo sapiens
ggcgccagcactgcagcgcctc

SEQ ID NO: 7346565 - DNA, 22 bp, Homo sapiens
ggcgaggccgggacaggctgga

SEQ ID NO: 7346566 - DNA, 22 bp, Homo sapiens
ggcgcacgccattggccgtgcg

SEQ ID NO: 7346567 - DNA, 22 bp, Homo sapiens
ggcgagggagcagtgcggtggg

SEQ ID NO: 7346568 - DNA, 22 bp, Homo sapiens
ggccccagggaagaaggtggtc

SEQ ID NO: 7346569 - DNA, 22 bp, Homo sapiens
ggccccagggattaggccaacc

SEQ ID NO: 7346570 - DNA, 22 bp, Homo sapiens
ggccccaggacctccacggtcc

SEQ ID NO: 7346571 - DNA, 22 bp, Homo sapiens
ggccccaggcctttggtctggc

SEQ ID NO: 7346572 - DNA, 22 bp, Homo sapiens
cacatttgggacaggagataaa

SEQ ID NO: 7346573 - DNA, 21 bp, Homo sapiens
cacatttgaacctcacagcaa

SEQ ID NO: 7346574 - DNA, 22 bp, Homo sapiens
cacatttgaaggaattagcatt

SEQ ID NO: 7346575 - DNA, 22 bp, Homo sapiens
caccaagaatcttcacttttta

SEQ ID NO: 7346576 - DNA, 18 bp, Homo sapiens
ggccagccccaggccagc

SEQ ID NO: 7346577 - DNA, 18 bp, Homo sapiens
ggccagccccaggccagc

SEQ ID NO: 7346578 - DNA, 22 bp, Homo sapiens
ggccagcccagtggtcctctct

SEQ ID NO: 7346579 - DNA, 22 bp, Homo sapiens
ggccagcctggggctcccagac

SEQ ID NO: 7346580 - DNA, 22 bp, Homo sapiens
ggccagcggcacagcctggccc

SEQ ID NO: 7346581 - DNA, 22 bp, Homo sapiens
ggccagccctcctccctgggtt

SEQ ID NO: 7346582 - DNA, 22 bp, Homo sapiens
ggccagcctggggctcccagac

SEQ ID NO: 7346583 - DNA, 22 bp, Homo sapiens
ggccagggcctggggactgtcc

SEQ ID NO: 7346584 - DNA, 22 bp, Homo sapiens
cacccaggcaggtggctgagaa

SEQ ID NO: 7346585 - DNA, 22 bp, Homo sapiens
cacccaggaggttgggaagggc

SEQ ID NO: 7346586 - DNA, 22 bp, Homo sapiens
cacccagcttttgcatcctccg

SEQ ID NO: 7346587 - DNA, 22 bp, Homo sapiens
ggccagctccttggcagtgcct

SEQ ID NO: 7346588 - DNA, 21 bp, Homo sapiens
ggccagctcggaaggtcccat

SEQ ID NO: 7346589 - DNA, 18 bp, Homo sapiens
ggccagctcctgaggcag

SEQ ID NO: 7346590 - DNA, 22 bp, Homo sapiens
ggccagctcagtctccatcagg

SEQ ID NO: 7346591 - DNA, 22 bp, Homo sapiens
ggccagctacccatctgcgtca

SEQ ID NO: 7346592 - DNA, 22 bp, Homo sapiens
ggccagctcagactccacttgc

SEQ ID NO: 7346593 - DNA, 22 bp, Homo sapiens
ggatcattaacacatccatcac

SEQ ID NO: 7346594 - DNA, 22 bp, Homo sapiens
ggatcaggcgccatgggaagtg

SEQ ID NO: 7346595 - DNA, 22 bp, Homo sapiens
ggatcagaggatcagggacagt

SEQ ID NO: 7346596 - DNA, 22 bp, Homo sapiens
ggataggaattgagatgctatt

SEQ ID NO: 7346597 - DNA, 22 bp, Homo sapiens
ggcaggaacacagatggtgccg

SEQ ID NO: 7346598 - DNA, 22 bp, Homo sapiens
ggagtctgtcacctgtttctct

SEQ ID NO: 7346599 - DNA, 21 bp, Homo sapiens
ggagtctgtggatgctgtttc

SEQ ID NO: 7346600 - DNA, 22 bp, Homo sapiens
ggagtttcttgagcccttaagg

SEQ ID NO: 7346601 - DNA, 22 bp, Homo sapiens
ggagtgagcaaatagagatttg

SEQ ID NO: 7346602 - DNA, 22 bp, Homo sapiens
ggagtgaaaggtaagttgagct

SEQ ID NO: 7346603 - DNA, 22 bp, Homo sapiens
ggcaggactcttctgtgggccg

SEQ ID NO: 7346604 - DNA, 22 bp, Homo sapiens
ggcaggactgatcagtgggatg

SEQ ID NO: 7346605 - DNA, 22 bp, Homo sapiens
ggcaggactcttctgtgggccg

SEQ ID NO: 7346606 - DNA, 22 bp, Homo sapiens
ggcaggactgatcagtgggatg

SEQ ID NO: 7346607 - DNA, 22 bp, Homo sapiens
cacatgcagtttacgtcactga

SEQ ID NO: 7346608 - DNA, 23 bp, Homo sapiens
cacatgcaggcagtggccttcaa

SEQ ID NO: 7346609 - DNA, 22 bp, Homo sapiens
ggcaggactctcaggaccaagc

SEQ ID NO: 7346610 - DNA, 20 bp, Homo sapiens
ggcaggacccggtagggagc

SEQ ID NO: 7346611 - DNA, 22 bp, Homo sapiens
ggcaggactctcaggaccaagc

SEQ ID NO: 7346612 - DNA, 22 bp, Homo sapiens
ggcaggacattgactacagtga

SEQ ID NO: 7346613 - DNA, 20 bp, Homo sapiens
ggcaggaccccagtggcatc

SEQ ID NO: 7346614 - DNA, 22 bp, Homo sapiens
cacatgcatacctatgtgtata

SEQ ID NO: 7346615 - DNA, 22 bp, Homo sapiens
cacatgcatcacgacttccttt

SEQ ID NO: 7346616 - DNA, 22 bp, Homo sapiens
cacatgcagttttccagcagtc

SEQ ID NO: 7346617 - DNA, 22 bp, Homo sapiens
ggcaggttggatgctgtagtga

SEQ ID NO: 7346618 - DNA, 22 bp, Homo sapiens
ggcaggtgtggtgaccagagat

SEQ ID NO: 7346619 - DNA, 19 bp, Homo sapiens
ggcaggtgtgcttatgctt

SEQ ID NO: 7346620 - DNA, 22 bp, Homo sapiens
ggcaggtgtgagatcgaggcca

SEQ ID NO: 7346621 - DNA, 22 bp, Homo sapiens
ggcaggtgtgagctgtaaagga

SEQ ID NO: 7346622 - DNA, 22 bp, Homo sapiens
ggctggcttggtgagctgtcac

SEQ ID NO: 7346623 - DNA, 23 bp, Homo sapiens
ggctgggagctccgggtgcacgt

SEQ ID NO: 7346624 - DNA, 22 bp, Homo sapiens
cagaaattcccatttcagattc

SEQ ID NO: 7346625 - DNA, 22 bp, Homo sapiens
cagaaattcccatttcagattc

SEQ ID NO: 7346626 - DNA, 20 bp, Homo sapiens
cagaaatttgtaaaagggat

SEQ ID NO: 7346627 - DNA, 21 bp, Homo sapiens
ggctgctgtcaccgctgtcac

SEQ ID NO: 7346628 - DNA, 21 bp, Homo sapiens
ggctgctgtcaccgctgtcac

SEQ ID NO: 7346629 - DNA, 21 bp, Homo sapiens
ggctgctgtcaccgctgtcac

SEQ ID NO: 7346630 - DNA, 22 bp, Homo sapiens
cagaaatagacaatggcagtgg

SEQ ID NO: 7346631 - DNA, 22 bp, Homo sapiens
ggctgctgtgacctcaggtgat

SEQ ID NO: 7346632 - DNA, 22 bp, Homo sapiens
ggctgctggtggaatggtaggc

SEQ ID NO: 7346633 - DNA, 22 bp, Homo sapiens
ggctgctggtaggggtaggaag

SEQ ID NO: 7346634 - DNA, 22 bp, Homo sapiens
ggctgctggtaggggtaggaag

SEQ ID NO: 7346635 - DNA, 22 bp, Homo sapiens
ggctgctgggtcatgatgcaga

SEQ ID NO: 7346636 - DNA, 20 bp, Homo sapiens
ggctgctggtttggctctgt

SEQ ID NO: 7346637 - DNA, 19 bp, Homo sapiens
ggctgctggttacagaggc

SEQ ID NO: 7346638 - DNA, 22 bp, Homo sapiens
cagaacaggtcatgcttgctgt

SEQ ID NO: 7346639 - DNA, 23 bp, Homo sapiens
cagaacagtaaaagatgccatgg

SEQ ID NO: 7346640 - DNA, 22 bp, Homo sapiens
cagaacagtcgcctgcatggat

SEQ ID NO: 7346641 - DNA, 22 bp, Homo sapiens
cagaacattgttttctcatctg

SEQ ID NO: 7346642 - DNA, 22 bp, Homo sapiens
cagaacatccccactgctacct

SEQ ID NO: 7346643 - DNA, 22 bp, Homo sapiens
ggctgggagctggacaggccgg

SEQ ID NO: 7346644 - DNA, 22 bp, Homo sapiens
ggcttggcaggtgccctgcgca

SEQ ID NO: 7346645 - DNA, 20 bp, Homo sapiens
cactgccctccagcctgagc

SEQ ID NO: 7346646 - DNA, 22 bp, Homo sapiens
cactgcccaggacctgccaccc

SEQ ID NO: 7346647 - DNA, 18 bp, Homo sapiens
ggctcctgtgatcacatt

SEQ ID NO: 7346648 - DNA, 19 bp, Homo sapiens
ggctcctgtggctgcagcc

SEQ ID NO: 7346649 - DNA, 22 bp, Homo sapiens
ggctcctgtggcaagacagctt

SEQ ID NO: 7346650 - DNA, 22 bp, Homo sapiens
ggctcctgtcctcctggagctc

SEQ ID NO: 7346651 - DNA, 22 bp, Homo sapiens
ggctcctgtcctcctggagctc

SEQ ID NO: 7346652 - DNA, 22 bp, Homo sapiens
ggctcctgggggtgctcctgcc

SEQ ID NO: 7346653 - DNA, 22 bp, Homo sapiens
ggctcctgtcccctcagctgct

SEQ ID NO: 7346654 - DNA, 22 bp, Homo sapiens
ggctcctgtcccctcagctgct

SEQ ID NO: 7346655 - DNA, 22 bp, Homo sapiens
cactgagttagtacgcaaacat

SEQ ID NO: 7346656 - DNA, 19 bp, Homo sapiens
ggctcctggggctcagccc

SEQ ID NO: 7346657 - DNA, 19 bp, Homo sapiens
ggctcctggggctcagccc

SEQ ID NO: 7346658 - DNA, 22 bp, Homo sapiens
cactgcaacctccacctcctgg

SEQ ID NO: 7346659 - DNA, 22 bp, Homo sapiens
cactgcaacctccacctcctgg

SEQ ID NO: 7346660 - DNA, 22 bp, Homo sapiens
ggctccagtttgtgccttcagc

SEQ ID NO: 7346661 - DNA, 20 bp, Homo sapiens
ggcgcctggcctcatggctg

SEQ ID NO: 7346662 - DNA, 20 bp, Homo sapiens
ggcgcctggcctcatggctg

SEQ ID NO: 7346663 - DNA, 22 bp, Homo sapiens
ggcgccgcactcggtgcagccg

SEQ ID NO: 7346664 - DNA, 22 bp, Homo sapiens
ggcgccgcactcggtgcagccg

SEQ ID NO: 7346665 - DNA, 22 bp, Homo sapiens
ggcgccgcactcggtgcagccg

SEQ ID NO: 7346666 - DNA, 22 bp, Homo sapiens
cactgaggtatctgtctctcct

SEQ ID NO: 7346667 - DNA, 22 bp, Homo sapiens
cactgagggcggagcccaggga

SEQ ID NO: 7346668 - DNA, 22 bp, Homo sapiens
cactgagggcggagcccaggga

SEQ ID NO: 7346669 - DNA, 22 bp, Homo sapiens
cactgagggagggtttcttctg

SEQ ID NO: 7346670 - DNA, 22 bp, Homo sapiens
ggctgaggctcatgccatcttg

SEQ ID NO: 7346671 - DNA, 22 bp, Homo sapiens
ggctgcagccctcgcctagcca

SEQ ID NO: 7346672 - DNA, 22 bp, Homo sapiens
ggctgcggatctaaggctggga

SEQ ID NO: 7346673 - DNA, 22 bp, Homo sapiens
ggctgctcacgcagccctccct

SEQ ID NO: 7346674 - DNA, 18 bp, Homo sapiens
ggctgctcctctccctac

SEQ ID NO: 7346675 - DNA, 22 bp, Homo sapiens
ggctgctcctttaccctggcag

SEQ ID NO: 7346676 - DNA, 18 bp, Homo sapiens
ggctgctcgctctccccg

SEQ ID NO: 7346677 - DNA, 22 bp, Homo sapiens
ggctgcctcaaagctcaagctc

SEQ ID NO: 7346678 - DNA, 22 bp, Homo sapiens
ggctgccttgaccctggctccg

SEQ ID NO: 7346679 - DNA, 22 bp, Homo sapiens
cactgtctgtgtgtccttgggg

SEQ ID NO: 7346680 - DNA, 22 bp, Homo sapiens
gaacatacaagaattaagtaca

SEQ ID NO: 7346681 - DNA, 22 bp, Homo sapiens
gaacataattaaatgtcctggg

SEQ ID NO: 7346682 - DNA, 23 bp, Homo sapiens
atgaggcattaaacaggcttttt

SEQ ID NO: 7346683 - DNA, 22 bp, Homo sapiens
atgaggcattcacagaaggcac

SEQ ID NO: 7346684 - DNA, 22 bp, Homo sapiens
atgaggcattccactcaaactc

SEQ ID NO: 7346685 - DNA, 22 bp, Homo sapiens
gaacaatgaaagacataaactc

SEQ ID NO: 7346686 - DNA, 15 bp, Homo sapiens
atgaggcatttgggg

SEQ ID NO: 7346687 - DNA, 22 bp, Homo sapiens
atgaggcatgggatcaaaatga

SEQ ID NO: 7346688 - DNA, 21 bp, Homo sapiens
atgaggcatgagagggtttct

SEQ ID NO: 7346689 - DNA, 22 bp, Homo sapiens
atgaggcatgtgaggagaaggg

SEQ ID NO: 7346690 - DNA, 22 bp, Homo sapiens
atgaggcatctgcagtcactag

SEQ ID NO: 7346691 - DNA, 22 bp, Homo sapiens
atgaggcatctaacattgcaaa

SEQ ID NO: 7346692 - DNA, 22 bp, Homo sapiens
atgaggcatatcctcctatggt

SEQ ID NO: 7346693 - DNA, 22 bp, Homo sapiens
atgaggcagtctggcctgaggg

SEQ ID NO: 7346694 - DNA, 22 bp, Homo sapiens
atgaggcatagcagggatcgga

SEQ ID NO: 7346695 - DNA, 22 bp, Homo sapiens
atgaggcagtctggcctgaggg

SEQ ID NO: 7346696 - DNA, 22 bp, Homo sapiens
atgaggcatagcagggatcgga

SEQ ID NO: 7346697 - DNA, 16 bp, Homo sapiens
atgaggcataggctgc

SEQ ID NO: 7346698 - DNA, 22 bp, Homo sapiens
gaaatgaactgattatcattgc

SEQ ID NO: 7346699 - DNA, 22 bp, Homo sapiens
gaaatctgaatcttctgttggt

SEQ ID NO: 7346700 - DNA, 22 bp, Homo sapiens
gaaatctgcccagtgcactggt

SEQ ID NO: 7346701 - DNA, 22 bp, Homo sapiens
gaaatctgcggtgaggcctgag

SEQ ID NO: 7346702 - DNA, 22 bp, Homo sapiens
gaaatctgcttcttgcatagta

SEQ ID NO: 7346703 - DNA, 22 bp, Homo sapiens
gaaatctgtctttgtttgaata

SEQ ID NO: 7346704 - DNA, 22 bp, Homo sapiens
gaaatctccaatcttttcttta

SEQ ID NO: 7346705 - DNA, 19 bp, Homo sapiens
gaaatctctttcttgtctt

SEQ ID NO: 7346706 - DNA, 22 bp, Homo sapiens
gaaatctgaacaacagctgtca

SEQ ID NO: 7346707 - DNA, 22 bp, Homo sapiens
gaaatctgaactctgtatcctt

SEQ ID NO: 7346708 - DNA, 22 bp, Homo sapiens
atgcaatgttcctttcttcacc

SEQ ID NO: 7346709 - DNA, 22 bp, Homo sapiens
atgcacaacagacgaatggaag

SEQ ID NO: 7346710 - DNA, 22 bp, Homo sapiens
atgcacaaacccacaattagtc

SEQ ID NO: 7346711 - DNA, 22 bp, Homo sapiens
atgcaataaatactttccagct

SEQ ID NO: 7346712 - DNA, 22 bp, Homo sapiens
atgcaataccttctgaaaataa

SEQ ID NO: 7346713 - DNA, 22 bp, Homo sapiens
gaagaaagattggcatgcttca

SEQ ID NO: 7346714 - DNA, 22 bp, Homo sapiens
gaagaaagatcaaatagtttcc

SEQ ID NO: 7346715 - DNA, 22 bp, Homo sapiens
gaacatgcaatgacaggggact

SEQ ID NO: 7346716 - DNA, 22 bp, Homo sapiens
gaacatctgggatcattgctgt

SEQ ID NO: 7346717 - DNA, 22 bp, Homo sapiens
gaacatttgatgatgacattgg

SEQ ID NO: 7346718 - DNA, 22 bp, Homo sapiens
gaactttgcgcagttcccgggg

SEQ ID NO: 7346719 - DNA, 19 bp, Homo sapiens
atgaattgagcacttacta

SEQ ID NO: 7346720 - DNA, 22 bp, Homo sapiens
gaaaagaactgcatgggattaa

SEQ ID NO: 7346721 - DNA, 22 bp, Homo sapiens
gaaaacttggatctctagaatg

SEQ ID NO: 7346722 - DNA, 22 bp, Homo sapiens
gaaaatagttcatcacaatgat

SEQ ID NO: 7346723 - DNA, 22 bp, Homo sapiens
gaaaatctgcttatattatttt

SEQ ID NO: 7346724 - DNA, 22 bp, Homo sapiens
cttgagatgtcatctgctttgg

SEQ ID NO: 7346725 - DNA, 22 bp, Homo sapiens
cttgagggcaggattctgtttt

SEQ ID NO: 7346726 - DNA, 22 bp, Homo sapiens
cttgagggactctatgacttag

SEQ ID NO: 7346727 - DNA, 22 bp, Homo sapiens
atgaatgacatctgattccata

SEQ ID NO: 7346728 - DNA, 22 bp, Homo sapiens
atgaatatgtacacatctgtca

SEQ ID NO: 7346729 - DNA, 22 bp, Homo sapiens
atgaatattgaatgtcttatga

SEQ ID NO: 7346730 - DNA, 21 bp, Homo sapiens
cttgagaattaactgttcatt

SEQ ID NO: 7346731 - DNA, 22 bp, Homo sapiens
cttgagaaaggaacaggaagct

SEQ ID NO: 7346732 - DNA, 22 bp, Homo sapiens
atcttcagcgaggtttcctttc

SEQ ID NO: 7346733 - DNA, 22 bp, Homo sapiens
atgcttaagctcagttatatat

SEQ ID NO: 7346734 - DNA, 22 bp, Homo sapiens
atgcttaatacactgttaaagg

SEQ ID NO: 7346735 - DNA, 22 bp, Homo sapiens
gacataaaccttgagatattaa

SEQ ID NO: 7346736 - DNA, 22 bp, Homo sapiens
gacagttttgctgaaattgagc

SEQ ID NO: 7346737 - DNA, 22 bp, Homo sapiens
gacagtttttaatcctttcatg

SEQ ID NO: 7346738 - DNA, 22 bp, Homo sapiens
gacagtttaagcacctaatatt

SEQ ID NO: 7346739 - DNA, 22 bp, Homo sapiens
gacagtttaggttcaaatctca

SEQ ID NO: 7346740 - DNA, 22 bp, Homo sapiens
gacagtttctgaatgcgtactt

SEQ ID NO: 7346741 - DNA, 22 bp, Homo sapiens
gacagtttggatgggggtttgc

SEQ ID NO: 7346742 - DNA, 22 bp, Homo sapiens
gacagttttgctaaaaggttga

SEQ ID NO: 7346743 - DNA, 22 bp, Homo sapiens
gacagggccgcagatggagact

SEQ ID NO: 7346744 - DNA, 22 bp, Homo sapiens
gacagggccgcagatggagact

SEQ ID NO: 7346745 - DNA, 22 bp, Homo sapiens
gacagggcatggtgcagagttc

SEQ ID NO: 7346746 - DNA, 22 bp, Homo sapiens
gacagggcatggtgcagagttc

SEQ ID NO: 7346747 - DNA, 22 bp, Homo sapiens
gaccctccactcactgctgtgt

SEQ ID NO: 7346748 - DNA, 18 bp, Homo sapiens
gaccccgggatctgtcga

SEQ ID NO: 7346749 - DNA, 18 bp, Homo sapiens
gaccccgggatctgtcga

SEQ ID NO: 7346750 - DNA, 22 bp, Homo sapiens
gaccccaggcagatcagggggt

SEQ ID NO: 7346751 - DNA, 22 bp, Homo sapiens
gacccggctccaggcccagcag

SEQ ID NO: 7346752 - DNA, 22 bp, Homo sapiens
gaccccagaggaaggggcgccg

SEQ ID NO: 7346753 - DNA, 22 bp, Homo sapiens
gactggggctctagccaggcct

SEQ ID NO: 7346754 - DNA, 22 bp, Homo sapiens
gactgggggcagccgcaccagt

SEQ ID NO: 7346755 - DNA, 22 bp, Homo sapiens
gactgggggcagccgcaccagt

SEQ ID NO: 7346756 - DNA, 22 bp, Homo sapiens
gactggggtaaggtgaggaggt

SEQ ID NO: 7346757 - DNA, 22 bp, Homo sapiens
gacagggacgaggcttcaggca

SEQ ID NO: 7346758 - DNA, 22 bp, Homo sapiens
atgcctgcttactccaggtgct

SEQ ID NO: 7346759 - DNA, 22 bp, Homo sapiens
atgcccgatacctagttaactc

SEQ ID NO: 7346760 - DNA, 22 bp, Homo sapiens
gaagcagagcctaaggcagaca

SEQ ID NO: 7346761 - DNA, 22 bp, Homo sapiens
gaagcagaaggtttggacgtgc

SEQ ID NO: 7346762 - DNA, 22 bp, Homo sapiens
gaagcactgtgctgctaagttg

SEQ ID NO: 7346763 - DNA, 22 bp, Homo sapiens
gaatcatagaacattaatagaa

SEQ ID NO: 7346764 - DNA, 22 bp, Homo sapiens
gaatcatgctcaataatgcttg

SEQ ID NO: 7346765 - DNA, 22 bp, Homo sapiens
gaatcatgtctagaagcagtgg

SEQ ID NO: 7346766 - DNA, 22 bp, Homo sapiens
gaagcacatggctatagctatt

SEQ ID NO: 7346767 - DNA, 22 bp, Homo sapiens
gaagcacagaatggttaacatg

SEQ ID NO: 7346768 - DNA, 22 bp, Homo sapiens
gaagcacagggctcgatctcag

SEQ ID NO: 7346769 - DNA, 19 bp, Homo sapiens
atgcatacttgcatagttt

SEQ ID NO: 7346770 - DNA, 22 bp, Homo sapiens
atgcatacagatttaaaatttt

SEQ ID NO: 7346771 - DNA, 22 bp, Homo sapiens
gaatgtttcatgtgtatgttag

SEQ ID NO: 7346772 - DNA, 22 bp, Homo sapiens
gaatgtttcatgtgtatgttag

SEQ ID NO: 7346773 - DNA, 20 bp, Homo sapiens
gaatgtttcacttgctccat

SEQ ID NO: 7346774 - DNA, 22 bp, Homo sapiens
gaatgtttaaggaaggcgtggc

SEQ ID NO: 7346775 - DNA, 22 bp, Homo sapiens
gaatgtttaaggaaggcgtggc

SEQ ID NO: 7346776 - DNA, 22 bp, Homo sapiens
gaatgtttaaaaggtgcagttt

SEQ ID NO: 7346777 - DNA, 22 bp, Homo sapiens
gaatgtttaaaaggtgcagttt

SEQ ID NO: 7346778 - DNA, 20 bp, Homo sapiens
gaatgtttcacttgctccat

SEQ ID NO: 7346779 - DNA, 19 bp, Homo sapiens
gaatgtttctgtctcttct

SEQ ID NO: 7346780 - DNA, 19 bp, Homo sapiens
gaatgtttctgtctcttct

SEQ ID NO: 7346781 - DNA, 22 bp, Homo sapiens
gaatgtttgactaaaggtagct

SEQ ID NO: 7346782 - DNA, 22 bp, Homo sapiens
gaatgtgggctgtgaagaggag

SEQ ID NO: 7346783 - DNA, 22 bp, Homo sapiens
gaatgttactttgattttgtcc

SEQ ID NO: 7346784 - DNA, 22 bp, Homo sapiens
gaatgtcagggccagaagaggc

SEQ ID NO: 7346785 - DNA, 22 bp, Homo sapiens
gaatgtcagttgcgggcatttc

SEQ ID NO: 7346786 - DNA, 21 bp, Homo sapiens
gaatgtctgccttcacaatga

SEQ ID NO: 7346787 - DNA, 22 bp, Homo sapiens
atgtaaggctgcctatgacact

SEQ ID NO: 7346788 - DNA, 22 bp, Homo sapiens
atgtaaggagccacagtggggg

SEQ ID NO: 7346789 - DNA, 22 bp, Homo sapiens
atgtaaggctgcctatgacact

SEQ ID NO: 7346790 - DNA, 22 bp, Homo sapiens
atgtaaggttcagagtatgtga

SEQ ID NO: 7346791 - DNA, 22 bp, Homo sapiens
atgtaatagggtaacataacat

SEQ ID NO: 7346792 - DNA, 22 bp, Homo sapiens
atgtaaggttcagagtatgtga

SEQ ID NO: 7346793 - DNA, 17 bp, Homo sapiens
atgtaagaagaaagcag

SEQ ID NO: 7346794 - DNA, 22 bp, Homo sapiens
atgtaacaaatggtatacatgt

SEQ ID NO: 7346795 - DNA, 22 bp, Homo sapiens
atgtaaattgtactgacacacg

SEQ ID NO: 7346796 - DNA, 22 bp, Homo sapiens
atgtcacaggcaacaagattgc

SEQ ID NO: 7346797 - DNA, 22 bp, Homo sapiens
atgtcacagcaggagtattctt

SEQ ID NO: 7346798 - DNA, 22 bp, Homo sapiens
atgtcacagttgcaacatgaat

SEQ ID NO: 7346799 - DNA, 22 bp, Homo sapiens
atgtacaaaatgttttgaaatg

SEQ ID NO: 7346800 - DNA, 22 bp, Homo sapiens
atgtacaaaatgttttgaaatg

SEQ ID NO: 7346801 - DNA, 22 bp, Homo sapiens
atgtacaatctatcacaagaag

SEQ ID NO: 7346802 - DNA, 22 bp, Homo sapiens
gagctttgcattattcagaagc

SEQ ID NO: 7346803 - DNA, 22 bp, Homo sapiens
gaggaaggaatgcagtgtatgc

SEQ ID NO: 7346804 - DNA, 22 bp, Homo sapiens
gaggaaggagggaaagcgcgcg

SEQ ID NO: 7346805 - DNA, 22 bp, Homo sapiens
gaggaaggatttagtttgaggg

SEQ ID NO: 7346806 - DNA, 22 bp, Homo sapiens
gaggaaggctaaggggcttaga

SEQ ID NO: 7346807 - DNA, 22 bp, Homo sapiens
gagctctgggaaacaaagtgta

SEQ ID NO: 7346808 - DNA, 22 bp, Homo sapiens
gagctctggcagggcaggtctg

SEQ ID NO: 7346809 - DNA, 22 bp, Homo sapiens
gagctctgctactcaaagtatg

SEQ ID NO: 7346810 - DNA, 22 bp, Homo sapiens
gagctggggcggatactcagct

SEQ ID NO: 7346811 - DNA, 22 bp, Homo sapiens
gagaggtggaggttgcagtgag

SEQ ID NO: 7346812 - DNA, 22 bp, Homo sapiens
gagaggctctgaggactggggt

SEQ ID NO: 7346813 - DNA, 22 bp, Homo sapiens
gagaggctctgaggactggggt

SEQ ID NO: 7346814 - DNA, 22 bp, Homo sapiens
gagaggctccgccactgctcag

SEQ ID NO: 7346815 - DNA, 22 bp, Homo sapiens
gagaggaatgaggttaaggact

SEQ ID NO: 7346816 - DNA, 22 bp, Homo sapiens
gagaggctgcatatgcacactg

SEQ ID NO: 7346817 - DNA, 22 bp, Homo sapiens
gagaggctgcatatgcacactg

SEQ ID NO: 7346818 - DNA, 22 bp, Homo sapiens
gagaggctggcagtgccaggtt

SEQ ID NO: 7346819 - DNA, 22 bp, Homo sapiens
gagaggtcatctcccatcagca

SEQ ID NO: 7346820 - DNA, 22 bp, Homo sapiens
gagaggtcatctcccatcagca

SEQ ID NO: 7346821 - DNA, 22 bp, Homo sapiens
gagaggctgaaatcacaggagc

SEQ ID NO: 7346822 - DNA, 22 bp, Homo sapiens
gagaggctgatcctgcagagaa

SEQ ID NO: 7346823 - DNA, 23 bp, Homo sapiens
gagctctgcactaggccctggga

SEQ ID NO: 7346824 - DNA, 22 bp, Homo sapiens
gagcagggccacttctgtacct

SEQ ID NO: 7346825 - DNA, 22 bp, Homo sapiens
gagccctgaacaacagcaggaa

SEQ ID NO: 7346826 - DNA, 22 bp, Homo sapiens
gagcagggagacaactctggtg

SEQ ID NO: 7346827 - DNA, 22 bp, Homo sapiens
gagggggtctatgaggtagagc

SEQ ID NO: 7346828 - DNA, 22 bp, Homo sapiens
gaggggtcacatgggctggctt

SEQ ID NO: 7346829 - DNA, 22 bp, Homo sapiens
gaggtagctcttactctctccg

SEQ ID NO: 7346830 - DNA, 22 bp, Homo sapiens
gaggttggggctgcagtgagct

SEQ ID NO: 7346831 - DNA, 22 bp, Homo sapiens
gagggggctccctgaagccagt

SEQ ID NO: 7346832 - DNA, 22 bp, Homo sapiens
gagggggctagcgcagtgccca

SEQ ID NO: 7346833 - DNA, 22 bp, Homo sapiens
gagggggctagcgcagtgccca

SEQ ID NO: 7346834 - DNA, 22 bp, Homo sapiens
gagggggctagcgcagtgccca

SEQ ID NO: 7346835 - DNA, 22 bp, Homo sapiens
gaggggggcgccctgcagtgca

SEQ ID NO: 7346836 - DNA, 22 bp, Homo sapiens
gagggggctctgccaacctgtc

SEQ ID NO: 7346837 - DNA, 22 bp, Homo sapiens
gagggggctctgccaacctgtc

SEQ ID NO: 7346838 - DNA, 22 bp, Homo sapiens
gagggggcgtgcaaggctccgc

SEQ ID NO: 7346839 - DNA, 22 bp, Homo sapiens
gagggggcgaacagaagcaagg

SEQ ID NO: 7346840 - DNA, 22 bp, Homo sapiens
gaggggagcccccatcctccag

SEQ ID NO: 7346841 - DNA, 22 bp, Homo sapiens
gagggcaccagaagagccagat

SEQ ID NO: 7346842 - DNA, 22 bp, Homo sapiens
gagggcagaaaattatgcggtg

SEQ ID NO: 7346843 - DNA, 22 bp, Homo sapiens
gagggcactcgagactacggca

SEQ ID NO: 7346844 - DNA, 22 bp, Homo sapiens
gagggaaaataaaattgcagta

SEQ ID NO: 7346845 - DNA, 22 bp, Homo sapiens
gaggcttgcaccatgagcacca

SEQ ID NO: 7346846 - DNA, 22 bp, Homo sapiens
gaggctgttggctgatctgagt

SEQ ID NO: 7346847 - DNA, 22 bp, Homo sapiens
gagggaaaggttaatacatgat

SEQ ID NO: 7346848 - DNA, 22 bp, Homo sapiens
gagggaaacagatgggttgtgg

SEQ ID NO: 7346849 - DNA, 22 bp, Homo sapiens
gagggatggtgtgagaggctca

SEQ ID NO: 7346850 - DNA, 22 bp, Homo sapiens
gagggatgtgcctgaaggcagg

SEQ ID NO: 7346851 - DNA, 22 bp, Homo sapiens
gagggatggtgtgagaggctca

SEQ ID NO: 7346852 - DNA, 22 bp, Homo sapiens
atgtcacatggcctgtactttg

SEQ ID NO: 7346853 - DNA, 22 bp, Homo sapiens
atgtcacatggtcacctctagc

SEQ ID NO: 7346854 - DNA, 22 bp, Homo sapiens
gaggccaatgaagtgagtttaa

SEQ ID NO: 7346855 - DNA, 22 bp, Homo sapiens
gaggctgttaggagggactctg

SEQ ID NO: 7346856 - DNA, 22 bp, Homo sapiens
gaggctgctttgatgacaggag

SEQ ID NO: 7346857 - DNA, 22 bp, Homo sapiens
gatccttgcaactctgtgaggt

SEQ ID NO: 7346858 - DNA, 22 bp, Homo sapiens
gatccttgcacttgacttggca

SEQ ID NO: 7346859 - DNA, 22 bp, Homo sapiens
gatctgggagcctcatggagac

SEQ ID NO: 7346860 - DNA, 22 bp, Homo sapiens
atgtttctaaaacttgcatggc

SEQ ID NO: 7346861 - DNA, 22 bp, Homo sapiens
gatctggaagaaagggagggca

SEQ ID NO: 7346862 - DNA, 22 bp, Homo sapiens
gatctgaagatatgaaatattt

SEQ ID NO: 7346863 - DNA, 16 bp, Homo sapiens
gatctgaaggtgctgg

SEQ ID NO: 7346864 - DNA, 22 bp, Homo sapiens
gatctgaatagacttgctaagg

SEQ ID NO: 7346865 - DNA, 22 bp, Homo sapiens
gatctgaatcaatagaataact

SEQ ID NO: 7346866 - DNA, 22 bp, Homo sapiens
gatctgaagagcaatgaaatat

SEQ ID NO: 7346867 - DNA, 22 bp, Homo sapiens
gatctgaaatagctactgcaga

SEQ ID NO: 7346868 - DNA, 22 bp, Homo sapiens
gatctgaaccttgcctgttggg

SEQ ID NO: 7346869 - DNA, 22 bp, Homo sapiens
gatctgaagagttattttctga

SEQ ID NO: 7346870 - DNA, 22 bp, Homo sapiens
gatctctgaatctgaagccttc

SEQ ID NO: 7346871 - DNA, 22 bp, Homo sapiens
gatctctgtggactcttagcac

SEQ ID NO: 7346872 - DNA, 22 bp, Homo sapiens
gatctgaaaatgctcttcttct

SEQ ID NO: 7346873 - DNA, 18 bp, Homo sapiens
gatctctgcagtgcctac

SEQ ID NO: 7346874 - DNA, 21 bp, Homo sapiens
gatctctggaatgactctggc

SEQ ID NO: 7346875 - DNA, 23 bp, Homo sapiens
gagtgcagaatagacatgcagtg

SEQ ID NO: 7346876 - DNA, 22 bp, Homo sapiens
gagtgcagatgaacagaagatt

SEQ ID NO: 7346877 - DNA, 22 bp, Homo sapiens
gagtgcagatgaacagaagatt

SEQ ID NO: 7346878 - DNA, 22 bp, Homo sapiens
gagtgcaggcctgagcaccatc

SEQ ID NO: 7346879 - DNA, 22 bp, Homo sapiens
gagtccagtgtttaccaggggt

SEQ ID NO: 7346880 - DNA, 22 bp, Homo sapiens
atgtttcagttctaaagttaga

SEQ ID NO: 7346881 - DNA, 22 bp, Homo sapiens
atgtttcatcagtaaggttttg

SEQ ID NO: 7346882 - DNA, 22 bp, Homo sapiens
atgtttcaggaaatcagctaga

SEQ ID NO: 7346883 - DNA, 22 bp, Homo sapiens
atgtttcagttctaaagttaga

SEQ ID NO: 7346884 - DNA, 22 bp, Homo sapiens
atgtttcaccagcaaattacct

SEQ ID NO: 7346885 - DNA, 22 bp, Homo sapiens
atgtttcaccagttttataaga

SEQ ID NO: 7346886 - DNA, 22 bp, Homo sapiens
atgtttcaccagttttataaga

SEQ ID NO: 7346887 - DNA, 22 bp, Homo sapiens
atgtttcaagagaaaaagagac

SEQ ID NO: 7346888 - DNA, 22 bp, Homo sapiens
atgtttcaataatgctgtgagt

SEQ ID NO: 7346889 - DNA, 22 bp, Homo sapiens
atgtttcaaatatatagagttg

SEQ ID NO: 7346890 - DNA, 22 bp, Homo sapiens
caaatgaatagggagtgtgatg

SEQ ID NO: 7346891 - DNA, 22 bp, Homo sapiens
caaatgaagggagctgaagtct

SEQ ID NO: 7346892 - DNA, 22 bp, Homo sapiens
caaatgaagagggcaacttctg

SEQ ID NO: 7346893 - DNA, 22 bp, Homo sapiens
caaatgaatttccctgcaaatg

SEQ ID NO: 7346894 - DNA, 22 bp, Homo sapiens
caaattcaatgaacatgtttaa

SEQ ID NO: 7346895 - DNA, 22 bp, Homo sapiens
caaattagaggtttgttttgat

SEQ ID NO: 7346896 - DNA, 22 bp, Homo sapiens
caaattcaaatttcatcagtgt

SEQ ID NO: 7346897 - DNA, 22 bp, Homo sapiens
gctgaggaagtcaggtggccca

SEQ ID NO: 7346898 - DNA, 22 bp, Homo sapiens
gctgaggaagtcaggtggccca

SEQ ID NO: 7346899 - DNA, 20 bp, Homo sapiens
gctgactgtttgggtggcgg

SEQ ID NO: 7346900 - DNA, 22 bp, Homo sapiens
caaatctaggatgcatgtagtg

SEQ ID NO: 7346901 - DNA, 22 bp, Homo sapiens
caaatgaaaatggcgtcttgga

SEQ ID NO: 7346902 - DNA, 22 bp, Homo sapiens
gctctgggtgaacttggagcaa

SEQ ID NO: 7346903 - DNA, 22 bp, Homo sapiens
gctctgggtgaatggcagattg

SEQ ID NO: 7346904 - DNA, 22 bp, Homo sapiens
caaatagacttaagcatctgta

SEQ ID NO: 7346905 - DNA, 22 bp, Homo sapiens
caaatcacaatgtgagactgag

SEQ ID NO: 7346906 - DNA, 22 bp, Homo sapiens
caaatcaccacttaatgggtta

SEQ ID NO: 7346907 - DNA, 22 bp, Homo sapiens
gctatttctttaaattgatctc

SEQ ID NO: 7346908 - DNA, 22 bp, Homo sapiens
gctatttttgagccatttataa

SEQ ID NO: 7346909 - DNA, 22 bp, Homo sapiens
gctatttctatattataaagaa

SEQ ID NO: 7346910 - DNA, 22 bp, Homo sapiens
gctcagggctaaggctgagggg

SEQ ID NO: 7346911 - DNA, 22 bp, Homo sapiens
gctacacaaaaggagagtgagt

SEQ ID NO: 7346912 - DNA, 22 bp, Homo sapiens
gctattgtgacagcttttcgcc

SEQ ID NO: 7346913 - DNA, 22 bp, Homo sapiens
gctattgtacatttcttgtttg

SEQ ID NO: 7346914 - DNA, 22 bp, Homo sapiens
gctatgttagacattctcattt

SEQ ID NO: 7346915 - DNA, 22 bp, Homo sapiens
gctatgtcaagtgtacatacca

SEQ ID NO: 7346916 - DNA, 22 bp, Homo sapiens
gctatggctcaccatgtcctgg

SEQ ID NO: 7346917 - DNA, 22 bp, Homo sapiens
gctatggctttggaatagctgt

SEQ ID NO: 7346918 - DNA, 22 bp, Homo sapiens
gctatgggatgtgctgtggatg

SEQ ID NO: 7346919 - DNA, 22 bp, Homo sapiens
gctaagaaaaattcatgtatat

SEQ ID NO: 7346920 - DNA, 22 bp, Homo sapiens
gctaaggaggaatagtgaggca

SEQ ID NO: 7346921 - DNA, 22 bp, Homo sapiens
gcgtggggtaggtagacatgga

SEQ ID NO: 7346922 - DNA, 22 bp, Homo sapiens
gcgttaaggtttcaaggggtgg

SEQ ID NO: 7346923 - DNA, 22 bp, Homo sapiens
gctaaaataactgagtttttgc

SEQ ID NO: 7346924 - DNA, 22 bp, Homo sapiens
gcctggctctgagggagctcct

SEQ ID NO: 7346925 - DNA, 22 bp, Homo sapiens
gcgcaggagccgcggagggccg

SEQ ID NO: 7346926 - DNA, 22 bp, Homo sapiens
gcgcaggagccgcggagggccg

SEQ ID NO: 7346927 - DNA, 22 bp, Homo sapiens
gctccaggcgagctggaccaga

SEQ ID NO: 7346928 - DNA, 22 bp, Homo sapiens
gctccaggcgagctggaccaga

SEQ ID NO: 7346929 - DNA, 22 bp, Homo sapiens
gctcagggtcccttggtgctgg

SEQ ID NO: 7346930 - DNA, 22 bp, Homo sapiens
gctcagggtcccttggtgctgg

SEQ ID NO: 7346931 - DNA, 22 bp, Homo sapiens
gctcaggggaatgggctgccgt

SEQ ID NO: 7346932 - DNA, 22 bp, Homo sapiens
gctcaggggaatgggctgccgt

SEQ ID NO: 7346933 - DNA, 22 bp, Homo sapiens
gctcagggtcccttggtgctgg

SEQ ID NO: 7346934 - DNA, 22 bp, Homo sapiens
gctcagggctaaggctgagggg

SEQ ID NO: 7346935 - DNA, 22 bp, Homo sapiens
gctcagggctaaggctgagggg

SEQ ID NO: 7346936 - DNA, 22 bp, Homo sapiens
gctcgcgccgcaccggtccacc

SEQ ID NO: 7346937 - DNA, 22 bp, Homo sapiens
gctcgcgccgcaccggtccacc

SEQ ID NO: 7346938 - DNA, 22 bp, Homo sapiens
gctcggagaactgggggctccg

SEQ ID NO: 7346939 - DNA, 22 bp, Homo sapiens
gctcctggatgttcaagtcggc

SEQ ID NO: 7346940 - DNA, 22 bp, Homo sapiens
gctccagggaacagaatgtact

SEQ ID NO: 7346941 - DNA, 17 bp, Homo sapiens
gctccaggcgtgagtga

SEQ ID NO: 7346942 - DNA, 22 bp, Homo sapiens
gctctaaagtccagtcaactag

SEQ ID NO: 7346943 - DNA, 22 bp, Homo sapiens
gctctaaagagaatctatgcgg

SEQ ID NO: 7346944 - DNA, 22 bp, Homo sapiens
gctctaggttcctagccaagtc

SEQ ID NO: 7346945 - DNA, 22 bp, Homo sapiens
gctctagattgttacaaagttc

SEQ ID NO: 7346946 - DNA, 22 bp, Homo sapiens
gctctagcccatttcctgcttg

SEQ ID NO: 7346947 - DNA, 19 bp, Homo sapiens
gccctcctcactgagctct

SEQ ID NO: 7346948 - DNA, 19 bp, Homo sapiens
gccctcctcactgagctct

SEQ ID NO: 7346949 - DNA, 22 bp, Homo sapiens
gccctcccctctgggtggtgag

SEQ ID NO: 7346950 - DNA, 22 bp, Homo sapiens
gccctgccctctcggcactcgc

SEQ ID NO: 7346951 - DNA, 22 bp, Homo sapiens
gccctgccctgagccgtagacc

SEQ ID NO: 7346952 - DNA, 22 bp, Homo sapiens
gccctgccctgttgaaactaga

SEQ ID NO: 7346953 - DNA, 22 bp, Homo sapiens
gccctgccgggtattttgtgct

SEQ ID NO: 7346954 - DNA, 23 bp, Homo sapiens
gccctgcccttagcacactcaca

SEQ ID NO: 7346955 - DNA, 22 bp, Homo sapiens
gcccccttgacctaatcacctt

SEQ ID NO: 7346956 - DNA, 22 bp, Homo sapiens
gccccgtcgtggggccagggat

SEQ ID NO: 7346957 - DNA, 22 bp, Homo sapiens
atttacatttatttgagaaggt

SEQ ID NO: 7346958 - DNA, 18 bp, Homo sapiens
gccagagggaagcaggtg

SEQ ID NO: 7346959 - DNA, 22 bp, Homo sapiens
atttacagacgtggattagtgc

SEQ ID NO: 7346960 - DNA, 22 bp, Homo sapiens
gccagagggattcctggtgtgt

SEQ ID NO: 7346961 - DNA, 22 bp, Homo sapiens
gccagaggggctcgaaggcgcg

SEQ ID NO: 7346962 - DNA, 22 bp, Homo sapiens
gccagaggggctcgaaggcgcg

SEQ ID NO: 7346963 - DNA, 20 bp, Homo sapiens
gcccactctaatccactgtc

SEQ ID NO: 7346964 - DNA, 22 bp, Homo sapiens
gcccactccagcttctcccaca

SEQ ID NO: 7346965 - DNA, 22 bp, Homo sapiens
gcccactccagcttctcccaca

SEQ ID NO: 7346966 - DNA, 22 bp, Homo sapiens
gcccagcaggggatggcagctc

SEQ ID NO: 7346967 - DNA, 22 bp, Homo sapiens
gcccagccacagtcactttcat

SEQ ID NO: 7346968 - DNA, 22 bp, Homo sapiens
gcccagcccctgggtggacgtg

SEQ ID NO: 7346969 - DNA, 22 bp, Homo sapiens
gcccagcccagaaaggttcgga

SEQ ID NO: 7346970 - DNA, 22 bp, Homo sapiens
gcccagccagagctgtgtgatg

SEQ ID NO: 7346971 - DNA, 22 bp, Homo sapiens
attttgaaatacttgaaggaaa

SEQ ID NO: 7346972 - DNA, 22 bp, Homo sapiens
attttcttctctccctggctgc

SEQ ID NO: 7346973 - DNA, 22 bp, Homo sapiens
attttctagatagatgatgcat

SEQ ID NO: 7346974 - DNA, 22 bp, Homo sapiens
gcctgcccacggggctggcata

SEQ ID NO: 7346975 - DNA, 22 bp, Homo sapiens
attttactactccaattaatga

SEQ ID NO: 7346976 - DNA, 22 bp, Homo sapiens
attttacataaggaaggtttaa

SEQ ID NO: 7346977 - DNA, 23 bp, Homo sapiens
gcctgccgcctggctgagaactg

SEQ ID NO: 7346978 - DNA, 22 bp, Homo sapiens
gcctgccccttcctgggcaggg

SEQ ID NO: 7346979 - DNA, 21 bp, Homo sapiens
atttgcattaaaatattacgc

SEQ ID NO: 7346980 - DNA, 20 bp, Homo sapiens
atttgcatctgaataactta

SEQ ID NO: 7346981 - DNA, 22 bp, Homo sapiens
atttgccttactgaagaaggag

SEQ ID NO: 7346982 - DNA, 23 bp, Homo sapiens
attttaaccttgactaacatgca

SEQ ID NO: 7346983 - DNA, 22 bp, Homo sapiens
atttgtctttggacctgtgaga

SEQ ID NO: 7346984 - DNA, 22 bp, Homo sapiens
attttaaggcttatttaaaggc

SEQ ID NO: 7346985 - DNA, 22 bp, Homo sapiens
attttaataagatccatttggt

SEQ ID NO: 7346986 - DNA, 22 bp, Homo sapiens
atttgcatatctgatagactaa

SEQ ID NO: 7346987 - DNA, 18 bp, Homo sapiens
atttgcaggcatgcaggc

SEQ ID NO: 7346988 - DNA, 22 bp, Homo sapiens
atttgagaaaggagggaacttt

SEQ ID NO: 7346989 - DNA, 22 bp, Homo sapiens
gcagccaggaagcctttccctc

SEQ ID NO: 7346990 - DNA, 21 bp, Homo sapiens
gcagccaggactttgggctgg

SEQ ID NO: 7346991 - DNA, 22 bp, Homo sapiens
gcagccaggctacagcgggctt

SEQ ID NO: 7346992 - DNA, 22 bp, Homo sapiens
gcagccagggagagaaccaggg

SEQ ID NO: 7346993 - DNA, 22 bp, Homo sapiens
gcagccagggctaagctgggga

SEQ ID NO: 7346994 - DNA, 19 bp, Homo sapiens
gcagccaggtgctctacct

SEQ ID NO: 7346995 - DNA, 22 bp, Homo sapiens
gcagccagggttaattatattt

SEQ ID NO: 7346996 - DNA, 22 bp, Homo sapiens
gcagccaggggctgtgacctgt

SEQ ID NO: 7346997 - DNA, 22 bp, Homo sapiens
gcagcctttggaattagagact

SEQ ID NO: 7346998 - DNA, 22 bp, Homo sapiens
gcagccttcctgacctctaccc

SEQ ID NO: 7346999 - DNA, 22 bp, Homo sapiens
gcaggagagtctgtgccaggtt

SEQ ID NO: 7347000 - DNA, 17 bp, Homo sapiens
gcagcctcttggtagtg

SEQ ID NO: 7347001 - DNA, 22 bp, Homo sapiens
gcagccaggtttgaggaccact

SEQ ID NO: 7347002 - DNA, 22 bp, Homo sapiens
gcagcctgggcaacagagtgag

SEQ ID NO: 7347003 - DNA, 22 bp, Homo sapiens
gcagaggctgtagggaaggttg

SEQ ID NO: 7347004 - DNA, 22 bp, Homo sapiens
gcagatctttaacagggtcact

SEQ ID NO: 7347005 - DNA, 22 bp, Homo sapiens
gcagaggctgggtgtcccagtc

SEQ ID NO: 7347006 - DNA, 22 bp, Homo sapiens
gcagaggctgtagggaaggttg

SEQ ID NO: 7347007 - DNA, 22 bp, Homo sapiens
gcagaggctgggtgtcccagtc

SEQ ID NO: 7347008 - DNA, 22 bp, Homo sapiens
gcagaggctctttaatgcttag

SEQ ID NO: 7347009 - DNA, 22 bp, Homo sapiens
gcagaggcctgaaggtggcggg

SEQ ID NO: 7347010 - DNA, 22 bp, Homo sapiens
gcagaggcctgaaggtggcggg

SEQ ID NO: 7347011 - DNA, 22 bp, Homo sapiens
gcagaggctccattttacagat

SEQ ID NO: 7347012 - DNA, 22 bp, Homo sapiens
gcagaggcctgaaggtggcggg

SEQ ID NO: 7347013 - DNA, 22 bp, Homo sapiens
gcagaggcctaggtggaaggcc

SEQ ID NO: 7347014 - DNA, 22 bp, Homo sapiens
gcagaatattatggaaaaagta

SEQ ID NO: 7347015 - DNA, 22 bp, Homo sapiens
gcagaatgtccaagctgggccc

SEQ ID NO: 7347016 - DNA, 22 bp, Homo sapiens
gcagaataatagaaaggcacac

SEQ ID NO: 7347017 - DNA, 22 bp, Homo sapiens
gcagaggcctaggtggaaggcc

SEQ ID NO: 7347018 - DNA, 16 bp, Homo sapiens
gcagaggaaaggggag

SEQ ID NO: 7347019 - DNA, 16 bp, Homo sapiens
gcagaggaaaggggag

SEQ ID NO: 7347020 - DNA, 22 bp, Homo sapiens
gcagaaggttgtttgggaaagg

SEQ ID NO: 7347021 - DNA, 22 bp, Homo sapiens
gcagaagtaggctctgtgtagg

SEQ ID NO: 7347022 - DNA, 22 bp, Homo sapiens
gcagaagtggtgctgtgccact

SEQ ID NO: 7347023 - DNA, 22 bp, Homo sapiens
gcagaaggtctggcacttcagg

SEQ ID NO: 7347024 - DNA, 22 bp, Homo sapiens
gcagaaggttgtttgggaaagg

SEQ ID NO: 7347025 - DNA, 22 bp, Homo sapiens
gcagaagggaataaggagcttt

SEQ ID NO: 7347026 - DNA, 22 bp, Homo sapiens
gcagaaggtcaaagcaagatgt

SEQ ID NO: 7347027 - DNA, 22 bp, Homo sapiens
gcagaagggaataaggagcttt

SEQ ID NO: 7347028 - DNA, 22 bp, Homo sapiens
gcactgtgacccagagcaggtg

SEQ ID NO: 7347029 - DNA, 22 bp, Homo sapiens
gcacacagggatttttgaatgg

SEQ ID NO: 7347030 - DNA, 22 bp, Homo sapiens
gcaaattaaccaatcatgctcg

SEQ ID NO: 7347031 - DNA, 22 bp, Homo sapiens
gcaacaagtgtaaacatgcatt

SEQ ID NO: 7347032 - DNA, 22 bp, Homo sapiens
gatttctgtggcttgtacatat

SEQ ID NO: 7347033 - DNA, 22 bp, Homo sapiens
atgtttctcactgtttctctat

SEQ ID NO: 7347034 - DNA, 22 bp, Homo sapiens
atgtttctcactgtttctctat

SEQ ID NO: 7347035 - DNA, 22 bp, Homo sapiens
gcaaaacagtcgatgcctccca

SEQ ID NO: 7347036 - DNA, 18 bp, Homo sapiens
gcacagagcccaggctct

SEQ ID NO: 7347037 - DNA, 18 bp, Homo sapiens
gcacagagcccaggctct

SEQ ID NO: 7347038 - DNA, 20 bp, Homo sapiens
gcacagagatgagcaaagta

SEQ ID NO: 7347039 - DNA, 22 bp, Homo sapiens
gcacagaggatgaggcagctct

SEQ ID NO: 7347040 - DNA, 22 bp, Homo sapiens
gcacagaggaagcacagactct

SEQ ID NO: 7347041 - DNA, 22 bp, Homo sapiens
gcacagaggatgaggcagctct

SEQ ID NO: 7347042 - DNA, 22 bp, Homo sapiens
gcacagggagacagccgtggcc

SEQ ID NO: 7347043 - DNA, 21 bp, Homo sapiens
gcacagggacagatcatcaca

SEQ ID NO: 7347044 - DNA, 22 bp, Homo sapiens
gcactggtgtgaaacagtagat

SEQ ID NO: 7347045 - DNA, 22 bp, Homo sapiens
gcactgggtgtgaggcagcgtc

SEQ ID NO: 7347046 - DNA, 22 bp, Homo sapiens
gcactgggtgggagatctgaat

SEQ ID NO: 7347047 - DNA, 22 bp, Homo sapiens
gcactgggggcagcagtgaggg

SEQ ID NO: 7347048 - DNA, 22 bp, Homo sapiens
gcacagggaggctggcctggcc

SEQ ID NO: 7347049 - DNA, 22 bp, Homo sapiens
gcacagggagcaggtctctggt

SEQ ID NO: 7347050 - DNA, 23 bp, Homo sapiens
gcactgggctctcagcaaggtgt

SEQ ID NO: 7347051 - DNA, 22 bp, Homo sapiens
gcactgggggcagcagtgaggg

SEQ ID NO: 7347052 - DNA, 22 bp, Homo sapiens
gcactgggggcagcagtgaggg

SEQ ID NO: 7347053 - DNA, 22 bp, Homo sapiens
gcaggagcagtcaggggcagct

SEQ ID NO: 7347054 - DNA, 22 bp, Homo sapiens
gcaggagcaaactgcagtgtgg

SEQ ID NO: 7347055 - DNA, 18 bp, Homo sapiens
gcaggagatgggtggggt

SEQ ID NO: 7347056 - DNA, 18 bp, Homo sapiens
gcaggagatgggtggggt

SEQ ID NO: 7347057 - DNA, 22 bp, Homo sapiens
gcaggatgaactaacacctgca

SEQ ID NO: 7347058 - DNA, 22 bp, Homo sapiens
gcaggatgggtgtagcccagca

SEQ ID NO: 7347059 - DNA, 22 bp, Homo sapiens
gcaggcggaggttgcagtgagc

SEQ ID NO: 7347060 - DNA, 22 bp, Homo sapiens
gcaggatgccagggcagcagcg

SEQ ID NO: 7347061 - DNA, 22 bp, Homo sapiens
gcaggctgtctaaagttagagt

SEQ ID NO: 7347062 - DNA, 22 bp, Homo sapiens
gcaggctgtctaaagttagagt

SEQ ID NO: 7347063 - DNA, 22 bp, Homo sapiens
gcaggctgtagacaccaaacta

SEQ ID NO: 7347064 - DNA, 22 bp, Homo sapiens
gcaggctggtctgaccatccct

SEQ ID NO: 7347065 - DNA, 22 bp, Homo sapiens
gcaggctgtgaggctcagatgg

SEQ ID NO: 7347066 - DNA, 22 bp, Homo sapiens
gcaggctgtggtatgttgggca

SEQ ID NO: 7347067 - DNA, 22 bp, Homo sapiens
gcagggactttggcaacaggtg

SEQ ID NO: 7347068 - DNA, 22 bp, Homo sapiens
gcagggactttggcaacaggtg

SEQ ID NO: 7347069 - DNA, 22 bp, Homo sapiens
gcagggactgtgatctcacaga

SEQ ID NO: 7347070 - DNA, 22 bp, Homo sapiens
gcagggacgccagggacagcaa

SEQ ID NO: 7347071 - DNA, 22 bp, Homo sapiens
gcaggtggatcacctgaggtca

SEQ ID NO: 7347072 - DNA, 22 bp, Homo sapiens
gcaggtggatcaccacgtcagg

SEQ ID NO: 7347073 - DNA, 22 bp, Homo sapiens
gcaggtggatcacctgaggtca

SEQ ID NO: 7347074 - DNA, 22 bp, Homo sapiens
gcagggattgtgcagggggcta

SEQ ID NO: 7347075 - DNA, 22 bp, Homo sapiens
gcagggggtcattcacgctggc

SEQ ID NO: 7347076 - DNA, 22 bp, Homo sapiens
gcaggggtagagattgctggtg

SEQ ID NO: 7347077 - DNA, 22 bp, Homo sapiens
gcaggggtggaggctgtcctgt

SEQ ID NO: 7347078 - DNA, 22 bp, Homo sapiens
gcaggggtagtgtcttcctgag

SEQ ID NO: 7347079 - DNA, 22 bp, Homo sapiens
gcagggtccatggaggcagccc

SEQ ID NO: 7347080 - DNA, 22 bp, Homo sapiens
gcaggggttttctgacttgagt

SEQ ID NO: 7347081 - DNA, 22 bp, Homo sapiens
gcaggggttttctgacttgagt

SEQ ID NO: 7347082 - DNA, 16 bp, Homo sapiens
gcaggggtgggtggag

SEQ ID NO: 7347083 - DNA, 22 bp, Homo sapiens
gcagggtctgaggccacagagg

SEQ ID NO: 7347084 - DNA, 22 bp, Homo sapiens
gcagggtcttgagaggcagcca

SEQ ID NO: 7347085 - DNA, 22 bp, Homo sapiens
gcagggtgaaggtcacatagaa

SEQ ID NO: 7347086 - DNA, 22 bp, Homo sapiens
gcagggtcgctctaggagatca

SEQ ID NO: 7347087 - DNA, 22 bp, Homo sapiens
gcagggtcgctctaggagatca

SEQ ID NO: 7347088 - DNA, 22 bp, Homo sapiens
gcattcctgagaatgcagagtg

SEQ ID NO: 7347089 - DNA, 15 bp, Homo sapiens
gcattcctcatttcc

SEQ ID NO: 7347090 - DNA, 22 bp, Homo sapiens
gcattcctacaggctgctatga

SEQ ID NO: 7347091 - DNA, 21 bp, Homo sapiens
gcattcctaggaggtaagcat

SEQ ID NO: 7347092 - DNA, 22 bp, Homo sapiens
gcattccttgttagcatttgat

SEQ ID NO: 7347093 - DNA, 22 bp, Homo sapiens
gcattccttggtttaaaacaag

SEQ ID NO: 7347094 - DNA, 22 bp, Homo sapiens
gcattcctgtacctctctgcta

SEQ ID NO: 7347095 - DNA, 22 bp, Homo sapiens
gcattccttgagttccctgtgc

SEQ ID NO: 7347096 - DNA, 22 bp, Homo sapiens
gccactgattccaagtcaattt

SEQ ID NO: 7347097 - DNA, 22 bp, Homo sapiens
gccactgattccaagtcaattt

SEQ ID NO: 7347098 - DNA, 22 bp, Homo sapiens
gccactgcactccagcccaggc

SEQ ID NO: 7347099 - DNA, 21 bp, Homo sapiens
gccactgcactccagcctggg

SEQ ID NO: 7347100 - DNA, 21 bp, Homo sapiens
gccactgcactccagcctggg

SEQ ID NO: 7347101 - DNA, 21 bp, Homo sapiens
gccactgcactccagcctggg

SEQ ID NO: 7347102 - DNA, 22 bp, Homo sapiens
gccacgttgccacccgggtgac

SEQ ID NO: 7347103 - DNA, 21 bp, Homo sapiens
gccacgtttcagtcttctcag

SEQ ID NO: 7347104 - DNA, 22 bp, Homo sapiens
attgttttgtagaatgaccctt

SEQ ID NO: 7347105 - DNA, 16 bp, Homo sapiens
attgttttcaattaga

SEQ ID NO: 7347106 - DNA, 22 bp, Homo sapiens
gccactgtcctgtgcctgtgct

SEQ ID NO: 7347107 - DNA, 22 bp, Homo sapiens
attgttttattaaatgagccct

SEQ ID NO: 7347108 - DNA, 22 bp, Homo sapiens
attgttttaattccattgtgaa

SEQ ID NO: 7347109 - DNA, 22 bp, Homo sapiens
gccactgtactccagcctgcga

SEQ ID NO: 7347110 - DNA, 22 bp, Homo sapiens
gccactgtagagtatggacaag

SEQ ID NO: 7347111 - DNA, 22 bp, Homo sapiens
gccactgtcatcttgtgaagca

SEQ ID NO: 7347112 - DNA, 22 bp, Homo sapiens
gccactgtcataccctggcaat

SEQ ID NO: 7347113 - DNA, 22 bp, Homo sapiens
attgtacaatgcctggaacatt

SEQ ID NO: 7347114 - DNA, 22 bp, Homo sapiens
gcagtgctaaggattctgcctt

SEQ ID NO: 7347115 - DNA, 22 bp, Homo sapiens
gcagtgctaagtagctggccca

SEQ ID NO: 7347116 - DNA, 22 bp, Homo sapiens
gcagtgctgatcccatggcaga

SEQ ID NO: 7347117 - DNA, 18 bp, Homo sapiens
gcagtgcaggaagaagag

SEQ ID NO: 7347118 - DNA, 22 bp, Homo sapiens
attgttgctaggattcaatgag

SEQ ID NO: 7347119 - DNA, 22 bp, Homo sapiens
attgtttacactaacttcataa

SEQ ID NO: 7347120 - DNA, 22 bp, Homo sapiens
gcattcacattgtggttgcacg

SEQ ID NO: 7347121 - DNA, 22 bp, Homo sapiens
ctgggtggagcctggtcatctg

SEQ ID NO: 7347122 - DNA, 22 bp, Homo sapiens
ctgggtggatcgcagccccagg

SEQ ID NO: 7347123 - DNA, 20 bp, Homo sapiens
ctgggtggcaagcaaggggg

SEQ ID NO: 7347124 - DNA, 22 bp, Homo sapiens
ctgggtggcagagcctgcagtg

SEQ ID NO: 7347125 - DNA, 22 bp, Homo sapiens
ctgggtggcagagcctgcagtg

SEQ ID NO: 7347126 - DNA, 22 bp, Homo sapiens
ctggtccctggacctccctgga

SEQ ID NO: 7347127 - DNA, 22 bp, Homo sapiens
atcaagaatgttcattcttcta

SEQ ID NO: 7347128 - DNA, 22 bp, Homo sapiens
ctggtcccagctctgccaccaa

SEQ ID NO: 7347129 - DNA, 22 bp, Homo sapiens
ctggtcccagctctgccaccaa

SEQ ID NO: 7347130 - DNA, 22 bp, Homo sapiens
ctgggggcaagcagacagctgt

SEQ ID NO: 7347131 - DNA, 23 bp, Homo sapiens
ctggggctttcaaatctgggcag

SEQ ID NO: 7347132 - DNA, 22 bp, Homo sapiens
atattattctagtaacagtgat

SEQ ID NO: 7347133 - DNA, 22 bp, Homo sapiens
ctgggggcaagcagacagctgt

SEQ ID NO: 7347134 - DNA, 22 bp, Homo sapiens
ctggggcttcaatgcttcggtg

SEQ ID NO: 7347135 - DNA, 19 bp, Homo sapiens
ctgggaggtgttcagagaa

SEQ ID NO: 7347136 - DNA, 22 bp, Homo sapiens
ctgggaggcggaggttgtagtg

SEQ ID NO: 7347137 - DNA, 22 bp, Homo sapiens
ctgggaggtggaggttgcattg

SEQ ID NO: 7347138 - DNA, 22 bp, Homo sapiens
ctgggaggtggaggttgcattg

SEQ ID NO: 7347139 - DNA, 22 bp, Homo sapiens
ctgggaggacaacttggagctc

SEQ ID NO: 7347140 - DNA, 22 bp, Homo sapiens
ctgggaggcggaggttgcagtg

SEQ ID NO: 7347141 - DNA, 22 bp, Homo sapiens
ctgggaggacaacttggagctc

SEQ ID NO: 7347142 - DNA, 22 bp, Homo sapiens
ctgggagcttgttaggaatgca

SEQ ID NO: 7347143 - DNA, 22 bp, Homo sapiens
ctgggagcttttagaaatgcag

SEQ ID NO: 7347144 - DNA, 22 bp, Homo sapiens
ctgggagcttgttaggaatgca

SEQ ID NO: 7347145 - DNA, 22 bp, Homo sapiens
atcacagcacacctgacatgta

SEQ ID NO: 7347146 - DNA, 22 bp, Homo sapiens
atcacagattgtgaataactat

SEQ ID NO: 7347147 - DNA, 22 bp, Homo sapiens
atcacaaaggtctcagagcaca

SEQ ID NO: 7347148 - DNA, 22 bp, Homo sapiens
atcacaaaggtctcagagcaca

SEQ ID NO: 7347149 - DNA, 22 bp, Homo sapiens
atcacaaaggtctcagagcaca

SEQ ID NO: 7347150 - DNA, 22 bp, Homo sapiens
atcacaaagggttttctctgag

SEQ ID NO: 7347151 - DNA, 22 bp, Homo sapiens
atcacaatccctctctctgata

SEQ ID NO: 7347152 - DNA, 22 bp, Homo sapiens
ctgtaagatgggataagacttt

SEQ ID NO: 7347153 - DNA, 21 bp, Homo sapiens
ctgtaagaaatcagttttatc

SEQ ID NO: 7347154 - DNA, 19 bp, Homo sapiens
atcagctgaagccttcaga

SEQ ID NO: 7347155 - DNA, 22 bp, Homo sapiens
atcagctgaaaaacaggcagca

SEQ ID NO: 7347156 - DNA, 22 bp, Homo sapiens
atcagctgatgaatggatgaat

SEQ ID NO: 7347157 - DNA, 22 bp, Homo sapiens
atcagcatctttaacaattacc

SEQ ID NO: 7347158 - DNA, 22 bp, Homo sapiens
atcagccaattacagaacatga

SEQ ID NO: 7347159 - DNA, 22 bp, Homo sapiens
ctgtctccagggcaggtgcagg

SEQ ID NO: 7347160 - DNA, 22 bp, Homo sapiens
atcagctggaacaagtgtctga

SEQ ID NO: 7347161 - DNA, 20 bp, Homo sapiens
atcagctggagaacattatg

SEQ ID NO: 7347162 - DNA, 22 bp, Homo sapiens
atcagctgctacattggcctct

SEQ ID NO: 7347163 - DNA, 22 bp, Homo sapiens
ctgtctcctccactgcatggga

SEQ ID NO: 7347164 - DNA, 22 bp, Homo sapiens
ctgtctctgataagctcgaggg

SEQ ID NO: 7347165 - DNA, 22 bp, Homo sapiens
atcagggtcttctttcagccta

SEQ ID NO: 7347166 - DNA, 22 bp, Homo sapiens
atcataaaattgcaccatttct

SEQ ID NO: 7347167 - DNA, 22 bp, Homo sapiens
atcagttttgttcactactata

SEQ ID NO: 7347168 - DNA, 22 bp, Homo sapiens
atcagtttttattaatgtagct

SEQ ID NO: 7347169 - DNA, 22 bp, Homo sapiens
atcagttttgggggacatactg

SEQ ID NO: 7347170 - DNA, 22 bp, Homo sapiens
atcagtttgtatatgaaacact

SEQ ID NO: 7347171 - DNA, 22 bp, Homo sapiens
atcagtttctaccatgtggaat

SEQ ID NO: 7347172 - DNA, 22 bp, Homo sapiens
atcagtttctgtgaagaacaca

SEQ ID NO: 7347173 - DNA, 22 bp, Homo sapiens
atcagtttctgtgaagaacaca

SEQ ID NO: 7347174 - DNA, 22 bp, Homo sapiens
atcagtttatacttataaatct

SEQ ID NO: 7347175 - DNA, 22 bp, Homo sapiens
atcagtttcacttgcttgcaaa

SEQ ID NO: 7347176 - DNA, 22 bp, Homo sapiens
atcagtttggtgctttcagtga

SEQ ID NO: 7347177 - DNA, 22 bp, Homo sapiens
atcagtttgagtgctgtgtcaa

SEQ ID NO: 7347178 - DNA, 22 bp, Homo sapiens
atcagtttgagtgctgtgtcaa

SEQ ID NO: 7347179 - DNA, 22 bp, Homo sapiens
atcagtttgataataaggcttg

SEQ ID NO: 7347180 - DNA, 22 bp, Homo sapiens
atcagtttggaacattcaggcc

SEQ ID NO: 7347181 - DNA, 22 bp, Homo sapiens
atcataaagtgctatctgattg

SEQ ID NO: 7347182 - DNA, 22 bp, Homo sapiens
atcataaaccactttgtaatct

SEQ ID NO: 7347183 - DNA, 22 bp, Homo sapiens
atcataaagtgctatctgattg

SEQ ID NO: 7347184 - DNA, 22 bp, Homo sapiens
cttcacaaaatatttcattata

SEQ ID NO: 7347185 - DNA, 22 bp, Homo sapiens
cttcacaaagctctctttatgt

SEQ ID NO: 7347186 - DNA, 22 bp, Homo sapiens
cttcacaaatggcctagagttc

SEQ ID NO: 7347187 - DNA, 22 bp, Homo sapiens
cttatgtatgctactttgtggt

SEQ ID NO: 7347188 - DNA, 22 bp, Homo sapiens
cttatgtatgctactttgtggt

SEQ ID NO: 7347189 - DNA, 22 bp, Homo sapiens
cttattaatggaatcctaatga

SEQ ID NO: 7347190 - DNA, 22 bp, Homo sapiens
atccatttcctccactataaag

SEQ ID NO: 7347191 - DNA, 22 bp, Homo sapiens
atccatttgacataatttcagc

SEQ ID NO: 7347192 - DNA, 22 bp, Homo sapiens
cttaataaatggtagctgttat

SEQ ID NO: 7347193 - DNA, 22 bp, Homo sapiens
atccatgaaggtacttctcagg

SEQ ID NO: 7347194 - DNA, 20 bp, Homo sapiens
atccatcagagaaaataaag

SEQ ID NO: 7347195 - DNA, 22 bp, Homo sapiens
atcatcagggacatttctgtgc

SEQ ID NO: 7347196 - DNA, 22 bp, Homo sapiens
cttaacaagcccaactttcatt

SEQ ID NO: 7347197 - DNA, 19 bp, Homo sapiens
atcatacatgttacactct

SEQ ID NO: 7347198 - DNA, 22 bp, Homo sapiens
atcatacagcctttgttagtgt

SEQ ID NO: 7347199 - DNA, 22 bp, Homo sapiens
cttaaggaaaagtctcttttaa

SEQ ID NO: 7347200 - DNA, 22 bp, Homo sapiens
cttaaggagtagtggtgatggc

SEQ ID NO: 7347201 - DNA, 22 bp, Homo sapiens
cttaagaaattgcattctaatc

SEQ ID NO: 7347202 - DNA, 21 bp, Homo sapiens
cttaacattttaaatgaaagg

SEQ ID NO: 7347203 - DNA, 22 bp, Homo sapiens
atctggttcttcttaggcatca

SEQ ID NO: 7347204 - DNA, 22 bp, Homo sapiens
atctggctctctcatttacaaa

SEQ ID NO: 7347205 - DNA, 22 bp, Homo sapiens
atctggctcttcctggagttcc

SEQ ID NO: 7347206 - DNA, 20 bp, Homo sapiens
atctggctcagatcctgcag

SEQ ID NO: 7347207 - DNA, 22 bp, Homo sapiens
atctggctcattcagggaacgg

SEQ ID NO: 7347208 - DNA, 22 bp, Homo sapiens
atctggctcccttggaatccgt

SEQ ID NO: 7347209 - DNA, 22 bp, Homo sapiens
atctggctcctacacttgaaga

SEQ ID NO: 7347210 - DNA, 22 bp, Homo sapiens
atctggctcgctaggctctggg

SEQ ID NO: 7347211 - DNA, 22 bp, Homo sapiens
cttcttaaattggattgctatt

SEQ ID NO: 7347212 - DNA, 22 bp, Homo sapiens
atctggttttggctgtgtccct

SEQ ID NO: 7347213 - DNA, 22 bp, Homo sapiens
atctggtttggggatccttgtg

SEQ ID NO: 7347214 - DNA, 22 bp, Homo sapiens
atctgtaactgctatcatctcc

SEQ ID NO: 7347215 - DNA, 22 bp, Homo sapiens
atctgtaaatgcaaatgtagct

SEQ ID NO: 7347216 - DNA, 22 bp, Homo sapiens
atctgtaattttgaatgcaaat

SEQ ID NO: 7347217 - DNA, 22 bp, Homo sapiens
atctgtacaagattttatgcgt

SEQ ID NO: 7347218 - DNA, 22 bp, Homo sapiens
atctgtatatttttcaatgcaa

SEQ ID NO: 7347219 - DNA, 22 bp, Homo sapiens
atctgttaggtcaggtatggaa

SEQ ID NO: 7347220 - DNA, 22 bp, Homo sapiens
atctgtgtgttgagttctcagc

SEQ ID NO: 7347221 - DNA, 22 bp, Homo sapiens
atctgtgtgttgagttctcagc

SEQ ID NO: 7347222 - DNA, 22 bp, Homo sapiens
cttctgctgccgcctcggcaca

SEQ ID NO: 7347223 - DNA, 22 bp, Homo sapiens
cttctgtgttaaatgagtcttt

SEQ ID NO: 7347224 - DNA, 22 bp, Homo sapiens
atctctatctttattgaaatct

SEQ ID NO: 7347225 - DNA, 22 bp, Homo sapiens
cttccttgctgtctgctccagg

SEQ ID NO: 7347226 - DNA, 22 bp, Homo sapiens
cttccttgtggtccttctcatt

SEQ ID NO: 7347227 - DNA, 20 bp, Homo sapiens
atctcctgctaccacccatt

SEQ ID NO: 7347228 - DNA, 22 bp, Homo sapiens
ataaagcaagcataccattaag

SEQ ID NO: 7347229 - DNA, 22 bp, Homo sapiens
ataaagcaggtccccagacact

SEQ ID NO: 7347230 - DNA, 22 bp, Homo sapiens
ctgcagggaccacaagcaggtt

SEQ ID NO: 7347231 - DNA, 22 bp, Homo sapiens
ctgcagggaccacaagcaggtt

SEQ ID NO: 7347232 - DNA, 22 bp, Homo sapiens
ctgcaggctgagcgcctgccgg

SEQ ID NO: 7347233 - DNA, 22 bp, Homo sapiens
ctgcagggaactgaggcccaga

SEQ ID NO: 7347234 - DNA, 22 bp, Homo sapiens
ataaaaatgagggcggtagcta

SEQ ID NO: 7347235 - DNA, 22 bp, Homo sapiens
ataaaaaggacagatgtggtct

SEQ ID NO: 7347236 - DNA, 22 bp, Homo sapiens
ataaaagatcccttctgagctc

SEQ ID NO: 7347237 - DNA, 20 bp, Homo sapiens
ataaaactctaatctggcct

SEQ ID NO: 7347238 - DNA, 22 bp, Homo sapiens
ataaaacttgggtatgatccct

SEQ ID NO: 7347239 - DNA, 22 bp, Homo sapiens
agttctctttagctcatatggt

SEQ ID NO: 7347240 - DNA, 22 bp, Homo sapiens
agttctgaatgaggaatctggg

SEQ ID NO: 7347241 - DNA, 22 bp, Homo sapiens
agttctgactctgaatctggga

SEQ ID NO: 7347242 - DNA, 22 bp, Homo sapiens
agttctgagcatctaggcagct

SEQ ID NO: 7347243 - DNA, 22 bp, Homo sapiens
agttctcatcatgaagcataag

SEQ ID NO: 7347244 - DNA, 22 bp, Homo sapiens
ctgctaaacctctctgagagct

SEQ ID NO: 7347245 - DNA, 22 bp, Homo sapiens
ctgctaccctagagctcactct

SEQ ID NO: 7347246 - DNA, 22 bp, Homo sapiens
ctgcctggaaggagcaagggga

SEQ ID NO: 7347247 - DNA, 22 bp, Homo sapiens
ctgcctgggttcaagtcctgtt

SEQ ID NO: 7347248 - DNA, 22 bp, Homo sapiens
ataaaggaaattccatgtctaa

SEQ ID NO: 7347249 - DNA, 22 bp, Homo sapiens
ctgcctggtctcaggcatgggg

SEQ ID NO: 7347250 - DNA, 19 bp, Homo sapiens
ctgctcagagcagctccag

SEQ ID NO: 7347251 - DNA, 20 bp, Homo sapiens
ctgctcagaccaactcttct

SEQ ID NO: 7347252 - DNA, 22 bp, Homo sapiens
ctgctcaattccggcacgctgg

SEQ ID NO: 7347253 - DNA, 22 bp, Homo sapiens
ctgctcaagtgcgcacccaggg

SEQ ID NO: 7347254 - DNA, 22 bp, Homo sapiens
ctgctattggaaggaggcatga

SEQ ID NO: 7347255 - DNA, 22 bp, Homo sapiens
ctgctgggcagaggctgcatga

SEQ ID NO: 7347256 - DNA, 22 bp, Homo sapiens
ctgctgggcagaggctgcatga

SEQ ID NO: 7347257 - DNA, 22 bp, Homo sapiens
atacacatatcaggtgtataca

SEQ ID NO: 7347258 - DNA, 22 bp, Homo sapiens
atacacatatatacacgtttaa

SEQ ID NO: 7347259 - DNA, 19 bp, Homo sapiens
atacacatacgtaaactga

SEQ ID NO: 7347260 - DNA, 21 bp, Homo sapiens
atacacatacacataaatgtg

SEQ ID NO: 7347261 - DNA, 22 bp, Homo sapiens
atacacaggtgctaggtcaata

SEQ ID NO: 7347262 - DNA, 22 bp, Homo sapiens
atacaagttgcccaaatgatta

SEQ ID NO: 7347263 - DNA, 22 bp, Homo sapiens
atacacagctacattgaacaat

SEQ ID NO: 7347264 - DNA, 22 bp, Homo sapiens
atacacatgcacacatgtgtgt

SEQ ID NO: 7347265 - DNA, 22 bp, Homo sapiens
atacacatatgtgtgtatatgt

SEQ ID NO: 7347266 - DNA, 22 bp, Homo sapiens
atacacatatcaggtgtataca

SEQ ID NO: 7347267 - DNA, 22 bp, Homo sapiens
atacaagttctcatgtgtatct

SEQ ID NO: 7347268 - DNA, 22 bp, Homo sapiens
atacaagttaatgagaatgaca

SEQ ID NO: 7347269 - DNA, 22 bp, Homo sapiens
ctgctgtggtgtcaagcatctc

SEQ ID NO: 7347270 - DNA, 22 bp, Homo sapiens
ctgctgtgggttaagacactgt

SEQ ID NO: 7347271 - DNA, 22 bp, Homo sapiens
ctgctgtggatgcaggacctca

SEQ ID NO: 7347272 - DNA, 22 bp, Homo sapiens
ctgctgggggacacaggtccgg

SEQ ID NO: 7347273 - DNA, 22 bp, Homo sapiens
ctgctgtgccttaaaatgcaag

SEQ ID NO: 7347274 - DNA, 22 bp, Homo sapiens
ctgctgtgccttaaaatgcaag

SEQ ID NO: 7347275 - DNA, 22 bp, Homo sapiens
atacacatgtgtatgtgcatgc

SEQ ID NO: 7347276 - DNA, 22 bp, Homo sapiens
atacacattactttctgtctga

SEQ ID NO: 7347277 - DNA, 22 bp, Homo sapiens
atacacattactttctgtctga

SEQ ID NO: 7347278 - DNA, 22 bp, Homo sapiens
atacatgtgtccctgatttatt

SEQ ID NO: 7347279 - DNA, 22 bp, Homo sapiens
atacatgtgtccctgatttatt

SEQ ID NO: 7347280 - DNA, 22 bp, Homo sapiens
atacatgtgtccctgatttatt

SEQ ID NO: 7347281 - DNA, 22 bp, Homo sapiens
atacatgtgtgtgcatacatgt

SEQ ID NO: 7347282 - DNA, 22 bp, Homo sapiens
atacatgtaactgcattgtaat

SEQ ID NO: 7347283 - DNA, 22 bp, Homo sapiens
atacatgtacataaatgtagca

SEQ ID NO: 7347284 - DNA, 22 bp, Homo sapiens
atacatgtgccatgttggtgta

SEQ ID NO: 7347285 - DNA, 22 bp, Homo sapiens
atacatgtgccgcgttggtgtg

SEQ ID NO: 7347286 - DNA, 22 bp, Homo sapiens
atacatgtgctatgttggtgta

SEQ ID NO: 7347287 - DNA, 22 bp, Homo sapiens
atacatgtgggtctaaacatat

SEQ ID NO: 7347288 - DNA, 22 bp, Homo sapiens
atacatgtgggtctaaacatat

SEQ ID NO: 7347289 - DNA, 19 bp, Homo sapiens
atacatgcatttacatgct

SEQ ID NO: 7347290 - DNA, 22 bp, Homo sapiens
atacatgcgccatgttggtgtg

SEQ ID NO: 7347291 - DNA, 22 bp, Homo sapiens
atacatgcgccatgttggtgtg

SEQ ID NO: 7347292 - DNA, 19 bp, Homo sapiens
atacatgcatttacatgct

SEQ ID NO: 7347293 - DNA, 19 bp, Homo sapiens
atacatgcatttacatgct

SEQ ID NO: 7347294 - DNA, 22 bp, Homo sapiens
atacatgcacatttttatacat

SEQ ID NO: 7347295 - DNA, 22 bp, Homo sapiens
atacatgcacatttttatacat

SEQ ID NO: 7347296 - DNA, 22 bp, Homo sapiens
atacatgtaactgcattgtaat

SEQ ID NO: 7347297 - DNA, 17 bp, Homo sapiens
atacatgtaaagtgctt

SEQ ID NO: 7347298 - DNA, 22 bp, Homo sapiens
atacatgtaactgcattgtaat

SEQ ID NO: 7347299 - DNA, 22 bp, Homo sapiens
atacatgcttgggtgtagtgcg

SEQ ID NO: 7347300 - DNA, 22 bp, Homo sapiens
atacatgcttgggtgtagtgcg

SEQ ID NO: 7347301 - DNA, 22 bp, Homo sapiens
ctggcacaggatccgagacctt

SEQ ID NO: 7347302 - DNA, 22 bp, Homo sapiens
ctggcacagccactgcaggcag

SEQ ID NO: 7347303 - DNA, 22 bp, Homo sapiens
ctggcctcacctcagacttact

SEQ ID NO: 7347304 - DNA, 22 bp, Homo sapiens
ctggcctcagagggtcatggtg

SEQ ID NO: 7347305 - DNA, 22 bp, Homo sapiens
ctggcctcagagggtcatggtg

SEQ ID NO: 7347306 - DNA, 22 bp, Homo sapiens
ctggcctcatagccaagctgtg

SEQ ID NO: 7347307 - DNA, 22 bp, Homo sapiens
ctggcctcacagaggctaagcc

SEQ ID NO: 7347308 - DNA, 22 bp, Homo sapiens
ctggccctatgagcctcctgat

SEQ ID NO: 7347309 - DNA, 22 bp, Homo sapiens
ctggccctatgagcctcctgat

SEQ ID NO: 7347310 - DNA, 22 bp, Homo sapiens
ctggccagactacacatgtgtg

SEQ ID NO: 7347311 - DNA, 20 bp, Homo sapiens
ctggccagaacgcctacaca

SEQ ID NO: 7347312 - DNA, 20 bp, Homo sapiens
ctggccagaacgcctacaca

SEQ ID NO: 7347313 - DNA, 22 bp, Homo sapiens
ctggcaggtggaggttgcagtg

SEQ ID NO: 7347314 - DNA, 22 bp, Homo sapiens
atatacacatttgcttatgtgt

SEQ ID NO: 7347315 - DNA, 22 bp, Homo sapiens
atatacactccactgatacagg

SEQ ID NO: 7347316 - DNA, 22 bp, Homo sapiens
atatacactcaccatggtattt

SEQ ID NO: 7347317 - DNA, 22 bp, Homo sapiens
atatacagtatgtactgtggtt

SEQ ID NO: 7347318 - DNA, 22 bp, Homo sapiens
atatacaggtggtatgtgtaaa

SEQ ID NO: 7347319 - DNA, 22 bp, Homo sapiens
atatacaggtggtatgtgtaaa

SEQ ID NO: 7347320 - DNA, 22 bp, Homo sapiens
ctgggagctgtcaggagcgtgt

SEQ ID NO: 7347321 - DNA, 22 bp, Homo sapiens
ctgggagctggatgccctgccc

SEQ ID NO: 7347322 - DNA, 22 bp, Homo sapiens
ctgggagctggatgccctgccc

SEQ ID NO: 7347323 - DNA, 22 bp, Homo sapiens
atatacagttttacagggtttc

SEQ ID NO: 7347324 - DNA, 19 bp, Homo sapiens
atatacatactgtgtgcat

SEQ ID NO: 7347325 - DNA, 22 bp, Homo sapiens
atatactgatagctgcacttct

SEQ ID NO: 7347326 - DNA, 22 bp, Homo sapiens
atatactgaggagactttatat

SEQ ID NO: 7347327 - DNA, 22 bp, Homo sapiens
atataaagtgtttagaaagctg

SEQ ID NO: 7347328 - DNA, 22 bp, Homo sapiens
atagtttgtgaaacacagcagt

SEQ ID NO: 7347329 - DNA, 23 bp, Homo sapiens
atataaacaccagatagattgta

SEQ ID NO: 7347330 - DNA, 22 bp, Homo sapiens
ctggctcacaggtgagatgcat

SEQ ID NO: 7347331 - DNA, 22 bp, Homo sapiens
atagtttgggcaaagaggacct

SEQ ID NO: 7347332 - DNA, 22 bp, Homo sapiens
ctggctcaatttgtactgctgt

SEQ ID NO: 7347333 - DNA, 22 bp, Homo sapiens
ctggctcaataaatattagctg

SEQ ID NO: 7347334 - DNA, 22 bp, Homo sapiens
ctggcgtgaaggtggccatgag

SEQ ID NO: 7347335 - DNA, 22 bp, Homo sapiens
ctggcgagcaggaggcgacggc

SEQ ID NO: 7347336 - DNA, 22 bp, Homo sapiens
ctggcgagggtcgctggggact

SEQ ID NO: 7347337 - DNA, 22 bp, Homo sapiens
ctggcctctctgagcagggagc

SEQ ID NO: 7347338 - DNA, 22 bp, Homo sapiens
ctggcctctctgagcagggagc

SEQ ID NO: 7347339 - DNA, 22 bp, Homo sapiens
agtgctaccctgggaggagctc

SEQ ID NO: 7347340 - DNA, 22 bp, Homo sapiens
agtgccctttacaacttcttga

SEQ ID NO: 7347341 - DNA, 22 bp, Homo sapiens
agtgccttaaacagcatcggag

SEQ ID NO: 7347342 - DNA, 22 bp, Homo sapiens
agtgccttctctgggctaggtc

SEQ ID NO: 7347343 - DNA, 20 bp, Homo sapiens
agtgccctccgacattgttt

SEQ ID NO: 7347344 - DNA, 22 bp, Homo sapiens
agtgccctcgtgcccagggcct

SEQ ID NO: 7347345 - DNA, 22 bp, Homo sapiens
agtgccctggacggcggcccca

SEQ ID NO: 7347346 - DNA, 22 bp, Homo sapiens
agtggagtgagtggcagaagga

SEQ ID NO: 7347347 - DNA, 22 bp, Homo sapiens
agtggaggttattgagttaagg

SEQ ID NO: 7347348 - DNA, 22 bp, Homo sapiens
agtggccacccactgagacagg

SEQ ID NO: 7347349 - DNA, 22 bp, Homo sapiens
agtggagcttttcctatcagag

SEQ ID NO: 7347350 - DNA, 20 bp, Homo sapiens
agtggagcagcccaagcagc

SEQ ID NO: 7347351 - DNA, 22 bp, Homo sapiens
agtggagcaggcggcgctcact

SEQ ID NO: 7347352 - DNA, 22 bp, Homo sapiens
agtggaggcactaattggattt

SEQ ID NO: 7347353 - DNA, 22 bp, Homo sapiens
agtggacattctgcacttggag

SEQ ID NO: 7347354 - DNA, 22 bp, Homo sapiens
agtggaccagaagactgaagct

SEQ ID NO: 7347355 - DNA, 22 bp, Homo sapiens
agtggactaaagccaggcagca

SEQ ID NO: 7347356 - DNA, 22 bp, Homo sapiens
agtggacccggaacagaggccc

SEQ ID NO: 7347357 - DNA, 22 bp, Homo sapiens
agtggagacaggacagtcgata

SEQ ID NO: 7347358 - DNA, 22 bp, Homo sapiens
agtggagaagaggatggtctcc

SEQ ID NO: 7347359 - DNA, 22 bp, Homo sapiens
agtggagaagaggatggtctcc

SEQ ID NO: 7347360 - DNA, 21 bp, Homo sapiens
agtggaacccttagggtcagg

SEQ ID NO: 7347361 - DNA, 22 bp, Homo sapiens
agtggaaggtcaggggacagtg

SEQ ID NO: 7347362 - DNA, 22 bp, Homo sapiens
agtggaaagaaccctggactca

SEQ ID NO: 7347363 - DNA, 22 bp, Homo sapiens
agtggacaaccatgctgagatt

SEQ ID NO: 7347364 - DNA, 19 bp, Homo sapiens
agtctcacccaagcagtct

SEQ ID NO: 7347365 - DNA, 22 bp, Homo sapiens
agtctcagaaaagaagcatgga

SEQ ID NO: 7347366 - DNA, 20 bp, Homo sapiens
ctcacagtcaatgcagaggt

SEQ ID NO: 7347367 - DNA, 22 bp, Homo sapiens
agtctcagaaaatatgcttttt

SEQ ID NO: 7347368 - DNA, 22 bp, Homo sapiens
ctcacagtctctccctaatttt

SEQ ID NO: 7347369 - DNA, 22 bp, Homo sapiens
ctcacagtctctccctaatttt

SEQ ID NO: 7347370 - DNA, 22 bp, Homo sapiens
ctcacagtctgcctttcccttg

SEQ ID NO: 7347371 - DNA, 21 bp, Homo sapiens
ctcacagtctgttttccttgc

SEQ ID NO: 7347372 - DNA, 22 bp, Homo sapiens
ctcacagtgatgtcttatgaca

SEQ ID NO: 7347373 - DNA, 22 bp, Homo sapiens
agtctatttgctgtccgagcaa

SEQ ID NO: 7347374 - DNA, 22 bp, Homo sapiens
agtctattttcagaagcagttt

SEQ ID NO: 7347375 - DNA, 22 bp, Homo sapiens
agtctatttccccttctcttga

SEQ ID NO: 7347376 - DNA, 22 bp, Homo sapiens
agtctacagtctgggtcgggtg

SEQ ID NO: 7347377 - DNA, 22 bp, Homo sapiens
agtctagatgatcctaggaata

SEQ ID NO: 7347378 - DNA, 22 bp, Homo sapiens
agtctagatgtgtactaggtta

SEQ ID NO: 7347379 - DNA, 22 bp, Homo sapiens
agtctaggcagccctgcagggt

SEQ ID NO: 7347380 - DNA, 22 bp, Homo sapiens
agtctagggtggggtccacagg

SEQ ID NO: 7347381 - DNA, 22 bp, Homo sapiens
agtctattgcctaacagagagg

SEQ ID NO: 7347382 - DNA, 22 bp, Homo sapiens
ctcacagttggctcattaatga

SEQ ID NO: 7347383 - DNA, 22 bp, Homo sapiens
ctcacagttggctcattaatga

SEQ ID NO: 7347384 - DNA, 22 bp, Homo sapiens
ctcacagtgtcaacattaacta

SEQ ID NO: 7347385 - DNA, 22 bp, Homo sapiens
ctcacagttggagaatttagat

SEQ ID NO: 7347386 - DNA, 22 bp, Homo sapiens
ctcacagtgtaatattgaaccc

SEQ ID NO: 7347387 - DNA, 22 bp, Homo sapiens
ctcacatatgctgggatttccg

SEQ ID NO: 7347388 - DNA, 22 bp, Homo sapiens
ctcacagttttctgtagtccaa

SEQ ID NO: 7347389 - DNA, 22 bp, Homo sapiens
ctcacagttttttcctgttaat

SEQ ID NO: 7347390 - DNA, 22 bp, Homo sapiens
ctcacagttgtggtacctggtt

SEQ ID NO: 7347391 - DNA, 22 bp, Homo sapiens
ctcacagtttcacagtgtagat

SEQ ID NO: 7347392 - DNA, 19 bp, Homo sapiens
agtctttcccactcgtctt

SEQ ID NO: 7347393 - DNA, 22 bp, Homo sapiens
agtgaaatagcatttatgaagc

SEQ ID NO: 7347394 - DNA, 22 bp, Homo sapiens
agtgaaatatgcccattgctgt

SEQ ID NO: 7347395 - DNA, 22 bp, Homo sapiens
agtgaaatcaggttttgactgc

SEQ ID NO: 7347396 - DNA, 22 bp, Homo sapiens
agtgaaataaagctgcctatgg

SEQ ID NO: 7347397 - DNA, 22 bp, Homo sapiens
agtgaaatactgtcgtttttag

SEQ ID NO: 7347398 - DNA, 22 bp, Homo sapiens
agtgaaaagatgcatttctctg

SEQ ID NO: 7347399 - DNA, 22 bp, Homo sapiens
agtgaaaagatgcatttctctg

SEQ ID NO: 7347400 - DNA, 22 bp, Homo sapiens
agtgaaaacctaatcatgcagt

SEQ ID NO: 7347401 - DNA, 22 bp, Homo sapiens
agtgaaaacactagttcttgcc

SEQ ID NO: 7347402 - DNA, 22 bp, Homo sapiens
agtgagggactagtgctgggga

SEQ ID NO: 7347403 - DNA, 22 bp, Homo sapiens
agtgaaattcctggtctttgtt

SEQ ID NO: 7347404 - DNA, 21 bp, Homo sapiens
agtgaaattgcatcagaggga

SEQ ID NO: 7347405 - DNA, 22 bp, Homo sapiens
agtgaaattgctgtaagaggaa

SEQ ID NO: 7347406 - DNA, 22 bp, Homo sapiens
agtgaaatgattctgagcaaga

SEQ ID NO: 7347407 - DNA, 19 bp, Homo sapiens
agtgaaatggagtattcaa

SEQ ID NO: 7347408 - DNA, 22 bp, Homo sapiens
agtgaaatggatgctgctactg

SEQ ID NO: 7347409 - DNA, 22 bp, Homo sapiens
agtgaaatgatagtgtaaatac

SEQ ID NO: 7347410 - DNA, 21 bp, Homo sapiens
agtgaaatgaagtgtatgctc

SEQ ID NO: 7347411 - DNA, 22 bp, Homo sapiens
agtgaaatgactgaatcagata

SEQ ID NO: 7347412 - DNA, 22 bp, Homo sapiens
agtgaaatcctggtcaacaggt

SEQ ID NO: 7347413 - DNA, 22 bp, Homo sapiens
agtgaggggcagctgagtgggc

SEQ ID NO: 7347414 - DNA, 22 bp, Homo sapiens
agtgaggggattcaggcaaggt

SEQ ID NO: 7347415 - DNA, 22 bp, Homo sapiens
agtgagggactagtgctgggga

SEQ ID NO: 7347416 - DNA, 22 bp, Homo sapiens
agtgaggctaataggcaatggt

SEQ ID NO: 7347417 - DNA, 22 bp, Homo sapiens
agtgagggatgaagaactgcgg

SEQ ID NO: 7347418 - DNA, 22 bp, Homo sapiens
agtgaggggcagctgagtgggc

SEQ ID NO: 7347419 - DNA, 22 bp, Homo sapiens
agtgagtggaccctgcaaggaa

SEQ ID NO: 7347420 - DNA, 22 bp, Homo sapiens
agtgaggtggggtcacagggac

SEQ ID NO: 7347421 - DNA, 19 bp, Homo sapiens
agtgagtgtacagtagaat

SEQ ID NO: 7347422 - DNA, 22 bp, Homo sapiens
agtgagtgggttacagatggga

SEQ ID NO: 7347423 - DNA, 22 bp, Homo sapiens
agtggtctatttaatagttttc

SEQ ID NO: 7347424 - DNA, 22 bp, Homo sapiens
agtggtctccccagtagaataa

SEQ ID NO: 7347425 - DNA, 22 bp, Homo sapiens
agtggtaagggcataggcactg

SEQ ID NO: 7347426 - DNA, 22 bp, Homo sapiens
agtgggtgcaaccatggctagg

SEQ ID NO: 7347427 - DNA, 20 bp, Homo sapiens
agtgggtgatgaaggaatag

SEQ ID NO: 7347428 - DNA, 22 bp, Homo sapiens
ctctggagttagtgatctgggc

SEQ ID NO: 7347429 - DNA, 22 bp, Homo sapiens
ctctggagttcccttgatctga

SEQ ID NO: 7347430 - DNA, 22 bp, Homo sapiens
ctctggagtgtctggccagggt

SEQ ID NO: 7347431 - DNA, 22 bp, Homo sapiens
ctctggagtgggtggccgggag

SEQ ID NO: 7347432 - DNA, 22 bp, Homo sapiens
ctctggagttctcatgaggaac

SEQ ID NO: 7347433 - DNA, 20 bp, Homo sapiens
ctctggagttggggaacatt

SEQ ID NO: 7347434 - DNA, 22 bp, Homo sapiens
ctctggagttcttcaagctact

SEQ ID NO: 7347435 - DNA, 22 bp, Homo sapiens
agtggggccgcggtcctgccct

SEQ ID NO: 7347436 - DNA, 20 bp, Homo sapiens
agtggggagtcaggagtgcc

SEQ ID NO: 7347437 - DNA, 22 bp, Homo sapiens
agtgggtgagcttggtctagat

SEQ ID NO: 7347438 - DNA, 22 bp, Homo sapiens
agtgtcattccagggaccctcg

SEQ ID NO: 7347439 - DNA, 22 bp, Homo sapiens
agtgtcatatgccactgcatcc

SEQ ID NO: 7347440 - DNA, 19 bp, Homo sapiens
agtgtcatcagctactcag

SEQ ID NO: 7347441 - DNA, 22 bp, Homo sapiens
agtgtcagttgccttgtcataa

SEQ ID NO: 7347442 - DNA, 18 bp, Homo sapiens
agtgtcagctgcagctca

SEQ ID NO: 7347443 - DNA, 21 bp, Homo sapiens
ctctggagtttgaaggctggg

SEQ ID NO: 7347444 - DNA, 22 bp, Homo sapiens
agtgtcaaatgtgtgccaagct

SEQ ID NO: 7347445 - DNA, 22 bp, Homo sapiens
agtgtcattttgtccatcttct

SEQ ID NO: 7347446 - DNA, 22 bp, Homo sapiens
agtgtcctagcaagccggtcct

SEQ ID NO: 7347447 - DNA, 22 bp, Homo sapiens
agtgtgagatgattgaggagca

SEQ ID NO: 7347448 - DNA, 22 bp, Homo sapiens
agtgtgagaacggactaataaa

SEQ ID NO: 7347449 - DNA, 19 bp, Homo sapiens
agtgtgagactccatctca

SEQ ID NO: 7347450 - DNA, 22 bp, Homo sapiens
agtgtgagccctggagtggtgc

SEQ ID NO: 7347451 - DNA, 22 bp, Homo sapiens
agtgtgagattaaaccgaatca

SEQ ID NO: 7347452 - DNA, 22 bp, Homo sapiens
agtgtgagcctacaggccaaag

SEQ ID NO: 7347453 - DNA, 22 bp, Homo sapiens
agtgtgagctaatagcagagcc

SEQ ID NO: 7347454 - DNA, 22 bp, Homo sapiens
agtgtgaggggttctttgatat

SEQ ID NO: 7347455 - DNA, 22 bp, Homo sapiens
agtgtgagtaattcagggaggg

SEQ ID NO: 7347456 - DNA, 22 bp, Homo sapiens
agtgtgagtaattgagtctgtc

SEQ ID NO: 7347457 - DNA, 22 bp, Homo sapiens
agttatttcagtaacataatag

SEQ ID NO: 7347458 - DNA, 19 bp, Homo sapiens
agttatttctaaatttacc

SEQ ID NO: 7347459 - DNA, 22 bp, Homo sapiens
agttccaaatggtccttgaaga

SEQ ID NO: 7347460 - DNA, 18 bp, Homo sapiens
agtgttctcgttttataa

SEQ ID NO: 7347461 - DNA, 22 bp, Homo sapiens
agtgtgggccacgcagctgagc

SEQ ID NO: 7347462 - DNA, 22 bp, Homo sapiens
agtgtggagccactgagtggct

SEQ ID NO: 7347463 - DNA, 22 bp, Homo sapiens
agtgtgcttaagtttatcagga

SEQ ID NO: 7347464 - DNA, 22 bp, Homo sapiens
agtgtgcttcactgggaggtga

SEQ ID NO: 7347465 - DNA, 22 bp, Homo sapiens
agtgtgctgtttccagaagggc

SEQ ID NO: 7347466 - DNA, 22 bp, Homo sapiens
agtgtgctgcttaaacagttgt

SEQ ID NO: 7347467 - DNA, 22 bp, Homo sapiens
agtgtgctctggttgccatgct

SEQ ID NO: 7347468 - DNA, 22 bp, Homo sapiens
agtgtgctgagcaggtgggggt

SEQ ID NO: 7347469 - DNA, 22 bp, Homo sapiens
agtgtgagtttggttgagactt

SEQ ID NO: 7347470 - DNA, 22 bp, Homo sapiens
agtgtgagtgctcatgtccatc

SEQ ID NO: 7347471 - DNA, 22 bp, Homo sapiens
agtgtgagttacaaagtgtgaa

SEQ ID NO: 7347472 - DNA, 19 bp, Homo sapiens
agtgtgagtaattggagtt

SEQ ID NO: 7347473 - DNA, 22 bp, Homo sapiens
agtgtgctagcaagaactgggg

SEQ ID NO: 7347474 - DNA, 22 bp, Homo sapiens
agtgtgctattgcaccatcata

SEQ ID NO: 7347475 - DNA, 22 bp, Homo sapiens
agtgtgctcaattcaagtcttt

SEQ ID NO: 7347476 - DNA, 22 bp, Homo sapiens
agtgtttctggcaaatgaaagt

SEQ ID NO: 7347477 - DNA, 22 bp, Homo sapiens
agtgtttctcagaagggcctat

SEQ ID NO: 7347478 - DNA, 22 bp, Homo sapiens
agtgtttgagacacatttcact

SEQ ID NO: 7347479 - DNA, 20 bp, Homo sapiens
agtgtttgctcacagtctcc

SEQ ID NO: 7347480 - DNA, 22 bp, Homo sapiens
agtgtttcccagtaggatgaaa

SEQ ID NO: 7347481 - DNA, 22 bp, Homo sapiens
agtgtttcacagcactttttct

SEQ ID NO: 7347482 - DNA, 17 bp, Homo sapiens
agtgtttccttatcatt

SEQ ID NO: 7347483 - DNA, 22 bp, Homo sapiens
agtgtttgtaaactacagatct

SEQ ID NO: 7347484 - DNA, 22 bp, Homo sapiens
agtgtttggggtgattgtaacc

SEQ ID NO: 7347485 - DNA, 22 bp, Homo sapiens
agtgtttgtaaactacagatct

SEQ ID NO: 7347486 - DNA, 22 bp, Homo sapiens
agttaaatcattactgacagag

SEQ ID NO: 7347487 - DNA, 22 bp, Homo sapiens
cctggggctttctttgtatcat

SEQ ID NO: 7347488 - DNA, 22 bp, Homo sapiens
cctggggctttctttgtatcat

SEQ ID NO: 7347489 - DNA, 22 bp, Homo sapiens
cctggggctctgcacagagcag

SEQ ID NO: 7347490 - DNA, 22 bp, Homo sapiens
cctggggctctgcacagagcag

SEQ ID NO: 7347491 - DNA, 22 bp, Homo sapiens
cctgggggccaggaaggtgtga

SEQ ID NO: 7347492 - DNA, 20 bp, Homo sapiens
cctggggtacactggcatgt

SEQ ID NO: 7347493 - DNA, 22 bp, Homo sapiens
cctgggctttgagggcaggatg

SEQ ID NO: 7347494 - DNA, 22 bp, Homo sapiens
cctggggctccagagcagcgga

SEQ ID NO: 7347495 - DNA, 22 bp, Homo sapiens
cctggggctccagagcagcgga

SEQ ID NO: 7347496 - DNA, 22 bp, Homo sapiens
cctgtgccagctgggccctgcc

SEQ ID NO: 7347497 - DNA, 22 bp, Homo sapiens
aggtgcagctggtggagtctgg

SEQ ID NO: 7347498 - DNA, 21 bp, Homo sapiens
aggtgcagaggcctcactcac

SEQ ID NO: 7347499 - DNA, 17 bp, Homo sapiens
aggtgcagaggcagagc

SEQ ID NO: 7347500 - DNA, 17 bp, Homo sapiens
aggtgcagaggcagagc

SEQ ID NO: 7347501 - DNA, 17 bp, Homo sapiens
aggtgcagaggcagagc

SEQ ID NO: 7347502 - DNA, 22 bp, Homo sapiens
cctgtgggagcccaggcagata

SEQ ID NO: 7347503 - DNA, 22 bp, Homo sapiens
cctgtgggcctgcacgtgggga

SEQ ID NO: 7347504 - DNA, 22 bp, Homo sapiens
ccttccaagtgcttgccgcttt

SEQ ID NO: 7347505 - DNA, 21 bp, Homo sapiens
ccttccaccttctgccatgtg

SEQ ID NO: 7347506 - DNA, 21 bp, Homo sapiens
ccttccaccttctgccatgtg

SEQ ID NO: 7347507 - DNA, 19 bp, Homo sapiens
ccttccagaactaaattaa

SEQ ID NO: 7347508 - DNA, 22 bp, Homo sapiens
aggtggcagcagaatcagggag

SEQ ID NO: 7347509 - DNA, 21 bp, Homo sapiens
agggttttatagatctcttcc

SEQ ID NO: 7347510 - DNA, 22 bp, Homo sapiens
aggtaagggctgcgactataag

SEQ ID NO: 7347511 - DNA, 22 bp, Homo sapiens
cctgggaggctgtgggtctgct

SEQ ID NO: 7347512 - DNA, 22 bp, Homo sapiens
cctgggagggcaagtgctgatg

SEQ ID NO: 7347513 - DNA, 22 bp, Homo sapiens
cctgggagggcaagtgctgatg

SEQ ID NO: 7347514 - DNA, 22 bp, Homo sapiens
cctgggaggtggaggttgcagc

SEQ ID NO: 7347515 - DNA, 22 bp, Homo sapiens
cctgggaggtggaggttgcagc

SEQ ID NO: 7347516 - DNA, 22 bp, Homo sapiens
cctgggaggtggaggttgcagt

SEQ ID NO: 7347517 - DNA, 22 bp, Homo sapiens
cctgggaggctgaggctgcagt

SEQ ID NO: 7347518 - DNA, 22 bp, Homo sapiens
cctgggaggctgaggctgcagt

SEQ ID NO: 7347519 - DNA, 22 bp, Homo sapiens
cctgggaggctgaggctgcagt

SEQ ID NO: 7347520 - DNA, 22 bp, Homo sapiens
cctgggagaactgctgggttgg

SEQ ID NO: 7347521 - DNA, 22 bp, Homo sapiens
aggtcacatggataatgatcag

SEQ ID NO: 7347522 - DNA, 22 bp, Homo sapiens
aggtcagctgtgtgtgcatgag

SEQ ID NO: 7347523 - DNA, 22 bp, Homo sapiens
agtaaagcggtgtcacagaatg

SEQ ID NO: 7347524 - DNA, 22 bp, Homo sapiens
agtaaacattttcatattttct

SEQ ID NO: 7347525 - DNA, 22 bp, Homo sapiens
ccttccagggctctccagaacc

SEQ ID NO: 7347526 - DNA, 22 bp, Homo sapiens
ccttccagggctctccagaacc

SEQ ID NO: 7347527 - DNA, 22 bp, Homo sapiens
ccttccaggtgcaggcaagcct

SEQ ID NO: 7347528 - DNA, 22 bp, Homo sapiens
ccttctcccctctgcagggtgt

SEQ ID NO: 7347529 - DNA, 22 bp, Homo sapiens
agtaaaaattgaggtgcaaaat

SEQ ID NO: 7347530 - DNA, 22 bp, Homo sapiens
agtaaaaattgaggtgcaaaat

SEQ ID NO: 7347531 - DNA, 22 bp, Homo sapiens
ccttctcctgccttgggttcat

SEQ ID NO: 7347532 - DNA, 22 bp, Homo sapiens
agtagataccagttctttgact

SEQ ID NO: 7347533 - DNA, 22 bp, Homo sapiens
agtagattttagattacatagt

SEQ ID NO: 7347534 - DNA, 23 bp, Homo sapiens
agtagcacatcttgtgtggtttg

SEQ ID NO: 7347535 - DNA, 22 bp, Homo sapiens
agtacatacttcaaatgtactt

SEQ ID NO: 7347536 - DNA, 22 bp, Homo sapiens
agtatttctgctcatgaaagag

SEQ ID NO: 7347537 - DNA, 22 bp, Homo sapiens
agtatttctagttggttctact

SEQ ID NO: 7347538 - DNA, 22 bp, Homo sapiens
agtatttctgaatattatcata

SEQ ID NO: 7347539 - DNA, 22 bp, Homo sapiens
ctagctttttatgacaatcttg

SEQ ID NO: 7347540 - DNA, 22 bp, Homo sapiens
ctagctttttatgacaatcttg

SEQ ID NO: 7347541 - DNA, 22 bp, Homo sapiens
ctagctgacgggttgataggtg

SEQ ID NO: 7347542 - DNA, 22 bp, Homo sapiens
ctagctccatataaagcaggat

SEQ ID NO: 7347543 - DNA, 22 bp, Homo sapiens
agtcctgggtccagcaggtcct

SEQ ID NO: 7347544 - DNA, 22 bp, Homo sapiens
ctattgcttttgtgtgctccca

SEQ ID NO: 7347545 - DNA, 22 bp, Homo sapiens
ctattgaatagcccaaatcatt

SEQ ID NO: 7347546 - DNA, 22 bp, Homo sapiens
ctattgaattaactattaaagt

SEQ ID NO: 7347547 - DNA, 22 bp, Homo sapiens
ctatctcatgcatcaactcttc

SEQ ID NO: 7347548 - DNA, 22 bp, Homo sapiens
ctatctcagagaaggacatttg

SEQ ID NO: 7347549 - DNA, 22 bp, Homo sapiens
ctatcttttgttcattttgagt

SEQ ID NO: 7347550 - DNA, 22 bp, Homo sapiens
ctatcttggtccagtctacacc

SEQ ID NO: 7347551 - DNA, 22 bp, Homo sapiens
ctattgaaagtgtacaattcaa

SEQ ID NO: 7347552 - DNA, 22 bp, Homo sapiens
agtcagcagtgaaagcacagcc

SEQ ID NO: 7347553 - DNA, 22 bp, Homo sapiens
ctagtctgcagcggggaggggt

SEQ ID NO: 7347554 - DNA, 22 bp, Homo sapiens
ctatattggtggccatttggaa

SEQ ID NO: 7347555 - DNA, 22 bp, Homo sapiens
ctatatttggtgagggatgtct

SEQ ID NO: 7347556 - DNA, 22 bp, Homo sapiens
ctatatttggtgagggatgtct

SEQ ID NO: 7347557 - DNA, 22 bp, Homo sapiens
ctatatttcttggctttaaaca

SEQ ID NO: 7347558 - DNA, 22 bp, Homo sapiens
ctatatttcttggctttaaaca

SEQ ID NO: 7347559 - DNA, 22 bp, Homo sapiens
catgtgtgcaccaaccctatgt

SEQ ID NO: 7347560 - DNA, 22 bp, Homo sapiens
catgtgtggagggcatgcatgg

SEQ ID NO: 7347561 - DNA, 22 bp, Homo sapiens
catgtgtggtctgtggctatct

SEQ ID NO: 7347562 - DNA, 22 bp, Homo sapiens
aggcacaggtggacttcacagt

SEQ ID NO: 7347563 - DNA, 22 bp, Homo sapiens
catgtgtctttatggagccaca

SEQ ID NO: 7347564 - DNA, 22 bp, Homo sapiens
aggatgaatatttagtgggata

SEQ ID NO: 7347565 - DNA, 22 bp, Homo sapiens
aggatgaataactgaaatggtg

SEQ ID NO: 7347566 - DNA, 22 bp, Homo sapiens
aggagtgttcagcgtggggatg

SEQ ID NO: 7347567 - DNA, 22 bp, Homo sapiens
aggagtgttgagttgggttttg

SEQ ID NO: 7347568 - DNA, 23 bp, Homo sapiens
aggagttgagggttgggttggca

SEQ ID NO: 7347569 - DNA, 22 bp, Homo sapiens
aggatcaaatgaaatattttga

SEQ ID NO: 7347570 - DNA, 22 bp, Homo sapiens
aggatctgttgaataaatttga

SEQ ID NO: 7347571 - DNA, 22 bp, Homo sapiens
aggatcctgtatggagaagctg

SEQ ID NO: 7347572 - DNA, 22 bp, Homo sapiens
aggatcctttggccacttctta

SEQ ID NO: 7347573 - DNA, 22 bp, Homo sapiens
aggatcctttttctgctgtttg

SEQ ID NO: 7347574 - DNA, 22 bp, Homo sapiens
aggatcctgcgctttgggggag

SEQ ID NO: 7347575 - DNA, 23 bp, Homo sapiens
aggatcctggtacaggagcagag

SEQ ID NO: 7347576 - DNA, 22 bp, Homo sapiens
aggatcctccttagaaaagacc

SEQ ID NO: 7347577 - DNA, 22 bp, Homo sapiens
aggatcagtgaatactcagggt

SEQ ID NO: 7347578 - DNA, 22 bp, Homo sapiens
aggcacaggtggacttcacagt

SEQ ID NO: 7347579 - DNA, 22 bp, Homo sapiens
aggcactgaaggaagcttgcgc

SEQ ID NO: 7347580 - DNA, 22 bp, Homo sapiens
aggcactgaagtggtaaatgta

SEQ ID NO: 7347581 - DNA, 23 bp, Homo sapiens
aggcactgaatgtgtcagtgagt

SEQ ID NO: 7347582 - DNA, 22 bp, Homo sapiens
aggcactgaatatccagtaaaa

SEQ ID NO: 7347583 - DNA, 22 bp, Homo sapiens
aggcactgaaaggtggccagag

SEQ ID NO: 7347584 - DNA, 22 bp, Homo sapiens
aggcactgaagaactctttttg

SEQ ID NO: 7347585 - DNA, 22 bp, Homo sapiens
aggcactgaagaactctttttg

SEQ ID NO: 7347586 - DNA, 22 bp, Homo sapiens
aggcagagagcagtggccgtct

SEQ ID NO: 7347587 - DNA, 22 bp, Homo sapiens
aggcactgcagattacaggcgc

SEQ ID NO: 7347588 - DNA, 22 bp, Homo sapiens
aggcactgattctgttttccat

SEQ ID NO: 7347589 - DNA, 22 bp, Homo sapiens
aggcactgacaattctggactg

SEQ ID NO: 7347590 - DNA, 22 bp, Homo sapiens
aggcactgacagattctgtgtc

SEQ ID NO: 7347591 - DNA, 22 bp, Homo sapiens
aggcactgagaggctgtgttgc

SEQ ID NO: 7347592 - DNA, 22 bp, Homo sapiens
aggcactgattctcagagttac

SEQ ID NO: 7347593 - DNA, 22 bp, Homo sapiens
aggcactgattctcagagttac

SEQ ID NO: 7347594 - DNA, 22 bp, Homo sapiens
aggcactgacctgcttccttga

SEQ ID NO: 7347595 - DNA, 22 bp, Homo sapiens
aggcactgactcaagggagcca

SEQ ID NO: 7347596 - DNA, 21 bp, Homo sapiens
ccaaagaactgccatttgtca

SEQ ID NO: 7347597 - DNA, 22 bp, Homo sapiens
ccaaactgtttcgtatttatgc

SEQ ID NO: 7347598 - DNA, 22 bp, Homo sapiens
aggcaggctcaatgcccagtct

SEQ ID NO: 7347599 - DNA, 22 bp, Homo sapiens
aggcaggctagtcgcttgagcc

SEQ ID NO: 7347600 - DNA, 22 bp, Homo sapiens
aggcaggctctgggtatgtgca

SEQ ID NO: 7347601 - DNA, 22 bp, Homo sapiens
aggcaggctgctatggagtaga

SEQ ID NO: 7347602 - DNA, 22 bp, Homo sapiens
aggcaggccctctggaaaggta

SEQ ID NO: 7347603 - DNA, 22 bp, Homo sapiens
aggcaggcctacacaatgggag

SEQ ID NO: 7347604 - DNA, 22 bp, Homo sapiens
aggcagagctgatgttctgtga

SEQ ID NO: 7347605 - DNA, 22 bp, Homo sapiens
aggcagaggaagggtggatttg

SEQ ID NO: 7347606 - DNA, 22 bp, Homo sapiens
aggcagaggagaatgatcttcc

SEQ ID NO: 7347607 - DNA, 22 bp, Homo sapiens
aggcagctttctggtgcaccat

SEQ ID NO: 7347608 - DNA, 22 bp, Homo sapiens
aggcagctttcagtgtctctca

SEQ ID NO: 7347609 - DNA, 22 bp, Homo sapiens
aggcagctggcagcacccaggg

SEQ ID NO: 7347610 - DNA, 20 bp, Homo sapiens
aggcagctggccaggcaggt

SEQ ID NO: 7347611 - DNA, 20 bp, Homo sapiens
aggcagctggccaggcaggt

SEQ ID NO: 7347612 - DNA, 22 bp, Homo sapiens
cagtggaaatattggcagcatc

SEQ ID NO: 7347613 - DNA, 22 bp, Homo sapiens
aggagccaagatggggcaagta

SEQ ID NO: 7347614 - DNA, 22 bp, Homo sapiens
aggagctggcctagaaaggaga

SEQ ID NO: 7347615 - DNA, 22 bp, Homo sapiens
aggagctgggcccaaggatgct

SEQ ID NO: 7347616 - DNA, 22 bp, Homo sapiens
aggagctgggctgctgctggga

SEQ ID NO: 7347617 - DNA, 22 bp, Homo sapiens
aggagctgggagaaggactaaa

SEQ ID NO: 7347618 - DNA, 22 bp, Homo sapiens
cagtctcttttcagctccatcc

SEQ ID NO: 7347619 - DNA, 22 bp, Homo sapiens
cagtgaggagtccagggcagag

SEQ ID NO: 7347620 - DNA, 22 bp, Homo sapiens
cagtgaggagtccagggcagag

SEQ ID NO: 7347621 - DNA, 22 bp, Homo sapiens
cagtgaggagtccagggcagag

SEQ ID NO: 7347622 - DNA, 22 bp, Homo sapiens
cagtgaggagtccagggcagag

SEQ ID NO: 7347623 - DNA, 18 bp, Homo sapiens
cagtgaggatgaagggtt

SEQ ID NO: 7347624 - DNA, 22 bp, Homo sapiens
aggaatttgctggaacacagat

SEQ ID NO: 7347625 - DNA, 22 bp, Homo sapiens
aggaatttggggttacatgatg

SEQ ID NO: 7347626 - DNA, 22 bp, Homo sapiens
aggaattaacaatatatttagg

SEQ ID NO: 7347627 - DNA, 22 bp, Homo sapiens
aggaattaataaccagtaagcc

SEQ ID NO: 7347628 - DNA, 22 bp, Homo sapiens
cagtgagggcattcagtgctgg

SEQ ID NO: 7347629 - DNA, 22 bp, Homo sapiens
cagtgagggcattcagtgctgg

SEQ ID NO: 7347630 - DNA, 22 bp, Homo sapiens
cagtgagggaagatctcagcac

SEQ ID NO: 7347631 - DNA, 22 bp, Homo sapiens
cagtgaggctctgctgagcggt

SEQ ID NO: 7347632 - DNA, 22 bp, Homo sapiens
catcatttcacttagatgaagt

SEQ ID NO: 7347633 - DNA, 20 bp, Homo sapiens
catcattttaaaatctctcc

SEQ ID NO: 7347634 - DNA, 22 bp, Homo sapiens
catcatttgtttgcatgcagga

SEQ ID NO: 7347635 - DNA, 22 bp, Homo sapiens
aggagtgggggcgagaagttaa

SEQ ID NO: 7347636 - DNA, 22 bp, Homo sapiens
aggagtgtggccagggctctgg

SEQ ID NO: 7347637 - DNA, 22 bp, Homo sapiens
aggagtggtgcaggacctgcca

SEQ ID NO: 7347638 - DNA, 22 bp, Homo sapiens
aggagtgggggcgagaagttaa

SEQ ID NO: 7347639 - DNA, 22 bp, Homo sapiens
aggagtggaattactgggttct

SEQ ID NO: 7347640 - DNA, 22 bp, Homo sapiens
aggaggtgttgatagaaggttt

SEQ ID NO: 7347641 - DNA, 22 bp, Homo sapiens
aggagggtttcaatgggatgag

SEQ ID NO: 7347642 - DNA, 22 bp, Homo sapiens
aggagggttgaggaggatactt

SEQ ID NO: 7347643 - DNA, 22 bp, Homo sapiens
aggagggttctctggacagagg

SEQ ID NO: 7347644 - DNA, 22 bp, Homo sapiens
aggagggtggcctcatgtgagt

SEQ ID NO: 7347645 - DNA, 22 bp, Homo sapiens
aggaggggcaatgatagtctgg

SEQ ID NO: 7347646 - DNA, 22 bp, Homo sapiens
aggaggctgggcacagtggcct

SEQ ID NO: 7347647 - DNA, 22 bp, Homo sapiens
aggaggctggttcaggccatat

SEQ ID NO: 7347648 - DNA, 22 bp, Homo sapiens
aggaggggcaatgatagtctgg

SEQ ID NO: 7347649 - DNA, 22 bp, Homo sapiens
aggaggggcaatgatagtctgg

SEQ ID NO: 7347650 - DNA, 22 bp, Homo sapiens
cagttctgactttcataatgtc

SEQ ID NO: 7347651 - DNA, 22 bp, Homo sapiens
cagttataggagccattgtata

SEQ ID NO: 7347652 - DNA, 22 bp, Homo sapiens
cagttcagctagaagaaacaaa

SEQ ID NO: 7347653 - DNA, 22 bp, Homo sapiens
cagttcatagtcttcatgtctc

SEQ ID NO: 7347654 - DNA, 22 bp, Homo sapiens
catcagaaaccttgaggaaact

SEQ ID NO: 7347655 - DNA, 22 bp, Homo sapiens
catcacttttaaaggtgatcga

SEQ ID NO: 7347656 - DNA, 22 bp, Homo sapiens
catcagaagaaagacaaatgat

SEQ ID NO: 7347657 - DNA, 22 bp, Homo sapiens
catcagaagaaagacaaatgat

SEQ ID NO: 7347658 - DNA, 22 bp, Homo sapiens
catcagaaggaaggacgattat

SEQ ID NO: 7347659 - DNA, 22 bp, Homo sapiens
aggaggctgcaaccctgaggcc

SEQ ID NO: 7347660 - DNA, 22 bp, Homo sapiens
aggaggctgcaaccctgaggcc

SEQ ID NO: 7347661 - DNA, 22 bp, Homo sapiens
aggaggctgggcacagtggcct

SEQ ID NO: 7347662 - DNA, 22 bp, Homo sapiens
caggaaatcactctgattttgg

SEQ ID NO: 7347663 - DNA, 22 bp, Homo sapiens
caggaaaatctgcccacacaag

SEQ ID NO: 7347664 - DNA, 17 bp, Homo sapiens
caggaaaatatgagtga

SEQ ID NO: 7347665 - DNA, 22 bp, Homo sapiens
caggaaatggctgaataaattc

SEQ ID NO: 7347666 - DNA, 22 bp, Homo sapiens
agctgcccccagggctgtgctt

SEQ ID NO: 7347667 - DNA, 22 bp, Homo sapiens
agctgccagatgacagtgctat

SEQ ID NO: 7347668 - DNA, 22 bp, Homo sapiens
agctgccctggcggagctgctc

SEQ ID NO: 7347669 - DNA, 20 bp, Homo sapiens
agctgcccctgggcactgcc

SEQ ID NO: 7347670 - DNA, 22 bp, Homo sapiens
agctgccctcgctggggccaga

SEQ ID NO: 7347671 - DNA, 22 bp, Homo sapiens
agctgcccttctcttgcccttg

SEQ ID NO: 7347672 - DNA, 22 bp, Homo sapiens
agctgcctcctggtgccccatc

SEQ ID NO: 7347673 - DNA, 17 bp, Homo sapiens
agctgcctctcccacca

SEQ ID NO: 7347674 - DNA, 21 bp, Homo sapiens
agctgcctgctctggacctgg

SEQ ID NO: 7347675 - DNA, 22 bp, Homo sapiens
agctgctgggagaagtgagcca

SEQ ID NO: 7347676 - DNA, 22 bp, Homo sapiens
agctgctgggagaagtgagcca

SEQ ID NO: 7347677 - DNA, 22 bp, Homo sapiens
agctgggtgcccgaagccacgt

SEQ ID NO: 7347678 - DNA, 22 bp, Homo sapiens
agctgggtgcccgaagccacgt

SEQ ID NO: 7347679 - DNA, 22 bp, Homo sapiens
caggcagaggaggccttctcct

SEQ ID NO: 7347680 - DNA, 22 bp, Homo sapiens
caggcagaggaggccttctcct

SEQ ID NO: 7347681 - DNA, 22 bp, Homo sapiens
caggcagagtcagattagactt

SEQ ID NO: 7347682 - DNA, 22 bp, Homo sapiens
agctggtgaacctgaggcacag

SEQ ID NO: 7347683 - DNA, 22 bp, Homo sapiens
agctggtgatgtggtccctcac

SEQ ID NO: 7347684 - DNA, 22 bp, Homo sapiens
agctggtgatggcctaagaagg

SEQ ID NO: 7347685 - DNA, 22 bp, Homo sapiens
agctgggttgacaagatggaaa

SEQ ID NO: 7347686 - DNA, 19 bp, Homo sapiens
agctgggtgttagtggaga

SEQ ID NO: 7347687 - DNA, 22 bp, Homo sapiens
agctgggcctgagctggaagct

SEQ ID NO: 7347688 - DNA, 22 bp, Homo sapiens
agctgggactcaactgtctggg

SEQ ID NO: 7347689 - DNA, 22 bp, Homo sapiens
agctgggcagactgcagtggtt

SEQ ID NO: 7347690 - DNA, 22 bp, Homo sapiens
agctggagccagtgtgaggctt

SEQ ID NO: 7347691 - DNA, 22 bp, Homo sapiens
aggaaaatcgagtctggaggca

SEQ ID NO: 7347692 - DNA, 22 bp, Homo sapiens
aggaaaatcgagtctggaggca

SEQ ID NO: 7347693 - DNA, 22 bp, Homo sapiens
aggaaacagaggtgccacaata

SEQ ID NO: 7347694 - DNA, 22 bp, Homo sapiens
aggaaaaataaggcagcagggc

SEQ ID NO: 7347695 - DNA, 20 bp, Homo sapiens
aggaaaaatggaaactggag

SEQ ID NO: 7347696 - DNA, 22 bp, Homo sapiens
cagggacataagaggaacatgg

SEQ ID NO: 7347697 - DNA, 22 bp, Homo sapiens
cagggacaggggagaaaagatg

SEQ ID NO: 7347698 - DNA, 22 bp, Homo sapiens
cagggacagcgggactctgaca

SEQ ID NO: 7347699 - DNA, 22 bp, Homo sapiens
cagggactacagccagccctcc

SEQ ID NO: 7347700 - DNA, 22 bp, Homo sapiens
cagggacattggtggccaggtt

SEQ ID NO: 7347701 - DNA, 22 bp, Homo sapiens
cagggacattggtggccaggtt

SEQ ID NO: 7347702 - DNA, 22 bp, Homo sapiens
cagggacatttccaagagaatt

SEQ ID NO: 7347703 - DNA, 22 bp, Homo sapiens
cagggacatgactggtctctgt

SEQ ID NO: 7347704 - DNA, 22 bp, Homo sapiens
aggaagggtggatagtaacgtg

SEQ ID NO: 7347705 - DNA, 22 bp, Homo sapiens
aggaagggttctttctgtttat
